United States Patent 7,709,616 (MICRORNAS AND USES THEREOF) - sequence listing, part 3

SEQ ID NO: 54360 - RNA, 64 nt, hsa
uauuagauccuauaaauugaacugauuuuuccauaaggaaaaugcuucuuuugagauuaauucu

SEQ ID NO: 54361 - RNA, 64 nt, hsa
ccuugaaugucuguugaugaaauagucacuguuuaaggaaaaaaguaauuaugagguguagcag

SEQ ID NO: 54362 - RNA, 64 nt, hsa
gcugagcugcuuguuuaaaaaaaaaaaaaaggaaaaggaaaaagcaugacauuguguaucgauu

SEQ ID NO: 54363 - RNA, 64 nt, hsa
caaaucgcugagcugcuuguuuaaaaaaaaaaaaaaggaaaaggaaaaagcaugacauugugua

SEQ ID NO: 54364 - RNA, 64 nt, hsa
cacaacgauuacucgaagaugacugcaaagguaaaaggaaaauaaaaguguauugcacaaugag

SEQ ID NO: 54365 - RNA, 64 nt, hsa
uuuaauguacuucaaaaagcaaauauauauuacuaaggaaaaaaaguuauuuauaauugccuug

SEQ ID NO: 54366 - RNA, 64 nt, hsa
uugcuaguuuauaaugucuuacuaaugcagaaacaaggaaaaaagcaaaauuggccugaauauu

SEQ ID NO: 54367 - RNA, 64 nt, hsa
uuauuaguugauucacaguacagaacaagguauaaaggaaaaaacccugcuagguaguguuaua

SEQ ID NO: 54368 - RNA, 64 nt, hsa
agguucauuuuaagauuuacuuggaagagcaaagaaggaaaaauuauauuuuuaaagaaagaga

SEQ ID NO: 54369 - RNA, 64 nt, hsa
ccagucccccaaccccagccgcucggaggccccaaaggaaaaagcacaagaagcgugagacgcc

SEQ ID NO: 54370 - RNA, 64 nt, hsa
cucauucucguagcuuuuuaaaaaaaugaaaguaaaggaaaaaaaaaaaacugcaaaucuagaa

SEQ ID NO: 54371 - RNA, 64 nt, hsa
auuuuccuucauccuugugacauuucauuucaguaaggaaaagauaacaaagugcaauuaucag

SEQ ID NO: 54372 - RNA, 64 nt, hsa
guuggaauccuccuucuagcugaaggugauugaaaaggaaaagagugagugaacagaaccauag

SEQ ID NO: 54373 - RNA, 64 nt, hsa
accucguuuuucuuuuguuugcauuuucugcaaaaaggaaaaagaaaccacaaauuggggaaaa

SEQ ID NO: 54374 - RNA, 64 nt, hsa
augggaagagaggagagggagaaaaauaaaaugaaaggaaaaaaaaaaguuugcaaauucagac

SEQ ID NO: 54375 - RNA, 64 nt, hsa
augcaguugaauggaaaauuacucaguguauagaaaggaaaaaaaccagaaauuuaaaauagau

SEQ ID NO: 54376 - RNA, 64 nt, hsa
aaauaacauaagucugaaagcaaugaaaacgucaaaggaaaauguuuauauacauccacauguu

SEQ ID NO: 54377 - RNA, 64 nt, hsa
agcauggagaaaacccgguacgcucaaaaagaaaaaggaaaaaaaaaaaucccaucacccacag

SEQ ID NO: 54378 - RNA, 64 nt, hsa
auuuggacauuuuaauuguuuaaaaauuguacaaaaggaaaaaauuagaauaaguacuggcgaa

SEQ ID NO: 54379 - RNA, 64 nt, hsa
cugauuuagaauuacugguagcuuauuuuaaagcaaggaaaagcagcugagcucaaguuugcug

SEQ ID NO: 54380 - RNA, 64 nt, hsa
auauuguauauaaacaaaacaauaugcuuuguugaaggaaaauuuucuuuauuggaaugugguu

SEQ ID NO: 54381 - RNA, 64 nt, hsa
ccagcuugggcaacagagcaagauccugucucaaaaggaaaaagaaaacaggaccuagguguuu

SEQ ID NO: 54382 - RNA, 64 nt, hsa
uugauaaauggaaccagagguuauauacaacuacaaggaaaaaaaugcauuuaaccaugccacc

SEQ ID NO: 54383 - RNA, 64 nt, hsa
cuacuguaagaaacuuaucauaaggaaaaauagaaaggaaaacuugaaucaauacucauugauu

SEQ ID NO: 54384 - RNA, 64 nt, hsa
guuguuguauaagcuacuguaagaaacuuaucauaaggaaaaauagaaaggaaaacuugaauca

SEQ ID NO: 54385 - RNA, 64 nt, hsa
uuuuugagauguaauuuaagauuguuuuauguaaaaggaaaaucuuguauggcaucgaauagcc

SEQ ID NO: 54386 - RNA, 64 nt, hsa
uucacgugcacaaagauuagcacacuuaaaagcaaaggaaaaaauaaaucagaacuccauaaau

SEQ ID NO: 54387 - RNA, 64 nt, hsa
gucaaaguuucaaagcaagauaguuauuaagcaaaaggaaaaaugguaaugauagaaagucagu

SEQ ID NO: 54388 - RNA, 64 nt, hsa
gagaaggacugaaaagguacauuaagugugcuguaaggaaaagucuuagaaacauaauaagcua

SEQ ID NO: 54389 - RNA, 64 nt, hsa
uauuguaaauauguuuuuuagaucaaauacuuuaaaggaaaaaauguuggauuuauaaaugcua

SEQ ID NO: 54390 - RNA, 64 nt, hsa
auaaaugcuauuuuuuauuuuacuuuuauaauaaaaggaaaagcaaauugaugaccucaccuug

SEQ ID NO: 54391 - RNA, 64 nt, hsa
uagcaagcaugaauuuuucacccaagagugaaaaaaggaaaaucuaccauggcuugaaguuaaa

SEQ ID NO: 54392 - RNA, 64 nt, hsa
guggcagguacuaugaauguaauucauaauuuaaaaggaaaacuaaaaacuauuuugauuuggg

SEQ ID NO: 54393 - RNA, 64 nt, hsa
uccacguaacuggcugcagagaaaucuaccgagcaaggaaaaggcacacacacacguuugcagg

SEQ ID NO: 54394 - RNA, 64 nt, hsa
aaaagccaacaacccagaaagguuuaaaaaacauaaggaaaaaaaagacaaauuaaaggagggg

SEQ ID NO: 54395 - RNA, 64 nt, hsa
ugaaaguuuaaagagggggaagaguugguuugcaaaggaaaaguuuaaauagcuuaauaucaau

SEQ ID NO: 54396 - RNA, 64 nt, hsa
aggaugagaaguaagcaaacuguggaaacaugcaaaggaaaaagugauagaauaauauucaaga

SEQ ID NO: 54397 - RNA, 64 nt, hsa
cagcacugcagaaaccacuccaggcaaaguagugaaggaaaaaagccugcucuccaguagccug

SEQ ID NO: 54398 - RNA, 64 nt, hsa
cuaucuguaacaucagagcugucuggccuuuggaaaggaaaaauuauggacucuguuaagaaau

SEQ ID NO: 54399 - RNA, 64 nt, hsa
aaauugcgaaggcuuuugccucccaguaaauagaaaggaaaauauauucuaguagguaagacug

SEQ ID NO: 54400 - RNA, 64 nt, hsa
gucuugcccuugaauaacuaagucauacaaauagaaggaaaaacaauggugaauuuuggagagc

SEQ ID NO: 54401 - RNA, 64 nt, hsa
ugaccuguuaggcugagcucaggaauuguccaaaaaggaaaaagcaaaauaauuaauugagagu

SEQ ID NO: 54402 - RNA, 64 nt, hsa
ucugaguccagauuucucaucaacuggcaauacaaaggaaaauaugguacaggaguuaguuaga

SEQ ID NO: 54403 - RNA, 64 nt, hsa
aaaggguuggagugugccagugcacagguagacuaaggaaaacauuauagaggagugaagagaa

SEQ ID NO: 54404 - RNA, 64 nt, hsa
gacaagaugucuaauuuuuuuuuaaguaggaccaaaggaaaacaagauuuagauagucugacuu

SEQ ID NO: 54405 - RNA, 64 nt, hsa
gauucagagaugucugcucuuuuaaauuauauauaaggaaaaaaaauagccugccuugggacag

SEQ ID NO: 54406 - RNA, 64 nt, hsa
aauuuuuuuuccaguguauugcucauauuaucagaaggaaaaguuauuuaaguaugucaguuaa

SEQ ID NO: 54407 - RNA, 64 nt, hsa
caugugguucacguacaaaacucuguauaaguugaaggaaaauguucauguucauauguacuug

SEQ ID NO: 54408 - RNA, 64 nt, hsa
acuucggagaggccaagucuaaugaagagaaaaaaaggaaaagaaguugcaagacucgaauaaa

SEQ ID NO: 54409 - RNA, 64 nt, hsa
aaaaagaaaagaaaaaaagggaaaaaagaaaagcaaggaaaaggcucuuuauuacuuaaaagua

SEQ ID NO: 54410 - RNA, 64 nt, hsa
gagcuuuguguuuggacugucuggucuguagcuaaaggaaaaaguuaggaggggaauauuuauu

SEQ ID NO: 54411 - RNA, 64 nt, hsa
ugauagcaccguuuguucugugagcuggaaacagaaggaaaaaacauacccuuggguacccaua

SEQ ID NO: 54412 - RNA, 64 nt, hsa
uugagauaaugaaaagugauaucuucgcauacgaaaggaaaaaagguugagguauauaugauuu

SEQ ID NO: 54413 - RNA, 64 nt, hsa
agcauccuuaagauuuaaaaaaaaaaaaaaaaaaaaggaaaaaaaagugauggaagccguaagu

SEQ ID NO: 54414 - RNA, 64 nt, hsa
ucuugucuauuuuuucucuucauguuguaacaaaaaggaaaaaagaaaaaaaaaucccaucccu

SEQ ID NO: 54415 - RNA, 64 nt, hsa
ccaacugaccuagugaagguucagaugcaaauggaaggaaaaaggaaacuggaaggaaaaccau

SEQ ID NO: 54416 - RNA, 64 nt, hsa
guucagaugcaaauggaaggaaaaaggaaacuggaaggaaaaccauugcgguaaguucuccaau

SEQ ID NO: 54417 - RNA, 64 nt, hsa
agaaacacaggaaaugaaaaauuuuuaaaaaaagaaggaaaaauguuuuaaauacaaaaggaaa

SEQ ID NO: 54418 - RNA, 64 nt, hsa
uuuaaaaaaagaaggaaaaauguuuuaaauacaaaaggaaaaacagacaaaaauuuaauuuuag

SEQ ID NO: 54419 - RNA, 64 nt, hsa
uaugucugccaaguuguuagaaucuuugaaucagaaggaaaaaaagcagcgcugguugacaaag

SEQ ID NO: 54420 - RNA, 64 nt, hsa
cuucuauuuugugaagggacuauauuuuuugagaaaggaaaaucucaguuagauauauuuugug

SEQ ID NO: 54421 - RNA, 64 nt, hsa
caaagaaaugcauucauaucaaaauuggaauagaaaggaaaaccuauuuuuaagauaucaaccu

SEQ ID NO: 54422 - RNA, 64 nt, hsa
gucugucauaaauuauuuccccgguaauuuuugaaaggaaaaauguauaacaaguacuauuuac

SEQ ID NO: 54423 - RNA, 64 nt, hsa
ggauuuaauuugacuggguuaacaugcaaaaaccaaggaaaaauauuuaguuuuuuuuuuuuuu

SEQ ID NO: 54424 - RNA, 64 nt, hsa
cagacaaucuuauguagcaaagauuaugccugaaaaggaaaauuauucagggcagcuaauuuug

SEQ ID NO: 54425 - RNA, 64 nt, hsa
aaaugagugugucauuuccacaugaaggagaggcaaggaaaagccccacaaaauuccuguuacc

SEQ ID NO: 54426 - RNA, 64 nt, hsa
gugaccaaauagucuacaggaggcagccauuuggaaggaaaacugcugugguugcugcugcuuc

SEQ ID NO: 54427 - RNA, 64 nt, hsa
acuuacuauuuucagcuuuuuaaagcaugcuuagaaggaaaagcuuaccaaaaauauauuuuga

SEQ ID NO: 54428 - RNA, 64 nt, hsa
ccuauauaugauuauuugaaugaagaggaguaggaaggaaaauggaaucaauauacucuuuguu

SEQ ID NO: 54429 - RNA, 64 nt, hsa
ucuccaacucucugauccugaaauaucuauuccaaaggaaaaucauauuuuaggguagaugaau

SEQ ID NO: 54430 - RNA, 64 nt, hsa
uguguguguguguguguguguguguuugaagauuaaggaaaagaacaccuaucucuccaacucu

SEQ ID NO: 54431 - RNA, 64 nt, hsa
gaacauacucuccuaagugguuguaggaaauugcaaggaaaauagaaggucuguucuugcucuc

SEQ ID NO: 54432 - RNA, 64 nt, hsa
uaauuuugaucaaaagacguguuacuucccuuugaaggaaaaguuuuuaguguguauuguacau

SEQ ID NO: 54433 - RNA, 64 nt, hsa
augucauugguauaugguggcuguuuaccaauaaaaggaaaaaauucauuaaccgguugcuucc

SEQ ID NO: 54434 - RNA, 64 nt, hsa
cuuccuugucucaugaaaaccuaaauauaaaaaaaaggaaaauacuggaguuuuuauuucucuu

SEQ ID NO: 54435 - RNA, 64 nt, hsa
agacaguuauuccauaaagcauuuguauaauuaaaaggaaaacagaaaaaggaaaaguaggcaa

SEQ ID NO: 54436 - RNA, 64 nt, hsa
uaaagcauuuguauaauuaaaaggaaaacagaaaaaggaaaaguaggcaaaugugaaaauaguu

SEQ ID NO: 54437 - RNA, 64 nt, hsa
ucaaaaugcauuguugcauuaagcuuuuucaauaaaggaaaauuacggaaggaaaauaggcaac

SEQ ID NO: 54438 - RNA, 64 nt, hsa
ugcauuaagcuuuuucaauaaaggaaaauuacggaaggaaaauaggcaacaccagcaaauuaua

SEQ ID NO: 54439 - RNA, 64 nt, hsa
ugaaacuccauguagcaaccaggacgaaguugagaaggaaaacgccaaaugcuuugguuauuag

SEQ ID NO: 54440 - RNA, 64 nt, hsa
cuuccucuucacuggcucgagguaaacccuuuucaaggaaaaacaacucuaggauuucuuuuuu

SEQ ID NO: 54441 - RNA, 64 nt, hsa
gaguaagugcuauuggcauuccaaaauucagcuaaaggaaaaaugaucaaaaacaaaguaaggu

SEQ ID NO: 54442 - RNA, 64 nt, hsa
uguguuaacauugcaaugaaaaaaugaaaaaaagaaggaaaaaagaauaagaaugaaaacugcu

SEQ ID NO: 54443 - RNA, 64 nt, hsa
gagaggagagucuuacggagggcugggagcuuaaaaggaaaacaauguccuuacuuguaaacag

SEQ ID NO: 54444 - RNA, 64 nt, hsa
acgacuucuguuucacaguucagaccggucuucaaaggaaaagccuguccgauuuuuccauggg

SEQ ID NO: 54445 - RNA, 64 nt, hsa
agcugaaaucuauucucauucuuguuugucaagaaaggaaaaucuguuauucaagguaaauuau

SEQ ID NO: 54446 - RNA, 64 nt, hsa
gaaggaggcuuuucuucucagcuaacaggcauauaaggaaaaccaucuagagaguuuucuuuag

SEQ ID NO: 54447 - RNA, 64 nt, hsa
caggcaugcuagcuggcccguguaaucccaagacaaggaaaacauucguuuuccucaugggucu

SEQ ID NO: 54448 - RNA, 64 nt, hsa
uucuaaauuuauuuaaaugcuuagcaggaagcauaaggaaaagccaucggccuccaauacccau

SEQ ID NO: 54449 - RNA, 64 nt, hsa
auuaguguucaauauugcuuuaaucaccauauaaaaggaaaaaaauuggugacagagcacaaau

SEQ ID NO: 54450 - RNA, 64 nt, hsa
gcuaaaauauuugccaucuuuauuaugagccuuuaaggaaaacaaacccuaaacacaaagcauc

SEQ ID NO: 54451 - RNA, 64 nt, hsa
gugcaaucaccccugccuuuuguucaacucuauaaaggaaaaggaauguagcucaacuugugau

SEQ ID NO: 54452 - RNA, 64 nt, hsa
uaacccuuucaaaaguguuuguaaaccaaguucaaaggaaaauagacagaaugauuuccaaaau

SEQ ID NO: 54453 - RNA, 58 nt, hsa
agaucccacuggauggguagcugaaauaaaggaaaagacagagaaaggggcuguggug

SEQ ID NO: 54454 - RNA, 64 nt, hsa
uuuaagaacuauuuuaaaguguuccagacccaaaaaggaaaaauaaaaaaaaaggaauauuugu

SEQ ID NO: 54455 - RNA, 64 nt, hsa
uuagcuuuaaaucauuuuugcuuuagucuuuuuaaaggaaaauaacaaaacuaugcuguuuaua

SEQ ID NO: 54456 - RNA, 64 nt, hsa
gcuguuacuuuuuauuuuuacacccaucagauuuaaggaaaagacuuuuuagccauuauaaucu

SEQ ID NO: 54457 - RNA, 64 nt, hsa
aagaaaaaaugaaaaaaaaaggaaaaaaagaaaaaaggaaaaaaacaguuugaacacaaaggcu

SEQ ID NO: 54458 - RNA, 64 nt, hsa
uuugaaaucuuaaaaaaagaaaaaaugaaaaaaaaaggaaaaaaagaaaaaaggaaaaaaacag

SEQ ID NO: 54459 - RNA, 64 nt, hsa
auaguuuaagaaauuuuuuuuuuaaauaaaaaaaaaggaaaagaggaagacuggacaaaacaac

SEQ ID NO: 54460 - RNA, 64 nt, hsa
cuguuuuuaaaaauguagcacuugacuuuuugccaaggaaaaaaauaaaaauuauuccagugca

SEQ ID NO: 54461 - RNA, 64 nt, hsa
acucugcuuuucugucaacaucccauuuuggggaaaggaaaagucauauuuauuccugcacccc

SEQ ID NO: 54462 - RNA, 64 nt, hsa
ucuaacaacacugauaauaggaaguaaaaacagaaaggaaaagaaauuaccacugggaaaaucu

SEQ ID NO: 54463 - RNA, 64 nt, hsa
caaguaguccuguuugccacuaaaaacauuuucaaaggaaaaauaaaaugaaaguacuuuuuac

SEQ ID NO: 54464 - RNA, 64 nt, hsa
ugacauauaacuacuaugcuuauaaaaaugaaguaaggaaaacaaguaguccuguuugccacua

SEQ ID NO: 54465 - RNA, 53 nt, hsa
ggacccagcaggaaucaugagggaaggaaaaugcagcacucuaaauggccacu

SEQ ID NO: 54466 - RNA, 64 nt, hsa
auaccaggcacuuaaagccuuuuccugaauuggaaaggaaaagaggcccaagugcaaaagaaaa

SEQ ID NO: 54467 - RNA, 64 nt, hsa
caauacagucuaguuuccugguuccguuuuagaaaaggaaaacgugaacaaacuuagaaaggga

SEQ ID NO: 54468 - RNA, 64 nt, hsa
agaaucaaauauucccaaggaggauuugucaaucaaggaaaacaugacagauggugagguaaag

SEQ ID NO: 54469 - RNA, 64 nt, hsa
aacacuaggaaaaucuuuccauuucagcauguuuaaggaaaauagcccacaaugucugcccuga

SEQ ID NO: 54470 - RNA, 64 nt, hsa
uacaaggccuaugaguauggauugggggggccaaaaggaaaaagcuccaugugccucuuugucu

SEQ ID NO: 54471 - RNA, 64 nt, hsa
uguaguuuuauuuuauguuuagauagggcugggcaaggaaaaagaaaauaaagacaaccauauu

SEQ ID NO: 54472 - RNA, 64 nt, hsa
aaaaaaaacaguaaaagugaaauauuacuguuuuaaggaaaacuaauuuaggguggcagccaau

SEQ ID NO: 54473 - RNA, 64 nt, hsa
uuucaacagaaaaccaaaaccaaacgaaaugucuaaggaaaauguuuucuuaaugagaugaugu

SEQ ID NO: 54474 - RNA, 64 nt, hsa
uuucaaaaguuggcagauuuuuuuuuuuguuuuuaaggaaaaaggcaugcuuucugacugacau

SEQ ID NO: 54475 - RNA, 64 nt, hsa
auuacuggcucucaagcuauaguuuguuuucaaaaaggaaaaacaaaauaguuuuuuacuggau

SEQ ID NO: 54476 - RNA, 64 nt, hsa
cugcugcugcugcugcccucagaggaagaugaggaaggaaaaaaacuggguggaccuacaaaaa

SEQ ID NO: 54477 - RNA, 64 nt, hsa
gugaucuuagccuagguaggccacauccaucccaaaggaaaauguagacaucaccuguaccuau

SEQ ID NO: 54478 - RNA, 64 nt, hsa
uccucagcaaggcauguuacuacuuuuaucaucuaaggaaaaaagacaagggaauuccagucag

SEQ ID NO: 54479 - RNA, 64 nt, hsa
gacccaucuggaggaaaaccagaucggacuaaaaaaggaaaaagaaaaacaaaaucuccgcagu

SEQ ID NO: 54480 - RNA, 64 nt, hsa
cccacuggaugagcggugagacgaacaaaagggaaaggaaaaaauggggguggggggugggggg

SEQ ID NO: 54481 - RNA, 64 nt, hsa
gaacccuuuuccugacucucauggaagaugguggaaggaaaauagacugucucaucaacccucc

SEQ ID NO: 54482 - RNA, 64 nt, hsa
acaggagcugucuggagcuccaccuuugcaaagaaaggaaaaacacaaauugcccccagauugg

SEQ ID NO: 54483 - RNA, 64 nt, hsa
uuuucauaaaaauuaaaugcuuuaagaaauggagaaggaaaaauagcuuuuaucaauuuuuuuc

SEQ ID NO: 54484 - RNA, 64 nt, hsa
aauuggacaaagagagagaaagaaagaaggaaggaaggaaaaacuuguuacugaaagagacuac

SEQ ID NO: 54485 - RNA, 64 nt, hsa
uugaaaagaaaaggggaaugugucccacuagugaaaggaaaacuuuucaacacuaucccugcuu

SEQ ID NO: 54486 - RNA, 64 nt, hsa
uauucaaauuugauuguggcgaaucuacuucaaaaaggaaaaauaauccaacuuuguggauauu

SEQ ID NO: 54487 - RNA, 64 nt, hsa
cauucuugggcccccccucauucccuuuccgaaaaaggaaaacuugcguuugagccguugagcu

SEQ ID NO: 54488 - RNA, 64 nt, hsa
cgaccaaaauuuugacaacgaugauguucaccagaaggaaaaaaaaaaaucaguuuuaugcacu

SEQ ID NO: 54489 - RNA, 64 nt, hsa
uccagaauuccacuucuaguuauuuauucaagagaaggaaaaacaaugaucacagcaauacuug

SEQ ID NO: 54490 - RNA, 64 nt, hsa
ucaauaaaugcaauauuauuggcagacauuguugaaggaaaaaagccagacaaacaacuacaua

SEQ ID NO: 54491 - RNA, 64 nt, hsa
guuuucacacuauuucagcagcaaaaacuuuuucaaggaaaaucuuacagaaccuuuaaacacg

SEQ ID NO: 54492 - RNA, 64 nt, hsa
uaauaggcgagcaaauaaaauucaaaucaauuucaaggaaaaacaucuggccagggguagcuug

SEQ ID NO: 54493 - RNA, 64 nt, hsa
aguuauuugguggugggaaguagcugaagcaaagaaggaaaaguaauaccuuuaaccucacuag

SEQ ID NO: 54494 - RNA, 64 nt, hsa
aaauguacuuuuacauucuuaaucuuuuuuuagaaaggaaaaguuuucuucauuuagcugcuga

SEQ ID NO: 54495 - RNA, 64 nt, hsa
uaucuggggaaaaaaaacuuuuuuuuaaauuaaaaaggaaaauaaaagauauugaggucuuccu

SEQ ID NO: 54496 - RNA, 64 nt, hsa
cccaaggcagggaagaaggauguguguguccaggaaggaaaaaaagguggaucagugauuuuac

SEQ ID NO: 54497 - RNA, 64 nt, hsa
ugacaccauuuuuaguuuuauuuccugauagcaaaaggaaaaaaaacacccaucccucaaaaag

SEQ ID NO: 54498 - RNA, 64 nt, hsa
ugucuuuuaaaauguagagaaaaggugacaguuuaaggaaaaauauauauagaauaccagaaau

SEQ ID NO: 54499 - RNA, 64 nt, hsa
aaaggcagaaaggagaucauuuaguugggucugaaaggaaaagucuuugcuauccgacauguac

SEQ ID NO: 54500 - RNA, 64 nt, hsa
ucugugaggugauaggcaaggaugaaagacaaagaaggaaaagaguaucaaaggcagaaaggag

SEQ ID NO: 54501 - RNA, 64 nt, hsa
uccccacccaccaaaugccucugccuugauggagaaggaaaaggcuggcaagguggguuccagg

SEQ ID NO: 54502 - RNA, 64 nt, hsa
aguuauauuguacugaaauuagcuuguuugauauaaggaaaauauguauugaguaccuuuuugc

SEQ ID NO: 54503 - RNA, 64 nt, hsa
agaaacuguuguuugguuaaaggacacagauuugaaggaaaaaaauuuugauguaacaauuuuu

SEQ ID NO: 54504 - RNA, 64 nt, hsa
gguuaaacaaacaaaaaaaaauuuuaaacaaagaaaggaaaaaaauugacaauaaaagucacuc

SEQ ID NO: 54505 - RNA, 64 nt, hsa
cugaagauucuuucuucugaaagccaagcaccacaaggaaaaaaaaaauuauuaauagcucagg

SEQ ID NO: 54506 - RNA, 64 nt, hsa
gauacacuuuacuaaucaugaaauucuaaccuaaaaggaaaacauuuuccugcuugucuuagaa

SEQ ID NO: 54507 - RNA, 64 nt, hsa
aacaccugcuuuagccuuuguuuucaaaagcacaaaggaaaagugaaagggaaagagaaacaag

SEQ ID NO: 54508 - RNA, 64 nt, hsa
uucuugcugaacauauuuuauucucuuuucagagaaggaaaauaaaaaggauucuaaaaguuug

SEQ ID NO: 54509 - RNA, 64 nt, hsa
cucugauucuaggugugguguugacuguccuuucaaggaaaaacuugcaauagagggaaaagcc

SEQ ID NO: 54510 - RNA, 64 nt, hsa
gaguuagcauguagaugggauauugggaugaggaaaggaaaaucagguagauggugcuuuuuuu

SEQ ID NO: 54511 - RNA, 64 nt, hsa
aaaaauauugcagugcuauuuuuucuuaaucagaaaggaaaauucucaaggccuuuugaagagc

SEQ ID NO: 54512 - RNA, 64 nt, hsa
ccaagagacuuccauguccugguuauuaacaaaaaaggaaaaauguaauaauugauaugauuuu

SEQ ID NO: 54513 - RNA, 64 nt, hsa
guuauucaguguugcgguagcagaugcauuaucaaaggaaaaauauuuggcuccuuuaauuccu

SEQ ID NO: 54514 - RNA, 64 nt, hsa
uuggaauuuuuuucaguggagugguuuucgcuuaaaggaaaaaaaaaucuaaaacugcgaagaa

SEQ ID NO: 54515 - RNA, 64 nt, hsa
cgcugcauaacaacacagugcaucuuuuuaaaacaaggaaaagggaaaaaaaggagaaaaaacg

SEQ ID NO: 54516 - RNA, 64 nt, hsa
augcccugaugccuaaccaaagaugaguuaaccaaaggaaaauaacauuaaaggagacuuaugu

SEQ ID NO: 54517 - RNA, 64 nt, hsa
aaacauuuuugucauauucuuguauucaaagaaaaaggaaaaaagauuauuguaaauauuuuau

SEQ ID NO: 54518 - RNA, 64 nt, hsa
uaaagacaaacuaaaacaaaacagaacaaaagcaaaggaaaaugcuuuagaaauuuuaacuccg

SEQ ID NO: 54519 - RNA, 64 nt, hsa
aucauggcaugacuuaagggaacauugguuugugaaggaaaaacagauuaucuaaagccaucuc

SEQ ID NO: 54520 - RNA, 64 nt, hsa
aguuugccuuugagauaauacguuacacuaagaaaaggaaaauguggauaguaaaacccaccuc

SEQ ID NO: 54521 - RNA, 64 nt, hsa
uaaacaacuaauuauuguugauacuuuucauuacaaggaaaauaaguuauaaauaccaugucaa

SEQ ID NO: 54522 - RNA, 64 nt, hsa
gaagccccaaggacacaaaacauuuucccauuuaaaggaaaacacucuaguuuugcaaguauau

SEQ ID NO: 54523 - RNA, 64 nt, hsa
aauaacuuuaauuaggaucauaugaccauugaaaaaggaaaaauguagacucugacuuccgucc

SEQ ID NO: 54524 - RNA, 64 nt, hsa
ucaguggguuaauuauaccccaugauaccuauuaaaggaaaaccagugggucugguggugcugg

SEQ ID NO: 54525 - RNA, 64 nt, hsa
gaauaauugaaguucagagucacccguggcuccuaaggaaaaaacagcaucaugaaaggcaaaa

SEQ ID NO: 54526 - RNA, 64 nt, hsa
guguaaugcauaaugcuuucucaccaacagaaaaaaggaaaaaaauuguuuucaguuaaacacu

SEQ ID NO: 54527 - RNA, 64 nt, hsa
uuuagcuuguugaaauguuuugcaucugucaauuaaggaaaaaaaaaaucacucuauguugccc

SEQ ID NO: 54528 - RNA, 64 nt, hsa
uagauaaacuagcucauuauuuccaucuuuggaaaaggaaaaaaaaaaaaacuucuuuaggcau

SEQ ID NO: 54529 - RNA, 64 nt, hsa
uuuaaaaaauauauaccaacagaacuacucucccaaggaaaauauugccaccauuuguagacca

SEQ ID NO: 54530 - RNA, 64 nt, hsa
aaacaaaacaaaacaaaauaaaacaaaaaaaaggaaggaaaaaaaaagaaaaaauuuaaaaaau

SEQ ID NO: 54531 - RNA, 64 nt, hsa
cauauuuauggacuuugaguaucuagcaaguagaaaggaaaaaaauauucaucauacucuaauc

SEQ ID NO: 54532 - RNA, 64 nt, hsa
gaguaacaaaaugagacccuaucucaaaaacaaaaaggaaaagaaaauauacaugaugggauuc

SEQ ID NO: 54533 - RNA, 64 nt, hsa
cgguuuuaguugagucuucacauuuagaauuugaaaggaaaaacagaacauuucucaugugcuu

SEQ ID NO: 54534 - RNA, 64 nt, hsa
cagaacauuucucaugugcuuuguagcuuaaaaaaaggaaaacucaccauuucauccauauuuc

SEQ ID NO: 54535 - RNA, 64 nt, hsa
auuacccccccacuaugcccucauuuuuuuaaaaaaggaaaaaaaaaagaaacuggguuccagu

SEQ ID NO: 54536 - RNA, 64 nt, hsa
aauaaaaaaauaaauaaaaauaaaaaaaauaaaaaaggaaaaaaaaaaaagaagaaacaagaca

SEQ ID NO: 54537 - RNA, 64 nt, hsa
aaagucuuucagcaacauucuuuauugucaucauaaggaaaaacuuuuaucgcaaugauaguca

SEQ ID NO: 54538 - RNA, 64 nt, hsa
guugccgucuucacagacaaacuugaaagguauuaaggaaaaaauuccacauagcucugggccu

SEQ ID NO: 54539 - RNA, 64 nt, hsa
agcuucuauuggacauauuuucuuuuuaggaaugaaggaaaauucucccauuuuugagccauuc

SEQ ID NO: 54540 - RNA, 64 nt, hsa
aacacugaaauuguugaaaaccgucucauaacaaaaggaaaaaacauuggaauuuuuguuuuag

SEQ ID NO: 54541 - RNA, 64 nt, hsa
cuggcaacagaacguuauuaagccauggagacauaaggaaaauuaaauacaaaacugagaaguc

SEQ ID NO: 54542 - RNA, 64 nt, hsa
acuaggucugacucuggggauuuuuuuccagccgaaggaaaaucacuuccguuaugucccccuc

SEQ ID NO: 54543 - RNA, 64 nt, hsa
gaucauccuuaagcaacugaaguuaaaauuguugaaggaaaaggcacuuaaauugguuacuuuc

SEQ ID NO: 54544 - RNA, 64 nt, hsa
gagggguuguacacacugccauuuuuguauuuuaaaggaaaaaugacuuucauucccaacugau

SEQ ID NO: 54545 - RNA, 64 nt, hsa
cagcagucaugaauacauuuuuagccauuuaccuaaggaaaaagacaguuuuucuagguaccau

SEQ ID NO: 54546 - RNA, 64 nt, hsa
uucaaaagcagaaaaagacaacaaauauuaaagcaaggaaaaguguaacugaaacacugcacuu

SEQ ID NO: 54547 - RNA, 64 nt, hsa
aguguucucaucucaaagcaaacuaucauuccagaaggaaaagugugucagggcaagcagacaa

SEQ ID NO: 54548 - RNA, 64 nt, hsa
guucugccuuaaauugggaggacuccaagccgggaaggaaaauucccuuuuccaaccuguauca

SEQ ID NO: 54549 - RNA, 64 nt, hsa
uggggaaauugaucuuuaaauuuugagacaguauaaggaaaaucugguuggugucuuacaagug

SEQ ID NO: 54550 - RNA, 64 nt, hsa
gauuguagacauuuuuuuuuucuuaaauaugaucaaggaaaauagcuuccagaauguggugguu

SEQ ID NO: 54551 - RNA, 64 nt, hsa
uugacaaaugggaauuagaggagugcaguuuuaaaaggaaaaguugcugucaucaaaauggcag

SEQ ID NO: 54552 - RNA, 64 nt, hsa
gacauacagagguugaauugaguauauauuugaaaaggaaaaaacaaaaaacaaacccagaccc

SEQ ID NO: 54553 - RNA, 64 nt, hsa
aauauauuuuauuacuagagcaagauggguuuuuaaggaaaauaaugugaaauucuggaaauuu

SEQ ID NO: 54554 - RNA, 64 nt, hsa
ccauccuaggcaacagagugauacgcuguuuaaaaaggaaaaaauccuucccuagagcuaguau

SEQ ID NO: 54555 - RNA, 64 nt, hsa
cagagugagacuccaucucaacagaaggaaaaaaaaggaaaauaggagaagguggaaaugggug

SEQ ID NO: 54556 - RNA, 64 nt, hsa
gccugggugacagagugagacuccaucucaacagaaggaaaaaaaaggaaaauaggagaaggug

SEQ ID NO: 54557 - RNA, 64 nt, hsa
auacuguaaauuaugcauuauaaagaguucauuuaaggaaaauuacuugguacaauaauuauug

SEQ ID NO: 54558 - RNA, 64 nt, hsa
ucuuggcugugagcaacugcgacaaaacauuuugaaggaaaauuaaaccaaugaagaagacaaa

SEQ ID NO: 54559 - RNA, 64 nt, hsa
aguuaaaccauucugggauuugggaacuucuuuaaaggaaaauuguaguagaggucaucuugau

SEQ ID NO: 54560 - RNA, 64 nt, hsa
uagucuugugugucucacauaucagcuuuuucauaaggaaaauacuuuauuugcuuuuaucuga

SEQ ID NO: 54561 - RNA, 64 nt, hsa
uaaauacauauuguuuaaaaaaaagcaagaaaaaaaggaaaacaaaggaaaauauccccaaagu

SEQ ID NO: 54562 - RNA, 64 nt, hsa
uuguuuaaaaaaaagcaagaaaaaaaggaaaacaaaggaaaauauccccaaaguuguuuucuag

SEQ ID NO: 54563 - RNA, 64 nt, hsa
gaguguccuaacaguccccgggcuagagaggacuaaggaaaacagagagaguguuacgcaggag

SEQ ID NO: 54564 - RNA, 64 nt, hsa
gaucuagggcccugggaggagguugagccuggggaaggaaaaagcaggaaacugaaggaagcag

SEQ ID NO: 54565 - RNA, 64 nt, hsa
uggauuggauucgguaaaaagaggggguugcuagaaggaaaaacaggugugaccugauccugcc

SEQ ID NO: 54566 - RNA, 64 nt, hsa
auuaauagguugcuaauuauuuaucacugcuaaaaaggaaaaaaggcauaaaaugaccuucuac

SEQ ID NO: 54567 - RNA, 64 nt, hsa
uacuuuucuggcaaaaaaaaaaaaaaaagaaagaaaggaaaacaaaaagcacuuuuuucuuaau

SEQ ID NO: 54568 - RNA, 64 nt, hsa
uacagugaacagaguuuugaaaggcauugcuuuaaaggaaaaaaguauagguauguguacauau

SEQ ID NO: 54569 - RNA, 64 nt, hsa
guguacagaguuggacuauguguauauuggaaauaaggaaaaacccuucucauuguuaacugga

SEQ ID NO: 54570 - RNA, 64 nt, hsa
gguauacuuacaaugugaaguaacuuaugaauaaaaggaaaaguuuaucccauauucaaauaau

SEQ ID NO: 54571 - RNA, 64 nt, hsa
cuuucuuggaaagacucacuuuaccaagcauauaaaggaaaaaugauuucaaacauugacaaga

SEQ ID NO: 54572 - RNA, 64 nt, hsa
ugaauaugugacacacacacuccuaaguaccuuuaaggaaaauuaauaaaucauuaauaguuaa

SEQ ID NO: 54573 - RNA, 64 nt, hsa
uucuucccaagugcuguuggguuuuuuucuucuuaaggaaaacguugucacuuuuauguuauaa

SEQ ID NO: 54574 - RNA, 64 nt, hsa
cuuuccuguucuuuaagaguuuaaaaucaucagaaaggaaaaacaaacucuauauuguucagca

SEQ ID NO: 54575 - RNA, 64 nt, hsa
aaaaccaagucacuuagguaguaccaaaauaaauaaggaaaagcuuagcuuuagaaacagugca

SEQ ID NO: 54576 - RNA, 64 nt, hsa
accacaggacugcagggugcacaacuccccugccaaggaaaaccaugcaguccuccccucccug

SEQ ID NO: 54577 - RNA, 64 nt, hsa
uccucaucauguuguauuccagcuucuuaaguggaaggaaaagagugcugagaaauggcucugu

SEQ ID NO: 54578 - RNA, 64 nt, hsa
cagccugggugacagagugagacucugucucaagaaggaaaaaaaaaaaaaagaauguacucau

SEQ ID NO: 54579 - RNA, 64 nt, hsa
aagcccuuuaagagucaugguaaggagaugggugaaggaaaauuuagcaacagguaauugaagu

SEQ ID NO: 54580 - RNA, 64 nt, hsa
uuuucaacuuuuuaguuuuguuccuucaaaguugaaggaaaaaaaguuugguuuuauaaaauuc

SEQ ID NO: 54581 - RNA, 64 nt, hsa
uuuuuuuguauaaaaauuuaaauugaauuaaaagaaggaaaaaaaaagcccaaacuuaaccucu

SEQ ID NO: 54582 - RNA, 64 nt, hsa
auacagauuuagacaaagacaagagcaucagacaaaggaaaagagaggaggauagagucaaggu

SEQ ID NO: 54583 - RNA, 64 nt, hsa
aagaaaggccagagaaagagcaguccaagcauaaaaggaaaaagaguuaugaagauacagauuu

SEQ ID NO: 54584 - RNA, 63 nt, hsa
ucugcauagauuuucuuuuaaauugguucuuuguuucugaagaaagaauuuuuuuuaacuuca

SEQ ID NO: 54585 - RNA, 63 nt, hsa
uuuuaacuucaugguuuuauuuauaauaauuuguuucugaagaaauuugccgagaguuacagg

SEQ ID NO: 54586 - RNA, 63 nt, hsa
uuuuaaaaaacaaaacaauguaaguaaaggauauuucugaaucuuaaaauucaucccaugugu

SEQ ID NO: 54587 - RNA, 63 nt, hsa
gauaccugguuguauauuauuugaugcaacaguuuucugaaaugauauuucaaauugcaucaa

SEQ ID NO: 54588 - RNA, 52 nt, hsa
augaugaagcuaacacuugaauuuucugaagucuagcuuaacaucuuugguu

SEQ ID NO: 54589 - RNA, 63 nt, hsa
uuuuugaaucgagguuuuuuuguuuuguuuuguuuucugaaaaaaucauacaacuuugugcuu

SEQ ID NO: 54590 - RNA, 63 nt, hsa
augcuaucaguaauagucccaguuccauccaacuuucugaaauuucauuuuuuuuuuugagau

SEQ ID NO: 54591 - RNA, 63 nt, hsa
gauuacaggugugagccaccgcacccggccaacuuucugaaauuucaaaacugaauugauccu

SEQ ID NO: 54592 - RNA, 63 nt, hsa
uaaaggucuagggagcaauaaccagcccuuuuuuuucugaaggcuuguuuuuaguccucauug

SEQ ID NO: 54593 - RNA, 63 nt, hsa
aacuguuauaagugcuuauuuauaaaaggaauguuucugaaugcaagugccuaaaaagaucuu

SEQ ID NO: 54594 - RNA, 63 nt, hsa
ggcauuuucuuuauuugaaccuaccucuuuuauuuucugaaccaaagagaaagauggacuggu

SEQ ID NO: 54595 - RNA, 63 nt, hsa
uucagcugaauacgaaugaacacagugguggaauuucugaagggaagugaugaaauuauauuu

SEQ ID NO: 54596 - RNA, 63 nt, hsa
accagucaggaacccuggcgauaucacuuuaacuuucugaaccucagagucuucaccuauaag

SEQ ID NO: 54597 - RNA, 63 nt, hsa
uccugauggacgcagcaccaucaaagcccagaauuucugaaaacggugacaagguuaacauaa

SEQ ID NO: 54598 - RNA, 63 nt, hsa
acgaaauauauauuucucgccaaguuuuuauacuuucugaaaugaaaacauaggauugacuag

SEQ ID NO: 54599 - RNA, 63 nt, hsa
ugaaucccaaacuuugcaccaggucgacaaacuuuucugaagguucuauuuauuuaccauaca

SEQ ID NO: 54600 - RNA, 63 nt, hsa
cuaauuuguggaaaaaggauuaaauauuucuguuuucugaaaagaguuauuuuguauuuuguu

SEQ ID NO: 54601 - RNA, 63 nt, hsa
uaaguaacaagauagaauuagaaaaauguugaauuucugaaugaccauucagagguguggcuu

SEQ ID NO: 54602 - RNA, 63 nt, hsa
auauauaguaggaggggguaugugucucaggcuuuucugaaguugcaagacuuaaagaaauaa

SEQ ID NO: 54603 - RNA, 63 nt, hsa
uuaagacauccaaucaauaaugaaggaaauuuuuuucugaauguagguuugagugaggggcac

SEQ ID NO: 54604 - RNA, 63 nt, hsa
aagcaguucaaguuacugaaaaccuuuuaaaccuuucugaaguucguuaguauaaauuacuuu

SEQ ID NO: 54605 - RNA, 63 nt, hsa
uacccuaacaguuuuaccaccuaguaacagucauuucugaaaauauguuggauagaaagucac

SEQ ID NO: 54606 - RNA, 63 nt, hsa
aaaaauauggagaagaguaauuugaaagccuacuuucugaagaaaauggugggauuuuuuuuu

SEQ ID NO: 54607 - RNA, 63 nt, hsa
gggaaaggauuuuuacauuuuuuaaacugcuauuuucugaauggaacaagcugggccaagggg

SEQ ID NO: 54608 - RNA, 63 nt, hsa
gggcagcucccaggauauccugccuuccaacuguuucugaagccccuccuccuaacauggcga

SEQ ID NO: 54609 - RNA, 63 nt, hsa
uuaguuaaaugagcuauagauaaggcagcuaaauuucugaaagauagccagaguaaguaagca

SEQ ID NO: 54610 - RNA, 63 nt, hsa
aggaaucucuguaauuccugcuugggcuccaaauuucugaagaguaauauuuuuaaacuauag

SEQ ID NO: 54611 - RNA, 63 nt, hsa
uuuuuccccucuuccccuucccgucuuguguuuuuucugaaccccacaucugccaucauuucu

SEQ ID NO: 54612 - RNA, 63 nt, hsa
gcauucauaaguuaacccaugguaaagaguguuuuucugaaacuuuuuuuuaguaagaugguu

SEQ ID NO: 54613 - RNA, 63 nt, hsa
aguguccuucaguuucucaguaugaagccuuuauuucugaaguaacaagacaccuagcaacua

SEQ ID NO: 54614 - RNA, 63 nt, hsa
uucugaaugguaauaaugucuaaaucuuuuuccuuucugaauucuugcuuguacauuuuuuuu

SEQ ID NO: 54615 - RNA, 63 nt, hsa
ugaauuuuacauuuuuccucaccauuuagcaauuuucugaaugguaauaaugucuaaaucuuu

SEQ ID NO: 54616 - RNA, 63 nt, hsa
uuuuauugcucugguggauuuuuguggcuggguuuucugaagucugaggaacaaugccuuaag

SEQ ID NO: 54617 - RNA, 63 nt, hsa
aagccucucucucuuucucuccuccccaacuuuuuucugaaagccuugauuucuguagacaga

SEQ ID NO: 54618 - RNA, 63 nt, hsa
aguggauguuucuauuuggcaaggaagguaggauuucugaaacucaggccuuaaccaauaggu

SEQ ID NO: 54619 - RNA, 63 nt, hsa
acauacagucucugucauaacuacucaacucuguuucugaagcaggaaagccaccacagacag

SEQ ID NO: 54620 - RNA, 63 nt, hsa
auauauuagaagcaauuauaauuacaucugugauuucugaacuaauggugcuaauucagagaa

SEQ ID NO: 54621 - RNA, 63 nt, hsa
uuuugcacauuuaauauuuuucuuauaucuacauuucugaauauguaaagcaaguuauugaaa

SEQ ID NO: 54622 - RNA, 63 nt, hsa
aagcaucucacauugguuuucuuucuuguaucuuuucugaaacuccuugcuguaaggcagcuu

SEQ ID NO: 54623 - RNA, 63 nt, hsa
ggcagguucaaaauucuguugaaagaaaaaugcuuucugaaacugagguauaacaccagagcu

SEQ ID NO: 54624 - RNA, 63 nt, hsa
aauccugaugcugaccaucugaaauguacuuuuuuucugaaugcuguuucaaucuaaaauagc

SEQ ID NO: 54625 - RNA, 63 nt, hsa
aauaguugauuuugaugccuuuguagaauauuuuuucugaauccuuaugcucuuuuaaagcca

SEQ ID NO: 54626 - RNA, 63 nt, hsa
auccugacgucuugggucuuuuaaguauauacuuuucugaaagguauccauuuuguaggcuug

SEQ ID NO: 54627 - RNA, 63 nt, hsa
gcuugucaugauuaacauaauccagguaugucauuucugaagagaauagucaucaaauuuaua

SEQ ID NO: 54628 - RNA, 63 nt, hsa
ccucuccgcggcgcucacccuccucagucccaguuucugaaaggacucagcugagaaaggaca

SEQ ID NO: 54629 - RNA, 63 nt, hsa
aauuuuuauuuucuucauucuacuuaucuuuauuuucugaacuuucuacaaugaacauguuuu

SEQ ID NO: 54630 - RNA, 63 nt, hsa
aagugcuuacuguguaagcccaagaacaaaggcuuucugaaucuucucaggcaguucagauuu

SEQ ID NO: 54631 - RNA, 63 nt, hsa
caaguuucuuauauuuauguauuucuauucugauuucugaaaugauaaccuaguagugucuga

SEQ ID NO: 54632 - RNA, 63 nt, hsa
auauuucuccaucauggccuuuuacuucacaauuuucugaagucugaauucaauuacaauuuu

SEQ ID NO: 54633 - RNA, 63 nt, hsa
ugcuuauguuuauaaguuuugagauuuuuuuuuuuucugaaaaggauaccaaagugcgauaac

SEQ ID NO: 54634 - RNA, 63 nt, hsa
agacagaacuuugucacuucagugcaguacauuuuucugaaagcuacccauaaaaucacuuuc

SEQ ID NO: 54635 - RNA, 63 nt, hsa
uuggggauuauuuuaaauaauugguuuuuguguuuucugaauuaccauuuuuucaagaauguu

SEQ ID NO: 54636 - RNA, 63 nt, hsa
acuuuauguuaacaggguuauuacaaagcacauuuucugaaucugcaaucauuccuuugacaa

SEQ ID NO: 54637 - RNA, 63 nt, hsa
gaaauaucuaagcuguacaugguacacuagaauuuucugaaagcagaaaacguucagauuuug

SEQ ID NO: 54638 - RNA, 63 nt, hsa
aauaucacaagucagucagucacuggguuuccauuucugaauuuuaugcacuccaaccaugaa

SEQ ID NO: 54639 - RNA, 63 nt, hsa
gggcuuuagccaucagcuuuguacaucaucauuuuucugaaugaccaaucccacuaaacaucu

SEQ ID NO: 54640 - RNA, 63 nt, hsa
aguauuucuaauuagccuaauaaauucccacacuuucugaagugaacacuaaugguauugucc

SEQ ID NO: 54641 - RNA, 63 nt, hsa
auuuguuuggcugacuggcaguaaccuagugaauuucugaaagaugaguaauuucuuuggcaa

SEQ ID NO: 54642 - RNA, 63 nt, hsa
aaauuagcaggugcaccuucuguggcugucuuguuucugaaguacuuaaacuuccacaagagu

SEQ ID NO: 54643 - RNA, 63 nt, hsa
agcucagggccugacuguauuuuucauccaucuuuucugaagugucuuugggcaguauguagu

SEQ ID NO: 54644 - RNA, 63 nt, hsa
acuuugauuugggguuuugauuaauucuuuauuuuucugaaaaaaaguuuaaauaaugucugu

SEQ ID NO: 54645 - RNA, 63 nt, hsa
guuuuacccagaugggccugcaccuccagcuucuuucugaagcaugacccaucuccagagaug

SEQ ID NO: 54646 - RNA, 63 nt, hsa
auugugguuugugaauugcaccuuugugccauguuucugaaucugguuuucaaauccagugga

SEQ ID NO: 54647 - RNA, 63 nt, hsa
caaaaccacuuauauugcuagcuacauuaagaauuucugaauauguuacugagcuugcuugug

SEQ ID NO: 54648 - RNA, 63 nt, hsa
uguccagaauuucguuccuaccaguuaaguaguuuucugaacggccagaagaccauucgaaau

SEQ ID NO: 54649 - RNA, 63 nt, hsa
uaauuuacauuagagugaaaaauaaaugguuuguuucugaaguuaguuucuuaagugaguuuu

SEQ ID NO: 54650 - RNA, 63 nt, hsa
guuacauuuauuuauauauuuugcaagaaaucuuuucugaaugaucaaugcauuucaauuuac

SEQ ID NO: 54651 - RNA, 63 nt, hsa
aucaggggaaaaagcuauaaauguccuguucuuuuucugaaguguggauaucaauauaaaauu

SEQ ID NO: 54652 - RNA, 63 nt, hsa
cauuucuguagcaugacagggauuucaaucaccuuucugaaaagagugggcugauaaacuugu

SEQ ID NO: 54653 - RNA, 63 nt, hsa
ucuagcucuggguucuguuuagagauugguuuauuucugaauauucaagaaaggaaaaugacu

SEQ ID NO: 54654 - RNA, 63 nt, hsa
caggucacaccaggggcagacccugucgcugcguuucugaacugugaaggagcccauucgggu

SEQ ID NO: 54655 - RNA, 63 nt, hsa
ccuuuuucucuuuauuaacgauuuaaauguaacuuucugaacacauugcauugaauucuuccu

SEQ ID NO: 54656 - RNA, 63 nt, hsa
aauauugaugacaucaauguaacauuugagauauuucugaauuacuguuguaauggcuaaaau

SEQ ID NO: 54657 - RNA, 63 nt, hsa
ccccugacucuuacauuuaucuuucuaaaucauuuucugaagcugacuugcucuagggugcuu

SEQ ID NO: 54658 - RNA, 63 nt, hsa
cuaaacucuaccaagaauggaaacaaagaauauuuucugaagauuuuuuugaagauuaauuua

SEQ ID NO: 54659 - RNA, 63 nt, hsa
agcuuuuaaaauaauucaauggauauacauuuuuuucugaagauuaagauuuuaauuauucaa

SEQ ID NO: 54660 - RNA, 63 nt, hsa
uuuucuuaauuguuauuuuuuauaaucauuauuuuucugaaccauucuucuggccucagaagu

SEQ ID NO: 54661 - RNA, 63 nt, hsa
cuccgaagaaaagaauuuuaguguuaaugacucuuucugaaggaagagaagacauuugccuuu

SEQ ID NO: 54662 - RNA, 63 nt, hsa
caggcagcucggauucaacuaccuuagauaauauuucugaaaaccuaccagccagaggguagg

SEQ ID NO: 54663 - RNA, 63 nt, hsa
ucuucugaaauacaaccagaaacaaugugucuauuucugaaagaauaggauuaaugaucauac

SEQ ID NO: 54664 - RNA, 62 nt, hsa
uaaaguugucuuuuaaacuacucggauguguccuuucugaacaaaacuauuaaauauaauaa

SEQ ID NO: 54665 - RNA, 63 nt, hsa
guuacaugaauaauuuguggaccagggauugcuuuucugaaggcaguauagggaacaugaaua

SEQ ID NO: 54666 - RNA, 63 nt, hsa
gaguaaaaugagaaaguuaauauguggccuccuuuucugaagccagaucaaacuguuaccuug

SEQ ID NO: 54667 - RNA, 63 nt, hsa
aacugcuaguaguggaauacuggaaaagcuucauuucugaagaugaauuuuauuuuuaaaaaa

SEQ ID NO: 54668 - RNA, 63 nt, hsa
caaaacuuuuagcuuugaucacaaguggacaaauuucugaaaccaaaggcaacuaaguugcug

SEQ ID NO: 54669 - RNA, 63 nt, hsa
cuagguauuuucuucaaaagguaaauacaaugguuucugaaagaaucauuugcauuaucagcc

SEQ ID NO: 54670 - RNA, 63 nt, hsa
gucuuuguaaucuauuuaguugauuuuaauuacuuucugaauaacggaagggaucagaagaua

SEQ ID NO: 54671 - RNA, 63 nt, hsa
uugcuauucuuuuugcuuaaauacuccuaucauuuucugaauuacuugguauuuagaacuccu

SEQ ID NO: 54672 - RNA, 63 nt, hsa
aauauguuuguuaauuuacuucauguuggguucuuucugaaauguacaucuuuacauauaaaa

SEQ ID NO: 54673 - RNA, 63 nt, hsa
aauaugaauaugauuggauucagaaaaauuaacuuucugaauuugaucugucuucagucuugu

SEQ ID NO: 54674 - RNA, 63 nt, hsa
acaguucuucucaaacauuuucauucagauagcuuucugaaaguucccuaucccucuuuacca

SEQ ID NO: 54675 - RNA, 63 nt, hsa
gcuacaggaaacaagcacacucaagaaaguuuuuuucugaauaacauuuuuuuccaauuucuc

SEQ ID NO: 54676 - RNA, 63 nt, hsa
ugacaggccauuauuaucugcuuugacaaagccuuucugaaacgcaguguacaaugaaucuua

SEQ ID NO: 54677 - RNA, 63 nt, hsa
auucaggugguuuauuaauuacauuuaaaaaguuuucugaaaaaacuuuugcaauaaaaaaaa

SEQ ID NO: 54678 - RNA, 63 nt, hsa
auagugaaugguaagacuagugcaaaacaguuauuucugaaaauuaaagaccauuauugcuac

SEQ ID NO: 54679 - RNA, 63 nt, hsa
gaaauauuuuauaaauccuguuuaacagcagaauuucugaauguguagagacuacuacaaaau

SEQ ID NO: 54680 - RNA, 63 nt, hsa
aacauuauuugccuaaaauuagcauugugaugcuuucugaaagaaauauuuuauaaauccugu

SEQ ID NO: 54681 - RNA, 63 nt, hsa
gaaauacuauaaaacacugagaguaucuaugucuuucugaauuuaaaaugaaaauucaugucc

SEQ ID NO: 54682 - RNA, 63 nt, hsa
cauggauuauuuuuauaugauuuguacaaauuuuuucugaaauuuaaauugacaagcaauguu

SEQ ID NO: 54683 - RNA, 63 nt, hsa
agccaaccagaaugagugggucaucuuauaaccuuucugaagcuccaugaggacauguauaga

SEQ ID NO: 54684 - RNA, 63 nt, hsa
acauaaagcauauuaaaauaucugcuccuuaauuuucugaaggaaauagauguaaguuucugc

SEQ ID NO: 54685 - RNA, 63 nt, hsa
gacaaguuuuuuuuuuuuuuuuuuuuuaaacccuuucugaacuuucacuuucuaugucuaccu

SEQ ID NO: 54686 - RNA, 63 nt, hsa
cuguuggacaaaccgagugcaaugaaugaugcuuuucugaaaaugaaauauaacaagugggug

SEQ ID NO: 54687 - RNA, 63 nt, hsa
auguguaagcacauuuuacuguaaauguuuggguuucugaauuuaaacagaucuguuuauuuc

SEQ ID NO: 54688 - RNA, 63 nt, hsa
aauugugggcuggggagaaacaguagucaaagcuuucugaauugagauacuuugaaauuccaa

SEQ ID NO: 54689 - RNA, 63 nt, hsa
auauuuuaucucaacuuugguuccugugauacauuucugaaugggcaauuccagaaaucuuag

SEQ ID NO: 54690 - RNA, 63 nt, hsa
cauaauuuuaguaauuuccuagagguucuggguuuucugaaaguaaaacaauuuaugcgaacc

SEQ ID NO: 54691 - RNA, 63 nt, hsa
guauguaacacauacauggaguauggaggaaauuuucugaaaaauacauuuagauuaguuuag

SEQ ID NO: 54692 - RNA, 63 nt, hsa
ucuaucucagagggccaaagugaaucacaccaguuucugaagguccuaaaaauagcucagaug

SEQ ID NO: 54693 - RNA, 63 nt, hsa
cucuauugucacacaugguuauauuuaaaguaauuucugaacuguguaaugugucuagaguaa

SEQ ID NO: 54694 - RNA, 63 nt, hsa
cgacguguuccuaaaacauguuugaaaggugaauuucugaaagucuacaauaaauguaggugu

SEQ ID NO: 54695 - RNA, 63 nt, hsa
gccuccgacuucacaccggaugagagagcuauguuucugaaguucgugaccagcugcuccaga

SEQ ID NO: 54696 - RNA, 63 nt, hsa
aaagccuacugugcgugagauccucuccuuccguuucugaaaucucuuacucagguaaggccu

SEQ ID NO: 54697 - RNA, 63 nt, hsa
gaaaguguucauugcacaauauauuuuuacugcuuucugaauguagacggaacaguguggaag

SEQ ID NO: 54698 - RNA, 63 nt, hsa
ccuuuuaaguggacucucugacaaaguggguacuuucugaaaauuuauauaacuguuguugau

SEQ ID NO: 54699 - RNA, 63 nt, hsa
cucaugaacgcagaauuauuaccugcuguuugcuuucugaaagaauuucagaaaucagagcaa

SEQ ID NO: 54700 - RNA, 63 nt, hsa
auuggcuaugaaguacuguggcagagcugcuguuuucugaaggugagaagccauuuuuagcuc

SEQ ID NO: 54701 - RNA, 63 nt, hsa
uaugagggaugccagauguugauaaacuuacucuuucugaaucuggacaaagucgacuuaaca

SEQ ID NO: 54702 - RNA, 63 nt, hsa
acuuaaucucuuccccuauccuucuaaauuaauuuucugaaguuggaguguagucuuuucccc

SEQ ID NO: 54703 - RNA, 63 nt, hsa
gggacagauuuuauguaaucuuuauaaguaugauuucugaagaaaagcaaaugcauuaguaug

SEQ ID NO: 54704 - RNA, 63 nt, hsa
uuauggcugccacucuuauuuaccuuuaaauaauuucugaaauuuaaccuuuucagaaugcau

SEQ ID NO: 54705 - RNA, 63 nt, hsa
agccacuguaccccgccuaaaacugaugaauuauuucugaaauuuucuauuuaacauuuucag

SEQ ID NO: 54706 - RNA, 63 nt, hsa
uagcuucauuuuuuaccuuugaaauacuuaaucuuucugaauaaauauaaugugucuauaaaa

SEQ ID NO: 54707 - RNA, 63 nt, hsa
auguggugaaaagaauuggcuagauaggggauuuuucugaacacugcaaaaauagaacguagc

SEQ ID NO: 54708 - RNA, 63 nt, hsa
guuaucacuuuugggugucuguauccuaagaaguuucugaaaagaucuaaagccuuuuuaucc

SEQ ID NO: 54709 - RNA, 63 nt, hsa
guaauaaaauagagcauaacgaaacugugaaacuuucugaagccuugucagugguuaaaagua

SEQ ID NO: 54710 - RNA, 63 nt, hsa
gacaauagaaauaaaaagaucuucagccaggccuuucugaaggaguuauucugcuaaaaaugg

SEQ ID NO: 54711 - RNA, 63 nt, hsa
uaacuuuuauagagaaaggguuuugucaaauguuuucugaaaaucugaguaauucaaagcaug

SEQ ID NO: 54712 - RNA, 63 nt, hsa
acacaacagcuguuuugcuuuuagauuucuguguuucugaagguaauguucuuccuguuuuca

SEQ ID NO: 54713 - RNA, 63 nt, hsa
caauauuaauacuguuuauagcuagaaguuugauuucugaauucuuugagauuuuagcaaaac

SEQ ID NO: 54714 - RNA, 63 nt, hsa
uaaagugcgcuugcaaacguuugcucuccuuuuuuucugaauguugauugccuuagcuggcca

SEQ ID NO: 54715 - RNA, 63 nt, hsa
aagagggaaaacugcaucucagcauuuucauuuuuucugaauauuaagugaaaagcaaguucu

SEQ ID NO: 54716 - RNA, 63 nt, hsa
ugcagucauuugcacgugaguucucaucuuuguuuucugaaacagacguuucuuuuaguaagu

SEQ ID NO: 54717 - RNA, 63 nt, hsa
ucuugugggcugugguugcugugacaguuucguuuucugaaucuuuguaaugcucuuccaccc

SEQ ID NO: 54718 - RNA, 63 nt, hsa
cccaggaccuucuauucacauuucaagaaucccuuucugaaauucuccaacucucuggucagg

SEQ ID NO: 54719 - RNA, 63 nt, hsa
uacuuuaaaccccgcuccucauggccuuggcccuuucugaagcugcuuccucuuauaaaauag

SEQ ID NO: 54720 - RNA, 63 nt, hsa
uugcccuggcagaaaaauggauucaacuuggccuuucugaaggcaagacugggauuggaucac

SEQ ID NO: 54721 - RNA, 63 nt, hsa
uaaaacauauuuauauauugugaugaggaguacuuucugaagaguacuucguauuuuuuuuua

SEQ ID NO: 54722 - RNA, 63 nt, hsa
ucuuacuuuuucucuuguggaacuuggccacaguuucugaacaaugugccuacauuaccagcu

SEQ ID NO: 54723 - RNA, 63 nt, hsa
cuguaaucuuuuuugacucuuaaaagaaauucauuucugaaaugcuugguuggaagacuguga

SEQ ID NO: 54724 - RNA, 63 nt, hsa
gaguuggaggaggcuguucucagcccuuucccuuuucugaaagcuguuccuggccgggcaucc

SEQ ID NO: 54725 - RNA, 63 nt, hsa
cgguuugcagagaauguuagccaugacuugggcuuucugaaaguuggcuauaauuucucuauc

SEQ ID NO: 54726 - RNA, 63 nt, hsa
cucaaagucuaacauauucaaugcaaguaagacuuucugaaaacacuugaugauguggaaaug

SEQ ID NO: 54727 - RNA, 63 nt, hsa
guuuuucaaaaauggaagcccacuucucagauuuuucugaagggcauacaaugaaaagugaag

SEQ ID NO: 54728 - RNA, 63 nt, hsa
ggaauaacaacucagugaaaagauggucuccaguuucugaaugaaaaagcuacagcugagaaa

SEQ ID NO: 54729 - RNA, 63 nt, hsa
ucuaaauugaacucaacauuuuacauuccaucuuuucugaagauuguccuacaauuuggauuu

SEQ ID NO: 54730 - RNA, 63 nt, hsa
ggcaguagggaugggguuagguaggggagaacauuucugaaaaagaacuuauaaugaagcuac

SEQ ID NO: 54731 - RNA, 63 nt, hsa
ucagugaugugaaauugagcccccaaaagguuguuucugaagcucgaguacuucccaaugccg

SEQ ID NO: 54732 - RNA, 63 nt, hsa
gauggcccugggcgcgcugggagugugguuguguuucugaaggggauaaaagagggcacggug

SEQ ID NO: 54733 - RNA, 63 nt, hsa
uaaauuugacaucgcguugcauuuauuuuuauauuucugaaaacuguugcuuuuucuuuuucc

SEQ ID NO: 54734 - RNA, 64 nt, hsa
ccuugucuugaaaaaaaaaaaaacaaaaaaccacauacaggaaaaaagagagggauggagucaa

SEQ ID NO: 54735 - RNA, 64 nt, hsa
gaggcaaaggggaucccugaaauaacauuagaacauacaggaaaaacgaggcaggcagaucacu

SEQ ID NO: 54736 - RNA, 64 nt, hsa
uacuaugugucaggcucuaugcuagguacuggggauacaggagagaaucaagcguaaagucuuu

SEQ ID NO: 54737 - RNA, 64 nt, hsa
ggacggccauggcaggaagcuuuuaguuggagagauacaggaagccuccuaggguucugagcag

SEQ ID NO: 54738 - RNA, 64 nt, hsa
gcaauacucaguaacaguguaguacucaguaacagugaaguacucaguaauacaguacaguauu

SEQ ID NO: 54739 - RNA, 64 nt, hsa
uacucaguaauacaguacaguauucaguaaggcagugaaguacucaguaauacaauacaguacu

SEQ ID NO: 54740 - RNA, 64 nt, hsa
auucccuuuuucuaaggcacagagcugguaaaaugugaaguaauagugaaccuaacagucagag

SEQ ID NO: 54741 - RNA, 64 nt, hsa
aaguugaaagaugggguuggguaaaguagauuaggugaaguagaacauaaaauugaauaguacc

SEQ ID NO: 54742 - RNA, 64 nt, hsa
aggcauuggaggugguuucuggccgugauuggaugugaaguagaagagguccucgaucauggug

SEQ ID NO: 54743 - RNA, 64 nt, hsa
ugucuucuagccuugagccucugagggucaguaagugaaguacagauagcaaaauuuuacuacc

SEQ ID NO: 54744 - RNA, 64 nt, hsa
uaguaugaauguggucagaggauuauaguugagagugaaguacuaugugugaguuauagaucuc

SEQ ID NO: 54745 - RNA, 64 nt, hsa
caugugcagauaaaagagguuuaugaaguuuagggugaaguaggcaagggaaucuguuuacucc

SEQ ID NO: 54746 - RNA, 64 nt, hsa
ucacaauuugugucucguuguucagaacaacccugugaaguaguuuuggcaaugucuguguuac

SEQ ID NO: 54747 - RNA, 64 nt, hsa
uugugccaguguugcaacguuuuaaacugcuaacagaccuuaaaauaucccccuaccugggucc

SEQ ID NO: 54748 - RNA, 64 nt, hsa
uuaccugauaacagucuuguuauuugggucucuuagaccuuaccucucaacucccucaagagua

SEQ ID NO: 54749 - RNA, 64 nt, hsa
gacacaaacacacauaagaauacacucuggagaaagaccuuauaaauguaagacaugugggaaa

SEQ ID NO: 54750 - RNA, 64 nt, hsa
gacacaaacacacguaagaaugcacucuguagaaagaccuuauaaauguaagauaugugggaaa

SEQ ID NO: 54751 - RNA, 64 nt, hsa
agaagcaucuggacagacaggccuugcuggguuuagaccuuaugcuuuuuguccaguuucaucu

SEQ ID NO: 54752 - RNA, 64 nt, hsa
uggaaaugucguuggaaacuugcaaagacucuccagaccuuagggaacaagaggcaucacucag

SEQ ID NO: 54753 - RNA, 64 nt, hsa
cugcugcguccugcacccuccugggcccaccuccgauucacagagguuucagggggacccaaau

SEQ ID NO: 54754 - RNA, 64 nt, hsa
aaugccuccaaacauuuuucuguacucauacuuagauucacaaugguuguguaucucuauaaug

SEQ ID NO: 54755 - RNA, 64 nt, hsa
guaauucagcauguuggucagagacacggucacugauucacacccagucccugccacagaccgu

SEQ ID NO: 54756 - RNA, 64 nt, hsa
accgucucagacacgcacagugggccugcugcaugauucacacccagucccugccacagaccgu

SEQ ID NO: 54757 - RNA, 64 nt, hsa; identical to SEQ ID NO: 54756

SEQ ID NO: 54758 - RNA, 64 nt, hsa
gaauuggggcaauuaccuuuugauccucaauacugauucacaauugaguuaaauuagacaacug

SEQ ID NO: 54759 - RNA, 64 nt, hsa
auggguggguaguguaaauacacaagaaaaggaugauucacaucccaugugggauggagcagaa

SEQ ID NO: 54760 - RNA, 64 nt, hsa
aacagagaaccaucccuauuuuguauugaagagggauucacaucugcaucuuaacugcucuuua

SEQ ID NO: 54761 - RNA, 64 nt, hsa
aagccuguuuugucuuuuguuguuguucaaacgggauucacagaguauuugaaaaauguauaua

SEQ ID NO: 54762 - RNA, 64 nt, hsa
cuuaguuaagauucacaaucuuuagaaagaaugagauucacaauaauuaacucuuccucucuuc

SEQ ID NO: 54763 - RNA, 64 nt, hsa
uuuuauuuuccgucaggugccaggucuuaguuaagauucacaaucuuuagaaagaaugagauuc

SEQ ID NO: 54764 - RNA, 64 nt, hsa
aggaacucuccaaagccuauuccacauauuuaaaccgcauuaaucauggcaaucaagcccccuu

SEQ ID NO: 54765 - RNA, 64 nt, hsa
aucuuuggugagcuucagugggcagagugaagucccgcauuagcauuuaggugcccugagcugu

SEQ ID NO: 54766 - RNA, 64 nt, hsa
cuggcuucauuacacuuguacagccgaguucuucccgcauuacugcuguuuaauagaacgugau

SEQ ID NO: 54767 - RNA, 64 nt, hsa
agccacagcagguccuccaucccaacagccaugcccgcauuagcucuuagacccacagacuggu

SEQ ID NO: 54768 - RNA, 64 nt, hsa
cuccucuguaaaaugggcaugauuagagugcccaccgcauuagggauguuggggugagucagug

SEQ ID NO: 54769 - RNA, 64 nt, hsa
gagcuuugccugggaccugaaccuggagcacuuaccgcauuaggaagaaaggagcuccccguaa

SEQ ID NO: 54770 - RNA, 64 nt, hsa
aaaagcauaacuggcuaagucaccgccccacccgccgcauuacauuuccuaaaacauacugcug

SEQ ID NO: 54771 - RNA, 64 nt, hsa
ugcuugugggaugcaguggucuucaggauucuccccgcauuauuauguaguuguucagaagcug

SEQ ID NO: 54772 - RNA, 64 nt, hsa
aguucaaagaugaaagcaccauguaucaggauuuccgcauuauaaaaaugaacuaaacauugcc

SEQ ID NO: 54773 - RNA, 64 nt, hsa
gugcuuuguuuuuggaagaucugguaacagcagcccgcauuagcagagagcuguagcugaguag

SEQ ID NO: 54774 - RNA, 64 nt, hsa
guuuuacuguauugagcggcggcacccgccggacccgcauuauggcugggggcgccagcccaag

SEQ ID NO: 54775 - RNA, 64 nt, hsa
gcuccuucccauacacucugcagacccaacagucccgcauuagcucuagcaaugagguucacug

SEQ ID NO: 54776 - RNA, 64 nt, hsa
uauaaauaacgggauuuucauggcgccgccccacccgcauuaucacugugugauggucucaguc

SEQ ID NO: 54777 - RNA, 64 nt, hsa
aguguguuuuuggaagaugugauugauuuguaaaccgcauuaaaugcucugaaauaaaaugaaa

SEQ ID NO: 54778 - RNA, 64 nt, hsa
agcuguuugguggaacccaugcaucuggugugguccgcauuaugauggaaggaucuuaaccagu

SEQ ID NO: 54779 - RNA, 64 nt, hsa
gagaagcauuuuaaagaaacccccacccugccgcccgcauuauaaacacaggagaauaaucaau

SEQ ID NO: 54780 - RNA, 64 nt, hsa
ugugcaaacucacuucugaggggggacccuggcaccgcauuagagcucgaaauaaaggcgauag

SEQ ID NO: 54781 - RNA, 64 nt, hsa
uaggagaaacagacaagcaaaacaaagugaaaaccgaauggauuaacuuuugcaaaccaaggga

SEQ ID NO: 54782 - RNA, 64 nt, hsa
cuuuuaauuuucuauuuagaaagaaaaguugaagcgaauggaaguaucagaaguaccaaauaau

SEQ ID NO: 54783 - RNA, 64 nt, hsa
uuggccuuccauuuuuacugagauuuggcgagaccgaauggaagcguccgcacaguaacugcag

SEQ ID NO: 54784 - RNA, 64 nt, hsa
uaaaauaauuugcccgaagacauacagcuagugacgaauggacugaugguuugaacuuaacguc

SEQ ID NO: 54785 - RNA, 64 nt, hsa
gagcccaggcccucccuccaggguagagaugcaccgaauggaaauugcacuaaggaccucuucc

SEQ ID NO: 54786 - RNA, 64 nt, hsa
cagcuccacucugcucuugcccacaaagcugacccgaauggaccacagcagugggcuccuaugc

SEQ ID NO: 54787 - RNA, 64 nt, hsa
uauguuacgggcgcuuuaaccaucagcugccucucgaauggaagaacagugguaauggauuaac

SEQ ID NO: 54788 - RNA, 64 nt, hsa
acugcuguaggcugucccagugcgaggccgggagcgaauggaaaagcugaggcuuugccuggcu

SEQ ID NO: 54789 - RNA, 64 nt, hsa
aaagaauucccugcaaauacugaaagcagucaugcgaauggagggugcucuuguguagcugguc

SEQ ID NO: 54790 - RNA, 59 nt, hsa
ucuuacaaagauguaacugaaagacuuuucgaauggacccuaugggacuccucuuuucc

SEQ ID NO: 54791 - RNA, 64 nt, hsa
uuaauaugcaagugaacaaagugagaaaugaaaucgaauggagauuggccugguuguuuccgua

SEQ ID NO: 54792 - RNA, 64 nt, hsa
gugaguugcacagcuaugaaggcuguacacugcacgaauggaagaggcaccugucccagaaaaa

SEQ ID NO: 54793 - RNA, 64 nt, hsa
cgcguuagccaugaaggagucggagcccuggguccgaauggacccgccugcggucugcaucagc

SEQ ID NO: 54794 - RNA, 64 nt, hsa
aauuagaauaaaauauaguugugauaauggucaucgaauggauuuguuuggaaagcuacaucuu

SEQ ID NO: 54795 - RNA, 64 nt, hsa
uugucuuuuuggagacacagugaacacugcuucucgaauggagucuaauggucaagguaagaca

SEQ ID NO: 54796 - RNA, 64 nt, hsa
aaaggaaugcugguuuaucuuuguagauuguaaucgaauggagaaauuugcaguauuuuagcca

SEQ ID NO: 54797 - RNA, 64 nt, hsa
uagauguucuauagugcuacaaggaauugccuuccgaauggagguucauguauaauacucauuu

SEQ ID NO: 54798 - RNA, 58 nt, hsa
ucaaugcaaagaagaaauaaaaucuagacgaauggagaugcaggagcugcgggagccg

SEQ ID NO: 54799 - RNA, 64 nt, hsa
guucugaggggcucggccuggucaggcccuggugcgaauggacuuuggaagcagguagguugca

SEQ ID NO: 54800 - RNA, 64 nt, hsa
gugaacauuagaaagagccaggguucaaagcuggcgaauggaugacgcacccuagccacuggcc

SEQ ID NO: 54801 - RNA, 64 nt, hsa
ggcuuaaaccaguguucagucuggugccaaacuucgaauggaauacaaauucacauaaucugaa

SEQ ID NO: 54802 - RNA, 64 nt, hsa
gccauuugcagagauuuagaaagauuuacaguaacgaauggauuccuauauaaagauuauuuuu

SEQ ID NO: 54803 - RNA, 64 nt, hsa
ugugcugccugucuucgcgccacuguugucccaccgaauggacagcuuugcaggugcuggcacu

SEQ ID NO: 54804 - RNA, 64 nt, hsa
ucuacuaugggcagggccccccaccaagcugagccgaauggagacagcugagcugaggccugac

SEQ ID NO: 54805 - RNA, 64 nt, hsa
gggagcucuuggauaucauuggccauguuucaaucgaauggagccacugggccccaacacuggc

SEQ ID NO: 54806 - RNA, 64 nt, hsa
ggcguucagcagcggguuuggaacauagcgaauccgaauggaucugaugaaaccuguaccaggu

SEQ ID NO: 54807 - RNA, 64 nt, hsa
agagagggagcccuguauucuuggcuguacccgucgaauggaguuuugaucucgcugaguuugg

SEQ ID NO: 54808 - RNA, 64 nt, hsa
gacgcgcgugacacaaugcugggugguuuucccacgaauggacccucuccuggacucgcguucc

SEQ ID NO: 54809 - RNA, 64 nt, hsa
gaugucaugacaacacuacacgcacccaauaaagcgaauggaccauccaugugugucccuguga

SEQ ID NO: 54810 - RNA, 64 nt, hsa
cagagccugggcacuucagaggaggagccaggaucgaauggaaggggggaauugggguccacca

SEQ ID NO: 54811 - RNA, 64 nt, hsa
aauuugccucucuguguuuaaagagcaccaggaccgaauggauuuucacuucaggcuuuccuuc

SEQ ID NO: 54812 - RNA, 64 nt, hsa
ucuguguugugauuccccggagcugggaaggucccgaauggaguccagaccugggcccugguuc

SEQ ID NO: 54813 - RNA, 64 nt, hsa
auggccuaaguucccucuguuccuuccucugaaucgaauggaugugggugaccgcccgaaggcc

SEQ ID NO: 54814 - RNA, 64 nt, hsa
uaagaauuggcucuccuguacagggcacuuacuacgaauggagcuugcagggcugagaguugcu

SEQ ID NO: 54815 - RNA, 64 nt, hsa
aucccacauugccugggacaucugaaugcugauacgaauggacaggaaagggagccagagcugu

SEQ ID NO: 54816 - RNA, 64 nt, hsa
ggcagccacagugguuucuacuguauguaugaaccgaauggaggaauguuuucaaagauugauu

SEQ ID NO: 54817 - RNA, 64 nt, hsa
ggcuccuaagauccagcccccauacugacagacggacagacagacaugcaaacaccagacugaa

SEQ ID NO: 54818 - RNA, 64 nt, hsa
ccuaagauccagcccccauacugacagacggacagacagacaugcaaacaccagacugaagcac

SEQ ID NO: 54819 - RNA, 64 nt, hsa
gcaggacauaugggcaagcucugcaggacagacagacagacaaacccucugaucuaugaagucu

SEQ ID NO: 54820 - RNA, 64 nt, hsa
accagcaggacauaugggcaagcucugcaggacagacagacagacaaacccucugaucuaugaa

SEQ ID NO: 54821 - RNA, 64 nt, hsa
ugggaccagcaggacauaugggcaagcucugcaggacagacagacagacaaacccucugaucua

SEQ ID NO: 54822 - RNA, 64 nt, hsa
ucaccuaagcaaucacugggcccagaggagaggagacagacacacacuggcuccuggaccuaaa

SEQ ID NO: 54823 - RNA, 64 nt, hsa
ccugaugggaguaggcuccagacaggaggagugggacagacagcagcuggacuugaagguuuga

SEQ ID NO: 54824 - RNA, 64 nt, hsa
caggcagaccgauaaaaagaccuccagauaggcagacagacagauggaccaccaaccuggacag

SEQ ID NO: 54825 - RNA, 64 nt, hsa
agauaggcagacagacagauggaccaccaaccuggacagacagccaaagcuucagagauacagu

SEQ ID NO: 54826 - RNA, 64 nt, hsa
cagccagagagaccaccaaacagagcccccaaaagacagacaucucugcuagcuggacagccag

SEQ ID NO: 54827 - RNA, 64 nt, hsa
ggaccccagcuagucagacaugauccuccagauugacagacaagucccccaaaugaguacacau

SEQ ID NO: 54828 - RNA, 64 nt, hsa
cuuguacagccaaaauaauguauauauggaaagugacagacaaauucucuaaucucuuugguac

SEQ ID NO: 54829 - RNA, 64 nt, hsa
cuccugaaguagcuucaucacagagugucaugaagacagacagucaggcugaaauggacaguuc

SEQ ID NO: 54830 - RNA, 64 nt, hsa
uagcuacuaacuagaaauuagaugaagcaagcaugacagacacagcuguggaggucacagcugc

SEQ ID NO: 54831 - RNA, 64 nt, hsa
ccuuugaacucucuuggcugaacagcagauuacugacagacaaucugugauaugguguuuuaua

SEQ ID NO: 54832 - RNA, 64 nt, hsa
ugaaguauucagagccccccaggagagacggauggacagacagacagccagguucuccaguggu

SEQ ID NO: 54833 - RNA, 64 nt, hsa
guauucagagccccccaggagagacggauggacagacagacagccagguucuccagugguaucu

SEQ ID NO: 54834 - RNA, 64 nt, hsa
ucgacuuguuuuuuagcauggacacugccagcaggacagacagggauggaguaaaccgaaguca

SEQ ID NO: 54835 - RNA, 64 nt, hsa
uuccucagagauucgugauacgcguuucuccacugacagacauuuaaaaacaaccuucagcucc

SEQ ID NO: 54836 - RNA, 64 nt, hsa
guguggguguucaguucugugucugguggguauggacagacaguaaucuccugugaucugugcu

SEQ ID NO: 54837 - RNA, 64 nt, hsa
agagcguguguagugcugcaucuuaugacaaggggacagacaagcugggacgucagggaaauga

SEQ ID NO: 54838 - RNA, 64 nt, hsa
ggcucuggacccaggacagacagacagacagacagacagacacgcacacacacccaucucuguc

SEQ ID NO: 54839 - RNA, 64 nt, hsa
ugacggcucuggacccaggacagacagacagacagacagacagacacgcacacacacccaucuc

SEQ ID NO: 54840 - RNA, 64 nt, hsa
gaauugacggcucuggacccaggacagacagacagacagacagacagacagacagacagacacg

SEQ ID NO: 54841 - RNA, 64 nt, hsa
ugaagaauugacggcucuggacccaggacagacagacagacagacagacagacagacagacaga

SEQ ID NO: 54842 - RNA, 64 nt, hsa
aggcugaagaauugacggcucuggacccaggacagacagacagacagacagacagacagacaga

SEQ ID NO: 54843 - RNA, 64 nt, hsa
acugaggcugaagaauugacggcucuggacccaggacagacagacagacagacagacagacaga

SEQ ID NO: 54844 - RNA, 64 nt, hsa
uccccgcccgcccuccucugcccccucccccgcagacagacagacagacggacgggacagcggc

SEQ ID NO: 54845 - RNA, 64 nt, hsa
cgcccgcccuccucugcccccucccccgcagacagacagacagacggacgggacagcggcccgg

SEQ ID NO: 54846 - RNA, 64 nt, hsa
acaaaauauguguggagauauauauacauauauagacagacaggaacgcguccacgagcuauau

SEQ ID NO: 54847 - RNA, 64 nt, hsa
cucggcuguuuuucugcauuauuuauauucaacugacagacaaaaaccaaccaacgacaaaaca

SEQ ID NO: 54848 - RNA, 64 nt, hsa
ucuccagacucuaccacuuacggacagacagacagacagacacacacacacacacacacacaca

SEQ ID NO: 54849 - RNA, 64 nt, hsa
uccaucuccagacucuaccacuuacggacagacagacagacagacacacacacacacacacaca

SEQ ID NO: 54850 - RNA, 64 nt, hsa
gugguccaucuccagacucuaccacuuacggacagacagacagacagacacacacacacacaca

SEQ ID NO: 54851 - RNA, 64 nt, hsa
aacugugguccaucuccagacucuaccacuuacggacagacagacagacagacacacacacaca

SEQ ID NO: 54852 - RNA, 64 nt, hsa
aguugguucuguguccauuuuccucugugccaaagacagacagacagaggcugagagaggcugu

SEQ ID NO: 54853 - RNA, 64 nt, hsa
gguucuguguccauuuuccucugugccaaagacagacagacagaggcugagagaggcuguuccu

SEQ ID NO: 54854 - RNA, 64 nt, hsa
accaagauguuggggcugccuggcgcccacuggagacagacagacagacgccugucccccggga

SEQ ID NO: 54855 - RNA, 64 nt, hsa
agauguuggggcugccuggcgcccacuggagacagacagacagacgccugucccccgggaccga

SEQ ID NO: 54856 - RNA, 64 nt, hsa
agagcagacacacauacagccugaaacagaccuggacagacagacacagccugaaacagacccg

SEQ ID NO: 54857 - RNA, 64 nt, hsa
cagacacacauacagccugaaacagaccuggacagacagacacagccugaaacagacccggaca

SEQ ID NO: 54858 - RNA, 64 nt, hsa
ccuggacagacagacacagccugaaacagacccggacagacagacacagccugaaacagaccca

SEQ ID NO: 54859 - RNA, 64 nt, hsa
gacagacagacacagccugaaacagacccggacagacagacacagccugaaacagacccagaca

SEQ ID NO: 54860 - RNA, 64 nt, hsa
gacagacacagccugaaacagacccagacaaacagacagacagacacagccugaaacagaccca

SEQ ID NO: 54861 - RNA, 64 nt, hsa
gacacagccugaaacagacccagacaaacagacagacagacacagccugaaacagacccagaca

SEQ ID NO: 54862 - RNA, 64 nt, hsa
aacagacagacagacacagccugaaacagacccagacagacagacagacagccugaaacagacc

SEQ ID NO: 54863 - RNA, 64 nt, hsa
gacagacagacacagccugaaacagacccagacagacagacagacagccugaaacagacccaga

SEQ ID NO: 54864 - RNA, 64 nt, hsa
gacagacacagccugaaacagacccagacagacagacagacagccugaaacagacccagacaca

SEQ ID NO: 54865 - RNA, 64 nt, hsa
gaaacagacccagacacagccugaaacagauccggacagacagacagaaacagccugaaacaga

SEQ ID NO: 54866 - RNA, 64 nt, hsa
cagacccagacacagccugaaacagauccggacagacagacagaaacagccugaaacagaccca

SEQ ID NO: 54867 - RNA, 64 nt, hsa
gacagacagacagaaacagccugaaacagacccagacagacagacagacacagccugaaacaga

SEQ ID NO: 54868 - RNA, 64 nt, hsa
gacagacagaaacagccugaaacagacccagacagacagacagacacagccugaaacagacccg

SEQ ID NO: 54869 - RNA, 64 nt, hsa
gacagaaacagccugaaacagacccagacagacagacagacacagccugaaacagacccggaca

SEQ ID NO: 54870 - RNA, 64 nt, hsa
gacagacagacagacacagccugaaacagacccggacagacagacagacacagccugaaacaga

SEQ ID NO: 54871 - RNA, 64 nt, hsa
gacagacagacacagccugaaacagacccggacagacagacagacacagccugaaacagacccg

SEQ ID NO: 54872 - RNA, 64 nt, hsa
gacagacacagccugaaacagacccggacagacagacagacacagccugaaacagacccggaca

SEQ ID NO: 54873 - RNA, 64 nt, hsa; identical to SEQ ID NO: 54870

SEQ ID NO: 54874 - RNA, 64 nt, hsa; identical to SEQ ID NO: 54871

SEQ ID NO: 54875 - RNA, 64 nt, hsa; identical to SEQ ID NO: 54872

SEQ ID NO: 54876 - RNA, 64 nt, hsa; identical to SEQ ID NO: 54870

SEQ ID NO: 54877 - RNA, 64 nt, hsa
gacagacagacacagccugaaacagacccggacagacagacagacacagccugaaacagaccua

SEQ ID NO: 54878 - RNA, 64 nt, hsa
gacagacacagccugaaacagacccggacagacagacagacacagccugaaacagaccuagaca

SEQ ID NO: 54879 - RNA, 64 nt, hsa
gacagacagacagacacagccugaaacagaccuagacagacagacacagauugaaacagaccca

SEQ ID NO: 54880 - RNA, 64 nt, hsa
gacagacagacacagccugaaacagaccuagacagacagacacagauugaaacagacccagaca

SEQ ID NO: 54881 - RNA, 64 nt, hsa
gacagacacagauugaaacagacccagacaaacagacagacacagccugaaacagacccagaca

SEQ ID NO: 54882 - RNA, 64 nt, hsa
gaaacagacccagacacagccugaaacagacccggacagacagacagacacagccugaaacaga

SEQ ID NO: 54883 - RNA, 64 nt, hsa
cagacccagacacagccugaaacagacccggacagacagacagacacagccugaaacagaccca

SEQ ID NO: 54884 - RNA, 64 nt, hsa
cccagacacagccugaaacagacccggacagacagacagacacagccugaaacagacccagaca

SEQ ID NO: 54885 - RNA, 64 nt, hsa
gacagacagacagacacagccugaaacagacccagacagacagacagacacagccugaaacaga

SEQ ID NO: 54886 - RNA, 64 nt, hsa
gacagacagacacagccugaaacagacccagacagacagacagacacagccugaaacagaccca

SEQ ID NO: 54887 - RNA, 64 nt, hsa
gacagacacagccugaaacagacccagacagacagacagacacagccugaaacagacccagaca

SEQ ID NO: 54888 - RNA, 64 nt, hsa
gacagacagacagacacagccugaaacagacccagacagacagaccgacgcagccugaaagaga

SEQ ID NO: 54889 - RNA, 64 nt, hsa
gagagacaggcagacacagccuaaaacagaccuggacagacaggcagacguagucugaaacaga

SEQ ID NO: 54890 - RNA, 64 nt, hsa
gacaggcagacguagucugaaacagaccugaacagacagacagacgcacacacacaacagaugc

SEQ ID NO: 54891 - RNA, 64 nt, hsa
aagccaucucagugaagauaugcgugcacgcacagacagacagacacacacacacacacacaca

SEQ ID NO: 54892 - RNA, 64 nt, hsa
caucucagugaagauaugcgugcacgcacagacagacagacacacacacacacacacacacaca

SEQ ID NO: 54893 - RNA, 64 nt, hsa
agggaugggagccaggaaagauuuaggggcaggagacagacacguaacaggaacucggaaggua

SEQ ID NO: 54894 - RNA, 64 nt, hsa
uccaccuccuuccccuucucccucaggcaaccccgacagacaguggcacuccugguccugcugu

SEQ ID NO: 54895 - RNA, 64 nt, hsa
agccucuucuccugcagccugagauggauggacagacagacaccacagccuccccuucccagac

SEQ ID NO: 54896 - RNA, 64 nt, hsa
aauaagccucuucuccugcagccugagauggauggacagacagacaccacagccuccccuuccc

SEQ ID NO: 54897 - RNA, 62 nt, hsa
auuacuugcuuccuugcaugauugucuuuaugcauccccaaucuuaauugagaccauacuug

SEQ ID NO: 54898 - RNA, 62 nt, hsa
uggaauugcacaucuaccuuacaauuacugaccauccccaguagacuccccagucccauaau

SEQ ID NO: 54899 - RNA, 57 nt, hsa
ucucuuuccugaaagaauaaucauggccauccccacucccuuuguauuuccucuuuc

SEQ ID NO: 54900 - RNA, 62 nt, hsa
ugucuauaguguuggacagcacauucuuagagcauccccaaucaauaguuucagaaguuaua

SEQ ID NO: 54901 - RNA, 62 nt, hsa
cgcccagcagugcugcucugaugacuugugcacauccccaaggguaagagcuucgaucucug

SEQ ID NO: 54902 - RNA, 62 nt, hsa
gugacugagagcacuuaacauucagcuugucucauccccagucuaccuccuuccuucuaccc

SEQ ID NO: 54903 - RNA, 62 nt, hsa
cuaacagguugggcuggcccagccuaggaaaacauccccauuucuaacuucagccagaccug

SEQ ID NO: 54904 - RNA, 62 nt, hsa
uaggccuugguaacuaugcgcccccccuccaucauccccaaggcugcccaaaccaccacugc

SEQ ID NO: 54905 - RNA, 62 nt, hsa
gguggggaggggaggcagguguggguagcgcacauccccacagaucaaucucugcagaugac

SEQ ID NO: 54906 - RNA, 62 nt, hsa
uaggaugagagucagagccuuuggaaaggcugcauccccagggcuagagcucagaugaccuu

SEQ ID NO: 54907 - RNA, 62 nt, hsa
ccacucgaugacugccucaucuuccucaguuucauccccauccccaggucuuccuagacgcu

SEQ ID NO: 54908 - RNA, 62 nt, hsa
gaugacugccucaucuuccucaguuucauccccauccccaggucuuccuagacgcucagcac

SEQ ID NO: 54909 - RNA, 62 nt, hsa
cugcccuggccuggguggaggaacugugccuccauccccagaagaaacagcccccucugcug

SEQ ID NO: 54910 - RNA, 62 nt, hsa
gagccccucccgccgccucagaccccugugcacauccccagggccucagccgucucauuggu

SEQ ID NO: 54911 - RNA, 62 nt, hsa
ggucuguggcuccucccgaaacccaaguuaugcauccccauccccaugcccucaucccgacc

SEQ ID NO: 54912 - RNA, 62 nt, hsa
uggcuccucccgaaacccaaguuaugcauccccauccccaugcccucaucccgaccucuuag

SEQ ID NO: 54913 - RNA, 62 nt, hsa
ugggagagggugagguucagcacaucacacaccauccccacugucauucagggccugggucu

SEQ ID NO: 54914 - RNA, 62 nt, hsa
ccauggagccacuaggccuggccuccucuacacauccccagggcuaucugguuaauuccauc

SEQ ID NO: 54915 - RNA, 62 nt, hsa
aucccaguaacuccucuucccauuuuccaauccauccccagccuuuuuuuuuuuucuucugu

SEQ ID NO: 54916 - RNA, 62 nt, hsa
acacuuuggggcugauuugucucuuuaggggacauccccaacaugguuaauuccaacucuca

SEQ ID NO: 54917 - RNA, 62 nt, hsa
agauuucaggcugaucccugcuuaagcccucucauccccacgcugguccugguauugauaca

SEQ ID NO: 54918 - RNA, 62 nt, hsa
ggcguuuggccccggccuggccaggagaggcccauccccagggcaguuucaggugccggcug

SEQ ID NO: 54919 - RNA, 62 nt, hsa
ugcaacugguuuuacuagugugcaaguguguucauccccaaguucucuuuuguccucacaug

SEQ ID NO: 54920 - RNA, 62 nt, hsa
augagcccagcauggaugugucucaggcaccucauccccaccccaccucaccccaacaaacu

SEQ ID NO: 54921 - RNA, 62 nt, hsa
ggcagagaggcuccauggccgugcugcugggccauccccaacucccuaucccauccccagcc

SEQ ID NO: 54922 - RNA, 62 nt, hsa
cgugcugcugggccauccccaacucccuaucccauccccagccuccacccccauccagaugg

SEQ ID NO: 54923 - RNA, 62 nt, hsa
acgccgugugucacgggcuagggcggcguguucauccccacaccgugugucacaacaggcua

SEQ ID NO: 54924 - RNA, 62 nt, hsa
aacagggucaccagugcauuauguggcguguucauccccacgccgugugucacgggcuaggg

SEQ ID NO: 54925 - RNA, 62 nt, hsa
gccgggcucugcguccccacguccccucgucccauccccacguccccucaucccgucaccuc

SEQ ID NO: 54926 - RNA, 62 nt, hsa
ugucaccucguccccacguccccucgucuccucauccccacguccucucguccccuuguccc

SEQ ID NO: 54927 - RNA, 62 nt, hsa
gccagguacgacgcuugccccggcccacccuccauccccacccuccauccccacccuagaug

SEQ ID NO: 54928 - RNA, 62 nt, hsa
cuugccccggcccacccuccauccccacccuccauccccacccuagauggagcgagggccuu

SEQ ID NO: 54929 - RNA, 62 nt, hsa
uuacccagcucuuggggugucucuguuuuuuccauccccacuuccugccuucucguggcccu

SEQ ID NO: 54930 - RNA, 62 nt, hsa
cucagccaccuuccucaggcucacuccaccuacauccccagucugccacaccccaucccuuu

SEQ ID NO: 54931 - RNA, 62 nt, hsa
cagcuucaacucucucggcgguagggcggugccauccccacccauagggcuggcucacaucc

SEQ ID NO: 54932 - RNA, 62 nt, hsa
cuucucuggucuucaguccagcacugggugcccauccccaucucuaaaaccaguaaaucagc

SEQ ID NO: 54933 - RNA, 62 nt, hsa
uuagugccaggcagcccugccagccaugccuacauccccaugggcacagaacaagccaaagc

SEQ ID NO: 54934 - RNA, 62 nt, hsa
gguggcugcacacucuuccuggcccgcacccccauccccagucccuguuccccaagaggaua

SEQ ID NO: 54935 - RNA, 62 nt, hsa
ugcuaucugcaaugaccaccauagcuuaaccccauccccacccucaaccccaagcucaaccc

SEQ ID NO: 54936 - RNA, 62 nt, hsa
uccuccaccccacaucccaccacauccaccuccauccccaacccauccucauccccaacuac

SEQ ID NO: 54937 - RNA, 62 nt, hsa
caccacauccaccuccauccccaacccauccucauccccaacuacagccccaaacccagccc

SEQ ID NO: 54938 - RNA, 62 nt, hsa
gccccaaacccagccccagacuaauccacagccauccccaacucauccucauccccaacugc

SEQ ID NO: 54939 - RNA, 62 nt, hsa
agacuaauccacagccauccccaacucauccucauccccaacugcagccccaaacccaaccc

SEQ ID NO: 54940 - RNA, 62 nt, hsa
ccccaacugcagccccaaacccaacccagggccauccccaaacccauccccaagccaaacuc

SEQ ID NO: 54941 - RNA, 62 nt, hsa
ccccaaacccaacccagggccauccccaaacccauccccaagccaaacucaacaccaucccc

SEQ ID NO: 54942 - RNA, 62 nt, hsa
ccuaaucaccucuccugccccuagcucagccucauccccaacuccaugccugucuccaaucc

SEQ ID NO: 54943 - RNA, 62 nt, hsa
uccucaacuaagcuccucuccagcccuggccacauccccauccucccccaaccuccagcccc

SEQ ID NO: 54944 - RNA, 62 nt, hsa
caccgucccgaagccaacuucacccauguccccauccccaaucuuguccccauuccugacuc

SEQ ID NO: 54945 - RNA, 62 nt, hsa
ccccuugcauccugggagccccacugcccugccauccccaguacugccgggaagugucggcc

SEQ ID NO: 54946 - RNA, 62 nt, hsa
gagccacgcccagugugugaacuugacaucuccauccccaggcucucaaccgucucccucgg

SEQ ID NO: 54947 - RNA, 62 nt, hsa
gggaccaggugggcuguguccgccacaucacccauccccauccccugacucuuucaccggca

SEQ ID NO: 54948 - RNA, 62 nt, hsa
agcugggccccucuuccagcagcggccguauccauccccaggggcugugcuccgggccaaug

SEQ ID NO: 54949 - RNA, 64 nt, hsa; identical to SEQ ID NO: 47016

SEQ ID NO: 54950 - RNA, 64 nt, hsa; identical to SEQ ID NO: 47017

SEQ ID NO: 54951 - RNA, 64 nt, hsa; identical to SEQ ID NO: 47018

SEQ ID NO: 54952 - RNA, 64 nt, hsa; identical to SEQ ID NO: 47019

SEQ ID NO: 54953 - RNA, 64 nt, hsa; identical to SEQ ID NO: 47020

SEQ ID NO: 54954 - RNA, 64 nt, hsa; identical to SEQ ID NO: 47021

SEQ ID NO: 54955 - RNA, 64 nt, hsa; identical to SEQ ID NO: 47022

SEQ ID NO: 54956 - RNA, 64 nt, hsa; identical to SEQ ID NO: 47023

SEQ ID NO: 54957 - RNA, 64 nt, hsa; identical to SEQ ID NO: 47024

SEQ ID NO: 54958 - RNA, 64 nt, hsa; identical to SEQ ID NO: 47025

SEQ ID NO: 54959 - RNA, 64 nt, hsa; identical to SEQ ID NO: 47026

SEQ ID NO: 54960 - RNA, 64 nt, hsa; identical to SEQ ID NO: 47027

SEQ ID NO: 54961 - RNA, 64 nt, hsa; identical to SEQ ID NO: 47028

SEQ ID NO: 54962 - RNA, 64 nt, hsa; identical to SEQ ID NO: 47029

SEQ ID NO: 54963 - RNA, 64 nt, hsa; identical to SEQ ID NO: 47030

SEQ ID NO: 54964 - RNA, 64 nt, hsa; identical to SEQ ID NO: 47031

SEQ ID NO: 54965 - RNA, 64 nt, hsa; identical to SEQ ID NO: 47032

SEQ ID NO: 54966 - RNA, 64 nt, hsa; identical to SEQ ID NO: 47033

SEQ ID NO: 54967 - RNA, 64 nt, hsa; identical to SEQ ID NO: 47034

SEQ ID NO: 54968 - RNA, 64 nt, hsa; identical to SEQ ID NO: 47035

SEQ ID NO: 54969 - RNA, 64 nt, hsa; identical to SEQ ID NO: 47036

SEQ ID NO: 54970 - RNA, 64 nt, hsa; identical to SEQ ID NO: 47037

SEQ ID NO: 54971 - RNA, 64 nt, hsa; identical to SEQ ID NO: 47038

SEQ ID NO: 54972 - RNA, 64 nt, hsa; identical to SEQ ID NO: 47039

SEQ ID NO: 54973 - RNA, 64 nt, hsa; identical to SEQ ID NO: 47040

SEQ ID NO: 54974 - RNA, 64 nt, hsa; identical to SEQ ID NO: 47041

SEQ ID NO: 54975 - RNA, 64 nt, hsa; identical to SEQ ID NO: 47042

SEQ ID NO: 54976 - RNA, 64 nt, hsa; identical to SEQ ID NO: 47043

SEQ ID NO: 54977 - RNA, 64 nt, hsa; identical to SEQ ID NO: 47044

SEQ ID NO: 54978 - RNA, 64 nt, hsa; identical to SEQ ID NO: 47045

SEQ ID NO: 54979 - RNA, 64 nt, hsa; identical to SEQ ID NO: 47046

SEQ ID NO: 54980 - RNA, 64 nt, hsa; identical to SEQ ID NO: 47047

SEQ ID NO: 54981 - RNA, 64 nt, hsa; identical to SEQ ID NO: 47048

SEQ ID NO: 54982 - RNA, 64 nt, hsa; identical to SEQ ID NO: 47049

SEQ ID NO: 54983 - RNA, 64 nt, hsa; identical to SEQ ID NO: 47050

SEQ ID NO: 54984 - RNA, 64 nt, hsa; identical to SEQ ID NO: 47051

SEQ ID NO: 54985 - RNA, 64 nt, hsa; identical to SEQ ID NO: 47052

SEQ ID NO: 54986 - RNA, 64 nt, hsa; identical to SEQ ID NO: 47053

SEQ ID NO: 54987 - RNA, 64 nt, hsa; identical to SEQ ID NO: 47054

SEQ ID NO: 54988 - RNA, 51 nt, hsa; identical to SEQ ID NO: 47055

SEQ ID NO: 54989 - RNA, 64 nt, hsa; identical to SEQ ID NO: 47056

SEQ ID NO: 54990 - RNA, 64 nt, hsa; identical to SEQ ID NO: 47057

SEQ ID NO: 54991 - RNA, 64 nt, hsa; identical to SEQ ID NO: 47058

SEQ ID NO: 54992 - RNA, 64 nt, hsa; identical to SEQ ID NO: 47059

SEQ ID NO: 54993 - RNA, 64 nt, hsa; identical to SEQ ID NO: 47060

SEQ ID NO: 54994 - RNA, 64 nt, hsa; identical to SEQ ID NO: 47061

SEQ ID NO: 54995 - RNA, 64 nt, hsa; identical to SEQ ID NO: 47062

SEQ ID NO: 54996 - RNA, 64 nt, hsa; identical to SEQ ID NO: 47063

SEQ ID NO: 54997 - RNA, 64 nt, hsa; identical to SEQ ID NO: 47064

SEQ ID NO: 54998 - RNA, 64 nt, hsa; identical to SEQ ID NO: 47065

SEQ ID NO: 54999 - RNA, 64 nt, hsa; identical to SEQ ID NO: 47066

SEQ ID NO: 55000 - RNA, 64 nt, hsa; identical to SEQ ID NO: 47067

SEQ ID NO: 55001 - RNA, 64 nt, hsa; identical to SEQ ID NO: 47068

SEQ ID NO: 55002 - RNA, 64 nt, hsa; identical to SEQ ID NO: 47069

SEQ ID NO: 55003 - RNA, 64 nt, hsa; identical to SEQ ID NO: 47070

SEQ ID NO: 55004 - RNA, 64 nt, hsa; identical to SEQ ID NO: 47071

SEQ ID NO: 55005 - RNA, 64 nt, hsa; identical to SEQ ID NO: 47072

SEQ ID NO: 55006 - RNA, 64 nt, hsa; identical to SEQ ID NO: 47073

SEQ ID NO: 55007 - RNA, 64 nt, hsa; identical to SEQ ID NO: 47074

SEQ ID NO: 55008 - RNA, 64 nt, hsa; identical to SEQ ID NO: 47075

SEQ ID NO: 55009 - RNA, 64 nt, hsa; identical to SEQ ID NO: 47076

SEQ ID NO: 55010 - RNA, 64 nt, hsa; identical to SEQ ID NO: 47077

SEQ ID NO: 55011 - RNA, 64 nt, hsa; identical to SEQ ID NO: 47078

SEQ ID NO: 55012 - RNA, 64 nt, hsa; identical to SEQ ID NO: 47079

SEQ ID NO: 55013 - RNA, 64 nt, hsa; identical to SEQ ID NO: 47080

SEQ ID NO: 55014 - RNA, 64 nt, hsa; identical to SEQ ID NO: 47081

SEQ ID NO: 55015 - RNA, 64 nt, hsa; identical to SEQ ID NO: 47082

SEQ ID NO: 55016 - RNA, 64 nt, hsa; identical to SEQ ID NO: 47083

SEQ ID NO: 55017 - RNA, 64 nt, hsa
uuucuaaugaagugcuagacuauccaauuacuuaauuucuuauaccuuuagauaaucaguauga

SEQ ID NO: 55018 - RNA, 64 nt, hsa
uuucaccauuuugauuuuuaaaguaugcuguagcauuucuuaauaacaucguugugauguucuu

SEQ ID NO: 55019 - RNA, 64 nt, hsa
auaaauauuuuacuuuuucacauguauagauugcauuucuuagguguuuuaauuuuuuaaauau

SEQ ID NO: 55020 - RNA, 64 nt, hsa
gucucaaggauuugauccauauuuaucccuaaauauuucuuaagggauguaacuuuuuauaacc

SEQ ID NO: 55021 - RNA, 64 nt, hsa
aagaaaucauacuucucuccacauugaucuuuucauuucuuacuagcuuuuaagaaauuaaaua

SEQ ID NO: 55022 - RNA, 64 nt, hsa
uguaguaguaacaagaauuuuucauuuaggaaagauuucuuagguuuugaaagaauacauuaaa

SEQ ID NO: 55023 - RNA, 64 nt, hsa
gcauaagccacugcgcccagccagaagaugcaugauuucuuaggaucauaugcuguuuguagcc

SEQ ID NO: 55024 - RNA, 64 nt, hsa
uauagagaguuuuuaaaugucucccauucuuuugauuucuuacuguacuggcuaucuuaauauu

SEQ ID NO: 55025 - RNA, 64 nt, hsa
uuauacauuguuuuaagaaaaaacuuuuaaaaauauuucuuauagucuccuaacauuugucucu

SEQ ID NO: 55026 - RNA, 64 nt, hsa
acagugaauuuugcacaggagaagcagcuaccugauuucuuacuuucucucuccuuaucaugga

SEQ ID NO: 55027 - RNA, 64 nt, hsa
augaaucuuaaaaucauuucacuucacuccuaacauuucuuacauugcagaacuaaugguaaag

SEQ ID NO: 55028 - RNA, 64 nt, hsa
uagggaugccuggaaguguauaaaauuggacugcauuucuuagaguguuuuacuauagaucagu

SEQ ID NO: 55029 - RNA, 64 nt, hsa
caagcauugcuuuuggcaaauuaaagugcaugucauuucuuaauacacuagaaaggggaaauaa

SEQ ID NO: 55030 - RNA, 64 nt, hsa
uucuuuaauuacuguaccauccauaaugcaggacauuucuuacugccuaaauuucacaccauug

SEQ ID NO: 55031 - RNA, 64 nt, hsa
uuuuuuuuugauuguugaagcauuuaucuuguugauuucuuacaaaagaaaaaggacgauguca

SEQ ID NO: 55032 - RNA, 64 nt, hsa
uauuauuuuuacuguuauguauguuuuuaaucauauuucuuaggaaguauaggcuacuggacuu

SEQ ID NO: 55033 - RNA, 64 nt, hsa
cauucauuugcuuuguacuauaaaaauaaaaaugauuucuuaaguuaaugacaucccagugggg

SEQ ID NO: 55034 - RNA, 64 nt, hsa
uugccauuuuguaaacuaaggauuuuggacugagauuucuuaaaucuuucuucaaaucucccac

SEQ ID NO: 55035 - RNA, 64 nt, hsa
auaucaugggcucugcagaacauaucaaaauaggauuucuuaaauuuuucaacccccagaccau

SEQ ID NO: 55036 - RNA, 64 nt, hsa
ccauaaaguccuagacuucuuauuugaaguuaaaauuucuuauuugaaaaguugaaauuuauga

SEQ ID NO: 55037 - RNA, 64 nt, hsa
gaguuacauuaaccuuguuguuuaccuuucacugauuucuuauaugguauaaauuaaaguucag

SEQ ID NO: 55038 - RNA, 64 nt, hsa
cuaaacugguuuaucuccacccacacuaucauagauuucuuagguaaauacaauucuuaucuag

SEQ ID NO: 55039 - RNA, 64 nt, hsa
gggguguauaacaagccugaaggacauuguaaucauuucuuacaaggugaaaauuaagaaagau

SEQ ID NO: 55040 - RNA, 64 nt, hsa
auuaagcagguauuagauuuaggaaaaccuuuccauuucuuaaaguauuaucaagugucaagau

SEQ ID NO: 55041 - RNA, 64 nt, hsa
cauuugaaaaacuuuuuauaaaaaauuguuugauauuucuuaaugucugcucugagccuuaaaa

SEQ ID NO: 55042 - RNA, 64 nt, hsa
ggaagcaguggauggaccaggauuaauuccuuucauuucuuaguaaauuaaaaccugcagcugg

SEQ ID NO: 55043 - RNA, 64 nt, hsa
auguucucaagucuguaucugccuccccugccuuauuucuuauguuuugccacaguuaacccau

SEQ ID NO: 55044 - RNA, 64 nt, hsa
aacaaaugccaggcuagauuccucacauguggcuauuucuuauguaagaagcuuuuaacugaag

SEQ ID NO: 55045 - RNA, 64 nt, hsa
gaugagacugagccauaucugcaguaagagaaauauuucuuaauguuuugguuacuuaugauag

SEQ ID NO: 55046 - RNA, 64 nt, hsa
gaaauguuaaugagauguauuuucuuauagagauauuucuuacagaaagcuuuguagcagaaua

SEQ ID NO: 55047 - RNA, 64 nt, hsa
uauaugugggaaaagagcuaacagagagaucauuauuucuuaaagauuggccauaaccuguauu

SEQ ID NO: 55048 - RNA, 64 nt, hsa
agcucucuaauagaaguccaugaguugaguggguauuucuuauuugaaaguguuuuucuuuaau

SEQ ID NO: 55049 - RNA, 64 nt, hsa
uguuacacaauauguguuuuuuaauauacuaaccauuucuuauggaaagguccuguggggagcc

SEQ ID NO: 55050 - RNA, 64 nt, hsa
auuuuaaaggaaaaaaauacaacuaaugaugcacauuucuuagaacacaauaguccauugauau

SEQ ID NO: 55051 - RNA, 64 nt, hsa
uuagagaaaguuguauuccacacacaaccuaauaauuucuuauaaaaauuuuaaacuacaaagc

SEQ ID NO: 55052 - RNA, 64 nt, hsa
ugggcagaagcucugcauucucacuuguacuuugauuucuuauuucuugggcaggcaauuugag

SEQ ID NO: 55053 - RNA, 64 nt, hsa
agaaauauggaaaugcuuuauauauuacuguuaaauuucuuagugcagaaauaacauuauuaau

SEQ ID NO: 55054 - RNA, 64 nt, hsa
gaaucuucugacacauuuauuauagcuuugucccauuucuuauccuuuuugcucuuuagaaauu

SEQ ID NO: 55055 - RNA, 64 nt, hsa
auuauuuuauuuuuucgagauagggucuugcucaauuucuuaggcuggagugcaguggcacgau

SEQ ID NO: 55056 - RNA, 64 nt, hsa
aaaaaauuaauauauauccuauuacauaaauguuauuucuuagguguuccauuaagaagagcaa

SEQ ID NO: 55057 - RNA, 64 nt, hsa
guuaugauaacaaguaaauaagagcaaagaauguauuucuuaauucaaaacuauacguuugaau

SEQ ID NO: 55058 - RNA, 64 nt, hsa
uuucuguaauauugagaguuauuuuauagaaaugauuucuuaauuagcuguugugagauauuuc

SEQ ID NO: 55059 - RNA, 64 nt, hsa
uuuuucacugaucaaaauguuguucugcuuuuucauuucuuaaggaauacauguuugggauuuu

SEQ ID NO: 55060 - RNA, 64 nt, hsa
acauugguagauuucuaaagacaacucauaaauaauuucuuaacccauauaaggauaaaauaau

SEQ ID NO: 55061 - RNA, 64 nt, hsa
uuaaucuaaggaauaauuaucuuccugcauuuugauuucuuagaucagaauuuuuuaaugccau

SEQ ID NO: 55062 - RNA, 64 nt, hsa
cagguuaaugauuuauuuuuugacuaaaugugcaauuucuuaucacuagauaacuuucaguauc

SEQ ID NO: 55063 - RNA, 64 nt, hsa
auuauuuuaauacaggaaaagaaaagauuuaguaauuucuuaccaugcuaauauguaaaguuca

SEQ ID NO: 55064 - RNA, 64 nt, hsa
gagcuguaucaugcuacuuagcuuuuauguaaauauuucuuaugucuccucuauuaagaguauu

SEQ ID NO: 55065 - RNA, 64 nt, hsa
ggcuaaugagcucuaguguuaaacuaccugauuaauuucuuauaaagcagcauaaccuuggcuu

SEQ ID NO: 55066 - RNA, 64 nt, hsa
ugugaaauuuuaacuacuuuaacuaguuuuauaaauuucuuaauauguuacaauaacuuaggga

SEQ ID NO: 55067 - RNA, 64 nt, hsa
ggcaaaugugaaaauaguuucaauauaucuuaugauuucuuaauguaaaauguuuuguugaagu

SEQ ID NO: 55068 - RNA, 64 nt, hsa
acucauagauaauacaaucuacuuacacacaugaauuucuuaaaaaaaucaauuuaaugcccua

SEQ ID NO: 55069 - RNA, 64 nt, hsa
ugagacauucaaaauucguauagggugcagaguaauuucuuauugugaggaacuguccaaugua

SEQ ID NO: 55070 - RNA, 64 nt, hsa
auuuuaacauuugauaaagcauauuuaugaacauauuucuuaauaagaaaaauauccauuuuau

SEQ ID NO: 55071 - RNA, 64 nt, hsa
gugucccuuauaggcucaaaaauuauaucuuacaauuucuuauuuagggggaaauuauuugaau

SEQ ID NO: 55072 - RNA, 64 nt, hsa
aaagcucuauauaaaugcucagaguucuuuauguauuucuuauuggcauucaacauauguaaaa

SEQ ID NO: 55073 - RNA, 64 nt, hsa
caugucuuagagcccgucuuuauguuuaaaacuaauuucuuaaaauaaagccuucaguaaaugu

SEQ ID NO: 55074 - RNA, 64 nt, hsa
ccuugucuuaggauauucuguagauugauugcagauuucuuaaaucugaaaugaucuuuacacu

SEQ ID NO: 55075 - RNA, 64 nt, hsa
uaaaaugcccccacccugauguaauugacauuacauuucuuaacauuuuaaaaucuagaauuuc

SEQ ID NO: 55076 - RNA, 64 nt, hsa
cuauaauguccaaaacauuccuuucagccuuuuuauuucuuacuguacugucucuuacuguacu

SEQ ID NO: 55077 - RNA, 64 nt, hsa
cauuaccucucccuggaggcaacuguuuugauccauuucuuacacacacugccagagauacucu

SEQ ID NO: 55078 - RNA, 64 nt, hsa
uucacucaauuuauauuuucaucauugacuacauauuucuuauacacaacacacaauuuaugaa

SEQ ID NO: 55079 - RNA, 64 nt, hsa
guauuugugcaauaaauuggaauaauguaacuugauuucuuaucuguguuuguguuggcaugca

SEQ ID NO: 55080 - RNA, 64 nt, hsa
uugauuuuuagaccaccacauggcaugcuugacuauuucuuauuucaaaugucugcuaaugcag

SEQ ID NO: 55081 - RNA, 64 nt, hsa
acauaugcuuucacuguuugugcaauaugcauuuauuucuuauaugaaugcuuuaaagucauuu

SEQ ID NO: 55082 - RNA, 64 nt, hsa
aaagccuagauuuacaauuugaugaacacuaaauauuucuuauuaauauaaucuauuuuuguau

SEQ ID NO: 55083 - RNA, 64 nt, hsa
uugugguaagucuuuuuucuuagauugcgcuaaaauuucuuagauuguucagcgcucagaacaa

SEQ ID NO: 55084 - RNA, 64 nt, hsa
cuuguguauuuuagaaacaauuauuuuucccauuauuucuuaugagauuaguuguuucaaguag

SEQ ID NO: 55085 - RNA, 64 nt, hsa
aagaugaagaaauaagucugacaacacuaaagaaauuucuuaauauacuauuauuagaauagua

SEQ ID NO: 55086 - RNA, 64 nt, hsa
acuucaaauacaugcauuuuucaauauaggguauauuucuuaacugaugagagaggcuuagaca

SEQ ID NO: 55087 - RNA, 64 nt, hsa
ugcaaaguauuacagccaaauauuaucuuaauuaauuucuuacacuuaaaaguguccaucaaca

SEQ ID NO: 55088 - RNA, 64 nt, hsa
acuggugugagccaccacggccagcugcuagcacauuucuuaccucccucaugcaagggugcgu

SEQ ID NO: 55089 - RNA, 64 nt, hsa
cugaaguuguuuaccggcucuaauacuuuugcggauuucuuagaauuuucuguagacagaucau

SEQ ID NO: 55090 - RNA, 64 nt, hsa
auaaacagaauauuuauuacaaauguuagaauauauuucuuauacuaggaaucucauuugcauu

SEQ ID NO: 55091 - RNA, 64 nt, hsa
ggggccccuuucuggggguuccccaucagcccucauuucuuauaauacccugaucccagacucc

SEQ ID NO: 55092 - RNA, 64 nt, hsa
uggcuuacagauuuacaugugcacacacacacaaauuucuuaucacauuuucgacuucuucacu

SEQ ID NO: 55093 - RNA, 64 nt, hsa
uucagguuuuuguacuccagcauagcuuggucuuauuucuuacuguaugaaagcuuaacagcaa

SEQ ID NO: 55094 - RNA, 64 nt, hsa
ucaugcagaugauugauugugauuauuguaagaaauuucuuacauguauauuucuuauguagaa

SEQ ID NO: 55095 - RNA, 64 nt, hsa
auugugauuauuguaagaaauuucuuacauguauauuucuuauguagaaaauacuguuucuacu

SEQ ID NO: 55096 - RNA, 64 nt, hsa
auuuuuaauacauuggaggcuuuauuuugaacuaauuucuuagagaauaguuauauuuucuauu

SEQ ID NO: 55097 - RNA, 64 nt, hsa
cuauauauguaaauagcuuuucaucaauucuuaaauuucuuaaccuaggcuucagggagcauau

SEQ ID NO: 55098 - RNA, 64 nt, hsa
uuaacagaagucuuauaaaaauuuaaaaagacacauuucuuacaaaaaagaguugaaugaggua

SEQ ID NO: 55099 - RNA, 64 nt, hsa
cuaaauuggagugauacuucuuacacuaaaaauuauuucuuaggcauucugaaucugggaugag

SEQ ID NO: 55100 - RNA, 64 nt, hsa
aaaaaaaaagccaagauuucauuguuuguugaauauuucuuaagcaucuggccccuaaagagac

SEQ ID NO: 55101 - RNA, 64 nt, hsa
gaauggaaauuaagaguacguauucaugguuuauauuucuuauucuauggaguucgugaacaca

SEQ ID NO: 55102 - RNA, 64 nt, hsa
guguuuguuuuguucuuauuacaaacuccaagacauuucuuagaauugucuacagauuucgugu

SEQ ID NO: 55103 - RNA, 64 nt, hsa
ucaucuuuuucugucuguuuugucugcuuucuuaauuucuuauaagucuuacauguuuagguca

SEQ ID NO: 55104 - RNA, 64 nt, hsa
uagaccuuaggaacaguguuucagugaucuggcaccaguuuauuuuguucugcugaaauucugu

SEQ ID NO: 55105 - RNA, 64 nt, hsa
uacgucaaaagaauauguuuuguugcagcugauuccaguuuauaauagaucccuaguaaaaagc

SEQ ID NO: 55106 - RNA, 64 nt, hsa
acauguuuuucugaaugaccagauguaggcuuagccaguuuauuuucucuaauuuaauggauaa

SEQ ID NO: 55107 - RNA, 64 nt, hsa
uuaaugaccacuagagcuuguccucauauucaguccaguuuaauacuguaugucuaguaagaug

SEQ ID NO: 55108 - RNA, 64 nt, hsa
uuuuuucaacccauauuucuagaaauuacagcugccaguuuauaguaguuugagcagaggauga

SEQ ID NO: 55109 - RNA, 64 nt, hsa
uagauuuuucggauggguggguauauuuuauuuuccaguuuauuuucauauuucuuuacugugu

SEQ ID NO: 55110 - RNA, 64 nt, hsa
uacuggaagacccaugucgguuuccggaaccccaccaguuuacccauaagcaagacuaaaccug

SEQ ID NO: 55111 - RNA, 64 nt, hsa
acuuguucuccuuucuuuugcuauagaaaaucuaccaguuuaaaugagcuucaccuucugggug

SEQ ID NO: 55112 - RNA, 64 nt, hsa
ccaaaucuucuugauauugugaaccguaccccuuccaguuuaguuucuucuggacuuuccuuac

SEQ ID NO: 55113 - RNA, 64 nt, hsa
guucccuggugccacaggcugacaacugcagucuccaguuuagaauaaauauuccauaguggug

SEQ ID NO: 55114 - RNA, 64 nt, hsa
ccauacacuacugucucuucagaucugaaauacuccaguuuagagccaggaaauuucacagguc

SEQ ID NO: 55115 - RNA, 64 nt, hsa
auauacuuagcacuuacuuaaucuuuucaguuuuccaguuuacgucucaggaaugaaguguagu

SEQ ID NO: 55116 - RNA, 64 nt, hsa
aucuuaguggaagaugguacgucaugcucaguguccaguuuaauucuguagaaguuacgucugg

SEQ ID NO: 55117 - RNA, 64 nt, hsa
gacaaauccuaacccaaccaugguccagcaguuaccaguuuaaacaaaaaaaccucagaugagu

SEQ ID NO: 55118 - RNA, 64 nt, hsa
ucuuuuaaagaucaaauuauccaugaaauuauagccaguuuaaaaugaauuauuuuaaaaaaaa

SEQ ID NO: 55119 - RNA, 64 nt, hsa
auugaaccugaauuuaagccucaagagccaacucccaguuuagagaaaauucaaggaauggaag

SEQ ID NO: 55120 - RNA, 64 nt, hsa
cgauuuucuacaccugucauugagccaagaaaguccaguuuaugacacguauguacuagugaac

SEQ ID NO: 55121 - RNA, 64 nt, hsa
guaaguucuuugaagacuuagugcuguuuuuaauccaguuuagaaaguaacuuaauuuuaauac

SEQ ID NO: 55122 - RNA, 64 nt, hsa
cgcuggcuuuacauaaaugaagaugcuugugauuccaguuuaucucugaaacuauucaacaugg

SEQ ID NO: 55123 - RNA, 64 nt, hsa
caaugauguaaacuuuguucuugcauuagacugaccaguuuaaaaauaugaacuaaaaccuaau

SEQ ID NO: 55124 - RNA, 64 nt, hsa
gacauuccuugagcaaaauauacugcugugaauuugcaaacaagaaaucugagccaaaacuuga

SEQ ID NO: 55125 - RNA, 64 nt, hsa
aaaauaucugaauaggugcaguuuuaguuuaacaugcaaacaaccauuguugcuaccuauccug

SEQ ID NO: 55126 - RNA, 64 nt, hsa
gauuucuuuuauaacuuuguuagguuuuugaagcugcaaacacuacaaugcuuugagggggucu

SEQ ID NO: 55127 - RNA, 64 nt, hsa
cucaaugaggaaaaaucccuacaggaucuuuuuuugcaaacaacugauauaugcagacaaauuu

SEQ ID NO: 55128 - RNA, 64 nt, hsa
ggagacccuaccucuuaaaaccaguuuucauuuaugcaaacaaggacaauuaagggaacccuga

SEQ ID NO: 55129 - RNA, 64 nt, hsa
cgauaggaggagaguccuucucggcagagcucacugcaaacaacuggaauugagguugcacacu

SEQ ID NO: 55130 - RNA, 64 nt, hsa
auuacuaaucuagguccuauuacuaaucuaugucugcaaacauuaaaggaaugaaacaaugaaa

SEQ ID NO: 55131 - RNA, 64 nt, hsa
gucagaugugcagaccauuacuaaggucuaugucugcaaacauuacuaaucuagguccuauuac

SEQ ID NO: 55132 - RNA, 64 nt, hsa
aucuugacauuuucuuuuuuaggauguugguuccugcaaacaagaacugacccuaucaccucug

SEQ ID NO: 55133 - RNA, 64 nt, hsa
aaaauuagucguauuuuaauggcuugggauuuggugcaaacaaacaugauugauagcuggacag

SEQ ID NO: 55134 - RNA, 64 nt, hsa
uacuauccacuauguaaauggcucacaagucaauugcaaacaaacugaauguacaaaucuuagu

SEQ ID NO: 55135 - RNA, 64 nt, hsa
ggcauuuucaucuuuauuauuguacuuuugguuaugcaaacacuuugauaauauaaacaguuau

SEQ ID NO: 55136 - RNA, 64 nt, hsa
cccaaucaugucucuuuauguaaagacaguaacaugcaaacacuuuuaguuuacaucccucauu

SEQ ID NO: 55137 - RNA, 64 nt, hsa
uuuggaacgaaaaaggguaaguauaagaaaauauugcaaacacauuaaaacaguuguauggugc

SEQ ID NO: 55138 - RNA, 64 nt, hsa
uucaacaauuuuaaauguguugagcaaguugcagugcaaacacugucauuauguagagaguuua

SEQ ID NO: 55139 - RNA, 64 nt, hsa
gcgacuauuuugccauggagaaaucugacagcauugcaaacaauaguauuguuugauguaguua

SEQ ID NO: 55140 - RNA, 64 nt, hsa
ucuggggucaugaccuuucgugauuauccgcaaaugcaaacaguuucagaucuaaugguuuaau

SEQ ID NO: 55141 - RNA, 64 nt, hsa
gaugccaacacuuccuuuugccuuuuguuuccugugcaaacaagugagucaccccuuugauccc

SEQ ID NO: 55142 - RNA, 64 nt, hsa
gccuucuagggucacugucauucccuggccauguugcaaacagcgcaauuccaagcucgagagc

SEQ ID NO: 55143 - RNA, 64 nt, hsa
uucuguuagaggccaaguauuauugacacaggauugcaaacacacaaacaauuggaacagagca

SEQ ID NO: 55144 - RNA, 64 nt, hsa
aaauaugcuuccuguaucaaagguacguauguggugcaaacaaggcagaaacuuccuuuuaauu

SEQ ID NO: 55145 - RNA, 64 nt, hsa
aaguauacuuuugcauuaauuuuuugagcuuauaugcaaacauaauaaauauuauuaaauauca

SEQ ID NO: 55146 - RNA, 64 nt, hsa
cugggauuacgggugugagccaccgugcccggccugcaaacacauuuuaauugacaacacuagg

SEQ ID NO: 55147 - RNA, 64 nt, hsa
uuugagcaucuuugaauuugacaaauggugcuguugcaaacacuuuuuuuuugagaugaagucu

SEQ ID NO: 55148 - RNA, 64 nt, hsa
ugacaacuaauguuaauaagaucucaguugcacgugcaaacaaauccaaauucgaacauucuua

SEQ ID NO: 55149 - RNA, 64 nt, hsa
auuugugcugggacugcuauacuugacauuauacugcaaacaaaacuuaaagagauaagcauua

SEQ ID NO: 55150 - RNA, 64 nt, hsa
aaacauuuuucauaauuagugcuguacauuugauugcaaacaaauuggugauacuucuaaacua

SEQ ID NO: 55151 - RNA, 64 nt, hsa
uaagagcuuuaaaauauuuucacagauaaaaaauugcaaacaaguacucugguuaauaaaugcu

SEQ ID NO: 55152 - RNA, 64 nt, hsa
ugaaguccagugaagucucucucuuaaagucuuuugcaaacauuuuuguaccuuguuauuucca

SEQ ID NO: 55153 - RNA, 64 nt, hsa
uauuacguccuuuccuacagaugaaggcucucauugcaaacaugcggacuguucaagagaauug

SEQ ID NO: 55154 - RNA, 64 nt, hsa
aauuauggguuuaugagucuguaauguuauaugcugcaaacauuuacuauguaaacgugaagua

SEQ ID NO: 55155 - RNA, 64 nt, hsa
uuaacccuauguuggagcacuggaaaccguuauuugcaaacauugcuguuaccauuuagaaaua

SEQ ID NO: 55156 - RNA, 64 nt, hsa
cuagucagcauaaugcuuugggcuuuauuaucuugucagucacuaccuccuaaagaaaaaaaaa

SEQ ID NO: 55157 - RNA, 64 nt, hsa
guacuucucccucagggacguagaacaauggaaugucagucagucucuguaguuaaaacuuuuu

SEQ ID NO: 55158 - RNA, 64 nt, hsa; identical to SEQ ID NO: 55157

SEQ ID NO: 55159 - RNA, 64 nt, hsa
cuggucaguccaagagcagacaaaaauaucacaagucagucagucacuggguuuccauuucuga

SEQ ID NO: 55160 - RNA, 64 nt, hsa
ucaguccaagagcagacaaaaauaucacaagucagucagucacuggguuuccauuucugaauuu

SEQ ID NO: 55161 - RNA, 64 nt, hsa
acuaaaacugucauuguuucuuuuuuuuuaacuggucagucauucacaauaagcuaugagggua

SEQ ID NO: 55162 - RNA, 64 nt, hsa
uaaacauccuguccuuuuuuaaaaucuuugcuuagucagucauauuuuugucuguaugauuaga

SEQ ID NO: 55163 - RNA, 63 nt, hsa
cuggaugcaauuuuucaaauauuaaaauuauacagucagucaggcuucaguuuauuuuuugaa

SEQ ID NO: 55164 - RNA, 64 nt, hsa
auguucuguauugaaauaggucugguugaucgaugucagucagucaguagaaccuacccacccu

SEQ ID NO: 55165 - RNA, 64 nt, hsa
ucuguauugaaauaggucugguugaucgaugucagucagucaguagaaccuacccacccucacg

SEQ ID NO: 55166 - RNA, 64 nt, hsa
uaugauguaaggaauuaucaauuacaacagugagaaaccauauuuccuucuauccgaugaguaa

SEQ ID NO: 55167 - RNA, 64 nt, hsa
uaggagaaguuucuuuaaagacguaaaaagaaaaaaaccauaggcugcucugccuguggaguag

SEQ ID NO: 55168 - RNA, 64 nt, hsa
caauucaaguugagauuuguggggggacacaaccaaaccauaucagcauccuuucaagaauauu

SEQ ID NO: 55169 - RNA, 64 nt, hsa
aauuucaaguugagauuuggguggggacauagccaaaccauaucauucuaccccuggccccucc

SEQ ID NO: 55170 - RNA, 64 nt, hsa
aauauuuggaacacucuuagaauucccauuuaauaaaccauaugagaaaacccucuauuacucu

SEQ ID NO: 55171 - RNA, 64 nt, hsa
acaauucaagaugagauuuggaugggacacagccaaaccauaucaauagguauuauuuuauccc

SEQ ID NO: 55172 - RNA, 64 nt, hsa
cugcugcagcuacugauaucuggccccuggaauaaaaccauaguuccuaaaauugagcaucccu

SEQ ID NO: 55173 - RNA, 64 nt, hsa
aaaucauucugcuuuugaaucuuaaaagcuagaaaaaccauaauguaauauucuuuuuaaaccc

SEQ ID NO: 55174 - RNA, 64 nt, hsa
ccauuuaaguugagauuucaguggggacacagccaaaccauaucauucuaccccuggcaccucc

SEQ ID NO: 55175 - RNA, 64 nt, hsa
aaauucaaguugcaauuucaguggggacauagccaaaccauaucacuggugaugccacuucuuc

SEQ ID NO: 55176 - RNA, 64 nt, hsa
auuuuacagcuguauacuauuccauugaauggauaaaccauaauuuauuuaaucagucccucac

SEQ ID NO: 55177 - RNA, 64 nt, hsa
auucuuucacucauaauaaaagaaaugcaacuuaaaaccauacugagauccuuuuuaaaacugu

SEQ ID NO: 55178 - RNA, 64 nt, hsa
ggccuccacucaggcuccaaauguggcagccaaagagaacaauccagggaaccuacauuuauuu

SEQ ID NO: 55179 - RNA, 64 nt, hsa
ccauuguagaccugacucaggcugaagcuaaauagagaacaauuuagaaaguuaacuaacaaua

SEQ ID NO: 55180 - RNA, 64 nt, hsa
ggcccucccgucgagaagcugguagucagugagugagaacaagagaacaagaacacccugaaca

SEQ ID NO: 55181 - RNA, 64 nt, hsa
cgucgagaagcugguagucagugagugagaacaagagaacaagaacacccugaacaguccuggu

SEQ ID NO: 55182 - RNA, 64 nt, hsa
cuggccucgcgcugggcggcugggaauuccaccugagaacaagucccgcaaaccggggacggaa

SEQ ID NO: 55183 - RNA, 64 nt, hsa
auuucauauuuauaaauaugcguuuauuuaaaaggagaacaaaagcuugacucugauucacagu

SEQ ID NO: 55184 - RNA, 64 nt, hsa
cauuuuucaacuaaucuuauguggaauugaauuagagaacaaggcauuauucuuuuagggaagg

SEQ ID NO: 55185 - RNA, 64 nt, hsa
uuucuggagcuuggcagauuuuccucugacaccagagaacaauaguagucucaagaauggaaac

SEQ ID NO: 55186 - RNA, 64 nt, hsa
uuugauuauauguugauugauaacauauuaaauagagaacaaauaagagagguccuuuacauga

SEQ ID NO: 55187 - RNA, 64 nt, hsa
cagaaacugcagugguaauuaaauuaauagaaaagagaacaaacugcagguuuagaaaaauggu

SEQ ID NO: 55188 - RNA, 64 nt, hsa
ucccaccaaggaggaauggccaaaccagaugggugagaacaagcccaaugugaugcacaccuac

SEQ ID NO: 55189 - RNA, 64 nt, hsa
augaagauguuguaugacaagaaggaaaguuacugagaacaaaaacccagauuggugagauagg

SEQ ID NO: 55190 - RNA, 64 nt, hsa
cauccaaaacaaauuccuccuucaaccuuauuuuuacuugaaauuugcuagaagaaauagcaaa

SEQ ID NO: 55191 - RNA, 64 nt, hsa
cacagucagaacaugcaaacuuuuuugaagaaauuacuugaauaaguaguuuucauguuuucaa

SEQ ID NO: 55192 - RNA, 64 nt, hsa
aggauuaagggacuuaaucugcuaggaacaccuguacuugaaguggaggaggcuagggggccac

SEQ ID NO: 55193 - RNA, 64 nt, hsa
ugucaacugucauuuugcuacuuuucaaauaaaauacuugaaaacugucauuuaaugguaaaca

SEQ ID NO: 55194 - RNA, 53 nt, hsa
guagggcugcguuuaucuaauaguacuugaauguuguauguuuucacugucac

SEQ ID NO: 55195 - RNA, 64 nt, hsa
guuaauuuuauaccaaaauguuaaauauuuguauuacuugaauuuugcucuuguauggcaaaau

SEQ ID NO: 55196 - RNA, 64 nt, hsa
gugcauauacuggcaauaaaacuguacauaacauuacuugaaaaaguuaauaauguauaucagu

SEQ ID NO: 55197 - RNA, 64 nt, hsa
uggaaccugguuuccuuuuaccaugaaauugucuuacuugaaaauauugauccugaugagagag

SEQ ID NO: 55198 - RNA, 64 nt, hsa
auuucauguuacauaauaacccaaaacaaauaauuacuugaauauguuuguagagauacuauuu

SEQ ID NO: 55199 - RNA, 64 nt, hsa
cacuaaaaauacaauucaaauuuauuagcucuacuacuugaaugauuuuggaauuuuaugucau

SEQ ID NO: 55200 - RNA, 64 nt, hsa
cucuucacugaagcuaauguuuggaaaaaauauauacuugaagaaccaauccaagugugugccc

SEQ ID NO: 55201 - RNA, 64 nt, hsa
aaucacuuuaccuagcguuuuagaaauauuaauuuacuugaagagauguagaauguagcaaauu

SEQ ID NO: 55202 - RNA, 64 nt, hsa
uguauggucauauuaguagcuauuuguugcaagauacuugaagccaaauguuugcaguauaggu

SEQ ID NO: 55203 - RNA, 64 nt, hsa
uuguuugauauuuaacaauaaguauauggugauauacuugaaauuuauguccagaaugucacug

SEQ ID NO: 55204 - RNA, 64 nt, hsa
ugaauuguuuaacaaauuagaauuuguuuacaacuacuugaauuuuuaaauuaugucaaaacuu

SEQ ID NO: 55205 - RNA, 64 nt, hsa
uaaucaguuuuuucauggauuuguguucuuacaguacuugaaaauauuuaaggaagagaugaag

SEQ ID NO: 55206 - RNA, 64 nt, hsa
ucucccuacugguaggaaccauaguuguguccuauacuugaagaggcuggaaaguagcccauaa

SEQ ID NO: 55207 - RNA, 64 nt, hsa
gucacauauauacaguagcagcuguaaauaagcuuacuugaacuaauuacuugaaaacuggugg

SEQ ID NO: 55208 - RNA, 64 nt, hsa
aguagcagcuguaaauaagcuuacuugaacuaauuacuugaaaacugguggaaaaaagagacca

SEQ ID NO: 55209 - RNA, 64 nt, hsa
ccagcccucgauuagcccugccugaaucaguagauacuugaacgaguccccagucugcgggagg

SEQ ID NO: 55210 - RNA, 64 nt, hsa
acaaaaauacacacacguguguuuuucuuugcaauacuugaaauauugccacugugcuuggacu

SEQ ID NO: 55211 - RNA, 64 nt, hsa
gauaaaaauaucuuuaccuuauuaauauuauacauacuugaaaaaaauuucauuuagaaaccua

SEQ ID NO: 55212 - RNA, 64 nt, hsa
uauaacuuaauguuagagaugguaaagcugcacuuacuugaacagcccaaaagcauuaaaaauc

SEQ ID NO: 55213 - RNA, 64 nt, hsa
ggcgccccaacccccugcccgccucuccgcacaauacuugaacauucaucuguacugaaguguu

SEQ ID NO: 55214 - RNA, 64 nt, hsa
cacaauacuugaacauucaucuguacugaaguguuacuugaaccgggggaaucucggaccuggg

SEQ ID NO: 55215 - RNA, 64 nt, hsa
ucugauaaaauaaaggcagggaaacaagcugaauuacuugaaauuacuugaauuuucuugucuu

SEQ ID NO: 55216 - RNA, 64 nt, hsa
uaaaggcagggaaacaagcugaauuacuugaaauuacuugaauuuucuugucuuaaaacugaaa

SEQ ID NO: 55217 - RNA, 64 nt, hsa
ucugggcaccacaaaauauacaaaacuuuaucagggaaacuaagauucuuuuaaauuagaaaau

SEQ ID NO: 55218 - RNA, 64 nt, hsa
uguugacuuuauaaauuucgcuucuuagaacaguggaaacuauguguuuuucucauauuugagg

SEQ ID NO: 55219 - RNA, 64 nt, hsa
auggaggggacauuuauggugcuuuggauuguguggaaacuaugcauuuucuguucaaaugcua

SEQ ID NO: 55220 - RNA, 64 nt, hsa
caguugcuuaccuccaguacugagccuugcuuugggaaacuaaaagauuuagaccaagucacug

SEQ ID NO: 55221 - RNA, 64 nt, hsa
uuuguuuuauucuuccuaagacugaggauugugcugaguccagagucauugugguaacugacau

SEQ ID NO: 55222 - RNA, 64 nt, hsa
gcucacacaagcaccagguacccugagcuuauacugaguccagugguuccuauuuuaugugugu

SEQ ID NO: 55223 - RNA, 64 nt, hsa
augccugggccugcaggcccaccccagccaccacugaguccacucggagugcccuguguuccug

SEQ ID NO: 55224 - RNA, 64 nt, hsa
uggaaagaaugugggauuuggagucagacaagccugaguccaguuccccguuuagaacucauua

SEQ ID NO: 55225 - RNA, 64 nt, hsa
ccccauuuucugugccuuaucucacuguuucagcugaguccaaguuguuuacucuguuccucuc

SEQ ID NO: 55226 - RNA, 64 nt, hsa
cuugggugaggcuguccaggcaccauguuuucuuugaguccaacucauuaaaaaagaagaaucu

SEQ ID NO: 55227 - RNA, 64 nt, hsa
gguggggaggggacccaggaccauaggaagguccugaguccaccuccuggucuccaccucuguc

SEQ ID NO: 55228 - RNA, 64 nt, hsa
ccaacgcccaggcaccccagucuacuugcugggcugaguccagcccuggggaagauuccugggg

SEQ ID NO: 55229 - RNA, 64 nt, hsa
ugggaccaaaaccuggguguccucacugcugcccugaguccagccaugguuuucagggggacag

SEQ ID NO: 55230 - RNA, 64 nt, hsa
ccagcacuuugggaguccaaggagggggaucgcuugaguccaggaguuugagaccagccuggac

SEQ ID NO: 55231 - RNA, 64 nt, hsa
uuauuuuuauuaacuuuuuucaguuucuuuuuauucaaagaaacaaaauucaaucucugauaau

SEQ ID NO: 55232 - RNA, 64 nt, hsa
auccaagugacucuauugauguauguauguucauucaaagaaugggaaaaggauaugacauaua

SEQ ID NO: 55233 - RNA, 64 nt, hsa
ccauucuccuucacugguuggcaaccuugagaguucaaagaaaaucaaccucugugguggucaa

SEQ ID NO: 55234 - RNA, 64 nt, hsa
cuuggcagugcuuuuucuuuagcauucugucaauucaaagaagggauccucuuucaaaggcuac

SEQ ID NO: 55235 - RNA, 64 nt, hsa
cugccucuguauuuggaguugucaguacaacucaucaaagaaaacugccuaauauaaaaaucau

SEQ ID NO: 55236 - RNA, 64 nt, hsa
gcacacauuaaagagagaguaaauuccaaagguuucaaagaacuuggucauaaauaugauaaug

SEQ ID NO: 55237 - RNA, 64 nt, hsa
ccccagaugcugccaggcagccccuccccaagccucaaagaagcauuugcugaggauggagagg

SEQ ID NO: 55238 - RNA, 64 nt, hsa
agugaccuguacaagugaugcagaaaggaggguuucaaagaaaaaggauuuuguuuaaaauacu

SEQ ID NO: 55239 - RNA, 64 nt, hsa
gggggugugguacuaccuucaggcauuugguaacucaaagaaggcuguacagauauauuuuuuc

SEQ ID NO: 55240 - RNA, 64 nt, hsa
aaagagagggcuacacugcuauggaaacuuagcuucaaagaaaaugcaauguaucugcaauuag

SEQ ID NO: 55241 - RNA, 64 nt, hsa
ucaaauguguuugguuuuggaaauauaacuuuugucaaagaaauacucucagaagagaaauggg

SEQ ID NO: 55242 - RNA, 64 nt, hsa
guucuaugagacagguaugucagaggaccgugucucaaagaaguggcauucuucugggugguuc

SEQ ID NO: 55243 - RNA, 64 nt, hsa
ggaaacuuaagaugugcaaggagauuuaaugauuucaaagaaaauaaugguucuuuguuuuuaa

SEQ ID NO: 55244 - RNA, 64 nt, hsa
cauuuggaaaaaugaaauuuaguaguuccaaguuucaaagaaaugucaacauuuuauuccauuc

SEQ ID NO: 55245 - RNA, 64 nt, hsa
aguguucauucauccuauauuuuuauucucagauucaaagaaagagcaacuacuuuggaccaaa

SEQ ID NO: 55246 - RNA, 64 nt, hsa
cuucccuaccuuucccauguacucaguuuagcucucaaagaaggggugaaucauaaagccagug

SEQ ID NO: 55247 - RNA, 64 nt, hsa
uuuaucaugacauguuauauauuuuuuguaggggucaaagaaaugcugauggauaaccuauaug

SEQ ID NO: 55248 - RNA, 64 nt, hsa
uagaaaccuuaauauguggacguaaucuccacagucaaagaaggauggcaccuaaaccaccagu

SEQ ID NO: 55249 - RNA, 64 nt, hsa
uggaaauggauugaaagagugaaagucacuggucucaaagaaucuacggaauuuagcauuuuga

SEQ ID NO: 55250 - RNA, 64 nt, hsa
acacauuugacuuggaagcaauguuugaacaaacucaaagaacagcuguggaaagaagucacaa

SEQ ID NO: 55251 - RNA, 64 nt, hsa
aagacuucagauugaauucacaucuuauucagcaucaaagaauucacacaggagagaaagcaca

SEQ ID NO: 55252 - RNA, 64 nt, hsa
uccauugcugcaaugaaugugaaaaagccaucagucaaagaaacuaccuuguuuaguaucaaau

SEQ ID NO: 55253 - RNA, 64 nt, hsa
ggagauucagucauaacccaacgcucauucaacaucaaagaauuuauaccuaagagaacuuauu

SEQ ID NO: 55254 - RNA, 64 nt, hsa
gcaguaucagcagcucuuuuccagaucaaagaacucaaagaaaacugucugggagauuccucag

SEQ ID NO: 55255 - RNA, 64 nt, hsa
gggaccgaugcaguaucagcagcucuuuuccagaucaaagaacucaaagaaaacugucugggag

SEQ ID NO: 55256 - RNA, 64 nt, hsa
ucgguccaugugguuuaucuuuacauuuuaaagaucaaagaagucuuuacaaccugaauccagg

SEQ ID NO: 55257 - RNA, 64 nt, hsa
gcaaccuggaaaguucaucucuuguuuccuucagucaaagaaaguccauuguacauaacaaaac

SEQ ID NO: 55258 - RNA, 64 nt, hsa
auauguuaagagccugagcuuagaaguauuuuuuucaaagaaauguguuuuuuacuugcuaaau

SEQ ID NO: 55259 - RNA, 64 nt, hsa
agaaugguuuuauauuucuaaaugguugaaagaaucaaagaauauugugacacaugaaaauuau

SEQ ID NO: 55260 - RNA, 64 nt, hsa
aaggaacaaagucuaugaguccuaaaauuuuaagucaaagaaaacugcucuguuuccccuuuag

SEQ ID NO: 55261 - RNA, 64 nt, hsa
guuuguguuucacaaacauggcuuaucaauuuuuucaaagaauucuuuuuucccaaaaagagga

SEQ ID NO: 55262 - RNA, 64 nt, hsa
agaauugugaaacagauaguuauauguauacaagucaaagaacaacuuaacuauugcugcaaca

SEQ ID NO: 55263 - RNA, 64 nt, hsa
gcagguuacucagcaguuugugccuccuacacagucaaagaaagagaaaaaagauaaaguagaa

SEQ ID NO: 55264 - RNA, 64 nt, hsa
auugcugacuaacuuucagguaaccagacccaucucaaagaaccaagaaaaggcuuuagcauga

SEQ ID NO: 55265 - RNA, 64 nt, hsa
ccgcccuagaggccacagaauuagcccaaaauuaucaaagaacauuaacuggaaggucagguuu

SEQ ID NO: 55266 - RNA, 64 nt, hsa
aguguaggcaaagguuuagaaaauggacauaaagucaaagaaugauggcagguaggaugaagga

SEQ ID NO: 55267 - RNA, 64 nt, hsa
cucccuguuuuagauauucagauuuaaaagguuuucaaagaauuacuuucuuccauguucaaag

SEQ ID NO: 55268 - RNA, 64 nt, hsa
auccaacucccucuucacugguacucccaaucaaucaaagaaccucaaaauuuaaacugaugug

SEQ ID NO: 55269 - RNA, 64 nt, hsa
gcuugaacacagaacagggagauggacaaccacuucaaagaaagacccaccgaaugcaguuucu

SEQ ID NO: 55270 - RNA, 64 nt, hsa
aaucaaagcucaucaguucccauaaaugcaguugucaaagaaaagauuugguugccauagucau

SEQ ID NO: 55271 - RNA, 64 nt, hsa
uuaacugguaucaaacgcugucauugagauguuuucaaagaacauugaguuguauuuaaucagc

SEQ ID NO: 55272 - RNA, 64 nt, hsa
agaaaaggaaaaggaagaagcagagaagaaaaaaucaaagaaaucugucuaauucuuaggauga

SEQ ID NO: 55273 - RNA, 64 nt, hsa
caaauaaacuaaauauaauauugagcugcauuucucaaagaaugacaaaagcauccuuauacug

SEQ ID NO: 55274 - RNA, 64 nt, hsa
auaugggauagaaacuacaaaugcaacaaaugcgucaaagaauuuagugugcacucaagccuua

SEQ ID NO: 55275 - RNA, 64 nt, hsa
auaagugggagcuaaacauugauuacacauggacucaaagaagggaacaguagacacgggcuua

SEQ ID NO: 55276 - RNA, 64 nt, hsa
aggccuuuaggcagagggcgcaucuuacucaacaucaaagaauuccuacuggugagaaacccua

SEQ ID NO: 55277 - RNA, 64 nt, hsa
agguuuuuaauaauuauccaacucuuacucaacaucaaagaauucauaccagugugaaacccua

SEQ ID NO: 55278 - RNA, 64 nt, hsa
gucauuuugauuuucaaagaagccguuuugauuuucaaagaagcagguucuggugacauuauuu

SEQ ID NO: 55279 - RNA, 64 nt, hsa
uuuuuucagaccauacaagaagucauuuugauuuucaaagaagccguuuugauuuucaaagaag

SEQ ID NO: 55280 - RNA, 64 nt, hsa
gaaguguuucuuauuauuauuuuauauugaguugaauauugaacucuaacaguuuucuacauac

SEQ ID NO: 55281 - RNA, 64 nt, hsa
uuucauuacaagucuuucacagaaguuuggugguaauauugaaagaacuagcauugggcagaau

SEQ ID NO: 55282 - RNA, 64 nt, hsa
ucauccuagaaagccuugacuagaaaaaugaauaaauauugaggguuuccuguccauaucuggc

SEQ ID NO: 55283 - RNA, 64 nt, hsa
uauuuguagcucauuuauuugguuauuuccuaagaauauugaaagugaagcaacuaugugacug

SEQ ID NO: 55284 - RNA, 64 nt, hsa
acuguaugauauuuuaagcaaauauguuauuuaaaauauugauccuucccuuggaccaccuuca

SEQ ID NO: 55285 - RNA, 64 nt, hsa
accuuuggauauguuuguaaucauuucgaaucaaaauauugauuuaauuuugaccucugguuua

SEQ ID NO: 55286 - RNA, 64 nt, hsa
gguuuccuuuuaccaugaaauugucuuacuugaaaauauugauccugaugagagagaagauggu

SEQ ID NO: 55287 - RNA, 64 nt, hsa
cacucguaaaaagguaucuuuuuuaaaugaauuaaauauugaaacacuguacaccauaguuuac

SEQ ID NO: 55288 - RNA, 64 nt, hsa
uauuauguagcugaaacaaaaaugccagaaggauaauauugauuccucacaucuuuaacuuagu

SEQ ID NO: 55289 - RNA, 64 nt, hsa
auauauuaaaaaagagcuugcuuacuacaagaaaaauauugaaauauugaaaauauugaaaaua

SEQ ID NO: 55290 - RNA, 64 nt, hsa
aaaaagagcuugcuuacuacaagaaaaauauugaaauauugaaaauauugaaaauauuauuauu

SEQ ID NO: 55291 - RNA, 64 nt, hsa
uugcuuacuacaagaaaaauauugaaauauugaaaauauugaaaauauuauuauugaaaauaaa

SEQ ID NO: 55292 - RNA, 64 nt, hsa
aaaaacaagaaaaacaacaacuaugaguuaucaaaauauugacuccauuuaugacuagacuaca

SEQ ID NO: 55293 - RNA, 64 nt, hsa
auuucugaaagaucuuugguuuaugauucuuaagaauauugacaauaccuauaaaacuuugaag

SEQ ID NO: 55294 - RNA, 64 nt, hsa
caaagagauaaaguuuagcuucuuuuuacuauucaauauugaacauaauauuguuaaauauuga

SEQ ID NO: 55295 - RNA, 64 nt, hsa
uuuuuacuauucaauauugaacauaauauuguuaaauauugagaugaaaugcuguuggauuuga

SEQ ID NO: 55296 - RNA, 64 nt, hsa
gacuauguacacauccacuuuuguuaauaaacucaauauugaauacuuugggauguuaaauuca

SEQ ID NO: 55297 - RNA, 64 nt, hsa
ugucuugacuguugcaccaggcugagaaagcagcaauauugauauuauaaagauaaaaauuuau

SEQ ID NO: 55298 - RNA, 64 nt, hsa
uuuguuugaaauuucagaacuguuuuucuauguaaauauugaaaacuuaugauuugugcaauaa

SEQ ID NO: 55299 - RNA, 64 nt, hsa
aucuguaggccuguacuaaucucuacgcauuagcaauauugacuguaaacccacauuaaggaaa

SEQ ID NO: 55300 - RNA, 64 nt, hsa
uuaaaagccuuaggauauucuauaugaugaccucaauauugacuuucagccauacugggaaaac

SEQ ID NO: 55301 - RNA, 64 nt, hsa
aaaaucugcaucaaaucaguuuccaugcaucaguaauauugaaggucauaaucagugauuuuug

SEQ ID NO: 55302 - RNA, 64 nt, hsa
uucuagaaacuuucugaaauaauuucuguuuaaaaauauugaauauuugcuucauuucaaauac

SEQ ID NO: 55303 - RNA, 64 nt, hsa
cagccuugccucacagcauguaaauaauuaaaacaauauugaugcugagguucuucuacugcua

SEQ ID NO: 55304 - RNA, 64 nt, hsa
cuuuaccaaugagccuuaauuuuuauauagguccaauauugagcuuuuacuuaaaauuuagaua

SEQ ID NO: 55305 - RNA, 64 nt, hsa
gaagggacuaaauaugacuuuaaagagacuucaaaauauugaguauuuuaaaaauuuaaaagua

SEQ ID NO: 55306 - RNA, 64 nt, hsa
caggaaaggagaguacuuugguuucugagcaccgaauauugagcaauaugucagucacuaaaag

SEQ ID NO: 55307 - RNA, 64 nt, hsa
uguuaccucaacaagaagaauuugaagacuucaaaauauugagcagaauucauucauacuuaaa

SEQ ID NO: 55308 - RNA, 64 nt, hsa
agaaccauuaauaaaacaaaacaaaacaaagcaaaauauugaugaucaggcagauuugaaaaca

SEQ ID NO: 55309 - RNA, 64 nt, hsa
cccaaguagucugguaugaucugugguuccuuagaauauugaggaucucuuuaaaaaaugaaau

SEQ ID NO: 55310 - RNA, 64 nt, hsa
ugaauuuagauagguaucaagcuguaacuaagacaauauugauaaauguuggaugacauuuaau

SEQ ID NO: 55311 - RNA, 64 nt, hsa
ucuaacggggagcaaucuuucucucgaaacugcuaauauugaucccaaaguuacuuugacugca

SEQ ID NO: 55312 - RNA, 64 nt, hsa
cacaauucaguuaagaugcuuugacacugaauaaaauauugauuucaugaaaucauuuugcugu

SEQ ID NO: 55313 - RNA, 64 nt, hsa
uaacuccuucaauauuucuaguagcacaacugauaauauugauauuuucuacaaauguuacuuc

SEQ ID NO: 55314 - RNA, 64 nt, hsa
uuccuuacuuuuaguuagaaaccccuaaaacgcuaauauugauuuuccugauagcuguauuaaa

SEQ ID NO: 55315 - RNA, 64 nt, hsa
auaaccucaccaaugaauacaaauguuuaaauaaaauauugauuaaaaaaacauuaaaagugca

SEQ ID NO: 55316 - RNA, 64 nt, hsa
uauuuuuaagaaaguaaccaguuauacugcuuuuaauauugauuggucuuuuuauuuggcuugg

SEQ ID NO: 55317 - RNA, 64 nt, hsa
uuuguuuuauuuugacauggcauguccugaaauaaauauugauucaauauggcagaugggucau

SEQ ID NO: 55318 - RNA, 64 nt, hsa
agaauugucccaaaaguaccuguacagaaaauugaauauugaaaaauugacaaauuguguacaa

SEQ ID NO: 55319 - RNA, 64 nt, hsa
gaugugagaaacaauucuuuuuaauuuacagcaaaauauugaauaaccauugacaaaaacacua

SEQ ID NO: 55320 - RNA, 64 nt, hsa
auguagagaugccugauuccaaacagguguggagaauauugaauggcucagaagccgcgucccu

SEQ ID NO: 55321 - RNA, 64 nt, hsa
ugugagacuucucucacuggccuugaaauaagaaaauauugaacauuuuaauauuaaaaauauu

SEQ ID NO: 55322 - RNA, 64 nt, hsa
aaacuuguauacacaagcguccaugucucacacaaauauugaugugauuauucuuaaguguuaa

SEQ ID NO: 55323 - RNA, 64 nt, hsa
guuaaaucauuaacacuuaaaugacuucauugggaauauugagcagagggacugugcuucuaug

SEQ ID NO: 55324 - RNA, 64 nt, hsa
aucauguugugggaaucuuuuuuuuaaauagugaaauauugaggcagcaauuuuuuacaaaaag

SEQ ID NO: 55325 - RNA, 64 nt, hsa
guuccaaauuuguagccaguuccaaacaaauuuaaauauugaguugagaccuguauggaauugu

SEQ ID NO: 55326 - RNA, 64 nt, hsa
uaauuaaaaaaauuuaauaauuuggugauguuugaauauugacugucaguuaaggacauagcua

SEQ ID NO: 55327 - RNA, 64 nt, hsa
uuaaggacauagcuauuccaaauaaacuaaauauaauauugagcugcauuucucaaagaaugac

SEQ ID NO: 55328 - RNA, 64 nt, hsa
aagaagagauacuuaacaauaauugggagaauggaauauugacaauauuagauaauauuaagaa

SEQ ID NO: 55329 - RNA, 64 nt, hsa
augugcuacaguaagauauacacaucuugccaaaaauauugaaccugaauuuaagccucaagag

SEQ ID NO: 55330 - RNA, 64 nt, hsa
guaaucugcuuuguuaaugaaaaugauaaaacagaauauugacaagcuaggacaccugugguau

SEQ ID NO: 55331 - RNA, 64 nt, hsa
aguuugcuucuuaugguauaauaaaguauggaagaauauugaguauauguuuacucugggccug

SEQ ID NO: 55332 - RNA, 64 nt, hsa
gcuucauuuauuuauugcuuuugcccaugcauucaauauugaucagcucagcacuuccaugggc

SEQ ID NO: 55333 - RNA, 64 nt, hsa
gcucccccuagccgcacacuagugugggaaggaaaauauugagcuaggcacauuacucucugaa

SEQ ID NO: 55334 - RNA, 64 nt, hsa
ugauagcaaaaucaagagauggcuuacaaaaagaaauauugaauuuuuauuuuugaaguuuuug

SEQ ID NO: 55335 - RNA, 64 nt, hsa
uuggcaugacucuugacucuugccugccuaacaaaauauugaaaggcaaacauuugaaggaggg

SEQ ID NO: 55336 - RNA, 64 nt, hsa
guuuucuuuccacacaggauuccguuggugaaccuguaaaaacaaaacaaacaaaacaaaacaa

SEQ ID NO: 55337 - RNA, 64 nt, hsa
cacagagcaggacgcucuaggccaaaucuauuuuuguaaaaaugcucaugccuaugggugacug

SEQ ID NO: 55338 - RNA, 64 nt, hsa
gauuuauugagauugaauuaugccaccacguuuauguaaaaaugaagguggcaccguggugaga

SEQ ID NO: 55339 - RNA, 64 nt, hsa
cguggugagaccuaaugagaaauaguuacucaguuguaaaaauuuugauuuauucucuuucuuc

SEQ ID NO: 55340 - RNA, 64 nt, hsa
ccuuugucaucuguuagacucuguaugugugauuuguaaaaagcaggcugaaacuauggacaug

SEQ ID NO: 55341 - RNA, 64 nt, hsa
uuugaaccccuaggcuucaggaaaacugcucuuuuguaaaaagaauagcgaugacauuuucuaa

SEQ ID NO: 55342 - RNA, 64 nt, hsa
ccauuugcacuguucagacauauauauguauguauguaaaaauuauauauacacaaauuagcug

SEQ ID NO: 55343 - RNA, 64 nt, hsa
ugcuaaagagacuuggcaccagcuuuguucaaacuguaaaaauagcaauuugccccuacucgcu

SEQ ID NO: 55344 - RNA, 64 nt, hsa
ugccuuuuaaguuacugacaucagcuuccaccaguguaaaaauugaguaaaaccugaaguuuug

SEQ ID NO: 55345 - RNA, 64 nt, hsa
uauagauauauuccaagccgccugacgaucuaauuguaaaaaguaaagcauacaaauacuagaa

SEQ ID NO: 55346 - RNA, 64 nt, hsa
aggcaagacagaaauaagagaaucaagacuugauuguaaaaauugacaacuuuagauucugagg

SEQ ID NO: 55347 - RNA, 64 nt, hsa
gcagcguccuauaauccuagaccuuuucaugacguguaaaaaaugauguuucauccucugauug

SEQ ID NO: 55348 - RNA, 64 nt, hsa
aguuguaaaaaggggagauuucgguaggcacagguguaaaaaggggagauuucagaagacgggc

SEQ ID NO: 55349 - RNA, 64 nt, hsa
ggacuuggaauaucagcagaguaguaggcacaguuguaaaaaggggagauuucgguaggcacag

SEQ ID NO: 55350 - RNA, 64 nt, hsa
gucacuguaaaaauguauuaucuuguaaaacuuauguaaaaaaaaaaaaaaaaaaaaggcaaag

SEQ ID NO: 55351 - RNA, 64 nt, hsa
gccaaguugcaaaguuguauccacaucaggucacuguaaaaauguauuaucuuguaaaacuuau

SEQ ID NO: 55352 - RNA, 64 nt, hsa
uugaaaaaaugaagaaaaauguauuuucccuuuauguaaaaauuagugaauaucuuaugaauua

SEQ ID NO: 55353 - RNA, 64 nt, hsa
cgggaacuugagagcuuuuacugugauucuucaauguaaaaaauaaacaacaaugucaaacugu

SEQ ID NO: 55354 - RNA, 64 nt, hsa
auugauuuuuuuauaauaagccuuuuuaccucuguguaaaaaauauauauacaaguguaugaug

SEQ ID NO: 55355 - RNA, 64 nt, hsa
ccucauuuauacuuggggaaaaaacaaggccauauguaaaaacccuuccaaugccuaagugucu

SEQ ID NO: 55356 - RNA, 64 nt, hsa
aaauagcuggcgagugcuuucuguauuuaaauauuguaaaaagaaaauaaguuauaacuguuau

SEQ ID NO: 55357 - RNA, 64 nt, hsa
uuucauuaucuuuaaugaagacaaaggaaucuaguguaaaaaacaacagcaaacaaaaagguga

SEQ ID NO: 55358 - RNA, 64 nt, hsa
aaccaacaacaauguguuguaaaaaugucuuucauguaaaaagugcaguaaauauuuacuauuu

SEQ ID NO: 55359 - RNA, 64 nt, hsa
cuuuguguugcagccucaaccaacaacaauguguuguaaaaaugucuuucauguaaaaagugca

SEQ ID NO: 55360 - RNA, 64 nt, hsa
aaguuuaaguuuacgucauugucucaaguguggcuguaaaaaucagaucuagaguuuagagaca

SEQ ID NO: 55361 - RNA, 64 nt, hsa
cagcucagauugucgaguuaguaaacaugagcgauguaaaaacuuuauuugaaaucuccuaagu

SEQ ID NO: 55362 - RNA, 64 nt, hsa
guuaaaagaccauaagcaaacugguuauuuaaaauguaaaaaggaauaugaaagucuuauuaaa

SEQ ID NO: 55363 - RNA, 64 nt, hsa
auaaaggcauugauauuuuagaugcacccguguuuguaaaaauguagagcacaauggaauuaug

SEQ ID NO: 55364 - RNA, 64 nt, hsa
ucauuucuuccauuaacugcuuccagagaugucauguaaaaaaguuaguguauuagagaaguuu

SEQ ID NO: 55365 - RNA, 64 nt, hsa
gggcuauuuuugagggauguauuuuuuuuaaaauuguaaaaauuguugaguucuguuuaaagaa

SEQ ID NO: 55366 - RNA, 64 nt, hsa
caugaguccuugugauuaggcccaccugaucaaauguaaaaacaugcaugggauauuugauuac

SEQ ID NO: 55367 - RNA, 64 nt, hsa
aucagcaagacuuuauaauuccuucugccuaacuuguaaaaagggggcugcauucuuguuggua

SEQ ID NO: 55368 - RNA, 64 nt, hsa
aaaggggaaauacuuuaauuuuuuuucuuaauaguguaaaaauucccugagcuaagcuaaaacc

SEQ ID NO: 55369 - RNA, 64 nt, hsa
guucuucaaacacucuuaaauuuuucuuaaguaauguaaaaauggaacugccaauuuuauuucu

SEQ ID NO: 55370 - RNA, 64 nt, hsa
uuucuuauucauuaaaugaauucaacauuuucucuguaaaaacaauagaguuucaguacaugaa

SEQ ID NO: 55371 - RNA, 64 nt, hsa
auaauguacauaaauguuacauuuguaaagaaaauguaaaaauguaacuauagcauaugaauug

SEQ ID NO: 55372 - RNA, 64 nt, hsa
uaccaguaccuauuuuuacucuuacaaaauuuccuguaaaaaaauacuacauuugaaauuauuu

SEQ ID NO: 55373 - RNA, 64 nt, hsa
gaaggauaccuggagcacaaggaauaagaucauuuguaaaaauguuuguuuauauagaccuauc

SEQ ID NO: 55374 - RNA, 64 nt, hsa
agcaugugaagaugugaucauuugugauguuacuuguaaaaaaaaguauauauacauaucuuuu

SEQ ID NO: 55375 - RNA, 64 nt, hsa
gaauuaacacaguauucauucaucuguguuauuuuguaaaaauaacuguagcuuauauucuuua

SEQ ID NO: 55376 - RNA, 64 nt, hsa
uuucuucuucugagaaugugacuuuuucugguguuguaaaaaagaaaaaaaaaagaaugcucau

SEQ ID NO: 55377 - RNA, 64 nt, hsa
guguuguaaaaaagaaaaaaaaaagaaugcucauuguaaaaauaaaaaaauaauaauaagcaag

SEQ ID NO: 55378 - RNA, 64 nt, hsa
gugggaauuucuuuuccuacgggguacgugauuuuguaaaaaggaaguauuucucccaaaauug

SEQ ID NO: 55379 - RNA, 64 nt, hsa
uaugcuaguuuaaaaaagaaaauauguaauauaauguaaaaaaaaacaaaaaaaagcuuuuaug

SEQ ID NO: 55380 - RNA, 64 nt, hsa
augaaaacguuugauuauuuucucaguguauuuuuguaaaaaauauauaaaggggguguuaauc

SEQ ID NO: 55381 - RNA, 64 nt, hsa
ccugccaccaguguccacccuccggcccccgucuuguaaaaaggggaggagaauuagccaaaca

SEQ ID NO: 55382 - RNA, 64 nt, hsa
guacgucucacuugaaauugcuuuguauacauuuuguaaaaauauuuauaaaauguuuuguaaa

SEQ ID NO: 55383 - RNA, 64 nt, hsa
guauacauuuuguaaaaauauuuauaaaauguuuuguaaaaaaaaaaaaacuauaacaaauugc

SEQ ID NO: 55384 - RNA, 64 nt, hsa
uucugauaaaacucagaauuucuuuuuaagcaguuguaaaaauugucauguuguaauucauuac

SEQ ID NO: 55385 - RNA, 64 nt, hsa
ugugaaccucaugcaugaaagcagcacauuaaauuguaaaaauacaaacagaucgugugaucau

SEQ ID NO: 55386 - RNA, 64 nt, hsa
aacccaugaagcaagaauagaugugagaaaucuauguaaaaaaauaauuaaagaaaugcaugug

SEQ ID NO: 55387 - RNA, 64 nt, hsa
cagagugaauagauccuaagucccaaauggccaguguaaaaauguccuuaugucugaugcuguc

SEQ ID NO: 55388 - RNA, 64 nt, hsa
gugacuuuuugagcaccuuucaguauuauguauuuguaaaaaccauuguuuuuggauauaaagc

SEQ ID NO: 55389 - RNA, 64 nt, hsa
uuuuaaaaguaguaagccacauuacauuuaucuuuguaaaaagauuuaugguaacugguuucuu

SEQ ID NO: 55390 - RNA, 64 nt, hsa
agaggacguugaguggauuccuggguacagcuuuuguaaaaaugucaccauggcuuucauccaa

SEQ ID NO: 55391 - RNA, 64 nt, hsa
uucugcaaaucccaaaucuuucuuuauuauuuauuguaaaaaaaguuuccuuagaagucauaaa

SEQ ID NO: 55392 - RNA, 64 nt, hsa
uaagaguauuuauacuggaaagaaacccuacaaauguaaaaaacguggcaaugccuuuaacugg

SEQ ID NO: 55393 - RNA, 64 nt, hsa
gguaagaauccauacugaagaaaacuccuggaaguguaaaaaauguggcaacacuuuuaauaaa

SEQ ID NO: 55394 - RNA, 64 nt, hsa
acagcccuauggaauuugcaaucugugauugccuuguaaaaaggagagugcauauggcacugca

SEQ ID NO: 55395 - RNA, 64 nt, hsa
uauagaaaauauaugaaccaaagugauuugaguuuguaaaaauguaaaauaguaugaacaaaau

SEQ ID NO: 55396 - RNA, 64 nt, hsa
acaaaaguuugcuuguuuaaaaugacaguugugauguaaaaaguuuaagaaauaugaaugugag

SEQ ID NO: 55397 - RNA, 64 nt, hsa
uuacuuuuuuaaagcugaguaguuaagaauucccuguaaaaacaaaacccuguaaauugagccu

SEQ ID NO: 55398 - RNA, 64 nt, hsa
auauuagagaacugugauuuaaaaguacuguuaauguaaaaaauaaagcaaguguaauuaauuc

SEQ ID NO: 55399 - RNA, 64 nt, hsa
acacuuccaaaaacaagggaacaaggugguuuauuguaaaaacaggaaauggugcaugucauug

SEQ ID NO: 55400 - RNA, 64 nt, hsa
ugaugugccuguaaaccaaggaguuuuccccguuuguaaaaagacauuguagauaauugaaugu

SEQ ID NO: 55401 - RNA, 64 nt, hsa
caccuggucaacuuagcuuuuaagcagacgaugcuguaaaaacuaacggcuucucugauauuua

SEQ ID NO: 55402 - RNA, 64 nt, hsa
uuaaaaguugugcaugggcuuauacaauuucaaauguaaaaacagccuauuuauauauguugaa

SEQ ID NO: 55403 - RNA, 64 nt, hsa
gcaauguaaauagaacacuaauuaaaaaacaacuuguaaaaaugcaauuuaaauuuuaauacag

SEQ ID NO: 55404 - RNA, 64 nt, hsa
uaaaauauuuuuuaauuuaauggucaguauauuuuguaaaaaucauguuaauuuauuucauagu

SEQ ID NO: 55405 - RNA, 64 nt, hsa
uuucugagcagcauuuugguauuuaaacauuucuuguaaaaagcugagacaguuuguaagaaaa

SEQ ID NO: 55406 - RNA, 64 nt, hsa
guauauauccaaagauauaguguguacauuuuuuuguaaaaaguuuagaggcuuaccccuguaa

SEQ ID NO: 55407 - RNA, 64 nt, hsa
uuagaggauguauuuauauaauuauuuguuaaauuguaaaaaaaaaaguguaaaauauguauau

SEQ ID NO: 55408 - RNA, 64 nt, hsa
gcaagacucccucucaaaagaaaaagaaaaaagauguaaaaaccauucuuaguuugugggccuu

SEQ ID NO: 55409 - RNA, 64 nt, hsa
ggguauuuauaugaccuuuguaaccauuuaaaaauguaaaaacgaccugacuuaguaaugcgaa

SEQ ID NO: 55410 - RNA, 64 nt, hsa
auccuuaaaucucuuguauggcaaccaaaauuacuguaaaaaaauaaauauacuauugcacuaa

SEQ ID NO: 55411 - RNA, 64 nt, hsa
guggccugcugaggcugccccauauuuuagaaaauguaaaaauggugguuuggccauuaauuug

SEQ ID NO: 55412 - RNA, 64 nt, hsa
ucccugugaaugccaaaguaaacuuuauguacaguguaaaaaaaaaaaaucucaguuauguuuu

SEQ ID NO: 55413 - RNA, 64 nt, hsa
aaaaauuaaguucugaaaauugaaaaaauuaaaauguaaaaaaauuaaagaauaaaaauacuuc

SEQ ID NO: 55414 - RNA, 64 nt, hsa
guguaaaaaaaagucuuaacaacagcuucuugcuuguaaaaauauguauuauacaucuguauuu

SEQ ID NO: 55415 - RNA, 64 nt, hsa
acuuccuuccugccccaaaauuauaaacucuaaguguaaaaaaaagucuuaacaacagcuucuu

SEQ ID NO: 55416 - RNA, 64 nt, hsa
gauuucuaagaauguuuuucuauaaauuacuaauuguaaaaagucuugcuuuuuaaaacaaguu

SEQ ID NO: 55417 - RNA, 64 nt, hsa
uucuccuugaggauagggauagguaagguaaacuuguaaaaaggaugucacagaagucacuuuu

SEQ ID NO: 55418 - RNA, 64 nt, hsa
uuguaaagaggaugcugccuuaagaauugcauguuguaaaaaaucuuuuuggaaaauacagacu

SEQ ID NO: 55419 - RNA, 64 nt, hsa
guuauuuaucaaaauuaugugagguuccaaaauauguaaaaaugauaauaauaaaaaaagauua

SEQ ID NO: 55420 - RNA, 64 nt, hsa
aggacuuauugagguaaauuaaaagaacaaaaacuguaaaaaggaaguaguucagcaucuaucg

SEQ ID NO: 55421 - RNA, 64 nt, hsa
guuugucucagggaaaaucuucccccaccgagcuuguaaaaaacuuuaauaauuggguggagaa

SEQ ID NO: 55422 - RNA, 64 nt, hsa
guauacacaaaaaucagauuuaguaacuaaagguuguaaaaaauuguaaaacugguuguacaau

SEQ ID NO: 55423 - RNA, 64 nt, hsa
uacaauagaugucucacacagaacaauacaaauauguaaaaaaucuuucaccacauauucuugc

SEQ ID NO: 55424 - RNA, 64 nt, hsa
ucuugcugguuuauaccuauguucauuuauaugcuguaaaaaaguaguagcuucuucuacaaug

SEQ ID NO: 55425 - RNA, 64 nt, hsa
auaugcuguaaaaaaguaguagcuucuucuacaauguaaaaauaaauguacauacaaaaaaaug

SEQ ID NO: 55426 - RNA, 64 nt, hsa
ugaagcucuaauuauugcagacauauuuuugagauguaaaaaaaaaaauuuaaaguuaaaugau

SEQ ID NO: 55427 - RNA, 64 nt, hsa
acauuuucauuaugccccaucacaucuucuuuacuguaaaaauauuaaaaagcuguuuccaagu

SEQ ID NO: 55428 - RNA, 64 nt, hsa
gugggaggaggcaaggucugcuaucaggaguuacuguaaaaacaagaacuggaagcucguguuu

SEQ ID NO: 55429 - RNA, 64 nt, hsa
gcuuguugcuuggcuuuuaaagaugguguauguuuguaaaaauauucuucugggcucaaaagcu

SEQ ID NO: 55430 - RNA, 64 nt, hsa
ucucgggcuuuaauuugcuaaagcugugcacauauguaaaaaaaaaaaaaaaaagauuauuuua

SEQ ID NO: 55431 - RNA, 64 nt, hsa
guaagaugauaaagcauuugaaugguacaguagauguaaaaaaaauucaguuuaaaagaacauu

SEQ ID NO: 55432 - RNA, 64 nt, hsa
uuuuuucuccuauacuugggcuacauuuuuugauuguaaaaauauuugauggccuuuugaugaa

SEQ ID NO: 55433 - RNA, 64 nt, hsa
cacaccuaugcaauauggcuuaucuauauuuauuuguaaaaauccaagcauaguuuaaaauaug

SEQ ID NO: 55434 - RNA, 64 nt, hsa
uaaaaaaugaaaguuaugacauuagcuuuaaagguguaaaaaagauguuucacuaauguaacgg

SEQ ID NO: 55435 - RNA, 64 nt, hsa
uuuaauaaaaauguuaauuuuggaagugcaguuuuguaaaaaccuuuuucagucaaacaguaaa

SEQ ID NO: 55436 - RNA, 64 nt, hsa
cacgacagaguccauguuggaggugauaaaaaacuguaaaaaaaaaaaaaaaaaaaaagacaaa

SEQ ID NO: 55437 - RNA, 64 nt, hsa
aaggggggugggaggggaagaaaaacucuauuuuuguaaaaagggaaaaagaccucguggagaa

SEQ ID NO: 55438 - RNA, 64 nt, hsa
ugaaaggaugcacacugcaaagaaacaguaugaauguaaaaaaugugggaaaacauacauuacu

SEQ ID NO: 55439 - RNA, 64 nt, hsa
ugaaaguacucacacuggagauaaacccuuugaguguaaaaaauguggaaaagcauuuagauac

SEQ ID NO: 55440 - RNA, 64 nt, hsa
ugaaagaacucacacuggagaaaaacccuaugaauguaaaaaaugugggaaaguguucguauau

SEQ ID NO: 55441 - RNA, 64 nt, hsa
ucagagaauucacacuagugagaaaccguaucaguguaaaaaauguagaaaauccuuuauugau

SEQ ID NO: 55442 - RNA, 64 nt, hsa
ucacacuggugacaaacccuaugaauguaaagauuguaaaaaagcuuuucuuuguuauucaaca

SEQ ID NO: 55443 - RNA, 64 nt, hsa
uaauguuguaaauauuuggcaauuuaagacauuguguaaaaagcaaucuguaaaaacaucucca

SEQ ID NO: 55444 - RNA, 64 nt, hsa
uuuggcaauuuaagacauuguguaaaaagcaaucuguaaaaacaucuccaggcuuugauuuuug

SEQ ID NO: 55445 - RNA, 64 nt, hsa
uguuuacucuaccaauguuaugucgaaacugcauuguaaaaagagaagaaaguggcagguuuuc

SEQ ID NO: 55446 - RNA, 64 nt, hsa
uuguuuuuaaaaauuauauuccaguuuuaaucauuguaaaaaaagcaccuggaguuucaaaaca

SEQ ID NO: 55447 - RNA, 64 nt, hsa
agguaggucuucagcauaagcugaaauauaugcauguaaaaacuuugacaucuuuuuuuuuaau

SEQ ID NO: 55448 - RNA, 64 nt, hsa
aaauuuacuaaccaguuuuuauauugaccugcaguguaaaaagcacauuuaauuauaaacaaua

SEQ ID NO: 55449 - RNA, 64 nt, hsa
gcccaccaaaaugauccagucuggaauaacauuuuguaaaaaaaaaaaaaauauauauauauau

SEQ ID NO: 55450 - RNA, 64 nt, hsa
ccagaauugucaaccaauuucuuuaauugaacauuguaaaaaacaggaauaaguacuuuugugu

SEQ ID NO: 55451 - RNA, 64 nt, hsa
auaaugcacaguaaauaugugaauuuuuccuagauguaaaaaaaaaaaucuuucauauaaagac

SEQ ID NO: 55452 - RNA, 64 nt, hsa
uuaucacuaguguggcuaaauaaccaaacauuuguguaaaaaaaaaaaaaagccaagauuucau

SEQ ID NO: 55453 - RNA, 64 nt, hsa
agauauauauauaaauuuuaauuucauagcaacuuguaaaaaauaaaauacuuguugaaaagcc

SEQ ID NO: 55454 - RNA, 64 nt, hsa
guauaaaaacauugcuuuuguugaauuguauagguguaaaaagggaauaacuguaugcagguuu

SEQ ID NO: 55455 - RNA, 64 nt, hsa
uacuguaaagcuacuuguguucucuucauuugucuguaaaaauuucccuaauugauuauauagu

SEQ ID NO: 55456 - RNA, 64 nt, hsa
cugagaugaaucuaauuuuuagauugcccuguauuuuguuaacauguauauauguacaacagug

SEQ ID NO: 55457 - RNA, 64 nt, hsa
cguuucugaacagggucugugcuauguguaaagguuuguuaacuguaaaguaauauaaaguuau

SEQ ID NO: 55458 - RNA, 64 nt, hsa
uguaaacugauauucagccagcaaugccuaagacuuuguuaagaucauuucuacugcuuuucuu

SEQ ID NO: 55459 - RNA, 64 nt, hsa
acacugguuaaguuugacucgucucuaaaacguuuuuguuaauuggacaccaagaggaagaauc

SEQ ID NO: 55460 - RNA, 64 nt, hsa
aacugauaaaguuuguaaagugcuauaaauguauuuuguuaaguacagauaaaagcuauugugu

SEQ ID NO: 55461 - RNA, 64 nt, hsa
ucccaaaucuggcuggucgggaauaccugggaaguuuguuaaaauuuuuuaaaaauguuuuaag

SEQ ID NO: 55462 - RNA, 64 nt, hsa
cuuuuuaguaucaaaucacuacuagaccauuuaauuuguuaaauuaucucuaggauggugauuu

SEQ ID NO: 55463 - RNA, 64 nt, hsa
ugacuaugucgaauauuucuuacugccaucauuauuuguuaaagauauuuugcacuuaauuuug

SEQ ID NO: 55464 - RNA, 64 nt, hsa
cguaauuuuaggacuccuauaaaauucuuccuuguuuguuaaugcuauuaaaacucagauucaa

SEQ ID NO: 55465 - RNA, 64 nt, hsa
aaggucaaguuuuauucuggugucuuggggaagcuuuguuaaauuuuuguuaauguggguaaau

SEQ ID NO: 55466 - RNA, 64 nt, hsa
uuauucuggugucuuggggaagcuuuguuaaauuuuuguuaauguggguaaaucugaguuuaau

SEQ ID NO: 55467 - RNA, 64 nt, hsa
aauuacagauuuaaaagagcuuaagaucugguguuuuguuaaugcuucuguuuauuccagaagc

SEQ ID NO: 55468 - RNA, 64 nt, hsa
uugagacuuguaaaccuggauauguugaaggguauuuguuaauuuuacuuuucaaagauacuuu

SEQ ID NO: 55469 - RNA, 64 nt, hsa
auuuuuaacccuuaaaaaaguggagauguauacauuuguuaacaaugccaugaaagcauuuucu

SEQ ID NO: 55470 - RNA, 64 nt, hsa
uguguugccucacacugugugugauuuuguuucuuuuguuaagcagcacuuauguagacugcau

SEQ ID NO: 55471 - RNA, 64 nt, hsa
acuagaaugugugacucuguggggacugcauagguuuguuaauugaccuauagcuaaaccuuaa

SEQ ID NO: 55472 - RNA, 64 nt, hsa
uuaaugcguuggaaagaaagcugcuuguguuugcuuuguuaauugccucaggauauuucuuuua

SEQ ID NO: 55473 - RNA, 64 nt, hsa
aauuagucuaacucugcauagacagggucuagauuuuguuaacccaaauguauaacugcaguua

SEQ ID NO: 55474 - RNA, 64 nt, hsa
gugucacucuucagggcucugcuccuggcucuauuuuguuaaggugucaucagccuucaaccuc

SEQ ID NO: 55475 - RNA, 64 nt, hsa
ccuuuaaaaaagauguaagacuuugguucccaacuuuguuaaaaaacaaaaaaagugauggaaa

SEQ ID NO: 55476 - RNA, 64 nt, hsa
auguuuguauauagauacaggaguuggcauaaauuuuguuaaauaaagcaacaaaaauuuucuu

SEQ ID NO: 55477 - RNA, 64 nt, hsa
guucuuaauuuugaaggaccuccaaucacuacauuuuguuaauacugccaauaaaaucauuuuc

SEQ ID NO: 55478 - RNA, 64 nt, hsa
aaaaguguaacauuuuuauuuaguuguguacuuauuuguuaauaauacagacauuguauguuau

SEQ ID NO: 55479 - RNA, 64 nt, hsa
gggaaagcugcagcaaagggagacuagagagagauuuguuaaaggauacaaaguuacagcuugg

SEQ ID NO: 55480 - RNA, 64 nt, hsa
uguuaaugcuuuguuaaugcuuuucccacucucauuuguuaaugcuuucccacucucaggggaa

SEQ ID NO: 55481 - RNA, 64 nt, hsa
aauauuuugaauauguaaagaccuguguuaaugcuuuguuaaugcuuuucccacucucauuugu

SEQ ID NO: 55482 - RNA, 64 nt, hsa
gauuuggggagaguagaaggagagauuugcuugauuuguuaacuucuaccuccaacccacaaaa

SEQ ID NO: 55483 - RNA, 64 nt, hsa
gcuggcugaguggauuuuaagagaaauaauuguauuuguuaacagugucuuuuuuuaaaaaguu

SEQ ID NO: 55484 - RNA, 64 nt, hsa
aauuucacauuacuuuuacuuaaugcuuuuguguuuuguuaauacuucauaauaugugaaaaac

SEQ ID NO: 55485 - RNA, 64 nt, hsa
uuuuuuuuuuuuccaucacucaguggagaaaagcuuuguuaaugaaagauuuugugauagagcu

SEQ ID NO: 55486 - RNA, 64 nt, hsa
aauugucaaagacuguauuuagaucucauaaugcuuuguuaaauguuuacaaguaaauaguuug

SEQ ID NO: 55487 - RNA, 64 nt, hsa
gacuaccaauuucuuuuauguuaacuagaaugcuuuuguuaaaaguuauuuguucauuauuugu

SEQ ID NO: 55488 - RNA, 64 nt, hsa
ccauugaccauuuaguguugaguacuguauguguuuuguuaauucuauaaagguaucuguuaga

SEQ ID NO: 55489 - RNA, 64 nt, hsa
uuaaaauuuaauccauucuuaauauuuuaaaacuuuuguuaagaaaaacugccaguuugugcuu

SEQ ID NO: 55490 - RNA, 64 nt, hsa
auuuucugaaggucuguuaguuaauuugagauaauuuguuaaaggcaaguaugucauauuacug

SEQ ID NO: 55491 - RNA, 64 nt, hsa
acuguaacaugauuugaguggugcuuuuccuugcuuuguuaaccaucacgagagucugcagcac

SEQ ID NO: 55492 - RNA, 64 nt, hsa
aagcgggagaggaggagcacuuacucauguuguauuuguuaauggaggaugucaucuuuucaua

SEQ ID NO: 55493 - RNA, 64 nt, hsa
aaugaacagucacaccaaaauagacuaugaugcuuuuguuaagaaagguuucauguuuuagaua

SEQ ID NO: 55494 - RNA, 64 nt, hsa
gggguuccucuguacagcaagauguuucuugccuuuuguuaaugcauuguuguaaaguauuuga

SEQ ID NO: 55495 - RNA, 64 nt, hsa
cuuucuguuuuguuuuuuucuccugcaaauuuaguuuguuaaagccuguuccauaggaaggcug

SEQ ID NO: 55496 - RNA, 64 nt, hsa
guauguguuuguuaaauauucgaaugcauguagauuuguuaaauguguguguauaguaacacug

SEQ ID NO: 55497 - RNA, 64 nt, hsa
ccauaacauccauaugacugaacacuuguauguguuuguuaaauauucgaaugcauguagauuu

SEQ ID NO: 55498 - RNA, 64 nt, hsa
ccaaacacccagcauagccaacuacugaaaugauuuuguuaauucuguauaaugagcucaauuc

SEQ ID NO: 55499 - RNA, 64 nt, hsa
ccuuugcacuuuuuuuuaacuuuuguagauaauuuuuguuaauuuguuuuguuaauuuauguuu

SEQ ID NO: 55500 - RNA, 64 nt, hsa
uuuuaacuuuuguagauaauuuuuguuaauuuguuuuguuaauuuauguuuuuccuaauuuuaa

SEQ ID NO: 55501 - RNA, 64 nt, hsa
aaauuguaauaccuagguaguugguugaucacaguuuguuaauuguauaaaaaaaaauuaccua

SEQ ID NO: 55502 - RNA, 64 nt, hsa
uauacccauuuuauuuauuuagaaaaauaguaucuuuguuaacgacuuacauggucacaguaua

SEQ ID NO: 55503 - RNA, 64 nt, hsa
uuucaaccauaguacgauguuugggguuguauauuuuguuaaaaagauuaaagaauuuaugagu

SEQ ID NO: 55504 - RNA, 64 nt, hsa
uuauauauauauauauauaucuguaaaaauguauuuuguuaauuuuuuuggccaauuuauuuuc

SEQ ID NO: 55505 - RNA, 64 nt, hsa
agcuaacugaauuuguucaguguuuuaaccuguauuuguuaaaaaagaaaaaaaaacacacaua

SEQ ID NO: 55506 - RNA, 64 nt, hsa
uuuucuuuuuuuuuuuuuugaggaaaagcaugaauuuguuaacagauuuugagucucaaccaac

SEQ ID NO: 55507 - RNA, 64 nt, hsa
ucucuuuuuuguuauuguuaugccaccauaccauuuuguuaaaauguuuucuuugugaaacauu

SEQ ID NO: 55508 - RNA, 64 nt, hsa
acagcauagguuuuucauauaaaaauauucugaauuuguuaagcacugccauaauaucauuaua

SEQ ID NO: 55509 - RNA, 64 nt, hsa
aaaauuuuucauuguuuuacuucaaaaguauuguuuuguuaaacccaacguuuaguuuuucuug

SEQ ID NO: 55510 - RNA, 64 nt, hsa
uuaaacccaacguuuaguuuuucuugugauacauuuuguuaaccuguguaaaaggauuaaauuu

SEQ ID NO: 55511 - RNA, 64 nt, hsa
gaaagaguuuaagggcuaauaauuuaauuuguuguuuguuaaaaauuaaaaucuccguucuuuc

SEQ ID NO: 55512 - RNA, 64 nt, hsa
uagauguaugcacagaccugucuguaugcugaacuuuguuaaaaauaucugccaguuauuaaaa

SEQ ID NO: 55513 - RNA, 64 nt, hsa
uuuauacagaaauucuuuguagaaauuacuauuuuuuguuaaagauuguuuauaugcuuacaaa

SEQ ID NO: 55514 - RNA, 64 nt, hsa
ugcacacuucaggcacuguaguugcugaagaugcuuuguuaaaugugaccuugacuggcuuuac

SEQ ID NO: 55515 - RNA, 64 nt, hsa
aaauauuauuaauagcuuauuaaaggaaauggucuuuguuaauuccagucagauaauggcauug

SEQ ID NO: 55516 - RNA, 64 nt, hsa
augucucagauugaccuuaccaaguuggucuuacuuuguuaauuuaucuguuguccccuuccuc

SEQ ID NO: 55517 - RNA, 64 nt, hsa
uaagaaguugcugcagauuccuuuggccacuguauuuguuaauuucuugcaauuugaagguacg

SEQ ID NO: 55518 - RNA, 64 nt, hsa
uuggaguaacaggcuuauuccacuuuccaugggguuuguuaauauuuugcauugacucauacua

SEQ ID NO: 55519 - RNA, 64 nt, hsa
ucuuuaaaaguugcuacagauuugaguucaugauuuuguuaaaaauugcuauggaguacuuugu

SEQ ID NO: 55520 - RNA, 64 nt, hsa
cuguuucaucagcagccuaauauauacuguuaaauuuguuaaggauuucacuuugaaggauaca

SEQ ID NO: 55521 - RNA, 64 nt, hsa
cacauaaucuguaccagguaugcauuaaaauauauuuguuaauuuaauauuuaaaccugagaga

SEQ ID NO: 55522 - RNA, 64 nt, hsa
gccuagauugcuuucuucuuaaccuauuuauuucuuuguuaaauuuuucugauuguuuccuuua

SEQ ID NO: 55523 - RNA, 64 nt, hsa
aaauauauagcacaucaccugggacuuggcaaucuuuguuaaaaaaaaauuuccuuucuaaugg

SEQ ID NO: 55524 - RNA, 64 nt, hsa
uaaaauuccacauguauuaaaauguacaaaauguuuuguuaauaaaauuuaauaauguuuauaa

SEQ ID NO: 55525 - RNA, 64 nt, hsa
aagcauuuuugugagugaccaccuuugcaauauguuuguuaauuuacuucauguuggguucuuu

SEQ ID NO: 55526 - RNA, 64 nt, hsa
guaauaucuaaggucaggcaccuaguaacaggguuuuguuaauucuuuucagaaucauugaagc

SEQ ID NO: 55527 - RNA, 64 nt, hsa
auuuuuaaaagugcuuucuuugaaacacuggaacuuuguuaagcugccuuuuuuuuuuuaacuu

SEQ ID NO: 55528 - RNA, 64 nt, hsa
gcaauguggaguugacuuagcuuggcauuuuagauuuguuaaaacuauuuuuuccauaaauacu

SEQ ID NO: 55529 - RNA, 64 nt, hsa
cauaauagauaaaaaccugaacuuucauuggauuuuuguuaauuuuccucauuuugaauuaugu

SEQ ID NO: 55530 - RNA, 64 nt, hsa
guuucaaucucugacuaaaaauacuuaaauuugguuuguuaauucuuauuuuagaaauuauaau

SEQ ID NO: 55531 - RNA, 64 nt, hsa
cuguuagucggguuagaguuggcucuacgcgagguuuguuaauaaaaguuuguuaaaaguuugu

SEQ ID NO: 55532 - RNA, 64 nt, hsa
agaguuggcucuacgcgagguuuguuaauaaaaguuuguuaaaaguuuguuuugugcaaguguc

SEQ ID NO: 55533 - RNA, 64 nt, hsa
guccuguggacuugcaaauauauauauauauugcuuuguuaauuuguuuuuauauuucauauau

SEQ ID NO: 55534 - RNA, 64 nt, hsa
uaaggaaucccuaacccuacuaucagaaaagguguuuguuaaagagccuucucuuguguguuac

SEQ ID NO: 55535 - RNA, 64 nt, hsa
ugacucuuucaaaugcaaaaaaccuauuuuaugcuuuguuaaaauuauggugucacuuagauug

SEQ ID NO: 55536 - RNA, 64 nt, hsa
uuuuaguuaauauaccaaagcuuaugaauaauuguuuguuaauugaacauuuucaauuauaugc

SEQ ID NO: 55537 - RNA, 64 nt, hsa
aauaagcagauguauguaugcaugguuauacuauuuuguuaacauguacaauuuccugauuuuu

SEQ ID NO: 55538 - RNA, 64 nt, hsa
acagaaaaaauuuuaaauuauuucacauuagccauuuguuaaaacacagcaucauaacucagca

SEQ ID NO: 55539 - RNA, 64 nt, hsa
ccuguaauugucuuuuaaaauacugauauuuuuauuuguuaauaauacuuugcccucagaaaga

SEQ ID NO: 55540 - RNA, 64 nt, hsa
ggcauuuuuacuguuugugaaaguaugaaacagauuuguuaacugaacucuuaauuauguuuuu

SEQ ID NO: 55541 - RNA, 64 nt, hsa
cucaauauauuuguaaccuuaagaagaguauuuuuuuguuaauacuaagauguucaaacuuaga

SEQ ID NO: 55542 - RNA, 64 nt, hsa
uccucauuauguagaauggaaugugaaaauuauuuuuguuaaaacaggauuuugccacaauuau

SEQ ID NO: 55543 - RNA, 64 nt, hsa
acuguuuacuucuucacuuucgaaguauuuggcuuuuguuaauaugcaguuuuacuaaacagau

SEQ ID NO: 55544 - RNA, 64 nt, hsa
acaagguuguagcugugcucaggcuucagcuugguuuguuaaauugagagauaaacaaugacaa

SEQ ID NO: 55545 - RNA, 64 nt, hsa
gauuaaaggggaagcauguaaacagcuaacuguuuuuguuaaagauuuauaggaaugaggaggu

SEQ ID NO: 55546 - RNA, 64 nt, hsa
guuuccuaaacuauaaaagcagauuuugcuuuuguuuguuaaucauaggcauggccgagcauug

SEQ ID NO: 55547 - RNA, 64 nt, hsa
cauuguuuuccuccauccugcaaaagaagaucccuuuguuaagcagcucacuuggaaauaugau

SEQ ID NO: 55548 - RNA, 64 nt, hsa
aaaaguucugaguuucuuguuucuacuugucaguuuuguuaaaggugauugaauauaaguaacc

SEQ ID NO: 55549 - RNA, 64 nt, hsa
uuuuucuguccgcaacacuggcucccgagcagcuuuuguuaaagcaguagguuuuaaggauucu

SEQ ID NO: 55550 - RNA, 64 nt, hsa
aaugccuguuuugaugaguugauuuauaaagauuuuuguuaagcucaggauuuuaaauuacaca

SEQ ID NO: 55551 - RNA, 64 nt, hsa
uuauaaugcaaauuagggcuacauuguaaucugcuuuguuaaugaaaaugauaaaacagaauau

SEQ ID NO: 55552 - RNA, 64 nt, hsa
aaucuuuaaaauaacagaauucagugcucuuucauuuguuaaugcuguccagauuuuucacaca

SEQ ID NO: 55553 - RNA, 64 nt, hsa
uuguggaaagaauguaaaauguuuuaauauauucuuuguuaaucugagaacuugauacugaauc

SEQ ID NO: 55554 - RNA, 64 nt, hsa
auugcacugcaguuauuuaccagaaguuuaaaucuuuguuaaaauauaguguuguguuacaaua

SEQ ID NO: 55555 - RNA, 64 nt, hsa
agcaauaaguugaaugauaauagcucacagcacauuuguuaaugauucuugugucaucaaguag

SEQ ID NO: 55556 - RNA, 64 nt, hsa
cugcauuuauaauuuugugacugaggaucguuuguuuguuaacguacugugacuuuaacuuuag

SEQ ID NO: 55557 - RNA, 64 nt, hsa
uuuuaaguaggugcacuugacaguauugaggucauuuguuaaggugcuauuucaauuaguguag

SEQ ID NO: 55558 - RNA, 64 nt, hsa
ugugaaaacucaccaaaaugaauaguuguuucguuacauuuagaugaaaguuaaacuuuacuga

SEQ ID NO: 55559 - RNA, 64 nt, hsa
uuugacauuuuggaaauuuuuuuaauuuuacaaguacauuuaacagaucauuuauaaagcagga

SEQ ID NO: 55560 - RNA, 64 nt, hsa
uuucucaggaucuauccuagccaaauaucucaguuacauuuaccauacaguuuccuuugugaaa

SEQ ID NO: 55561 - RNA, 64 nt, hsa
cucccacucagcagagugcccaagggacauaccuuacauuuagcauguagaauuccagauuaca

SEQ ID NO: 55562 - RNA, 64 nt, hsa
aauguggcagccaaagagaacaauccagggaaccuacauuuauuuuuaaggacaaauauuuccu

SEQ ID NO: 55563 - RNA, 64 nt, hsa
ggggguugggguugggagugguuaguacauuuauuacauuuauuaagaaacguaaugacauaaa

SEQ ID NO: 55564 - RNA, 64 nt, hsa
cucuacacuggggguugggguugggagugguuaguacauuuauuacauuuauuaagaaacguaa

SEQ ID NO: 55565 - RNA, 64 nt, hsa
ugcgcggaugaggggagguggcaggagagaauucuacauuuaggggguuaggcugaaaaguguu

SEQ ID NO: 55566 - RNA, 64 nt, hsa
cccucaacauguagacuaaugcagccauuggugguacauuuauuuuagccacggauaauugaac

SEQ ID NO: 55567 - RNA, 64 nt, hsa
aauggcuuuuguucucaaaugauaagagagcuaauacauuuagcuaauauucuagcucucuuua

SEQ ID NO: 55568 - RNA, 64 nt, hsa
aacuaguaugcuacauuugaagcacucugacauguacauuuaaagugacaguuuuaaaaguaaa

SEQ ID NO: 55569 - RNA, 64 nt, hsa
auacuucuacauuugagaaggguuuuuuuagaaauacauuuaguaaaguccccaagacauuagu

SEQ ID NO: 55570 - RNA, 64 nt, hsa
aauacauuuaguaaaguccccaagacauuagucuuacauuuaaacuuuuuucuuuaaaacaugg

SEQ ID NO: 55571 - RNA, 64 nt, hsa
uccucuggacauaagacauaacaguaacacgauguacauuuacaagcggccuuauguacauuuc

SEQ ID NO: 55572 - RNA, 64 nt, hsa
uuuuaucucuuugggauacauuugcauuuuaguguacauuuacgucccugcccucuuugaccug

SEQ ID NO: 55573 - RNA, 64 nt, hsa
aguauuauuuuaggucauaaagguuauaacaaaauacauuuaacauugcuuucuuuuuagcaag

SEQ ID NO: 55574 - RNA, 64 nt, hsa
aaauugacccuucguugacuaucaguacuguugauacauuuauuagaauguaugucucagaaga

SEQ ID NO: 55575 - RNA, 64 nt, hsa
uugauggcaccuugaaagugaacuucuagaaaucuacauuuaaaaggcaaagcuuuaaaagcag

SEQ ID NO: 55576 - RNA, 64 nt, hsa
gacuaaaggaaacccaggaauauuuaccugguguuacauuuaauauuuaauguaacuggucuag

SEQ ID NO: 55577 - RNA, 64 nt, hsa
gaaauccacugcacacuguugccuauacacuuuguacauuuaauugauauuugugcugagguga

SEQ ID NO: 55578 - RNA, 64 nt, hsa
uauuuuucuuguuaaaauguaguuuuucauuuccuacauuuauuagauuuucauuuucuauuaa

SEQ ID NO: 55579 - RNA, 64 nt, hsa
guaaaaauaauaauuuuuauauuuaauuauuaacuacauuuaugaguaacuauuauuauaggua

SEQ ID NO: 55580 - RNA, 64 nt, hsa
ccaccguuacaaguauacuuauauuucccuaaaauacauuuaaaacuuaccuaagugacauuug

SEQ ID NO: 55581 - RNA, 64 nt, hsa
uacuauaaaaugcaguaacauucuacuugcuuauuacauuuaaauccuuguguaacugaauguu

SEQ ID NO: 55582 - RNA, 64 nt, hsa
auguuuauggugagguuuaaaggauaugaaacucuacauuuaaacaaguauuuuauauuugggu

SEQ ID NO: 55583 - RNA, 64 nt, hsa
cuugcauuuaauacauuuauacauaauacauuuguacauuuaauucauaacgucucuuggucac

SEQ ID NO: 55584 - RNA, 64 nt, hsa
gacauuggugucauuauaugaagcuugcauuuaauacauuuauacauaauacauuuguacauuu

SEQ ID NO: 55585 - RNA, 64 nt, hsa
acccaacaggucaaaauaaaaguugaacuugaguuacauuuaauuuaaauauaaaugcauuuug

SEQ ID NO: 55586 - RNA, 64 nt, hsa
ucaaccucugaaaaaagguuuuuccaggaagauuuacauuuagguuuaauauuuuuuuaguuag

SEQ ID NO: 55587 - RNA, 64 nt, hsa
ugaaaaaugcuuuuuaguacuuuuucauauuuuauacauuuauuuuccgaauguaucauugaau

SEQ ID NO: 55588 - RNA, 64 nt, hsa
agaguuccacgguuuguuuacacauuuccuguuguacauuuagguuauucaaaguuuucagcuc

SEQ ID NO: 55589 - RNA, 64 nt, hsa
agcaaaagguaaaauuugcaggcugcuucaggauuacauuuaaauaacuguuaaaauguuguau

SEQ ID NO: 55590 - RNA, 64 nt, hsa
gcaguuuuugaccaagaaucagaagcccaagggguacauuuauugcuuuaaucugcacucauug

SEQ ID NO: 55591 - RNA, 64 nt, hsa
uaaaacuguuuaaugugaugugaauacauuuauguacauuuauuuuuaaauuuguaaauagcuu

SEQ ID NO: 55592 - RNA, 64 nt, hsa
uguaauauuuuaaaacuguuuaaugugaugugaauacauuuauguacauuuauuuuuaaauuug

SEQ ID NO: 55593 - RNA, 64 nt, hsa
cuaauuaaaauauauaagcuuaaauuuuauaucuuacauuuaaaauauuaagauuccuuugacu

SEQ ID NO: 55594 - RNA, 64 nt, hsa
uccaguaugcauauuuuuuucuccucuagauucauacauuuauauagcauugaaacacuuucaa

SEQ ID NO: 55595 - RNA, 64 nt, hsa
gaguggcucuuucacuggcaauucucaaaugauauacauuuaaagggcagauuuuuuaaaaaga

SEQ ID NO: 55596 - RNA, 64 nt, hsa
auuuucuagauacacagucuaugcauuauucauauacauuuauuuuagccuaaagugguuuuca

SEQ ID NO: 55597 - RNA, 64 nt, hsa
gauaugugaaucucuucucccuuugaagaaacuauacauuuauuguuacgguaugaagucuucu

SEQ ID NO: 55598 - RNA, 64 nt, hsa
ucugauuuuaaaacuuacaauuggcacuaaagaauacauuuaauuauuuccuauguuagcuguu

SEQ ID NO: 55599 - RNA, 64 nt, hsa
aaaggcaugucuaucauguggaugcaguaacauuuacauuuaguuuuugaucguaguuuuauau

SEQ ID NO: 55600 - RNA, 64 nt, hsa
cuuuuuaaaaacuacaaaguagcauaauuuguucuacauuuauuugaaaaguaaguaauuuuaa

SEQ ID NO: 55601 - RNA, 64 nt, hsa
cauacauggaguauggaggaaauuuucugaaaaauacauuuagauuaguuuaguuugaaggaga

SEQ ID NO: 55602 - RNA, 64 nt, hsa
aaaaauagcucagauguccuaaugaacaugcaccuacauuuaauaggaguacaauaaaacuguu

SEQ ID NO: 55603 - RNA, 64 nt, hsa
aaucaugcccagcuucugucauaugaaugagauauacauuuauucaaggaacagcaaugucaac

SEQ ID NO: 55604 - RNA, 64 nt, hsa
ugugccccagcacaagaggcacugguguucggucuacauuuaguucuccccacucugauccccu

SEQ ID NO: 55605 - RNA, 64 nt, hsa
acacauaaaagccacugcuuuuaacaucccauuguacauuuaacacauaaaugguguuaacauc

SEQ ID NO: 55606 - RNA, 64 nt, hsa
cauuuaacacauaaaugguguuaacaucccauuguacauuuaacacauaaauggccauugucuu

SEQ ID NO: 55607 - RNA, 64 nt, hsa
auuucauucaguuuuuggagcucaguuaagccaauacauuuaaaguuuugcaugaggaacacug

SEQ ID NO: 55608 - RNA, 64 nt, hsa
ucuugcuucuaaaacauauuucauguaaacauuguacauuuauuauuguaauauauacuauuau

SEQ ID NO: 55609 - RNA, 64 nt, hsa
uauauagaaaauguaauacaauuuauuuaguacauacauuuauuauuuuaaugagaaugccuca

SEQ ID NO: 55610 - RNA, 64 nt, hsa
agugacuuuuuaacuuguaaauuguagcugauuuuacauuuaucuuccugaaggaaacucugua

SEQ ID NO: 55611 - RNA, 64 nt, hsa
agaaacacauuggcucugucagcauuuguaauuguacauuuauucaucagguauuuauagugaa

SEQ ID NO: 55612 - RNA, 64 nt, hsa
aaaacauaacaacaaugaccaccauugucuuugauacauuuauuuuaauucuuaaguggccaaa

SEQ ID NO: 55613 - RNA, 64 nt, hsa
aaguuaugacaucuguccuaauuaguuucuuaaauacauuuacuacuuaaugguuuugaagcaa

SEQ ID NO: 55614 - RNA, 64 nt, hsa
aucuggauauauuuugcauucauuuuccaacgccuacauuuaauuccugguaagagcagugcuc

SEQ ID NO: 55615 - RNA, 64 nt, hsa
aaaguugcauccagaaggguuuuguuagaaugaauacauuuauauuaggacugacaacuucagc

SEQ ID NO: 55616 - RNA, 64 nt, hsa
gccuuuuuaaaaagacauuugccugcuagucagauacauuuacauuuaugcaaauuuuuuaaau

SEQ ID NO: 55617 - RNA, 64 nt, hsa
uuaaaaagacauuugccugcuagucagauacauuuacauuuaugcaaauuuuuuaaauaggaga

SEQ ID NO: 55618 - RNA, 64 nt, hsa
gcacuuuaaaucuguuuugaaauuagaacugauauacauuuauuugaauaauguguaacuauua

SEQ ID NO: 55619 - RNA, 64 nt, hsa
uucucugucuuuaguauuuuuugcuggugcuucuuacauuuaauauggaaaggugggaagaaua

SEQ ID NO: 55620 - RNA, 64 nt, hsa
aauaaauauauaauuuuuuacaaauguaaaauuuuacauuuaagcauuuguaaaguuacagcaa

SEQ ID NO: 55621 - RNA, 64 nt, hsa
uucaugucugccauaacaugcauguuucuuccuguacauuuauuugagaaaacacuggauuuaa

SEQ ID NO: 55622 - RNA, 64 nt, hsa
aacuagauuuuauggcuuuaguucacugugauuguacauuuauacuuggccuaugugcuggccg

SEQ ID NO: 55623 - RNA, 64 nt, hsa
gucaccugccuuaauguagguaggcccagagucuuacauuuaagaucuuacaugcaguuauaaa

SEQ ID NO: 55624 - RNA, 64 nt, hsa
uuucuguucuuuuuuuuuuuuuuuuucuauccuguacauuuaguugaacugugcggaauugugg

SEQ ID NO: 55625 - RNA, 64 nt, hsa
uaaacugugagccaccuuuucuucuuuauauuguuacauuuaaguguucuugcuuucagcaacu

SEQ ID NO: 55626 - RNA, 64 nt, hsa
aguaguaacuuaauauguaaaguuguaacauacauacauuuaaaauggaaaugcagaaagcugu

SEQ ID NO: 55627 - RNA, 64 nt, hsa
aagggaaugaaacauuuauggccucaagauacuauacauuuaaagcaccccaaugucucucuuu

SEQ ID NO: 55628 - RNA, 64 nt, hsa
aaacccucaaauuggugcuuucauuauauaaugauacauuuagacaaaaccccaaacuaagcca

SEQ ID NO: 55629 - RNA, 64 nt, hsa
uaacauuuggacuauucauuggagaguuuacccauacauuuagcaaauugaauggccaaaacau

SEQ ID NO: 55630 - RNA, 64 nt, hsa
aauaaauugugaucaauaauaguaccuuugauuauacauuuauuauugugucucucucugaugu

SEQ ID NO: 55631 - RNA, 64 nt, hsa
auuauugugucucucucugauguacuguggauuguacauuuaacuuuggaauggcuuuguaaua

SEQ ID NO: 55632 - RNA, 64 nt, hsa
gcuuuuuaacuauccagucaacuuucagcuuuucuacauuuagguaaaaugguuaggauauaac

SEQ ID NO: 55633 - RNA, 64 nt, hsa
aaugguuaggauauaacucaugguguggcuaaucuacauuuaucaauaaaauguaaauuaucug

SEQ ID NO: 55634 - RNA, 64 nt, hsa
auauauuuuaaaaagcacuuugcaaaauaguuuguacauuuauuuccuaauuuauacaugauuu

SEQ ID NO: 55635 - RNA, 64 nt, hsa
caggucaaauuugucuuguuauuugugaguacaguacauuuaaaaaacauccuuaucgguuauu

SEQ ID NO: 55636 - RNA, 64 nt, hsa
auucucauuaggaaguuaaauguagauucacagauacauuuacuuucagaauccucaagaggau

SEQ ID NO: 55637 - RNA, 64 nt, hsa
gaguaacaagaaguaaaauacauguuuguauaucuacauuuacauucugcgccccagagcuaag

SEQ ID NO: 55638 - RNA, 64 nt, hsa
uuugcuuaaacucucuaauucccaauuucugaguuacauuuagauaucauauuaauuaucauau

SEQ ID NO: 55639 - RNA, 64 nt, hsa
ugaguuacauuuagauaucauauuaauuaucauauacauuuacuucaacauaaaauacuguguu

SEQ ID NO: 55640 - RNA, 64 nt, hsa
uauacaguccuaguguuugccuucuugguaaaauuacauuuaaggaugucauuucaugagucaa

SEQ ID NO: 55641 - RNA, 64 nt, hsa
auuauaauauaaauuaccauuguuuguggaggauuacauuuaaaaaagcaaaaagugaaaaaaa

SEQ ID NO: 55642 - RNA, 63 nt, hsa
aaaucucuccacuuucagcugucuuuuggaggacguacguaauaagguuuuaauuuaguaaac

SEQ ID NO: 55643 - RNA, 63 nt, hsa
uuugaguguaugcuguagcugaaagaguauguacguacguauaagacuagagagauauuaagu

SEQ ID NO: 55644 - RNA, 63 nt, hsa
cccauuggcgccgcccuacuggggaagccgguccguacguaggccuugcaucucgccaccucc

SEQ ID NO: 55645 - RNA, 63 nt, hsa
ugugaacuuuaugguaacuucuacucuagaauacguacguaugcacccacagacacacacagu

SEQ ID NO: 55646 - RNA, 63 nt, hsa
ucuccuuuggaagugaggcauugcacagggagacguacguaucagcggccccuugacucuggg

SEQ ID NO: 55647 - RNA, 64 nt, hsa
cagcuacuugggaggcugaggugggaggauugcuugaacccaagaggucgaggcugcagugagc

SEQ ID NO: 55648 - RNA, 64 nt, hsa
ccauaaucccaacacuuuggcucagcagauugcuugaacccaggaauucaaguccaaucugggc

SEQ ID NO: 55649 - RNA, 64 nt, hsa
aacauaagauccucucucuauauuucauuauuggugaacccacauugugcuguguuuugugaua

SEQ ID NO: 55650 - RNA, 64 nt, hsa
ucuagauucuuauguggaucuaauaacgaccacuugaacccaguuucacagaauccuuauuuuu

SEQ ID NO: 55651 - RNA, 64 nt, hsa
uuuuucuagaagguaaagccuaguuugcugacauugaacccaaauuugauagacugcuguuuuu

SEQ ID NO: 55652 - RNA, 64 nt, hsa
auacuaagagggggaggaaaggcuguucugugucugaacccaguugggcuaguccccaagagga

SEQ ID NO: 55653 - RNA, 64 nt, hsa
gggauaguuuacacccgggcagcagcaccacacaugaacccaaagacauguucuuuuuaaagcu

SEQ ID NO: 55654 - RNA, 64 nt, hsa
cuuuucuuguaugccuugggaaagccaguugcccugaacccagcagacaccauggaauguccuu

SEQ ID NO: 55655 - RNA, 64 nt, hsa
cacuuuugcuucuggggcuggcaaaaaccuucucugaacccacacaccaaguucguaguuggua

SEQ ID NO: 55656 - RNA, 64 nt, hsa
uaauguucaucucuuuuccacugcccauccucugugaacccauaccucucuagauggagcaggu

SEQ ID NO: 55657 - RNA, 64 nt, hsa
cagcuacucgggcagcugagacaggagaaucacuugaacccaggaggcagagguugcagugagc

SEQ ID NO: 55658 - RNA, 64 nt, hsa
aacuuuauagugaauagaugagacugacaacgucugaacccacucaucaucucaacuucacaaa

SEQ ID NO: 55659 - RNA, 64 nt, hsa
cagcuacucugaagacugaggcaggagaauggcgugaacccaggaggcggagcuugcagugagc

SEQ ID NO: 55660 - RNA, 64 nt, hsa
ccucccuuccauaauggaucguggucugugugacugaacccacacagagugucaugggugacag

SEQ ID NO: 55661 - RNA, 64 nt, hsa
gcuuccugcuccacucagcuccguccagucaaccugaacccacccaguccagcugucuguggga

SEQ ID NO: 55662 - RNA, 64 nt, hsa
cagcuacucugcaggcugaggugggaggauugcuugaacccaggaggucgaggcugcagugagc

SEQ ID NO: 55663 - RNA, 64 nt, hsa
uuuucucucacccuggcuuugucaagucuacugcugaacccauugaaggcauucuucaacucag

SEQ ID NO: 55664 - RNA, 64 nt, hsa
gaggcuugcccacuuuugcagcucuuuggaauccugaacccauguguggaaaagccugaacugu

SEQ ID NO: 55665 - RNA, 64 nt, hsa
ccagccagggcaugaaacaucaaccccccacaugugaacccaucauuccuaaacccuggguagg

SEQ ID NO: 55666 - RNA, 64 nt, hsa
ccugagcccaccucccagcccucuccucauucucugaacccacuguggugagaagaauuugcuc

SEQ ID NO: 55667 - RNA, 62 nt, hsa
agggcaagggggccaucacugcagucaggcccucagaggaguccugcaggcuuccuaccagu

SEQ ID NO: 55668 - RNA, 62 nt, hsa
cacucucgcauacuuugccaaaugaggccugcucagaggaguaggagcugaaagauggugcc

SEQ ID NO: 55669 - RNA, 62 nt, hsa
gagacuggcagccagggagcccggggcagagcucagaggagucugggaaggggcgugucccu

SEQ ID NO: 55670 - RNA, 62 nt, hsa
ccaagaggcuagccccagggugagcagggcccucagaggaaaggcaguauggcggaggccau

SEQ ID NO: 55671 - RNA, 62 nt, hsa
aggggauccugaugccacuuagcagugggauuucagaggaccuuucagaggagcuaagguaa

SEQ ID NO: 55672 - RNA, 62 nt, hsa
ugccacuuagcagugggauuucagaggaccuuucagaggagcuaagguaagaugagauggag

SEQ ID NO: 55673 - RNA, 62 nt, hsa
agaucagugaucuugggucauugaucccuggcucagaggauagcgguuuccaucauaaacca

SEQ ID NO: 55674 - RNA, 62 nt, hsa
cuggcauucgagacuuccuccuguucccugggucagaggauagcgguuuccaucauaaacca

SEQ ID NO: 55675 - RNA, 62 nt, hsa
gggguucccaaggcacccugugccugcuucccucagaggaccuuccaauccauuugccccgc

SEQ ID NO: 55676 - RNA, 62 nt, hsa
guucucuccuagccucagcccccagcugggucucagaggagcugggggagcgguggccagcc

SEQ ID NO: 55677 - RNA, 62 nt, hsa
cucugggacuccugagaugggagaggcagggaucagaggacgaacaggugggacuuugcgag

SEQ ID NO: 55678 - RNA, 62 nt, hsa
aagauaccagcuuuuucucucaggguucugagucagaggacaccauccaagaauguuguuag

SEQ ID NO: 55679 - RNA, 62 nt, hsa
agugaaugugccuuaaaaaucaagacacuaguucagaggaagcacauaauguccagaucuau

SEQ ID NO: 55680 - RNA, 62 nt, hsa
ugaggagugagggaacccuggggcucacccucucagaggaagggcacagagaggaagggaag

SEQ ID NO: 55681 - RNA, 62 nt, hsa
cgaauucccuguggccugccaugccuucggcaucagaggauggaguggucgaggcuagugga

SEQ ID NO: 55682 - RNA, 62 nt, hsa
gagugaacuucuuaugggaggcugcagcuggaucagaggaaaaauccagugugacagagugc

SEQ ID NO: 55683 - RNA, 62 nt, hsa
agacaguaacuucuaaggucacguuuacuauuucagaggaaauaucuugccaggauaccuac

SEQ ID NO: 55684 - RNA, 62 nt, hsa
acauaggccugcucagccucuagcaccaggacucagaggaugaggucaauuuccugaugcau

SEQ ID NO: 55685 - RNA, 62 nt, hsa
aauaccagggcuugugccccgcuauuccucacucagaggaagacuuugauccaggugccaag

SEQ ID NO: 55686 - RNA, 62 nt, hsa
caggcaacagugugggauaaacagagucacgaucagaggaaccccagggucuggugauggca

SEQ ID NO: 55687 - RNA, 62 nt, hsa
uauauauauauauauaaauaauauacuuuuccucagaggagcaggcaacagugugggauaaa

SEQ ID NO: 55688 - RNA, 62 nt, hsa
ccaaaucccaucucaauuuuaauccccaugugucagaggagggccuuggugggagaugacug

SEQ ID NO: 55689 - RNA, 62 nt, hsa
cuguuuuaucuugcagguaagcuuuacagcuuucagaggaguuguaguacacuacagaaaua

SEQ ID NO: 55690 - RNA, 62 nt, hsa
caggagagggauauggagagcaggugguggaaucagaggacgaggcugcucuaaagacuguu

SEQ ID NO: 55691 - RNA, 62 nt, hsa
gaacagcuggcccaggagcuaccacuggcuacucagaggaggcucauuagcuggcuacaugc

SEQ ID NO: 55692 - RNA, 62 nt, hsa
cgaggaugcccagugagagcuucuagcugaucucagaggaccagagugacugaggguaaagu

SEQ ID NO: 55693 - RNA, 62 nt, hsa
ucuucugcagguccagcccuggcgagggcaggucagaggaagugaagaaaucaagagcaaag

SEQ ID NO: 55694 - RNA, 62 nt, hsa
aacugccuuguaaacaaaaaugagagcuugagucagaggaagccgagacaauauccuuccuc

SEQ ID NO: 55695 - RNA, 62 nt, hsa
gcacugugguugcugugguuggaauucuucuuucagaggagcgccuggggcuccugcaaguc

SEQ ID NO: 55696 - RNA, 64 nt, hsa
gaauguaguggaaauuuauugauugagacacagaaauccugauuagugauaggccugucuucug

SEQ ID NO: 55697 - RNA, 64 nt, hsa
uuuggaagcgucaguggauauauuugaaagugguaauccugaaucucuuuuaaacuauuauaug

SEQ ID NO: 55698 - RNA, 64 nt, hsa
ucuaccaagcguuuucauggaugcuaugagagacaauccugaagcugcuguacauauuuuugaa

SEQ ID NO: 55699 - RNA, 64 nt, hsa
agcugcuguacauauuuuugaaggaacucaugaaaauccugaguuaauuuggaaugauaauucc

SEQ ID NO: 55700 - RNA, 64 nt, hsa
uccuaacauuuugaaguuucuguaguucauccuuaauccugacacccauguaaauguccaaaau

SEQ ID NO: 55701 - RNA, 64 nt, hsa
caagcuuucucucauaacguaaugauuauaugacaauccugaagaaaccacagguuccauagaa

SEQ ID NO: 55702 - RNA, 64 nt, hsa
caucaacugaucucauuucuagagagccccugacaauccugaggcuucaucaggagcuagagcc

SEQ ID NO: 55703 - RNA, 64 nt, hsa
cuuguuaugguuguuuggaccgauaagugugcuuaauccugaggcaaaguagugaauauguuuu

SEQ ID NO: 55704 - RNA, 64 nt, hsa
uccucaaaacuguaaaaaucauggaaaauaagggaauccugagaaacaaucacagaccacauga

SEQ ID NO: 55705 - RNA, 64 nt, hsa
cucacaauugaguugaagcuguuccuccuaaaacaauccugacuuuuauuuugccaaaaucaau

SEQ ID NO: 55706 - RNA, 64 nt, hsa
accuucaugggcccagaagauuauguacugagagaauccugaagaauggaacagcuguagaaag

SEQ ID NO: 55707 - RNA, 64 nt, hsa
cuuauuuccuauuguguuggucucacaacacaccaauccugauacaaugugagagacugcagaa

SEQ ID NO: 55708 - RNA, 64 nt, hsa
uuaagcaggcuuuaaaugucaccugcuaccuuagagugugaaggugaugguaacugccacagca

SEQ ID NO: 55709 - RNA, 64 nt, hsa
uuuagucaagugacuuuacuaaucaguuguucuaagugugaauauggcaugcuaauuagcuaau

SEQ ID NO: 55710 - RNA, 64 nt, hsa
auuucuacacugauugcacugaggauuucuccccagugugaaguuucuggcauagaguccuggc

SEQ ID NO: 55711 - RNA, 64 nt, hsa
uuuccugcauuugcuguuuucucaugucucucccagugugaauucuuuggugugcagugcgcuc

SEQ ID NO: 55712 - RNA, 64 nt, hsa
aaagacuggggagagcugugugccucaguguugcagugugaauuccuaaauagaggguaaagug

SEQ ID NO: 55713 - RNA, 64 nt, hsa
auggggaauguggggaucagggagguggagggacagugugaauaaauggcaucuaggaagguaa

SEQ ID NO: 55714 - RNA, 64 nt, hsa
uuguuaaauguucagcaggagaacgccaccgccuagugugaaugcuaggucagaagcugcuuuu

SEQ ID NO: 55715 - RNA, 64 nt, hsa
uuuauuaauacuucccuaggauauccuguguuugagugugaaguuaauaucacacaaagcaugu

SEQ ID NO: 55716 - RNA, 64 nt, hsa
gccucaacagcugcccuugaggagcacaggcagaagugugaacuugugaauguaauugaucuuu

SEQ ID NO: 55717 - RNA, 64 nt, hsa
ucaagcagcuuucucuggaaaaugaaugcuaauuagugugaaccaaaagaguaaguaagagucu

SEQ ID NO: 55718 - RNA, 64 nt, hsa
gucucuguaccuuacaacagcgauucaggacccaagugugaacaacacucagcccgcccucugg

SEQ ID NO: 55719 - RNA, 64 nt, hsa
ggcuuucucgguucucagaggaaaaguaugaaugagugugaaguguaugugagaacuuuuguuu

SEQ ID NO: 55720 - RNA, 64 nt, hsa
gcacauaccaugcggauuuuauauguacaucaguagugugaauccacuggcacaguguguguaa

SEQ ID NO: 55721 - RNA, 64 nt, hsa
ugcaaguaggguccuauuauguuuuuuuuucaguagugugaauuaauccuuuugugcuguguuu

SEQ ID NO: 55722 - RNA, 64 nt, hsa
cugaggccagggacgucacccaaggcugguggucagugugaagggcuccgugccaacuggucag

SEQ ID NO: 55723 - RNA, 64 nt, hsa
agccgagaguucgccccaacccuuccccaggcccagugugaaaaacagacucacaaggggcuuc

SEQ ID NO: 55724 - RNA, 64 nt, hsa
ccuggucugaucagugcuaugagauggacagauaagugugaauguuuuauacagaaaauggaaa

SEQ ID NO: 55725 - RNA, 64 nt, hsa
uaaaaaaaaaaaaaaaacuucauuggcuuguccgagugugaaaugcacauuuaggaagguuaca

SEQ ID NO: 55726 - RNA, 64 nt, hsa
cuaaaauaggaguaaagcaugcacuacuuguugaagugugaaauggagacucuggacuuugggu

SEQ ID NO: 55727 - RNA, 64 nt, hsa
auguaucuuugcacucuugugcuaguaugucuauagugugaauacauucauaaauuucuugauc

SEQ ID NO: 55728 - RNA, 64 nt, hsa
cauaagaacauucauacugaagaggaacccuaugagugugaagaauauggcaaagccuucaaca

SEQ ID NO: 55729 - RNA, 64 nt, hsa
gguaagauaguucauacugaagaaaacuucuacaagugugaacaguguggcaaaacuuuuaaug

SEQ ID NO: 55730 - RNA, 64 nt, hsa
uuuuuaucuuggggaccagcuaagucucugcaguagugugaaauuccaaaugguuguuuuauca

SEQ ID NO: 55731 - RNA, 64 nt, hsa
cccaacuucugagucgcccaucuguugcugugggagugugaacggaucgcugaaggagagggag

SEQ ID NO: 55732 - RNA, 64 nt, hsa
caguugugugcaauagacaggggcguauucaugggagcaucagccaguuucuaaaacccacagg

SEQ ID NO: 55733 - RNA, 64 nt, hsa
ccgagaugcugacguugcugagcaacgagauggugagcaucagugcaaaugcaccauucagcac

SEQ ID NO: 55734 - RNA, 64 nt, hsa
aaaaugaaccugcaagccuucuaaaugagucacugagcaucacuagugacaagucucgggugag

SEQ ID NO: 55735 - RNA, 64 nt, hsa
agucuuuucaguuucaucauuugcacaaacuugugagcaucagagggcugauggauuccaaacc

SEQ ID NO: 55736 - RNA, 64 nt, hsa
agagucaaaggcaucucccuucauuagcugcucugagcaucaagaauuagaagucuuucagugg

SEQ ID NO: 55737 - RNA, 64 nt, hsa
cauccccacuagguucuuuuccauugucaauaaggagcaucagccagugaaucuguuucagguu

SEQ ID NO: 55738 - RNA, 64 nt, hsa; identical to SEQ ID NO: 24993

SEQ ID NO: 55739 - RNA, 64 nt, hsa; identical to SEQ ID NO: 24994

SEQ ID NO: 55740 - RNA, 64 nt, hsa; identical to SEQ ID NO: 24995

SEQ ID NO: 55741 - RNA, 64 nt, hsa; identical to SEQ ID NO: 24996

SEQ ID NO: 55742 - RNA, 64 nt, hsa; identical to SEQ ID NO: 24997

SEQ ID NO: 55743 - RNA, 64 nt, hsa; identical to SEQ ID NO: 24998

SEQ ID NO: 55744 - RNA, 64 nt, hsa; identical to SEQ ID NO: 24999

SEQ ID NO: 55745 - RNA, 64 nt, hsa; identical to SEQ ID NO: 25000

SEQ ID NO: 55746 - RNA, 64 nt, hsa; identical to SEQ ID NO: 25001

SEQ ID NO: 55747 - RNA, 64 nt, hsa; identical to SEQ ID NO: 25002

SEQ ID NO: 55748 - RNA, 64 nt, hsa; identical to SEQ ID NO: 25003

SEQ ID NO: 55749 - RNA, 64 nt, hsa; identical to SEQ ID NO: 25004

SEQ ID NO: 55750 - RNA, 64 nt, hsa; identical to SEQ ID NO: 25005

SEQ ID NO: 55751 - RNA, 64 nt, hsa; identical to SEQ ID NO: 25006

SEQ ID NO: 55752 - RNA, 64 nt, hsa; identical to SEQ ID NO: 25007

SEQ ID NO: 55753 - RNA, 64 nt, hsa; identical to SEQ ID NO: 25008

SEQ ID NO: 55754 - RNA, 64 nt, hsa; identical to SEQ ID NO: 25009

SEQ ID NO: 55755 - RNA, 64 nt, hsa; identical to SEQ ID NO: 25010

SEQ ID NO: 55756 - RNA, 64 nt, hsa; identical to SEQ ID NO: 25011

SEQ ID NO: 55757 - RNA, 64 nt, hsa; identical to SEQ ID NO: 25012

SEQ ID NO: 55758 - RNA, 64 nt, hsa; identical to SEQ ID NO: 25013

SEQ ID NO: 55759 - RNA, 64 nt, hsa; identical to SEQ ID NO: 25014

SEQ ID NO: 55760 - RNA, 64 nt, hsa; identical to SEQ ID NO: 25015

SEQ ID NO: 55761 - RNA, 64 nt, hsa; identical to SEQ ID NO: 25016

SEQ ID NO: 55762 - RNA, 64 nt, hsa; identical to SEQ ID NO: 25017

SEQ ID NO: 55763 - RNA, 64 nt, hsa; identical to SEQ ID NO: 25018

SEQ ID NO: 55764 - RNA, 64 nt, hsa; identical to SEQ ID NO: 25019

SEQ ID NO: 55765 - RNA, 64 nt, hsa; identical to SEQ ID NO: 25020

SEQ ID NO: 55766 - RNA, 64 nt, hsa; identical to SEQ ID NO: 25021

SEQ ID NO: 55767 - RNA, 64 nt, hsa; identical to SEQ ID NO: 25022

SEQ ID NO: 55768 - RNA, 64 nt, hsa; identical to SEQ ID NO: 25023

SEQ ID NO: 55769 - RNA, 64 nt, hsa; identical to SEQ ID NO: 25024

SEQ ID NO: 55770 - RNA, 64 nt, hsa; identical to SEQ ID NO: 25025

SEQ ID NO: 55771 - RNA, 64 nt, hsa; identical to SEQ ID NO: 25026

SEQ ID NO: 55772 - RNA, 64 nt, hsa; identical to SEQ ID NO: 25027

SEQ ID NO: 55773 - RNA, 64 nt, hsa; identical to SEQ ID NO: 25028

SEQ ID NO: 55774 - RNA, 64 nt, hsa; identical to SEQ ID NO: 25029

SEQ ID NO: 55775 - RNA, 64 nt, hsa; identical to SEQ ID NO: 25030

SEQ ID NO: 55776 - RNA, 64 nt, hsa; identical to SEQ ID NO: 25031

SEQ ID NO: 55777 - RNA, 64 nt, hsa; identical to SEQ ID NO: 25032

SEQ ID NO: 55778 - RNA, 64 nt, hsa; identical to SEQ ID NO: 25033

SEQ ID NO: 55779 - RNA, 64 nt, hsa; identical to SEQ ID NO: 25034

SEQ ID NO: 55780 - RNA, 64 nt, hsa; identical to SEQ ID NO: 25035

SEQ ID NO: 55781 - RNA, 64 nt, hsa; identical to SEQ ID NO: 25036

SEQ ID NO: 55782 - RNA, 64 nt, hsa; identical to SEQ ID NO: 25037

SEQ ID NO: 55783 - RNA, 64 nt, hsa; identical to SEQ ID NO: 25038

SEQ ID NO: 55784 - RNA, 64 nt, hsa; identical to SEQ ID NO: 25039

SEQ ID NO: 55785 - RNA, 64 nt, hsa; identical to SEQ ID NO: 25040

SEQ ID NO: 55786 - RNA, 64 nt, hsa; identical to SEQ ID NO: 25041

SEQ ID NO: 55787 - RNA, 64 nt, hsa; identical to SEQ ID NO: 25042

SEQ ID NO: 55788 - RNA, 64 nt, hsa; identical to SEQ ID NO: 25043

SEQ ID NO: 55789 - RNA, 64 nt, hsa; identical to SEQ ID NO: 25044

SEQ ID NO: 55790 - RNA, 64 nt, hsa; identical to SEQ ID NO: 25045

SEQ ID NO: 55791 - RNA, 64 nt, hsa; identical to SEQ ID NO: 25046

SEQ ID NO: 55792 - RNA, 64 nt, hsa; identical to SEQ ID NO: 25047

SEQ ID NO: 55793 - RNA, 64 nt, hsa; identical to SEQ ID NO: 25048

SEQ ID NO: 55794 - RNA, 64 nt, hsa; identical to SEQ ID NO: 25049

SEQ ID NO: 55795 - RNA, 64 nt, hsa; identical to SEQ ID NO: 25050

SEQ ID NO: 55796 - RNA, 64 nt, hsa; identical to SEQ ID NO: 25051

SEQ ID NO: 55797 - RNA, 64 nt, hsa; identical to SEQ ID NO: 25052

SEQ ID NO: 55798 - RNA, 64 nt, hsa; identical to SEQ ID NO: 25053

SEQ ID NO: 55799 - RNA, 64 nt, hsa; identical to SEQ ID NO: 25054

SEQ ID NO: 55800 - RNA, 64 nt, hsa; identical to SEQ ID NO: 25055

SEQ ID NO: 55801 - RNA, 64 nt, hsa; identical to SEQ ID NO: 25056

SEQ ID NO: 55802 - RNA, 64 nt, hsa; identical to SEQ ID NO: 25057

SEQ ID NO: 55803 - RNA, 64 nt, hsa; identical to SEQ ID NO: 25058

SEQ ID NO: 55804 - RNA, 64 nt, hsa; identical to SEQ ID NO: 25059

SEQ ID NO: 55805 - RNA, 64 nt, hsa; identical to SEQ ID NO: 25060

SEQ ID NO: 55806 - RNA, 64 nt, hsa; identical to SEQ ID NO: 25061

SEQ ID NO: 55807 - RNA, 64 nt, hsa; identical to SEQ ID NO: 25062

SEQ ID NO: 55808 - RNA, 64 nt, hsa; identical to SEQ ID NO: 25063

SEQ ID NO: 55809 - RNA, 64 nt, hsa; identical to SEQ ID NO: 25064

SEQ ID NO: 55810 - RNA, 64 nt, hsa; identical to SEQ ID NO: 25065

SEQ ID NO: 55811 - RNA, 64 nt, hsa; identical to SEQ ID NO: 25066

SEQ ID NO: 55812 - RNA, 64 nt, hsa; identical to SEQ ID NO: 25067

SEQ ID NO: 55813 - RNA, 64 nt, hsa; identical to SEQ ID NO: 25068

SEQ ID NO: 55814 - RNA, 64 nt, hsa; identical to SEQ ID NO: 25069

SEQ ID NO: 55815 - RNA, 64 nt, hsa; identical to SEQ ID NO: 25070

SEQ ID NO: 55816 - RNA, 64 nt, hsa; identical to SEQ ID NO: 25071

SEQ ID NO: 55817 - RNA, 64 nt, hsa; identical to SEQ ID NO: 25072

SEQ ID NO: 55818 - RNA, 64 nt, hsa; identical to SEQ ID NO: 25073

SEQ ID NO: 55819 - RNA, 64 nt, hsa; identical to SEQ ID NO: 25074

SEQ ID NO: 55820 - RNA, 64 nt, hsa; identical to SEQ ID NO: 25075

SEQ ID NO: 55821 - RNA, 64 nt, hsa; identical to SEQ ID NO: 25076

SEQ ID NO: 55822 - RNA, 64 nt, hsa; identical to SEQ ID NO: 25077

SEQ ID NO: 55823 - RNA, 64 nt, hsa; identical to SEQ ID NO: 25078

SEQ ID NO: 55824 - RNA, 64 nt, hsa; identical to SEQ ID NO: 25079

SEQ ID NO: 55825 - RNA, 64 nt, hsa; identical to SEQ ID NO: 25080

SEQ ID NO: 55826 - RNA, 64 nt, hsa; identical to SEQ ID NO: 25081

SEQ ID NO: 55827 - RNA, 64 nt, hsa; identical to SEQ ID NO: 25082

SEQ ID NO: 55828 - RNA, 64 nt, hsa; identical to SEQ ID NO: 25083

SEQ ID NO: 55829 - RNA, 64 nt, hsa; identical to SEQ ID NO: 25084

SEQ ID NO: 55830 - RNA, 64 nt, hsa; identical to SEQ ID NO: 25085

SEQ ID NO: 55831 - RNA, 64 nt, hsa; identical to SEQ ID NO: 25086

SEQ ID NO: 55832 - RNA, 64 nt, hsa; identical to SEQ ID NO: 25087

SEQ ID NO: 55833 - RNA, 64 nt, hsa; identical to SEQ ID NO: 25088

SEQ ID NO: 55834 - RNA, 64 nt, hsa; identical to SEQ ID NO: 25089

SEQ ID NO: 55835 - RNA, 64 nt, hsa; identical to SEQ ID NO: 25090

SEQ ID NO: 55836 - RNA, 64 nt, hsa; identical to SEQ ID NO: 25091

SEQ ID NO: 55837 - RNA, 64 nt, hsa; identical to SEQ ID NO: 25092

SEQ ID NO: 55838 - RNA, 64 nt, hsa; identical to SEQ ID NO: 25093

SEQ ID NO: 55839 - RNA, 64 nt, hsa; identical to SEQ ID NO: 25094

SEQ ID NO: 55840 - RNA, 64 nt, hsa; identical to SEQ ID NO: 25095

SEQ ID NO: 55841 - RNA, 64 nt, hsa; identical to SEQ ID NO: 25096

SEQ ID NO: 55842 - RNA, 64 nt, hsa; identical to SEQ ID NO: 25097

SEQ ID NO: 55843 - RNA, 64 nt, hsa; identical to SEQ ID NO: 25098

SEQ ID NO: 55844 - RNA, 64 nt, hsa; identical to SEQ ID NO: 25099

SEQ ID NO: 55845 - RNA, 64 nt, hsa; identical to SEQ ID NO: 25100

SEQ ID NO: 55846 - RNA, 64 nt, hsa; identical to SEQ ID NO: 25101

SEQ ID NO: 55847 - RNA, 64 nt, hsa; identical to SEQ ID NO: 25102

SEQ ID NO: 55848 - RNA, 64 nt, hsa; identical to SEQ ID NO: 25103

SEQ ID NO: 55849 - RNA, 64 nt, hsa; identical to SEQ ID NO: 25104

SEQ ID NO: 55850 - RNA, 64 nt, hsa; identical to SEQ ID NO: 25105

SEQ ID NO: 55851 - RNA, 64 nt, hsa; identical to SEQ ID NO: 25106

SEQ ID NO: 55852 - RNA, 64 nt, hsa; identical to SEQ ID NO: 25107

SEQ ID NO: 55853 - RNA, 64 nt, hsa; identical to SEQ ID NO: 25108

SEQ ID NO: 55854 - RNA, 64 nt, hsa; identical to SEQ ID NO: 25109

SEQ ID NO: 55855 - RNA, 64 nt, hsa; identical to SEQ ID NO: 25110

SEQ ID NO: 55856 - RNA, 64 nt, hsa; identical to SEQ ID NO: 25111

SEQ ID NO: 55857 - RNA, 64 nt, hsa; identical to SEQ ID NO: 25112

SEQ ID NO: 55858 - RNA, 64 nt, hsa; identical to SEQ ID NO: 25113

SEQ ID NO: 55859 - RNA, 64 nt, hsa; identical to SEQ ID NO: 25114

SEQ ID NO: 55860 - RNA, 64 nt, hsa; identical to SEQ ID NO: 25115

SEQ ID NO: 55861 - RNA, 64 nt, hsa; identical to SEQ ID NO: 25116

SEQ ID NO: 55862 - RNA, 64 nt, hsa; identical to SEQ ID NO: 25117

SEQ ID NO: 55863 - RNA, 64 nt, hsa; identical to SEQ ID NO: 25118

SEQ ID NO: 55864 - RNA, 64 nt, hsa; identical to SEQ ID NO: 25119

SEQ ID NO: 55865 - RNA, 64 nt, hsa; identical to SEQ ID NO: 25120

SEQ ID NO: 55866 - RNA, 64 nt, hsa; identical to SEQ ID NO: 25121

SEQ ID NO: 55867 - RNA, 64 nt, hsa; identical to SEQ ID NO: 25122

SEQ ID NO: 55868 - RNA, 64 nt, hsa; identical to SEQ ID NO: 25123

SEQ ID NO: 55869 - RNA, 64 nt, hsa; identical to SEQ ID NO: 25124

SEQ ID NO: 55870 - RNA, 64 nt, hsa; identical to SEQ ID NO: 25125

SEQ ID NO: 55871 - RNA, 64 nt, hsa; identical to SEQ ID NO: 25126

SEQ ID NO: 55872 - RNA, 64 nt, hsa; identical to SEQ ID NO: 25127

SEQ ID NO: 55873 - RNA, 64 nt, hsa; identical to SEQ ID NO: 25128

SEQ ID NO: 55874 - RNA, 64 nt, hsa; identical to SEQ ID NO: 25129

SEQ ID NO: 55875 - RNA, 64 nt, hsa; identical to SEQ ID NO: 25130

SEQ ID NO: 55876 - RNA, 64 nt, hsa; identical to SEQ ID NO: 25131

SEQ ID NO: 55877 - RNA, 64 nt, hsa; identical to SEQ ID NO: 25132

SEQ ID NO: 55878 - RNA, 64 nt, hsa; identical to SEQ ID NO: 25133

SEQ ID NO: 55879 - RNA, 64 nt, hsa; identical to SEQ ID NO: 25134

SEQ ID NO: 55880 - RNA, 64 nt, hsa; identical to SEQ ID NO: 25135

SEQ ID NO: 55881 - RNA, 64 nt, hsa; identical to SEQ ID NO: 25136

SEQ ID NO: 55882 - RNA, 64 nt, hsa; identical to SEQ ID NO: 25137

SEQ ID NO: 55883 - RNA, 64 nt, hsa; identical to SEQ ID NO: 25138

SEQ ID NO: 55884 - RNA, 64 nt, hsa; identical to SEQ ID NO: 25139

SEQ ID NO: 55885 - RNA, 64 nt, hsa; identical to SEQ ID NO: 25140

SEQ ID NO: 55886 - RNA, 64 nt, hsa; identical to SEQ ID NO: 25141

SEQ ID NO: 55887 - RNA, 64 nt, hsa; identical to SEQ ID NO: 25142

SEQ ID NO: 55888 - RNA, 64 nt, hsa; identical to SEQ ID NO: 25143

SEQ ID NO: 55889 - RNA, 64 nt, hsa; identical to SEQ ID NO: 25144

SEQ ID NO: 55890 - RNA, 64 nt, hsa; identical to SEQ ID NO: 25145

SEQ ID NO: 55891 - RNA, 64 nt, hsa; identical to SEQ ID NO: 25146

SEQ ID NO: 55892 - RNA, 64 nt, hsa; identical to SEQ ID NO: 25147

SEQ ID NO: 55893 - RNA, 64 nt, hsa; identical to SEQ ID NO: 25148

SEQ ID NO: 55894 - RNA, 64 nt, hsa; identical to SEQ ID NO: 25149

SEQ ID NO: 55895 - RNA, 64 nt, hsa; identical to SEQ ID NO: 25150

SEQ ID NO: 55896 - RNA, 64 nt, hsa; identical to SEQ ID NO: 25151

SEQ ID NO: 55897 - RNA, 64 nt, hsa; identical to SEQ ID NO: 25152

SEQ ID NO: 55898 - RNA, 64 nt, hsa; identical to SEQ ID NO: 25153

SEQ ID NO: 55899 - RNA, 64 nt, hsa; identical to SEQ ID NO: 25154

SEQ ID NO: 55900 - RNA, 64 nt, hsa; identical to SEQ ID NO: 25155

SEQ ID NO: 55901 - RNA, 64 nt, hsa; identical to SEQ ID NO: 25156

SEQ ID NO: 55902 - RNA, 64 nt, hsa; identical to SEQ ID NO: 25157

SEQ ID NO: 55903 - RNA, 64 nt, hsa; identical to SEQ ID NO: 25158

SEQ ID NO: 55904 - RNA, 64 nt, hsa; identical to SEQ ID NO: 25159

SEQ ID NO: 55905 - RNA, 64 nt, hsa; identical to SEQ ID NO: 25160

SEQ ID NO: 55906 - RNA, 64 nt, hsa; identical to SEQ ID NO: 25161

SEQ ID NO: 55907 - RNA, 64 nt, hsa; identical to SEQ ID NO: 25162

SEQ ID NO: 55908 - RNA, 64 nt, hsa; identical to SEQ ID NO: 25163

SEQ ID NO: 55909 - RNA, 64 nt, hsa; identical to SEQ ID NO: 25164

SEQ ID NO: 55910 - RNA, 64 nt, hsa; identical to SEQ ID NO: 25165

SEQ ID NO: 55911 - RNA, 64 nt, hsa; identical to SEQ ID NO: 25166

SEQ ID NO: 55912 - RNA, 64 nt, hsa; identical to SEQ ID NO: 25167

SEQ ID NO: 55913 - RNA, 64 nt, hsa; identical to SEQ ID NO: 25168

SEQ ID NO: 55914 - RNA, 64 nt, hsa; identical to SEQ ID NO: 25169

SEQ ID NO: 55915 - RNA, 64 nt, hsa; identical to SEQ ID NO: 25170

SEQ ID NO: 55916 - RNA, 64 nt, hsa; identical to SEQ ID NO: 25171

SEQ ID NO: 55917 - RNA, 64 nt, hsa; identical to SEQ ID NO: 25172

SEQ ID NO: 55918 - RNA, 64 nt, hsa; identical to SEQ ID NO: 25173

SEQ ID NO: 55919 - RNA, 64 nt, hsa; identical to SEQ ID NO: 25174

SEQ ID NO: 55920 - RNA, 56 nt, hsa
caauucagucuucagauugaacaagaagggaucagaugccacaucguuuuugucgu

SEQ ID NO: 55921 - RNA, 64 nt, hsa
guacuuuauaguaauaaaucugaccagcagagggagggaucaggcagcaguguuuagagcacac

SEQ ID NO: 55922 - RNA, 64 nt, hsa
aaggcuuuugagacacaagggaaucucaacaaccagggaucaggaggguccaaagccgacauuc

SEQ ID NO: 55923 - RNA, 64 nt, hsa
agguucugcaggggaaucuggagcuacacacaggagggaucagcuccugggugugucagaggcc

SEQ ID NO: 55924 - RNA, 64 nt, hsa
cugcagagcucacagggcccaggacaccaacgccgcauaggacugcccacaugggaccgcccac

SEQ ID NO: 55925 - RNA, 64 nt, hsa
cuggcauuuggacacacaucacaugucgauauuugcauaggagucauuuucaguggaauaacau

SEQ ID NO: 55926 - RNA, 64 nt, hsa
agccugaugccaccuccucuguucuuggaacaacgcauaggaaaagaaucuccuuuggaaggug

SEQ ID NO: 55927 - RNA, 64 nt, hsa
ggaugcugucuucgaggacagcaaugcagagagggcauaggaucugaggacaaggaaauuccuc

SEQ ID NO: 55928 - RNA, 64 nt, hsa
gugggaaucccuuuugcuucaugcucacaacuaagcauaggaaguuuuauuuaaaggaaagaau

SEQ ID NO: 55929 - RNA, 64 nt, hsa
uauuagaacucuuccuuugcgaauuuuauguugagcauaggaaguacauucuagaggaaagguu

SEQ ID NO: 55930 - RNA, 64 nt, hsa
auaauguauguguuguuuaagaaauguauaaaaaaccugaaaaaaaugaguaagaacuggcaga

SEQ ID NO: 55931 - RNA, 64 nt, hsa
cuuuuucacuaaaggucaguuguuuuaauuugaaaccugaaaugccucuuuagcaaaagccugu

SEQ ID NO: 55932 - RNA, 64 nt, hsa
aagaaaaauauaaaaguaaaacaaacaaaaacaaaccugaaaacugcuuggcauuugaguagcu

SEQ ID NO: 55933 - RNA, 64 nt, hsa
auaauggauuaauuccucaaaggaagagcagaacaccugaaaaucagcaauuuccugacaacga

SEQ ID NO: 55934 - RNA, 64 nt, hsa
augauggauuaauuccuccaaggaagagcagaacaccugaaagccagcaauuuccugacacuga

SEQ ID NO: 55935 - RNA, 64 nt, hsa
uuuauuggaugugauggacguucuguaauagaaaaccugaaacgaugauugaaugggaaaaaga

SEQ ID NO: 55936 - RNA, 64 nt, hsa
gaauacugcuaguuucuuaauuuuaauucacaucaccugaaaaguaaaacaacaggcuuugcca

SEQ ID NO: 55937 - RNA, 64 nt, hsa
ucaacuggguaaagccuuccagagcucucuaaauaccugaaagacuuaagccuuuuuuuaagua

SEQ ID NO: 55938 - RNA, 64 nt, hsa
aagaaaaucuggaugccugugauucgagaauugaaccugaaacccaaagugaacuggggugggg

SEQ ID NO: 55939 - RNA, 64 nt, hsa
aaaaacuguugcuauuuccuaaccugcaggcagaaccugaaagggcauuuuggcuccggggcau

SEQ ID NO: 55940 - RNA, 64 nt, hsa
acccuuugcacacaggggcuacagcgcauuuucuaccugaaauuggaagacuuggugccaccgc

SEQ ID NO: 55941 - RNA, 64 nt, hsa
auaauuaaaaauaauguaaugugccuagcacacuaccugaaaacgauggcauuuguucuuauua

SEQ ID NO: 55942 - RNA, 64 nt, hsa
uucuucaaacaguaucuuggugggugacuuggcuaccugaaaaaucuuaggaggaauagcucac

SEQ ID NO: 55943 - RNA, 64 nt, hsa
cacugaaauauuaacuguuucuuaauaaaaaguuaccugaaauaacaacaaaauacaacuccuc

SEQ ID NO: 55944 - RNA, 64 nt, hsa
agaguauaaugaugacccuucuugaguuuugaacaccugaaauuguaaucacugaaauauuaac

SEQ ID NO: 55945 - RNA, 64 nt, hsa
ggaguuuugcuuguugauauaaccuuuuuaguuaaccugaaagauuccaaaaauuguucuuaag

SEQ ID NO: 55946 - RNA, 64 nt, hsa
gagcaguuggucuuaccagaaucauuguugaacuaccugaaacaagucuuuagaauacuaaaua

SEQ ID NO: 55947 - RNA, 64 nt, hsa
aaauuguaacaauucaauugaauuuuaaaaugacaccugaaaagauacaucugauauuuucuau

SEQ ID NO: 55948 - RNA, 64 nt, hsa
caucuguauuguugcuccuaccuucaaauaugacaccugaaauaauaagucuguuguccagaau

SEQ ID NO: 55949 - RNA, 64 nt, hsa
cccagcaaacguugacuucugggcaaaccugaaaaccugaaaaugccacuuucaugcaguuugu

SEQ ID NO: 55950 - RNA, 64 nt, hsa
ucuccaagcccagcaaacguugacuucugggcaaaccugaaaaccugaaaaugccacuuucaug

SEQ ID NO: 55951 - RNA, 64 nt, hsa
aauagaauuguaaaggaaaagugguacuguuccaaccugaaaugucuguuauaauuagguuauu

SEQ ID NO: 55952 - RNA, 64 nt, hsa
guuguagaucagaauuucaccagggaguaaaauuaccugaaaacguaagaaguuuuaaacagcu

SEQ ID NO: 55953 - RNA, 64 nt, hsa
cagaacuucacacgugauucuucaagccacacccaccugaaaucaaaccaaaggagugcugugg

SEQ ID NO: 55954 - RNA, 64 nt, hsa
uugaaaucucuuagauguggaaauauuuuuucgaaccugaaaaugcagcugguagaauuucaau

SEQ ID NO: 55955 - RNA, 64 nt, hsa
aguggacagggaaggccucugacauuuauccaagaccugaaagaugggcaaaagacgggaagca

SEQ ID NO: 55956 - RNA, 64 nt, hsa
ggcuccgcggcaggaggagccggugcucuggaagaccugaaagaagcccagguggccacagggc

SEQ ID NO: 55957 - RNA, 64 nt, hsa
uuuuaagagacuuacucaauuucaugacuguacuaccugaaacaaagugagaaaggacaggugu

SEQ ID NO: 55958 - RNA, 64 nt, hsa
guucugcaaaauuaauugggcagguuaauuguguaccugaaacuuaacaagcaguuuuuggaag

SEQ ID NO: 55959 - RNA, 64 nt, hsa
ucaaaaggaacacugcuucagaguaucuuuaccuaccugaaaacauccaaggaagccaaaccau

SEQ ID NO: 55960 - RNA, 64 nt, hsa
cccagaagugccucugcugugcuggcauaaaauaaccugaaaagauucugaaaagccaggaugu

SEQ ID NO: 55961 - RNA, 64 nt, hsa
uuguuucacaagauuuauaauauagaugguuuuguuugacuaaagaauaaucucauauaacuag

SEQ ID NO: 55962 - RNA, 64 nt, hsa
uaacuauuaauuuuucauagaauuauaaaugucauuugacuaugucaaucuguauauauuguac

SEQ ID NO: 55963 - RNA, 64 nt, hsa
gucaguguauaaguaaguuggguuuauggugggcuuugacuaugucauuagguggguacaaaac

SEQ ID NO: 55964 - RNA, 64 nt, hsa
acuuucucagaauuaccuaaauguuuuguagaguuuugacuaguaaucaaucaaaauuauauaa

SEQ ID NO: 55965 - RNA, 64 nt, hsa
cacuuguaacauauucaacguccuguacuccaguuuugacuacgagaucagauuuuggaggugu

SEQ ID NO: 55966 - RNA, 64 nt, hsa
uauggcaaugaacugcagcaugcugggacaauuauuugacuacuuuuuuuuguaauauugucaa

SEQ ID NO: 55967 - RNA, 64 nt, hsa
acguuugacuagccaucucaagcaaguuucgacguuugacuagccaucucaagcaaguuuaauc

SEQ ID NO: 55968 - RNA, 64 nt, hsa
gucuaguuaccuacuuuuucuuugauuuucgacguuugacuagccaucucaagcaaguuucgac

SEQ ID NO: 55969 - RNA, 64 nt, hsa
uagauuuguauuuguuauaaacuuguuuauggaguuugacuaauuuuuucuauucaauuuguau

SEQ ID NO: 55970 - RNA, 64 nt, hsa
acuagaauuuuaaaaucaaguuggauuuauagaguuugacuaguuuuuucgauuagauuuguau

SEQ ID NO: 55971 - RNA, 64 nt, hsa
ugcuuguagaguuguacugcuuugauuuuugaaguugggguaguaguuagaacuagauuuaacu

SEQ ID NO: 55972 - RNA, 64 nt, hsa
agugggagaaauuagaaaacaaaacgaacucugguugggguacuacgaucacagacacagacau

SEQ ID NO: 55973 - RNA, 64 nt, hsa
auuugguuuggaagagccucuuguuuccuucucuuugggguaugucuucguuucuuaauauguu

SEQ ID NO: 55974 - RNA, 64 nt, hsa
aauaggacaggacacagagcuggaauauuggaguuugggguauaaaacacuccucccugccccc

SEQ ID NO: 55975 - RNA, 64 nt, hsa
ucaaaacuacuagacaaaaaagugagaggauagauuuagaaaacaucagugaugcucagauaaa

SEQ ID NO: 55976 - RNA, 64 nt, hsa
aggaaaauauuauuaaauuuauaucccuaaaauuuuuagaaaucucucaaaaucuuuccaaaug

SEQ ID NO: 55977 - RNA, 64 nt, hsa
uaaaaaauuuuuaagaauuguuugucacgucauuuuuagaaauguucuaccuguauaugguaau

SEQ ID NO: 55978 - RNA, 64 nt, hsa
cacagaaguaacaaauaugguagucaguuuuguauuuagaaauguauugguagcagggauguuu

SEQ ID NO: 55979 - RNA, 64 nt, hsa
cacuuuuagaucaagaaaacacuucaacagccuuuuuagaaauuggcacacuccuauaguccca

SEQ ID NO: 55980 - RNA, 64 nt, hsa
uucuaacaguauuacugaauauuaauguuucuuguuuagaaaaugcaacuauaucuauaugugg

SEQ ID NO: 55981 - RNA, 64 nt, hsa
uuuauagaauaauaugaauuuuauuaagcuauucuuuagaaauucaguucuaaggaaagaguug

SEQ ID NO: 55982 - RNA, 64 nt, hsa
aauucuagugucauguuuuacuuuuuauugguauuuuagaaacucaggugcuuaaaaaauaugu

SEQ ID NO: 55983 - RNA, 64 nt, hsa
uuaagaaguuauaguuaaacgacuuuucaggagauuuagaaagccuuaugcacucuuuguguuu

SEQ ID NO: 55984 - RNA, 64 nt, hsa
ugucauguugauuuuccuuaugaacccgaagccauuuagaaaaucccugugugucaaaauuaca

SEQ ID NO: 55985 - RNA, 64 nt, hsa
augaaagcauacuguugaaacccgcaguguugcauuuagaaaacaguugaacagaaugucaaug

SEQ ID NO: 55986 - RNA, 64 nt, hsa
cauucaugcaaaaaaacauuuaaucugcaucuguuuuagaaaagggggaaaugaagcaacuugu

SEQ ID NO: 55987 - RNA, 64 nt, hsa
uuuugauacuuucuauuuuuuuggucaaaucauguuuagaaacuuuggaugaguuaagaagucu

SEQ ID NO: 55988 - RNA, 64 nt, hsa
uggaagugggugggguuaugaaauuguagauguuuuuagaaaaacuugugaaugaaaaugaauc

SEQ ID NO: 55989 - RNA, 64 nt, hsa
aguuaaaauggugcauuauguauauauauuauaauuuagaaauaccauuuuauaauuuuacuau

SEQ ID NO: 55990 - RNA, 64 nt, hsa
aauugccaauacuucuacauuugagaaggguuuuuuuagaaauacauuuaguaaaguccccaag

SEQ ID NO: 55991 - RNA, 64 nt, hsa
gguugaauaaagcuuauucuuuguccauguguauuuuagaaauaguaacuucuaaagagucugg

SEQ ID NO: 55992 - RNA, 64 nt, hsa
agaauaagucccuuuuuguauguguuuuuauacuuuuagaaaauaaaaacuuuagauuaacuca

SEQ ID NO: 55993 - RNA, 64 nt, hsa
cugguuugugcugguuuaacgacaucuaagaagguuuagaaauggugagaccaaaacaauaacu

SEQ ID NO: 55994 - RNA, 64 nt, hsa
acuuguaacaguagaaaauagaagucauucuuauuuuagaaaaagugacagaagcaguccagua

SEQ ID NO: 55995 - RNA, 64 nt, hsa
agcauaaagcucaaaugaaauguaugcauucacauuuagaaaagugaauugaaguuucaaguuu

SEQ ID NO: 55996 - RNA, 64 nt, hsa
acuugccaauaagaagcaagaggcaagcugaaauuuuagaaauauucacaucuucggagaugag

SEQ ID NO: 55997 - RNA, 64 nt, hsa
uccaucucugcaagcucccuguguuuccuugcccuuuagaaaaugaauuguucacuacaauuag

SEQ ID NO: 55998 - RNA, 64 nt, hsa
ggguucacuuccucgugagcccucgguaaguauguuuagaaauagaacauuagccacgagccau

SEQ ID NO: 55999 - RNA, 64 nt, hsa
cugaucuuacgaugcccugccuuuuacuagcuacuuuagaaauagaaaaugugaagagugacua

SEQ ID NO: 56000 - RNA, 64 nt, hsa
uuuauccugucacauguuucuguuucuauaguaauuuagaaauugcaaauaguuaacuuuucau

SEQ ID NO: 56001 - RNA, 64 nt, hsa
acaacuaggaugucuugaaacccgugcauuuaauuuuagaaauggcaaauuuguaagcguguca

SEQ ID NO: 56002 - RNA, 64 nt, hsa
uuuacuguaugaaaacaggaaaauaaaagagaaauuuagaaaauacagcucauuacaauaaaau

SEQ ID NO: 56003 - RNA, 64 nt, hsa
ugacugcuugugucuuuuuaugaccuguuugccuuuuagaaaauugguaaauaaagcaaguaua

SEQ ID NO: 56004 - RNA, 64 nt, hsa
aaauggacacauaugcucauguugcuuuuuuuguuuuagaaaaaaaaacaacauaguuuucuga

SEQ ID NO: 56005 - RNA, 64 nt, hsa
aucaucaugauguuuuggaguuauuacuguguauuuuagaaaucauucuuuacaguuuugcauu

SEQ ID NO: 56006 - RNA, 64 nt, hsa
aagauuuccugccgcuuuuugacaaucuuguguauuuagaaaaauguauuacuugaaaacauga

SEQ ID NO: 56007 - RNA, 64 nt, hsa
uuucucugaccagaguacuaauaaauauagaucauuuagaaaaguggucuucuugccucuugua

SEQ ID NO: 56008 - RNA, 64 nt, hsa
ggugugagcuaccucaccuggccaaaacaguuuuuuuagaaaugaaguauauuagacaacaaca

SEQ ID NO: 56009 - RNA, 64 nt, hsa
cuucauugccuaaguucauuucaaagaauuuguauuuagaaaagguuuauauuauuagugaaaa

SEQ ID NO: 56010 - RNA, 64 nt, hsa
uuuuugcaucuuuuuucaaaguuuaaugugaacuuuuagaaaagugauuaauguugcccuaaua

SEQ ID NO: 56011 - RNA, 64 nt, hsa
gcugacuauucugcuuccucaggcaacacuaaaguuuagaaagauaucaucaacguucugucac

SEQ ID NO: 56012 - RNA, 64 nt, hsa
uaauugauuuccuacuauauucccagcagacacauuuagaaacuaagcuauguuaaccucagug

SEQ ID NO: 56013 - RNA, 64 nt, hsa
aaaugucuuuugguuuauuccaacaauuauuuauuuuagaaaguaaguuuaaagacuuuaagga

SEQ ID NO: 56014 - RNA, 64 nt, hsa
cucggaugagagguuggaaauguagcugcuuuucuuuagaaaauauguagcugucaucauuugg

SEQ ID NO: 56015 - RNA, 64 nt, hsa
aaaccaaaaagauuugucuacaaaugcuaucuuuuuuagaaacuauuagaaaugacucccuuuc

SEQ ID NO: 56016 - RNA, 64 nt, hsa
uugucagcaugcacaaugccucugauucugcaguuuuagaaacuugguggcacuuauuaauccu

SEQ ID NO: 56017 - RNA, 64 nt, hsa
uaaaauuauauaauuuaaauguauuuuuuguauauuuagaaauaaggaguccagagacuacgcu

SEQ ID NO: 56018 - RNA, 64 nt, hsa
ggcuguguuagugaaagcacauggaagguguugcuuuagaaagguagucaggaaaaacauucag

SEQ ID NO: 56019 - RNA, 64 nt, hsa
aaaaauccagugucacaugggccugagauuuuauuuuagaaaaagguuguuacauaaaacaccc

SEQ ID NO: 56020 - RNA, 64 nt, hsa
augcuguugucuuauuauuauauagaaaaauaacuuuagaaaaauauugaagacauuguauuac

SEQ ID NO: 56021 - RNA, 64 nt, hsa
uacuuaaguuuuagaaaugagaaaaauacagaguuuuagaaaugagaucuagagaacacgucuu

SEQ ID NO: 56022 - RNA, 64 nt, hsa
uuuuaguaaggucaguuugauuggauacuuaaguuuuagaaaugagaaaaauacagaguuuuag

SEQ ID NO: 56023 - RNA, 64 nt, hsa
uuugaaauuuaaaucacaaacucauuuucugguuuuuagaaaguagaugaugauuucagaggag

SEQ ID NO: 56024 - RNA, 64 nt, hsa
guauucuaaacauuucagcuaggaauaccacugauuuagaaacaaaacuguuugucucugguuu

SEQ ID NO: 56025 - RNA, 64 nt, hsa
uguaucuucguaacuucauauuaauauaaguuucuuuagaaaacccaaguuuuuaaucguuuuu

SEQ ID NO: 56026 - RNA, 64 nt, hsa
uuuuuccuguguauuaaaccuuuccauuuuacguuuuagaaaauuuuauguauuuuaaaauaag

SEQ ID NO: 56027 - RNA, 64 nt, hsa
uguccuguauccuuuaauuucaggucucaggauguuuagaaagcuaaaacccccuaccccuuuc

SEQ ID NO: 56028 - RNA, 64 nt, hsa
guauuuaaaucuugcaagaauauuuugugcuuucuuuagaaacacaagaguauagauuuuucuc

SEQ ID NO: 56029 - RNA, 64 nt, hsa
ucuaaucucauuucacaugaaagaagaaguauauuuuagaaauuuguuaaugagaguaaaagaa

SEQ ID NO: 56030 - RNA, 64 nt, hsa
cuuuauucgaaaagaggcuuuuaaaaugugcauguuuagaaacaaaauuucuucauggaaauca

SEQ ID NO: 56031 - RNA, 64 nt, hsa
aaaaagagauguacaaaucaauaauaauuacacuuuuagaaacuguaucaucaaagauuuucag

SEQ ID NO: 56032 - RNA, 64 nt, hsa
auccccacucuuccuuauugccucuucagaacccuuuagaaaguauaaaauauugccuccaaca

SEQ ID NO: 56033 - RNA, 64 nt, hsa
uugucugauggucugggcucauuuuuauguuuauuuuagaaaacuguugcaucaauauauuaug

SEQ ID NO: 56034 - RNA, 64 nt, hsa
cuguguauaaaauauuuaugccguuaaaacuguuuuuagaaaguauuuuuaauuucagcaaguu

SEQ ID NO: 56035 - RNA, 64 nt, hsa
uccuuauuuggaaaaaccaacaacaaaaaaggcuuuuagaaaaugguuguaaaucugacuucuu

SEQ ID NO: 56036 - RNA, 64 nt, hsa
uuuuaaaagaggucuuucuccccgaaauacaaguuuuagaaaaucuuagaagaggggugggugc

SEQ ID NO: 56037 - RNA, 64 nt, hsa
uggugcaauaaaguuccuuucuaaccauuucugguuuagaaaacauucagccauccuagaaacu

SEQ ID NO: 56038 - RNA, 64 nt, hsa
guuuuaucugaauuuuuaaacaaguauuuguuaauuuagaaaacuuuaaagcguuugcacagau

SEQ ID NO: 56039 - RNA, 64 nt, hsa
aagcauucagaagaaaaagaagcaaccucaguaauuuagaaaucauuuugcaaucccuuaauau

SEQ ID NO: 56040 - RNA, 64 nt, hsa
aucauauuuauacugcuguccaaucuuuucuauauuuagaaauaauaauguacauauuuaucua

SEQ ID NO: 56041 - RNA, 64 nt, hsa
aauaucaaagagaaucauagaugaucauuaaauuuuuagaaauucucggaaguuaaggagaagc

SEQ ID NO: 56042 - RNA, 64 nt, hsa
uggaaaugauucuuauguuuuuuuuuuuucuccuuuuagaaaauucuccaaaagguuuugaugu

SEQ ID NO: 56043 - RNA, 64 nt, hsa
augucauuucaguauuuuugcuggauaaauccauuuuagaaaugucuuacaaaaaguuuagggc

SEQ ID NO: 56044 - RNA, 64 nt, hsa
ugaaaaaacuguaaaauuauagcacuaacuugauuuuagaaaaugagcauuuuuuacaacugcc

SEQ ID NO: 56045 - RNA, 64 nt, hsa
gucuccauauacuauuuuuuucuacugaaaacaauuuagaaagaagcuauugggcagaaacaga

SEQ ID NO: 56046 - RNA, 64 nt, hsa
aagaaaaaaacaaguuaaaaacugaauguacugauuuagaaaauauauauaaauauauauuguu

SEQ ID NO: 56047 - RNA, 64 nt, hsa
auuuauuuugaagcucuauuuuaauaguauuuauuuuagaaagucuacuauuguaagaguucuu

SEQ ID NO: 56048 - RNA, 64 nt, hsa
gaugauugcuuuugucuguuuacugaaaaaugaguuuagaaaggcuagcccacugacauuggaa

SEQ ID NO: 56049 - RNA, 64 nt, hsa
aauaugucaugcauucuuucuuaugaauuguauauuuagaaaucuuucuaaauaccauuaaggc

SEQ ID NO: 56050 - RNA, 64 nt, hsa
ucauucccuuacaaccccaaucuauacauggauuuuuagaaagucuucauggcuaucuauaguu

SEQ ID NO: 56051 - RNA, 64 nt, hsa
ccucuagguuaugaaaacuaucuuagaaggugcuuuuagaaagaaccaggagaacaaccaaagc

SEQ ID NO: 56052 - RNA, 64 nt, hsa
cucaaaaugaaaguaauggagaaagacacugaaauuuagaaaauuuugucgauuuaaaauauuu

SEQ ID NO: 56053 - RNA, 64 nt, hsa
ccuucaguuuuuacucacuagacaauaauucaaguuuagaaacagguaaucagcuauuugaucu

SEQ ID NO: 56054 - RNA, 64 nt, hsa
ugguccuuagaaaagacuuugcuuuuauaaagcauuuagaaaaaaugcauacuuuuaaaacaag

SEQ ID NO: 56055 - RNA, 64 nt, hsa
cauuuuaagaugggggaaaauuaagguuugagguuuuagaaauuagcaaguagugcauacccuu

SEQ ID NO: 56056 - RNA, 64 nt, hsa
auuuaauagauaaagugccuauaaaggaaacacguuuagaaaugauuucaaaaugauauucaau

SEQ ID NO: 56057 - RNA, 64 nt, hsa
uaauguacuuucauucccuuucaugauuugcaacuuuagaaagaaauuguuuuucugaaaguau

SEQ ID NO: 56058 - RNA, 64 nt, hsa
ugauguggaaaaucucugaagucagaucucaauuuuuagaaaacucucugaauauaaugaauau

SEQ ID NO: 56059 - RNA, 64 nt, hsa
agguuugagugugccuagugccaauauuuuguaauuuagaaauuuuauucacaaacuucuguuu

SEQ ID NO: 56060 - RNA, 64 nt, hsa
cauuaggguguguuuuauguuaagcaaaacauacuuuagaaacaaaugaaaaaggcaauugaaa

SEQ ID NO: 56061 - RNA, 64 nt, hsa
uuguuaggccacaaaaacacugcacugugaacauuuuagaaaagguaugucagacugggauuaa

SEQ ID NO: 56062 - RNA, 64 nt, hsa
aguaucaagccaugugcuuuagcauaaaagaauauuuagaaaaacaucccaagaaaaucacauc

SEQ ID NO: 56063 - RNA, 64 nt, hsa
auguuacaacaacuauuuuuuaagaaaaacaaguuuuagaaauuugguuucaaguguacaugug

SEQ ID NO: 56064 - RNA, 64 nt, hsa
uuuggaauugguuaaccuuauugggaauggauaauuuagaaacaaaccaaaaaaaaaaaaagau

SEQ ID NO: 56065 - RNA, 64 nt, hsa
uuacauucaacuuauuguaaauuuugagauuuuauuuagaaaugaauugucuaauuaauuuaug

SEQ ID NO: 56066 - RNA, 64 nt, hsa
auaacuuagucuuuauuuugcugggcuucugacuuuuagaaacaaaauucuaaaaauuugcaag

SEQ ID NO: 56067 - RNA, 64 nt, hsa
uuuucuaagagaaugaauuaucccccaaaaugcauuuagaaaacagucuuuggugauauuuauu

SEQ ID NO: 56068 - RNA, 64 nt, hsa
uuagcuuugggaaaaguaaugaaaauauaaugguuuuagaaauccuguguuaaauauugcuaua

SEQ ID NO: 56069 - RNA, 64 nt, hsa
uuuauuuucaguuccuuuugcaugccuauuuugauuuagaaaucacuuuaagauaaaugaacaa

SEQ ID NO: 56070 - RNA, 64 nt, hsa
auuuagguauuuguaugugaaagagaaacacauauuuagaaacacagcaagggagauuuugaau

SEQ ID NO: 56071 - RNA, 64 nt, hsa
ucuuugcuuuagaguuaaauauuccuaucuuaaguuuagaaaaauacaaaaaaccauuccaagg

SEQ ID NO: 56072 - RNA, 64 nt, hsa
caagagaggaaucuauuucuuucuccugaaacaauuuagaaaauaguuauccauugacuagaaa

SEQ ID NO: 56073 - RNA, 64 nt, hsa
gucugaugauugauugauuacuguccagguacauuuuagaaaaaguguucuucuuccaguuugu

SEQ ID NO: 56074 - RNA, 64 nt, hsa
ugaaaaaugucucuuucaguuuguucuguaaauauuuagaaaagugacagcugucaaccucaga

SEQ ID NO: 56075 - RNA, 64 nt, hsa
gacucugauggaaggaaggugccguaggugggcuuuuagaaacuaacgggacugguuuucaaag

SEQ ID NO: 56076 - RNA, 64 nt, hsa
cccucucccucagaguuuucacugccgucucgucuuuagaaagcuguuugaauuccccccgccc

SEQ ID NO: 56077 - RNA, 64 nt, hsa
uaauagcuauagucucuucagcauuuguuuaaauuuuagaaaaccuguauaaauuacuggugca

SEQ ID NO: 56078 - RNA, 64 nt, hsa
aguccacuggcauuuuaguguauuuuuuuuucuuuuuagaaacacacauuucuaaaaaugucau

SEQ ID NO: 56079 - RNA, 64 nt, hsa
acaaguucucugauuaaauugguuuagaaaaaaauuuagaaauauuccgcuuaaaaauacuagc

SEQ ID NO: 56080 - RNA, 64 nt, hsa
guuauauuuuaaacaaguucucugauuaaauugguuuagaaaaaaauuuagaaauauuccgcuu

SEQ ID NO: 56081 - RNA, 64 nt, hsa
uuucuauuacuuaaauguuuuaauuggacuguaguuuagaaauuacaggaccagcuuguuacag

SEQ ID NO: 56082 - RNA, 64 nt, hsa
aaagaaauuaacugcuuauuuaugaaucuaaucauuuagaaaugucugagaguaacacugcauu

SEQ ID NO: 56083 - RNA, 64 nt, hsa
ucuuuauuccuuaagaccaaaaacuguaauauccuuuagaaaugcucuagaagaucuguauugu

SEQ ID NO: 56084 - RNA, 64 nt, hsa
aaagagugaggauggauuuagaaaaaaacaugaauuuagaaauauucaaaaugguuuuuguggc

SEQ ID NO: 56085 - RNA, 64 nt, hsa
ccuugaaagaaguauuaaaaagagugaggauggauuuagaaaaaaacaugaauuuagaaauauu

SEQ ID NO: 56086 - RNA, 64 nt, hsa
caccacuguauuuugaccaaauaaugacaacuucuuuagaaauuugaauggcuuggugaggaaa

SEQ ID NO: 56087 - RNA, 64 nt, hsa
agugguuucauguuaaaaaacaaacuccuaguccuuuagaaauaacagauucucugcacaaaac

SEQ ID NO: 56088 - RNA, 64 nt, hsa
aggaaaagaggcccaagugcaaaagaaaaaacauuuuagaaacggacagcuuauaaaaauaaag

SEQ ID NO: 56089 - RNA, 64 nt, hsa
uaaaacccaauacagucuaguuuccugguuccguuuuagaaaaggaaaacgugaacaaacuuag

SEQ ID NO: 56090 - RNA, 64 nt, hsa
cgagcgcauccauguccugagaaaaagucugugguuuagaaaauauguccaugguugcccacag

SEQ ID NO: 56091 - RNA, 64 nt, hsa
guguucaaaagauuguguaaaaguucaagcccguuuuagaaagccaacauuuuauguuauaaua

SEQ ID NO: 56092 - RNA, 64 nt, hsa
agcugauuguauuuuaucucuaaagauuuagaacuuuagaaaaugccgacuucuuccaucuauu

SEQ ID NO: 56093 - RNA, 64 nt, hsa
acuaguccaaaggccaaagcuaauuuauuuccacuuuagaaaaguuagcacaugcuuuugaaaa

SEQ ID NO: 56094 - RNA, 64 nt, hsa
uuuaaacgaucacaauaggccgcugcuaucagauuuuagaaauaaaugcagcuuuaccaugaac

SEQ ID NO: 56095 - RNA, 64 nt, hsa
agcuccagcuguuugaagagagggaacaacacgguuuagaaagaauccccauuccagcaguaga

SEQ ID NO: 56096 - RNA, 64 nt, hsa
uacuaugggcuguaaaccuguuuuuuaaaacuauuuuagaaaccugagacuugccgucuggcau

SEQ ID NO: 56097 - RNA, 64 nt, hsa
cccagguaucacugugcuguccuuugcugucagauuuagaaauguuuuuaagagcuaugugaaa

SEQ ID NO: 56098 - RNA, 64 nt, hsa
auuuugacucuauuaccuguuuugccuuauacauuuuagaaacuggaaauuuuuuaaagaaaau

SEQ ID NO: 56099 - RNA, 64 nt, hsa
guuacuuaaaauaugauuuuaaauuacauauuaauuuagaaaauuccuguguuuacuuauauuu

SEQ ID NO: 56100 - RNA, 64 nt, hsa
uucuaccauagcaaggccuaauguuagcuuuagcuuuagaaaauaacaguuugugaacuuacuu

SEQ ID NO: 56101 - RNA, 64 nt, hsa
ugguaagaggauuuuuuuggagaaaaaaaugauauuuagaaaguuaauuucuaauuccggaaug

SEQ ID NO: 56102 - RNA, 64 nt, hsa
aacccuaaugguuucuuguuuguuuuucaaauuauuuagaaauaaguucuccggaugggcuguu

SEQ ID NO: 56103 - RNA, 64 nt, hsa
cauguugauuuugucuuagucuagaaaucucuaguuuagaaaggauguuuaggggaacaugagg

SEQ ID NO: 56104 - RNA, 64 nt, hsa
ugucuccaaaaccaugccauaauaauauaagugcuuuagaaauuaaaucauuguguuuuuuaug

SEQ ID NO: 56105 - RNA, 64 nt, hsa
aaaauaagggauggucaaauauaugaaacaugucuuuagaaaauuuaggagauaaauuuauuuu

SEQ ID NO: 56106 - RNA, 64 nt, hsa
uaaaaauacuuaaauuugguuuguuaauucuuauuuuagaaauuauaauuuuaguuuauauuaa

SEQ ID NO: 56107 - RNA, 64 nt, hsa
aagauuuuaaaaguuuuguucuuuuauagacugauuuagaaaaacaaaugauuaguuaaaaaaa

SEQ ID NO: 56108 - RNA, 64 nt, hsa
gccaccaauaucuagcuauggaucguguguuuuguuuagaaaucaguagcuugguuuucuuacu

SEQ ID NO: 56109 - RNA, 64 nt, hsa
aauuaaauuaauagaaaagagaacaaacugcagguuuagaaaaaugguuuucauauucaccauu

SEQ ID NO: 56110 - RNA, 64 nt, hsa
uaaugucugagaggcacuucugucuucuccuuacuuuagaaacagaaaguauccauaccuauug

SEQ ID NO: 56111 - RNA, 64 nt, hsa
uuuuuaaagaaaagcuaagcaagagagccaaauuuuuagaaaucugauggucaaaauagcugaa

SEQ ID NO: 56112 - RNA, 64 nt, hsa
gaaauggagucucaaagcuucauaaauuuauaacuuuagaaaugauucuaauaacaacguaugu

SEQ ID NO: 56113 - RNA, 64 nt, hsa
cuggaaacgcaaacucuuuuaaggaagucccuaauuuagaaacacccacaaacuucacauauca

SEQ ID NO: 56114 - RNA, 64 nt, hsa
caguuuguucccucuuuuauuuuacuguuuucuuuuuagaaacccacuguuaaaauuuaaaaag

SEQ ID NO: 56115 - RNA, 64 nt, hsa
augugguguuuuuuuuguuuguuuguuuguuuguuuuagaaaaauugggauuuccccccacccc

SEQ ID NO: 56116 - RNA, 64 nt, hsa
caccagcacaagagaauuagagcuucagugagaauuuagaaaaauuauacuaaagugagaugca

SEQ ID NO: 56117 - RNA, 64 nt, hsa
uaagcaggauguuggccaccaggugccuuucaaauuuagaaacuaauugacuuuagaaagcuga

SEQ ID NO: 56118 - RNA, 64 nt, hsa
accaggugccuuucaaauuuagaaacuaauugacuuuagaaagcugacauugccaaaaaggaua

SEQ ID NO: 56119 - RNA, 64 nt, hsa
uuauuaauauuauacauacuugaaaaaaauuucauuuagaaaccuaguucagaaucugagcaaa

SEQ ID NO: 56120 - RNA, 64 nt, hsa
uuauuuuguucagguaggaguauuucuuguguauuuuagaaacaauuauuuuucccauuauuuc

SEQ ID NO: 56121 - RNA, 64 nt, hsa
acauaaaucugccuuuauguugcauaagugaaaauuuagaaaauuaaaagcaauuaucuuucag

SEQ ID NO: 56122 - RNA, 64 nt, hsa
aauuuauauuugucacuuuaaaaaauccauuucuuuuagaaaaaauuagggugauaggauauuc

SEQ ID NO: 56123 - RNA, 64 nt, hsa
uuguuauauuuucuggaaugauaagugagaauuauuuagaaaagacaugcuccaaaaaaaaaac

SEQ ID NO: 56124 - RNA, 64 nt, hsa
ugaugcaguauagucuuaaggguucugcauacauuuuagaaacaucuuagccguaaguuagguc

SEQ ID NO: 56125 - RNA, 64 nt, hsa
acuagagaaagucauuugcuuguacuauugccauuuuagaaagcucugaugugaauucaaauuu

SEQ ID NO: 56126 - RNA, 64 nt, hsa
aaucacuuauaaaauuuuaaauaucaagugaaaauuuagaaaggccauuacuauucuauaaacc

SEQ ID NO: 56127 - RNA, 64 nt, hsa
guguuuucgguucuuguacuuuuaacauauuccauuuagaaauuuugccauucuguuuuccauu

SEQ ID NO: 56128 - RNA, 64 nt, hsa
uaaaaguaaauuacccuuaacucuuuagccuuuauuuagaaagaaauguggaaugggcuaaacu

SEQ ID NO: 56129 - RNA, 64 nt, hsa
uugaacaugggaggcauuuuuaauggaccaaauuuuuagaaaaauuaguuuuuggauuuuuuuu

SEQ ID NO: 56130 - RNA, 64 nt, hsa
cucauuucauuuuucuaaaggggcagaggccucuuuuagaaaauaauaaaaugcaaugugugug

SEQ ID NO: 56131 - RNA, 64 nt, hsa
uggaauuaagaccaccuagauugcgagagcugaauuuagaaaccagacaacgucaugcagccca

SEQ ID NO: 56132 - RNA, 64 nt, hsa
acaggaaacuuguuuuuuuaacgucagccagauauuuagaaaauaaccucaaaaguguuuauau

SEQ ID NO: 56133 - RNA, 64 nt, hsa
aaccaaaagagguuguuaauuagcacauauuccuuuuagaaaaauguuucagaaaccucagucu

SEQ ID NO: 56134 - RNA, 64 nt, hsa
aaacaccaaaccaaaagaagguaggagugccauuuuuagaaaagacacaacuuuaauuccuguc

SEQ ID NO: 56135 - RNA, 64 nt, hsa
guauuuaaguguugucuaaacaguugauuuuuacuuuagaaaagaucaucuucaacuguuuauu

SEQ ID NO: 56136 - RNA, 64 nt, hsa
cuuugauucaauuuaaaauuuguacuuauuuucuuuuagaaauaauguauugugucugugcaga

SEQ ID NO: 56137 - RNA, 64 nt, hsa
uuacucccccucuaaacacugcugcugccuuaauuuuagaaagcagcuuacuaguuuacccuug

SEQ ID NO: 56138 - RNA, 64 nt, hsa
uccuacaggagaaaaguuguaugaauguggaaacuuuagaaauugaaggaauuuuucaguucca

SEQ ID NO: 56139 - RNA, 64 nt, hsa
cauaagaagaugaaugguagagcaaccugaaggauuuagaaauuacauauaaaucuuugcaguu

SEQ ID NO: 56140 - RNA, 64 nt, hsa
auuguuuuacuggcaguucuauaguaguccagacuuuagaaaccaaacacaacaaaauggcuug

SEQ ID NO: 56141 - RNA, 64 nt, hsa
acagauauuuucuccauuggaaagcuauuuucauuuuagaaaaauggguuguuugaagaugaaa

SEQ ID NO: 56142 - RNA, 64 nt, hsa
aguacacacuguuggcaaaaggcuaacaccugacuuuagaaaaugcugauuugagaacaaaagg

SEQ ID NO: 56143 - RNA, 64 nt, hsa
uuguguuuuuguucuuuugaagaauagagugguauuuagaaaauaaauugcauugcaaagcucu

SEQ ID NO: 56144 - RNA, 64 nt, hsa
gacugcagugggcucggauaggcccauugagguuuuuagaaaagcaggauuuguuuuguuaggg

SEQ ID NO: 56145 - RNA, 64 nt, hsa
auaauuuaagcagagcuuagcauuuauuuuauucuuuagaaaacuuaaguauuuacuuuuuuaa

SEQ ID NO: 56146 - RNA, 64 nt, hsa
caaauuuaggagcuuguucccauugccaaauggauuuagaaauucccuugugagugccugguag

SEQ ID NO: 56147 - RNA, 64 nt, hsa
aaguuuacaaccuuauuccaugcugucuuucagauuuagaaaagaucuaauuucugucucagcu

SEQ ID NO: 56148 - RNA, 64 nt, hsa
uuuauaaguauguauuacuuuuguaaucagaauuuuuagaaaguauuuugcugauuuaaaggcu

SEQ ID NO: 56149 - RNA, 64 nt, hsa
gcugauguggcuaacaaguuuauuuuaagaauuguuuagaaaugcuguugcuucagguucuuaa

SEQ ID NO: 56150 - RNA, 64 nt, hsa
aaacaguauuuauuuuuacuuuugugaccacuauuuuagaaacuuuauuuaauauuuuaauguu

SEQ ID NO: 56151 - RNA, 64 nt, hsa
cagaauuguuuuugaaagccuaagaacccagcuuuuuagaaaggauuuucacacuggcauuucu

SEQ ID NO: 56152 - RNA, 64 nt, hsa
ucuucuggguaguaauuacauugugguauuaauauuuagaaaaauggaccucagcaguguauuu

SEQ ID NO: 56153 - RNA, 64 nt, hsa
aguuaaaaaacuguaauacccuuuuguggaaagcuuuagaaaugauauaauuauuaaagauauu

SEQ ID NO: 56154 - RNA, 64 nt, hsa
guggcuuucaucgcuuuguaaaaauuugcaucuguuuagaaacuagccuauaaaauaucaccau

SEQ ID NO: 56155 - RNA, 64 nt, hsa
acaaaguuagaaaucugccgauaaccuaaaauaauuuagaaaugaauuaaaaaugugaaaucgg

SEQ ID NO: 56156 - RNA, 64 nt, hsa
agaugccauuguacuuguaggcauuuuauuuuccuuuagaaauggacaucagcucuucucuucu

SEQ ID NO: 56157 - RNA, 64 nt, hsa
cugaaagugaggaugaggauacagaguugauauuuuuagaaacaguaauuuuacuuuuaaggaa

SEQ ID NO: 56158 - RNA, 64 nt, hsa
agaugcauguagagcauucuuaggagaccauuguuuuagaaaacuuugauuuguacauguuagu

SEQ ID NO: 56159 - RNA, 64 nt, hsa
uuugggagugaccucuagaaaaaagaaaacuguuuuuagaaauacauaaaaucacuuccaaauc

SEQ ID NO: 56160 - RNA, 64 nt, hsa
uucuugguauauucuuguguuaacugcccauuggccugaaaauacucauuguaagccugaaaaa

SEQ ID NO: 56161 - RNA, 64 nt, hsa
aacugcccauuggccugaaaauacucauuguaagccugaaaaaaaaaaucuuucccacuguuuu

SEQ ID NO: 56162 - RNA, 64 nt, hsa
uaauguauguguuguuuaagaaauguauaaaaaaccugaaaaaaaugaguaagaacuggcagaa

SEQ ID NO: 56163 - RNA, 64 nt, hsa
agaaaaauauaaaaguaaaacaaacaaaaacaaaccugaaaacugcuuggcauuugaguagcuu

SEQ ID NO: 56164 - RNA, 64 nt, hsa
auagacauuauuggcaaaauugcucaucccuaauccugaaaaacaggccagaauggguaaagac

SEQ ID NO: 56165 - RNA, 64 nt, hsa
uucccuuccuuaacucucccccuuugcccuccgcccugaaaaagguguccuugaagucccuucc

SEQ ID NO: 56166 - RNA, 64 nt, hsa
uaauuaaaaauaauguaaugugccuagcacacuaccugaaaacgauggcauuuguucuuauuaa

SEQ ID NO: 56167 - RNA, 64 nt, hsa
ucuucaaacaguaucuuggugggugacuuggcuaccugaaaaaucuuaggaggaauagcucaca

SEQ ID NO: 56168 - RNA, 64 nt, hsa
uauauuuuuuaagggaugugccuaugcauugaugccugaaaaauauguauaaagaaaugagguu

SEQ ID NO: 56169 - RNA, 64 nt, hsa
cuggggcaaagacacugaugaaacaacacccauaccugaaaagaauaaaugugugacuuucaaa

SEQ ID NO: 56170 - RNA, 64 nt, hsa
uuuaucuccuauuccucaccacauagugcuuuuuccugaaaagcuggacugagaauuggccuug

SEQ ID NO: 56171 - RNA, 64 nt, hsa
ggggugcagugaaugaaacuaaagaguuguugcaccugaaaaagacaccagugauuguuuauug

SEQ ID NO: 56172 - RNA, 64 nt, hsa
gaaugacagacaaucuuauguagcaaagauuaugccugaaaaggaaaauuauucagggcagcua

SEQ ID NO: 56173 - RNA, 64 nt, hsa
ucuagauuacacugcaccauucccaaguuaauccccugaaaacuuacucucaacuggagcaaau

SEQ ID NO: 56174 - RNA, 64 nt, hsa
uuuuguguucuaauuguuuuugagauauaaagacccugaaaaagcccauuuuagaaccuguuua

SEQ ID NO: 56175 - RNA, 64 nt, hsa
ggcagccacugcccaccuccccucuacccaggggccugaaaagaggggcugcccuccugcgcca

SEQ ID NO: 56176 - RNA, 64 nt, hsa
caaaaagagauugcucucagauuuuccugaaaauccugaaaaccaggauuuuccaaucucuaca

SEQ ID NO: 56177 - RNA, 64 nt, hsa
gagagcuuccaaaaagagauugcucucagauuuuccugaaaauccugaaaaccaggauuuucca

SEQ ID NO: 56178 - RNA, 64 nt, hsa
cuuucacucugauuacccacucacuacaugaaguccugaaaauaacagagaaacuguuauaucu

SEQ ID NO: 56179 - RNA, 64 nt, hsa
uuuuaaugauuuauuugcaaguauugagauuugaccugaaaaacaaugaaacacaugaacacac

SEQ ID NO: 56180 - RNA, 64 nt, hsa
aacccuccuggggcucugggguagaugagagaagccugaaaaaggcagaguuugaaagcuccca

SEQ ID NO: 56181 - RNA, 64 nt, hsa
uggagaugcaggagcugcgggagccgaauucgguccugaaaaacacuaauuugcugcuuucuga

SEQ ID NO: 56182 - RNA, 64 nt, hsa
cacaugaggaaauaggcugucacuaucacauuguccugaaaacagcaucugcuuuccucuuggc

SEQ ID NO: 56183 - RNA, 64 nt, hsa
cuguccauugggugcagucauguagaucugaagcccugaaaagccucaugucugcauccccuuu

SEQ ID NO: 56184 - RNA, 64 nt, hsa
agagugccaaaugacaucuucccuccacccugccccugaaaaacaguacacacacauccguuca

SEQ ID NO: 56185 - RNA, 64 nt, hsa
gcacacagcguuccacugcgggguuucacgcucaccugaaaacaccuguucccaaccuacuucu

SEQ ID NO: 56186 - RNA, 64 nt, hsa
ccagcaaacguugacuucugggcaaaccugaaaaccugaaaaugccacuuucaugcaguuuguu

SEQ ID NO: 56187 - RNA, 64 nt, hsa
cuccaagcccagcaaacguugacuucugggcaaaccugaaaaccugaaaaugccacuuucaugc

SEQ ID NO: 56188 - RNA, 64 nt, hsa
ugagggacuggaagugaggccuguguugacccuuccugaaaauccucuagcagcccccgacuuc

SEQ ID NO: 56189 - RNA, 64 nt, hsa
aucacuaacuccuuccuuuuccucugcaugccagccugaaaauuccaaaucuagccucugaaug

SEQ ID NO: 56190 - RNA, 64 nt, hsa
caaaaggaacacugcuucagaguaucuuuaccuaccugaaaacauccaaggaagccaaaccauu

SEQ ID NO: 56191 - RNA, 64 nt, hsa
ccagaagugccucugcugugcuggcauaaaauaaccugaaaagauucugaaaagccaggaugug

SEQ ID NO: 56192 - RNA, 64 nt, hsa
gaggccauuggcucccagagggaacagugcuggcuguggcuagagaacagcaggucugugcagu

SEQ ID NO: 56193 - RNA, 64 nt, hsa
cugaugggggacaugccgugguggagaacacaccuguggcuaucuuaugugaggacuagaggug

SEQ ID NO: 56194 - RNA, 64 nt, hsa
guuuuuauagucaauggcuuguucaucauccagauguggcuacugacauaucuacacuucgcac

SEQ ID NO: 56195 - RNA, 64 nt, hsa
acauaucuacacuucgcaccggagugucuggaauuguggcuauccugauuauaggauuuuaacu

SEQ ID NO: 56196 - RNA, 64 nt, hsa
uacagcacccagcacugugcuguuguugucugacuguggcuaucucugucccaucacccugagc

SEQ ID NO: 56197 - RNA, 64 nt, hsa
cagaggaggggauccaguagcccuuuccacauacuguggcuacagcacccagcacugugcuguu

SEQ ID NO: 56198 - RNA, 64 nt, hsa
uugcaguuagaauaugaauauguuuuaucacuaguguggcuaaauaaccaaacauuuguguaaa

SEQ ID NO: 56199 - RNA, 64 nt, hsa
aaaaaauaagucuguuugucauauuuaaguagccuguggcuauuuuuauacugauuuugauauc

SEQ ID NO: 56200 - RNA, 64 nt, hsa
gcugugccccaucccccaagccuccugggaggauccagccaaaucuugcgacuccuggcacaca

SEQ ID NO: 56201 - RNA, 64 nt, hsa
gggucagacaucaaugucccuguccccccuggguccagccaagcugugccccaucccccaagcc

SEQ ID NO: 56202 - RNA, 64 nt, hsa
cugcagaacuaggcucccucugccacgguccgugccagccaauagauguccugaggccugcccc

SEQ ID NO: 56203 - RNA, 64 nt, hsa
augaucgagguccccaguagcucugaacaagaguccagccaacccucuucagccaggccucugu

SEQ ID NO: 56204 - RNA, 64 nt, hsa
cucaaacagcgcuacuuacucaggaucaguggcaccagccaacucagcuuugggacaaacccag

SEQ ID NO: 56205 - RNA, 64 nt, hsa
caguggcaccagccaacucagcuuugggacaaacccagccaagugaccaggacacuuuagugca

SEQ ID NO: 56206 - RNA, 64 nt, hsa
cuccugcggcgccuugcccuccuccgaccccuuuccagccaaaguccccccaccccuucagaga

SEQ ID NO: 56207 - RNA, 64 nt, hsa
cugucaucuaaccucaguccugccuacugcaguuccagccaaccugcucuuuccugaguucaaa

SEQ ID NO: 56208 - RNA, 64 nt, hsa
ccagccaaucagggccuugaggaggauguauccuccagccaaucagggccuggggaaucuguug

SEQ ID NO: 56209 - RNA, 64 nt, hsa
ucuucuggccaaucaaggcuugcuggagugucucccagccaaucagggccuugaggaggaugua

SEQ ID NO: 56210 - RNA, 64 nt, hsa
gcccacagggugcaggacuccacugaugagagauccagccaaagagcugcccccagggguauga

SEQ ID NO: 56211 - RNA, 64 nt, hsa
ggaguauuugggagagacuggcugcagauccccgccagccaagaugcaagccacucgggaccug

SEQ ID NO: 56212 - RNA, 64 nt, hsa
ugugagcaaacacacacacgugcgccuucauagcccagccaagggcaugcaggcagggugugcu

SEQ ID NO: 56213 - RNA, 64 nt, hsa
gcugugaccaccccccauccuucucccuacacucccagccaaccuagugcccaagcagcuaaac

SEQ ID NO: 56214 - RNA, 64 nt, hsa
gcuuaugugugggcacucuacugccucacagaagccagccaagugccaaggucagcuuggcugg

SEQ ID NO: 56215 - RNA, 64 nt, hsa
gagagaccugauggccagggugggguguccagcaccagccaagcuggugcuccagcgcaccucc

SEQ ID NO: 56216 - RNA, 64 nt, hsa
uuuguagcuuaugacuuauuuaaugaauggaugcccagccaagcucagaguaggcgcccaaagc

SEQ ID NO: 56217 - RNA, 64 nt, hsa
uaauguccguguagaaaaaggaccauguucuuauccagccaauacugggagugcugucuccaca

SEQ ID NO: 56218 - RNA, 64 nt, hsa
uuccacauuugggggcuauucuaaggugacuaugccagccaaccugggaaauacauaaaagaga

SEQ ID NO: 56219 - RNA, 64 nt, hsa
gacaaacugcuguggccagugggccccucugaggccagccaaggcaaagaaugcacucugcagg

SEQ ID NO: 56220 - RNA, 64 nt, hsa
cucuggccucccaggcccauccucaacagcuaccccagccaacaccaaggccacaaggggaccc

SEQ ID NO: 56221 - RNA, 64 nt, hsa
cucacccaaggccaaacuccaaacacaaucagaaccagccaaagaagcacuuccugggcacggc

SEQ ID NO: 56222 - RNA, 64 nt, hsa
gaguagcugggaccacagguucaugccaccauggccagccaacuuuugcauguuuuguagagau

SEQ ID NO: 56223 - RNA, 64 nt, hsa
guuagguagagggaguugucaagucucugcuggcccagccaaacccugucugacaaccucuugg

SEQ ID NO: 56224 - RNA, 64 nt, hsa
ccaaagcuccccccgccuuggucagggccucagaccagccaaccuuuguggaauaagccccagc

SEQ ID NO: 56225 - RNA, 64 nt, hsa
cagaccagccaaccuuuguggaauaagccccagcccagccaaaccaaacccagaugccugaggc

SEQ ID NO: 56226 - RNA, 64 nt, hsa
guuuuguuuccccaccuaauaauauauccuacaaccagccaaaugcacuuuugugaaaaugggg

SEQ ID NO: 56227 - RNA, 64 nt, hsa
aaagagaaaguagcaggaaaggaagugggaagggccagccaaggacagacuguagaggauccac

SEQ ID NO: 56228 - RNA, 64 nt, hsa
uggccuucauggagggugguaacagcaccucaguccagccaaaauguuuagaaacacucagucu

SEQ ID NO: 56229 - RNA, 64 nt, hsa
aggugggcucuguuuaggagggcagugagaccacccagccaaauugcuucucaacccuagacaa

SEQ ID NO: 56230 - RNA, 64 nt, hsa
agagggaucccugcacccaggaggccuccugacaccagccaaaauccugacagcagggucugcc

SEQ ID NO: 56231 - RNA, 64 nt, hsa
aaauaaugcuacuuucaaaguagcauuuuuuuaguuaguuuacagguuacauacccaaaaccuu

SEQ ID NO: 56232 - RNA, 64 nt, hsa
cggguaaaaggaaugacuguccuugagagaaccauuaguuuaucaaagguuuauguaguuuugu

SEQ ID NO: 56233 - RNA, 64 nt, hsa
ccuuaauuguuuuuucaagucuuccagguauuuguuaguuuagcuacuauguaacuuuuucagg

SEQ ID NO: 56234 - RNA, 64 nt, hsa
cauccuuccccuuuuuucuaaauuugaaauagcuuuaguuuaaaaaaaaauccucccuuccccc

SEQ ID NO: 56235 - RNA, 64 nt, hsa
gagccacuagccacaugaggcuauuuaaguaaauuuaguuuaaaauccaguuuucgaauuacau

SEQ ID NO: 56236 - RNA, 64 nt, hsa
gccugcuguaucuucccuauuuaguugacccacuuuaguuuauauguuuauuaguaaacaugaa

SEQ ID NO: 56237 - RNA, 64 nt, hsa
uaacaguguuaguuuuauuuuuguacugcaauuuuuaguuuaaaauauguuggaugcacucguc

SEQ ID NO: 56238 - RNA, 64 nt, hsa
gauuuuugaagggauaugacuuccuacuaaggauuuaguuuaccacaacaauucugacuacaau

SEQ ID NO: 56239 - RNA, 64 nt, hsa
gaaaugauguguuaaguuuuuauuuccaaaguguuuaguuuauuggcugauggguuguucuugg

SEQ ID NO: 56240 - RNA, 64 nt, hsa
uguuucuaaaguuggaccuugcugccaugacuguuuaguuuacagaaacuugaccccggcucau

SEQ ID NO: 56241 - RNA, 64 nt, hsa
aaacaccgagucuccaaaaauacuuaguuuagcuuuaguuuaguaaguucagaaguagaaacaa

SEQ ID NO: 56242 - RNA, 64 nt, hsa
uauccuuucuuaaacaccgagucuccaaaaauacuuaguuuagcuuuaguuuaguaaguucaga

SEQ ID NO: 56243 - RNA, 64 nt, hsa
uugcuccgauuugaauuguggagguggaagcaaauuaguuuacauggcauguccucccuaggca

SEQ ID NO: 56244 - RNA, 64 nt, hsa
aaauauuguugaauuuaaauaagguaaaucuuuuuuaguuuauauauuugcagacuauacaugu

SEQ ID NO: 56245 - RNA, 64 nt, hsa
uauacuuuugguguguuacauagccauguuucuauuaguuuacuuuuaaaucucaaauuuaagu

SEQ ID NO: 56246 - RNA, 64 nt, hsa
auauugugagcaauacugaacaucaauaauacccuuaguuuauauacuuauuauuuuaucuuua

SEQ ID NO: 56247 - RNA, 64 nt, hsa
guuguguuuuguaaacaccuauguaacucaucuuuuaguuuacacuuccuggggaaauugucuu

SEQ ID NO: 56248 - RNA, 64 nt, hsa
guaacuuggcacuuuaguaguguauacacuagcauuaguuuauacaccacuuuugccgcugggg

SEQ ID NO: 56249 - RNA, 64 nt, hsa
aauaaacuauaauuuuugaaaacuuccuuuuuuauuaguuuagaaagccccuuauuuuucaaca

SEQ ID NO: 56250 - RNA, 64 nt, hsa
acaaaggggauuuuguacacauaacauggguuauuuaguuuaacucuggcaaaaaaaaaaaaaa

SEQ ID NO: 56251 - RNA, 64 nt, hsa
uauuuuagaaaccugagacuugccgucuggcauuuuaguuuaauacaaacuaaugauugcauuu

SEQ ID NO: 56252 - RNA, 64 nt, hsa
aauguuuuuaagagcuaugugaaaacagacaauauuaguuuaggucgggaacugagauauugua

SEQ ID NO: 56253 - RNA, 64 nt, hsa
aucagugggaguucuuggcuuauguuaguuuauguuaguuuauuaugaaaacaucaaagauuuu

SEQ ID NO: 56254 - RNA, 64 nt, hsa
uaagcacugcaucagugggaguucuuggcuuauguuaguuuauguuaguuuauuaugaaaacau

SEQ ID NO: 56255 - RNA, 64 nt, hsa
gaaccuuagucuuuuuuguuuuugucuaaacauguuaguuuagugaugucuuggugaacuguga

SEQ ID NO: 56256 - RNA, 64 nt, hsa
caagcaugguccugaacaguguauuagcagagcuuuaguuuaucucaguccuggaugggagaga

SEQ ID NO: 56257 - RNA, 64 nt, hsa
accuuugaguuagcugauuucuuuauucuguucuuuaguuuauucuuacuagaugcagaggaau

SEQ ID NO: 56258 - RNA, 64 nt, hsa
gcagaggaauucaucuacugucuguuauuaacuguuaguuuauucucauacuuacgauguugag

SEQ ID NO: 56259 - RNA, 64 nt, hsa
cauuacuaaccuuuaauuuaaucaaucauguacuuuaguuuaauguauaaagauccucuagaaa

SEQ ID NO: 56260 - RNA, 64 nt, hsa
uaaaggucccaggaucacuuuuaagggauuuuuauuaguuuaaagguaaauaaagucagcugaa

SEQ ID NO: 56261 - RNA, 64 nt, hsa
ccaauuuaacuggcuaccuguuaccucagcugaguuaguuuaggaaguuuacauucguuucuaa

SEQ ID NO: 56262 - RNA, 64 nt, hsa
cuaugagauagccaaaguuucaaacacaguuaucuuaguuuaccgguggaguauuucaacacca

SEQ ID NO: 56263 - RNA, 64 nt, hsa
gcacauaggagaaccuucagcugcaucuuucuccuuaguuuacagugcaauuuuaucucaggaa

SEQ ID NO: 56264 - RNA, 64 nt, hsa
uauguacauuuauugcuauccagugucagaacaguuaguuuaggaaaaguaugcaaacuuuaau

SEQ ID NO: 56265 - RNA, 64 nt, hsa
aagccuagaaauaucuuauuuucuaaguuuaccuuuaguuuaccuaaacuuuuguucagauaac

SEQ ID NO: 56266 - RNA, 64 nt, hsa
cuucuuuuauauuuuuuggaaaccaaauuuauaguuaguuuagguaaacuuuuuauuaugacca

SEQ ID NO: 56267 - RNA, 64 nt, hsa
aagccuagaaauaucuuauuuucuaaguuuaccuuuaguuuaccuaaacuuuuguucagauaau

SEQ ID NO: 56268 - RNA, 64 nt, hsa; identical to SEQ ID NO: 56266

SEQ ID NO: 56269 - RNA, 64 nt, hsa; identical to SEQ ID NO: 47016

SEQ ID NO: 56270 - RNA, 64 nt, hsa; identical to SEQ ID NO: 47017

SEQ ID NO: 56271 - RNA, 64 nt, hsa; identical to SEQ ID NO: 47018

SEQ ID NO: 56272 - RNA, 64 nt, hsa; identical to SEQ ID NO: 47019

SEQ ID NO: 56273 - RNA, 64 nt, hsa; identical to SEQ ID NO: 47020

SEQ ID NO: 56274 - RNA, 64 nt, hsa; identical to SEQ ID NO: 47021

SEQ ID NO: 56275 - RNA, 64 nt, hsa; identical to SEQ ID NO: 47022

SEQ ID NO: 56276 - RNA, 64 nt, hsa; identical to SEQ ID NO: 47023

SEQ ID NO: 56277 - RNA, 64 nt, hsa; identical to SEQ ID NO: 47024

SEQ ID NO: 56278 - RNA, 64 nt, hsa; identical to SEQ ID NO: 47025

SEQ ID NO: 56279 - RNA, 64 nt, hsa; identical to SEQ ID NO: 47026

SEQ ID NO: 56280 - RNA, 64 nt, hsa; identical to SEQ ID NO: 47027

SEQ ID NO: 56281 - RNA, 64 nt, hsa; identical to SEQ ID NO: 47028

SEQ ID NO: 56282 - RNA, 64 nt, hsa; identical to SEQ ID NO: 47029

SEQ ID NO: 56283 - RNA, 64 nt, hsa; identical to SEQ ID NO: 47030

SEQ ID NO: 56284 - RNA, 64 nt, hsa; identical to SEQ ID NO: 47031

SEQ ID NO: 56285 - RNA, 64 nt, hsa; identical to SEQ ID NO: 47032

SEQ ID NO: 56286 - RNA, 64 nt, hsa; identical to SEQ ID NO: 47033

SEQ ID NO: 56287 - RNA, 64 nt, hsa; identical to SEQ ID NO: 47034

SEQ ID NO: 56288 - RNA, 64 nt, hsa; identical to SEQ ID NO: 47035

SEQ ID NO: 56289 - RNA, 64 nt, hsa; identical to SEQ ID NO: 47036

SEQ ID NO: 56290 - RNA, 64 nt, hsa; identical to SEQ ID NO: 47037

SEQ ID NO: 56291 - RNA, 64 nt, hsa; identical to SEQ ID NO: 47038

SEQ ID NO: 56292 - RNA, 64 nt, hsa; identical to SEQ ID NO: 47039

SEQ ID NO: 56293 - RNA, 64 nt, hsa; identical to SEQ ID NO: 47040

SEQ ID NO: 56294 - RNA, 64 nt, hsa; identical to SEQ ID NO: 47041

SEQ ID NO: 56295 - RNA, 64 nt, hsa; identical to SEQ ID NO: 47042

SEQ ID NO: 56296 - RNA, 64 nt, hsa; identical to SEQ ID NO: 47043

SEQ ID NO: 56297 - RNA, 64 nt, hsa; identical to SEQ ID NO: 47044

SEQ ID NO: 56298 - RNA, 64 nt, hsa; identical to SEQ ID NO: 47045

SEQ ID NO: 56299 - RNA, 64 nt, hsa; identical to SEQ ID NO: 47046

SEQ ID NO: 56300 - RNA, 64 nt, hsa; identical to SEQ ID NO: 47047

SEQ ID NO: 56301 - RNA, 64 nt, hsa; identical to SEQ ID NO: 47048

SEQ ID NO: 56302 - RNA, 64 nt, hsa; identical to SEQ ID NO: 47049

SEQ ID NO: 56303 - RNA, 64 nt, hsa; identical to SEQ ID NO: 47050

SEQ ID NO: 56304 - RNA, 64 nt, hsa; identical to SEQ ID NO: 47051

SEQ ID NO: 56305 - RNA, 64 nt, hsa; identical to SEQ ID NO: 47052

SEQ ID NO: 56306 - RNA, 64 nt, hsa; identical to SEQ ID NO: 47053

SEQ ID NO: 56307 - RNA, 64 nt, hsa; identical to SEQ ID NO: 47054

SEQ ID NO: 56308 - RNA, 51 nt, hsa; identical to SEQ ID NO: 47055

SEQ ID NO: 56309 - RNA, 64 nt, hsa; identical to SEQ ID NO: 47056

SEQ ID NO: 56310 - RNA, 64 nt, hsa; identical to SEQ ID NO: 47057

SEQ ID NO: 56311 - RNA, 64 nt, hsa; identical to SEQ ID NO: 47058

SEQ ID NO: 56312 - RNA, 64 nt, hsa; identical to SEQ ID NO: 47059

SEQ ID NO: 56313 - RNA, 64 nt, hsa; identical to SEQ ID NO: 47060

SEQ ID NO: 56314 - RNA, 64 nt, hsa; identical to SEQ ID NO: 47061

SEQ ID NO: 56315 - RNA, 64 nt, hsa; identical to SEQ ID NO: 47062

SEQ ID NO: 56316 - RNA, 64 nt, hsa; identical to SEQ ID NO: 47063

SEQ ID NO: 56317 - RNA, 64 nt, hsa; identical to SEQ ID NO: 47064

SEQ ID NO: 56318 - RNA, 64 nt, hsa; identical to SEQ ID NO: 47065

SEQ ID NO: 56319 - RNA, 64 nt, hsa; identical to SEQ ID NO: 47066

SEQ ID NO: 56320 - RNA, 64 nt, hsa; identical to SEQ ID NO: 47067

SEQ ID NO: 56321 - RNA, 64 nt, hsa; identical to SEQ ID NO: 47068

SEQ ID NO: 56322 - RNA, 64 nt, hsa; identical to SEQ ID NO: 47069

SEQ ID NO: 56323 - RNA, 64 nt, hsa; identical to SEQ ID NO: 47070

SEQ ID NO: 56324 - RNA, 64 nt, hsa; identical to SEQ ID NO: 47071

SEQ ID NO: 56325 - RNA, 64 nt, hsa; identical to SEQ ID NO: 47072

SEQ ID NO: 56326 - RNA, 64 nt, hsa; identical to SEQ ID NO: 47073

SEQ ID NO: 56327 - RNA, 64 nt, hsa; identical to SEQ ID NO: 47074

SEQ ID NO: 56328 - RNA, 64 nt, hsa; identical to SEQ ID NO: 47075

SEQ ID NO: 56329 - RNA, 64 nt, hsa; identical to SEQ ID NO: 47076

SEQ ID NO: 56330 - RNA, 64 nt, hsa; identical to SEQ ID NO: 47077

SEQ ID NO: 56331 - RNA, 64 nt, hsa; identical to SEQ ID NO: 47078

SEQ ID NO: 56332 - RNA, 64 nt, hsa; identical to SEQ ID NO: 47079

SEQ ID NO: 56333 - RNA, 64 nt, hsa; identical to SEQ ID NO: 47080

SEQ ID NO: 56334 - RNA, 64 nt, hsa; identical to SEQ ID NO: 47081

SEQ ID NO: 56335 - RNA, 64 nt, hsa; identical to SEQ ID NO: 47082

SEQ ID NO: 56336 - RNA, 64 nt, hsa; identical to SEQ ID NO: 47083

SEQ ID NO: 56337 - RNA, 64 nt, hsa
auagaucaguuggagaaaauacaaaacaauucaaagcucuuaagguauuuaaaccuuucuucuc

SEQ ID NO: 56338 - RNA, 64 nt, hsa
ccaacuuaugugaccccugagggguggggcugugagcucuuaauuuguuuuugauucugaaaaa

SEQ ID NO: 56339 - RNA, 64 nt, hsa
gugugggucacaguacuguguucuuaguugcuuuagcucuuaaaacauacgaaguguugccuaa

SEQ ID NO: 56340 - RNA, 64 nt, hsa
cugaggacuggaugguagaauacuggggucccccagcucuuagcaggaugcaggcuauugcuuc

SEQ ID NO: 56341 - RNA, 64 nt, hsa
cagccagaggaccuuccuggcuaugcaggugcacagcucuuaggcaucaagcaaagggucagcc

SEQ ID NO: 56342 - RNA, 64 nt, hsa
gaaaaggagucaggaaaacuacagguguuguccaagcucuuagcgguuauccacgaacuucgac

SEQ ID NO: 56343 - RNA, 64 nt, hsa
uguuggaaaauaguccccaucuaauauguauaggagcucuuaaaaaacugugcaaucaccccug

SEQ ID NO: 56344 - RNA, 64 nt, hsa
ccauuuguuuuucuccaaguuaggucucaucuacagcucuuagcuucucaguaaagaggauacu

SEQ ID NO: 56345 - RNA, 64 nt, hsa
gagucgucagacugaaaggccagguuguagucccagcucuuaucugccaucuuggacaaagcuu

SEQ ID NO: 56346 - RNA, 64 nt, hsa
accccaacucugcccuucucccauccaagagaaaccagcaaaaugauaaagaagcuaaccugcc

SEQ ID NO: 56347 - RNA, 64 nt, hsa
aaguagcugggaugacaggcgcacaccaccacgcccagcaaauuuuuuguauuuuuaguagaaa

SEQ ID NO: 56348 - RNA, 64 nt, hsa
cuuguaaugaucgaauacccacucugauguuuugccagcaaagggauaucuaauauuucagaag

SEQ ID NO: 56349 - RNA, 64 nt, hsa
cugaugagaaauagggaauacucccaguccaggcccagcaaaaccaaaaugcuaagcaaugaau

SEQ ID NO: 56350 - RNA, 64 nt, hsa
ugaaggaguacacaaaccagagaaugacaugaauccagcaaauaggauccaacacaggcaauau

SEQ ID NO: 56351 - RNA, 64 nt, hsa
ugcccuuuuuagggaagcuguuggagaaaauacuccagcaaaaugaaggaguacacaaaccaga

SEQ ID NO: 56352 - RNA, 64 nt, hsa
cucuaagauaagaggccaggccagucaguuuggcccagcaaacauguggguacuucuccaccua

SEQ ID NO: 56353 - RNA, 64 nt, hsa
uuagauuucuaucucuuguaagucacucuuuuaaccagcaaaggacuuucaucuuagauuaucc

SEQ ID NO: 56354 - RNA, 64 nt, hsa
gaaagggaggguggagggugaggccaaaucagguccagcaaaagucaguagggacauugcagaa

SEQ ID NO: 56355 - RNA, 64 nt, hsa
aaaccacaccagggaggaaaaaugacauucagaaccagcaaacacugaauuucucuuguuguuu

SEQ ID NO: 56356 - RNA, 64 nt, hsa
ucuucaucaagaaaaaguggaaccagcugucccuccagcaaaaacagcagcccuaauagcagcc

SEQ ID NO: 56357 - RNA, 64 nt, hsa
aauaagccgucaaguaguaagaagaacuuggaugccagcaaagagaauggggcugggcagaucu

SEQ ID NO: 56358 - RNA, 64 nt, hsa
cucaguauugagacacugucaagauuaaguuauaccagcaaaagugcaguagugucacuuuuuu

SEQ ID NO: 56359 - RNA, 64 nt, hsa
agauggauuugacacacucaccauuuaaucauuuccagcaaaauauauguuuggcugaaauuau

SEQ ID NO: 56360 - RNA, 64 nt, hsa
agaaaaaggccgggugacaccggggggcucccagcccgugcacccuggaagggcaggucuggcg

SEQ ID NO: 56361 - RNA, 64 nt, hsa
accuucguauccccucucagucgcccggggcugucccgugcauggguuggcuguggggacccca

SEQ ID NO: 56362 - RNA, 64 nt, hsa
ucaaaguggauuuuuaaaaaguguuuuagcaauacuccuuaaccaaauaaaccuucggagaacg

SEQ ID NO: 56363 - RNA, 64 nt, hsa
gggaccaauuaugaggacugacauccuggccacucuccuuaaaauaaacacugacauuuuucuu

SEQ ID NO: 56364 - RNA, 64 nt, hsa
augaugggcacagagcaucacaugagcuguuucucuccuuaaagaagaucccuggaaaggaugc

SEQ ID NO: 56365 - RNA, 64 nt, hsa
ccuuaggccauaucaacuuuggccaucaauaucucuccuuaaacaauuauauuucaccuuuuag

SEQ ID NO: 56366 - RNA, 64 nt, hsa
cuugaaucugaaagagcauuauuccuggucaaagcuccuuaaaguucugggcagcuaaaagcau

SEQ ID NO: 56367 - RNA, 64 nt, hsa
cuucaagaaaaaaaaaaaaucucuccccaaugcucuccuuaaccuuuaagucuuacaggaagcc

SEQ ID NO: 56368 - RNA, 64 nt, hsa
auuauuauugugaaaauauuauuaacacuggggacuccuuaagaguacaucagaguucucucua

SEQ ID NO: 56369 - RNA, 64 nt, hsa
cgauuucuuagccuccauaaucacaugagccaaucuccuuaauaaaugccugcucauagaucug

SEQ ID NO: 56370 - RNA, 64 nt, hsa
cacagcugcuuucuucuuacaccccggucucaugcuccuuaauggcgccaugggugcuuguugg

SEQ ID NO: 56371 - RNA, 64 nt, hsa
cugacuccaaccauucaaaaauuucaccccaucccuccuuaagagauuggaucaaguauuacua

SEQ ID NO: 56372 - RNA, 64 nt, hsa
uugagguuaagauauagcuagugucugaacgacacuccuuaaaguaaguuccaaauguaaaaca

SEQ ID NO: 56373 - RNA, 64 nt, hsa
gacacuccuuaaaguaaguuccaaauguaaaacacuccuuaaguuccaaauguuuuccgcuaau

SEQ ID NO: 56374 - RNA, 64 nt, hsa
uucucuuuauaaaugaauuuuguguucuuuaguucuccuuaaaagaacuuuugaauuauaaaaa

SEQ ID NO: 56375 - RNA, 64 nt, hsa
uccuagggcugccauggucacaagcacacugaugcuccuuaagauuguuuaucuggagcccaca

SEQ ID NO: 56376 - RNA, 64 nt, hsa
ggaauaugucacacuccuuaauagggaccugugacuccuuaauaaggaccugugacaugcccag

SEQ ID NO: 56377 - RNA, 64 nt, hsa
aauucuaccaagacacucaauggaauaugucacacuccuuaauagggaccugugacuccuuaau

SEQ ID NO: 56378 - RNA, 64 nt, hsa
agcaagugacuuucuaaguaggaugaaucauauucauaugcagaugucuuagccucuugacgcu

SEQ ID NO: 56379 - RNA, 64 nt, hsa
agcaagugaacacuguucuaccaagaacugaaggcauaugcacagucaaggucacuuaaagggu

SEQ ID NO: 56380 - RNA, 64 nt, hsa
aaauggugcuuuauauuuagauuggaaagaauuucauaugcaaagcauauuaaagagaaagccc

SEQ ID NO: 56381 - RNA, 64 nt, hsa
ccuucuaucacccuacauuccagcaucuuaccuucauaugcaguaaaagaaagaaagaaaaaaa

SEQ ID NO: 56382 - RNA, 64 nt, hsa
gaaggcaaaaggugacaguaaaaacaguaagauccauaugcauaagauuguacaaggcuauuca

SEQ ID NO: 56383 - RNA, 64 nt, hsa
caaagaucuuaaugaguaaaacaacugcuacauacauaugcagaauguguaauaaaacaaaaag

SEQ ID NO: 56384 - RNA, 64 nt, hsa
ugcaaaaaugaguaugaggaaaucaaauguaaaucauaugcaaauauuauucaaccaagcuucu

SEQ ID NO: 56385 - RNA, 64 nt, hsa
aaagcugugauacuaaggagaggagagauuaugucauaugcaacugcucuaggcugugcagggg

SEQ ID NO: 56386 - RNA, 64 nt, hsa
acauaugcaaagcuuuccuuaacaguaaaggguacauaugcauagugggaggagaucagaccuu

SEQ ID NO: 56387 - RNA, 64 nt, hsa
uuuaguauuuacguagcuuauucuucuauaucuacauaugcaaagcuuuccuuaacaguaaagg

SEQ ID NO: 56388 - RNA, 64 nt, hsa
ugcauuugaggauuuuaauuuauggaaagcacaacauaugcaauuauauuuauugaauuccuag

SEQ ID NO: 56389 - RNA, 64 nt, hsa
uauaggaacaaauaaauaaauuguugugugugcacauaugcauauauuuuguguucauucuacu

SEQ ID NO: 56390 - RNA, 64 nt, hsa
ucuuuaauaaauggugcugggaaaacuggauauccauaugcagaagaaugaaacuagaccccca

SEQ ID NO: 56391 - RNA, 64 nt, hsa
uaaugaaaccagcauuuaguaccagcauaugguucauaugcaaauaauacuuuccccaaaaucu

SEQ ID NO: 56392 - RNA, 64 nt, hsa
ccugguuuuguuucauuuugcucuguuuuaaauccauaugcaaauaaaacugcuucucucuuac

SEQ ID NO: 56393 - RNA, 64 nt, hsa
gcgcuuugugcacuuggaggggaaaacccaacuacauaugcacuuucuugguugugugugcuau

SEQ ID NO: 56394 - RNA, 64 nt, hsa
ucaggaaccaucucugucccaggugcucagcccucauaugcauuuucuucuggagccucuuaga

SEQ ID NO: 56395 - RNA, 64 nt, hsa
ggcagguacacaaaggaccuuagaugagaucuggcauaugcacccgcaauagaagggcaccacu

SEQ ID NO: 56396 - RNA, 64 nt, hsa
ccucaucuggguuugaccacuuuuuauacauguucauaugcauauggcagcaacaagagaaccc

SEQ ID NO: 56397 - RNA, 64 nt, hsa
gucuguauugaucauggaugcccuccuuaauagccauaugcaauaaaauaaaguacauuauuua

SEQ ID NO: 56398 - RNA, 64 nt, hsa
aauuuuccucuauccuguacauuucacaaaaaggcauaugcaauauuuacauuuuuaauuuagu

SEQ ID NO: 56399 - RNA, 64 nt, hsa
caaggcaaggaaggguguugcagagagggaacagcauaugcaaaggcguaucaguucauggcau

SEQ ID NO: 56400 - RNA, 64 nt, hsa
aaaaaaauuaacaugucacaauguaacggaugaccauaugcacaauuccaugaauuaaaucugu

SEQ ID NO: 56401 - RNA, 64 nt, hsa
cauucaguaagugguacugggauaacuagcuagccauaugcagaggauugaaacugaaccacuu

SEQ ID NO: 56402 - RNA, 64 nt, hsa
ugcagaggauugaaacugaaccacuuccuuacaccauaugcaaaaaucaacucaagauggauua

SEQ ID NO: 56403 - RNA, 64 nt, hsa; identical to SEQ ID NO: 50680

SEQ ID NO: 56404 - RNA, 64 nt, hsa; identical to SEQ ID NO: 50681

SEQ ID NO: 56405 - RNA, 64 nt, hsa; identical to SEQ ID NO: 50682

SEQ ID NO: 56406 - RNA, 64 nt, hsa; identical to SEQ ID NO: 50683

SEQ ID NO: 56407 - RNA, 64 nt, hsa; identical to SEQ ID NO: 50684

SEQ ID NO: 56408 - RNA, 64 nt, hsa; identical to SEQ ID NO: 50685

SEQ ID NO: 56409 - RNA, 64 nt, hsa; identical to SEQ ID NO: 50686

SEQ ID NO: 56410 - RNA, 64 nt, hsa; identical to SEQ ID NO: 50687

SEQ ID NO: 56411 - RNA, 64 nt, hsa; identical to SEQ ID NO: 50688

SEQ ID NO: 56412 - RNA, 64 nt, hsa; identical to SEQ ID NO: 50689

SEQ ID NO: 56413 - RNA, 64 nt, hsa; identical to SEQ ID NO: 50690

SEQ ID NO: 56414 - RNA, 64 nt, hsa; identical to SEQ ID NO: 50691

SEQ ID NO: 56415 - RNA, 64 nt, hsa; identical to SEQ ID NO: 50692

SEQ ID NO: 56416 - RNA, 64 nt, hsa; identical to SEQ ID NO: 50693

SEQ ID NO: 56417 - RNA, 61 nt, hsa
aaaacuaaccgugaccacuacuccaaacaaaacacaauaugccuaggggcacggaugaacg

SEQ ID NO: 56418 - RNA, 61 nt, hsa
uaauguaguuagaaguuucauugucugauggacacaauaugcccuuccgguucuauucaaa

SEQ ID NO: 56419 - RNA, 61 nt, hsa
ugauaaugcuuuuccaaagugaaaauaagauacacaauaaucauugcucugugugauuaca

SEQ ID NO: 56420 - RNA, 61 nt, hsa
uaauuguauuuuguguuuauacagguauuucacacaauaauuuguucuuaaugcagccacu

SEQ ID NO: 56421 - RNA, 61 nt, hsa
aaaucuuaauagauuuaaugcaauuuuacagacacaauaccuucaugaauuucaaaauuca

SEQ ID NO: 56422 - RNA, 61 nt, hsa
cuugugcacugaaagcuaacagggagagguuacacaauauuuuacaguuucuuaaacauaa

SEQ ID NO: 56423 - RNA, 61 nt, hsa
uuuucuguaauguaaauaaacuauuuauaucacacaauauaguuuuuucuuucccauguau

SEQ ID NO: 56424 - RNA, 61 nt, hsa
cacaguggcuggacuaccgagagcuuggacuacacaauacaguauuauagacaaaagaaua

SEQ ID NO: 56425 - RNA, 61 nt, hsa
aggguauuugauacaaucauuaauggaucauacacaauagguuuuuaaaaauuaauaacuu

SEQ ID NO: 56426 - RNA, 61 nt, hsa
acaugaucugauacaaccauuaaugaaucauacacaauagguuuuuuaaaauuaauauuaa

SEQ ID NO: 56427 - RNA, 64 nt, hsa
ugcaagaauuucuggaagaaaggcuguggaagggccaauggagaaaaugaauggacaaagcuca

SEQ ID NO: 56428 - RNA, 64 nt, hsa
uuuaugugugcagacaauucucccugagguuagcccaauggagaaaugaagcagaggaaggaaa

SEQ ID NO: 56429 - RNA, 64 nt, hsa
uaaaacuuggccuccuccagccccucucauggcaccaauggaaguguccuccuguucucugguc

SEQ ID NO: 56430 - RNA, 64 nt, hsa
uccacuuauucuugacucugagaacuuuuggaacccaauggaaucagcauuucaaggucaagau

SEQ ID NO: 56431 - RNA, 64 nt, hsa
uaaugaauuucugguuuguauuaaauauguccuuccaauggauaaguucuaaaacauacgcuau

SEQ ID NO: 56432 - RNA, 64 nt, hsa
uaguacaagcagcccaagaaacucugaacggggcccaauggaggcaaacuugagcaaauaauug

SEQ ID NO: 56433 - RNA, 64 nt, hsa
accaauggggaccuacccaaaccaauauucauccccaauggaaugccaaacacuguugugccau

SEQ ID NO: 56434 - RNA, 64 nt, hsa
cuggucacuccucaggaccaugagguagcuuuggccaauggauuccuuuaugagcaugaagcau

SEQ ID NO: 56435 - RNA, 64 nt, hsa
uagccauguguuaauauaaaguaggcauggcuucccaauggaaaucucugagaaugacagugga

SEQ ID NO: 56436 - RNA, 64 nt, hsa
aaacuaacuuuuagcuaacaauaagggcugugccccaauggaaacugaguucauuuucugagaa

SEQ ID NO: 56437 - RNA, 57 nt, hsa
gucuccagacucacgugugacaucuuuccaauggaagaguccugggaucuccaacuu

SEQ ID NO: 56438 - RNA, 64 nt, hsa
cacccuggcucucccugaggggaacuuugcucggccaauggaaaugcagccaagauggccauau

SEQ ID NO: 56439 - RNA, 64 nt, hsa
cugucccugcguguggccacuccucagcauccuccccacccaccaugguucauuccgacuuuuc

SEQ ID NO: 56440 - RNA, 64 nt, hsa
accgccacguggccuucagaggaauccacagguccccacccaagaucccucaauuauaugggga

SEQ ID NO: 56441 - RNA, 64 nt, hsa
ggaaggcacugguuaggaaggauguucaaacggucccacccaagccugucaccucugcucaucc

SEQ ID NO: 56442 - RNA, 64 nt, hsa
gccaugccuaccaagcucgagcuggcccuugacccccacccacccccacccuugcuggcagggg

SEQ ID NO: 56443 - RNA, 64 nt, hsa
aucaaaccccauggagcagccagcguuagaugcccccacccaccuguacucuggagagacugug

SEQ ID NO: 56444 - RNA, 64 nt, hsa
cuguaaggcaaaauaaucuaaaaagacuaaccugcccacccacuccuuauauugcugugagauu

SEQ ID NO: 56445 - RNA, 64 nt, hsa
cucucuaggccauccccucuucuaccuccugcaacccacccauccuauuagccucccacauuca

SEQ ID NO: 56446 - RNA, 64 nt, hsa
uuccuugggcuucuccugagguaaugauuacccccccacccacagcugagucugugaggcccca

SEQ ID NO: 56447 - RNA, 64 nt, hsa
uccaucgcagggugcucacacacccccacacccacccacccacacacaacacugggacaauuca

SEQ ID NO: 56448 - RNA, 64 nt, hsa
cuauuccaucgcagggugcucacacacccccacacccacccacccacacacaacacugggacaa

SEQ ID NO: 56449 - RNA, 64 nt, hsa
uguuucauccaccggcugcacaggcacaaacucccccacccaggacggcugugaugagguggcc

SEQ ID NO: 56450 - RNA, 64 nt, hsa
auguccagaggccuagggagguuuuagggcccuccccacccacacccacaggucgauuuggucu

SEQ ID NO: 56451 - RNA, 64 nt, hsa
cccuugcccgugauggcuccuuggggucugccugcccacccacaugagcccgcgaguauggcag

SEQ ID NO: 56452 - RNA, 64 nt, hsa
uauucuuagguuagcggagcuuuuuccucuuuuccccacccaucuccccaauauugcccauuau

SEQ ID NO: 56453 - RNA, 64 nt, hsa
uggggggcccacuagcagcccccagcaucucccacccacccagcuagggcagaggggucaggau

SEQ ID NO: 56454 - RNA, 64 nt, hsa
gggcuggggggcccacuagcagcccccagcaucucccacccacccagcuagggcagagggguca

SEQ ID NO: 56455 - RNA, 64 nt, hsa
gagugguuaaaaaagauaccuuauccuauuccuccccacccacccauguuuuuaaacuaauuua

SEQ ID NO: 56456 - RNA, 64 nt, hsa
gguuaaaaaagauaccuuauccuauuccuccccacccacccauguuuuuaaacuaauuuauaua

SEQ ID NO: 56457 - RNA, 64 nt, hsa
ccuccaccgcuguuccgcugcagccccgcccugccccacccacccagugccuugcugaagccca

SEQ ID NO: 56458 - RNA, 64 nt, hsa
caccgcuguuccgcugcagccccgcccugccccacccacccagugccuugcugaagcccauagc

SEQ ID NO: 56459 - RNA, 64 nt, hsa
gugccuuuucuuuuauuucagugcugccuucccacccacccaguccauucacccucaccucucc

SEQ ID NO: 56460 - RNA, 64 nt, hsa
ucuggugccuuuucuuuuauuucagugcugccuucccacccacccaguccauucacccucaccu

SEQ ID NO: 56461 - RNA, 64 nt, hsa
gcgcccuccuccuggccuucugacgggcggcguucccacccacaccuucgacgcgacgccuacg

SEQ ID NO: 56462 - RNA, 64 nt, hsa
cggucccccgucucccggccgccccucuucccuucccacccagcugcgcccucggcucggucuc

SEQ ID NO: 56463 - RNA, 64 nt, hsa
cccagcuggccugagcagggggccugccaccagacccacccacgcucugacgagaggcuuuucc

SEQ ID NO: 56464 - RNA, 64 nt, hsa
cacucagagucugggucucacuggccccaagucucccacccagaacucuggccaaaaauggcuc

SEQ ID NO: 56465 - RNA, 64 nt, hsa
cgcuaccuguggccuuuuaacauucaagaguaugcccacccagccccaaagccaccggcaugug

SEQ ID NO: 56466 - RNA, 64 nt, hsa
cuaauagaggcagugagacugcaggugggcugggcccacccagggagcugaugccccuucuccc

SEQ ID NO: 56467 - RNA, 64 nt, hsa
ccuuccuguucuuccuuccuagaagccccugucgcccacccagcugguccuguggaugggaucc

SEQ ID NO: 56468 - RNA, 50 nt, hsa
gaaacaccgcagaccacuagcccacccagcaucagagaccuucucuuccu

SEQ ID NO: 56469 - RNA, 64 nt, hsa
cuucuccuucuaccacucuuaaauuuacucccuccccacccagaacccagaugggguggagggg

SEQ ID NO: 56470 - RNA, 64 nt, hsa
uggcccccuccccccccgccccucugcuucccuccccacccaccaccucaaggguagggaguug

SEQ ID NO: 56471 - RNA, 64 nt, hsa
guucuccuggcaggccugcugugugccaaaaacucccacccaaggucccucaggggauauuuca

SEQ ID NO: 56472 - RNA, 64 nt, hsa
acaaccuaugacccccucccccaggacaccaccucccacccacagaccuucccuuuagcuguug

SEQ ID NO: 56473 - RNA, 64 nt, hsa
gcuugagaagcccccucucccugguccucuccuacccacccauguccucucagaaccccagccu

SEQ ID NO: 56474 - RNA, 64 nt, hsa
caggcuuagaggacagaaaaaugugaagagacgccccacccacccucagccagcccucuccagu

SEQ ID NO: 56475 - RNA, 64 nt, hsa
uguccccauaguacaguucuucaguggacaugaccccacccagcccccugcagcccugcugcac

SEQ ID NO: 56476 - RNA, 64 nt, hsa
cucccaucuguccccaucuuccuccccacaccuacccacccagugggcccugaagcagggccaa

SEQ ID NO: 56477 - RNA, 64 nt, hsa
ucaguccagcuggaggcuggagggagacacaggccccacccagcagacugaggggcagaggcac

SEQ ID NO: 56478 - RNA, 64 nt, hsa
aacugugaauuggagaaauggagcucuguggcuucccacccaaaccuucucaguccagcuggag

SEQ ID NO: 56479 - RNA, 64 nt, hsa
cucucugcagugcccuccucgccugugcagcccgcccacccacaggcucaccccuccugccggc

SEQ ID NO: 56480 - RNA, 64 nt, hsa
ugcuggccgccuucuuggugccaaacccccuucccccacccagagacugggcagcugugucugg

SEQ ID NO: 56481 - RNA, 64 nt, hsa
augggccugguugggagcagccccuggcccauugcccacccacccaucucacuaugcaauucga

SEQ ID NO: 56482 - RNA, 64 nt, hsa
gccugguugggagcagccccuggcccauugcccacccacccaucucacuaugcaauucgaguuc

SEQ ID NO: 56483 - RNA, 64 nt, hsa
uuuggcauucucugaauuuauuuccucuccuucccccacccagcuuucuuuuuauggccccagg

SEQ ID NO: 56484 - RNA, 64 nt, hsa
gugggcuuggggcuacgcgccaggagagucuccccccacccaccuuuuuucuuugguugcuuuu

SEQ ID NO: 56485 - RNA, 64 nt, hsa
ucccacccauauaucccuccuuuaccauaguacucccacccacuuccaucacccauccaauaaa

SEQ ID NO: 56486 - RNA, 64 nt, hsa
gggggagggggaugggggacuuuuguugguggcucccacccauauaucccuccuuuaccauagu

SEQ ID NO: 56487 - RNA, 64 nt, hsa
acuucucccagucuccccgagucacagugccgaucccacccacccaccguagggugcacagcaa

SEQ ID NO: 56488 - RNA, 64 nt, hsa
cucccagucuccccgagucacagugccgaucccacccacccaccguagggugcacagcaaggca

SEQ ID NO: 56489 - RNA, 64 nt, hsa
gccuuuccuccccacuggagggcaagcccccccacccacccaggauguccuggcucacuccgca

SEQ ID NO: 56490 - RNA, 64 nt, hsa
cagugccuuuccuccccacuggagggcaagcccccccacccacccaggauguccuggcucacuc

SEQ ID NO: 56491 - RNA, 64 nt, hsa
uugguguggcuuacuauuucauugugugcacccacccacccaccacacuggacuuuucuagaga

SEQ ID NO: 56492 - RNA, 64 nt, hsa
gccuuugguguggcuuacuauuucauugugugcacccacccacccaccacacuggacuuuucua

SEQ ID NO: 56493 - RNA, 64 nt, hsa
aaaaaaagguagcugugauacaaaccccaggacacccacccacccaaagagccaaagaauaguu

SEQ ID NO: 56494 - RNA, 64 nt, hsa
aaagguagcugugauacaaaccccaggacacccacccacccaaagagccaaagaauaguuccug

SEQ ID NO: 56495 - RNA, 64 nt, hsa
caaggagaacguuugguacaaucgacauccuagccccacccagagguggcccucccaggcuggu

SEQ ID NO: 56496 - RNA, 64 nt, hsa
aaaaacuuugcuccaggcaucacugauucccucucccacccaaggagaacguuugguacaaucg

SEQ ID NO: 56497 - RNA, 64 nt, hsa
cagccagugcccugagccagggucuccagaaagccccacccaggccaggcauguggcagggguu

SEQ ID NO: 56498 - RNA, 64 nt, hsa
cucuuccccagacgccuggcugcugaucgccuuccccacccaccaacccucagggcaaagccag

SEQ ID NO: 56499 - RNA, 64 nt, hsa
cagguccugcagcaccuuaguccauacuaccagccccacccaccuuccuuccucuucccucuuc

SEQ ID NO: 56500 - RNA, 64 nt, hsa
ccaccucccaccuagaggagaccaugggcccugccccacccacuccaggauguuaggguccccu

SEQ ID NO: 56501 - RNA, 64 nt, hsa
cagcugccuugggcuggggccugcggaggggaagcccacccacaaugcauggaguauuauuuuu

SEQ ID NO: 56502 - RNA, 64 nt, hsa
ugggggguccuggccccugugaugcucccccauccccacccacuucuacauccauccacacccc

SEQ ID NO: 56503 - RNA, 64 nt, hsa
caaaggguccugcccacagcgcccuguaccugcucccacccagcccuuggugugcccacccagc

SEQ ID NO: 56504 - RNA, 64 nt, hsa
gcccuguaccugcucccacccagcccuuggugugcccacccagccuccucuccagcaccuugcu

SEQ ID NO: 56505 - RNA, 64 nt, hsa
ccccaaagccaagaagaucaagucucagcaccggcccacccaaagauucuggcccaacuccauc

SEQ ID NO: 56506 - RNA, 64 nt, hsa
accaaaucccugaggauagauggcacccauggcccccacccacggaaggacuugaguuguuuac

SEQ ID NO: 56507 - RNA, 64 nt, hsa
cccaagagccugcggggaugcccaucccacacaccccacccagcuguucuaacccugcuaucca

SEQ ID NO: 56508 - RNA, 64 nt, hsa
gaggcucuccacuguccacccuaacacauacccucccacccaccuuccagacccccuugguugg

SEQ ID NO: 56509 - RNA, 64 nt, hsa
uggccuugcaucugaauaggccuacccucacccacccacccaguuuaauugugcuuagagccca

SEQ ID NO: 56510 - RNA, 64 nt, hsa
uugcuggccuugcaucugaauaggccuacccucacccacccacccaguuuaauugugcuuagag

SEQ ID NO: 56511 - RNA, 64 nt, hsa
aggguggcagcuccccaaggcccugccccccagccccacccacucaugacucuaaguguguugu

SEQ ID NO: 56512 - RNA, 64 nt, hsa
ggccuccugcuucuugccuaccacuuggccagugcccacccagccccucagguggcacaucugg

SEQ ID NO: 56513 - RNA, 64 nt, hsa
cagcgggccgagugcccucuccguccccucuccucccacccacgccacaggccagccuacucuu

SEQ ID NO: 56514 - RNA, 64 nt, hsa
cagggcucagggccauguaccagaucugucugugcccacccaggcacagccacugccucccccu

SEQ ID NO: 56515 - RNA, 64 nt, hsa
ccaucucuuccccaacccuggauaccaguagcuucccacccaguccaaaccugcaccauccauc

SEQ ID NO: 56516 - RNA, 64 nt, hsa
auucccucaucuguaggauuugggcugccccaggcccacccagggggcucugaauguauuuugu

SEQ ID NO: 56517 - RNA, 64 nt, hsa
ugucugcuccuccucuugaacuugggugggaaaccccacccaaaagcccccuuuguuacuuagg

SEQ ID NO: 56518 - RNA, 64 nt, hsa
accccuugguacugccucugaacacucugguuuccccacccaacugcggcuaagucucuuuuuc

SEQ ID NO: 56519 - RNA, 64 nt, hsa
ggggcacagaccucucccacccacaagaacuccucccacccaacuuccccuuagagugcuguga

SEQ ID NO: 56520 - RNA, 64 nt, hsa
ggcaggaucggcuuccucaggggcacagaccucucccacccacaagaacuccucccacccaacu

SEQ ID NO: 56521 - RNA, 64 nt, hsa
agccugucucaccaguggccugcccucucgcucccccacccagcccacccauugaagucuccuu

SEQ ID NO: 56522 - RNA, 64 nt, hsa
caccaguggccugcccucucgcucccccacccagcccacccauugaagucuccuugggccacca

SEQ ID NO: 56523 - RNA, 64 nt, hsa
acacugugcaggcccaggcaggcccagccucugccccacccaucaguggaguccagauggcagg

SEQ ID NO: 56524 - RNA, 64 nt, hsa
gccaggcucccgaccccauccaccuauccaccaccccacccaccuuugcagggaauaccucguu

SEQ ID NO: 56525 - RNA, 64 nt, hsa
ugcacuuauacaaaccuagaugggacaccuaugacccacccaggccagaugguacagccuguug

SEQ ID NO: 56526 - RNA, 64 nt, hsa
aauccucugacaaguugacucuucgacccccacccccacccaagacauuuuaauaguaaauaga

SEQ ID NO: 56527 - RNA, 64 nt, hsa
cgccgccugcuccccacacggacuccaggcgguccccacccacagaagcagaccuucagcucag

SEQ ID NO: 56528 - RNA, 64 nt, hsa
accccgggguggcccuggaggccccugaccccaccccacccacagagcacgagggccccgucag

SEQ ID NO: 56529 - RNA, 64 nt, hsa
cgcacaccucccucagcaccaagaccgggacccccccacccacgugucucauuguggcugccua

SEQ ID NO: 56530 - RNA, 64 nt, hsa
gcagggcccccacaccagaccccaacauagcuuccccacccaggcacccccucccggggcagca

SEQ ID NO: 56531 - RNA, 64 nt, hsa
auauccccugagaguuauaggaagugcccacugacccacccacccaccuacaccccccgccaca

SEQ ID NO: 56532 - RNA, 64 nt, hsa
ccccugagaguuauaggaagugcccacugacccacccacccaccuacaccccccgccacacaca

SEQ ID NO: 56533 - RNA, 64 nt, hsa
aagacugcaguauccauaacccccugcccacguccccacccacgggggagacggagagauauaa

SEQ ID NO: 56534 - RNA, 64 nt, hsa
ggaccaggccuggagggcacuuccuccacagucccccacccaccuccugcggcucagccuugca

SEQ ID NO: 56535 - RNA, 59 nt, hsa
uggagaacagcaagaucuagggcaccagccccacccacuggcuguuucuccguccucuc

SEQ ID NO: 56536 - RNA, 64 nt, hsa
aacuucaaaagagcuaaccccuucccacacuccacccacccaccuacauuuccucugugaaauc

SEQ ID NO: 56537 - RNA, 64 nt, hsa
ugugagcaaaagcagaaguggaccaccaucagcucccacccacccagcgauuuuuccuuggagg

SEQ ID NO: 56538 - RNA, 64 nt, hsa
agcaaaagcagaaguggaccaccaucagcucccacccacccagcgauuuuuccuuggaggucag

SEQ ID NO: 56539 - RNA, 64 nt, hsa
agacauucuucaccuccuuggcgcugccaccugccccacccaguuucuggaaaaaguugaugcu

SEQ ID NO: 56540 - RNA, 64 nt, hsa
aaccuugcugagccuccuugucuauccuuccucccccacccaccauuguaaaguuuaugucacc

SEQ ID NO: 56541 - RNA, 64 nt, hsa
ugccucagcgggucaggccuucagaacacugccacccacccaguuuuauaaucccgcucccucu

SEQ ID NO: 56542 - RNA, 64 nt, hsa
ccaguuuuauaaucccgcucccucuccaggcaaccccacccaccagccuaggccugcuccucca

SEQ ID NO: 56543 - RNA, 64 nt, hsa
ucagcccugggccugcaggagaggcugagaccagcccacccagccaguggucgagcacugcccc

SEQ ID NO: 56544 - RNA, 64 nt, hsa
cugggcucuaucccacacccacccccaccccacccccacccagccuccagaagcuggaaccauu

SEQ ID NO: 56545 - RNA, 64 nt, hsa
cacccuucccugggggcgauuagcugcugagucacccacccagccuuggagcuggaugccugug

SEQ ID NO: 56546 - RNA, 64 nt, hsa
gugggcaggccacugcugggacagggucuaugggcccacccagugccuuuccuuggcccucacu

SEQ ID NO: 56547 - RNA, 64 nt, hsa
ggcagcccggcagaggacgggaggagaccagucccccacccagccguaccagaaauaaaggcuu

SEQ ID NO: 56548 - RNA, 64 nt, hsa
gccugggcacgcggcccucuccugucagugccggcccacccaccagcaggcccccaacccccag

SEQ ID NO: 56549 - RNA, 64 nt, hsa
guggagaggguggggcgggcugggguuggagggucccacccaccacccugcugugcuugggaac

SEQ ID NO: 56550 - RNA, 64 nt, hsa
gaaauguuugaggcuagacggggaggggccaggacccacccacugcuccugggggaugaggucc

SEQ ID NO: 56551 - RNA, 64 nt, hsa
caggggaagcggagaccagggugcaggcuccgcccccacccaaggccgggcccagccagaggag

SEQ ID NO: 56552 - RNA, 64 nt, hsa
gcuccacaggucugagcagggagcaacucaggcccccacccaagccugcgucagcggaacuuga

SEQ ID NO: 56553 - RNA, 64 nt, hsa
agccucaagugacucagccugguuggagaacugccccacccaguaucuucugugccaugguucc

SEQ ID NO: 56554 - RNA, 64 nt, hsa
aaucuccaaauaaguacgauaacauagucauagucccacccaacaugaugcaguuaucuugcau

SEQ ID NO: 56555 - RNA, 64 nt, hsa
cacgcuuaacuccagcccccacccacacccccaucccacccaaccacaggccccacuugcuaag

SEQ ID NO: 56556 - RNA, 64 nt, hsa
guauggaaagaggggcucacgcuuaacuccagcccccacccacacccccaucccacccaaccac

SEQ ID NO: 56557 - RNA, 62 nt, hsa
ugggugcgaacucacagugacuguccuacccacccacccaccucuguagagucccagaaaca

SEQ ID NO: 56558 - RNA, 58 nt, hsa
ugggugcgaacucacagugacuguccuacccacccacccaccucuguagagucccaga

SEQ ID NO: 56559 - RNA, 64 nt, hsa
ccuguguggcugugccgggcagccauccugcauucccacccagcgcgcagucuccaccucggcc

SEQ ID NO: 56560 - RNA, 64 nt, hsa
auagcggggcccacaggcagggguaugagugcgucccacccaacgcagcaccagccccggccac

SEQ ID NO: 56561 - RNA, 64 nt, hsa
ucaccacccagaaguggggagagacuuugggccucccacccaguggggcuuggccuggcuucug

SEQ ID NO: 56562 - RNA, 64 nt, hsa
gcugcaccagcgaaucugccugggcugcuccugucccacccacccucacugagauccauguaag

SEQ ID NO: 56563 - RNA, 64 nt, hsa
gaagccaggggucccagcccgucuaccuccccaucccacccaggcccccagcuccccgcggggg

SEQ ID NO: 56564 - RNA, 64 nt, hsa
uuaccguucaucaccacucgggggcaccgggccgcccacccacucccaaaauccgucaguauuc

SEQ ID NO: 56565 - RNA, 64 nt, hsa
uguacuucagggccuggguauccagcgagcccuccccacccacccacgguccucaccuggagcu

SEQ ID NO: 56566 - RNA, 64 nt, hsa
cuucagggccuggguauccagcgagcccuccccacccacccacgguccucaccuggagcugugg

SEQ ID NO: 56567 - RNA, 64 nt, hsa
ggcccaccuugcggcccuggcucugagucgcucucccacccagccuggacuuggccccauggga

SEQ ID NO: 56568 - RNA, 64 nt, hsa
gcugugggcccuccugcuccacccccaucccacucccacccaugucugggcucccaggcaggga

SEQ ID NO: 56569 - RNA, 64 nt, hsa
uuccgagccucagaauccaggagauacgcacagccccacccacucugagaugacaguggcugac

SEQ ID NO: 56570 - RNA, 64 nt, hsa
gacgccagggccugcccggccuccuguuccugcccccacccaccaccugccuggagaggaacgg

SEQ ID NO: 56571 - RNA, 64 nt, hsa
cuucuagcccuccucccauccacacacacaggcacccacccacaccaggucggcuuguuucuca

SEQ ID NO: 56572 - RNA, 64 nt, hsa
cccaaucaccagaaagcaccaaagccccuggcaccccacccacuccauccuacccagggacccc

SEQ ID NO: 56573 - RNA, 64 nt, hsa
uccuugggcuucuccugagguaaugauuuacccccccacccacagcugagucugugaggcccca

SEQ ID NO: 56574 - RNA, 64 nt, hsa
cucucuaggccauccccucuucuaccuccugcaacccacccauccuauuagccucccacauucu

SEQ ID NO: 56575 - RNA, 64 nt, hsa
gcgcugcacgaccugcucaccaccuaugccguuacccacccacagguguccuacugccagggca

SEQ ID NO: 56576 - RNA, 64 nt, hsa
augggcuccaggagggacccucugguccagcugccccacccagcugcccuuaucagcuccaagu

SEQ ID NO: 56577 - RNA, 64 nt, hsa
ggcuuggggguaaauccugaggcuuuggugcucccccacccacccauucccgcccuuugcagca

SEQ ID NO: 56578 - RNA, 64 nt, hsa
uggggguaaauccugaggcuuuggugcucccccacccacccauucccgcccuuugcagcagccc

SEQ ID NO: 56579 - RNA, 64 nt, hsa
aggccccuguagugacccacgcguccagcagacgcccacccaccgcuagccguuguuccugugc

SEQ ID NO: 56580 - RNA, 64 nt, hsa
gccguuguuccugugcaaaguagugugcuaugcacccacccagguggccgccucugggcccaag

SEQ ID NO: 56581 - RNA, 64 nt, hsa
auacugagaaucuaggccaccccaaccucuguuccccacccaguucuucauuuggaggaaucac

SEQ ID NO: 56582 - RNA, 64 nt, hsa
uccugaucaggccucaccccuccccugggacuuucccacccaggaaaggaggaccagucaggau

SEQ ID NO: 56583 - RNA, 64 nt, hsa
acccagcaccacuucccagccaggagccccccaggaacagcacagaacagcagggccuggccuc

SEQ ID NO: 56584 - RNA, 64 nt, hsa
acuucccagccaggagccccccaggaacagcacagaacagcagggccuggccucugggucuucu

SEQ ID NO: 56585 - RNA, 64 nt, hsa
agucugugcaguugacuuggcuguacugaaaagugaacagcauggauuaacucauccugcugcu

SEQ ID NO: 56586 - RNA, 64 nt, hsa
acacuccacgaaaaccgcaucguaaacagagagugaacagcaccucuccauugcuacaucucca

SEQ ID NO: 56587 - RNA, 64 nt, hsa
ucaucugugcuuucuuuaccaacuggcuagaacggaacagcaucacagcaacgcugcggaucuu

SEQ ID NO: 56588 - RNA, 64 nt, hsa
aaauuggaaaagccagccauuuacuaauucagaggaacagcauagccaaggcuagcgaggcaua

SEQ ID NO: 56589 - RNA, 64 nt, hsa
ccaccaugucacuuugaguccuucauggguuuuugaacagcauuuaucaagaagaaaauguggg

SEQ ID NO: 56590 - RNA, 64 nt, hsa
gcucacuugucccggguuuaggacguggucaagugaacagcagggucuaacugugcuuacuuag

SEQ ID NO: 56591 - RNA, 64 nt, hsa
uaguagucaaaccaaaaaucuaagauuccaaaaagaacagcauucauugaaauaauauuccauu

SEQ ID NO: 56592 - RNA, 64 nt, hsa
caucaaccaacaucuuuuccaaauuagggccacagaacagcaacauuugucugacaguaguaua

SEQ ID NO: 56593 - RNA, 64 nt, hsa
uguuuaggcacagcagaggggacgcggggggcaagaacagcaggacgcugguuuaaaaauaacu

SEQ ID NO: 56594 - RNA, 64 nt, hsa
cgcucagcauggcucacuggagaguuccaugagagaacagcacucaagcuucuggccgcaugga

SEQ ID NO: 56595 - RNA, 64 nt, hsa
gauggcuggaagggguccagccucguuggaagaggaacagcacuggggagucuuuguggauucu

SEQ ID NO: 56596 - RNA, 64 nt, hsa
ucccugaaaccuaguacugccccccaugaggaaggaacagcaauggugucaguauccaggcuuu

SEQ ID NO: 56597 - RNA, 64 nt, hsa
acaucuaccuucgaggcaggagcccucucauggugaacagcaacuauuaugucaugguaugaac

SEQ ID NO: 56598 - RNA, 64 nt, hsa
cuacaaagcaaggcccacagacuaccccacucaagaacagcaguugcauuuuauucgucauuac

SEQ ID NO: 56599 - RNA, 64 nt, hsa
uuugcugacagcgguagaugccugugaggagcuacuacaagaaauagacaucaccccauuucuc

SEQ ID NO: 56600 - RNA, 64 nt, hsa
aaaauuuugacauucauauucuccuauuuuacagcuacaagaacuuucuugaaaaucuuauuua

SEQ ID NO: 56601 - RNA, 64 nt, hsa
gaaaugggggcuacauaugcccucuccuccccgucuacaagaguugugguuuuccaucugaucc

SEQ ID NO: 56602 - RNA, 64 nt, hsa
aauagcuuuuauuuuugauagaccaacugugaaccuacaagacgucuuggacaacugaaguuua

SEQ ID NO: 56603 - RNA, 64 nt, hsa
gugccuggccauguuccuacggcucagguccucccuacaagaccuaccacucacccaugccuau

SEQ ID NO: 56604 - RNA, 64 nt, hsa
auuuauucauauuguuuugauuacccucguguuacuacaagauggcaauaaauacuaugggauu

SEQ ID NO: 56605 - RNA, 64 nt, hsa
ccuccuuuccgcuucuccucucugcuguuccucucuacaagaaccugggaggccaacgccuaaa

SEQ ID NO: 56606 - RNA, 64 nt, hsa
ucacaguuccucuuuguuggaagaagugugugaccuacaagauuccugguugauacaguucagg

SEQ ID NO: 56607 - RNA, 64 nt, hsa
gugacagucccuggacaaccuccugcuccauccacuacaagaaggaaggauguccccagcccag

SEQ ID NO: 56608 - RNA, 64 nt, hsa
agccaucacccaaugaccgccccuuccuuccggucuacaagagcucucaaggcugggucugcca

SEQ ID NO: 56609 - RNA, 64 nt, hsa
augagagacuggugggucugucuaccuguuucuucuacaagaucccuauuugacuguaaaagua

SEQ ID NO: 56610 - RNA, 64 nt, hsa
guguucgagguuauaacaagagacagccaaggaccuacaagacaguugacuugauuuugcacag

SEQ ID NO: 56611 - RNA, 64 nt, hsa
gcucauccugcuacagaaugaacuccuuguaauucuacaagauaugccaugggccuuuucacag

SEQ ID NO: 56612 - RNA, 64 nt, hsa
gcuggaagaaacuuuggcuguagguuuuuauuuucuacaagaauucugguuugaauuauuuuug

SEQ ID NO: 56613 - RNA, 64 nt, hsa
uagaaaugaagcagugaguguucagaaauuagaucuacaagaaguuuugcaaacagacccucag

SEQ ID NO: 56614 - RNA, 64 nt, hsa
uuuggcaagcucuaucaccaaggagccaaacauccuacaagacacagugaccauacuaauuaua

SEQ ID NO: 56615 - RNA, 64 nt, hsa
auuuggcaucuccuguccugggccagggaucucucuacaagagccccugccccucuguuggagg

SEQ ID NO: 56616 - RNA, 64 nt, hsa
cacucagauaaguauacagcgacaauccuguuuucuacaagaauccugucuaguaaauaggauc

SEQ ID NO: 56617 - RNA, 64 nt, hsa
uucacuuacaccugacugacccuccugaacugcacuacaagacacuuuguagaagaggagauga

SEQ ID NO: 56618 - RNA, 64 nt, hsa
cuuacagccauaccacaagguacguccauuuggacuacaagaagagcuuccuuuaaaguuccua

SEQ ID NO: 56619 - RNA, 64 nt, hsa
acuugauuucuaguguguuuuguacaguauauaacuacaagauaguacauuuuguagcaguuca

SEQ ID NO: 56620 - RNA, 64 nt, hsa
ugccugcccagggaggaacggaggaggacucgcgcuacaagaggccacucccagggacccaggg

SEQ ID NO: 56621 - RNA, 64 nt, hsa
acagauuauaccucauauuagcaauuacauuacacuacaagaaaauguauuugcauaggcucuu

SEQ ID NO: 56622 - RNA, 64 nt, hsa
aaauucauaaugaauauauuugccuauauucucccuacaagaauauuuuugcuccagaaagaca

SEQ ID NO: 56623 - RNA, 64 nt, hsa
uuccccagcccaggguggacuuagaaagcaggggcuacaagagggaauccccgaaggugcugga

SEQ ID NO: 56624 - RNA, 64 nt, hsa
uuauucuaacuugagaucaguggcggaucaaaaccuacaagauucaacugaaaaguuggcaguu

SEQ ID NO: 56625 - RNA, 64 nt, hsa
uucccuuccccagggcccccaagggugucucaugcuacaagaagaggcaagagacaggccccag

SEQ ID NO: 56626 - RNA, 64 nt, hsa
aaaauugcuccuaacuccaccgccuaucccaaaccuacaagaacuaaugauaaucccaccaccc

SEQ ID NO: 56627 - RNA, 64 nt, hsa
agacagcucacugcagacacagguggagugguuccuacaagacauccaguuuuaacaacaaaag

SEQ ID NO: 56628 - RNA, 64 nt, hsa
ggcuacucugaaugaugcugcuaugaacauauuucuacaagauuuuguguggacauauguuuuc

SEQ ID NO: 56629 - RNA, 64 nt, hsa
ugacaauauuuaaauacuaagugguacuagggaacuacaagaauacuguaaagcuuaagccauu

SEQ ID NO: 56630 - RNA, 64 nt, hsa
aacucuuguuuuuuuaaucuuuagaacuuaaauucuacaagaauuuuaaauauuuucuguauau

SEQ ID NO: 56631 - RNA, 64 nt, hsa
caguccagaugccaacaaggaaaugcguuuauggcuacaagagugccucugcuuucuccuccuc

SEQ ID NO: 56632 - RNA, 64 nt, hsa
cacacuucaaaacucccguuagaucagcauucuacuacaagagugaaaggaaaacccuaacaga

SEQ ID NO: 56633 - RNA, 64 nt, hsa
guguguuuggccuuuucaguauuagacaaucauucuacaagagcuuuuccucucucugagaugu

SEQ ID NO: 56634 - RNA, 64 nt, hsa
guaaacgaucacugaagauuccuuggcuuucaaccuacaagacuuacuauuuaaauaaggagga

SEQ ID NO: 56635 - RNA, 64 nt, hsa
cacugcuguggccucauacucuuuuuuccauuuucuacaagaagccuuuuaguauaugaaaauu

SEQ ID NO: 56636 - RNA, 64 nt, hsa
agagguuuaaguuuguuguggccaaugucgaaaccuacaagauuuccuuaaaaucucuaauaga

SEQ ID NO: 56637 - RNA, 64 nt, hsa
cuuauaaaaacaagucaucuuaaguucacaauugcuacaagaagaaaguuguggauaacuagga

SEQ ID NO: 56638 - RNA, 64 nt, hsa
agaggagcaaagcaguugaaaacuaguuaaugagcuacaagagucaaauaguccucugaaugga

SEQ ID NO: 56639 - RNA, 64 nt, hsa
gcaaaugccaacauuuuguggaauagcagcaaaucuacaagagacccugguugguuuuucguuu

SEQ ID NO: 56640 - RNA, 64 nt, hsa
caaggucuuuggucuucucccuacaccaaguuaccuacaagaacaaugacaccacacucugccu

SEQ ID NO: 56641 - RNA, 64 nt, hsa
ccacuaggauuuggguucugccuguggcuauuugcuacaagagguuaggaagcccaagaaaaug

SEQ ID NO: 56642 - RNA, 64 nt, hsa
uccgggaaaagugaacauaugggcccuuuaaagacuacaagauuugcuagauaaacuggaaaug

SEQ ID NO: 56643 - RNA, 64 nt, hsa
uuaauuuuugcaccauuaauuuagcaaaggccaucuacaagagguauaccacuguauuuugcaa

SEQ ID NO: 56644 - RNA, 64 nt, hsa
gaucuaugucauauauuaaaaaagagcuugcuuacuacaagaaaaauauugaaauauugaaaau

SEQ ID NO: 56645 - RNA, 64 nt, hsa
acuucuauuuccagucgggggaguaacacuaaagcuacaagaaauauguaauaaugauagguaa

SEQ ID NO: 56646 - RNA, 64 nt, hsa
gaauguagaugugugauugucugagugagugaaacuacaagagguaaaaaauaaugggugguug

SEQ ID NO: 56647 - RNA, 64 nt, hsa
ccuuccccuguagcagucuucagccuccucuacccuacaagaucuggagcaacagcuaggaaau

SEQ ID NO: 56648 - RNA, 64 nt, hsa
caccuugacgcucuucuuuucauuauuucuaaugcuacaagaaugcuguaaagugucuucuaaa

SEQ ID NO: 56649 - RNA, 64 nt, hsa
uacuggguuuggauccacaguuugaaaaauauugcuacaagacacuuaaggagaccauccuguu

SEQ ID NO: 56650 - RNA, 64 nt, hsa
cuuaugcuucacuccuuuauguuuaaccaugugucuacaagaauaaguuuguuuuggaaaguug

SEQ ID NO: 56651 - RNA, 64 nt, hsa
cagaccguuugccuuuucaaguuuccuaguccugcuacaagaugagcuucuuccgugguuuccu

SEQ ID NO: 56652 - RNA, 64 nt, hsa
acuaagguaccaauagcucuuucauagacuugugcuacaagaagguuaaaagaccaguuuuauu

SEQ ID NO: 56653 - RNA, 64 nt, hsa
aggugaacagccuccagacggugugcaccaacaucuacaagauccuccugcugcaggcguacag

SEQ ID NO: 56654 - RNA, 64 nt, hsa
ucugugucugcuguauuauaaacagauaagcagccuacaagauaacuguauuuauaaaccacuc

SEQ ID NO: 56655 - RNA, 64 nt, hsa
ugaguuauaugauauuugaacauacagguuuuuacuacaagauuugauuacuuuaaugcauuaa

SEQ ID NO: 56656 - RNA, 64 nt, hsa
ccgcucuguggugcaauaucccuauuuguagggacuacaagaaauaacuuugaagggaaaaaag

SEQ ID NO: 56657 - RNA, 64 nt, hsa
guauaauuugcaucuuuacuaauguaugcuagagcuacaagagaccuuaaggauaauauaugaa

SEQ ID NO: 56658 - RNA, 64 nt, hsa
cucuuuuuuccuuucugcugauuugcuggaagcacuacaagacuucuguuuguucguucguuug

SEQ ID NO: 56659 - RNA, 64 nt, hsa
ccacugucucccaucccaggagguggugaguuggcuacaagagaaagggacaagugaggcaggc

SEQ ID NO: 56660 - RNA, 64 nt, hsa
guuuucugucuagcuccauaugguaucagagaaucuacaagaagaacagguucacagaaggaga

SEQ ID NO: 56661 - RNA, 64 nt, hsa
uugccgugaggacaguugaauuuggggcauuuuucuacaagaagcagucagccuucucuccccc

SEQ ID NO: 56662 - RNA, 64 nt, hsa
ucaugugcugaguuaaaacucagggauucugugacuacaagaugaaagacaauuugguugcuga

SEQ ID NO: 56663 - RNA, 64 nt, hsa
ggcacacaaagugcuuguaggcagcaaccauaugcuacaagaauuguaaacugcauacaguuug

SEQ ID NO: 56664 - RNA, 64 nt, hsa
augcuuuguuuuggggcuguauuuuugaaauacucuacaagaaagcuguggcucaacacaugag

SEQ ID NO: 56665 - RNA, 64 nt, hsa
uuucacaagcaaugcgaguuguaaaauaccagcucuacaagaagcuaggcucugugacggcaua

SEQ ID NO: 56666 - RNA, 64 nt, hsa
agaccagccugggcaacaggguaagguccugucucuacaagaucaaaaacuuagccggguaugg

SEQ ID NO: 56667 - RNA, 64 nt, hsa
ugggucccugaaucaccgacuggaggagaguuaccuacaagagccuucauccaggagcauccac

SEQ ID NO: 56668 - RNA, 64 nt, hsa
uuccuguaaugaggacguucaacauggugaggggcuacaagaaaacgcuuuucuguacagaguc

SEQ ID NO: 56669 - RNA, 64 nt, hsa
uuuagaccaaaauaugaaagacuuacaggccucgcuacaagaaccugcuaaggcugccucagac

SEQ ID NO: 56670 - RNA, 64 nt, hsa
aguauaguaaaaccaaccagcugaaccuuucaggcuacaagagaacccgggucgguaaugucuu

SEQ ID NO: 56671 - RNA, 64 nt, hsa
ucucugaacucagggagggcacauacuuagauaccuacaagacuuggaggaauuaagaguucac

SEQ ID NO: 56672 - RNA, 64 nt, hsa
aacacuugcagguuuagcuuuuucccaggguugacuacaagaaagaaaaccauguuuuugcaag

SEQ ID NO: 56673 - RNA, 64 nt, hsa
aacuguggggaccaaaagggagagagccuggggucuacaagaggagacacaucaucaaauguuu

SEQ ID NO: 56674 - RNA, 64 nt, hsa
uauauuggcaaugaagcacuuucaaugccuuuuucuacaagagccauuuccagaagauuauuuu

SEQ ID NO: 56675 - RNA, 64 nt, hsa
uacccaaagaacuauagauguaaagauugaacuucuacaagaaguacaacucaggagagcugua

SEQ ID NO: 56676 - RNA, 64 nt, hsa
uuuuucaauuuaaagguuaguauggaaucagcugcuacaagaaugcaaaaaaucuuccaaagac

SEQ ID NO: 56677 - RNA, 64 nt, hsa
accagucaggcuuauuucaguaaguuccacaguucuacaagacugcaggaauucuccuuaaggg

SEQ ID NO: 56678 - RNA, 64 nt, hsa
ucuaguuaucacuuaagcacucaaucauuagaggcuacaagaauaauauuuuuaaaguuacagu

SEQ ID NO: 56679 - RNA, 64 nt, hsa
aacuaauucccuucccuucccccuucuuccccuucuacaagaucaauauguaaaggagacauga

SEQ ID NO: 56680 - RNA, 64 nt, hsa
aggaauaagcucuaguucuuaacaaccgacacuccuacaagauuuagaaaaaaguuuacaacau

SEQ ID NO: 56681 - RNA, 64 nt, hsa
gaucagcucuuccuguguuuguaauuuaaugcugcuacaagauguuucuguuucuuagauucug

SEQ ID NO: 56682 - RNA, 64 nt, hsa
uagagguuuguguguguguacguauguguguguucuacaagaacggaagugugauauguuuaaa

SEQ ID NO: 56683 - RNA, 64 nt, hsa
auaagauuuggguugauguauuuuacuauuaguucuacaagaaguagugugguguaauuuuaga

SEQ ID NO: 56684 - RNA, 64 nt, hsa
aaauacugaauagacuugcuaaauggcacaugcacuacaagaggaaccuuuuggguuauuuaau

SEQ ID NO: 56685 - RNA, 64 nt, hsa
ccucagccucuauucgcaacucauaauccguagacuacaagaugaaaucucaauaaauuauuuu

SEQ ID NO: 56686 - RNA, 64 nt, hsa
ggacauaugcaucauugauguugcaguguugaaacuacaagagcuagaaaacugaagaugucgu

SEQ ID NO: 56687 - RNA, 64 nt, hsa
acaucacuuucacaccacuuggggauggaaauaccuacaagagugaaggucaagggcccucccc

SEQ ID NO: 56688 - RNA, 64 nt, hsa
gagcggagacugcaccacugcauuccagcccggccuacaagaacaaaacuccaucucaaaauaa

SEQ ID NO: 56689 - RNA, 64 nt, hsa
acaccuucucuuucuuaugucuuuuuacuacaaacuacaagacaauuguugaaaccugcuauac

SEQ ID NO: 56690 - RNA, 64 nt, hsa
ugccagcaacuugggggaauaagcgaagguuucccuacaagagggaaagaaggcaaaaacggca

SEQ ID NO: 56691 - RNA, 64 nt, hsa
gggcugugguaccugcagcgugggggacgugcuucuacaagaacaguccugaguccacguucug

SEQ ID NO: 56692 - RNA, 64 nt, hsa
cucuuaacuacugauguugucuuccugaucuuuucuacaagaagcuuuuaaacuuuuuggacuu

SEQ ID NO: 56693 - RNA, 64 nt, hsa
uuaucaaauacagaugacauuuaaaaauucuuaacuacaagagauuagaaauauaaaccuugcc

SEQ ID NO: 56694 - RNA, 64 nt, hsa
ugaagagcugaguacucaggccacuccaaucacccuacaagaugccaaggaggucccaggaagu

SEQ ID NO: 56695 - RNA, 64 nt, hsa
uaaaacacacuuccugcugcgaaagacccacaugcuacaagacgggcaaaauaaagugacagau

SEQ ID NO: 56696 - RNA, 64 nt, hsa
cugaaauacuccugaagaugguggugcuuauugacuacaagaggaaauucuacaggauuaggau

SEQ ID NO: 56697 - RNA, 64 nt, hsa
gagauacaacuccacugcaaguggagguuucuuucuacaagaguuuucugcccaaggccacagc

SEQ ID NO: 56698 - RNA, 64 nt, hsa
ugucuaaguaaaagcgcucuauuaaucuaaaacacuacaagagaauuuaacaccaucucucaaa

SEQ ID NO: 56699 - RNA, 64 nt, hsa
cagucaggagcacagcauccccuacuuacuaucacuacaagaaaacugagucacuugcaguggg

SEQ ID NO: 56700 - RNA, 64 nt, hsa
cacauuauguuguagcuggcuggcugucaggcgacuacaagacugagggucuugugccuuauag

SEQ ID NO: 56701 - RNA, 64 nt, hsa
ugcucuucuucaauauuuacaauaauaggaugaucuacaagaaaauaaguuucuuuuugcaaau

SEQ ID NO: 56702 - RNA, 64 nt, hsa
augaaaacuuggggaacugguaaguuuuugcaugcuacaagauuuuuuuacuuauuaaaaaauu

SEQ ID NO: 56703 - RNA, 64 nt, hsa
uuucaggcaaaucaaauuaaaucagacuaucaaacuacaagagaaccuuagucuuuuuuguuuu

SEQ ID NO: 56704 - RNA, 64 nt, hsa
ucaucaugaugguguccaacaucuacggcaaguacuacaagaggcucuccaaagagguccagaa

SEQ ID NO: 56705 - RNA, 64 nt, hsa
uuggugaugaauaaaugccauagaguuagagucacuacaagacaauguucucuaagaacugagc

SEQ ID NO: 56706 - RNA, 64 nt, hsa
guuugcaguccucuguuaguuuugcauaguugcacuacaagaagaauguaguugugcaaaucua

SEQ ID NO: 56707 - RNA, 64 nt, hsa
ucuuuaaaaaaauaaguaaaggagaaauauuuuccuacaagaguacugaauuucaggaaauggg

SEQ ID NO: 56708 - RNA, 64 nt, hsa
uuuuuuuagccauuugacuggcucuuuaaauagucuacaagacauucacguuuaacaucacuuu

SEQ ID NO: 56709 - RNA, 64 nt, hsa
cucaguauucaggaagcuuaauacuguuuuugaucuacaagauccaaauaauuaucccuaucuu

SEQ ID NO: 56710 - RNA, 64 nt, hsa
uucuuuaagccaaugaaccccaauuccuggcagucuacaagaagucucuuaaugcuaaugaaga

SEQ ID NO: 56711 - RNA, 64 nt, hsa
ugugccagcgaaguuucucucccacgugagugugcuacaagaaaaucugaacccgagaaucuga

SEQ ID NO: 56712 - RNA, 64 nt, hsa
uuaugagucucaccggucaacccaggaggccucacuacaagagccuugacaaggcacuguuuuu

SEQ ID NO: 56713 - RNA, 64 nt, hsa
ucuggccaguucuuuccaguagccauggggcuggcuacaagaagcaaaacugcccaugcaaaga

SEQ ID NO: 56714 - RNA, 64 nt, hsa
ccuuccacacugagguagccgagccucucaagaccuacaagaugggguacuaacaccaccccca

SEQ ID NO: 56715 - RNA, 64 nt, hsa
cacauuugacuuuuuuuucucauauuuuaaauuacuacaagauuauuaaagauaaaaugauuug

SEQ ID NO: 56716 - RNA, 64 nt, hsa
uuauuggaaugacaguguucucggaaggagcagccuacaagauaacuugaauuugccaauucug

SEQ ID NO: 56717 - RNA, 64 nt, hsa
ugucaucugcuccuguucacaccagagaaccaggcuacaagagaaaaagcagaggccaagaguu

SEQ ID NO: 56718 - RNA, 64 nt, hsa
gcccauauugguuuguguuuaaaugcuguacuuacuacaagaaggaucuuuuuucaagcuguac

SEQ ID NO: 56719 - RNA, 64 nt, hsa
cuacugcccuggcccguucauccuguguaucccccuacaagaaugggcaccuccugcccgcagg

SEQ ID NO: 56720 - RNA, 64 nt, hsa
guaagaaugauuauaaugaagauacacacuguaacuacaagaaauuauaaauguuuuucacauc

SEQ ID NO: 56721 - RNA, 64 nt, hsa
ugaaaccuguucugguggaaaugaaaaccaagagcuacaagauggcugcucugaggccuuugag

SEQ ID NO: 56722 - RNA, 64 nt, hsa
aauauuuuacagaauaguaaaaugcuuccaggaacuacaagaugccaucugccguuugcaaaag

SEQ ID NO: 56723 - RNA, 64 nt, hsa
ucuguuaaccagaacaccgucauuugaccaagcccuacaagaguuuaccacacuagauguucug

SEQ ID NO: 56724 - RNA, 64 nt, hsa
ggauccauccguccagccaagagcucuucaucugcuacaagaacauuugaaucuugggaccuuu

SEQ ID NO: 56725 - RNA, 64 nt, hsa
uucugugcccaguaugugggcggaugacgcaagacuacaagauccuugcccucaagcugcuagg

SEQ ID NO: 56726 - RNA, 64 nt, hsa
cugacagauaccacgaaacaugaagcacguggaacuacaagacccccggggucuuucugagugc

SEQ ID NO: 56727 - RNA, 64 nt, hsa
uguugcacacaugguuuucagaugacccagccaucuacaagaucugaauucuacugaaaauauc

SEQ ID NO: 56728 - RNA, 64 nt, hsa
caccugauggugaucuuggcacucuccauguucucuacaagaagcuguggugauuggcccugug

SEQ ID NO: 56729 - RNA, 64 nt, hsa
ggccacguggauucuuggcuuuguacaggaagaucuacaagagcaagccaacagaguaaagugg

SEQ ID NO: 56730 - RNA, 64 nt, hsa
aauaagcacaaucaaauuuuuaaccacagaaugucuacaagaauuauagcuuuaaaaaauacaa

SEQ ID NO: 56731 - RNA, 64 nt, hsa
accaccccucagagugcugcuucaccuacacuaccuacaagaucccgcgucagcggauuaugga

SEQ ID NO: 56732 - RNA, 64 nt, hsa
uccuuuauguaagaaugauauaaccaaaaggagccuacaagaaaguacgagauuuagucaacuu

SEQ ID NO: 56733 - RNA, 64 nt, hsa
aucugaucaccaggcugcccaagggugcugugcucuacaagacuuuuguccacgugguuccugc

SEQ ID NO: 56734 - RNA, 64 nt, hsa
uuuagguccuacuacauuguuaguuuccauaauucuacaagaauguuuccuuuuacuucaguua

SEQ ID NO: 56735 - RNA, 64 nt, hsa
gagccaagaucgugccacugcacuccagccugggcuacaagauugaaaagaucgaaacucuguc

SEQ ID NO: 56736 - RNA, 64 nt, hsa
ucuggcaaggcauaucaugaggcuagugaagcaccuacaagaaacuuauaacucaagguuguaa

SEQ ID NO: 56737 - RNA, 64 nt, hsa
acucaagccugggcaauguagcaagauccugucucuacaagaaauuuuuuaaaaaugagccaag

SEQ ID NO: 56738 - RNA, 64 nt, hsa
agaccagccugggcaacacggggagacccugucucuacaagaaauuaaaaauuagccaggcaua

SEQ ID NO: 56739 - RNA, 64 nt, hsa
cuugccauuggacugagcucuuucucagaagcugcuacaagaugacaccucaugucccugcccu

SEQ ID NO: 56740 - RNA, 64 nt, hsa
aagaccagccugggcaacacagcaagacccaucucuacaagaaauuuaaaaacuagccaggcgu

SEQ ID NO: 56741 - RNA, 64 nt, hsa
guaugcauuccuuugugucccuguaaaugugggacuacaagaagaggagcugccugagugguac

SEQ ID NO: 56742 - RNA, 64 nt, hsa
aaaaggagcaauuaaaucuaaaauaaggguaauucuacaagaggaaucaccugguuucccaacc

SEQ ID NO: 56743 - RNA, 64 nt, hsa
uuaaauguuugcaauguuucccguuuacagaaugcuacaagaauaauguacguacuaccuaaaa

SEQ ID NO: 56744 - RNA, 64 nt, hsa
uuuuuaucguuuuugaaggagaucuuuuuaaaaccuacaagagacaucucucuaugccuucuua

SEQ ID NO: 56745 - RNA, 64 nt, hsa
ucuuuucaccaggagcaaacccaagucuuaguugcuacaagaaaauccccuggaaguacugggg

SEQ ID NO: 56746 - RNA, 64 nt, hsa
aaguuccuucagugguugccucacuugcguuuuccuacaagauguaagacuguuuauaauuaaa

SEQ ID NO: 56747 - RNA, 64 nt, hsa
uggcuauaacaucuauaacaaaacgacgauuccucuacaagaggcuguuucucacugcuaacgu

SEQ ID NO: 56748 - RNA, 64 nt, hsa
caaccuugacaaauggcuuccaauguuagguuugcuacaagaugguuacuggagcucuagcugc

SEQ ID NO: 56749 - RNA, 64 nt, hsa
aucuugagaacuucaacauccuaaaaauguguuucuacaagacuuuauauuuuaagcuaagugg

SEQ ID NO: 56750 - RNA, 64 nt, hsa
ccagagcuguuuauggccucagcugccucacuuccuacaagagcagccuguggcaucuuugccu

SEQ ID NO: 56751 - RNA, 64 nt, hsa
uuccuuuaagucaaccaugauuucuccuugauuucuacaagagacaaagaaaugauuuugccuc

SEQ ID NO: 56752 - RNA, 64 nt, hsa
gcuugaaucaggaggagauuaacacacugaaccgcuacaagagggcaaagcugauuuuuuuuuu

SEQ ID NO: 56753 - RNA, 64 nt, hsa
uucuucgcuaauuuguauuuguauucccuucccccuacaagauuaugagaccccagagggggaa

SEQ ID NO: 56754 - RNA, 64 nt, hsa
ucugcauguaagagugagggagggaaggaaggaacuacaagagagucggagaugaugcagcaca

SEQ ID NO: 56755 - RNA, 64 nt, hsa
ucacuuugugcagugaacaaacuacacaagucaucuacaagagcccugaccacagggugagaca

SEQ ID NO: 56756 - RNA, 64 nt, hsa; identical to SEQ ID NO: 56618

SEQ ID NO: 56757 - RNA, 64 nt, hsa
aaacaggaaagcuagaagagguugcugugucaaccuacaagauagugauucuuggaaguuggua

SEQ ID NO: 56758 - RNA, 64 nt, hsa
ugccuaagaccugcccugacaaucagaguagggacuacaagaguguaugguguaugagguucug

SEQ ID NO: 56759 - RNA, 64 nt, hsa
cugggaaacccauguuauuucuugaauucagacacuacaagagcagaggauuaagguuuuuuua

SEQ ID NO: 56760 - RNA, 64 nt, hsa
aauuccuauucucugacgaauaaagacuuacugccuacaagaggagaggaggaggucauggcga

SEQ ID NO: 56761 - RNA, 64 nt, hsa
gccuaauguuuguuacagaaaugaucccagagaccuacaagaugugggaaucagcauaacaggg

SEQ ID NO: 56762 - RNA, 64 nt, hsa
uagaggucaucagccagguugauugugcggguuagauagagaucaucagccggguugauucuac

SEQ ID NO: 56763 - RNA, 64 nt, hsa
cagaggucaucagccagguugauuguguggguuagauagagaucaucagccugguagauugugu

SEQ ID NO: 56764 - RNA, 57 nt, hsa
caagaacuagaaauaaauaaggauggugauagagagguugaagaagaaaugaagaag

SEQ ID NO: 56765 - RNA, 64 nt, hsa
aagaucucaagaaccagaaauaaauaaggauggugauagagagcuagaaaauuuuauggcuauc

SEQ ID NO: 56766 - RNA, 64 nt, hsa
gguggggaaacugaggcaggaacaggguucugcccucccagagccuccacucugggaugccaga

SEQ ID NO: 56767 - RNA, 64 nt, hsa
gcccuucaucugggaaucauauacuccacucuagcucccagaaucuacagaccuggcuccucgg

SEQ ID NO: 56768 - RNA, 64 nt, hsa
ggacacaagacuucugauuucuacccucaagauacucccagauccuaaauccaguagccuccca

SEQ ID NO: 56769 - RNA, 64 nt, hsa
aaggguggggcaggcaguacccccaagcaggcugcucccagagguggggaacccuucauaggaa

SEQ ID NO: 56770 - RNA, 64 nt, hsa
ccauuuggggucacagaugccuagcuggacacagcucccagaacuggcuccacccuggggccuu

SEQ ID NO: 56771 - RNA, 64 nt, hsa
agccgagcgugggucccagucuauggaaucgagucucccagacaaaaaaggagaggcccuggcg

SEQ ID NO: 56772 - RNA, 64 nt, hsa
uauguauuuuuuugcgacagggucgugcucuugucucccagacuggacugcaguggcacaauca

SEQ ID NO: 56773 - RNA, 64 nt, hsa
caguggcacaaucauagcucacugcagcuuugaccucccagacccaagugauccucccaccuca

SEQ ID NO: 56774 - RNA, 64 nt, hsa
ugaugccuucccagagucaaccuccugugacgcccucccagagccaaccucgggugacacccuc

SEQ ID NO: 56775 - RNA, 64 nt, hsa
ugacgcccucccagagccaaccucgggugacacccucccagagucaaccucaugugacaccuua

SEQ ID NO: 56776 - RNA, 64 nt, hsa
ccagccucugucuagacuugcuucuagacagaaucucccagaguguggaaauguugccuuagaa

SEQ ID NO: 56777 - RNA, 64 nt, hsa
aacuuuuggaagauaagugaugugugaccaguggcucccagauucccaagcacaaggaaggaug

SEQ ID NO: 56778 - RNA, 64 nt, hsa
gggcuuugguguauuuaccuuccuucccuuccugcucccagacagucucacaaguaaacaccag

SEQ ID NO: 56779 - RNA, 64 nt, hsa
caguagugcaaucucagcucacugcaaccuccaccucccagacucaagccauccucccaccuca

SEQ ID NO: 56780 - RNA, 64 nt, hsa
ugauuguauauaagauaauucauacuggagaaaacucccagaaguggaguuuuccuuauugcac

SEQ ID NO: 56781 - RNA, 64 nt, hsa
caauggcgugaucucagcucaccgcaaccucugccucccagauucaagcaauucuccugccuca

SEQ ID NO: 56782 - RNA, 64 nt, hsa
ggguggccuccaccuccuggcuggggcacuuaugcucccagagccuuuggugccagguuugugg

SEQ ID NO: 56783 - RNA, 64 nt, hsa
ggaaggucuuugggucauuuuaacuucucggcaacucccagacucucagaguguggggcugggg

SEQ ID NO: 56784 - RNA, 64 nt, hsa
cugccaggucuuagaagucaggaccacccagggucucccagagugaacuuggugcucuaagucc

SEQ ID NO: 56785 - RNA, 64 nt, hsa
cuugugacacccccucgacucccuggugacgcuccucccagaucgcucuacaugacauucagga

SEQ ID NO: 56786 - RNA, 64 nt, hsa
acaugugucagccaugccucuguggggagucugccucccagacuggcuacuguauguaauguau

SEQ ID NO: 56787 - RNA, 64 nt, hsa
agcuugcaccaccaaaaauggcaaacaucaccagcucccagauuuuggaccaguugaaagcucc

SEQ ID NO: 56788 - RNA, 64 nt, hsa
aagcccagcugagcagguggggaucucagccagccucccagacugcaccucuucuauugcucuc

SEQ ID NO: 56789 - RNA, 64 nt, hsa
ggcuucuucucgcaggucagcuccuuagagaggucucccagauuccccguaaagcagcccugca

SEQ ID NO: 56790 - RNA, 64 nt, hsa
guucuugccccucguguccuaggcccaacccagccucccagaccucacuuuccccaucagcaau

SEQ ID NO: 56791 - RNA, 64 nt, hsa
cugggggccuuuggggaccagaaggggagaugugcucccagagccucucugcuguaagacccca

SEQ ID NO: 56792 - RNA, 64 nt, hsa
cagagcaggaccucccuuccgacccucugggaaccucccagagguccagcccaucucggagcau

SEQ ID NO: 56793 - RNA, 64 nt, hsa
ggcucugccccagucguuagaauauaggucucuucucccagaaucccagccggccaauggaaac

SEQ ID NO: 56794 - RNA, 64 nt, hsa
gccuucugcugcagcccaagcagggagugucccccucccagaagcauaucccagaugaguggua

SEQ ID NO: 56795 - RNA, 64 nt, hsa
gcaaugaggacaccugcaggaggggcuagccugacucccagaacuuuaagacuuucuccccacu

SEQ ID NO: 56796 - RNA, 64 nt, hsa
gagaauuaugggaaaccugguaagcaaaacuuuccucccagauaauugcuuccaaauucgaaga

SEQ ID NO: 56797 - RNA, 64 nt, hsa
ugcauuugauuuaggaccuuggaucaguggucaccucccagaagaggcacggcacaaggaagca

SEQ ID NO: 56798 - RNA, 64 nt, hsa
caugccccaccuuugcuuccucccucucuccucccucccagacacccuuaugcucuugguuuuu

SEQ ID NO: 56799 - RNA, 64 nt, hsa
ugcggaacgaccguaccaccaucaggcgcgcgcucucccagaaacacgaacugaagaaguaucu

SEQ ID NO: 56800 - RNA, 64 nt, hsa
uccuguuuuccuuccucugcuaucucucacaccucucccagacuaugucaucuuguucuccugc

SEQ ID NO: 56801 - RNA, 64 nt, hsa
accucgcucucccagcaccagugcccuucuccugcucccagauacucuuuccuuuccucucucc

SEQ ID NO: 56802 - RNA, 64 nt, hsa
ucaccuuggaggagugggcccuggaguccugucccucccagaagcccccagggugggauuucuc

SEQ ID NO: 56803 - RNA, 64 nt, hsa
gccugccuccugcacggggcuccacggagcccagcucccagacacgcuacuaagugccuagggu

SEQ ID NO: 56804 - RNA, 64 nt, hsa
uaagugccccccacccccauagccugcauguccacucccagacgauggccaagagcagaaacac

SEQ ID NO: 56805 - RNA, 64 nt, hsa
gggcuugugcuuggcaguuccugugcuguccugucucccagauccugagacccuggcugagaac

SEQ ID NO: 56806 - RNA, 64 nt, hsa
gcccugcacacacagaaagccaaagcgaucggugcucccagaucccgcagccucuggagagagc

SEQ ID NO: 56807 - RNA, 64 nt, hsa
cgaggugaugggggcuggggccccaggcgucagccucccagagggacagcugagcccccugccu

SEQ ID NO: 56808 - RNA, 64 nt, hsa
guggugugucucgaccccaucagccucucacccacucccagacacacacaaguccucaaaaguu

SEQ ID NO: 56809 - RNA, 64 nt, hsa
gggauccaggcucguagagucacucccugcccgucucccagagaugcuucaccagcaccugccu

SEQ ID NO: 56810 - RNA, 64 nt, hsa
ugauccuauccaaagcggccuacagucuccugggcucccagaagaguggcaagcugccauccuc

SEQ ID NO: 56811 - RNA, 64 nt, hsa
aacagugccgccaguacauggacuucaccucugccucccagaugucugacuccacccuucaugc

SEQ ID NO: 56812 - RNA, 63 nt, hsa
acugucaaugguuauggguccuauaaaaaugccccucccagauaaagcuucagcguuggccug

SEQ ID NO: 56813 - RNA, 64 nt, hsa
ccaaauaaacggacucaguggacacucagaccagcucccagauggcccuggacagcaggagagg

SEQ ID NO: 56814 - RNA, 64 nt, hsa
uggaggagacugcagucaggauaugcauuccaggcucccagacaccucaagcccuauucacagg

SEQ ID NO: 56815 - RNA, 64 nt, hsa
ccccacauggcccacagcuccugugcuggccagacucccagaaaauucucuauuuuuuaaguaa

SEQ ID NO: 56816 - RNA, 64 nt, hsa
caaagucugugaaaugaaagucccugacaugaagcucccagagauaaaacuccccaaggugccu

SEQ ID NO: 56817 - RNA, 64 nt, hsa
caaggugccugaaauggccgugcccgaugugcaccucccagaggugcagcugcccaaagucugu

SEQ ID NO: 56818 - RNA, 64 nt, hsa
gaaggugcccgagauggccgugcccgaugugcaccucccagaagugcagcuuccaaaaguccca

SEQ ID NO: 56819 - RNA, 64 nt, hsa
agagguacagcugccgaaagugucagagaugaaacucccagaggugucagagguggcugugcca

SEQ ID NO: 56820 - RNA, 64 nt, hsa
aaaagugcccgaggcagcccuuccagagguucgacucccagagguggagcuccccaagguguca

SEQ ID NO: 56821 - RNA, 64 nt, hsa
ccgugcucauugcuaaccacugucugucccugaacucccagaaccacuacaucuggcuuugggc

SEQ ID NO: 56822 - RNA, 64 nt, hsa
aacuccugggcucaagcaguccucccaccuuggccucccagaaugcuggguuuauagaugugag

SEQ ID NO: 56823 - RNA, 64 nt, hsa
caaauuuaagagggugggacaguccccugcuccucucccagagggcacugcuuggaaauugugu

SEQ ID NO: 56824 - RNA, 64 nt, hsa
uauggugcucuguauucuggcauuaugcagcagccucccagaagcucucuucugcuucaaaacc

SEQ ID NO: 56825 - RNA, 64 nt, hsa
aacuccugagcucaagugauccacccaccucagccucccagagugcuaggauuacaggccuuuu

SEQ ID NO: 56826 - RNA, 64 nt, hsa
cugcagaucauguaaggaagggacugacaagaagcucccagaugcuggggagaaugaagagcua

SEQ ID NO: 56827 - RNA, 64 nt, hsa
caaccccagaccaucccucuggccucugcugaaucucccagaguguguccaucuggggaucuaa

SEQ ID NO: 56828 - RNA, 64 nt, hsa
accucucccgcgccccagagccggaaauuucucccucccagaccccgcgcugcucuucuaacuu

SEQ ID NO: 56829 - RNA, 64 nt, hsa
aggagggagagaacacgcugugaaaacacagaagcucccagagaagccuucucagcuuuuaucu

SEQ ID NO: 56830 - RNA, 64 nt, hsa
aagcagaaaggcuggaguuauuauucaacucaaucucccagagaacucagaggcuacaguuucu

SEQ ID NO: 56831 - RNA, 64 nt, hsa
gugcugaccagggugaaggcacggcgagggacuccucccagacgugccucuugugugccagcug

SEQ ID NO: 56832 - RNA, 64 nt, hsa
gagcguugucuggagguuccagggacagggcagccucccagagccgagcaagagcucaagguac

SEQ ID NO: 56833 - RNA, 64 nt, hsa
agcucagcguccgcuacucagcccagccaaaacccucccagacgucuccucuccugccugggca

SEQ ID NO: 56834 - RNA, 64 nt, hsa
uuccgugccugcuccaacucuccgugaggccccucucccagagccugacacacucuguggccga

SEQ ID NO: 56835 - RNA, 64 nt, hsa
agagaguguauguucacccuaucuggcuguaucccauuggcaguggacagauugaggaaauucc

SEQ ID NO: 56836 - RNA, 64 nt, hsa
ggugcugggaaucccaaagccaagguucuggcuucauuggcaacccacuaggaacuugaaugug

SEQ ID NO: 56837 - RNA, 64 nt, hsa
cugcugcccuccaggauguauaugcagacgccuccauuggcaacgugacgggcagcaacgccgu

SEQ ID NO: 56838 - RNA, 64 nt, hsa
acggcugggccugcuucgccgucuccauccucaucauuggcaugcucaccgccaucauugggga

SEQ ID NO: 56839 - RNA, 64 nt, hsa
ggcgccccacuccaucagcacuaaugcuccacuccauuggcacuaacgccccaacuccagcggc

SEQ ID NO: 56840 - RNA, 64 nt, hsa
aacgccccgcuccaccggcaccagugccucgcuccauuggcaccaacgcccagcuccaccggua

SEQ ID NO: 56841 - RNA, 64 nt, hsa
ggcucccugcuccaucggcacuaacgcccugcuucauuggcacuuugcugcugccuccugagca

SEQ ID NO: 56842 - RNA, 64 nt, hsa
uccgcgggacuguguucguacgugcauaguuucgauaucacaucgcggggcuguguucguagcu

SEQ ID NO: 56843 - RNA, 64 nt, hsa
aucgcggggcuguguucguagcugcgucguuucgauaucacacccucugugugccgccuuacuu

SEQ ID NO: 56844 - RNA, 64 nt, hsa
aucacaacucaaaggacugugauauaauccauuuauaucacagcucacaguuucugaaaaugua

SEQ ID NO: 56845 - RNA, 64 nt, hsa
aucacagcucaaaggacugugauauaauccauuuauaucacaacucaaaggacugugauauaau

SEQ ID NO: 56846 - RNA, 64 nt, hsa
ucuggauagaaauagagaauagcaacguuuauggauaucacaaauaaagaauucaauucuuuac

SEQ ID NO: 56847 - RNA, 64 nt, hsa
gagaugggcuucacaggaauguaguugccaguucauaucacaauagcccuuucuauaugagguu

SEQ ID NO: 56848 - RNA, 64 nt, hsa
guaaggugcacaguuagcaaaagaugcagauguuauaucacagcaauucucaugcuaaaaauac

SEQ ID NO: 56849 - RNA, 64 nt, hsa
augugacaauuacacauuguagacagguagcaaaauaucacauacacccccaaaauauguacaa

SEQ ID NO: 56850 - RNA, 64 nt, hsa
uuaaauauucuugaauaaaucuguuauuuuaagaauaucacauuauucaaugcauauaaaacua

SEQ ID NO: 56851 - RNA, 64 nt, hsa
ucaacagaaauuuuagcucuuuucuuugcaagauauaucacagcugcuuugggcaguagcugaa

SEQ ID NO: 56852 - RNA, 64 nt, hsa
gaacagucaagaaaaacauuauugaggaaaauuaauaucacagcauaaccccacccuuuacauu

SEQ ID NO: 56853 - RNA, 64 nt, hsa
uuuguauaacccauaucugugcaauggaauauaaauaucacaaaguuguuuaacuagacugcgu

SEQ ID NO: 56854 - RNA, 64 nt, hsa
uggaaaaauacauauuaugagaaaauugugcaugauaucacauuuuuugcaccaagauaaacug

SEQ ID NO: 56855 - RNA, 64 nt, hsa
augugguuuucaucuuucauuauguucaagugguauaucacauugauuugcuugacuauguuga

SEQ ID NO: 56856 - RNA, 64 nt, hsa
cagaugugcuuuuguauuaaauuuaaauuuucacauaucacauccauucucaagguaguuauau

SEQ ID NO: 56857 - RNA, 64 nt, hsa
auauccucagauuggugcagcuuuuucaguucagauaucacaccccaaguggauaaaggcaacu

SEQ ID NO: 56858 - RNA, 64 nt, hsa
ccuacaggguuaccguugugcugcucaccacagagcagcugaggcauuaugccuuggaagaccu

SEQ ID NO: 56859 - RNA, 64 nt, hsa
acuucuggacauugcauccuuauucacacauguggcagcugaacgaggugcuguuguggguguc

SEQ ID NO: 56860 - RNA, 64 nt, hsa
augccaagcggaggccugcguggccuccugagcagcagcugaccgcccgucucaugcuggacgg

SEQ ID NO: 56861 - RNA, 64 nt, hsa
acgccgugcggaggccuacguggcugccugagcagcagcugaccgcccgucucacuguuggcca

SEQ ID NO: 56862 - RNA, 64 nt, hsa
gaaccauucuuuaaaggugaguggaggcugauuugcagcugaagugggccagccuugcaccagc

SEQ ID NO: 56863 - RNA, 64 nt, hsa
agacagcuaucuaagcucuggacuaccccuuugugcagcugaaucacugcaggguugaccaugc

SEQ ID NO: 56864 - RNA, 64 nt, hsa
uuaaauucaaccucugaacugaaaugugucaggggcagcugagcaagacagcaguuguaucccc

SEQ ID NO: 56865 - RNA, 64 nt, hsa
accaugagcaacagauuugagguaccagugcauagcagcugaaugccagcccuguaaaagacca

SEQ ID NO: 56866 - RNA, 64 nt, hsa
uuuuuuuguucuuguauuuaacccuuuuuuauaagcagcugaagacaccauauuuaacacuaua

SEQ ID NO: 56867 - RNA, 64 nt, hsa
cugauucauuaaaauugugcauacgauuuuaugggcagcugaugaucuaggugaaaaaugacuu

SEQ ID NO: 56868 - RNA, 64 nt, hsa
agcaacugaaagggaggugaggggcuuccuuucugcagcugagaugcacgcagacccaucuccc

SEQ ID NO: 56869 - RNA, 64 nt, hsa
cggcuuggacaggcaccugagauggugccaaagugcagcugacucuucccacgacagcccugcc

SEQ ID NO: 56870 - RNA, 64 nt, hsa
cuccuacacacucucugaaacucaggcugaggcagcagcugaggcccuguccaaagagaacuua

SEQ ID NO: 56871 - RNA, 64 nt, hsa
agacuaugacucgcgcacagcucugcauguugcugcagcugaagguacugaaggguuaaggagg

SEQ ID NO: 56872 - RNA, 64 nt, hsa
ccagugccgaagaggagcaggcacagcuacaugggcagcugaaggagcaaagggugcacugcca

SEQ ID NO: 56873 - RNA, 64 nt, hsa
accagugcugaggucuucugcagcaguacuaucagcagcugaucucugaggaggaggcacugca

SEQ ID NO: 56874 - RNA, 64 nt, hsa
gcauggagauggauaagaccagggaaugggccgagcagcugacaaagaugggccggggcaagca

SEQ ID NO: 56875 - RNA, 64 nt, hsa
ugggcgucacagagcuuucagacgcccagaagaagcagcugaaggagcagcaggagguaagacu

SEQ ID NO: 56876 - RNA, 64 nt, hsa
ucgcagcaguagcaaacuuuucacaugcuaaugugcagcugagugcacuuuauuuaaaaagaau

SEQ ID NO: 56877 - RNA, 64 nt, hsa
gauguccuagaaguucuuugauccagaggugggugcagcugaaaguaaacagaauggauugcca

SEQ ID NO: 56878 - RNA, 64 nt, hsa
ugagcaaguacagcggcgucuucuccuuccugcugcagcugaagcucaugaugugggcgcucaa

SEQ ID NO: 56879 - RNA, 64 nt, hsa
cccagguccagucugccgcugaugagacugcugugcagcugagcgaguugcugacgcugcccgu

SEQ ID NO: 56880 - RNA, 64 nt, hsa
guggacguuaggccaggccuuaucugaaaggccagcagcugaugcuguacuaacccagucuuuc

SEQ ID NO: 56881 - RNA, 64 nt, hsa
uccuuuucaggagauggggaauaauuuccuucaggcagcugaaauucaccaagaacagcgggua

SEQ ID NO: 56882 - RNA, 60 nt, hsa
uauuuccucuuuauuuucccucauugaaagaugcaaaacagcucucuauuguguacagaa

SEQ ID NO: 56883 - RNA, 60 nt, hsa
gcucucuauuguguacagaaaggguaaauaaugcaaaauaccugguaguaaaauaaaugc

SEQ ID NO: 56884 - RNA, 60 nt, hsa
auuauuacauggugguggugguuuuauuauaugcaaaaucucugucuauuaugagauacu

SEQ ID NO: 56885 - RNA, 60 nt, hsa
acaguaauguguguuuuguucagcauuauuaugcaaaaauucacuaguugagaugguuug

SEQ ID NO: 56886 - RNA, 60 nt, hsa
uagaaggauuuuauucucaacagaugcaaaaugcaaaauaaaauauuggcaaacaauaca

SEQ ID NO: 56887 - RNA, 60 nt, hsa
acauuuuuagaaggauuuuauucucaacagaugcaaaaugcaaaauaaaauauuggcaaa

SEQ ID NO: 56888 - RNA, 60 nt, hsa
gguuuguauguagcaccuuucaugcaaggcaugcaaaaagccuauuuuaaaaucacugug

SEQ ID NO: 56889 - RNA, 60 nt, hsa
acuuuuuuuuucuuaaagccaauuauuuugaugcaaaagaaauucaguuuauaagauaaa

SEQ ID NO: 56890 - RNA, 60 nt, hsa
caucagcaucacccgggaacuuuuuuagaaaugcaaaaucucuacugcuuuggauccugg

SEQ ID NO: 56891 - RNA, 60 nt, hsa
ccugggucaaaaaaaagaaaaaaaaaagaaaugcaaaacuuuaggcccugccccagauuu

SEQ ID NO: 56892 - RNA, 50 nt, hsa
uccaacggaucaauagauaaaugcaaaaauggauaaaauaauuuuuguua

SEQ ID NO: 56893 - RNA, 60 nt, hsa
cccuaauauauucuuauauguagagcaauaaugcaaaagcuguucuauaugcaaacauga

SEQ ID NO: 56894 - RNA, 60 nt, hsa
uuguaauguaguaucaaaguuuuuuagguaaugcaaaauuuuacaaaucauuuguggaau

SEQ ID NO: 56895 - RNA, 60 nt, hsa
uuuucaucaagaagguagcuugagccugaaaugcaaaacccauggaggaauucugaagcc

SEQ ID NO: 56896 - RNA, 60 nt, hsa
uguuaucagaaauaggagaguggaugauagaugcaaaauaauaccuguccacaacaaacu

SEQ ID NO: 56897 - RNA, 60 nt, hsa
auauacuuguauaugucacagagaaaaaaaaugcaaaauuuauaauagaguuacauuaac

SEQ ID NO: 56898 - RNA, 60 nt, hsa
caacuuaaacuuuucuuugcaucaagguauaugcaaaacauuggugccgugcaucaccaa

SEQ ID NO: 56899 - RNA, 60 nt, hsa
gccuuggauuuuacauauuuuucuuuuuaaaugcaaaaccuuuucaacaaaauaguguuu

SEQ ID NO: 56900 - RNA, 60 nt, hsa
ggagcaaagauuuucaaacaagcauacacgaugcaaaauaccaaucuggcuucuagucuc

SEQ ID NO: 56901 - RNA, 60 nt, hsa
guauugagugccuauucauugucacuguagaugcaaaacgaaugagcuguaaccccuuca

SEQ ID NO: 56902 - RNA, 60 nt, hsa
gguaauguaaaaucauuucauuuaucauucaugcaaaaaaaaguauguauugagugccua

SEQ ID NO: 56903 - RNA, 60 nt, hsa
caaccacauacaacacaaagagaaaaagaaaugcaaaaaucucugcgugcagggacaaag

SEQ ID NO: 56904 - RNA, 60 nt, hsa
gagugagaggucucucuuccugauuuagauaugcaaaagcugguauguucaguaggaacu

SEQ ID NO: 56905 - RNA, 60 nt, hsa
aggcaugugugaaacauacucauagauguuaugcaaaaaaaagucuauggccagguaugc

SEQ ID NO: 56906 - RNA, 60 nt, hsa
uuguaagcuuuaacuauaucucucuuuaaaaugcaaaauaaugucuuaagauucaaaguc

SEQ ID NO: 56907 - RNA, 60 nt, hsa
aauucuaaauguuuaaaugcuuuucuaaaaaugcaaaacuaugauguuuaguugcuuuau

SEQ ID NO: 56908 - RNA, 60 nt, hsa
aauguagaaaagauacucagucuuaauccuaugcaaaaaaaaaaaucaaguaauuguuuu

SEQ ID NO: 56909 - RNA, 60 nt, hsa
aucuaaucaaaacugggaguucucaagugaaugcaaaaggagcaggccauaacuuuauuu

SEQ ID NO: 56910 - RNA, 60 nt, hsa
uaaauucauagaguggauauuaggauuaggaugcaaaaauaaaugcuuaaccaacacuac

SEQ ID NO: 56911 - RNA, 60 nt, hsa
ccccuuucacccaagugaugucacaguucgaugcaaaaucaaugauccagaaugaucgug

SEQ ID NO: 56912 - RNA, 60 nt, hsa
acucaaaguguuucuuaagggugaguuggcaugcaaaaaauuacauugauuacagugugu

SEQ ID NO: 56913 - RNA, 60 nt, hsa
ucauuuuuaaauaauucaaaaucaguagcaaugcaaaaauauucugauuacuuuagccuu

SEQ ID NO: 56914 - RNA, 60 nt, hsa
ucuccaacacauuguuucugagcuccacaaaugcaaaagauguauuuuccuguggcccau

SEQ ID NO: 56915 - RNA, 60 nt, hsa
cuuguauauuagcaauuauaauguuuguauaugcaaaacugcuagcuugauuuuaaaaaa

SEQ ID NO: 56916 - RNA, 60 nt, hsa
cuuccacacauuaauggcaugauuuuuuuuaugcaaaaagaaaagaaaagaaaaccaccc

SEQ ID NO: 56917 - RNA, 60 nt, hsa
acuuuccucagauuuucaaaaguauuuuuaaugcaaaaaauguagaaagaguuuaaaacc

SEQ ID NO: 56918 - RNA, 60 nt, hsa
auauuuccaaaaaugaaccuuuaaaaugguaugcaaaauuuugucuauauauauuugugu

SEQ ID NO: 56919 - RNA, 60 nt, hsa
auguaagugucgauguuuuuuuaaaaaaaaaugcaaaaaaauucuuauggcggaguuuuu

SEQ ID NO: 56920 - RNA, 60 nt, hsa
guguguguguguguguguguguuugcagacaugcaaaacugcagcugaaauaauaccuua

SEQ ID NO: 56921 - RNA, 60 nt, hsa
aguccgguaggaugucaggugagacuguguaugcaaaaugaauggcacaggugaugccag

SEQ ID NO: 56922 - RNA, 60 nt, hsa
acaucuguacucgucaaucaacaaaaccugaugcaaaaaacagaaaaggggugauguagg

SEQ ID NO: 56923 - RNA, 60 nt, hsa
acuaaagcuggcacucccccagccguucucaugcaaaauaccugugucagaauacuccuu

SEQ ID NO: 56924 - RNA, 60 nt, hsa
acuacaagaagaauguaguugugcaaaucuaugcaaaacugaugguggccugcuauuucc

SEQ ID NO: 56925 - RNA, 60 nt, hsa
cagcugugugauauucugcugugcaaauccaugcaaaacugacugugguagugaaaaguc

SEQ ID NO: 56926 - RNA, 60 nt, hsa
aguaaacaggaaaccuacuuuuuaugugcuaugcaaaauagacaucuuuaacauaguccu

SEQ ID NO: 56927 - RNA, 60 nt, hsa
ucauuccaaaaagaacaauaaugagagcaaaugcaaaaauaaccaaguccuccgaaggca

SEQ ID NO: 56928 - RNA, 60 nt, hsa
augguguuuucagggaacacagaaaugcggaugcaaaacaacuuuugacagaggcccauc

SEQ ID NO: 56929 - RNA, 60 nt, hsa
guuugcagaacacugauuugaaagcuuccuaugcaaaaugagaagggguucaaauauauu

SEQ ID NO: 56930 - RNA, 60 nt, hsa
aaacugguuaccuguaucaaagacccauuuaugcaaaaauguuaaaaaaaaaaaaaaaca

SEQ ID NO: 56931 - RNA, 60 nt, hsa
uaaguugauuuacugaugauaugucauaugaugcaaaaaagguuuugugucauuaacuga

SEQ ID NO: 56932 - RNA, 60 nt, hsa
cuuuuaagaaucauguguucaauguagacaaugcaaaauuuguaguuaaauuugaccuca

SEQ ID NO: 56933 - RNA, 54 nt, hsa
acuacugucuuacagauugacuugaugcaaaacaucacaaaggcuccauguuac

SEQ ID NO: 56934 - RNA, 60 nt, hsa
aagaggaauaugguauaauuuuaaauuuuaaugcaaaauuuuaauuugucuuuauuuuuu

SEQ ID NO: 56935 - RNA, 60 nt, hsa
acuuguggaaagcuucaaggaguuccacugaugcaaaagggucuuuuccuagcuuccugg

SEQ ID NO: 56936 - RNA, 60 nt, hsa
aauauauauauauaugucaaaagguaggaaaugcaaaaaagaaaaaaaaaaaaggugaca

SEQ ID NO: 56937 - RNA, 60 nt, hsa
gagccucuggacuaaauggacauauuucuuaugcaaaaaggaaaacacacacaaccaaua

SEQ ID NO: 56938 - RNA, 60 nt, hsa
uuuuuugaagugaauucuuuugaaaaaaaaaugcaaaacuagaaaacuuuauucauuuua

SEQ ID NO: 56939 - RNA, 60 nt, hsa
aacaucugcauaauuucacuuaaaauuauuaugcaaaaaugaauguuuuuucaaaaaaug

SEQ ID NO: 56940 - RNA, 60 nt, hsa
uauuucuuauucagugcugaauacuaccucaugcaaaauauugguguggcugcaaauuuc

SEQ ID NO: 56941 - RNA, 60 nt, hsa
gagagaaggccuagagguuagagcacuagaaugcaaaagaggauuuauuuucuuaaguuu

SEQ ID NO: 56942 - RNA, 64 nt, hsa
uguauucagagcaccucuccagaugcaccaugcaugcucacagucccuugccuauguguggcag

SEQ ID NO: 56943 - RNA, 64 nt, hsa
uguaauaggccauggcacaccagccaagaugcucugcucacagucaguaugugugaagaucccu

SEQ ID NO: 56944 - RNA, 64 nt, hsa
gccaggcccauuuccugcuuuuguguaaggaaggugcucacauaggaaguuuuuauuugguuag

SEQ ID NO: 56945 - RNA, 64 nt, hsa
augaggcagcugaggccuggggaugugaacaaccugcucacaguccucauuuacuggauuugac

SEQ ID NO: 56946 - RNA, 64 nt, hsa
cuuuccuugaacuuauucgugauacagauuccuuugcucacauguuucccugcugaccuucuuc

SEQ ID NO: 56947 - RNA, 64 nt, hsa
auguuguuagccuauaacuuuagccccaacucugugcucacagaaacaugcgcuguaaugaauc

SEQ ID NO: 56948 - RNA, 64 nt, hsa
gaauuaugggaugccuuaagugcuguuacuagguugcucacagccuaaccuggcguguuguuua

SEQ ID NO: 56949 - RNA, 64 nt, hsa
cugacaacccagugaggcagauacacuuucuuacugcucacaucuuacaggugaguacucauaa

SEQ ID NO: 56950 - RNA, 64 nt, hsa
uuaugaccaagggcuugaaacauauuggauuacaugcucacauuuaacaaagagaggaaaugug

SEQ ID NO: 56951 - RNA, 64 nt, hsa
ucucccuaggaugccaaaguggcauuaugucuguugcucacagaugcagagacugacaauugug

SEQ ID NO: 56952 - RNA, 64 nt, hsa
gguggaguggaaaaagauauggugaaggcagaacugcucacaccagcuccagaagcacguccuc

SEQ ID NO: 56953 - RNA, 64 nt, hsa
guaaauucuguuaauaaacaaggaguucauccguugcucacaucuuucauuggugcccucugaa

SEQ ID NO: 56954 - RNA, 64 nt, hsa
cucaagggaagagauugcccaggcacuaccacucugcucacauguuccccccuuggcaaugugg

SEQ ID NO: 56955 - RNA, 64 nt, hsa
uucugacauccuggauaguguggggagguaauggugcucacaguagguuaauuggagacaccau

SEQ ID NO: 56956 - RNA, 64 nt, hsa
ccaggaaaauguggagacaguucuucuccuccacugcucacaggaggcccgugguaauucuccc

SEQ ID NO: 56957 - RNA, 64 nt, hsa
uuuaguacuggaauugcacuugggguugacaaggugcucacaccaugagaauggaggcaggaau

SEQ ID NO: 56958 - RNA, 64 nt, hsa
caguaucagucuuguccugggagccggguccugcugcucacaagcccagagcugccagggagcu

SEQ ID NO: 56959 - RNA, 64 nt, hsa
auuccaaauauuuguucccaaguagcuacugaacugcucacaccauuggaagauuuuguauuuu

SEQ ID NO: 56960 - RNA, 64 nt, hsa
uacaagugcaaacaauguggcaaaacuuaauuuaugcucacaccuuacugcacagaaaagaauu

SEQ ID NO: 56961 - RNA, 64 nt, hsa
caaauauaaagaauguggaaaagccguuaauaucugcucacaucuuacucagcaucagaaagua

SEQ ID NO: 56962 - RNA, 64 nt, hsa
cgccuacaugugugaacaauauggcaaaacuuaaugcucacacuuuauugcuaggaaagcauuu

SEQ ID NO: 56963 - RNA, 64 nt, hsa
caaauauaaagacugugaaaaagccaucauuaucugcucacauuuuacucaacacagagaguuc

SEQ ID NO: 56964 - RNA, 64 nt, hsa
uaccagugugaacaacguggccaagcuucgacaaugcucacacccuauugcacaggaaagcauu

SEQ ID NO: 56965 - RNA, 64 nt, hsa
caaauauuggcaaaguaaaaaauccauuaacaccugcucacaucuuacucaaaauuguagaguu

SEQ ID NO: 56966 - RNA, 64 nt, hsa
caaauauaaagacugugaaaaagccauuaauacaugcucacaucuuacucaacaucagagaguu

SEQ ID NO: 56967 - RNA, 64 nt, hsa
caugugugaacagugugacaaaacuuuuaacuaaugcucacaccuucacaggaaagcauuuaua

SEQ ID NO: 56968 - RNA, 59 nt, hsa
ucaauaacauuuuaaaggaccaauaaacagccuccuauaaaguaaaccucuucccgugg

SEQ ID NO: 56969 - RNA, 59 nt, hsa
gguagaguaacaccuuuauacgugugcuugccuccuaauuuaaaauacuguauucgcau

SEQ ID NO: 56970 - RNA, 59 nt, hsa
ucauuauuucaagaggaacccaaaguccagccuccuacauagaugcugccccacgaagg

SEQ ID NO: 56971 - RNA, 59 nt, hsa
uccccagcucaagcaauccucccaccucagccuccuaaguaccugguacuacaggcgcg

SEQ ID NO: 56972 - RNA, 59 nt, hsa
cugcuucuccacaggugcggccuggcccggccuccuaaaggccacacccuccccacgca

SEQ ID NO: 56973 - RNA, 59 nt, hsa
ccgccuuccacgcuaggauguaagaggucgccuccuauuguacauuuggggaaagccuu

SEQ ID NO: 56974 - RNA, 59 nt, hsa
cuggguggagggaguggcaagucaggcgugccuccuacaagcuuccuaaccucuuaagc

SEQ ID NO: 56975 - RNA, 59 nt, hsa
agauugugggaaauggucauuugcugagcgccuccuaguugccaggcacuggagggcgc

SEQ ID NO: 56976 - RNA, 64 nt, hsa
agucuucuuuccuucugacagaccaggucaucuggcuuccgagaucaucagagaagauaagucu

SEQ ID NO: 56977 - RNA, 64 nt, hsa
ccgucguccucccagacaaaugaaaccacgcugcgcuuccgaugcccccgcuugccguguaaug

SEQ ID NO: 56978 - RNA, 64 nt, hsa
ccuagccggggcccgagggaagcggagauccccggcuuccgacguccuugggcaccgucgccuc

SEQ ID NO: 56979 - RNA, 64 nt, hsa
aucucaggagaauagcuuuuacucugguaggaaugcuuccgagacaccacaaggcagccugaac

SEQ ID NO: 56980 - RNA, 64 nt, hsa
cgccgggaggcguugggcagaaacccucgggaaugcuuccgagcacgcuguaggguaugggaag

SEQ ID NO: 56981 - RNA, 64 nt, hsa
gcagagaucgaagccguggagguggagaucggccgcuuccgagaccagcaguacgagaugcuca

SEQ ID NO: 56982 - RNA, 64 nt, hsa
aauucuucucuauuguaagguuuccauuuaguuugcuuccgaugauuaaaucuaagucauuuga

SEQ ID NO: 56983 - RNA, 64 nt, hsa
uucuggccuguggcagggccgggaagggccgcuggcuuccgaacagacgugguugcucuccacg

SEQ ID NO: 56984 - RNA, 64 nt, hsa
gcaguaagaagcgugucugggucuggagaagggugcuuccgagagugugcagguggcccuuccc

SEQ ID NO: 56985 - RNA, 60 nt, hsa
agaaagcacaugaguccuaaugccccagcagcuuccgauuggaaaaugcaaauuguuuuu

SEQ ID NO: 56986 - RNA, 64 nt, hsa
gggauuucacuugggaaaugaaguacuuuaguuggcuuccgaguuccagacuauauguccagau

SEQ ID NO: 56987 - RNA, 64 nt, hsa
agcuaguguuaauccagagaaccccccgcaaugugcuuccgagauucagacugcuucauuggga

SEQ ID NO: 56988 - RNA, 64 nt, hsa
caacucccuccuuuagugaaggagccguguuagagcuuccgagaauagcuccacuggagagaag

SEQ ID NO: 56989 - RNA, 64 nt, hsa
uuuucacaucaaaaugaugcuguuggacuuagaggcuuccgaacuguuuuauugagggcuacua

SEQ ID NO: 56990 - RNA, 64 nt, hsa
gauccuugaaggaaccuggucagucuccgguucagcuuccgacaccagaguggaacccaguaag

SEQ ID NO: 56991 - RNA, 64 nt, hsa
ugaaacaaacaauaugcacuucuuuucugaagaugcuuccgaagauuugaaaauaggauccaaa

SEQ ID NO: 56992 - RNA, 64 nt, hsa
ugccccaacugaauguguucugucacucagcuuugcuuccgacaccucuguuuccucuuccccu

SEQ ID NO: 56993 - RNA, 64 nt, hsa
ccugccacuugcuaaccaugcuaucugcgcagacgcuuccgagggcagaaauagucccauguau

SEQ ID NO: 56994 - RNA, 64 nt, hsa
caggaggugucgcacugccucccacccugugucugcuuccgaauaaaagaagaaagcaauaucu

SEQ ID NO: 56995 - RNA, 64 nt, hsa
aucaggagaggguagcugccugcauaggagccucgcuuccgauuauucccuucccaauauuauu

SEQ ID NO: 56996 - RNA, 64 nt, hsa
cuaaguaccacucauggagaguaugugcugagaugcuuccgaccuuucaggugacgcaggaaca

SEQ ID NO: 56997 - RNA, 64 nt, hsa
agcuguacagacucuuucagagguuuaacgugcugcuuccgaugugccaccugcaguaguggau

SEQ ID NO: 56998 - RNA, 64 nt, hsa
cagcuggcucugacaagaugguccauuuguuccugcuuccgagauccccagggcagccuggauc

SEQ ID NO: 56999 - RNA, 64 nt, hsa
cgagagguuaagguggcuucuguggccacgaagcgcuuccgagcugugcccagucccgggaauu

SEQ ID NO: 57000 - RNA, 64 nt, hsa
uuuggggcugccccuuugucuggagucacugggggcuuccgagggucucccucgacccucuguc

SEQ ID NO: 57001 - RNA, 64 nt, hsa
agagcccaguuaauucuccgcaccucgguugugugcuuccgaaugggcucacucccgugguggu

SEQ ID NO: 57002 - RNA, 64 nt, hsa
ucaccgacgaugagggcgcaccugcuguccuggagcuuccgaucucuguucggggacccuguga

SEQ ID NO: 57003 - RNA, 64 nt, hsa
ccuaaggcaauagugcacaacuuagguuauuuuugcuuccgaauuugaaugaaaaacuuaaugc

SEQ ID NO: 57004 - RNA, 64 nt, hsa
caugucuaugcucuacccccaggguagcaucucagcuuccgaacccugggcuguuuccuuaguc

SEQ ID NO: 57005 - RNA, 64 nt, hsa
uaccuaggggagcugcugcugccugcucauucuagcuuccgauuccauucccagccccugcguu

SEQ ID NO: 57006 - RNA, 64 nt, hsa
ccauccaaguacuaaccaggcccgacccugcuuagcuuccgagaucagaugagaucaggcgcgu

SEQ ID NO: 57007 - RNA, 64 nt, hsa
uuaacuuuaggcuuuugggcauaugcuagucugagcuuccgaaaagauacauauauguuucccu

SEQ ID NO: 57008 - RNA, 64 nt, hsa
cucaaucaacuugcugauauuuuaguaguuaacagcuuccgagccuaucaugcaauuuggaguc

SEQ ID NO: 57009 - RNA, 64 nt, hsa
accuaguaagcaaccaagagacccucccuucauggcuuccgaucagauggcaagggucuuugca

SEQ ID NO: 57010 - RNA, 64 nt, hsa
uuuuacguuugcagcacaacaccauugcccggaggcuuccgaaucuagcaaagcagcauauuaa

SEQ ID NO: 57011 - RNA, 64 nt, hsa
cugaucccuaaguugagaccugucuuccuguaacgcuuccgaauaagagguccggucgaaaaga

SEQ ID NO: 57012 - RNA, 50 nt, hsa
ccccgcgcuuccagcccugagcuuccgaugcggggagagcagagccucgg

SEQ ID NO: 57013 - RNA, 64 nt, hsa
agccacucucccuggggccucuggggugagagcagcuuccgauaggaccugcccagauuucugc

SEQ ID NO: 57014 - RNA, 64 nt, hsa
uagucacagagaugugugugcucggcacuccugggcuuccgaugcucccucugaaccacugaaa

SEQ ID NO: 57015 - RNA, 64 nt, hsa
gucccguuccuuuaccauaggauucuccacaguggcuuccgacucaggcuccaauggaccaaau

SEQ ID NO: 57016 - RNA, 64 nt, hsa
ggcggcuaccggggccgcggcggggaccguggaggcuuccgagggggccggggugguggggaca

SEQ ID NO: 57017 - RNA, 64 nt, hsa
cacagcuucaccaggggcuuuucaggugugcucggcuuccgagaguucuucaagugggccaaca

SEQ ID NO: 57018 - RNA, 64 nt, hsa
uuccuguggcucccuccaaaccuggccaagcccagcuuccgaagcaggaaccagcacugucucu

SEQ ID NO: 57019 - RNA, 64 nt, hsa
cucuccccucccuuugaaugagagaaacuaccccgcuuccgaagccccugaaagacacugcucc

SEQ ID NO: 57020 - RNA, 64 nt, hsa
cuggggucagggcaggaaggaacuucacucugcugcuuccgagaaccucggccgugacauucgg

SEQ ID NO: 57021 - RNA, 64 nt, hsa
caugucucccguuggggaggcaagaggcugaggggcuuccgagccccugagagcggacaucucc

SEQ ID NO: 57022 - RNA, 64 nt, hsa
ccgugucuugugaacucccaucaccuucaagaaagcuuccgagguaagaauuuuauggucaucu

SEQ ID NO: 57023 - RNA, 64 nt, hsa
cccagcccuaagggugugaaccucaccuccuggggcuuccgagcuacagggcugggaccagguc

SEQ ID NO: 57024 - RNA, 64 nt, hsa
ggcccugagguggcagcaggggucagggaagugggcuuccgagugcccucuguugaaauuguca

SEQ ID NO: 57025 - RNA, 64 nt, hsa
gaaacagaagcggcucaguucaccuugauaaggugcuuccgagcugggaugagaggaaggaaac

SEQ ID NO: 57026 - RNA, 64 nt, hsa
gaaacagaagcggcucaguucaccuugauaaggugcuuccgagcugggaugagaggaagggaaa

SEQ ID NO: 57027 - RNA, 64 nt, hsa
ugcccugacugaauguguucugucacucagcuuugcuuccgacaccucuguuuccucuuccccu

SEQ ID NO: 57028 - RNA, 64 nt, hsa
agugagcaguuauggacagcacuuuccauguggugcuuccgacccuggcugucagagugaaaug

SEQ ID NO: 57029 - RNA, 64 nt, hsa
gauccuugccuccaacgugccuccagcacaugcggcuuccgagggcacuaccgggggcucugag

SEQ ID NO: 57030 - RNA, 64 nt, hsa
acuggccucugcugccaggccacugccugucucugcuuccgacuuugucuucuuucucccuuuc

SEQ ID NO: 57031 - RNA, 64 nt, hsa
gcccaugcuuagagcccaggcuccagcccugagugcuuccgagcuggcggacugcccaggggcc

SEQ ID NO: 57032 - RNA, 64 nt, hsa
caaguuuguggagaguacagacugcguuggcugggcuuccgagagcuucggccugccuaagucu

SEQ ID NO: 57033 - RNA, 63 nt, hsa
uaccucaaguugcuuggcagcacaacuaucuuugcaaaaaaaaguaaagaaaaaguaaaugau

SEQ ID NO: 57034 - RNA, 63 nt, hsa
gaauaaucaaagugauuuuucagaauuaugugugcaaaaaauuaaugugcauucauauauucu

SEQ ID NO: 57035 - RNA, 63 nt, hsa
uugaugagcuuaaaaaaauaaaaauagaaaauugcaaaaaaaaaaaaaaaaaaaaaucucaga

SEQ ID NO: 57036 - RNA, 63 nt, hsa
uuagaaaaaaacaacaaagcaaaaccuaucuuggcaaaaaaaggaagugagucagagcccauu

SEQ ID NO: 57037 - RNA, 63 nt, hsa
ucauuugaaguuggcaaaaacaaauacaaacaagcaaaaaaccucaaauuuuuuucagcagug

SEQ ID NO: 57038 - RNA, 63 nt, hsa
aaugggcugcugucauuuuaugcuaaguaaggggcaaaaaaaaaaauuacauuaugcccuuga

SEQ ID NO: 57039 - RNA, 63 nt, hsa
uguuuucgagcaggacuaacaacugggaaauaagcaaaaaacugcaucgauccccagccuggu

SEQ ID NO: 57040 - RNA, 63 nt, hsa
uguuauaacaccaucuggagucuuccuguaguggcaaaaaagaacaguguugaaauuggaaag

SEQ ID NO: 57041 - RNA, 63 nt, hsa
uauguaugcuauuuguuguauuuaugcuuaagagcaaaaaaguuuugaugggauuuuaaauuc

SEQ ID NO: 57042 - RNA, 63 nt, hsa
ccuggcuuguuuugucucuuugcaacugauuuugcaaaaaaaaauuguagcuuuaaaauaaca

SEQ ID NO: 57043 - RNA, 63 nt, hsa
augauaaacacgcaaaaaaaaccuagaaauuaagcaaaaaauagcacaauaauuuaacugaaa

SEQ ID NO: 57044 - RNA, 63 nt, hsa
ugcccacuuuaccuacggagacaugauaaacacgcaaaaaaaaccuagaaauuaagcaaaaaa

SEQ ID NO: 57045 - RNA, 63 nt, hsa
gacauuuuagcauguuaaauagcacuuuuaauagcaaaaaaaggcacaucaacugcgaaguua

SEQ ID NO: 57046 - RNA, 63 nt, hsa
uuccaaguuuucuaguccauaccacagugccuugcaaaaaacaccacaugaauaaagcaauaa

SEQ ID NO: 57047 - RNA, 63 nt, hsa
ugauauguacuauagugauucuguuuuugaggugcaaaaaacauacauauauaccaguuggua

SEQ ID NO: 57048 - RNA, 63 nt, hsa
ggagaugcuuauagaugauaguuguacauaugugcaaaaaaaaauccacuugcaaugguaaga

SEQ ID NO: 57049 - RNA, 63 nt, hsa
augauauuuuaggaauaacggacuuuuaaagaagcaaaaaaaaagacugaauuuccuugcuua

SEQ ID NO: 57050 - RNA, 63 nt, hsa
cauguuuaauuuguauuuguaaaaaaacaaaaagcaaaaaaauucccaaaacccagauaacaa

SEQ ID NO: 57051 - RNA, 63 nt, hsa
gcccaaagauuacauguugguguucaaaguguagcaaaaaaugauguauauuuauaaaucuau

SEQ ID NO: 57052 - RNA, 63 nt, hsa
ccaagccauguaaaagaucuacuuuuucuaagggcaaaaaaaaaaaaaaaaaaaaaagaacac

SEQ ID NO: 57053 - RNA, 63 nt, hsa
uuaccuggucauuuugugaucacaagagucuaugcaaaaaaaaaaauuucuuuaccccagauu

SEQ ID NO: 57054 - RNA, 63 nt, hsa
acuacagaucuggauggcuauucagauaacauggcaaaaaaugauagcagaagaucauuaaaa

SEQ ID NO: 57055 - RNA, 63 nt, hsa
cauuuggacagauccugucauuguuuaagcugagcaaaaaaccacacaaaaguuguguaagag

SEQ ID NO: 57056 - RNA, 63 nt, hsa
ccugacauaguaaaguuugcuuucauaacugcagcaaaaaaggucaacuugccaagucacugc

SEQ ID NO: 57057 - RNA, 63 nt, hsa
guaauagacaucaccagcaaugaauuuugaaaagcaaaaaauacuauuaaccuauauaaccau

SEQ ID NO: 57058 - RNA, 63 nt, hsa
ccagccuggacaacauagugaaacacugucucugcaaaaaauacaaaaauuagcuggguaugg

SEQ ID NO: 57059 - RNA, 63 nt, hsa
acuuggauauaugguugaagaaucaaaacaaaagcaaaaaaaaaaagcaaaaaaagaaaagag

SEQ ID NO: 57060 - RNA, 63 nt, hsa
guugaagaaucaaaacaaaagcaaaaaaaaaaagcaaaaaaagaaaagagaaaaaaagaaaaa

SEQ ID NO: 57061 - RNA, 63 nt, hsa
ucauuauuuaucuauguuuauuaaugggccaaugcaaaaaaucauuuuuucaaagaaaaauuu

SEQ ID NO: 57062 - RNA, 63 nt, hsa
aauucucaugcuaaaaauacaacaaaagacaaagcaaaaaauaaaccuuugcuuuuuuuuuuu

SEQ ID NO: 57063 - RNA, 63 nt, hsa
uagucaauucugaaccaccaccccccgccccccgcaaaaaaguaaaagucaaaccaaacuucc

SEQ ID NO: 57064 - RNA, 63 nt, hsa
aaagagguuucuuugauguuuuaacuuuugcuggcaaaaaaaaauucacgcuuggugugaaua

SEQ ID NO: 57065 - RNA, 63 nt, hsa
gaaaugugaacugaacaggagaaaaaaagaaaagcaaaaaacuccuguaacccuugagauuaa

SEQ ID NO: 57066 - RNA, 63 nt, hsa
uucaggcuaaugauuaccucuuauucucuacaugcaaaaaauuaaauauuuuguguucaaaua

SEQ ID NO: 57067 - RNA, 63 nt, hsa
agauggaacuucaggucuuaagugcaaaucaaagcaaaaaacaaacaaaacuuacauggaaaa

SEQ ID NO: 57068 - RNA, 63 nt, hsa
ccuaggcaacagagcgagacucugucuccccccgcaaaaaaaaaaaagaaagaaagaaagaga

SEQ ID NO: 57069 - RNA, 63 nt, hsa
uacacauaacauggguuauuuaguuuaacucuggcaaaaaaaaaaaaaaaaauuuuguauguu

SEQ ID NO: 57070 - RNA, 63 nt, hsa
aacucaaaguguuucuuaagggugaguuggcaugcaaaaaauuacauugauuacaguguguuu

SEQ ID NO: 57071 - RNA, 63 nt, hsa
ccuacaaaaauaaacugaacuugcaauauuuuugcaaaaaaaucugucguuaaaacugaggau

SEQ ID NO: 57072 - RNA, 63 nt, hsa
ucacagcuaugacaaaaccgaaaaagcaaaacugcaaaaaaguacuaagauguacgggucuug

SEQ ID NO: 57073 - RNA, 63 nt, hsa
aacuuuucauguagcguaucacauaacuuuuuugcaaaaaauauaaaaagaaauaaacuucaa

SEQ ID NO: 57074 - RNA, 63 nt, hsa
gaaugaaaauauguggacugucauuuuguugcagcaaaaaaguguuaauaaaaugcucuauuu

SEQ ID NO: 57075 - RNA, 63 nt, hsa
gauguaagugucgauguuuuuuuaaaaaaaaaugcaaaaaaauucuuauggcggaguuuuuug

SEQ ID NO: 57076 - RNA, 63 nt, hsa
aauuaauuugcuucuguuuuuaggucugggagggcaaaaaagaggugggugggaugaaacaug

SEQ ID NO: 57077 - RNA, 63 nt, hsa
ugcaaaaaaugauaugaguuucucccugccaaggcaaaaaauauauauauauaccuauauuua

SEQ ID NO: 57078 - RNA, 63 nt, hsa
uguuuuuauuuuauuuugcuuauuuuuaugauugcaaaaaaugauaugaguuucucccugcca

SEQ ID NO: 57079 - RNA, 63 nt, hsa
auucuuuugaauuguuacaucaugcuggaaccugcaaaaaauacuuuuucuaaugaggagaga

SEQ ID NO: 57080 - RNA, 63 nt, hsa
guuaauagauuuuuucagacuugucaagccugugcaaaaaaauuaaaauggaugccuugaaua

SEQ ID NO: 57081 - RNA, 63 nt, hsa
uuucaaaauagaaaaguuauuagugguuuaucagcaaaaaaguccaauuuuaauuuaguaaau

SEQ ID NO: 57082 - RNA, 63 nt, hsa
ccccagcuauugucuguuguguucagcugagaugcaaaaaagaaauuaagcaaaaaagaaaaa

SEQ ID NO: 57083 - RNA, 63 nt, hsa
uuguguucagcugagaugcaaaaaagaaauuaagcaaaaaagaaaaagaugaagacuuuucau

SEQ ID NO: 57084 - RNA, 63 nt, hsa
aaauucuauugaaaaaggaaaaucagcaauucagcaaaaaauaaauaaaaaauaaaaauguaa

SEQ ID NO: 57085 - RNA, 63 nt, hsa
gugaccgaccccuuggccaaaaaaaaacaaaaagcaaaaaacaaaaaccuacccuguucuggu

SEQ ID NO: 57086 - RNA, 63 nt, hsa
cuaugacagagcaaugcuuuuaaugaauuuaaggcaaaaaagguggagagggagaugugugag

SEQ ID NO: 57087 - RNA, 63 nt, hsa
auaaacguggauuuuaaaaaaucaaucaauggugcaaaaaaaaacuuaaagcaaaauaguauu

SEQ ID NO: 57088 - RNA, 63 nt, hsa
caaggaaccagggaugaaaucaguuuggauucugcaaaaaaggguaauggcaaaguuugccaa

SEQ ID NO: 57089 - RNA, 63 nt, hsa
uuguauuuuacagaugcaaacagcuauaauuuugcaaaaaaggaaaauaacucuccugaacau

SEQ ID NO: 57090 - RNA, 62 nt, hsa
aaguuguuaaauaaaguuauaauacagcugugaagggcuaaaguuagaguugauuacauaag

SEQ ID NO: 57091 - RNA, 62 nt, hsa
uuagguuugaaaauacuauuuaauaagggcagaagggcuauauaugauuuggcuauuauuuc

SEQ ID NO: 57092 - RNA, 62 nt, hsa
auccagaucaacacccuuucuuccauacagaaaagggcuaaccauaccacagcuggaaucuc

SEQ ID NO: 57093 - RNA, 62 nt, hsa
aaaauuauauuuagaauuuuuaaacauguacaaagggcuacauuuuaauuuuaaaauagcuu

SEQ ID NO: 57094 - RNA, 62 nt, hsa
ccccauucucuuggggucagggaggggcugggaagggcuacugaaggccccauucucccaca

SEQ ID NO: 57095 - RNA, 62 nt, hsa
aacauuuuuauaugauuauaaaagaauucuucaagggcuaauuaccuaaccagcuuguauug

SEQ ID NO: 57096 - RNA, 62 nt, hsa
uuacuacauauuuuccaucuguaguuucucagaagggcuauggauuaguuugaacugucaaa

SEQ ID NO: 57097 - RNA, 62 nt, hsa
ggaggaacacuaugguuaacccucucuugauuaagggcuacuuaaugcacagugcauuaugu

SEQ ID NO: 57098 - RNA, 62 nt, hsa
cuuucucccccgacacugcugcaccagagugaaagggcuauggcaagggggugucaucugag

SEQ ID NO: 57099 - RNA, 62 nt, hsa
caucacgacugauccccaccuccucagggucaaagggcuacuuucuggaagucuccccaggc

SEQ ID NO: 57100 - RNA, 62 nt, hsa
acugugugggagccuggacugacagauaggccaagggcuacucucuggcaucuccagguguu

SEQ ID NO: 57101 - RNA, 62 nt, hsa
uuccaucugggagaggcagaaucuauauacugaagggcuaguggcacugccaggggaaggga

SEQ ID NO: 57102 - RNA, 62 nt, hsa
gaagaagcuggcauuguuuacagaaacagaucaagggcuauaauuuaugucauuuuauagca

SEQ ID NO: 57103 - RNA, 62 nt, hsa
augagaagcuuuauuaagaaagauccuauuuaaagggcuaauuugguauugaaagcaugcug

SEQ ID NO: 57104 - RNA, 62 nt, hsa
gagagccaugaggagagggcugaggagggcagaagggcuaggcagggggcaaauugagcccc

SEQ ID NO: 57105 - RNA, 62 nt, hsa
agaggagccgcccacuuccaggaccugugaauaagggcuaaugaugaggguugguggggcuc

SEQ ID NO: 57106 - RNA, 62 nt, hsa
gcucuugccuucccagcaugcccuuuacuacaaagggcuauuuuucuuuucuuucuuuuguu

SEQ ID NO: 57107 - RNA, 62 nt, hsa
ccacaucaguucaacauccucugguuuuucuaaagggcuauucaucuguuugcuccaguuuu

SEQ ID NO: 57108 - RNA, 62 nt, hsa
ccaauggggguggggaaguugcugggguggagaagggcuagcccaccgcagcagccucccuc

SEQ ID NO: 57109 - RNA, 62 nt, hsa
cuuaaaaauguuuuuguuguuaugcauugauuaagggcuagagcaaauauaaaauuaaaugu

SEQ ID NO: 57110 - RNA, 62 nt, hsa
augaguuccagucugaauacagguagauauuaaagggcuaauaaaaaaugagaaaccggucg

SEQ ID NO: 57111 - RNA, 62 nt, hsa
ggagaaaauuuucgcaaccuacucaucugacaaagggcuaauaaccagaaucuacaaugaac

SEQ ID NO: 57112 - RNA, 62 nt, hsa
uugaguagauauuuuaaacaccuaacaaaguaaagggcuaaaagccauucagauagcaguaa

SEQ ID NO: 57113 - RNA, 62 nt, hsa
auuuucuuaagcuaaaauacagacauguuucaaagggcuaaaguuggagaugaguagauagg

SEQ ID NO: 57114 - RNA, 62 nt, hsa
cgcuguguccucucugcccagccuggcuuaccaagggcuaccucagugggagaugagguugg

SEQ ID NO: 57115 - RNA, 62 nt, hsa
acaacagauaccuucuauuuuaguugcuaauaaagggcuacacaacucaaaauagucugauu

SEQ ID NO: 57116 - RNA, 62 nt, hsa
agccaacuccugaguuuugcuauacuuaaggaaagggcuaucuuuguucuuuguuagucucu

SEQ ID NO: 57117 - RNA, 62 nt, hsa
gaacauugcuggacguccucauaguacucacaaagggcuagccuugaaugucacucgcccag

SEQ ID NO: 57118 - RNA, 62 nt, hsa
agaagccguauuuguacgcacaacauuaaaucaagggcuacaauucaagcacuuuuauucgu

SEQ ID NO: 57119 - RNA, 62 nt, hsa
uuuccuuagccucuucggugaucuuuggucugaagggcuauguggcugagcggaagggugag

SEQ ID NO: 57120 - RNA, 62 nt, hsa
cagggaauccccaagguuagccugcuuaggggaagggcuagggguaccuggaauguaggauc

SEQ ID NO: 57121 - RNA, 62 nt, hsa
cugacugauagcauuucagaaugugucuuuugaagggcuaugauaccaguuauuaaauagug

SEQ ID NO: 57122 - RNA, 62 nt, hsa
ucuauguaauucagaagcagaacucuuggcuaaagggcuaguguggccuucagaaaccauuc

SEQ ID NO: 57123 - RNA, 62 nt, hsa
aagacuaacuugaaagcaggcacaguuugaugaagggcuagagagcuguuugcaauaaaaag

SEQ ID NO: 57124 - RNA, 62 nt, hsa
caugaaugcuuauuuagguuguucaaaguaaaaagggcuacaggucacagaucgucagugcc

SEQ ID NO: 57125 - RNA, 62 nt, hsa
caaauauucuggagaaccuggauaaaaguuugaagggcuagauugggauuugaagacaaaau

SEQ ID NO: 57126 - RNA, 62 nt, hsa
uuaggaccucuuuuauuaaaaaagccuauuuaaagggcuauuucuguagacagaaguucagu

SEQ ID NO: 57127 - RNA, 62 nt, hsa
cgcugaaggcuuacuucagaugcgauggcuacaagggcuacgaccuggucuacagcccccag

SEQ ID NO: 57128 - RNA, 62 nt, hsa
uuucagagcugcagggacagggugagcagcugaagggcuaggagggaagccggcccccgcuc

SEQ ID NO: 57129 - RNA, 62 nt, hsa
uuauucagaauuucuaaaaauuuaaguucuguaagggcuaauauauucucuuccuaugguuu

SEQ ID NO: 57130 - RNA, 62 nt, hsa
aggcaaaaucuguacugagguagaucauuugaaagggcuagauuauaaaauuaagccuuaga

SEQ ID NO: 57131 - RNA, 62 nt, hsa
acaacugucuccauuuuucaagugugagagauaagggcuaaugaugacaucucauuuauuuu

SEQ ID NO: 57132 - RNA, 62 nt, hsa
cucaggcauuuuuuuuuuuuacacauuaacuaaagggcuauucgaaaucuugacucaggggu

SEQ ID NO: 57133 - RNA, 62 nt, hsa
gggcucaagcauuucuccuaccucggccuuccaagggcuaggauuacaggcaugagccacug

SEQ ID NO: 57134 - RNA, 62 nt, hsa
cccaaaccucugcagcaucugcuuuauugccaaagggcuaguuucgguuuucugcagccauu

SEQ ID NO: 57135 - RNA, 62 nt, hsa
uuuaaagaaaaguuuuaauuauauaaauagcaaagggcuauugccaauacuagggucaaaaa

SEQ ID NO: 57136 - RNA, 62 nt, hsa
cuaacugugugaccuuaggugaccaguucauuaagggcuaauagauuuccauuuuucaauua

SEQ ID NO: 57137 - RNA, 62 nt, hsa
gacacauacaugucacauuuagcugugcucagaagggcuaucaucauccuacaacucacauu

SEQ ID NO: 57138 - RNA, 62 nt, hsa
gguuccacugaaccucaugggacuuuuaaaagaagggcuauuuaaggaauucacuugguagu

SEQ ID NO: 57139 - RNA, 62 nt, hsa
agugucccuuuuaaaaauagugugugcuaacuaagggcuauucauucugccauuuuuaacuu

SEQ ID NO: 57140 - RNA, 62 nt, hsa
gguuagcccugaucugaauauaaaagugagaaaagggcuacagugcauuucuugguaacuua

SEQ ID NO: 57141 - RNA, 62 nt, hsa
ugggcauugucuuuucagagagcuuguagcacaagggcuacacaugggcgccaagauggugg

SEQ ID NO: 57142 - RNA, 62 nt, hsa
aaggcaccaugacugcccaucgagaugccaagaagggcuauggaacuaugcagguggcuagu

SEQ ID NO: 57143 - RNA, 62 nt, hsa
uuauagaccaugcuaaugcuagaccaguauuuaagggcuaaucucacaccuccuuagcugua

SEQ ID NO: 57144 - RNA, 62 nt, hsa
ggccuauaugagaaaccaucuucucacagauuaagggcuaagggcaaaaggggugggaggug

SEQ ID NO: 57145 - RNA, 62 nt, hsa
gggauuugugacaagauaguacacauuacuauaagggcuauuauuuccugaacuggaugucc

SEQ ID NO: 57146 - RNA, 62 nt, hsa
gggaaagaccuuugagagccuagcccaggccuaagggcuauguuugguaccaguguuuuguc

SEQ ID NO: 57147 - RNA, 62 nt, hsa
uaucauauugguauucacuaaucugggaagggaagggcuacugcagcuuuacaugcaauuua

SEQ ID NO: 57148 - RNA, 62 nt, hsa
gcaaguuuaaucuuuggaugccugaauuuuaaaagggcuagaaaaaaaugauugaccagccu

SEQ ID NO: 57149 - RNA, 62 nt, hsa
ugaagacaguugcuggugaguggagaugauugaagggcuaggaggugagggccuucauuaau

SEQ ID NO: 57150 - RNA, 62 nt, hsa
guuacccacgccauuuuacgucuccuucacugaagggcuagaguuuuaacuuuuaauuuuuu

SEQ ID NO: 57151 - RNA, 62 nt, hsa
augcuuguaacucuggaaagaggccuacacccaagggcuaggaauuuuauuuuuccuuuucu

SEQ ID NO: 57152 - RNA, 62 nt, hsa
gacauagaaaguucauggaacucauguuuuuaaagggcuauguaaauauaugaacauuagaa

SEQ ID NO: 57153 - RNA, 62 nt, hsa
cuucauaaaacacuuauagccuuaaaccauucaagggcuaauuaaaaaaauaguuaugaaau

SEQ ID NO: 57154 - RNA, 62 nt, hsa
ucuuguucucucccagcaauuuauuuuaaaacaagggcuagcuucaagcaugacuguuaaug

SEQ ID NO: 57155 - RNA, 51 nt, hsa
agcaguucaauacccacuaggaagggcuagcgacugacagaaauaacuacc

SEQ ID NO: 57156 - RNA, 62 nt, hsa
auuccuuccuuguuaucaagccucucggacaaaagggcuaggaaaaggugauaugucuccug

SEQ ID NO: 57157 - RNA, 62 nt, hsa
gagagaaucaugaagaaaagaaggucaauaaaaagggcuaaaaccuuggacaaaaguuuuug

SEQ ID NO: 57158 - RNA, 62 nt, hsa
gcuuguuggaaugcagucuacaaaagcgcuauaagggcuaaaggauuauaguaauagcuuga

SEQ ID NO: 57159 - RNA, 62 nt, hsa
acauauauauuuauguagauauacuuccaugaaagggcuaauacgaugcauauacugaaggg

SEQ ID NO: 57160 - RNA, 62 nt, hsa
uaucggcuucccaaguuuacuaagaaacuuugaagggcuauuucaguaguauagaccaguga

SEQ ID NO: 57161 - RNA, 62 nt, hsa
guuauuuccaaauagaauggacucggucuguuaagggcuaaggagaagaggaagauaagguu

SEQ ID NO: 57162 - RNA, 62 nt, hsa
agcauaacagcuugucuuccgaaaaaggcauuaagggcuagagaugucaaauggaagagacu

SEQ ID NO: 57163 - RNA, 62 nt, hsa
ggugcauucuccccaccccacccccauuauauaagggcuauuuuagaugcuuuuaaccuccc

SEQ ID NO: 57164 - RNA, 62 nt, hsa
gaagaagagggucuugagaaauccuuagcauaaagggcuacuggugagauugagaucugagc

SEQ ID NO: 57165 - RNA, 62 nt, hsa
guaggcugguuuucuucccaccccuuuccuagaagggcuacugcuccuggaagaguggacgg

SEQ ID NO: 57166 - RNA, 62 nt, hsa
gggccugcugcuuuuauauuuugaaagaguuuaagggcuaauaauuuaauuuguuguuuguu

SEQ ID NO: 57167 - RNA, 62 nt, hsa
uuugaaauagugacauaucauccacuagucccaagggcuaaggaauagugaguuuauucugg

SEQ ID NO: 57168 - RNA, 62 nt, hsa
agaaucuaccugagaccaugccacuagcuuuuaagggcuaccaagauguacaacagaacaug

SEQ ID NO: 57169 - RNA, 62 nt, hsa
ggagucuagaacauccuuaaaugucuaacaacaagggcuaccucugaguaccuuuuaguauu

SEQ ID NO: 57170 - RNA, 62 nt, hsa
ugaaugaauaagaggauguggcacugagcgccaagggcuaccuuggaacgcaccgaggagcg

SEQ ID NO: 57171 - RNA, 62 nt, hsa
aggcauagccugggcauaucaccucauugguaaagggcuagagccuuucuuuuuuauggcac

SEQ ID NO: 57172 - RNA, 62 nt, hsa
uuguuaaaguagccuucuucagaugcuuuucuaagggcuaguuaccaacuuuauuucugugu

SEQ ID NO: 57173 - RNA, 62 nt, hsa
gagaaauggcacaaaaacaggcagucaucuuuaagggcuaugccuaggcaaacuacuaacau

SEQ ID NO: 57174 - RNA, 62 nt, hsa
gauggguagugggcugagaagaggggacuaggaagggcuauuccaggcucagcccugcuccu

SEQ ID NO: 57175 - RNA, 62 nt, hsa
uuccuuuuugaggaagguuucuuuauaagugcaagggcuacccuaauaaaggaauguauaua

SEQ ID NO: 57176 - RNA, 62 nt, hsa
aauucccaaauuucauuuguagauacugaacuaagggcuaaugucaggagcugauuuuuaau

SEQ ID NO: 57177 - RNA, 62 nt, hsa
uguguguauguguacccaagcacacaugugugaagggcuauagccaaaguauuuuuacuagc

SEQ ID NO: 57178 - RNA, 62 nt, hsa
ugucuauguagucauacugaauuuagauagauaagggcuacagcauacuaaaucgacaacca

SEQ ID NO: 57179 - RNA, 62 nt, hsa
uugccucugauucuuguaaguuugaguuccacaagggcuaauuuauuccccuuuuacuuggg

SEQ ID NO: 57180 - RNA, 62 nt, hsa
gguugcucaugaaguuaaucucucacgugacuaagggcuauauucaaugcuagugauuucuu

SEQ ID NO: 57181 - RNA, 62 nt, hsa
cgagcguggauugucacagcugcgggcaugggaagggcuagcugagcucuucaccugcaucc

SEQ ID NO: 57182 - RNA, 62 nt, hsa
ugggugcugcuggccuccaagcuggcagugggaagggcuagugagaccacacagggguagcc

SEQ ID NO: 57183 - RNA, 62 nt, hsa
gccuagguuugaacagcagaugcugucccaggaagggcuagggacaucggaggggaccugcc

SEQ ID NO: 57184 - RNA, 62 nt, hsa
ucuuccaaccccaacuggcuugggggcaggacaagggcuaggcuugaugguggccaggcuug

SEQ ID NO: 57185 - RNA, 62 nt, hsa
ugaaggaaaucauagaaaguuugcugaaagcaaagggcuaagcuuaugaaggaaugccuccu

SEQ ID NO: 57186 - RNA, 62 nt, hsa
cagggacuggagaagccaaggggagagucuaaaagggcuagagcauuuuuaaaaauagacac

SEQ ID NO: 57187 - RNA, 62 nt, hsa
cuaugaacagaucagcgcauucucuaggccaaaagggcuagccagguggcaagaucaauuua

SEQ ID NO: 57188 - RNA, 62 nt, hsa
caguaacuuggguggaggcaaaacacuaauaaaagggcuaaaaaggaaaaugaugcuuuucu

SEQ ID NO: 57189 - RNA, 62 nt, hsa
cucugauccagcuggcgcgcagauaccugcagaagggcuacaccacgcugcuguuccaggag

SEQ ID NO: 57190 - RNA, 62 nt, hsa
uauauauggcaggcuucccuggugccgauguaaagggcuacauuugggaacauuugacuucc

SEQ ID NO: 57191 - RNA, 62 nt, hsa
ggcuguugaugauggguuaaaaauguucauuuaagggcuacccccguguuuaauagaugaac

SEQ ID NO: 57192 - RNA, 62 nt, hsa
guguguuuaagcuuaggaaucgccuuuauggaaagggcuaugugggagagucagcuaucuug

SEQ ID NO: 57193 - RNA, 62 nt, hsa
uccaccauaccaguguuuagaagcaaaacaugaagggcuagcgccaccaggauaguuagcag

SEQ ID NO: 57194 - RNA, 62 nt, hsa
uguagguuuguaguagccaccgguaauaagccaagggcuaggcucuuguuugaguuuauggc

SEQ ID NO: 57195 - RNA, 62 nt, hsa
ucagagggaauaugcacuggcgaguuuaaaguaagggcuaugauauuugauggucccaaagu

SEQ ID NO: 57196 - RNA, 62 nt, hsa
caccccagccucacauugccagauguuggcagaagggcuaauauugaccgucuugacuggcu

SEQ ID NO: 57197 - RNA, 62 nt, hsa
ggaaagacacagauuucggucauaaagaauguaagggcuauaaguagaaacuuucuauaacc

SEQ ID NO: 57198 - RNA, 62 nt, hsa
agaacucuggagcuacaggccacucuaggcccaagggcuaguccucuuccccaguccccuca

SEQ ID NO: 57199 - RNA, 62 nt, hsa
gauauuucuuucaaucuguauuggauggcuuaaagggcuauaaaucuguuuauaaagagcau

SEQ ID NO: 57200 - RNA, 62 nt, hsa
auguuaaaagguuaaacuuauggcuauuuuuaaagggcuauucauuuaaucugaguuuuccc

SEQ ID NO: 57201 - RNA, 62 nt, hsa
aaauagcagagugagccaggcggugccaaagcaagggcuaguugagacauugggaaauggaa

SEQ ID NO: 57202 - RNA, 62 nt, hsa
aagcaagaaggcuuaguagcucagucuuuaacaagggcuagaaaagaauguaaucugauaug

SEQ ID NO: 57203 - RNA, 62 nt, hsa
uuuuguagaaccuuccagaauauguggggaaaaagggcuauugcuaagugagcuuuaucuaa

SEQ ID NO: 57204 - RNA, 62 nt, hsa
gcagucuuugccucuuucuguugguugugcccaagggcuacaguagcucugaaauaacaaga

SEQ ID NO: 57205 - RNA, 62 nt, hsa
aauuuugaaauuucgguauauuuauccaguuaaagggcuaaauuauauaagcaaacacuacu

SEQ ID NO: 57206 - RNA, 62 nt, hsa
augcuaugauuucacgugcaggucuaauuucaaagggcuagaguuaguacuacuuaccagau

SEQ ID NO: 57207 - RNA, 62 nt, hsa
uuucacgcugaaacaugcuagugauaucuagaaagggcuaauuaggucucauccuuuaaugc

SEQ ID NO: 57208 - RNA, 62 nt, hsa
ucaugacuguaauucauuaugacugcuccaggaagggcuaauggggccaauauauuauugcc

SEQ ID NO: 57209 - RNA, 62 nt, hsa
uucauuaaagcagcaaauuccuucucgccuuuaagggcuaugguuguagugugacccguggc

SEQ ID NO: 57210 - RNA, 62 nt, hsa
uuuuuuuuuuaaggugaggacucagaaaaucaaagggcuaguagaaacaguguuauguuggg

SEQ ID NO: 57211 - RNA, 62 nt, hsa
aaaaggcccuggcaauuaaauugucaaggcccaagggcuaauuuuaauuuucuuuuuacuug

SEQ ID NO: 57212 - RNA, 62 nt, hsa
cauuucccuuauuugguucagcuuuuagcaaaaagggcuacaguucacccugcagaguauua

SEQ ID NO: 57213 - RNA, 62 nt, hsa
cauaauuuaaucuuugccauccuuagauagagaagggcuauagaucacauacguuaucaaaa

SEQ ID NO: 57214 - RNA, 62 nt, hsa
ggagggcuagaacuggagaggcuagaaccaagaagggcuagaaccuggaggggcuagaaccu

SEQ ID NO: 57215 - RNA, 62 nt, hsa
ggagggcuagaaccuggagagcuagaaccuagaagggcuagaaccuggagggcuggaaucug

SEQ ID NO: 57216 - RNA, 62 nt, hsa
ggagggcuagaaccuggagggcuagaaccuagaagggcuagaaccuggagggcuggaaucug

SEQ ID NO: 57217 - RNA, 62 nt, hsa
ggagggcuagaaccuggagggcuagaaccuagaagggcuagaaccuggagggcuagaaccug

SEQ ID NO: 57218 - RNA, 62 nt, hsa
ggagggcuagaaccuggcagguuagaaccuagaagggcuagaaccuggagagccagaaccug

SEQ ID NO: 57219 - RNA, 62 nt, hsa
ggagagccagaaccuggagggcuagaaccuggaagggcuagaaccuguagagcuagaacaug

SEQ ID NO: 57220 - RNA, 62 nt, hsa
gcugggcugcuuggggcuuggcauaggguggaaagggcuacccuggggcucugaccacacug

SEQ ID NO: 57221 - RNA, 62 nt, hsa
ugggacaaaaauaggaauggugugugacgacaaagggcuacuggaagaacaaaagggauaca

SEQ ID NO: 57222 - RNA, 62 nt, hsa
gagucugacacagcuuucaugagguuacagaaaagggcuacagauuugggaagcugugugua

SEQ ID NO: 57223 - RNA, 62 nt, hsa
aguucaguuuguugggauggaagcaugaaggaaagggcuagagaaguaugaaaucucgaaug

SEQ ID NO: 57224 - RNA, 62 nt, hsa
ggaaauuuaagauuguuaacccuguuuuucagaagggcuacuguuaauugcacauaaacaug

SEQ ID NO: 57225 - RNA, 62 nt, hsa
guaaauuaaauaaagauuccuuuaaggcagacaagggcuaagauuuccuuagcaguaauaau

SEQ ID NO: 57226 - RNA, 62 nt, hsa
uuaaaaucuuugcaaauugaauaauuacagaaaagggcuacauuuaaaauuuguauuuguuu

SEQ ID NO: 57227 - RNA, 62 nt, hsa
ggaaacaucucaggccaacauaggcaaaugaaaagggcuauuaaaauauuuuuacaccuuug

SEQ ID NO: 57228 - RNA, 62 nt, hsa
gcugccugauauuucccuccccuggggacagcaagggcuaucccuuuccaaaggccauggag

SEQ ID NO: 57229 - RNA, 62 nt, hsa
uucguuagguagaaccagagcagugcucagucaagggcuaaugauugcccacccccaaggua

SEQ ID NO: 57230 - RNA, 62 nt, hsa
aguucauucccagggccccaucuugaugggccaagggcuaaacaugcaugugucaguggcuu

SEQ ID NO: 57231 - RNA, 62 nt, hsa
uaccaugcauuucucguucuuuacugggucuaaagggcuaugccuccauuucagagagcuuc

SEQ ID NO: 57232 - RNA, 62 nt, hsa
ccacauggaccacgaauauucuuucuguccagaagggcuacuuuccacauauagagcuccag

SEQ ID NO: 57233 - RNA, 62 nt, hsa
uuuuucuagcaugcuugauuuaggagagaauaaagggcuauauaauaauaaauccagauuuc

SEQ ID NO: 57234 - RNA, 62 nt, hsa
uggggagaaugacuuucccuuuuuugccccauaagggcuagcauaagcugagguagaacuua

SEQ ID NO: 57235 - RNA, 62 nt, hsa
acagcacccccaacccuggcacccagggugggaagggcuacaccuuagccugcccuccuuuc

SEQ ID NO: 57236 - RNA, 62 nt, hsa
ugcuagaaaauucacagggaagaaaacauuucaagggcuauaccucagcaucuaggcuuuuu

SEQ ID NO: 57237 - RNA, 62 nt, hsa
uuucauagcauuuugauaaaaugccacaaaauaagggcuauagagagauuuuuacaagucag

SEQ ID NO: 57238 - RNA, 62 nt, hsa
cuaguuucccugaaggaacauuccuuagucucaagggcuagcaucccugaggagccaggccg

SEQ ID NO: 57239 - RNA, 62 nt, hsa
ucuagugcugguauuuguugacuaccaugcagaagggcuaucuuucuauucacgucaaacuu

SEQ ID NO: 57240 - RNA, 62 nt, hsa
aaugaacuugcuuguguguauuugauggcucuaagggcuauaaauuacaaacaaaacacauc

SEQ ID NO: 57241 - RNA, 62 nt, hsa
gccauaccuugagaccaagccggugcccaccuaagggcuaaggccucuugcuggugcacaug

SEQ ID NO: 57242 - RNA, 62 nt, hsa
uguuuugaagcucaugggaaaauugugaucaaaagggcuaugggaagggcagaccccgccaa

SEQ ID NO: 57243 - RNA, 62 nt, hsa
auauucaguuaaucauaugguuccuagcuuacaagggcuagaucuaagauuauucccaugag

SEQ ID NO: 57244 - RNA, 62 nt, hsa
cuucuucagugaagcagccuuacuauucauagaagggcuagaauaggagaaaaugaaaggua

SEQ ID NO: 57245 - RNA, 62 nt, hsa
gcagcaggaauggugcccaccucggcgaauugaagggcuaagagucccagauagcuaggcca

SEQ ID NO: 57246 - RNA, 62 nt, hsa
ugcucugcuguccuggacccugugugccucauaagggcuauucuuucuuucacgugcaaaac

SEQ ID NO: 57247 - RNA, 62 nt, hsa
uggcuucugcugaccgcugggccccagcucagaagggcuauagcuggucccagaggccuggc

SEQ ID NO: 57248 - RNA, 62 nt, hsa
aaugaacuugcuuguguguauuugauggcuccaagggcuauaaauuacaaacaaaacacauc

SEQ ID NO: 57249 - RNA, 62 nt, hsa
aaccuaaggaaauuauucauuucuguucuuaaaagggcuagaauuuguucuccuucucuucc

SEQ ID NO: 57250 - RNA, 62 nt, hsa
cuuuuucacagaacuggugucaggaaucacugaagggcuaaccgugauaguccuugcaagua

SEQ ID NO: 57251 - RNA, 62 nt, hsa
accaggagcuuauuauaggaaaggcugaacagaagggcuaguguauugauuacacuuaacag

SEQ ID NO: 57252 - RNA, 62 nt, hsa; identical to SEQ ID NO: 57240

SEQ ID NO: 57253 - RNA, 62 nt, hsa
ugagagccuugggggucuccaccagugcagacaagggcuacagucuccagggccgggucuug

SEQ ID NO: 57254 - RNA, 62 nt, hsa
ccaguguguguucauuguaaacacuuuugggaaagggcuaaacaugugaggccuggagauag

SEQ ID NO: 57255 - RNA, 62 nt, hsa
cagaaugauccaggggagauuaagcuuugggcaagggcuauuuaccagggcuuaaauguugu

SEQ ID NO: 57256 - RNA, 62 nt, hsa
uccccagucuggccuuggccuccagccuggagaagggcuaacaucagcucauugucaaggcc

SEQ ID NO: 57257 - RNA, 62 nt, hsa
ggagaaaauuuucgcaaccuacucaucugacaaagggcuaauauccagaaucuacaaugaac

SEQ ID NO: 57258 - RNA, 62 nt, hsa
auacacccaacauuauaacaaaggacuguagcaagggcuaugggaguucugaagcagaaacc

SEQ ID NO: 57259 - RNA, 62 nt, hsa
cacugaagggacacagagguccaguccuucugaagggcuaggaucggguucuggcagggaga

SEQ ID NO: 57260 - RNA, 62 nt, hsa
cugaaaagcuucauaaggggcaguuggugggaaagggcuaauacuguaaugguggaaugugg

SEQ ID NO: 57261 - RNA, 62 nt, hsa
agccauguguuaauuguuaaauaaauucuccaaagggcuaaaaguaaauuacuuauaaauuu

SEQ ID NO: 57262 - RNA, 62 nt, hsa
gguguguauuuuagggauuaugagcuucuuucaagggcuaaggcugcagagauauuuccucc

SEQ ID NO: 57263 - RNA, 62 nt, hsa
ggcugcaauaaggugccaugaaaucaaaaucaaagggcuagaacucuccaaggucuugcccc

SEQ ID NO: 57264 - RNA, 62 nt, hsa
uccuguuugcccugagccgccuggcuguagagaagggcuacaucccugaacccaggugggac

SEQ ID NO: 57265 - RNA, 62 nt, hsa
acagauagaccggccucgccccuuccagcuccaagggcuacaucaaccgaccuuucggguuu

SEQ ID NO: 57266 - RNA, 62 nt, hsa
auuauuucaagagaaucccaaaguacuugaauaagggcuauuguaaaauuuaaaagaaauau

SEQ ID NO: 57267 - RNA, 62 nt, hsa
gacggagaaggcagacaucaugcaacaugcucaagggcuauucauuuuaagcugaaacauac

SEQ ID NO: 57268 - RNA, 62 nt, hsa
acccugcauccauguguguccguggguaccguaagggcuacugggggaagaaccuguaagca

SEQ ID NO: 57269 - RNA, 62 nt, hsa
aauugacaaaauaucugauaaucauguuguuuaagggcuaggugaagaaaguuucaguauug

SEQ ID NO: 57270 - RNA, 62 nt, hsa
ggacaaaaugucucuuagaccuguucuggcugaagggcuaucucuggcaccucugagauccc

SEQ ID NO: 57271 - RNA, 62 nt, hsa
augagggugggucacuacagauguuggggagcaagggcuaggaucacuuuuuaaaaaaucac

SEQ ID NO: 57272 - RNA, 62 nt, hsa
gauauggugucuuuuucuugaaacaagcuuccaagggcuagaaauaaaauagccaaaaaaug

SEQ ID NO: 57273 - RNA, 62 nt, hsa
gacaugcccaugccaccuaugccacagugccuaagggcuaggccacccagagacugugcccg

SEQ ID NO: 57274 - RNA, 62 nt, hsa
ggauuuaaucuggguaaaaucagccuucugagaagggcuaagaaacaguucaauuaacugua

SEQ ID NO: 57275 - RNA, 62 nt, hsa
cugaccuggccucuugccuaaaccacaaggcuaagggcuauagacaaugguuuccuuaggaa

SEQ ID NO: 57276 - RNA, 62 nt, hsa
uauauguagaaccauacagaauuuagguggauaagggcuagaaauuuugagcaacaaaauuu

SEQ ID NO: 57277 - RNA, 64 nt, hsa
cuaaguuguuaaauaaaguuauaauacagcugugaagggcuaaaguuagaguugauuacauaag

SEQ ID NO: 57278 - RNA, 64 nt, hsa
auuuagguuugaaaauacuauuuaauaagggcagaagggcuauauaugauuuggcuauuauuuc

SEQ ID NO: 57279 - RNA, 64 nt, hsa
ccauccagaucaacacccuuucuuccauacagaaaagggcuaaccauaccacagcuggaaucuc

SEQ ID NO: 57280 - RNA, 64 nt, hsa
uaaaaauuauauuuagaauuuuuaaacauguacaaagggcuacauuuuaauuuuaaaauagcuu

SEQ ID NO: 57281 - RNA, 64 nt, hsa
gcccccauucucuuggggucagggaggggcugggaagggcuacugaaggccccauucucccaca

SEQ ID NO: 57282 - RNA, 64 nt, hsa
aaaacauuuuuauaugauuauaaaagaauucuucaagggcuaauuaccuaaccagcuuguauug

SEQ ID NO: 57283 - RNA, 64 nt, hsa
auuuacuacauauuuuccaucuguaguuucucagaagggcuauggauuaguuugaacugucaaa

SEQ ID NO: 57284 - RNA, 64 nt, hsa
agggaggaacacuaugguuaacccucucuugauuaagggcuacuuaaugcacagugcauuaugu

SEQ ID NO: 57285 - RNA, 64 nt, hsa
gccuuucucccccgacacugcugcaccagagugaaagggcuauggcaagggggugucaucugag

SEQ ID NO: 57286 - RNA, 64 nt, hsa
uucaucacgacugauccccaccuccucagggucaaagggcuacuuucuggaagucuccccaggc

SEQ ID NO: 57287 - RNA, 64 nt, hsa
ugacugugugggagccuggacugacagauaggccaagggcuacucucuggcaucuccagguguu

SEQ ID NO: 57288 - RNA, 64 nt, hsa
cuuuccaucugggagaggcagaaucuauauacugaagggcuaguggcacugccaggggaaggga

SEQ ID NO: 57289 - RNA, 64 nt, hsa
cugaagaagcuggcauuguuuacagaaacagaucaagggcuauaauuuaugucauuuuauagca

SEQ ID NO: 57290 - RNA, 64 nt, hsa
caaugagaagcuuuauuaagaaagauccuauuuaaagggcuaauuugguauugaaagcaugcug

SEQ ID NO: 57291 - RNA, 64 nt, hsa
aagagagccaugaggagagggcugaggagggcagaagggcuaggcagggggcaaauugagcccc

SEQ ID NO: 57292 - RNA, 64 nt, hsa
ggagaggagccgcccacuuccaggaccugugaauaagggcuaaugaugaggguugguggggcuc

SEQ ID NO: 57293 - RNA, 64 nt, hsa
uggcucuugccuucccagcaugcccuuuacuacaaagggcuauuuuucuuuucuuucuuuuguu

SEQ ID NO: 57294 - RNA, 64 nt, hsa
gcccacaucaguucaacauccucugguuuuucuaaagggcuauucaucuguuugcuccaguuuu

SEQ ID NO: 57295 - RNA, 64 nt, hsa
gaccaauggggguggggaaguugcugggguggagaagggcuagcccaccgcagcagccucccuc

SEQ ID NO: 57296 - RNA, 64 nt, hsa
ugcuuaaaaauguuuuuguuguuaugcauugauuaagggcuagagcaaauauaaaauuaaaugu

SEQ ID NO: 57297 - RNA, 64 nt, hsa
agaugaguuccagucugaauacagguagauauuaaagggcuaauaaaaaaugagaaaccggucg

SEQ ID NO: 57298 - RNA, 64 nt, hsa
ugggagaaaauuuucgcaaccuacucaucugacaaagggcuaauaaccagaaucuacaaugaac

SEQ ID NO: 57299 - RNA, 64 nt, hsa
auuugaguagauauuuuaaacaccuaacaaaguaaagggcuaaaagccauucagauagcaguaa

SEQ ID NO: 57300 - RNA, 64 nt, hsa
aaauuuucuuaagcuaaaauacagacauguuucaaagggcuaaaguuggagaugaguagauagg

SEQ ID NO: 57301 - RNA, 64 nt, hsa
accgcuguguccucucugcccagccuggcuuaccaagggcuaccucagugggagaugagguugg

SEQ ID NO: 57302 - RNA, 64 nt, hsa
guacaacagauaccuucuauuuuaguugcuaauaaagggcuacacaacucaaaauagucugauu

SEQ ID NO: 57303 - RNA, 64 nt, hsa
ugagccaacuccugaguuuugcuauacuuaaggaaagggcuaucuuuguucuuuguuagucucu

SEQ ID NO: 57304 - RNA, 64 nt, hsa
ucgaacauugcuggacguccucauaguacucacaaagggcuagccuugaaugucacucgcccag

SEQ ID NO: 57305 - RNA, 64 nt, hsa
gcagaagccguauuuguacgcacaacauuaaaucaagggcuacaauucaagcacuuuuauucgu

SEQ ID NO: 57306 - RNA, 64 nt, hsa
cuuuuccuuagccucuucggugaucuuuggucugaagggcuauguggcugagcggaagggugag

SEQ ID NO: 57307 - RNA, 64 nt, hsa
uccagggaauccccaagguuagccugcuuaggggaagggcuagggguaccuggaauguaggauc

SEQ ID NO: 57308 - RNA, 64 nt, hsa
cccugacugauagcauuucagaaugugucuuuugaagggcuaugauaccaguuauuaaauagug

SEQ ID NO: 57309 - RNA, 64 nt, hsa
guucuauguaauucagaagcagaacucuuggcuaaagggcuaguguggccuucagaaaccauuc

SEQ ID NO: 57310 - RNA, 64 nt, hsa
uaaagacuaacuugaaagcaggcacaguuugaugaagggcuagagagcuguuugcaauaaaaag

SEQ ID NO: 57311 - RNA, 64 nt, hsa
uacaugaaugcuuauuuagguuguucaaaguaaaaagggcuacaggucacagaucgucagugcc

SEQ ID NO: 57312 - RNA, 64 nt, hsa
uccaaauauucuggagaaccuggauaaaaguuugaagggcuagauugggauuugaagacaaaau

SEQ ID NO: 57313 - RNA, 64 nt, hsa
guuuaggaccucuuuuauuaaaaaagccuauuuaaagggcuauuucuguagacagaaguucagu

SEQ ID NO: 57314 - RNA, 64 nt, hsa
cacgcugaaggcuuacuucagaugcgauggcuacaagggcuacgaccuggucuacagcccccag

SEQ ID NO: 57315 - RNA, 64 nt, hsa
uuuuucagagcugcagggacagggugagcagcugaagggcuaggagggaagccggcccccgcuc

SEQ ID NO: 57316 - RNA, 64 nt, hsa
ccuuauucagaauuucuaaaaauuuaaguucuguaagggcuaauauauucucuuccuaugguuu

SEQ ID NO: 57317 - RNA, 64 nt, hsa
aaaggcaaaaucuguacugagguagaucauuugaaagggcuagauuauaaaauuaagccuuaga

SEQ ID NO: 57318 - RNA, 64 nt, hsa
gaacaacugucuccauuuuucaagugugagagauaagggcuaaugaugacaucucauuuauuuu

SEQ ID NO: 57319 - RNA, 64 nt, hsa
gccucaggcauuuuuuuuuuuuacacauuaacuaaagggcuauucgaaaucuugacucaggggu

SEQ ID NO: 57320 - RNA, 64 nt, hsa
cugggcucaagcauuucuccuaccucggccuuccaagggcuaggauuacaggcaugagccacug

SEQ ID NO: 57321 - RNA, 64 nt, hsa
uucccaaaccucugcagcaucugcuuuauugccaaagggcuaguuucgguuuucugcagccauu

SEQ ID NO: 57322 - RNA, 64 nt, hsa
aauuuaaagaaaaguuuuaauuauauaaauagcaaagggcuauugccaauacuagggucaaaaa

SEQ ID NO: 57323 - RNA, 64 nt, hsa
uacuaacugugugaccuuaggugaccaguucauuaagggcuaauagauuuccauuuuucaauua

SEQ ID NO: 57324 - RNA, 64 nt, hsa
uagacacauacaugucacauuuagcugugcucagaagggcuaucaucauccuacaacucacauu

SEQ ID NO: 57325 - RNA, 64 nt, hsa
uggguuccacugaaccucaugggacuuuuaaaagaagggcuauuuaaggaauucacuugguagu

SEQ ID NO: 57326 - RNA, 64 nt, hsa
caagugucccuuuuaaaaauagugugugcuaacuaagggcuauucauucugccauuuuuaacuu

SEQ ID NO: 57327 - RNA, 64 nt, hsa
aggguuagcccugaucugaauauaaaagugagaaaagggcuacagugcauuucuugguaacuua

SEQ ID NO: 57328 - RNA, 64 nt, hsa
gcugggcauugucuuuucagagagcuuguagcacaagggcuacacaugggcgccaagauggugg

SEQ ID NO: 57329 - RNA, 64 nt, hsa
gcaaggcaccaugacugcccaucgagaugccaagaagggcuauggaacuaugcagguggcuagu

SEQ ID NO: 57330 - RNA, 64 nt, hsa
uuuuauagaccaugcuaaugcuagaccaguauuuaagggcuaaucucacaccuccuuagcugua

SEQ ID NO: 57331 - RNA, 64 nt, hsa
uuggccuauaugagaaaccaucuucucacagauuaagggcuaagggcaaaaggggugggaggug

SEQ ID NO: 57332 - RNA, 64 nt, hsa
aagggauuugugacaagauaguacacauuacuauaagggcuauuauuuccugaacuggaugucc

SEQ ID NO: 57333 - RNA, 64 nt, hsa
cugggaaagaccuuugagagccuagcccaggccuaagggcuauguuugguaccaguguuuuguc

SEQ ID NO: 57334 - RNA, 64 nt, hsa
uauaucauauugguauucacuaaucugggaagggaagggcuacugcagcuuuacaugcaauuua

SEQ ID NO: 57335 - RNA, 64 nt, hsa
aagcaaguuuaaucuuuggaugccugaauuuuaaaagggcuagaaaaaaaugauugaccagccu

SEQ ID NO: 57336 - RNA, 64 nt, hsa
gaugaagacaguugcuggugaguggagaugauugaagggcuaggaggugagggccuucauuaau

SEQ ID NO: 57337 - RNA, 64 nt, hsa
uuguuacccacgccauuuuacgucuccuucacugaagggcuagaguuuuaacuuuuaauuuuuu

SEQ ID NO: 57338 - RNA, 64 nt, hsa
ugaugcuuguaacucuggaaagaggccuacacccaagggcuaggaauuuuauuuuuccuuuucu

SEQ ID NO: 57339 - RNA, 64 nt, hsa
augacauagaaaguucauggaacucauguuuuuaaagggcuauguaaauauaugaacauuagaa

SEQ ID NO: 57340 - RNA, 64 nt, hsa
ugcuucauaaaacacuuauagccuuaaaccauucaagggcuaauuaaaaaaauaguuaugaaau

SEQ ID NO: 57341 - RNA, 64 nt, hsa
ugucuuguucucucccagcaauuuauuuuaaaacaagggcuagcuucaagcaugacuguuaaug

SEQ ID NO: 57342 - RNA, 51 nt, hsa; identical to SEQ ID NO: 57155

SEQ ID NO: 57343 - RNA, 64 nt, hsa
agauuccuuccuuguuaucaagccucucggacaaaagggcuaggaaaaggugauaugucuccug

SEQ ID NO: 57344 - RNA, 64 nt, hsa
gagagagaaucaugaagaaaagaaggucaauaaaaagggcuaaaaccuuggacaaaaguuuuug

SEQ ID NO: 57345 - RNA, 64 nt, hsa
aagcuuguuggaaugcagucuacaaaagcgcuauaagggcuaaaggauuauaguaauagcuuga

SEQ ID NO: 57346 - RNA, 64 nt, hsa
auacauauauauuuauguagauauacuuccaugaaagggcuaauacgaugcauauacugaaggg

SEQ ID NO: 57347 - RNA, 64 nt, hsa
uuuaucggcuucccaaguuuacuaagaaacuuugaagggcuauuucaguaguauagaccaguga

SEQ ID NO: 57348 - RNA, 64 nt, hsa
uuguuauuuccaaauagaauggacucggucuguuaagggcuaaggagaagaggaagauaagguu

SEQ ID NO: 57349 - RNA, 64 nt, hsa
ucagcauaacagcuugucuuccgaaaaaggcauuaagggcuagagaugucaaauggaagagacu

SEQ ID NO: 57350 - RNA, 64 nt, hsa
cuggugcauucuccccaccccacccccauuauauaagggcuauuuuagaugcuuuuaaccuccc

SEQ ID NO: 57351 - RNA, 64 nt, hsa
uugaagaagagggucuugagaaauccuuagcauaaagggcuacuggugagauugagaucugagc

SEQ ID NO: 57352 - RNA, 64 nt, hsa
ggguaggcugguuuucuucccaccccuuuccuagaagggcuacugcuccuggaagaguggacgg

SEQ ID NO: 57353 - RNA, 64 nt, hsa
uggggccugcugcuuuuauauuuugaaagaguuuaagggcuaauaauuuaauuuguuguuuguu

SEQ ID NO: 57354 - RNA, 64 nt, hsa
aguuugaaauagugacauaucauccacuagucccaagggcuaaggaauagugaguuuauucugg

SEQ ID NO: 57355 - RNA, 64 nt, hsa
caagaaucuaccugagaccaugccacuagcuuuuaagggcuaccaagauguacaacagaacaug

SEQ ID NO: 57356 - RNA, 64 nt, hsa
uuggagucuagaacauccuuaaaugucuaacaacaagggcuaccucugaguaccuuuuaguauu

SEQ ID NO: 57357 - RNA, 64 nt, hsa
caugaaugaauaagaggauguggcacugagcgccaagggcuaccuuggaacgcaccgaggagcg

SEQ ID NO: 57358 - RNA, 64 nt, hsa
acaggcauagccugggcauaucaccucauugguaaagggcuagagccuuucuuuuuuauggcac

SEQ ID NO: 57359 - RNA, 64 nt, hsa
uuuuguuaaaguagccuucuucagaugcuuuucuaagggcuaguuaccaacuuuauuucugugu

SEQ ID NO: 57360 - RNA, 64 nt, hsa
uugagaaauggcacaaaaacaggcagucaucuuuaagggcuaugccuaggcaaacuacuaacau

SEQ ID NO: 57361 - RNA, 64 nt, hsa
uggauggguagugggcugagaagaggggacuaggaagggcuauuccaggcucagcccugcuccu

SEQ ID NO: 57362 - RNA, 64 nt, hsa
auuuccuuuuugaggaagguuucuuuauaagugcaagggcuacccuaauaaaggaauguauaua

SEQ ID NO: 57363 - RNA, 64 nt, hsa
agaauucccaaauuucauuuguagauacugaacuaagggcuaaugucaggagcugauuuuuaau

SEQ ID NO: 57364 - RNA, 64 nt, hsa
ccuguguguauguguacccaagcacacaugugugaagggcuauagccaaaguauuuuuacuagc

SEQ ID NO: 57365 - RNA, 64 nt, hsa
aaugucuauguagucauacugaauuuagauagauaagggcuacagcauacuaaaucgacaacca

SEQ ID NO: 57366 - RNA, 64 nt, hsa
gauugccucugauucuuguaaguuugaguuccacaagggcuaauuuauuccccuuuuacuuggg

SEQ ID NO: 57367 - RNA, 64 nt, hsa
uggguugcucaugaaguuaaucucucacgugacuaagggcuauauucaaugcuagugauuucuu

SEQ ID NO: 57368 - RNA, 64 nt, hsa
ggcgagcguggauugucacagcugcgggcaugggaagggcuagcugagcucuucaccugcaucc

SEQ ID NO: 57369 - RNA, 64 nt, hsa
ucugggugcugcuggccuccaagcuggcagugggaagggcuagugagaccacacagggguagcc

SEQ ID NO: 57370 - RNA, 64 nt, hsa
gagccuagguuugaacagcagaugcugucccaggaagggcuagggacaucggaggggaccugcc

SEQ ID NO: 57371 - RNA, 64 nt, hsa
uaucuuccaaccccaacuggcuugggggcaggacaagggcuaggcuugaugguggccaggcuug

SEQ ID NO: 57372 - RNA, 64 nt, hsa
auugaaggaaaucauagaaaguuugcugaaagcaaagggcuaagcuuaugaaggaaugccuccu

SEQ ID NO: 57373 - RNA, 64 nt, hsa
ggcagggacuggagaagccaaggggagagucuaaaagggcuagagcauuuuuaaaaauagacac

SEQ ID NO: 57374 - RNA, 64 nt, hsa
cacuaugaacagaucagcgcauucucuaggccaaaagggcuagccagguggcaagaucaauuua

SEQ ID NO: 57375 - RNA, 64 nt, hsa
ugcaguaacuuggguggaggcaaaacacuaauaaaagggcuaaaaaggaaaaugaugcuuuucu

SEQ ID NO: 57376 - RNA, 64 nt, hsa
gucucugauccagcuggcgcgcagauaccugcagaagggcuacaccacgcugcuguuccaggag

SEQ ID NO: 57377 - RNA, 64 nt, hsa
uguauauauggcaggcuucccuggugccgauguaaagggcuacauuugggaacauuugacuucc

SEQ ID NO: 57378 - RNA, 64 nt, hsa
agggcuguugaugauggguuaaaaauguucauuuaagggcuacccccguguuuaauagaugaac

SEQ ID NO: 57379 - RNA, 64 nt, hsa
guguguguuuaagcuuaggaaucgccuuuauggaaagggcuaugugggagagucagcuaucuug

SEQ ID NO: 57380 - RNA, 64 nt, hsa
ccuccaccauaccaguguuuagaagcaaaacaugaagggcuagcgccaccaggauaguuagcag

SEQ ID NO: 57381 - RNA, 64 nt, hsa
ucuguagguuuguaguagccaccgguaauaagccaagggcuaggcucuuguuugaguuuauggc

SEQ ID NO: 57382 - RNA, 64 nt, hsa
cuucagagggaauaugcacuggcgaguuuaaaguaagggcuaugauauuugauggucccaaagu

SEQ ID NO: 57383 - RNA, 64 nt, hsa
uccaccccagccucacauugccagauguuggcagaagggcuaauauugaccgucuugacuggcu

SEQ ID NO: 57384 - RNA, 64 nt, hsa
gaggaaagacacagauuucggucauaaagaauguaagggcuauaaguagaaacuuucuauaacc

SEQ ID NO: 57385 - RNA, 64 nt, hsa
ccagaacucuggagcuacaggccacucuaggcccaagggcuaguccucuuccccaguccccuca

SEQ ID NO: 57386 - RNA, 64 nt, hsa
augauauuucuuucaaucuguauuggauggcuuaaagggcuauaaaucuguuuauaaagagcau

SEQ ID NO: 57387 - RNA, 64 nt, hsa
acauguuaaaagguuaaacuuauggcuauuuuuaaagggcuauucauuuaaucugaguuuuccc

SEQ ID NO: 57388 - RNA, 64 nt, hsa
acaaauagcagagugagccaggcggugccaaagcaagggcuaguugagacauugggaaauggaa

SEQ ID NO: 57389 - RNA, 64 nt, hsa
ccaagcaagaaggcuuaguagcucagucuuuaacaagggcuagaaaagaauguaaucugauaug

SEQ ID NO: 57390 - RNA, 64 nt, hsa
gcuuuuguagaaccuuccagaauauguggggaaaaagggcuauugcuaagugagcuuuaucuaa

SEQ ID NO: 57391 - RNA, 64 nt, hsa
cagcagucuuugccucuuucuguugguugugcccaagggcuacaguagcucugaaauaacaaga

SEQ ID NO: 57392 - RNA, 64 nt, hsa
gaaauuuugaaauuucgguauauuuauccaguuaaagggcuaaauuauauaagcaaacacuacu

SEQ ID NO: 57393 - RNA, 64 nt, hsa
gaaugcuaugauuucacgugcaggucuaauuucaaagggcuagaguuaguacuacuuaccagau

SEQ ID NO: 57394 - RNA, 64 nt, hsa
acuuucacgcugaaacaugcuagugauaucuagaaagggcuaauuaggucucauccuuuaaugc

SEQ ID NO: 57395 - RNA, 64 nt, hsa
ugucaugacuguaauucauuaugacugcuccaggaagggcuaauggggccaauauauuauugcc

SEQ ID NO: 57396 - RNA, 64 nt, hsa
aguucauuaaagcagcaaauuccuucucgccuuuaagggcuaugguuguagugugacccguggc

SEQ ID NO: 57397 - RNA, 64 nt, hsa
uuuuuuuuuuuuaaggugaggacucagaaaaucaaagggcuaguagaaacaguguuauguuggg

SEQ ID NO: 57398 - RNA, 64 nt, hsa
acaaaaggcccuggcaauuaaauugucaaggcccaagggcuaauuuuaauuuucuuuuuacuug

SEQ ID NO: 57399 - RNA, 64 nt, hsa
aacauuucccuuauuugguucagcuuuuagcaaaaagggcuacaguucacccugcagaguauua

SEQ ID NO: 57400 - RNA, 64 nt, hsa
cacauaauuuaaucuuugccauccuuagauagagaagggcuauagaucacauacguuaucaaaa

SEQ ID NO: 57401 - RNA, 64 nt, hsa
cuggagggcuagaacuggagaggcuagaaccaagaagggcuagaaccuggaggggcuagaaccu

SEQ ID NO: 57402 - RNA, 64 nt, hsa
cuggagggcuagaaccuggagagcuagaaccuagaagggcuagaaccuggagggcuggaaucug

SEQ ID NO: 57403 - RNA, 64 nt, hsa
cuggagggcuagaaccuggagggcuagaaccuagaagggcuagaaccuggagggcuggaaucug

SEQ ID NO: 57404 - RNA, 64 nt, hsa
cuggagggcuagaaccuggagggcuagaaccuagaagggcuagaaccuggagggcuagaaccug

SEQ ID NO: 57405 - RNA, 64 nt, hsa
cuggagggcuagaaccuggcagguuagaaccuagaagggcuagaaccuggagagccagaaccug

SEQ ID NO: 57406 - RNA, 64 nt, hsa
cuggagagccagaaccuggagggcuagaaccuggaagggcuagaaccuguagagcuagaacaug

SEQ ID NO: 57407 - RNA, 64 nt, hsa
gggcugggcugcuuggggcuuggcauaggguggaaagggcuacccuggggcucugaccacacug

SEQ ID NO: 57408 - RNA, 64 nt, hsa
gaugggacaaaaauaggaauggugugugacgacaaagggcuacuggaagaacaaaagggauaca

SEQ ID NO: 57409 - RNA, 64 nt, hsa
cugagucugacacagcuuucaugagguuacagaaaagggcuacagauuugggaagcugugugua

SEQ ID NO: 57410 - RNA, 64 nt, hsa
cuaguucaguuuguugggauggaagcaugaaggaaagggcuagagaaguaugaaaucucgaaug

SEQ ID NO: 57411 - RNA, 64 nt, hsa
ggggaaauuuaagauuguuaacccuguuuuucagaagggcuacuguuaauugcacauaaacaug

SEQ ID NO: 57412 - RNA, 64 nt, hsa
caguaaauuaaauaaagauuccuuuaaggcagacaagggcuaagauuuccuuagcaguaauaau

SEQ ID NO: 57413 - RNA, 64 nt, hsa
acuuaaaaucuuugcaaauugaauaauuacagaaaagggcuacauuuaaaauuuguauuuguuu

SEQ ID NO: 57414 - RNA, 64 nt, hsa
agggaaacaucucaggccaacauaggcaaaugaaaagggcuauuaaaauauuuuuacaccuuug

SEQ ID NO: 57415 - RNA, 64 nt, hsa
gagcugccugauauuucccuccccuggggacagcaagggcuaucccuuuccaaaggccauggag

SEQ ID NO: 57416 - RNA, 64 nt, hsa
gauucguuagguagaaccagagcagugcucagucaagggcuaaugauugcccacccccaaggua

SEQ ID NO: 57417 - RNA, 64 nt, hsa
ccaguucauucccagggccccaucuugaugggccaagggcuaaacaugcaugugucaguggcuu

SEQ ID NO: 57418 - RNA, 64 nt, hsa
cuuaccaugcauuucucguucuuuacugggucuaaagggcuaugccuccauuucagagagcuuc

SEQ ID NO: 57419 - RNA, 64 nt, hsa
aaccacauggaccacgaauauucuuucuguccagaagggcuacuuuccacauauagagcuccag

SEQ ID NO: 57420 - RNA, 64 nt, hsa
guuuuuucuagcaugcuugauuuaggagagaauaaagggcuauauaauaauaaauccagauuuc

SEQ ID NO: 57421 - RNA, 64 nt, hsa
cuuggggagaaugacuuucccuuuuuugccccauaagggcuagcauaagcugagguagaacuua

SEQ ID NO: 57422 - RNA, 64 nt, hsa
uuacagcacccccaacccuggcacccagggugggaagggcuacaccuuagccugcccuccuuuc

SEQ ID NO: 57423 - RNA, 64 nt, hsa
auugcuagaaaauucacagggaagaaaacauuucaagggcuauaccucagcaucuaggcuuuuu

SEQ ID NO: 57424 - RNA, 64 nt, hsa
gauuucauagcauuuugauaaaaugccacaaaauaagggcuauagagagauuuuuacaagucag

SEQ ID NO: 57425 - RNA, 64 nt, hsa
cccuaguuucccugaaggaacauuccuuagucucaagggcuagcaucccugaggagccaggccg

SEQ ID NO: 57426 - RNA, 64 nt, hsa
uuucuagugcugguauuuguugacuaccaugcagaagggcuaucuuucuauucacgucaaacuu

SEQ ID NO: 57427 - RNA, 64 nt, hsa
caaaugaacuugcuuguguguauuugauggcucuaagggcuauaaauuacaaacaaaacacauc

SEQ ID NO: 57428 - RNA, 64 nt, hsa
augccauaccuugagaccaagccggugcccaccuaagggcuaaggccucuugcuggugcacaug

SEQ ID NO: 57429 - RNA, 64 nt, hsa
ucuguuuugaagcucaugggaaaauugugaucaaaagggcuaugggaagggcagaccccgccaa

SEQ ID NO: 57430 - RNA, 64 nt, hsa
gaauauucaguuaaucauaugguuccuagcuuacaagggcuagaucuaagauuauucccaugag

SEQ ID NO: 57431 - RNA, 64 nt, hsa
uucuucuucagugaagcagccuuacuauucauagaagggcuagaauaggagaaaaugaaaggua

SEQ ID NO: 57432 - RNA, 64 nt, hsa
cugcagcaggaauggugcccaccucggcgaauugaagggcuaagagucccagauagcuaggcca

SEQ ID NO: 57433 - RNA, 64 nt, hsa
uuugcucugcuguccuggacccugugugccucauaagggcuauucuuucuuucacgugcaaaac

SEQ ID NO: 57434 - RNA, 64 nt, hsa
ucuggcuucugcugaccgcugggccccagcucagaagggcuauagcuggucccagaggccuggc

SEQ ID NO: 57435 - RNA, 64 nt, hsa
caaaugaacuugcuuguguguauuugauggcuccaagggcuauaaauuacaaacaaaacacauc

SEQ ID NO: 57436 - RNA, 64 nt, hsa
auaaccuaaggaaauuauucauuucuguucuuaaaagggcuagaauuuguucuccuucucuucc

SEQ ID NO: 57437 - RNA, 64 nt, hsa
uucuuuuucacagaacuggugucaggaaucacugaagggcuaaccgugauaguccuugcaagua

SEQ ID NO: 57438 - RNA, 64 nt, hsa
caaccaggagcuuauuauaggaaaggcugaacagaagggcuaguguauugauuacacuuaacag

SEQ ID NO: 57439 - RNA, 64 nt, hsa; identical to SEQ ID NO: 57427

SEQ ID NO: 57440 - RNA, 64 nt, hsa
ucugagagccuugggggucuccaccagugcagacaagggcuacagucuccagggccgggucuug

SEQ ID NO: 57441 - RNA, 64 nt, hsa
ucccaguguguguucauuguaaacacuuuugggaaagggcuaaacaugugaggccuggagauag

SEQ ID NO: 57442 - RNA, 64 nt, hsa
aacagaaugauccaggggagauuaagcuuugggcaagggcuauuuaccagggcuuaaauguugu

SEQ ID NO: 57443 - RNA, 64 nt, hsa
ccuccccagucuggccuuggccuccagccuggagaagggcuaacaucagcucauugucaaggcc

SEQ ID NO: 57444 - RNA, 64 nt, hsa
ugggagaaaauuuucgcaaccuacucaucugacaaagggcuaauauccagaaucuacaaugaac

SEQ ID NO: 57445 - RNA, 64 nt, hsa
uaauacacccaacauuauaacaaaggacuguagcaagggcuaugggaguucugaagcagaaacc

SEQ ID NO: 57446 - RNA, 64 nt, hsa
cccacugaagggacacagagguccaguccuucugaagggcuaggaucggguucuggcagggaga

SEQ ID NO: 57447 - RNA, 64 nt, hsa
gacugaaaagcuucauaaggggcaguuggugggaaagggcuaauacuguaaugguggaaugugg

SEQ ID NO: 57448 - RNA, 64 nt, hsa
guagccauguguuaauuguuaaauaaauucuccaaagggcuaaaaguaaauuacuuauaaauuu

SEQ ID NO: 57449 - RNA, 64 nt, hsa
augguguguauuuuagggauuaugagcuucuuucaagggcuaaggcugcagagauauuuccucc

SEQ ID NO: 57450 - RNA, 64 nt, hsa
gaggcugcaauaaggugccaugaaaucaaaaucaaagggcuagaacucuccaaggucuugcccc

SEQ ID NO: 57451 - RNA, 64 nt, hsa
cguccuguuugcccugagccgccuggcuguagagaagggcuacaucccugaacccaggugggac

SEQ ID NO: 57452 - RNA, 64 nt, hsa
guacagauagaccggccucgccccuuccagcuccaagggcuacaucaaccgaccuuucggguuu

SEQ ID NO: 57453 - RNA, 64 nt, hsa
ugauuauuucaagagaaucccaaaguacuugaauaagggcuauuguaaaauuuaaaagaaauau

SEQ ID NO: 57454 - RNA, 64 nt, hsa
gugacggagaaggcagacaucaugcaacaugcucaagggcuauucauuuuaagcugaaacauac

SEQ ID NO: 57455 - RNA, 64 nt, hsa
caacccugcauccauguguguccguggguaccguaagggcuacugggggaagaaccuguaagca

SEQ ID NO: 57456 - RNA, 64 nt, hsa
guaauugacaaaauaucugauaaucauguuguuuaagggcuaggugaagaaaguuucaguauug

SEQ ID NO: 57457 - RNA, 64 nt, hsa
auggacaaaaugucucuuagaccuguucuggcugaagggcuaucucuggcaccucugagauccc

SEQ ID NO: 57458 - RNA, 64 nt, hsa
ucaugagggugggucacuacagauguuggggagcaagggcuaggaucacuuuuuaaaaaaucac

SEQ ID NO: 57459 - RNA, 64 nt, hsa
augauauggugucuuuuucuugaaacaagcuuccaagggcuagaaauaaaauagccaaaaaaug

SEQ ID NO: 57460 - RNA, 64 nt, hsa
cugacaugcccaugccaccuaugccacagugccuaagggcuaggccacccagagacugugcccg

SEQ ID NO: 57461 - RNA, 64 nt, hsa
uuggauuuaaucuggguaaaaucagccuucugagaagggcuaagaaacaguucaauuaacugua

SEQ ID NO: 57462 - RNA, 64 nt, hsa
accugaccuggccucuugccuaaaccacaaggcuaagggcuauagacaaugguuuccuuaggaa

SEQ ID NO: 57463 - RNA, 64 nt, hsa
cauauauguagaaccauacagaauuuagguggauaagggcuagaaauuuugagcaacaaaauuu

SEQ ID NO: 57464 - RNA, 64 nt, hsa
cuuuaaguugacuuuuuuuacuucauuauuuuuaggaauaaauguaagauuuuacaaaucuuuu

SEQ ID NO: 57465 - RNA, 64 nt, hsa
guacucucccuauuaauauuugaaggaccucaauggaauaaauuugaaaagcuaaauuaaaaua

SEQ ID NO: 57466 - RNA, 64 nt, hsa
uaugauacccacuuggacuuuuaacaaaaguaaaggaauaaauuugcauauaggcuuggaaagu

SEQ ID NO: 57467 - RNA, 64 nt, hsa
ucagccuuuugaccaccuggugccagcuauauaaggaauaaaguugauucauaucaacauuaga

SEQ ID NO: 57468 - RNA, 64 nt, hsa
cauucuacagggagaaagagauagccaauacauaggaauaaauauauacaagguaucauguagu

SEQ ID NO: 57469 - RNA, 64 nt, hsa
gggaaacaagacuuuuccugcaauagccugggaaggaauaaaaggauagaguguuuggguuuuu

SEQ ID NO: 57470 - RNA, 64 nt, hsa
uuuucccagcaaaauaaaucauauggcgagucagggaauaaaaagucaaaagaaacaaauagaa

SEQ ID NO: 57471 - RNA, 64 nt, hsa
ugccuuuuuuucacaguaguccuuggcucugcacggaauaaaugauacccucaaaucuaauugg

SEQ ID NO: 57472 - RNA, 64 nt, hsa
uucacugucuguugcuucaguaaaaggaccucggggaauaaaacauuucucucuuauaugccag

SEQ ID NO: 57473 - RNA, 64 nt, hsa
uguuuucgaugagguuccauguuuuguuuucuugggaauaaauuaauauauuguuuuccacuuc

SEQ ID NO: 57474 - RNA, 64 nt, hsa
aaucaacggggaaaacaucuucuccaaaaaacuuggaauaaauccaaggaccaguuuuuaccca

SEQ ID NO: 57475 - RNA, 64 nt, hsa
caacacaaaauaaacuagaaggccagaggauaauggaauaaaagaucauugcaauuacuuaucc

SEQ ID NO: 57476 - RNA, 64 nt, hsa
uuuuuacagcaacaauaugaaauauauuuuauaaggaauaaaaugguaccuugucugauuuaau

SEQ ID NO: 57477 - RNA, 64 nt, hsa
ucuuaugccguugguauacagggcaggaaagagaggaauaaagggagagagcaguguggaaacc

SEQ ID NO: 57478 - RNA, 64 nt, hsa
uuguuaagaacacguguauuaaauucauguaaguggaauaaaaguuuuaugaauggacuuuuca

SEQ ID NO: 57479 - RNA, 64 nt, hsa
agaaaacugccuacauacugguuuguccuggcggggaauaaaagggaucauugguuccagucac

SEQ ID NO: 57480 - RNA, 64 nt, hsa
gaugggucccugugccaggccucaauacugccagggaauaaaaccagagggagaggacccucag

SEQ ID NO: 57481 - RNA, 64 nt, hsa
gcuaaagagauauacauucuggauacuugggaggggaauaaauuaaaguuuucacacuguguac

SEQ ID NO: 57482 - RNA, 64 nt, hsa
uaaauuuuuauuaaugcacuugaacaacuuugcaggaauaaagcaacccccuaaccacaaaaua

SEQ ID NO: 57483 - RNA, 64 nt, hsa
uuaacuugugaacuccuuggauaugauauuauuuggaauaaacagaauuuaucauugaacccaa

SEQ ID NO: 57484 - RNA, 64 nt, hsa
aucuucuauucaaaaucuuuuuuuuauuuuuaagggaauaaaaauuuuaaaaauuaagagauau

SEQ ID NO: 57485 - RNA, 64 nt, hsa
gauuagaaaauaagacuucugagaaaaaguucaaggaauaaagauuguuugacucuggagagga

SEQ ID NO: 57486 - RNA, 64 nt, hsa
cucgugaagggcaaauguaacaccauaacaguagggaauaaacugugucccaccuguuuacuug

SEQ ID NO: 57487 - RNA, 64 nt, hsa
ugucugcucacaagagauaaagauacccucucauggaauaaacaccuugcuuagaauucauaua

SEQ ID NO: 57488 - RNA, 64 nt, hsa
agagugaaaggggcuauuauuaggugggacaaaaggaauaaaugaagacugcccagaaaaaacu

SEQ ID NO: 57489 - RNA, 64 nt, hsa
cagguuuguuuuuccaaaguaacagaugacauguggaauaaaguaauagaguaacaaguggcag

SEQ ID NO: 57490 - RNA, 64 nt, hsa
cuccccgagagcaggccuguccccuacccaacugggaauaaacuggaagcugggucucuuuguu

SEQ ID NO: 57491 - RNA, 64 nt, hsa
uuaaaagacuuauuaugugggguucaaauugaguggaauaaaguauagauuaaaaguauacaau

SEQ ID NO: 57492 - RNA, 64 nt, hsa
uaauaaaauucucuuucagcuagagaaguuaacaggaauaaauauaugaacaaaaaagcugcaa

SEQ ID NO: 57493 - RNA, 64 nt, hsa
uuaauuuuuguacuuuugcagaagaaacuucagcaagcuagaacuggaagguacuuuaauuuuu

SEQ ID NO: 57494 - RNA, 64 nt, hsa
ugagcuuuugccugccugugcuauuuuacuuguaaagcuagagcacccaagcuucugccuucug

SEQ ID NO: 57495 - RNA, 64 nt, hsa
agaacauuccaaacuaguaacauuucgcuacuaaaagcuagaaaggaugaacugugaaagguuc

SEQ ID NO: 57496 - RNA, 64 nt, hsa
cauugcaugggaagaguacagagguggcagaaugaagcuagagugggaaggacuaaagacugag

SEQ ID NO: 57497 - RNA, 64 nt, hsa
ugcucuucaacuagugaaugaaagaaacuucagaaagcuagaauugcuuaucaaucaaaagacu

SEQ ID NO: 57498 - RNA, 64 nt, hsa
cucaacaacaauauucucaagagucuucuacuggaagcuagaaagaaauaggaauuuaagucca

SEQ ID NO: 57499 - RNA, 64 nt, hsa
uuucaagcuucacuuuugugcaguagaaacaaaaguaggcuacagucugugccauguugaugua

SEQ ID NO: 57500 - RNA, 64 nt, hsa
ucaguccgaauuaauucccccucccuaggugccuguaggcuaugguacuucuuccucauuguuu

SEQ ID NO: 57501 - RNA, 64 nt, hsa
acauuugaacagggcaaaaugaacuaacugccauguaggcuaagaaagaaaugcuaaccugugg

SEQ ID NO: 57502 - RNA, 64 nt, hsa
cacuccucugagagggcagaacacacauauccaaguaggcuacccaccacuggguagggauuuc

SEQ ID NO: 57503 - RNA, 64 nt, hsa
gugcccucaucagagucaucagcaaacuguccaaguaggcuaggcuccagauuuaugaggaaag

SEQ ID NO: 57504 - RNA, 64 nt, hsa
ugaauguucauucuuucuuuuugcucauacugcuguaggcuauaauuccccccuguuuuuccau

SEQ ID NO: 57505 - RNA, 64 nt, hsa
cucagcccguuuugaggacagacagucccccgagguaggcuacauccccccaccccagcugguc

SEQ ID NO: 57506 - RNA, 64 nt, hsa
gaguuaaaccucuggcaugaagucugggaguaggguaggcuaggggguuucuucuaugacacuu

SEQ ID NO: 57507 - RNA, 64 nt, hsa
gaauacagcacuagacuucauccuagaguuucagguaggcuaaugcuuagugccugaguauuua

SEQ ID NO: 57508 - RNA, 64 nt, hsa
ugguuacccuugccuccacccaugugucauaagaguaggcuacagaggugaccaggccuggcag

SEQ ID NO: 57509 - RNA, 64 nt, hsa
gaacccuuccauccuuugacaccugguuguauguguaggcuaagaaggaaggacccuccuguca

SEQ ID NO: 57510 - RNA, 64 nt, hsa
cccguugucacuaaucacacaacaauuuugagaaguaggcuauaaaacaaaaaaagguugcugu

SEQ ID NO: 57511 - RNA, 64 nt, hsa
caaaaccuucacaagaagucgacuguuuucuuuaguaggcuaacuuuuuaaacauuccacaaga

SEQ ID NO: 57512 - RNA, 64 nt, hsa
aaaguguuagccuuuuuuccccagacuuguuggcguaggcuacagagaagccuucaagcucuga

SEQ ID NO: 57513 - RNA, 64 nt, hsa
gacaccuugguguguuuguuaucuuuaucuguggguaggcuagcugacccaucuccuugaguca

SEQ ID NO: 57514 - RNA, 64 nt, hsa
ccuaaccaagccuuggcaccgccagauccuuucuguaggcuaauuccucuugcccaacggcaua

SEQ ID NO: 57515 - RNA, 64 nt, hsa
gagauagaaaagaccuuuaagacaauaaaagauuguaggcuaucucuguaaucaugcaauagcu

SEQ ID NO: 57516 - RNA, 64 nt, hsa
ggccccagcauggagggaagcccugugggccacgguaggcuagaagggaauucgagcugggcau

SEQ ID NO: 57517 - RNA, 64 nt, hsa
agugcugcccuuuaucagcacccugggucauaguguaggcuagaguuaaggcacuggcagacuu

SEQ ID NO: 57518 - RNA, 64 nt, hsa
uuguauuguguguugcuaaagaauucuacuuuuaguaggcuaaucaacaaugaaaggguuagaa

SEQ ID NO: 57519 - RNA, 64 nt, hsa
gcguaggugccucagggacuuuuggauuuggaaaguaggcuaagcuagugggugucuccaacuc

SEQ ID NO: 57520 - RNA, 64 nt, hsa
uggaaauaaacauuauuuucuuuuuuuguucccuguaggcuacuugauccuggauaguuucucu

SEQ ID NO: 57521 - RNA, 64 nt, hsa
aggacugcuuccacuuagaaacaaacucugagaaguaggcuaagagaagacaagagggccgggc

SEQ ID NO: 57522 - RNA, 64 nt, hsa
uuuguugaaaaaucacaaacccauagaaaaguaaguaggcuaaguuggggaggcucaaaccauu

SEQ ID NO: 57523 - RNA, 64 nt, hsa
auuuaguguucaaguaucagcuuaacuauuuuguguaggcuacacacagcuugcuuuuguuucu

SEQ ID NO: 57524 - RNA, 64 nt, hsa
ucaaugcauaaguuguauaggcuaaauguugcuuguaggcuacauuaaacucaaauguaauagu

SEQ ID NO: 57525 - RNA, 64 nt, hsa
caaggccaagaccaucuuuuguaccguugguacaguaggcuaaagguacgguguuccauauuaa

SEQ ID NO: 57526 - RNA, 64 nt, hsa
uccccgccugcaccagugccguccugcugaugugguaggcuagcaauauuuugguuaaaaucau

SEQ ID NO: 57527 - RNA, 64 nt, hsa
aaaaggaauuauacaaaggaacauaaagaccacuguaggcuauccuuaucuguggcuuugggau

SEQ ID NO: 57528 - RNA, 64 nt, hsa
uaucacgggucacuugaaauucuuucagcuaucaguaggcuaaugucaaaauuguuuaaaaauu

SEQ ID NO: 57529 - RNA, 64 nt, hsa
ugugauuuuuuuauauaaguuaaagagacaaauaguaggcuaaaaacauuuuaaaaucaacuuu

SEQ ID NO: 57530 - RNA, 64 nt, hsa
aaagugcuacuugagagugggggagaauggcaugguaggcuacuuuucagggccuugacaagua

SEQ ID NO: 57531 - RNA, 64 nt, hsa
uaaguccucuagugaauguaggcuggcuuucagaguaggcuauuccugagagcugcaugugucc

SEQ ID NO: 57532 - RNA, 64 nt, hsa
guaauucagauguuaaugccacuugaagaaguugguaggcuagcaaagaggaugagacaugaac

SEQ ID NO: 57533 - RNA, 64 nt, hsa
guuaauuucccaucuaugaauagcacuuuaugauguaggcuaaacuaagcaaauaaugcagcgu

SEQ ID NO: 57534 - RNA, 64 nt, hsa
ccucagcugcuguccgccugaucugucuugggcuguaggcuagaaugcccgggcuggugcccac

SEQ ID NO: 57535 - RNA, 64 nt, hsa
ucucccuuaucauuuguauccagauuacuguacuguaggcuaaaauaacacaguauuuacaugu

SEQ ID NO: 57536 - RNA, 64 nt, hsa
aagcugcauguaaaaggggaaauuaguauaugauguaggcuaaaagugaaaucauaguaacaua

SEQ ID NO: 57537 - RNA, 64 nt, hsa
cagaauugaagaaagaguauuauaccagaguguaguaggcuagggugauuguaagaacucugua

SEQ ID NO: 57538 - RNA, 64 nt, hsa
aguaaauaauuuucuccccaugguacacucuaguguaggcuauucauaccacacugaaaugaac

SEQ ID NO: 57539 - RNA, 64 nt, hsa
gauuuaucuagcuguccagccgcuguggcuggagguaggcuaguugggaugggcagcuaagcag

SEQ ID NO: 57540 - RNA, 64 nt, hsa
guugauugucugcacuugccuugcccaauagccaguaggcuacagcuuuugccccacacccuua

SEQ ID NO: 57541 - RNA, 64 nt, hsa
uguuaaucucuuucaugugcaaucuuugcuucuuguaggcuaucgccccauuccagcggagacu

SEQ ID NO: 57542 - RNA, 64 nt, hsa
agaucuuuuuccucagaauuguuuucuuuucacuguaggcuauuacaggauacuucaggaucaa

SEQ ID NO: 57543 - RNA, 64 nt, hsa
ccaagcaaaucauccccauuaaaaagcuuuuccuguaggcuaguaggauuucuaaauagaugaa

SEQ ID NO: 57544 - RNA, 64 nt, hsa
caggcucuuugagagccaugggcugcacccggccguaggcuaguguaacucgcaucccauugca

SEQ ID NO: 57545 - RNA, 64 nt, hsa
ccuuaguacucagauaauaaauaagagaccaaaaguaggcuaucacccaaagcaaacauccuua

SEQ ID NO: 57546 - RNA, 64 nt, hsa
aacauaccauggccuauuggaugaaucauuugccguaggcuaaaucagacuguaggguuuguga

SEQ ID NO: 57547 - RNA, 64 nt, hsa
gaggcaccucugagggagcagagagguggauccuguaggcuaaaaggcuuccaggcugagagcc

SEQ ID NO: 57548 - RNA, 64 nt, hsa
cucacuuaccaagaaugguugguugcuauuuaggguaggcuaacagcugugacaguacacucca

SEQ ID NO: 57549 - RNA, 64 nt, hsa
acucuucccagggaaaauucauguugcugcagaaguaggcuaaggcagaccacccacuucugcu

SEQ ID NO: 57550 - RNA, 64 nt, hsa
caauaucugcuccuuuucgaguuguuugagaaauguaggcuauuuuuucaguguauauccacuc

SEQ ID NO: 57551 - RNA, 64 nt, hsa
ugguuuucugccauacuuuucuccauuggcccagguaggcuaauugguaguuguucauuucagc

SEQ ID NO: 57552 - RNA, 64 nt, hsa
auguuggggcggcaagcggugggccgagggccggguaggcuagcacgggagguaagggugguau

SEQ ID NO: 57553 - RNA, 64 nt, hsa
gaauuauccuuuaauuuuacagauaccacuugcuguaggcuacggaccaagauguccaaaauua

SEQ ID NO: 57554 - RNA, 64 nt, hsa
aaaaggggggaggauaacuuucacaggguaauugguaggcuaaauaggaguuacagaaaacugu

SEQ ID NO: 57555 - RNA, 64 nt, hsa
agugguaauggggacaagaugcggcccuggugcuguaggcuacauccugauaccuauaaguuca

SEQ ID NO: 57556 - RNA, 64 nt, hsa
aaacgggcuucguguuagauaauuuugcuaaacaguaggcuacuguaaguguucugagcauauu

SEQ ID NO: 57557 - RNA, 64 nt, hsa
agaggcugugauuucuguauuugucgaccuacagguaggcuaguauuauuuuucuaguuaguag

SEQ ID NO: 57558 - RNA, 64 nt, hsa
aauauggugucugucauucagggcauagcucacuguaggcuagccucugcuuacuuaagucucu

SEQ ID NO: 57559 - RNA, 64 nt, hsa
uaucauccuuuggcaucccaacuaacaauaaagaguaggcuauaagggaagauugucaauauuu

SEQ ID NO: 57560 - RNA, 64 nt, hsa
acuauuucuuauuucaaaugucugcuaaugcagaguaggcuacuccaugauaguguuaaaaaac

SEQ ID NO: 57561 - RNA, 64 nt, hsa
caacccaucuacaaaugugcccagaucuaacaaaguaggcuaagaccuuccacuuaaaagcaug

SEQ ID NO: 57562 - RNA, 64 nt, hsa
ggaauuugucuaauaacaauuuuaggguuuaacaguaggcuaauaguugaaggaaggauaauaa

SEQ ID NO: 57563 - RNA, 64 nt, hsa
acuauauauuguagacuauguauuauucuaacauguaggcuaauuuacaugacuuguuaucgcc

SEQ ID NO: 57564 - RNA, 64 nt, hsa
ugcccguuuuaugcuugauguguauaguaauaggguaggcuauuuauuuuauuaaaauuuuuuu

SEQ ID NO: 57565 - RNA, 64 nt, hsa
cuuggcugucccugccacaguuccagaguuaucaguaggcuagauagaaggugaccucuccuca

SEQ ID NO: 57566 - RNA, 64 nt, hsa
accugagagagagacccaaacuuuacucugggagguaggcuaugcccauccaaauaaaucucca

SEQ ID NO: 57567 - RNA, 64 nt, hsa
agcacauucagcuuuggaaacuauauuauuuaauguaggcuagcuuguuuucaaauuuuaaaag

SEQ ID NO: 57568 - RNA, 64 nt, hsa
accugucuuggugggccgggcccucuugugccccguaggcuaggucuuagggcaacuccuugcc

SEQ ID NO: 57569 - RNA, 64 nt, hsa
acgcccuaguuaagcagcugacauaagacagcccguaggcuaccaagggacaccugccugcaaa

SEQ ID NO: 57570 - RNA, 64 nt, hsa
ggaagggacucaaagcagcaaugccccucauaguguaggcuaaggugaguuuggugcaugcaaa

SEQ ID NO: 57571 - RNA, 64 nt, hsa
agagaccauaccuaauauuguuuaaauucuagauguaggcuaacaaugaaaaguauuugccaaa

SEQ ID NO: 57572 - RNA, 64 nt, hsa
uuauuuuaccagcuauuuauugagugucuuuuauguaggcuaaaugaacauaggucucuggccu

SEQ ID NO: 57573 - RNA, 64 nt, hsa
ugggccccagaugguuaagugcuaaauuuguaggguaggcuaucaggaagugcaggcuggaaac

SEQ ID NO: 57574 - RNA, 64 nt, hsa
cacaccacauuuccucaaagcuaaucugaauucuguaggcuaaaaauauucauguagcaaaucu

SEQ ID NO: 57575 - RNA, 64 nt, hsa
gaguaaugaauuagccugaccacagguggucacuguaggcuaauggaaaauacccaagggaggg

SEQ ID NO: 57576 - RNA, 64 nt, hsa
acuuccggccuagucugccagcuuuugcuggcacguaggcuaccacucuccgggcaccggcugg

SEQ ID NO: 57577 - RNA, 64 nt, hsa
aaaaauccuuucgauuuagccaacucuuuuugcuguaggcuaggaauacacccuuuuuaaauua

SEQ ID NO: 57578 - RNA, 63 nt, hsa
uaugugcaaaauaauucuggcuaacuguaaaauguauucaauuuuaggauuuuuuuuuuuugu

SEQ ID NO: 57579 - RNA, 63 nt, hsa
uuucauuguaaacguuauugugccaaauguacuguauucaaaaggaugugaauguguauuguu

SEQ ID NO: 57580 - RNA, 63 nt, hsa
ccuaacuugagcagaucugauuauucuuggauaguauucaagugguaucuugacuauuaaacu

SEQ ID NO: 57581 - RNA, 63 nt, hsa
uuagccauaguaacuuuuugucacaauaacuaaguauucaauuauauauaaagagugaaacau

SEQ ID NO: 57582 - RNA, 63 nt, hsa
ugugguuuuagaaucuucuguggcugacuucuuguauucaacucugguuuauuaucuuaaucu

SEQ ID NO: 57583 - RNA, 63 nt, hsa
guacacuguucacguuuagccugccccacuuuuguauucaaaauuaaugaaacugaagguuua

SEQ ID NO: 57584 - RNA, 63 nt, hsa
acaguguucagauuuguccuguguguguuuacaguauucaauuuauugcaguuauagaauugg

SEQ ID NO: 57585 - RNA, 63 nt, hsa
uuuuagcuuagugccauuaugucauuuugauuuguauucaaguacucuucaaguaucuuugua

SEQ ID NO: 57586 - RNA, 63 nt, hsa
cuaguagcuagcagagagccuggcacauaguauguauucaaaacaaguguguuaauuaauaaa

SEQ ID NO: 57587 - RNA, 63 nt, hsa
cagaauaaaagggugaggacaucagaucacucuguauucaaagcuuacuagacgaacaaucuu

SEQ ID NO: 57588 - RNA, 64 nt, hsa
ucaagaugauuuaauugagcuucuauaacuaucaacuaucaaauucuaguuucaaguaucucac

SEQ ID NO: 57589 - RNA, 64 nt, hsa
uuccacuucaagaugauuuaauugagcuucuauaacuaucaacuaucaaauucuaguuucaagu

SEQ ID NO: 57590 - RNA, 64 nt, hsa
agggacuucguugguuuuuuggagucuugguugugacuccaagagcagagugaggaagaccccc

SEQ ID NO: 57591 - RNA, 64 nt, hsa
aagggacuuuguuggcuuuuagaguguuggucaugacuccaagagcagagcagggaagagccca

SEQ ID NO: 57592 - RNA, 64 nt, hsa
acuaccaacuuagucaucaagccucaauuuuccuuuaccugaaggauuaagugaaagcuuuugg

SEQ ID NO: 57593 - RNA, 64 nt, hsa
gguaaagauggaaggcugggcagacuggcuuuuguuaccugacaugccguagggugagcuuaga

SEQ ID NO: 57594 - RNA, 64 nt, hsa
aacuuguauuagaauuguuuuuucuaaaguuauguuaccugagaaauuaaggacugcaccuggu

SEQ ID NO: 57595 - RNA, 64 nt, hsa
acuuguauuagaauuguuuuuuucuaaaguuauguuaccugaaaaaucaaggagugcaccugau

SEQ ID NO: 57596 - RNA, 64 nt, hsa
ucauuaugugcaucaauauuuuucucagcuacuauuaccugaaacuuguuuaacauguauuaga

SEQ ID NO: 57597 - RNA, 64 nt, hsa
ugucugaaacaaacacagagcacuccaucaaaauuuaccugaucuuugugauuagaacagaaca

SEQ ID NO: 57598 - RNA, 64 nt, hsa
ugaaggaucuucaaagcaggaugaagaccuagacuuaccugaaggccuagacucagcugaagga

SEQ ID NO: 57599 - RNA, 64 nt, hsa
ugaaggaucuucaaagcaggaugaagaccuagacuuaccugaaggaucuucaaagcagaaugaa

SEQ ID NO: 57600 - RNA, 64 nt, hsa
ugaaggaucuucaaagcagaaugaagaccuaggcuuaccugaaggaucuucaaagcaggaugaa

SEQ ID NO: 57601 - RNA, 64 nt, hsa
ugaaggaucuucaaagcaggaugaagaccuagacuuaccugaaggaucuucacaggaggauaaa

SEQ ID NO: 57602 - RNA, 64 nt, hsa
ugaaggaucuucacaggaggauaaagacguagaauuaccugaaggaucuucacaggaggaugaa

SEQ ID NO: 57603 - RNA, 63 nt, hsa
ugcgggacaaccucuacuaggcgauggcucugcucugucuacauuuauuuguacccacacgug

SEQ ID NO: 57604 - RNA, 64 nt, hsa
uguguguguguguguguguguuugugugugugugucugucuauuuuguauccuggaccacaagu

SEQ ID NO: 57605 - RNA, 64 nt, hsa
gccuggcucugucuacacuggccgagucucugggucugucuacacuggccgagucuccgacugu

SEQ ID NO: 57606 - RNA, 64 nt, hsa
guggggccagcgucgccgggcugcccagccuggcucugucuacacuggccgagucucugggucu

SEQ ID NO: 57607 - RNA, 64 nt, hsa
aaauggaauuucaggagcacaguaaauuucagggucugucuaucuuaagcuuucuuuauaucag

SEQ ID NO: 57608 - RNA, 64 nt, hsa
cuguaguccuugucuccuugacauagugcugguuucugucuauagguuuaugggcuauuacuuu

SEQ ID NO: 57609 - RNA, 64 nt, hsa
ucccaccaauuagucaacucuuuuagggcagaagucugucuaauucaucuuugcuuccuguuac

SEQ ID NO: 57610 - RNA, 64 nt, hsa
cuauuaaguucuaguauuuggagucaaaugcaagucugucuaaaucuagagcccauguucuuua

SEQ ID NO: 57611 - RNA, 64 nt, hsa
agucuacuaggcauagcaccguugcuaccgagugucugucuaagaacacagaggagaauuuauu

SEQ ID NO: 57612 - RNA, 64 nt, hsa
gaggacaaagcagcggauacaaccucaaaagacgucugucuacauugaauuggguaagggucuc

SEQ ID NO: 57613 - RNA, 64 nt, hsa
guauuuggaagucugaauuggagauguuuguaccucugucuaaacaguucccuugagaacuucc

SEQ ID NO: 57614 - RNA, 64 nt, hsa
cuaguuagcuaguagcaaccguguuuucuccagaucugucuagauacaaaggucagaaaucuua

SEQ ID NO: 57615 - RNA, 63 nt, hsa
uacucuuaaguguaaauaauauaaaauguuucaagcgcuuaacucccccucauucacaaagua

SEQ ID NO: 57616 - RNA, 63 nt, hsa
ugacaguaaauaucagaauuuuaugguuugaccagcgcuuaucacauucccaauucagugaga

SEQ ID NO: 57617 - RNA, 63 nt, hsa
uguuuuuauaaaagcaaaaggauauucacuuucagcgcuuauacugaaguauuagauuaaagc

SEQ ID NO: 57618 - RNA, 63 nt, hsa
uaauuaaaugggggcucuuacugacuuuaaauuagcgcuuauaaaauaaaaauguuuaguuca

SEQ ID NO: 57619 - RNA, 63 nt, hsa
agaguauaaagcagcugucacacuucaaagagcagcgcuuaaauuccuagcgaagugccguaa

SEQ ID NO: 57620 - RNA, 63 nt, hsa
gcagucugaaggauuccccaccuccaaucccccagcgcuuagaaacauguuccuguuccucgg

SEQ ID NO: 57621 - RNA, 50 nt, hsa
augcacagcagaggcgaugaagcgcuuacucuuugauccuucuccugaag

SEQ ID NO: 57622 - RNA, 63 nt, hsa
cuaugugaaguacuguguugcagaaguggcaaaagcgcuuauuuuuaaaaaugcaaaauauuu

SEQ ID NO: 57623 - RNA, 63 nt, hsa
ccaaguucccaucacgucagauuuggagcugguagcgcuuacgaugcccccacgugugaacau

SEQ ID NO: 57624 - RNA, 63 nt, hsa
uggugagggucagaaggggacgguaccaagaguagcgcuuagcccuuacccaggaaauauccu

SEQ ID NO: 57625 - RNA, 63 nt, hsa
uggaggcaagaaagcauuuccuuugggguuuagagcgcuuaaguuguuccucuguuaucaugc

SEQ ID NO: 57626 - RNA, 63 nt, hsa
agaguaaaagucuaccccucugaagcacuauuaagcgcuuaacguauauuuaaauacuaccau

SEQ ID NO: 57627 - RNA, 63 nt, hsa
uucauuuguggcaauuaaguggucccaaugcucagcgcuuaaaaaaacaaauuggacagcuac

SEQ ID NO: 57628 - RNA, 63 nt, hsa
gcuaaaaugccagguaaaggguugguuggacacagcgcuuagugcacgcugucaucauggaca

SEQ ID NO: 57629 - RNA, 63 nt, hsa
cacuuaagccuagaauuucucuuuagguauaucagcgcuuaaauccaagacuauuuuuuauug

SEQ ID NO: 57630 - RNA, 63 nt, hsa
uugagcauuguauuucucgcaucccuucucgugagcgcuuagaccuuuuucuauuuuagucgg

SEQ ID NO: 57631 - RNA, 63 nt, hsa
ugcacugcucgagacacaagugcugcuguaguuagcgcuuagugacacgcgggccuuuggugg

SEQ ID NO: 57632 - RNA, 63 nt, hsa
uauguuuuucuugaauagguauugauaaauggaagcgcuuaccagcccagcuuugccagcccu

SEQ ID NO: 57633 - RNA, 63 nt, hsa
gcuggcuugcacuuucuuauuuucuuauuuuagagcgcuuaaaaaauccggaaaaaugggguu

SEQ ID NO: 57634 - RNA, 66 nt, hsa
aaugagauggcaugugaaagcacuuugaaaauuguaaagcgcuauguaaauguaagguauuauaga

SEQ ID NO: 57635 - RNA, 66 nt, hsa
aauggugcuguguuuugguuguggucugaagcuuugaagcgcuacuuagcaucuccuuucuuccau

SEQ ID NO: 57636 - RNA, 66 nt, hsa
uugguggacgccgacccuguuguggacagcucucagaagcgcuaccgggccgccagugccuucuuc

SEQ ID NO: 57637 - RNA, 66 nt, hsa
ucacccccuccacacacaaaacaggaaacauaaucaaagcgcuagucagcuagucuaaccacuagg

SEQ ID NO: 57638 - RNA, 66 nt, hsa
ugauauuaauuuugccuuuuuuuuuuuuuuuuuuuuaagcgcuacuaauguagagaaugaauugaa

SEQ ID NO: 57639 - RNA, 66 nt, hsa
ugcacagaaauuuggguaauguuugaguagauugccaagcgcuacugugauucaugaaugaauuuc

SEQ ID NO: 57640 - RNA, 66 nt, hsa
auuucaaucucuuuguguucagaacucguuaaagcaaagcgcuaaguaaaaauauuaacugacgaa

SEQ ID NO: 57641 - RNA, 66 nt, hsa
aaaacacuuauuacccuucugcagcaaaggcauuaaaagcgcuaagcauauauuaauaaaugcaag

SEQ ID NO: 57642 - RNA, 66 nt, hsa
accaucucccaugaagaaagggaacggugaaguacuaagcgcuagaggaagcagccaagucgguua

SEQ ID NO: 57643 - RNA, 66 nt, hsa
gucauaaaggacucagcaaccagccagggacagauaaagcgcuauggaaaggggcuuccaaguucu

SEQ ID NO: 57644 - RNA, 66 nt, hsa
aaauaaauguuuacaauuuuauaugaaagauggaauaagcgcuagagcuuccaacuguauauuuuu

SEQ ID NO: 57645 - RNA, 66 nt, hsa
guacaccagcuccaaguaaacuaguuaccuggguaaaagcgcuaacgacccaaaggcucuucuaag

SEQ ID NO: 57646 - RNA, 66 nt, hsa
uccacuaaagaaagcuuguuggaaugcagucuacaaaagcgcuauaagggcuaaaggauuauagua

SEQ ID NO: 57647 - RNA, 66 nt, hsa
accuagcaucagcaauagauuucaaagauaaguauuaagcgcuacccuaaaguguguaaguuuuuc

SEQ ID NO: 57648 - RNA, 66 nt, hsa
gagggccugcggagccucaagaagccagaccgcaagaagcgcuacaccguggugggcaaccccuac

SEQ ID NO: 57649 - RNA, 66 nt, hsa
uaauuucugcaaauguaauugauuuauuuguuuaaaaagcgcuaauuucuauuugaucugauauca

SEQ ID NO: 57650 - RNA, 66 nt, hsa
uuuuuuugcucuugauuuaaaaaaaaguuuuguugaaagcgcuauugaauauugcaaucuauauag

SEQ ID NO: 57651 - RNA, 66 nt, hsa
guccacaccgcuucauugaugaggacaggagacuccaagcgcuaguauugcacgcugcacuuaaug

SEQ ID NO: 57652 - RNA, 66 nt, hsa
caacagaaagaugucaacaaggaaaagaggagagccaagcgcuagcaugccuuuugccucugcaua

SEQ ID NO: 57653 - RNA, 66 nt, hsa
ucuuuuuuguuuugucuuucuaccugauguguauucaagcgcuauaacacguauuuccuugacaaa

SEQ ID NO: 57654 - RNA, 66 nt, hsa
uguucaggcuuuuaaaaaaauaccacugugagaauaaagcgcuagcaagauacaucacuuacugau

SEQ ID NO: 57655 - RNA, 66 nt, hsa
cuggacuccgaguucuauaaaaaccucaccuccaucaagcgcuaugauggggacaucacugaccug

SEQ ID NO: 57656 - RNA, 66 nt, hsa
ccuggcuucaagagauccacccaccucagccucccaaagcgcuaggauuacaaguaugagacuuug

SEQ ID NO: 57657 - RNA, 66 nt, hsa
uguuuuauaaagaacgugauuuccagugaucucuggaagcgcuaaagcuaaaauuucuguucuuga

SEQ ID NO: 57658 - RNA, 66 nt, hsa
uauuguaagaacuguuaauaaaaguugucaaguaaaaagcgcuauaucuaaaaagacuuuaugaac

SEQ ID NO: 57659 - RNA, 66 nt, hsa
agacugcccaugaccugaaggcuccagguggcuuuaaagcgcuauguuuaccaacuaucccggugu

SEQ ID NO: 57660 - RNA, 66 nt, hsa
caggaaaacgugcuuuucggcaaagcccugaaccccaagcgcuaccagcagacucuggaggccugu

SEQ ID NO: 57661 - RNA, 66 nt, hsa
cuguggccucaggaaucaacuuaggcaguucccaacaagcgcuagccuguaauuguagcuuuccac

SEQ ID NO: 57662 - RNA, 66 nt, hsa
gucccuuuucaauucccuucugguucaugaugcauaaagcgcuaggcccuagaacuccagaaacag

SEQ ID NO: 57663 - RNA, 66 nt, hsa
ccuagucuuaagcaaucuuccugcuuuggccucccaaagcgcuaggauuccaggugugagcuacug

SEQ ID NO: 57664 - RNA, 66 nt, hsa
gcugggaguggggagggcguggagacagucuacggaaagcgcuagcagacccccgagagggugcag

SEQ ID NO: 57665 - RNA, 66 nt, hsa
caaaauuguguccacauaauccacgcucaucuugcaaagcgcuauuucaggcacaucauuggaaua

SEQ ID NO: 57666 - RNA, 66 nt, hsa
cccacccagcgcgcagucuccaccucggccccagcaaagcgcuaagcagccggagagacagccagg

SEQ ID NO: 57667 - RNA, 66 nt, hsa
caugugacugugcccauuccugcauggaccuuucccaagcgcuagcacaggugcaaaauccaucag

SEQ ID NO: 57668 - RNA, 66 nt, hsa
ccugggcucaugcaauccuccugccuuggccucccaaagcgcuaggauuagaggugugagccgcug

SEQ ID NO: 57669 - RNA, 63 nt, hsa
aagugcgccugugugcgcgggugugggagcacacuuugcaaagccacagcguuucugguuuug

SEQ ID NO: 57670 - RNA, 63 nt, hsa
caggcaccgaggcagggcuggaggaguaaguggcuuugcaauaaaaugggugcuggagucuaa

SEQ ID NO: 57671 - RNA, 63 nt, hsa
gcuuugcuaaugugcugauccgcacuaacucaucuuugcaaaaggaacugcucccucggcgug

SEQ ID NO: 57672 - RNA, 63 nt, hsa
ccuggccuccauucucuugggggagucuuggcacuuugcaaacauccuggccaccaugggcac

SEQ ID NO: 57673 - RNA, 63 nt, hsa
ucuacgcucuccuuccucgccagcacgccuuagcuuugcaagccugcaugcauucaggcuucu

SEQ ID NO: 57674 - RNA, 63 nt, hsa
aaugaguuguuguuuccuuaucacuccuggucccuuugcaagugaacccugcagcucacccau

SEQ ID NO: 57675 - RNA, 63 nt, hsa
ccuuuaccucaaguugcuuggcagcacaacuaucuuugcaaaaaaaaguaaagaaaaaguaaa

SEQ ID NO: 57676 - RNA, 63 nt, hsa
acaacuuuuuuucccaaacaguguuaaaagccacuuugcaacacuugacuucaucuuaaugua

SEQ ID NO: 57677 - RNA, 63 nt, hsa
cuuccugaguaauuaaauggaccaacaaugagccuuugcaaaauuuucaagcggaaauuuuaa

SEQ ID NO: 57678 - RNA, 63 nt, hsa
uaaaaagaacauugguuuagauaaauacuuauacuuugcaaagucaaaaauggcuugauuuuu

SEQ ID NO: 57679 - RNA, 63 nt, hsa
cuuuuugauugcugcagaaauguccuaugcacucuuugcaagagcacacaacaaaugucagau

SEQ ID NO: 57680 - RNA, 63 nt, hsa
uuuuaaauuacuuuguggacuguguuuucaaaacuuugcaaauucaucuguuacacagaaaau

SEQ ID NO: 57681 - RNA, 63 nt, hsa
cugccucaccugccuccucaccuugcauagcaccuuugcaagccugcggcgauuugggugcca

SEQ ID NO: 57682 - RNA, 63 nt, hsa
ucauguucucuccaaccagggcuggcaucacugcuuugcaaaguggggccugagguagaagaa

SEQ ID NO: 57683 - RNA, 63 nt, hsa
uaucucuuggaaaauaagacaauaguauuucuccuuugcaauagcaguuauaacagaugugaa

SEQ ID NO: 57684 - RNA, 63 nt, hsa
ucauuuucugaggugcuuggcucugauucagggcuuugcaagggguuagaagcugacuguaaa

SEQ ID NO: 57685 - RNA, 63 nt, hsa
gaucaguucuuagcaaugauguuuuuuuuucugcuuugcaaggcgcuagaaucuuuuauuuua

SEQ ID NO: 57686 - RNA, 63 nt, hsa
ugacacacagcugcuguaccagugaaaacgaggcuuugcaagcuuguaccuacuauauaacau

SEQ ID NO: 57687 - RNA, 63 nt, hsa
aaaacggugccagguaccacaacaguaacagaacuuugcaauuuucugggguuuuguuuuuua

SEQ ID NO: 57688 - RNA, 63 nt, hsa
caccagucaaacccaccaaauugcuuuauuccccuuugcaagaugggcacugccauaguucug

SEQ ID NO: 57689 - RNA, 63 nt, hsa
uacuguguaaauagguuacaccccaguugaaaucuuugcaaaggucgguucuauucagcgaac

SEQ ID NO: 57690 - RNA, 63 nt, hsa
gcagugccauccuacagguggcuggagcagcugcuuugcaaccugaucaccuugaguucugag

SEQ ID NO: 57691 - RNA, 63 nt, hsa
ggccuaacggagcccacccaggcacagccaccacuuugcaagugggaggaggggagaagggga

SEQ ID NO: 57692 - RNA, 63 nt, hsa
augcacaagcagagaucaugguauaauaaaucccuuugcaacuccacucagcccugacaaccc

SEQ ID NO: 57693 - RNA, 63 nt, hsa
cuccugauugaacugaugcacagaaucuuuuuacuuugcaauagauuuguacuaaccagaccu

SEQ ID NO: 57694 - RNA, 63 nt, hsa
aauaagugauaaugaaaaccacugaguuauauacuuugcaaggguaaauuacaucugaauaaa

SEQ ID NO: 57695 - RNA, 63 nt, hsa
agggccuagaaacucacccgugcauauguugaccuuugcaaaaugaccuggugacauggcaag

SEQ ID NO: 57696 - RNA, 63 nt, hsa
ggugcucuguggauugaguugaacguguugaggcuuugcaauuucacuuguguuaaaggcucu

SEQ ID NO: 57697 - RNA, 63 nt, hsa
agaaaugaacguguaaguaauguuucuacaggucuuugcaacaaacugucacuuucgucucca

SEQ ID NO: 57698 - RNA, 63 nt, hsa
auauuugacuugaaaagaaagaaaccaagugcgcuuugcaauauuuauuacacaaagaacuug

SEQ ID NO: 57699 - RNA, 63 nt, hsa
ucccugacuggccaaacccuugcuuuccugggccuuugcaagaugcuugguuguguugagguu

SEQ ID NO: 57700 - RNA, 63 nt, hsa
cggguacaauaacacacuguacugaugucacaacuuugcaagcucugccuuggguucagccca

SEQ ID NO: 57701 - RNA, 63 nt, hsa
ccgacaucccaccgaaucugaugcugcugcugccuuugcaaggacuacugggcuucccaagaa

SEQ ID NO: 57702 - RNA, 63 nt, hsa
auagaaaguuuucuauagcucuaaagguuucuccuuugcaacccauucaauuucagucugcug

SEQ ID NO: 57703 - RNA, 63 nt, hsa
aacaauuuucccccgaggguuuuccaugguguacuuugcaagaaauaagcacucuaauuuuua

SEQ ID NO: 57704 - RNA, 63 nt, hsa
acuguuuauauuuuuaaaagcaauauuuaaugucuuugcaacuuuaugcugggauuguuuuua

SEQ ID NO: 57705 - RNA, 63 nt, hsa
auaauauaaggaaggugagcuccucaacaauaacuuugcaauaauuaaaacuacccuaaguaa

SEQ ID NO: 57706 - RNA, 63 nt, hsa
augcuuugguauuuucuuggggaagaccuucaccuuugcaaacuucccucauguaaggaaggu

SEQ ID NO: 57707 - RNA, 63 nt, hsa
aaauucuuuaacuucuuauuucucguccugucucuuugcaaaguaugggcuuuuuuguuuuug

SEQ ID NO: 57708 - RNA, 63 nt, hsa
aagugccaagcacagaaagccgcuaaauaaaaucuuugcaauuguuuucugcauguuuguuca

SEQ ID NO: 57709 - RNA, 63 nt, hsa
aauuuacauuaguuuuuuucauacccuuuugaacuuugcaacuuccguaauuaggaaccuguu

SEQ ID NO: 57710 - RNA, 63 nt, hsa
ugcucugagacaagaaggguggggucucauuagcuuugcaacaggaaacauccuguuuuaugg

SEQ ID NO: 57711 - RNA, 63 nt, hsa
ucugucugucaccuggucaugagcuucuaccaccuuugcaauugucauuuaucuuucacuccc

SEQ ID NO: 57712 - RNA, 63 nt, hsa
ucugucugucaccuggucacgagcuucuaccaccuuugcaauugucacuuaucuuucacuccc

SEQ ID NO: 57713 - RNA, 63 nt, hsa
aacaagugaagaucaacagaaaaauucaaguagcuuugcaaauacuaguugauacucagugaa

SEQ ID NO: 57714 - RNA, 63 nt, hsa
guaacgcuuagucucacagugucuuuaacucaucuuugcaaucaacaacuuuacuagugacuu

SEQ ID NO: 57715 - RNA, 63 nt, hsa
auuuaagaaugcgcuuuaucuagcucaugguaacuuugcaacgccuuagauuaaaaugacagu

SEQ ID NO: 57716 - RNA, 63 nt, hsa
gagaaaaauaauuacacuuucaaagagaauucccuuugcaauuuuauguuuggaucaccacug

SEQ ID NO: 57717 - RNA, 63 nt, hsa
guaggaagcacugaaaauaguguucccagagcacuuugcaacucccuggguaagagggacgac

SEQ ID NO: 57718 - RNA, 63 nt, hsa
auuuauuggggccuuuuauucuuucccaaagugcuuugcaaacauuaaguuuuagccacuagc

SEQ ID NO: 57719 - RNA, 63 nt, hsa
cuuugagaggucuguguacagugacagguauaucuuugcaaagaaucuuuuugaaaaugguuc

SEQ ID NO: 57720 - RNA, 63 nt, hsa
gacauuccuguacuaagguggcacagagcuguccuuugcaacauucucauaaaauugggcaca

SEQ ID NO: 57721 - RNA, 63 nt, hsa
ucaguuauuggauauguaucuuuguguacauaucuuugcaaaaauggauaaguacaaaacuug

SEQ ID NO: 57722 - RNA, 63 nt, hsa
gcccacccacugugucuuccacguaagggagaccuuugcaaagggcauccaaauggguaggca

SEQ ID NO: 57723 - RNA, 63 nt, hsa
ugaaguccgcaugaaacacugcaccaggcagggcuuugcaaagugcaagguauccccagucca

SEQ ID NO: 57724 - RNA, 63 nt, hsa
gaguuuuagaagauuagaccauuaggaacguaucuuugcaaacugcccauucacccaugaaga

SEQ ID NO: 57725 - RNA, 63 nt, hsa
aucccucuccaccccuuccccccaaaagguuuucuuugcaagugcuuuuggaacuaagagcua

SEQ ID NO: 57726 - RNA, 63 nt, hsa
ggauccagagcuauagguacagugugaucucagcuuugcaaacacauuuucuacauagauagu

SEQ ID NO: 57727 - RNA, 63 nt, hsa
cugaaauaauagcacaauuucaaagaagagacucuuugcaaaguugauaacauuucaaacccu

SEQ ID NO: 57728 - RNA, 63 nt, hsa
cauuuuuauugcuuuucuuaaaauaagggauagcuuugcaaccacuauuguuuuaauggaaag

SEQ ID NO: 57729 - RNA, 63 nt, hsa
cuuuucucccacccucuuuuccaagcuguuucgcuuugcaauauauuacugguaaugaguugc

SEQ ID NO: 57730 - RNA, 63 nt, hsa
gcucccaguucuguuaggacaggcauacuguuacuuugcaauauccacuuuauaaaauagcuc

SEQ ID NO: 57731 - RNA, 63 nt, hsa
ugcaaaauauagcuaaccacuuuccauugcaagcuuugcaaagugaagagagguucguacuuc

SEQ ID NO: 57732 - RNA, 63 nt, hsa
uaaugcuuauuagaaaauguccucguccccuuucuuugcaaauauuaguucuuuuacgaaguc

SEQ ID NO: 57733 - RNA, 63 nt, hsa
gaaauugggacaaaacaccuucauguaaaccagcuuugcaaaauuuuccagcccagauacucu

SEQ ID NO: 57734 - RNA, 63 nt, hsa
ugcuaucaugucagugaacgccaggagugcuuucuuugcaacuuguguaacauuuucuguuuu

SEQ ID NO: 57735 - RNA, 63 nt, hsa
aagauagcugaguaggaugguucuaaggaaagccuuugcaaucuugcaagauuuguagaccag

SEQ ID NO: 57736 - RNA, 63 nt, hsa
ugaugccgaacauuaggaauuguuuauacacaacuuugcaaauuauuuauuacuugugcacuu

SEQ ID NO: 57737 - RNA, 63 nt, hsa
uuuuacaauguguuuauuggacacacaaaaaaacuuugcaaccaucauaauacaucaauauuu

SEQ ID NO: 57738 - RNA, 63 nt, hsa
uguaauuuugucuuuggaaaauuacaacacugccuuugcaacacugcaguuuuuaugguaaaa

SEQ ID NO: 57739 - RNA, 63 nt, hsa
uuuaaaaauuaucuugacauaagcgucauauaccuuugcaaaaggaugguuguuugcaguuag

SEQ ID NO: 57740 - RNA, 63 nt, hsa
acauauauauauuaaaauugcaugggacagagacuuugcaauccgaaagaauagacugugaaa

SEQ ID NO: 57741 - RNA, 63 nt, hsa
ucuauuacugccuuugccuggcuuguuuugucucuuugcaacugauuuugcaaaaaaaaauug

SEQ ID NO: 57742 - RNA, 63 nt, hsa
gaauggaaaagcucugucucccuaacucaacugcuuugcaaggggaaaucaagcugggagaau

SEQ ID NO: 57743 - RNA, 63 nt, hsa
gcucuucauguuacacuaaugacaguuuguucucuuugcaagagaggggcauuacugucaccu

SEQ ID NO: 57744 - RNA, 63 nt, hsa
cuaaagagauuucuuuuaaaaacuuucuagacucuuugcaaaauguauauuacuaacauaguu

SEQ ID NO: 57745 - RNA, 63 nt, hsa
uggguggcauauguuuugccauaacuugacaugcuuugcaaaucuggauuccaauggaccuuu

SEQ ID NO: 57746 - RNA, 63 nt, hsa
uaugucaucagucaucucuuuauggugacuucccuuugcaaaccaggcugugaccaacacaug

SEQ ID NO: 57747 - RNA, 63 nt, hsa
cuguggguccuuggaccuuuagccuuuuucuuccuuugcaaaggccuugggggcacuggcugg

SEQ ID NO: 57748 - RNA, 63 nt, hsa
auacacaaaugcuucucuguaaugugcaauaugcuuugcaacuguagaugauauuuuauguuu

SEQ ID NO: 57749 - RNA, 63 nt, hsa
cagagagauugaacuuugaggaggaagcagaaucuuugcaagaaagucagaccuguuucuugu

SEQ ID NO: 57750 - RNA, 63 nt, hsa
cuuagccuaccacacuaccagucauucccaucgcuuugcaaucacaagccacaggaugagaag

SEQ ID NO: 57751 - RNA, 63 nt, hsa
aggggaugucaauccuuugcauuugaaugaagacuuugcaaaacacaccaaguuuggaaauac

SEQ ID NO: 57752 - RNA, 63 nt, hsa
auauuuauaggaauauauucacuacuuuguauacuuugcaaauuugucucucuggcuuuaccc

SEQ ID NO: 57753 - RNA, 63 nt, hsa
cuagaugaaagguguccaugguuagaauuugaucuuugcaaacuguauauaauuguuauuuuu

SEQ ID NO: 57754 - RNA, 63 nt, hsa
ccaauucacaggguuugugguucuggaugaaaucuuugcaaaggguuucccuggcacucaaac

SEQ ID NO: 57755 - RNA, 63 nt, hsa
ggaccaucagauguuugggcaaaacugaaagcucuuugcaaccacacaccuucccugagcuua

SEQ ID NO: 57756 - RNA, 63 nt, hsa
cuggaaauguauaaacuaaaguaagcugauuggcuuugcaaacauguucauuuguuuuucaga

SEQ ID NO: 57757 - RNA, 63 nt, hsa
uagccucugucaaaagucaaaagacuauaaaugcuuugcaaaaaugguuucacguuugcuuaa

SEQ ID NO: 57758 - RNA, 63 nt, hsa
guagaaauuaaaagauacuguauaauuuuaugccuuugcaaagauucguucuuguauuugaau

SEQ ID NO: 57759 - RNA, 63 nt, hsa
uuuauuauugacuauaauaauuaguuuaauuagcuuugcaaacugauggcaucaagguaaaua

SEQ ID NO: 57760 - RNA, 63 nt, hsa
auaauuuaaguugcuaucagcugauauuaguagcuuugcaacccugauagaguaaauaaauuu

SEQ ID NO: 57761 - RNA, 63 nt, hsa
cguccaacaaauucuguacaugcugcuuuacaucuuugcaacaaaccucuuaacuagcagcau

SEQ ID NO: 57762 - RNA, 63 nt, hsa
uaagcacuguaaacuucugcaacaagcaugcagcuuugcaaacccauuaaggggaagaaugaa

SEQ ID NO: 57763 - RNA, 63 nt, hsa
gccguacaggguagcaccuccucaccugccaaucuuugcaauuugcuugacucaccucagacu

SEQ ID NO: 57764 - RNA, 63 nt, hsa
aucucagccacaugcaacacuguguccagcauucuuugcaauaaauacuuuuuaaaaaauaau

SEQ ID NO: 57765 - RNA, 63 nt, hsa
aucuaggucuugguuagagaaguaagcagaguucuuugcaagcuuauuuagcacauuuugaca

SEQ ID NO: 57766 - RNA, 63 nt, hsa
cuuaauuuugcaaaggaggaugcauugucugaacuuugcaacuucauccagugcaaguuugau

SEQ ID NO: 57767 - RNA, 63 nt, hsa
ucuugcugagaauguggaugcagccucacagaucuuugcaacacuccaaccagccaggaccag

SEQ ID NO: 57768 - RNA, 63 nt, hsa
ucgaaugggguagaaacauuguaaauauuuacucuuugcaaacccuggugguauuuuauuuug

SEQ ID NO: 57769 - RNA, 63 nt, hsa
uaauaauagcaacccuugucucccucuucucuccuuugcaaauggcucagugacuggaagagg

SEQ ID NO: 57770 - RNA, 63 nt, hsa
ugaaaggaauaaaaccuacacacaagguuggagcuuugcaauucuuuuuggaaaagagcuggg

SEQ ID NO: 57771 - RNA, 63 nt, hsa
uaagauguacuugacuaguuuacuuaugcaucucuuugcaagaaucagccagccaacaauguc

SEQ ID NO: 57772 - RNA, 63 nt, hsa
gcaaggacaaagguaauagcagcaguuagaauucuuugcaaauguaccuuaagacaaaauaau

SEQ ID NO: 57773 - RNA, 63 nt, hsa
uuuuacucucuaacuguugaguugauuaagagacuuugcaaacgacaaagggaugaauuccuu

SEQ ID NO: 57774 - RNA, 63 nt, hsa
uggagugugcggccuaacaaggccauccuuaugcuuugcaaagcacccucaaaagcugcacca

SEQ ID NO: 57775 - RNA, 63 nt, hsa
ucucuccaccuuguuuuucuucuauucuugguucuuugcaauucuaugaauauuucaggguca

SEQ ID NO: 57776 - RNA, 63 nt, hsa
agcuguaacuaguuguaagugcuuaggaagaaacuuugcaaacauuuaaugaggauacacugu

SEQ ID NO: 57777 - RNA, 63 nt, hsa
uguaacuuuguagcuaucuuugaaaucacuugacuuugcaauggugcuaagcugauagauuua

SEQ ID NO: 57778 - RNA, 63 nt, hsa
ugcacugugcccaugcugcccucccaucacccccuuugcaauauauuuuuauauuuuauuauu

SEQ ID NO: 57779 - RNA, 63 nt, hsa
uuacggugcaauugcuucuguuugcuaaugcugcuuugcaaauaaaacuugcugccgaccacc

SEQ ID NO: 57780 - RNA, 63 nt, hsa
cccccauuccccaaagcaaucaaaccgucaugacuuugcaauuuggcacauccuagcuuguua

SEQ ID NO: 57781 - RNA, 63 nt, hsa
gucccauauuucaccuguucaguguauacuguacuuugcaaucaucuuuccuuuuuucacauu

SEQ ID NO: 57782 - RNA, 63 nt, hsa
ugucaaacagguugguguggguucauuggcauucuuugcaauacugcuuaauugcugauacca

SEQ ID NO: 57783 - RNA, 63 nt, hsa
auuuaguggauuaaccaguccagacgcacugaucuuugcaaaggagacuuaauuucaaaucug

SEQ ID NO: 57784 - RNA, 63 nt, hsa
caaugcuauuugccuuaguucauucguuguuuacuuugcaaaauuugugacuuuuaaguacua

SEQ ID NO: 57785 - RNA, 63 nt, hsa
uagagaaaaguuacuuuaaaaauagcuauaacgcuuugcaauuucaguaacaguucugccucu

SEQ ID NO: 57786 - RNA, 63 nt, hsa
uugcaaaggcugugugugaaaugaguaaacaaucuuugcaaguccuaaguaaguuuuauguca

SEQ ID NO: 57787 - RNA, 63 nt, hsa
cagacaucacccguguucaaguuuaaaaguacacuuugcaacuauuuuucagaaauagaaauu

SEQ ID NO: 57788 - RNA, 63 nt, hsa
gagaugacaaagaaauccaaguaaaugccuugucuuugcaaauguuuuuauauuaaaucauaa

SEQ ID NO: 57789 - RNA, 63 nt, hsa
auaugucaucuuauugcguuuugcuuuauugcacuuugcaaauaaugcauuuuuuacaaaugg

SEQ ID NO: 57790 - RNA, 63 nt, hsa
aaauguuuacagacaaauaauuuugggagcugccuuugcaaaccugccuguuggcauauugaa

SEQ ID NO: 57791 - RNA, 63 nt, hsa
uuuuacuuauguggcaaagaacuggauauuaaacuuugcaaaagagaauuuagaugagagaug

SEQ ID NO: 57792 - RNA, 63 nt, hsa
aaccgcauguucuaagugugcauuuuugucaaucuuugcaacaguuauuucauacagauguuu

SEQ ID NO: 57793 - RNA, 63 nt, hsa
aaggcuuuuagaaaaugguuguaaaucugacuucuuugcaaguaacuauguauauuguaaaua

SEQ ID NO: 57794 - RNA, 63 nt, hsa
aauuuccaagauuauuuguggcucaccugaaggcuuugcaaaauuuguaccauaaccguuuau

SEQ ID NO: 57795 - RNA, 51 nt, hsa
ggaaagagaaaucuucauaaucuuugcaagcgcauugauuaaugucugcaa

SEQ ID NO: 57796 - RNA, 63 nt, hsa
aauuuauaucuuuaugcaaaaacauaugucugucuuugcaaaggacuguaagcagauuacaau

SEQ ID NO: 57797 - RNA, 63 nt, hsa
cacauaaaaggcuucacuuuugacugagggcagcuuugcaaaaugagacuuucuaaaucaaac

SEQ ID NO: 57798 - RNA, 63 nt, hsa
gaaucauuaaauacaccugcuuuggguaaaacucuuugcaagcaguaauuaacacuaguaaca

SEQ ID NO: 57799 - RNA, 63 nt, hsa
uaauaguuuuugcuuucuguuuugcuguuguugcuuugcaaagcuuuccccucauagccugua

SEQ ID NO: 57800 - RNA, 63 nt, hsa
gugacuuaaguuuuugcuguuuucguuuucccgcuuugcaauuuccuccuuuugccaaaaaug

SEQ ID NO: 57801 - RNA, 63 nt, hsa
cuacaguuuugugaaucuuugugcuucaacauucuuugcaagaugauacgguauuuaggcauu

SEQ ID NO: 57802 - RNA, 63 nt, hsa
acagucccuuacuggaauucuaacuguaauuugcuuugcaaucaaacugcuuuuagggcagcc

SEQ ID NO: 57803 - RNA, 63 nt, hsa
ggaagcucccccccccccaacagugugucgagucuuugcaaagaaaccuuuagaugugguuca

SEQ ID NO: 57804 - RNA, 63 nt, hsa
aacaagcuaugggaauuuggcuucauacucuuucuuugcaacagcaguguucugggugauaau

SEQ ID NO: 57805 - RNA, 63 nt, hsa
uaucacacauaggcccacacacagacucaccaacuuugcaauagaaauacuggugccugcaga

SEQ ID NO: 57806 - RNA, 63 nt, hsa
auagugccauuuagagaugaaaaccagcuuuaacuuugcaaagugaacauguacauggucugc

SEQ ID NO: 57807 - RNA, 63 nt, hsa
ggggcucacaacaguaucucaaaaaauauguugcuuugcaacgagucagaauuacuaaucaua

SEQ ID NO: 57808 - RNA, 63 nt, hsa
aaauaacuaguucaaaccaacuaucuaucuaugcuuugcaaagacuaaggcguauuauaggaa

SEQ ID NO: 57809 - RNA, 63 nt, hsa
uuuuaaggcuaacuucuuuucacuguugugcuccuuugcaaaauguauguuacaauagauagu

SEQ ID NO: 57810 - RNA, 63 nt, hsa
auguucuuuccaaguuaauacugaagugguuaacuuugcaacuggacugucuuuuacuuuaug

SEQ ID NO: 57811 - RNA, 63 nt, hsa
aauuuggguuuuuguacugaaguugucuugcggcuuugcaagugucccuuuauauuuaaauuu

SEQ ID NO: 57812 - RNA, 63 nt, hsa
aacuuguauuuccaaaccugguucauauuuauacuuugcaauccaaauaaagauaacccuuau

SEQ ID NO: 57813 - RNA, 63 nt, hsa
uaaacacggcgaggucaccucucacucuucugucuuugcaaaccgagaagaguggcaugcuuc

SEQ ID NO: 57814 - RNA, 63 nt, hsa
uacaugucuacacaugacuacacaaaugcaaaccuuugcaaacacauuaugcuuuugcacaca

SEQ ID NO: 57815 - RNA, 63 nt, hsa
ggaaucuccucacugaaaauuacaguaugguaacuuugcaaauggugguuguuucuuccaaga

SEQ ID NO: 57816 - RNA, 63 nt, hsa
gguuuugugcaacuucugagccucaguuuucuccuuugcaaauuaauaauuacauaccuuuau

SEQ ID NO: 57817 - RNA, 63 nt, hsa
ugagugccaagaaccaacuugguaagguugaggcuuugcaaguuaacugcugggguuauagga

SEQ ID NO: 57818 - RNA, 63 nt, hsa
uugugaagugguauaagaaaugacuuugaaccacuuugcaauuguagauucccaacaauaaaa

SEQ ID NO: 57819 - RNA, 63 nt, hsa
auauuuugaauugcaacauuaugcuaaguauaacuuugcaagucaugauauugccuaacugcu

SEQ ID NO: 57820 - RNA, 63 nt, hsa
gggguggucucugauagguagcauuuuccagcacuuugcaaggaauguuuuguagcucuaggg

SEQ ID NO: 57821 - RNA, 63 nt, hsa
uucaaagucuguauuuuuaaagcauggcuuuggcuuugcaaaauaaaaaauguguuuuguaca

SEQ ID NO: 57822 - RNA, 63 nt, hsa
augcagggcguauauuuuguugagcccuuccuccuuugcaaaauuuauauuaaagcauuggua

SEQ ID NO: 57823 - RNA, 63 nt, hsa
uagguagacugcugcucuaauggggaaagggggcuuugcaaagccgaggaaucaagccagaug

SEQ ID NO: 57824 - RNA, 63 nt, hsa
agcagauagaaguuauuguauaauuguuaaucacuuugcaaauaggggcuaucaaauuaccua

SEQ ID NO: 57825 - RNA, 63 nt, hsa
aaggaucagccaugugccucuguacuauguccacuuugcaauauuuaccgacagccgucuuuu

SEQ ID NO: 57826 - RNA, 63 nt, hsa
acuugaggcuuuuuuguuuuaauugagaaaagacuuugcaauuuuuuuuuuaggaugagccuc

SEQ ID NO: 57827 - RNA, 63 nt, hsa
auagaaugacauguaaugcuaaauucauuuuggcuuugcaagucaugaagcuuaggaggccug

SEQ ID NO: 57828 - RNA, 63 nt, hsa
uuuuuguagauucucggucuugaagucauuugccuuugcaaucucuacuuuaguauacucauu

SEQ ID NO: 57829 - RNA, 63 nt, hsa
acaugguagcaucugugacuugaaugagcagcacuuugcaacuucaaaacagaugcagugaac

SEQ ID NO: 57830 - RNA, 63 nt, hsa
uaaaugugagaacuguucucauggagaagacuucuuugcaacaauaauaaauguuauuuaaga

SEQ ID NO: 57831 - RNA, 63 nt, hsa
agaagcugcuagaguuauccaguguuugcuggucuuugcaacaaacuguggagaauggguggu

SEQ ID NO: 57832 - RNA, 63 nt, hsa
cuaucuaccauauuuuaaguguagcagcuuugacuuugcaauaacguggcaaguaucugauuu

SEQ ID NO: 57833 - RNA, 63 nt, hsa
gguggauuccaugccgcagacaugaaauaaaagcuuugcaaaggcacgaagcagcacgggugu

SEQ ID NO: 57834 - RNA, 63 nt, hsa
ccaucuuuguauuuuuuuaaauuugauucuuuucuuugcaaugcuaucuaaccagaauacaua

SEQ ID NO: 57835 - RNA, 63 nt, hsa
ugucccgugggcuguguuucuuguuguuuuucucuuugcaaagacauagcuaggaaagcgaau

SEQ ID NO: 57836 - RNA, 63 nt, hsa
ugcauuguugugccgagaacaccgagcacugaacuuugcaaagaccuucgucuuugagaagac

SEQ ID NO: 57837 - RNA, 63 nt, hsa
aguguuuugugcuuacaucuuucggggggaagccuuugcaagaaaauugcauacaaggcuuug

SEQ ID NO: 57838 - RNA, 63 nt, hsa
gggcgccuugcagccuccauaauauacauuugacuuugcaaacgucuagacauguuuucugaa

SEQ ID NO: 57839 - RNA, 63 nt, hsa
uagggaguguuuuuucccacgcuuuuccaguaacuuugcaaaagcauuaauuguucacuggca

SEQ ID NO: 57840 - RNA, 63 nt, hsa
agcagugcuucccaaagugugcucugucaccugcuuugcaaucggcuuccauuagcgcauguu

SEQ ID NO: 57841 - RNA, 63 nt, hsa
caccugggagcaucugagucugcuccuaaguggcuuugcaacugggccuaaguucuguuuccu

SEQ ID NO: 57842 - RNA, 63 nt, hsa
guuuuaaugacacagaaaacuuugcugcaucaccuuugcaacuuugccaaagcucagaguuca

SEQ ID NO: 57843 - RNA, 63 nt, hsa
ugggggcuuccgcagcuucaggggagcccggagcuuugcaagcgucugugcauuuauuucuua

SEQ ID NO: 57844 - RNA, 63 nt, hsa
ucacaggcccaaaggacucuucuucagcagcaucuuugcaaaugucuuucucucaaugaagag

SEQ ID NO: 57845 - RNA, 63 nt, hsa
uaucagcccaguggaaagcacaggugucucccacuuugcaaccuauguggcagccaugagggc

SEQ ID NO: 57846 - RNA, 63 nt, hsa
uuugacuuuguccauuaacauuuauccauaugccuuugcaauaacuagauugugaaaagcuaa

SEQ ID NO: 57847 - RNA, 63 nt, hsa
gcaguuuuaaggauuugggcaacauucugcagucuuugcaauaguucaccuauaauccuauuu

SEQ ID NO: 57848 - RNA, 63 nt, hsa
gcccacuugaggcuggcacuccccugaccucaccuuugcaaaguuacagaugcaccccaacau

SEQ ID NO: 57849 - RNA, 63 nt, hsa
ccacuaguuggcauccuuuugaacuuuugucuccuuugcaaacagugguccuaaaauacgagg

SEQ ID NO: 57850 - RNA, 63 nt, hsa
uugguuucaaaucccaguuaugacaucuguuaacuuugcaaacucacaaaaauuauuugaaau

SEQ ID NO: 57851 - RNA, 63 nt, hsa
aaaaagucauugggaaacuuaaagucuauucuacuuugcaagaggagaaauguguuuuaugaa

SEQ ID NO: 57852 - RNA, 63 nt, hsa
uaauaaacugcaaaugugcaguucaguuugucucuuugcaacuccuguaauacggucuggugu

SEQ ID NO: 57853 - RNA, 63 nt, hsa
cuaaugaccaaagacccaggguaccuaaaaggacuuugcaaccaagcaaagucacugucuuca

SEQ ID NO: 57854 - RNA, 63 nt, hsa
ugaggaguguaaugcuuauuuuuuuguguauaucuuugcaaucuauuuuauauauauugacaa

SEQ ID NO: 57855 - RNA, 63 nt, hsa
cuugugaguuauagucugcuuauuuaauuaccacuuugcaagccuuacaagagagcacaaguu

SEQ ID NO: 57856 - RNA, 63 nt, hsa
gggacagagguggcccugguucacuugccggcccuuugcaaugaaugacucuuccugagccug

SEQ ID NO: 57857 - RNA, 63 nt, hsa
acaguggguagacuaaggcaguagcucaaagggcuuugcaaaauuuuaauauauuaaaacaag

SEQ ID NO: 57858 - RNA, 63 nt, hsa
cagucgugguggcucaugccuguaaucccagcacuuugcaaggccgaggaggguggaucacuu

SEQ ID NO: 57859 - RNA, 63 nt, hsa
guuuccaucuuaagauuuuuauaaacacaaagccuuugcaaaauuggauuaaauuccaccuau

SEQ ID NO: 57860 - RNA, 63 nt, hsa
aacaaacaaaaauaggaguauaggaacugcuggcuuugcaaauagaaguggucuccagcaacc

SEQ ID NO: 57861 - RNA, 63 nt, hsa
acuuacucccuucuggauauuuuugccacauuucuuugcaaaaggagauauauauaucuuuag

SEQ ID NO: 57862 - RNA, 63 nt, hsa
cacugcuugugggaauguaaaguacuguagccacuuugcaaaacaguuugacagcuccucaaa

SEQ ID NO: 57863 - RNA, 63 nt, hsa
ugaugacgaguugucuugaauaaaucauguguucuuugcaaugggcauuggugcugugaugag

SEQ ID NO: 57864 - RNA, 63 nt, hsa
gggcccaagacugggugagagucuuggcagagccuuugcaacaccuuaaguggacaggacugg

SEQ ID NO: 57865 - RNA, 63 nt, hsa
gcgcaguaggggaugaggguuagccauaguauucuuugcaaaugugaaagcgagacauuauau

SEQ ID NO: 57866 - RNA, 63 nt, hsa
uaauucaaccacaugguuguuugcuguacaguccuuugcaaauauuaaaaaauuuuuuuugcu

SEQ ID NO: 57867 - RNA, 63 nt, hsa
uuuuagugauauuuuucaacuucaccacaguaacuuugcaacaucauuuuucauuuguggggu

SEQ ID NO: 57868 - RNA, 63 nt, hsa
cagaacacagggcucgagccucuggaacugacccuuugcaagucuuuacaaaagaaaaaaggc

SEQ ID NO: 57869 - RNA, 63 nt, hsa
caguguuuuucagauuccuuucacugccuuaaucuuugcaacaggguggaaguuuuuuucuuc

SEQ ID NO: 57870 - RNA, 63 nt, hsa
agggagauacuauagaaaggagaacacugccuacuuugcaagccagugaccugccuuuugagg

SEQ ID NO: 57871 - RNA, 63 nt, hsa
uuuugaaggcagaaagcaaaauuauguuugccacuuugcaaaggagcucacuguggugucugu

SEQ ID NO: 57872 - RNA, 63 nt, hsa
aacuuuauuaucaacagaaauuuuagcucuuuucuuugcaagauauaucacagcugcuuuggg

SEQ ID NO: 57873 - RNA, 63 nt, hsa
cagucauguaauauacagaacuauaagcagagacuuugcaaaacuaaauaaagggcugcaugc

SEQ ID NO: 57874 - RNA, 63 nt, hsa
uugcaaaugauaagcauuuuugugagugaccaccuuugcaauauguuuguuaauuuacuucau

SEQ ID NO: 57875 - RNA, 63 nt, hsa
gaaggaaaugaaguccugaaauaaagugaugggcuuugcaaauccaggguagaggcccuaaca

SEQ ID NO: 57876 - RNA, 63 nt, hsa
acaacaagcaaggagguagacaauauugucuaccuuugcaaaugaggaaacagaggcuuagag

SEQ ID NO: 57877 - RNA, 63 nt, hsa
uacaaagccagugccaaaacccagccaugggcucuuugcaaccucccagcugcgcucauucca

SEQ ID NO: 57878 - RNA, 63 nt, hsa
accaagauucgccaaucucauacaagccauuuacuuugcaagugagauagcuuccccaccagc

SEQ ID NO: 57879 - RNA, 63 nt, hsa
uggggguugaauaggaguuaaccccugcgcucucuuugcaacugucucucuucucagaguggu

SEQ ID NO: 57880 - RNA, 63 nt, hsa
gcucaagccacugcuguugcauuacacccaucccuuugcaaaaucccuauggagccugucacc

SEQ ID NO: 57881 - RNA, 63 nt, hsa
cacaaaaagucuacauuuauuuaauaugauggucuuugcaaaaaggaacaaaacaacacaaaa

SEQ ID NO: 57882 - RNA, 63 nt, hsa
ggcagacacagcugucugguucaggccaagccccuuugcaaugcaagcccuuucugguguuau

SEQ ID NO: 57883 - RNA, 63 nt, hsa
ucaugaacacacccgagaaaucuuaaauagacacuuugcaauauuuaagaaccuaaugcuguu

SEQ ID NO: 57884 - RNA, 63 nt, hsa
guaaagggugugauuuuacuuuuaaagccacuccuuugcaacaggaaaagucuguuuuguguu

SEQ ID NO: 57885 - RNA, 63 nt, hsa
agagcugaaaauguagaaauugaguuaucuucccuuugcaaaauuuuuacacuuuaaauuagu

SEQ ID NO: 57886 - RNA, 63 nt, hsa
cuguuacacuaauuugaauaaacucuccccuuucuuugcaacuucccagcaacaauaaugauu

SEQ ID NO: 57887 - RNA, 63 nt, hsa
acguagggacuucaugucaugucaaagauagcucuuugcaagugccuugauuaaaccagaaaa

SEQ ID NO: 57888 - RNA, 63 nt, hsa
uggacuauggcccagucccccaucuaaguggugcuuugcaaaugucuuggaggaguauaggac

SEQ ID NO: 57889 - RNA, 63 nt, hsa
cccgccuaggacaggagcugucuggagcuccaccuuugcaaagaaaggaaaaacacaaauugc

SEQ ID NO: 57890 - RNA, 63 nt, hsa
aguauuguguuuugcuuuggaaacacccacucacuuugcaauagccgugcaagaugaaugcag

SEQ ID NO: 57891 - RNA, 63 nt, hsa
ucugaaaguucuggcuuguagaccccuccccuccuuugcaaagguaugggauagaggggucag

SEQ ID NO: 57892 - RNA, 63 nt, hsa
guccgggaggcaccguccggcggcgagcucuggcuuugcaagggccccuccuucugggggcuu

SEQ ID NO: 57893 - RNA, 63 nt, hsa
ugaaguaaauguaugguagaaauuaagacguuucuuugcaaaacaaggaaaucacacauaugc

SEQ ID NO: 57894 - RNA, 63 nt, hsa
gguuacaauuagaacuccugaccccagauucaacuuugcaaacaacaggggaaaaaaaugggg

SEQ ID NO: 57895 - RNA, 63 nt, hsa
guuuaauggccaccuguucucuccugugaaaggcuuugcaaagucacauuaaguuugcaugac

SEQ ID NO: 57896 - RNA, 63 nt, hsa
uucuggcuaacguuaaaugcugcuauacaacugcuuugcaacaguugcugguauauuuaaauc

SEQ ID NO: 57897 - RNA, 63 nt, hsa
gggaccaggaugauacagucaucugagguuaugcuuugcaaaaggcugacgguauggaauaug

SEQ ID NO: 57898 - RNA, 63 nt, hsa
gcacccuuaauucaggcacuguccauuagcuuccuuugcaaaggcuacuuauggccggucaca

SEQ ID NO: 57899 - RNA, 63 nt, hsa
uuauuguucugcucauuguguuugugacaaacucuuugcaauauggcuuaauuuucuuugugu

SEQ ID NO: 57900 - RNA, 63 nt, hsa
aacaaacguuuuuccaaagaauucacagugcuccuuugcaauuuauagauuucauguugaaau

SEQ ID NO: 57901 - RNA, 63 nt, hsa
ggacuaaauuuugucaauuucauguaauuuacccuuugcaauaaaaaugauucauuaaauaua

SEQ ID NO: 57902 - RNA, 63 nt, hsa
uauguguguuauucguuugucugguuuuacuaccuuugcaaaaacaaaauaccccaaagauau

SEQ ID NO: 57903 - RNA, 63 nt, hsa
gacuuccuucaacaaauauuuauuaaauauccacuuugcaacagcacugaaauggcuguaagg

SEQ ID NO: 57904 - RNA, 63 nt, hsa
uugggcuccagaggacuuaccuacaaaauacuccuuugcaaugauaauugugggucaggaauc

SEQ ID NO: 57905 - RNA, 63 nt, hsa
cccaguucccccgccccaggaaacacugcugaccuuugcaaaggcugccgagcuuucgugcac

SEQ ID NO: 57906 - RNA, 63 nt, hsa
ugggugaggucuacaaaauugggugugacuuuccuuugcaaauggauuucuccuggggaauuu

SEQ ID NO: 57907 - RNA, 63 nt, hsa
ugguuuuggggaaauguggagaagagugcccugcuuugcaaacaucaaccuggcaaaaaugca

SEQ ID NO: 57908 - RNA, 63 nt, hsa
ccacacauacccucuaagccagcaagauuuccucuuugcaaaaucauauuuuugugggaaugg

SEQ ID NO: 57909 - RNA, 63 nt, hsa
uaacucuuuucaauccuuuuagauaaaauuguucuuugcaagaaugauuggugcuuauuuuuu

SEQ ID NO: 57910 - RNA, 63 nt, hsa
cuuguaacucauaccugucugcuucagcaacugcuuugcaaugacauuuauuuauuaauucau

SEQ ID NO: 57911 - RNA, 63 nt, hsa
agaaguacugugcucaaauuuuacauuuuuuuccuuugcaaauucuguaauuucacucaacga

SEQ ID NO: 57912 - RNA, 63 nt, hsa
gcccugacugguugugcaaccauugcuucauuucuuugcaaaauguaguuaagauauacuuua

SEQ ID NO: 57913 - RNA, 63 nt, hsa
aauaauuaagaacgcucuuccucuucauaacugcuuugcaaguuuccugugaaaacaucaguu

SEQ ID NO: 57914 - RNA, 63 nt, hsa
guauaagcuguaacagaauuuugaauuguuuuucuuugcaaaaccccuccacaaaagcaaauc

SEQ ID NO: 57915 - RNA, 63 nt, hsa
uugucgguuuguuuuuucauucauguugaagugcuuugcaaggcuucaggaaacagaguugug

SEQ ID NO: 57916 - RNA, 63 nt, hsa
acuccccaaucuggaugcauuacauucaccaggcuuugcaaacccagccucccagugcucauu

SEQ ID NO: 57917 - RNA, 63 nt, hsa
cuuuccaucccaccccccuuggaauuauuuagucuuugcaauauuagaaaccuugacucugau

SEQ ID NO: 57918 - RNA, 63 nt, hsa
auagcuuaaagagcagaguagaaacggaagaggcuuugcaaaaggcuagauaacuaacaacac

SEQ ID NO: 57919 - RNA, 63 nt, hsa
uuugcccucccauucccaucuaucccccaaguccuuugcaauuucuucccugcccuacauagg

SEQ ID NO: 57920 - RNA, 63 nt, hsa
ugauguaaaaaauacaaacauucuaauuaaaggcuuugcaacacaugccuugucuguuuuuau

SEQ ID NO: 57921 - RNA, 63 nt, hsa
uugugacuggggaggggcuccguauaaucucaccuuugcaagcguuuauuuacugauguaugc

SEQ ID NO: 57922 - RNA, 63 nt, hsa
uaguuacuugugcuuuuuuuuuuuuuuuuggaucuuugcaagggcaaaacuacaaguaacgag

SEQ ID NO: 57923 - RNA, 63 nt, hsa
cuacccauuuacaaauaagaggacagauaacugcuuugcaaauucaagagccuccccuggguu

SEQ ID NO: 57924 - RNA, 63 nt, hsa
ccuuuccucaauagcuuccuuugcuccaauaagcuuugcaaucaaggccaaagaaaaugaucu

SEQ ID NO: 57925 - RNA, 63 nt, hsa
auaacagacaaaaauacacacacguguguuuuucuuugcaauacuugaaauauugccacugug

SEQ ID NO: 57926 - RNA, 63 nt, hsa
ugaccugccuggcuuccuuagcuugccccucagcuuugcaaagagccacccuaggccccagcu

SEQ ID NO: 57927 - RNA, 63 nt, hsa
auagaacauaauuuuaugagucuuccagaagaccuuugcaaguuugccaccaguagauaccgg

SEQ ID NO: 57928 - RNA, 63 nt, hsa
gacaggcaugaggagugccuauuccaugcuugccuuugcaauaccugcauccccagcacuggu

SEQ ID NO: 57929 - RNA, 63 nt, hsa
guccacgagguggggugcaggcggacaggcgggcuuugcaaugauccccguacuccugccccu

SEQ ID NO: 57930 - RNA, 63 nt, hsa
gguucuaggagccagauucauuccuucuucauucuuugcaaaacagugguacagacauggagu

SEQ ID NO: 57931 - RNA, 63 nt, hsa
aaugauggcaugacaauccagagaucauaacuucuuugcaagaaaacagcuucuccacacaug

SEQ ID NO: 57932 - RNA, 63 nt, hsa
uaggauagauauuugucaucuugacaaguagcccuuugcaauuuauacuugaguucacuccug

SEQ ID NO: 57933 - RNA, 63 nt, hsa
cugcaugcgccaccauuuuuggcagcguggcagcuuugcaaggggcuggggcccucggcgugg

SEQ ID NO: 57934 - RNA, 63 nt, hsa
cucccuacucuccaccgauaaccuaucaaagggcuuugcaagagcuuuugacuaaucgucugu

SEQ ID NO: 57935 - RNA, 63 nt, hsa
cugacccaccgccaccuccgcggagaaacugcacuuugcaauggggccgccuccccgcguagc

SEQ ID NO: 57936 - RNA, 63 nt, hsa
auaacagacuaggccagacauagcaucuuguggcuuugcaaccauuuucauuuguuuguuuuc

SEQ ID NO: 57937 - RNA, 63 nt, hsa
acuuuugccacauuguauacuuauaaugggaaacuuugcaaggacauuuuugggaagcaaugc

SEQ ID NO: 57938 - RNA, 63 nt, hsa
auagguuccagugauagaguuauaauuuugcuccuuugcaaacaaaugguaucuaauuaauaa

SEQ ID NO: 57939 - RNA, 63 nt, hsa
auaucuaaaguuauauuucagauguaauguuuucuuugcaaaguauuguaaauuauauuugug

SEQ ID NO: 57940 - RNA, 63 nt, hsa
uugauugcaugugguuaauguugcauuagagcacuuugcaauugcauaauucauuaauguuuu

SEQ ID NO: 57941 - RNA, 63 nt, hsa
gaacuagaagguagguuuaagccaucaccaggccuuugcaaauggccuaaaugguguucccuu

SEQ ID NO: 57942 - RNA, 63 nt, hsa
cagagacccgccuuaagagacuggaucgcacaccuuugcaacagauguguucugauucucuga

SEQ ID NO: 57943 - RNA, 63 nt, hsa
cacugccacccccagcguggcugcuuucaaguucuuugcaauuaaagguucuguauaaaacca

SEQ ID NO: 57944 - RNA, 63 nt, hsa
agagcuggggcacaaggggacuggaggcaguugcuuugcaagauggcugaggagaaagcacac

SEQ ID NO: 57945 - RNA, 63 nt, hsa
caaaaugaugauauucucuugaguauuacuucccuuugcaauguuuuuauuguuaauguagca

SEQ ID NO: 57946 - RNA, 63 nt, hsa
auagcuuagauauaaaaggucuccaacaaagaccuuugcaauauauuuuaauuacaaacacuu

SEQ ID NO: 57947 - RNA, 63 nt, hsa
cauuaccugcaaagaaagggcacucaggcagcccuuugcaaucgcgauggcagccacuagaua

SEQ ID NO: 57948 - RNA, 63 nt, hsa
ucaugugccaaagccagggcagagcuucuaguucuuugcaaucccuuuauugagcuccuccac

SEQ ID NO: 57949 - RNA, 63 nt, hsa
cuuucacugacauuuuaaucauuauuuuaaaagcuuugcaaccuauauauuuauauaacuuug

SEQ ID NO: 57950 - RNA, 63 nt, hsa
gcugaagucccuugugaacccugcaauaaacugcuuugcaaauucaucuggaagugucugugu

SEQ ID NO: 57951 - RNA, 63 nt, hsa
gcugaagugccuugugaacccugcaauaaacugcuuugcaaauucaucugaaagugucugugu

SEQ ID NO: 57952 - RNA, 63 nt, hsa
aacagaaccagaguaacuccucgccuguugcugcuuugcaaugaauuuccuuuaccuuucugg

SEQ ID NO: 57953 - RNA, 63 nt, hsa
auccaaguuucugccucuuuuaaauguacuugacuuugcaaggcaaguaguuuuacagccauu

SEQ ID NO: 57954 - RNA, 63 nt, hsa
cacaacguccccucaagccccuucucucaaucccuuugcaacgcucacugguuuuggccaccc

SEQ ID NO: 57955 - RNA, 63 nt, hsa
ccaugagucccccacacccaccccauccucggucuuugcaaagaagggcccgagcuuaguuuc

SEQ ID NO: 57956 - RNA, 63 nt, hsa
auucagucugcuuuuggauuuucauauauuuaacuuugcaaaaagauuuacuuuguacauguu

SEQ ID NO: 57957 - RNA, 63 nt, hsa
aauguacuuggaaauuaauguauguuuacaucucuuugcaaauuccuguacauagagauauau

SEQ ID NO: 57958 - RNA, 63 nt, hsa
ugccaugaccuuccgcacaucucuaaguuuuaucuuugcaauacucaagguucucggaaauuu

SEQ ID NO: 57959 - RNA, 63 nt, hsa
auauuuaaugcauuaaaccugucuccacugugccuuugcaaaucaguguuuuucuuacuggag

SEQ ID NO: 57960 - RNA, 63 nt, hsa
gaagaauugagaauugauagauuuggagaugagcuuugcaaaggcuguuugcuuuucaugucu

SEQ ID NO: 57961 - RNA, 63 nt, hsa
ccaaaguuuggacaguagauggacuucucagaacuuugcaaacauaaucauuguucucacccu

SEQ ID NO: 57962 - RNA, 63 nt, hsa
aaaauggaguuugcaauuaauaucaggauuuaucuuugcaaaaaucagugauuuccacauuca

SEQ ID NO: 57963 - RNA, 63 nt, hsa
accucuuccacuccuucucucacuguguuacugcuuugcaaagacccgggagcuggcggggaa

SEQ ID NO: 57964 - RNA, 63 nt, hsa
uguucgaugcacucuuuccuccuugccacuuaccuuugcaaaguuaaaaaaaaggggggaggg

SEQ ID NO: 57965 - RNA, 63 nt, hsa
aaagcuaaaauuucuguucuugaaacacuucagcuuugcaacuaaaauauuacagauuaauaa

SEQ ID NO: 57966 - RNA, 63 nt, hsa
guaaagggagacuuuuuuaaauaacaguugagucuuugcaaguaaaaagauuuagagauuauu

SEQ ID NO: 57967 - RNA, 63 nt, hsa
caaugcucagaauugaaaauuacuacuuaaaaucuuugcaaauugaauaauuacagaaaaggg

SEQ ID NO: 57968 - RNA, 63 nt, hsa
acuugcugggacagugugggugggagaccagggcuuugcaauucguggcauccuuuaggauaa

SEQ ID NO: 57969 - RNA, 63 nt, hsa
cuuuggcccuuguguaacauugcaaaccuguggcuuugcaaaauguacccaggucacaagggg

SEQ ID NO: 57970 - RNA, 63 nt, hsa
uuuuuuuauggugcuuaaaguaaagagcccauccuuugcaagucauccauguuguuacuuagg

SEQ ID NO: 57971 - RNA, 63 nt, hsa
uguuaaaucguaacaagcaauaaacaacuuucacuuugcaaagacaguguguccaguuaccac

SEQ ID NO: 57972 - RNA, 63 nt, hsa
gaaagaugcuccaagaaccaacacuaucaaugucuuugcaaauccucacaggauuccuguggg

SEQ ID NO: 57973 - RNA, 63 nt, hsa
cagcucagcaccagcacccgggcguccugagcacuuugcaagagagaugggcccaaggaauuc

SEQ ID NO: 57974 - RNA, 63 nt, hsa
aagauaaucuauuuacuguaaaaauaaauuggacuuugcaaaagcuuuuagaaggaaaagaaa

SEQ ID NO: 57975 - RNA, 63 nt, hsa
guccccucuguaguugguuuccuuccugugucccuuugcaagcuuccaggcgaucuaaggugu

SEQ ID NO: 57976 - RNA, 63 nt, hsa
cuguguaaaugcuccagcacucaauaaagugggcuuugcaagcuaccuccuucccugccuccu

SEQ ID NO: 57977 - RNA, 63 nt, hsa
ccacuuccuugcuucucaagcugacaauucucacuuugcaauaaauaguccaguguuuccuuc

SEQ ID NO: 57978 - RNA, 63 nt, hsa
ccucccacgccguggaagcuuuguucuuucgcucuuugcaauaaaucuugcuacugcccacuc

SEQ ID NO: 57979 - RNA, 63 nt, hsa
ggaauaaagcccccuaguugccuuuggccccaccuuugcaaaguuccagagggcugacccucu

SEQ ID NO: 57980 - RNA, 63 nt, hsa
uuuaguggcucuuuagagagaaacucuuucucccuuugcaaaaaugggcuagaaugaaaagga

SEQ ID NO: 57981 - RNA, 63 nt, hsa
guuuacguguccugguucacacccaggacuuuucuuugcaagcgaaccuguuugaagcccaag

SEQ ID NO: 57982 - RNA, 63 nt, hsa
uggaacuaaugcggaggcugcuugcugugcuggcuuugcaacaagacagacuguccccaagag

SEQ ID NO: 57983 - RNA, 63 nt, hsa
cuucugcuguggagagaucuagccagucccugacuuugcaacagaccuacugacuacuggauc

SEQ ID NO: 57984 - RNA, 63 nt, hsa
ucaauucuugaaaauguggauacaccagaauugcuuugcaaauguguuaagugcauucuuuug

SEQ ID NO: 57985 - RNA, 63 nt, hsa
gaugaaagucagaaggcugucaaacucaaauaucuuugcaaacaguuugaauacugugaauuc

SEQ ID NO: 57986 - RNA, 63 nt, hsa; identical to SEQ ID NO: 57984

SEQ ID NO: 57987 - RNA, 63 nt, hsa
uaagaaagcuuauuuauuagcgauauaaccuugcuuugcaaacagaaugcaagcguuaacuuu

SEQ ID NO: 57988 - RNA, 63 nt, hsa
aaguugaacuuucagucccugccugaaucugggcuuugcaagcuccugcuccauauuggugga

SEQ ID NO: 57989 - RNA, 63 nt, hsa
auacagcuugugaggaagugagccagcaguggccuuugcaauuguggaucuugagcucugcuc

SEQ ID NO: 57990 - RNA, 63 nt, hsa
cagacucaguagcguuuuagucguuuuauguuucuuugcaacggccucagaaguuuggccgga

SEQ ID NO: 57991 - RNA, 63 nt, hsa
cacacgguuagccgugcaugcacuuuguggccccuuugcaaggggcagaggguacuggaagug

SEQ ID NO: 57992 - RNA, 63 nt, hsa
accacaguucuaccccugggauguuuugagggucuuugcaagaaucauuaauacaaagaauuu

SEQ ID NO: 57993 - RNA, 63 nt, hsa
gcaaauauuauccagcaagcagucuacccuguccuuugcaauugcucuucuccacgucuuucc

SEQ ID NO: 57994 - RNA, 63 nt, hsa
aaggaauuuagguuucugcaacugaucgaugaucuuugcaaucuuuuuuuuguuuucaauauc

SEQ ID NO: 57995 - RNA, 63 nt, hsa
aaggaauuuagguuucugcaacugaucaaucaucuuugcaauuauauuuucauuuuaaauauc

SEQ ID NO: 57996 - RNA, 63 nt, hsa
aaggaauuuagguuucugcaacugaucaauaaucuuugcaaucauauuuuuguuuucaauauc

SEQ ID NO: 57997 - RNA, 63 nt, hsa
acucugugcacaccuuagaguuccuggccuucucuuugcaaggggagcugagaaucugguuuu

SEQ ID NO: 57998 - RNA, 63 nt, hsa
uucuauaaaaucugccauaguuggauuaugcagcuuugcaaaaauuuuuacuagauuuugcac

SEQ ID NO: 57999 - RNA, 63 nt, hsa
ugccauuuucuacagcuugcugaguugucauuccuuugcaacauuaaaauacaugcugaacuc

SEQ ID NO: 58000 - RNA, 63 nt, hsa
auucugcaggacaggaaauaacuguauuaccugcuuugcaagguggcuuuaagaaucacugaa

SEQ ID NO: 58001 - RNA, 63 nt, hsa
caagacuccaucucaaaaaaauuauaaauaacucuuugcaaauaggaaagugaagcucaaggg

SEQ ID NO: 58002 - RNA, 63 nt, hsa
ugggucuaugugugugugaccgugcaucugcuccuuugcaaguggggucuugggagcaggccu

SEQ ID NO: 58003 - RNA, 63 nt, hsa
agagagagagagaaagaaagaaagaaaggcugccuuugcaaaaauccuacuggucaaauaacc

SEQ ID NO: 58004 - RNA, 63 nt, hsa
aaaugaaaaagccgauuuaccuugaaacugagccuuugcaagcauugaagcccacgcucugag

SEQ ID NO: 58005 - RNA, 63 nt, hsa
aguaaaucgaccuuuaagaauuccugggguggacuuugcaaacacauucuacaaccugauggu

SEQ ID NO: 58006 - RNA, 63 nt, hsa
uuccuagugagcagggcucuggcccugaggagucuuugcaauguauugaaggaauugcugccg

SEQ ID NO: 58007 - RNA, 63 nt, hsa
cuuccagauuagaaaaauuucaacuguaggugccuuugcaaccuauccugggagacccuaaaa

SEQ ID NO: 58008 - RNA, 63 nt, hsa
uccugucuacuaggaugacaaggaguaugugggcuuugcaacccuccccaaccaaguccaccg

SEQ ID NO: 58009 - RNA, 63 nt, hsa
acacagcgggguccuguccaggcccagggacaucuuugcaagccagacacacuuccucuugag

SEQ ID NO: 58010 - RNA, 63 nt, hsa
aaaauuuaauaaauucauaaaaaagacucauaucuuugcaaacaaaagaagggcagauacugg

SEQ ID NO: 58011 - RNA, 63 nt, hsa
uguggaauuuucuuuaugaaaaaugauuuuagccuuugcaaauguuaaccaugugaaacacau

SEQ ID NO: 58012 - RNA, 63 nt, hsa
cccagcccagucuuucuccccggcauucacaaacuuugcaagcgugguccagggccuucucca

SEQ ID NO: 58013 - RNA, 63 nt, hsa
uaguuguucuccuuguugcaauaauuaauaacucuuugcaaaaugucuccuuugagacagagg

SEQ ID NO: 58014 - RNA, 63 nt, hsa
acauuuaauucaaggaucaaaaauuguggccaucuuugcaaaugacuaccuauagccugugaa

SEQ ID NO: 58015 - RNA, 63 nt, hsa
aguuaauuucccguguuggaaaaaaauaaucuccuuugcaauguaauuuggaaauaagucaau

SEQ ID NO: 58016 - RNA, 63 nt, hsa
auugauggaccagccucuuuccaggucccaggacuuugcaagagauggagacagguuaggugg

SEQ ID NO: 58017 - RNA, 63 nt, hsa
auuauuuaaauggaacuuauuacauaccaauggcuuugcaagaagaugacauuucagaaaauc

SEQ ID NO: 58018 - RNA, 63 nt, hsa
acgaauugaggcagggaauagaccucacuagcccuuugcaauggagaucaucguucuaguggc

SEQ ID NO: 58019 - RNA, 63 nt, hsa
auacaaauauuuacaauuuuuaugaaugguggucuuugcaaagagcauuuauauuuucuuuuu

SEQ ID NO: 58020 - RNA, 63 nt, hsa
cucuauaccaggccugagugcaggucuuggcgccuuugcaaagugauagaaaagaucugacca

SEQ ID NO: 58021 - RNA, 63 nt, hsa
aggaaccuguggacuaggggugcagggacuucccuuugcaagggguaacagaccgcuggaaaa

SEQ ID NO: 58022 - RNA, 63 nt, hsa
agaaauguagaaaagcauuccauaauuucucuucuuugcaaauacaugaaaggaugcacagag

SEQ ID NO: 58023 - RNA, 63 nt, hsa
gugaguuuccugcuauauuaacaucaucuuagacuuugcaagcagagagucguggaaucaaau

SEQ ID NO: 58024 - RNA, 63 nt, hsa
guggguugcuugggggugggaugggaagaggcucuuugcaaacgaggguccccagagaagacu

SEQ ID NO: 58025 - RNA, 63 nt, hsa
uaaaacaacugacguuacucaagaauuagaaaacuuugcaagauuugacuuguuuaaaaauca

SEQ ID NO: 58026 - RNA, 63 nt, hsa
ggggcucccguggccuguagaauagccuguggccuuugcaauuuguuaagguucaagacagau

SEQ ID NO: 58027 - RNA, 63 nt, hsa
cugaaggaagaaagcagcagcuggacaauguuucuuugcaaagcaacacucgaaccaaaagau

SEQ ID NO: 58028 - RNA, 63 nt, hsa
ggguaccaggcuucugccacccccggcucagaucuuugcaaaucaguacgacagccucagagc

SEQ ID NO: 58029 - RNA, 63 nt, hsa
cauuguaagaguuccacagagcucugggcacuucuuugcaaagccauguuugcacgguggggg

SEQ ID NO: 58030 - RNA, 63 nt, hsa
cauguggaacugugugugaguuaaaccucuuuccuuugcaaauuaccuagucucagguaguuc

SEQ ID NO: 58031 - RNA, 63 nt, hsa
guaagacauacaauaauuuauacuggagaaaaacuuugcaaguauaaugaauguagcagagcc

SEQ ID NO: 58032 - RNA, 63 nt, hsa
gaaaaggcuacuauuuauaacuuccaaccagaacuuugcaaugugcugauuuuauacaugauu

SEQ ID NO: 58033 - RNA, 63 nt, hsa
cgguggggaagccgcugaauccaccugcuucuccuuugcaaccgacagcaaacagcuuucucc

SEQ ID NO: 58034 - RNA, 57 nt, hsa
auuucauuacagauaggugaucuucagcuuugcaaacuggaugaacuagauugcuug

SEQ ID NO: 58035 - RNA, 63 nt, hsa
aagucaacaugcauauuacauuuucauccuuugcuuugcaagcacugguggcuugcaguuugc

SEQ ID NO: 58036 - RNA, 63 nt, hsa
acucuuugagucccaggagaagccuggcacccucuuugcaaauuggccuuugcucuuucaaug

SEQ ID NO: 58037 - RNA, 63 nt, hsa
aggcagguuucgggccugaagcagaucagagggcuuugcaaaagacagcauagagccaucuuc

SEQ ID NO: 58038 - RNA, 63 nt, hsa
uuuuugucaaaacaaaugcuguacuccaauuuucuuugcaaggccuuauucuugccucuauag

SEQ ID NO: 58039 - RNA, 63 nt, hsa
ucucuuggagaauaaguggacuccaagcuaacucuuugcaaauguaaacacauguccaucuug

SEQ ID NO: 58040 - RNA, 63 nt, hsa
aucuugaauguuguguauauauuuuaaaaagcacuuugcaaaauaguuuguacauuuauuucc

SEQ ID NO: 58041 - RNA, 63 nt, hsa
agcagcaauuucccaauuuauugaaagugaucgcuuugcaaggaugucuaagcuaaucccguc

SEQ ID NO: 58042 - RNA, 63 nt, hsa
caaguucagccugagaugcuggcuguacucagccuuugcaauuuuuguagauguagcuuagga

SEQ ID NO: 58043 - RNA, 63 nt, hsa
ccuggucuacagauggaagcugcagguuggugacuuugcaaaugcacuuccuacagaugaacu

SEQ ID NO: 58044 - RNA, 63 nt, hsa
uaaguuuguuucaacuaaaauauuaagugaaugcuuugcaaguuugacuguaugcagguuuau

SEQ ID NO: 58045 - RNA, 63 nt, hsa
gcagcuacuccugccccagagaugaaggggcagcuuugcaaggauccggagccagcucccagg

SEQ ID NO: 58046 - RNA, 63 nt, hsa
gcaagugcuacaaucacgauuguugcuaugcugcuuugcaaaaaguugaaaaaauaaaaaaaa

SEQ ID NO: 58047 - RNA, 63 nt, hsa
ucaggugacuagagaauuucaggcaacagugcccuuugcaauuaccuuuuugaugauuaaggu

SEQ ID NO: 58048 - RNA, 63 nt, hsa
gaaagcaucacuucuuuuuuauguugugggaaucuuugcaaguuaguguugcaucugauuuuc

SEQ ID NO: 58049 - RNA, 63 nt, hsa
ccacugcacuccagccugagugacagagugagacuuugcaaccaaaaaauaaaauaauaauaa

SEQ ID NO: 58050 - RNA, 63 nt, hsa
caugauugcuaucuuauuuuuguuauccgagaccuuugcaaacauuggcaaauagcaucaauu

SEQ ID NO: 58051 - RNA, 63 nt, hsa
uaucaccuuucccagauucucggauucucgacucuuugcaacagcacuugcuugcggaacucu

SEQ ID NO: 58052 - RNA, 63 nt, hsa
gaugcacugggaauuuauuagcacaaaaucauucuuugcaacucaaaauucagaagggacucu

SEQ ID NO: 58053 - RNA, 61 nt, hsa
uuaccaaaaggguccauuauuucauaagaguuacuuugcaaaaaaaaaaauguggguuuuu

SEQ ID NO: 58054 - RNA, 63 nt, hsa
agcucaggaccuggagauguacggugugaacuacuuugcaauccggguguguugaaaccucuc

SEQ ID NO: 58055 - RNA, 63 nt, hsa
aguuuuaaguuugauuuuuuuuauuucaaaaugcuuugcaauuaaaugaauuacuguucagaa

SEQ ID NO: 58056 - RNA, 63 nt, hsa
ccucagaacagacaaaucaugaaugagcuggaacuuugcaagaauauucauauuauaaauguc

SEQ ID NO: 58057 - RNA, 63 nt, hsa
auugugucugguuaauuucuguauucucugcaacuuugcaauguuuggcuugaagaaggagcu

SEQ ID NO: 58058 - RNA, 63 nt, hsa
guaguguuguuuucucguguccacccuguggcccuuugcaauggguaggagaucuggggaggc

SEQ ID NO: 58059 - RNA, 63 nt, hsa
caucuguucuugcaccaccauccagaaugcccccuuugcaaggccugcugcaguccccagucu

SEQ ID NO: 58060 - RNA, 63 nt, hsa
ucucuggcucaggggaaaguccuguucauauugcuuugcaauuccaggagcggcauugccccc

SEQ ID NO: 58061 - RNA, 63 nt, hsa
aaucacuggccccuugaagacagcagaaugucccuuugcaaugaggaggagaucugggcuggg

SEQ ID NO: 58062 - RNA, 63 nt, hsa
gagccaagggagcagggucauuaacuuuuucuucuuugcaaagugggcacuuggcaucagggu

SEQ ID NO: 58063 - RNA, 63 nt, hsa
agugcggacccguggcuggcagcccgggcaguccuuugcaaaggcaccccuugucuuaaaauc

SEQ ID NO: 58064 - RNA, 63 nt, hsa
acaaauaaauauggaagucacgucauaaucuaccuuugcaaagccauacaugaacuuuuauuu

SEQ ID NO: 58065 - RNA, 55 nt, hsa
uguucaaggaaacggucuagcccuucuuugcaaaacacaacugccuaguuuacca

SEQ ID NO: 58066 - RNA, 63 nt, hsa
ugucugaacuuuauuuacucauuagucaagguucuuugcaaggcaggugauuaacuuaaauau

SEQ ID NO: 58067 - RNA, 63 nt, hsa
uauguggaaucccccaaagucucugguuuaauucuuugcaauuauaauaaccuggcugugagg

SEQ ID NO: 58068 - RNA, 63 nt, hsa
aaguguagacuaugacaaaaaauacacuaauaccuuugcaaucugaaugagaauuugaccauu

SEQ ID NO: 58069 - RNA, 63 nt, hsa
uuaauauaauuuugaucacaauuuacaaaugaucuuugcaaauaguggucagacggcauuagu

SEQ ID NO: 58070 - RNA, 63 nt, hsa
uuccccucuaucagucacugacaguuaauaaaccuuugcaaacguuccccaguuguuugcacc

SEQ ID NO: 58071 - RNA, 63 nt, hsa
uuccccuguaucagucacugacaguuaauaaaccuuugcaaacguuccccaguuguuuguucc

SEQ ID NO: 58072 - RNA, 63 nt, hsa
gguagccucccacugcaucccauccugaauauccuuugcaacuccccaagagugcuuauuuaa

SEQ ID NO: 58073 - RNA, 63 nt, hsa
uuccccucuaucagucacugacaguuaacaaaccuuugcaaacauuccccaguuguuuguucc

SEQ ID NO: 58074 - RNA, 63 nt, hsa
uuccccuguagcagucacugacaguuaauaaaccuuugcaaacguuccccaguuguuugcucg

SEQ ID NO: 58075 - RNA, 63 nt, hsa
gggauguaaguuuguguaaauuaaugguuuauucuuugcaaauaaaacgcuuuccccgucugu

SEQ ID NO: 58076 - RNA, 63 nt, hsa
uauugcugucugaaaaaguguuuuuacauauagcuuugcaaccuuguacuuuacaaucaugcc

SEQ ID NO: 58077 - RNA, 63 nt, hsa
ucaguggccuaaauucucugccuuuuuaacuugcuuugcaagccuacucugaaaauaaguuau

SEQ ID NO: 58078 - RNA, 63 nt, hsa
aguacagcaauuguaguaacugacacauccucucuuugcaagcugcugacugggcacacucau

SEQ ID NO: 58079 - RNA, 63 nt, hsa
aaauuuguauuuuauauuguuuuaucuaucugucuuugcaagcagucuucagguuaaagauac

SEQ ID NO: 58080 - RNA, 63 nt, hsa
gcuuaacccaugagcuccaugugccuuuuggaucuuugcaacacugaagauuuggaagaagcu

SEQ ID NO: 58081 - RNA, 63 nt, hsa
uuguuuuuuguuauugauauuaaacaguguaaucuuugcaagcguauauugaagauuauucug

SEQ ID NO: 58082 - RNA, 63 nt, hsa
aaguguccaacaaggaauucacaccucugccuccuuugcaacaacaacauuuacacaguuggu

SEQ ID NO: 58083 - RNA, 63 nt, hsa
uacauuuuuucuaaccucagauaagugcagugucuuugcaaugccaacauaagggagaucuug

SEQ ID NO: 58084 - RNA, 63 nt, hsa
uaauaauacacauuucugugagugcugacuugucuuugcaauauuucuuuucugauuuauuua

SEQ ID NO: 58085 - RNA, 63 nt, hsa
aucaagaauacaccuaugaaguuaguccauauacuuugcaacuccuuagaguacuuuuuuccu

SEQ ID NO: 58086 - RNA, 63 nt, hsa
uuccccucuaucagucacugccaguuaauaaaccuuugcaaacguuccccaguuguuugcucc

SEQ ID NO: 58087 - RNA, 63 nt, hsa
auuccccguaucagucacugacaguuaauacaccuuugcaaacguuccccaguuguuugcucc

SEQ ID NO: 58088 - RNA, 63 nt, hsa
uuccccuguagcagucacugacaguaaauaaaccuuugcaaacguuccccaguuguuugcucg

SEQ ID NO: 58089 - RNA, 63 nt, hsa
uuccguuguaucagucacugacaguuaauaaaccuuugcaaacguuccccaguuguuugcauc

SEQ ID NO: 58090 - RNA, 63 nt, hsa; identical to SEQ ID NO: 58087

SEQ ID NO: 58091 - RNA, 63 nt, hsa
uuaagaucaaugaaccuuuccccaauaucuagucuuugcaaauucuaguagaagauuuccaca

SEQ ID NO: 58092 - RNA, 63 nt, hsa
ggguguguaauuugaaguuuuggacugaaauaucuuugcaaguauccacauaaaauucuguaa

SEQ ID NO: 58093 - RNA, 63 nt, hsa
ugguaguggauuuugaauuaaguauuuauuucucuuugcaagugacuauuugauuaacacauu

SEQ ID NO: 58094 - RNA, 63 nt, hsa
acguuuuuuaacucauguagugauugcucaccacuuugcaaaguauuuuuccugccuuucagu

SEQ ID NO: 58095 - RNA, 63 nt, hsa
auaauuaacacuuaagguugggugcugcuaauucuuugcaaaaauccaaauauuguuaaggga

SEQ ID NO: 58096 - RNA, 63 nt, hsa
aucaucucuacaacuaagaugcuguaguucuaucuuugcaaugugucauaaauucucuucuuu

SEQ ID NO: 58097 - RNA, 63 nt, hsa
cauacaccagcaacaguauaaauguaagccuaacuuugcaaaauucguaauaauuuagugaug

SEQ ID NO: 58098 - RNA, 63 nt, hsa
acuuccuggggccaagaaacuaaggaaacucggcuuugcaacaggcauuacucgccauugauu

SEQ ID NO: 58099 - RNA, 63 nt, hsa
cucccagcgcuggccgccuggccacugagggcccuuugcaaaaaucacggguguagagauggc

SEQ ID NO: 58100 - RNA, 63 nt, hsa
uuuuucugagaauccugugaaggaacgcugucucuuugcaaaguaaggaggacuaagggaaaa

SEQ ID NO: 58101 - RNA, 63 nt, hsa
cauugaaauguuaaaauggcuuacacuugcagacuuugcaaaucuuaagacuaacaaauccuu

SEQ ID NO: 58102 - RNA, 63 nt, hsa
caauccugcuuucucaaguacuauucuaacauugcgcuuuauaagggaugauauuucuaccac

SEQ ID NO: 58103 - RNA, 63 nt, hsa
auaaagcccaggaacuucuagaauaacccagaugcgcuuuaauuuuuuuuaauauguuuugau

SEQ ID NO: 58104 - RNA, 63 nt, hsa
gccuuaauauaucuauggcagacauuuaagaaugcgcuuuaucuagcucaugguaacuuugca

SEQ ID NO: 58105 - RNA, 63 nt, hsa
uacgguaguuaggaugcucaguugcuaaacacugcgcuuuauuuucuuaaccaguuguggugu

SEQ ID NO: 58106 - RNA, 63 nt, hsa
ucaugggauaaaaauaaucgauguauguuacgggcgcuuuaaccaucagcugccucucgaaug

SEQ ID NO: 58107 - RNA, 63 nt, hsa
ggguucaccuggguggcuggagccgccggcgcugcgcuuuauuucggagcgcaaugccaucua

SEQ ID NO: 58108 - RNA, 63 nt, hsa
cuguuucccuuaaugauacaagucucuguaccagcgcuuuauguuaauuaccaaaacucuccu

SEQ ID NO: 58109 - RNA, 63 nt, hsa
uagaaguggcagaacacuggauuuguguguguggcgcuuuagggugcuggacuguauggcuga

SEQ ID NO: 58110 - RNA, 63 nt, hsa
aucccuccccuugcacuugugaaaacacuuugagcgcuuuaagagauuagccugagaaauaau

SEQ ID NO: 58111 - RNA, 63 nt, hsa
aaagugacuguuuggcuuauaaacacauugaaugcgcuuuauugcccaugggauauguggugu

SEQ ID NO: 58112 - RNA, 63 nt, hsa
ggaauaacaaguugucccuagcaaaaccgcugagcgcuuuauaauuuugugguguauuuuugu

SEQ ID NO: 58113 - RNA, 63 nt, hsa
acucaguuuuauaaggugauacuuuuuaaauaagcgcuuuaaugaaaaugguuagacugaaaa

SEQ ID NO: 58114 - RNA, 63 nt, hsa
guacauugucaugugacuggaucacauggggaagcgcuuuauacagacaucaguuccauggug

SEQ ID NO: 58115 - RNA, 63 nt, hsa
cucucaccucacaggcacaucaggcugcagaaugcgcuuuagaaagcauuguuuuaguccagg

SEQ ID NO: 58116 - RNA, 63 nt, hsa
ucauugcaugagucaagucggccacagacuugagcgcuuuauuauuaguuaaucuuuugcagg

SEQ ID NO: 58117 - RNA, 63 nt, hsa
aaauuuuuaaacuucuaagugaaaguagucugagcgcuuuauaaaauucauauuauugugugu

SEQ ID NO: 58118 - RNA, 63 nt, hsa
uaccccagcacacacacucccugccacuguucugcgcuuuaauugugggagaagagaggagag

SEQ ID NO: 58119 - RNA, 63 nt, hsa
uucaugaugacaacacugccucgcguuucaauagcgcuuuauacuuuuuuaaguguuuucuau

SEQ ID NO: 58120 - RNA, 63 nt, hsa
uuuuugcuauuguaaauauuagugguuuacaaugcgcuuuagacauauuucuuuaaaaugcaa

SEQ ID NO: 58121 - RNA, 63 nt, hsa
cuguagcuaucuucaccugcgccaauugugagggcgcuuuagcauuugagugauucaauaguu

SEQ ID NO: 58122 - RNA, 63 nt, hsa
agggccgaggugggcuucaguaaguccccggcggcgcuuuaguuugagcgcauggcaagucac

SEQ ID NO: 58123 - RNA, 63 nt, hsa
aaaagauugaacuuaaaugccccccucccaacagcgcuuuaaaagcgaccucucuugagguag

SEQ ID NO: 58124 - RNA, 63 nt, hsa
cuugccgccaucucuuaguuuucuuuuucacaagcgcuuuauuuuuuuaauagacaaaucaca

SEQ ID NO: 58125 - RNA, 63 nt, hsa
accuuggauuuaauuuaaagucuucaacacuaugcgcuuuaucauauuauucacagaugcauu

SEQ ID NO: 58126 - RNA, 63 nt, hsa
uccaauccaacuugaagucaauugaauauuaaggcgcuuuacuuccgugugcuuucaguuuuu

SEQ ID NO: 58127 - RNA, 63 nt, hsa
cucugccucagaaagcucugcgcuuuccagaaagcgcuuuacccugcaggguuuugcuaaccu

SEQ ID NO: 58128 - RNA, 63 nt, hsa
ucuugagaaccuucacccuuucacuuaaaggaggcgcuuuauagcuucucuuuggcauaucca

SEQ ID NO: 58129 - RNA, 63 nt, hsa
uuucauucucccccucucucccuccugugucuugcgcuuuauguuuucuuccguuugauaauu

SEQ ID NO: 58130 - RNA, 63 nt, hsa
cuccuagagaagccaugugauucccagagccaggcgcuuuacaccuaaaguaguuugacuuuc

SEQ ID NO: 58131 - RNA, 63 nt, hsa
ugcuuguguguguagcuucuuguagcuuagaaagcgcuuuaugcccaugaugucauuucaggc

SEQ ID NO: 58132 - RNA, 64 nt, hsa
gcaaucacaauacauuuguagcucccgaguguccuaaagggagugcacuucuuugaagcuggug

SEQ ID NO: 58133 - RNA, 64 nt, hsa
auacuuuagcuugugaagaagauaaugaauuuuuuaaagggaacuuucuaugcaauguucagga

SEQ ID NO: 58134 - RNA, 64 nt, hsa
ugaauuucuauauuagugguuaauugcaguuuauuaaagggaucauuaucaguaauuucauagc

SEQ ID NO: 58135 - RNA, 64 nt, hsa
ugguaaaccagguaauugaaugaagaaaggucacuaaagggagaaaugacauguuuucuauuuu

SEQ ID NO: 58136 - RNA, 64 nt, hsa
guaguuuuguaaucaagauuuuauguaacauuuguaaagggaaaauuagcacuuuugugguucu

SEQ ID NO: 58137 - RNA, 64 nt, hsa
uugaaguugucaauuccucuuauucuuaaauaucuaaagggaaaggaaaccaacuuuaauuuca

SEQ ID NO: 58138 - RNA, 64 nt, hsa
gugaaccugugaaagucauuauuuacauuugcuuuaaagggacaguuuuaccguucaacuucaa

SEQ ID NO: 58139 - RNA, 64 nt, hsa
uacaggugauuaacuuggaugaguuuugggaaguuaaagggaagaaaacacuguuaucauuuuu

SEQ ID NO: 58140 - RNA, 64 nt, hsa
auauacaacaccaaaaaauaucuaguaauauauuuaaagggaaauugagcugcuuuuuuugaaa

SEQ ID NO: 58141 - RNA, 63 nt, hsa
uagagccuucuugcuuucauuuuccuugaauguacauaggaacaagggggaaagucucuuacu

SEQ ID NO: 58142 - RNA, 63 nt, hsa
uuuuaaauuauaucugucccaggugcucuccacacauaggaugguaaugccagucccagggga

SEQ ID NO: 58143 - RNA, 63 nt, hsa
uucauucacuauuguauagaagaugcuguuaaaacauaggaaggguauuuuucuugauccaaa

SEQ ID NO: 58144 - RNA, 63 nt, hsa
auagccguguuuacuuguauuaacuuacaguuaacauaggaaaaauacaaguaaggaugugag

SEQ ID NO: 58145 - RNA, 63 nt, hsa
acgccgcauaggacugcccacaugggaccgcccacauaggaccgcccacauaggaccgcccac

SEQ ID NO: 58146 - RNA, 63 nt, hsa
ugcccacaugggaccgcccacauaggaccgcccacauaggaccgcccacaugggaccgcccac

SEQ ID NO: 58147 - RNA, 63 nt, hsa
cuuugccaaaaagcauacaagcaaccuggucauacauaggaugacaaaauucuuucugguugu

SEQ ID NO: 58148 - RNA, 63 nt, hsa
uuuaaacaauaaagcaauaagaacaaauacaauacauaggaaguuaaaagcacaaaggaauga

SEQ ID NO: 58149 - RNA, 63 nt, hsa
uauuuguuuucuuuccuaacaacucugaagaauacauaggacuuugcacuuuuuuuuuuuuuu

SEQ ID NO: 58150 - RNA, 63 nt, hsa
auuuuuagcuaauaucuagccaggagagcaagcacauaggacagacugaaagacuguaauuuu

SEQ ID NO: 58151 - RNA, 63 nt, hsa
aauaacaguuuuguugacuuaaaaauaugagauacauaggaugugaaaaaaaauguuugcagu

SEQ ID NO: 58152 - RNA, 63 nt, hsa
auauacugggguagauuauugccugccccuuauacauaggaauaugcugcauaauugcgcaua

SEQ ID NO: 58153 - RNA, 63 nt, hsa
ggucuguggcagacauugccgagugacuuucuaacauaggaauucacuguguuuucauuugau

SEQ ID NO: 58154 - RNA, 63 nt, hsa
cuuacauaacagugcagagcacaaugcuguguaacauaggaauucacuguguuuucauuugau

SEQ ID NO: 58155 - RNA, 63 nt, hsa
uaaccuuaaacucauguaagcaguucccaaagaacauaggacuuauguuuggggagaggguug

SEQ ID NO: 58156 - RNA, 63 nt, hsa
uuaaccacuaauuuugaaaauuaccagugugauacauaggaaucauuauucagaauguagucu

SEQ ID NO: 58157 - RNA, 63 nt, hsa
ccaacuaguauauaaaguacuaauuaaaugcuaacauaggaaguuagaaaauacuaauaacuu

SEQ ID NO: 58158 - RNA, 63 nt, hsa
uucgaauugagucaagcccauuuccucuuagccacauaggacucuggacuggguugccggaug

SEQ ID NO: 58159 - RNA, 63 nt, hsa
aagaagguggggucuuggauaucaccuaaguuuacauaggaaugaaauauguaacccagaaca

SEQ ID NO: 58160 - RNA, 63 nt, hsa
caaaguuuucagucacagaucacgccuuaaaagacauaggagaauucauacuggagagaaacc

SEQ ID NO: 58161 - RNA, 63 nt, hsa
caaggucuucagucaagcuucauccuaugcaaaacauaggagaauucaugcaggagagaaaug

SEQ ID NO: 58162 - RNA, 63 nt, hsa
caaggucuucagucaagcuucauccuaugcaaaacauaggagaauuuauacaggagagaaacc

SEQ ID NO: 58163 - RNA, 63 nt, hsa
acaaaguuuccauuuggaaaucacaccuuaaagacauaggagaauuuauacuggagagaaagc

SEQ ID NO: 58164 - RNA, 63 nt, hsa
caaggucuucagucaagcuucauccuaugcaaaacauaggaggauucauacaggagagaaacc

SEQ ID NO: 58165 - RNA, 63 nt, hsa
acaaaguuuucauucacaaauccagcuucaaauacauaggagaauucacacuggagaaaagcc

SEQ ID NO: 58166 - RNA, 64 nt, hsa
agcuccccuccacagcugcagcugauccauaggacuaccgcaggcccggacucaccaacuugcc

SEQ ID NO: 58167 - RNA, 64 nt, hsa
cccuuccugacccggauuggcccugccccucccccuaccgcauggcagcugggcccacagcccc

SEQ ID NO: 58168 - RNA, 64 nt, hsa
uauuguuugaagguuuaucuuuucuaaucaugcucuaccgcauuguagagagccuaaagagagu

SEQ ID NO: 58169 - RNA, 64 nt, hsa
uggcuucggcggcugagcuuaccucuacaguacacuaccgcaaaaccaacggcccuuuucaggg

SEQ ID NO: 58170 - RNA, 64 nt, hsa
gcggggacugacccuccgugccgagggcugcaugcuaccgcacuaagucaauacaugggcuccc

SEQ ID NO: 58171 - RNA, 64 nt, hsa
gaggauguaauuccaucauauauacucucugugccuaccgcauuuggaaccaugcgagugauac

SEQ ID NO: 58172 - RNA, 64 nt, hsa
aaaaaauuuuuuuguucucuugcauuuuuuucaacuaccgcaaagcuauacagauuuuuuugua

SEQ ID NO: 58173 - RNA, 64 nt, hsa
cagccucccaaagugcugagauuacaggugugagcuaccgcaccccgccgagguuagcacuuuc

SEQ ID NO: 58174 - RNA, 64 nt, hsa
gucuccaccuugauggagaggccaggcgggagaacuaccgcagcaggugggcguacggacugcu

SEQ ID NO: 58175 - RNA, 56 nt, hsa
gccugaugcaguccuccugaccguuccuaccgcagguccagggccugggcccgcgg

SEQ ID NO: 58176 - RNA, 64 nt, hsa
ccagggugcacgucuccccagguccugggaguggcuaccgcagguaguuucuggagagcacguu

SEQ ID NO: 58177 - RNA, 64 nt, hsa
agagcgucauguccuuggcagaggcagggaagcucuaccgcaaggaccuggagauugugcucug

SEQ ID NO: 58178 - RNA, 64 nt, hsa
ccagagucacacugcgcgucugugcaucucuggccuaccgcaguggccccggcugucugcacau

SEQ ID NO: 58179 - RNA, 64 nt, hsa
ucccagccccugaagcucuaugccaagaacacagcuaccgcacaccacccugaaacagccacag

SEQ ID NO: 58180 - RNA, 64 nt, hsa
ccuccuccgaggacccuuuguguaucuccuccagcuaccgcagagcccacaaacccaggcaucu

SEQ ID NO: 58181 - RNA, 64 nt, hsa
ccucucucuccaggaaugucaccgucucccucuucuaccgcaaugacuccgcccaccugccccu

SEQ ID NO: 58182 - RNA, 64 nt, hsa
gagagcuaaguaaguaaaguuuuauaacuguuagguuucuuaaugaucauauuuugcaguuuua

SEQ ID NO: 58183 - RNA, 64 nt, hsa
uaacauccuuauacuuucuauuuuaaguauaucuguuucuuaaguaaacaacuuagauauuuuc

SEQ ID NO: 58184 - RNA, 64 nt, hsa
agaaggaauuaagaguacacugauaauugcaacuguuucuuauccuaagauucaauauuacguu

SEQ ID NO: 58185 - RNA, 64 nt, hsa
auuuuuaaagauuauuuagugcuaacuuuuaaugguuucuuaaauuuuuugcaauuauuagcug

SEQ ID NO: 58186 - RNA, 64 nt, hsa
gcuuggcaacacgacuugaaauaaauaaaacuuuguuucuuaggagaaaaugauucuguaauuc

SEQ ID NO: 58187 - RNA, 64 nt, hsa
aguauacaccuagaguuuuaauuaccuuuauaauguuucuuaaaagugaaacuuagauacaauu

SEQ ID NO: 58188 - RNA, 64 nt, hsa
auggucauauagcuaguuaucuuguaaaaccaauguuucuuaguucauacuuacaacugcaauu

SEQ ID NO: 58189 - RNA, 64 nt, hsa
cugcaauuucacuuucauuuagaaaagaauaaauguuucuuaauugaacaacuauuuuaucugu

SEQ ID NO: 58190 - RNA, 64 nt, hsa
caacuagaaacagcuccaguguuuuuaagagaauguuucuuaaaaccaauaggaaacuuaagcg

SEQ ID NO: 58191 - RNA, 64 nt, hsa
gccagagaaacugagguaacugucauuagaaaagguuucuuaaaauacucacaaagcuguuauu

SEQ ID NO: 58192 - RNA, 64 nt, hsa
uuuucccuggugccucucacuucguuggugaccaguuucuuaaacugaaagcuuuaauguuaca

SEQ ID NO: 58193 - RNA, 64 nt, hsa
uacuauuuuucuuuccaagucauuuuuguuuuugguuucuuauucaaagaugauaauuuagugg

SEQ ID NO: 58194 - RNA, 64 nt, hsa
ugucaggggaaggagggaaagaucuugaugcaggguuucuuaaccugcagucuaugcacaacac

SEQ ID NO: 58195 - RNA, 64 nt, hsa
ugccuuuucugaccucauauaacacauuauguagguuucuuaucacuuucucuuugcauaauaa

SEQ ID NO: 58196 - RNA, 64 nt, hsa
agaccacaaauaguuaucuuuuaauuacagaagaguuucuuaacuuacuuuuguaaguuuuuau

SEQ ID NO: 58197 - RNA, 64 nt, hsa
cuauauauuucuuaauaaaauaauucucaaauuuguuucuuaugaaucaucucucaaaucuagu

SEQ ID NO: 58198 - RNA, 64 nt, hsa
uccccaacauccuaggcacagcuuucauaacccaguuucuuagguguaagaaacuguuuuuauc

SEQ ID NO: 58199 - RNA, 64 nt, hsa
uucuuuucuagccaaucaucucugaagaguugcuguuucuuacugacaauaaaaaauguucucu

SEQ ID NO: 58200 - RNA, 64 nt, hsa
augugcuauguaccagauaauucuuuagaugaauguuucuuaggauuguaggaaaauuaucuag

SEQ ID NO: 58201 - RNA, 64 nt, hsa
aaauaauuauaucugacugauuuaaaauguucagguuucuuauccaaaucccuuggaacuaugg

SEQ ID NO: 58202 - RNA, 64 nt, hsa
ugcuuccuaaucuuuuuguuguacagggauucagguuucuuauucuuacaacaugauuguuuau

SEQ ID NO: 58203 - RNA, 64 nt, hsa
gauauugugaaaauaagugcaauuuggauuucauguuucuuaauauucauucuuguuucacaaa

SEQ ID NO: 58204 - RNA, 64 nt, hsa
uauuaacuuucuuuuauguaaguaauuuguaaaaguuucuuaaaauuuuugcuuuugcuuauuu

SEQ ID NO: 58205 - RNA, 64 nt, hsa
uugcugaacugucuugaccauugacuaugacacaguuucuuauuuauguaaauacuugcaucac

SEQ ID NO: 58206 - RNA, 64 nt, hsa
ugaucuuuagucuucauuuucugucacucagugaguuucuuacuggaaaugaugacuccugaca

SEQ ID NO: 58207 - RNA, 64 nt, hsa
caauugguacagacauuuuguguaucauuuuuuuguuucuuaauccaauauuccuuuacaaauu

SEQ ID NO: 58208 - RNA, 64 nt, hsa
aaguaugugccuggugugaaaugaucuauggccuguuucuuacacaggaagcccccugaaccuc

SEQ ID NO: 58209 - RNA, 64 nt, hsa
agcaagagagugcacccguuuagcccuggacccuguuucuuacugugugacuuggcuagaguug

SEQ ID NO: 58210 - RNA, 64 nt, hsa
ugauauauuacuuuguuaauaauaguuaacaauaguuucuuauuuucuuucagaguuugggccu

SEQ ID NO: 58211 - RNA, 64 nt, hsa
agaagagccuuuacuaucuuauuggugaugacacguuucuuaaguaggaguuugagugaauuau

SEQ ID NO: 58212 - RNA, 64 nt, hsa
gaaugccucauaaauuaaugauucugaagcuuauguuucuuauucucuguuugcuuuugaacgu

SEQ ID NO: 58213 - RNA, 64 nt, hsa
gaauccugcucuaaaauacacaaggagcuuucuuguuucuuauuaggccucagaaagaagucag

SEQ ID NO: 58214 - RNA, 64 nt, hsa
uuaucucuuaagaccauaugcccccuguuuuaauguuucuuacaucuuguuuuuacucauuucu

SEQ ID NO: 58215 - RNA, 64 nt, hsa
uuagucucuuuuaaguuacaaaaagccaauugauguuucuuauucuuuuuaaauuuuaaauauu

SEQ ID NO: 58216 - RNA, 64 nt, hsa
ccauccuuuuccugagcacagccuggauuuuuauuucugccaugaaacccagcucccaugacuc

SEQ ID NO: 58217 - RNA, 64 nt, hsa
ucagccuguggcuuguggccugugaccugugaccuucugccagaauugucaugccucugaggcc

SEQ ID NO: 58218 - RNA, 64 nt, hsa
cucuacgcucauugcagaaauacuuugaaauagguucugccagucuacaauagcagugaagacu

SEQ ID NO: 58219 - RNA, 64 nt, hsa
cauccaugaagaagguaaaaucccuacgugauccuucugccaaaaugucgaaaucagacccuga

SEQ ID NO: 58220 - RNA, 64 nt, hsa
uuuuuuuuuuuuuuuuuucaaauuuccauguauuuucugccauuuuucagggucuaagauuggu

SEQ ID NO: 58221 - RNA, 64 nt, hsa
guaguggggucaggaauguaggaacugguauccauucugccaauuccaccacccauucaguuug

SEQ ID NO: 58222 - RNA, 64 nt, hsa
auucuaggggcuuauagcuccaauaauggaaugguucugccaucuugaaacccccauucuguuu

SEQ ID NO: 58223 - RNA, 64 nt, hsa
ggaagagcccagaucugaauguaaaacgucucuguucugccagagauggaaaaaauacagguau

SEQ ID NO: 58224 - RNA, 64 nt, hsa
caggccauuucugugaacccuacuccauugugguuucugccacuaucaaaguuccagcuaccug

SEQ ID NO: 58225 - RNA, 64 nt, hsa
gcagugcagccccaggaugccucgcagacgugccuucugccaugauugugaaguucuagccacg

SEQ ID NO: 58226 - RNA, 64 nt, hsa
augugaucucugcacacgcuagcucuccuucgccuucugccaugcuggaaguagccugaggccc

SEQ ID NO: 58227 - RNA, 64 nt, hsa
ugccuugcuuuucuuccucuucccccaaccuaacuucugccaugggaacugguuaaaaacacug

SEQ ID NO: 58228 - RNA, 64 nt, hsa
uucuccaaaggcuuggaguuuucuucugagguuuuucugccagugucuugucugaaggcagacu

SEQ ID NO: 58229 - RNA, 64 nt, hsa
uuuagguuuaagauguaagugaacaauucuuucuuucugccaagaaacaaaguuuuggaugagc

SEQ ID NO: 58230 - RNA, 64 nt, hsa
gccaaacagccaugcaucuauaaaggucaucaucuucugccaccuuuacuggguucuaaaugcu

SEQ ID NO: 58231 - RNA, 64 nt, hsa
uaaagacaaauuuugcauauucucuauuuuacuuuucugccaaaauaaaccuguucuuccuuuu

SEQ ID NO: 58232 - RNA, 64 nt, hsa
cuugaacaaagacauuuauauggguuuauuuucauucugccaaaguaaaacaauacaucaacaa

SEQ ID NO: 58233 - RNA, 64 nt, hsa
agaagagagcccuugguaaccaguuuugcucuucuucugccacuccucccugcuugcaucucgu

SEQ ID NO: 58234 - RNA, 64 nt, hsa
gagaggaaggaugucugcagaacuuuguucuguuuucugccacaaaaaugugaauaguucagag

SEQ ID NO: 58235 - RNA, 64 nt, hsa
gaaaguagcauuccuucgccgaagaaauggugauuucugccaggggcugguagacaagaacugu

SEQ ID NO: 58236 - RNA, 64 nt, hsa
aaauuaggaagcagaaaaacaaaucucuaggagauucugccaaaggauuuuggaaaguagcauu

SEQ ID NO: 58237 - RNA, 64 nt, hsa
cuucacuuaucccacccuacagagaccagcaagguucugccaggccucgagcauccaagcauga

SEQ ID NO: 58238 - RNA, 64 nt, hsa
cuucauuuaucccauccuucagagaccagcaagguucugccaggccccaagcaucugagcauga

SEQ ID NO: 58239 - RNA, 64 nt, hsa
gguuaaguuucagugccagcuagaaaauacugcuuucugccaucgauugggggugguuuuuguc

SEQ ID NO: 58240 - RNA, 64 nt, hsa
ucuggaaaaugcucuugcuguagagagcagcugcuucugccaggguguuggaggugguggagcg

SEQ ID NO: 58241 - RNA, 64 nt, hsa
cugcucccaaaaccgcuggaaggacuggggcacuuucugccacaguagaacacagacagggcuu

SEQ ID NO: 58242 - RNA, 64 nt, hsa
uucacggcaagaccccccucucuuccccacuggguucugccaccaccaggaggauuucaagaaa

SEQ ID NO: 58243 - RNA, 64 nt, hsa
auucugccuggccccauguccucuuggaggauuuuucugccauguagaugcuccauuagcaguu

SEQ ID NO: 58244 - RNA, 64 nt, hsa
gugggcucugggcuugacggucuccagcuccccuuucugccaggaagccaccccuuagcacucc

SEQ ID NO: 58245 - RNA, 64 nt, hsa
cccuccccuuuuaauuuauuucccugacccugccuucugccaugaccccagggccacuagucuc

SEQ ID NO: 58246 - RNA, 64 nt, hsa
gggcccugaaacuguaccaguucugaagaccguuuucugccacacccccacccccagcugacca

SEQ ID NO: 58247 - RNA, 64 nt, hsa
uguauuuuccuauuucccugccaucaucugcuauuucugccacuucucuuagacuccuugucug

SEQ ID NO: 58248 - RNA, 64 nt, hsa
cauccagagcccauucuggaguuuuguuuuuuccuucugccagaugcuuuguguccugucuucc

SEQ ID NO: 58249 - RNA, 64 nt, hsa
ugggaaaaugggcaagcagagugcacagcccucguucugccagcuggagccaagaagcacagag

SEQ ID NO: 58250 - RNA, 64 nt, hsa
ucucaggggcagaagacauggguuccaguucugguucugccacacacccaccggccuugaauuu

SEQ ID NO: 58251 - RNA, 64 nt, hsa
ggcugggcuuuugcuguccucuucucacgcagaguucugccaggagggugugcuguggggguca

SEQ ID NO: 58252 - RNA, 64 nt, hsa
gguuaagcggcaggcaggauugggcuuuucuggcuucugccaugaaauccuggccaugggaccc

SEQ ID NO: 58253 - RNA, 64 nt, hsa
guaguugccuaaauuuaagauuccuacacuuuauuucugccauugaugcuuuuccuaaacccuu

SEQ ID NO: 58254 - RNA, 64 nt, hsa
acacuuacaauauacuggcuuauaaucauuuuuauucugccauaugguuuauuucauauacacu

SEQ ID NO: 58255 - RNA, 64 nt, hsa
cuuauaaauguuagauaugugggaaaggccuuuauucugccaagucauuucgaagacaugaaaa

SEQ ID NO: 58256 - RNA, 64 nt, hsa
cuuauaaauguaagauaugugggaaaggcuuuuauucugccaagucauuucaaauaccugaaaa

SEQ ID NO: 58257 - RNA, 64 nt, hsa
gugaacuugaagaagguugucagcugcagccacuuucugccagcaucugcagccacuuucugcc

SEQ ID NO: 58258 - RNA, 64 nt, hsa
cugcagccacuuucugccagcaucugcagccacuuucugccagcaucugcagccagcaagcugg

SEQ ID NO: 58259 - RNA, 64 nt, hsa
cgaagagaagcacgcuguccccgucucuccuggcuucugccagaaaaucgaacaagugcaauua

SEQ ID NO: 58260 - RNA, 64 nt, hsa
cuggacgccucuccccuggucuggaaucuuccaguucugccagaauuggccuuucccagaugcu

SEQ ID NO: 58261 - RNA, 64 nt, hsa
auaaauguccaugaaaccuucacaauccauguuuuucugccauggcuucagccaguccccccgu

SEQ ID NO: 58262 - RNA, 64 nt, hsa
caagcucuaccuuccguaaaaugcuagaauacaguucugccaaguucuucaccacuuuauauca

SEQ ID NO: 58263 - RNA, 64 nt, hsa
gagcuuacguaguucuaccggcuuugccaugugcuucugccacccugcugagucuguucuggua

SEQ ID NO: 58264 - RNA, 64 nt, hsa
agccugcccagcccccuggucuuugagcucccacuucugccagauguccuaauggugaugcagu

SEQ ID NO: 58265 - RNA, 64 nt, hsa
cgacgauccaaaugccgugugucaccaaccccgcuucugccacuggcggcuucccuucuuggcu

SEQ ID NO: 58266 - RNA, 64 nt, hsa
ugccauucuuggaaacugucccauugcuucguauuucugccaacguagcucugccugccuguca

SEQ ID NO: 58267 - RNA, 64 nt, hsa
cccguggacuacacagcuccugagcuugaucuuuuucugccaugaaguuuaaagauucuaugcc

SEQ ID NO: 58268 - RNA, 64 nt, hsa
uaaauuaagcucuugcuaacuugaaaaaucccuguucugccagcgaagcuuccuccuccucucc

SEQ ID NO: 58269 - RNA, 64 nt, hsa
guaaguuugugguuuguuucugguuuacagugguggcugacaccccuuguaagaaagcauuccu

SEQ ID NO: 58270 - RNA, 64 nt, hsa
ggugcggggccagcugcuaugugguggccgcuguggcugacacugagugaagguguuugaaaug

SEQ ID NO: 58271 - RNA, 64 nt, hsa
cacagcccugagagaugguguugcuagcucagguggcugacacaugggguaugccgggcacugg

SEQ ID NO: 58272 - RNA, 64 nt, hsa
aaggcuaaaaauaacuggugcgcucccuuguguuggcugacacgcgcguucaaagcacuuuugu

SEQ ID NO: 58273 - RNA, 64 nt, hsa
ggggcaggguuagcagauggcagcccuucucuguggcugacaggucacugagugauaagcaugg

SEQ ID NO: 58274 - RNA, 64 nt, hsa
uucuuguagaucuagcuccucagaguuggaggaaggcugacagagaaggucuccucugugcucc

SEQ ID NO: 58275 - RNA, 64 nt, hsa
cucuggaggcugccuguggucuccuuccggcuguggcugacaguggcucuggccaggguugcuu

SEQ ID NO: 58276 - RNA, 64 nt, hsa
aaguaaagagucuauuuauggcugacauauuuacggcugacaaacuccuggaagaagcuaugcu

SEQ ID NO: 58277 - RNA, 64 nt, hsa
caaacagaaaaaaaaaaguaaagagucuauuuauggcugacauauuuacggcugacaaacuccu

SEQ ID NO: 58278 - RNA, 64 nt, hsa
acacauugcaugccuauaucaaaacaucucauguaccccauaaauauauacaccuaauacccac

SEQ ID NO: 58279 - RNA, 64 nt, hsa
uuuguaacacaaauaaaugcuugaggagauggacaccccauauuacaugaugugauuauuacac

SEQ ID NO: 58280 - RNA, 64 nt, hsa
auguacuuagccacaggcagaauagcuuucgaugaccccauagcacuuuguuucuucgccuuga

SEQ ID NO: 58281 - RNA, 64 nt, hsa
gaacaucauccuagagagugugauguucacuauaaccccauaccuacauucccuaaugauacag

SEQ ID NO: 58282 - RNA, 64 nt, hsa
uugggcuaguuagagauccagauucuggauccauaccccauaccuacugaauuagaaacucuag

SEQ ID NO: 58283 - RNA, 64 nt, hsa
aguuugucaggcagagauguuuaugguugaggauaccccauaugaaucugggaaaugggcuagg

SEQ ID NO: 58284 - RNA, 64 nt, hsa
cuggcccaaggcagcgaggcuucuacagucccacaccccauagccgccugggcuggggcuuacu

SEQ ID NO: 58285 - RNA, 64 nt, hsa
ggacugcguuguaugcuuuccauccacucaccuuaccccauagcaucuugcggcccagaaacca

SEQ ID NO: 58286 - RNA, 59 nt, hsa
aggacaaggcuggaggcauuugucaucacuacagauaugcaacuaaaauagacguggag

SEQ ID NO: 58287 - RNA, 59 nt, hsa
uuguggaucaccugaggauccugugaaaauacagauacugauucagugggucugcguag

SEQ ID NO: 58288 - RNA, 59 nt, hsa
gaacaaauaguaaaauccaaaguauuaauuacagauaacuuuucaaaaauucaucauuc

SEQ ID NO: 58289 - RNA, 59 nt, hsa
aacagagugaggccuuuuuaaccugagauuacagauacuuauaaaacccucuauaaaua

SEQ ID NO: 58290 - RNA, 59 nt, hsa
ccaagcccacuggaauuauccuuuaauuuuacagauaccacuugcuguaggcuguggac

SEQ ID NO: 58291 - RNA, 59 nt, hsa
uggauuauggaucugaauagagaaaugcuuacagauaaucauuagcccacauaccagua

SEQ ID NO: 58292 - RNA, 59 nt, hsa
uugcaaggcuuuuaucccugaaaaucauuuacagauaaccacaauuugcugugguauau

SEQ ID NO: 58293 - RNA, 59 nt, hsa
uaaaauuuaagauuuuucuaauaaaagaguacagauaaugggacaguugagagagaugg

SEQ ID NO: 58294 - RNA, 59 nt, hsa
uuccauuccugaauaugcaggcuaauuuguacagauagggauuaaggaauacagacuau

SEQ ID NO: 58295 - RNA, 59 nt, hsa
aauuuuacugaguaggcacagaagaaaaguacagauaggcugaugguuauugccuuauu

SEQ ID NO: 58296 - RNA, 59 nt, hsa
auuugaaauuucuggcugccuuacuuguuuacagauaguuuaagacuauuuaaauuucu

SEQ ID NO: 58297 - RNA, 59 nt, hsa
cugaaguaucugugugcuuccagaaagcuuacagauaaauggguuucaagcacaagaau

SEQ ID NO: 58298 - RNA, 59 nt, hsa
acuuguuuuaauuuuagagaaacuuugaguacagauacugugagcuuacauugaaaaca

SEQ ID NO: 58299 - RNA, 59 nt, hsa
uuucuagaugacauaaaauuuacauuuaauacagauaaguguucuucaguguaauguga

SEQ ID NO: 58300 - RNA, 59 nt, hsa
uauauuuaaaaauauuuuuuuaaauucuuuacagauaauauuauacuuguuacccuuca

SEQ ID NO: 58301 - RNA, 59 nt, hsa
ggcaauuucuuggccauggauguagaaccuacagauaaggugagccaacugcauuagga

SEQ ID NO: 58302 - RNA, 59 nt, hsa
uccauacaacgaaucuauuauucccaucuuacagauaaaacaacugaggcucagggaga

SEQ ID NO: 58303 - RNA, 59 nt, hsa
uauauuugaccaaaauauucugguuuagauacagauauuuacagaaaguagggaggaag

SEQ ID NO: 58304 - RNA, 59 nt, hsa; identical to SEQ ID NO: 58291

SEQ ID NO: 58305 - RNA, 59 nt, hsa
ccaagcccauuggaauuauccuuuaauuuuacagauaccacuugcuguaggcuacggac

SEQ ID NO: 58306 - RNA, 59 nt, hsa
guuauguaggaccuuuggacccaggguccuacagauagauauggugugcccagauuuua

SEQ ID NO: 58307 - RNA, 59 nt, hsa
cagauguuacuggucugugaggaaauaaguacagauacugacaggaagcuuuuauaaac

SEQ ID NO: 58308 - RNA, 59 nt, hsa
uuuuacuccugauagguagaugcagcucuuacagauauuuacuugguaaagugcagugg

SEQ ID NO: 58309 - RNA, 59 nt, hsa
uuuacucacguaccuguuacacuuuagcauacagauagaucauagaucacguuacaagc

SEQ ID NO: 58310 - RNA, 59 nt, hsa
auacagauaucuauaucuauauauauauauacagauauauauauaugacgcgucacaga

SEQ ID NO: 58311 - RNA, 59 nt, hsa
aaaacacaaaaaaagaaaaucuaucuauauacagauaucuauaucuauauauauauaua

SEQ ID NO: 58312 - RNA, 64 nt, hsa
gcccugaagccuccguggaacauucuggaucugacccucccagucucaucuccugacccuccca

SEQ ID NO: 58313 - RNA, 64 nt, hsa
uucuggaucugacccucccagucucaucuccugacccucccacucccaucuccuuaccucugga

SEQ ID NO: 58314 - RNA, 64 nt, hsa
cccgcguucaguauggguugagggucacagaccucccucccaucugggugccugaguuuugacu

SEQ ID NO: 58315 - RNA, 64 nt, hsa
accucugaaaaaaguauaguaucgaguacccguucccucccagaggugggaguaacugcuggua

SEQ ID NO: 58316 - RNA, 64 nt, hsa
gggugggacagggcuucuccugcgggggcgaggccccucccaguaagggcguggcucugggugg

SEQ ID NO: 58317 - RNA, 64 nt, hsa
aggacagggacuucgcagaggcaagcgaccgaggcccucccaaagaggcccgcccugcccgggc

SEQ ID NO: 58318 - RNA, 64 nt, hsa
cagccaggcagcgaguccugccccgcccgcagcucccucccacaccccgccuggccaagaugac

SEQ ID NO: 58319 - RNA, 64 nt, hsa
guugcguuaguuuuuaaucaucaggacuaucucacccucccacuccuguuuuuaaaacucagaa

SEQ ID NO: 58320 - RNA, 64 nt, hsa
caggcaggcuugcucugucccuuccucucugcuucccucccaggccucgccagggcucccuucu

SEQ ID NO: 58321 - RNA, 64 nt, hsa
uggagggggacuggacccagugcccucugcagaccccucccagccgcagcaccaagggcuugcu

SEQ ID NO: 58322 - RNA, 64 nt, hsa
ugcguccuuaccacugaucuggccaagaaugaggcccucccaacacuuucacucccucuccaag

SEQ ID NO: 58323 - RNA, 64 nt, hsa
agcagguggaugcucaagauuacgugcaaggaaucccucccaucugguacuaaaauuucagugu

SEQ ID NO: 58324 - RNA, 64 nt, hsa
cugcugcccagcucuaccccucccagggaccuaccccucccagggaccgaccccuggcccaagc

SEQ ID NO: 58325 - RNA, 64 nt, hsa
guuggccacuggccaugcugcugcccagcucuaccccucccagggaccuaccccucccagggac

SEQ ID NO: 58326 - RNA, 64 nt, hsa
agcacacucagugcagcaagacugaccccugacccccucccagcccucccuaccuuggacagga

SEQ ID NO: 58327 - RNA, 64 nt, hsa
gggaaaggacaggugccgagcccugcauguggagcccucccaccccacccccagauagagggaa

SEQ ID NO: 58328 - RNA, 64 nt, hsa
gggaaggggcgugucccuccucuuccuguagugccccucccauggcccagcagcuuggcugagc

SEQ ID NO: 58329 - RNA, 64 nt, hsa
agggaucuucucccuccccucacccgcugcccagcccucccagcuggugucacucugccucuaa

SEQ ID NO: 58330 - RNA, 64 nt, hsa
ggagguuguggaauuucuuucuucuccccuucuucccucccaaaagcuuagcuauguauaaagu

SEQ ID NO: 58331 - RNA, 64 nt, hsa
uaguggguuuuggaggagggaguggaguaagaugcccucccacuuuuaucaguuuaguaguagu

SEQ ID NO: 58332 - RNA, 64 nt, hsa
aaauuaugaucugacuggaaaacaauccuguauccccucccaaagaaucaugggcuuuuuuuuu

SEQ ID NO: 58333 - RNA, 64 nt, hsa
cugcuuuccaacuccaagcucccuccacaaguuucccucccaggccccccacaccccagugugg

SEQ ID NO: 58334 - RNA, 64 nt, hsa
ucucuguugcuucucuucugguguugcuucuccucccucccauucucucugcaacucccugcgg

SEQ ID NO: 58335 - RNA, 64 nt, hsa
ucaccuggugggccugggcucagcaaacagcccucccucccaguauuucaucaaggacagggaa

SEQ ID NO: 58336 - RNA, 64 nt, hsa
ucccucccaguauuucaucaaggacagggaauaucccucccacacacaggccagcugcucaccc

SEQ ID NO: 58337 - RNA, 64 nt, hsa
guuugacaccugucuacccagagccagugacugucccucccagcagccuccaaaggguccaaag

SEQ ID NO: 58338 - RNA, 64 nt, hsa
ugacuucucugggcugaggcuggucguccuggagcccucccaguaccucgggcugcaagagcug

SEQ ID NO: 58339 - RNA, 64 nt, hsa
cacccagucccucugugggagcccgggugccaggcccucccaacaccacaccacccuccaggcc

SEQ ID NO: 58340 - RNA, 64 nt, hsa
guugaugccuucccagagucaaccuccugugacgcccucccagagccaaccucgggugacaccc

SEQ ID NO: 58341 - RNA, 64 nt, hsa
ugugacgcccucccagagccaaccucgggugacacccucccagagucaaccucaugugacaccu

SEQ ID NO: 58342 - RNA, 64 nt, hsa
ugcccuauacgccgccuucacuccacagccucaccccucccacccccauacugguacugcugua

SEQ ID NO: 58343 - RNA, 64 nt, hsa
ugcugaggaguugacgacagggaguaccacucuccccucccacaaacuucaacuccuccaugga

SEQ ID NO: 58344 - RNA, 64 nt, hsa
auacucccgucacuccuccccacugccgccccuccccucccacucucgucuccuuccccucgcc

SEQ ID NO: 58345 - RNA, 64 nt, hsa
agggcaugcaggcccucagcccgggcugugccagcccucccagccccaggcccaucugagggac

SEQ ID NO: 58346 - RNA, 64 nt, hsa
uuggcuuuuuccuuugucgccuccccagcaccugcccucccagucucccaccccggccccaggc

SEQ ID NO: 58347 - RNA, 64 nt, hsa
uaaaaaaguagcacugauguguuuuguaaucugccccucccagcccuccguggaggcugccagg

SEQ ID NO: 58348 - RNA, 64 nt, hsa
guguguagggggguuucagggcugaaccccaccucccucccaccuuccucccaccucaccuguc

SEQ ID NO: 58349 - RNA, 64 nt, hsa
accccacgggaggaguggcaucuggggcucuuggcccucccaccuggagccuguuacccguuag

SEQ ID NO: 58350 - RNA, 64 nt, hsa
gaggugaagcgaagccacucuuaccucucccuuccccucccaccugcccccugcguaggcaccc

SEQ ID NO: 58351 - RNA, 64 nt, hsa
uuuacuccuuggucugucucgcuuuaucugucgccccucccagcgcugagagccuccccuggcu

SEQ ID NO: 58352 - RNA, 64 nt, hsa
augaaaaauggacagcugcuuuugacaauaaugccccucccaacuucccauucauagaaucaua

SEQ ID NO: 58353 - RNA, 64 nt, hsa
cccuaaucgcuuacaccuaauauaagcuuguccucccucccacacucaucccugcuucuuuggg

SEQ ID NO: 58354 - RNA, 64 nt, hsa
ccucccccgguugccccccacucuaaagccuccucccucccagcguccacuggcuccaggcucc

SEQ ID NO: 58355 - RNA, 64 nt, hsa
cuuuggucagucccuguggucccccaccagcucccccucccauagggcugcccaccaagcccug

SEQ ID NO: 58356 - RNA, 64 nt, hsa
uuuuaaaauuguucuccagcauuuuauggcuccucccucccauguccucagacccagcaaaagc

SEQ ID NO: 58357 - RNA, 64 nt, hsa
cuggcagcccuguugucuggaggguucuuguugucccucccauuagccagggcggagacugucu

SEQ ID NO: 58358 - RNA, 64 nt, hsa
uuccguccagcccggggcagucugacugucggugcccucccaggaacggggaaggccuccgucu

SEQ ID NO: 58359 - RNA, 64 nt, hsa
agaacaacaggaaaccaaggucugaccuaggguucccucccagucuucacaucacucuggccuc

SEQ ID NO: 58360 - RNA, 64 nt, hsa
caggucuucucuucugccaacuaacgugcucgcgcccucccagcacguggagagcuucaauugu

SEQ ID NO: 58361 - RNA, 64 nt, hsa
gcauucgaguuaccuggugagagaccguguugcccccucccacagcucucugcccugcgcguuc

SEQ ID NO: 58362 - RNA, 64 nt, hsa
gugccuagggggugugggguuccguucucccuuccccucccacugaaguuugugcuuaaaaaac

SEQ ID NO: 58363 - RNA, 64 nt, hsa
cucugaggucaggucugaggccaguauccuccagcccucccaaugccaacccccaccccguuuc

SEQ ID NO: 58364 - RNA, 64 nt, hsa
gccuugugggugugagcagcacccauccaccguccccucccagggagcaagggcagggacaggg

SEQ ID NO: 58365 - RNA, 64 nt, hsa
aggcugagcugaaagaggccaaacaggcccuccucccucccagcuccaccccgcaagcaccauc

SEQ ID NO: 58366 - RNA, 64 nt, hsa
ugugugaaauuccagagcuuugggggagaauccacccucccaucaucugcuucccccaaggccu

SEQ ID NO: 58367 - RNA, 64 nt, hsa
ccauccagcuucccuccccuuccuccaaaacccucccucccaccuccccacacccauugaguca

SEQ ID NO: 58368 - RNA, 64 nt, hsa
uucuuguuucaucccugcuucuggacuugggguacccucccaauugccacauccuaucuggucc

SEQ ID NO: 58369 - RNA, 64 nt, hsa
ggguuuaguccguggacauuucagagggagaucccccucccauuuaacuguccucacaggcccu

SEQ ID NO: 58370 - RNA, 64 nt, hsa
gcaagcauuccccuuuaagagcuuccacugcacccccucccaagggacacagcgguaggaaugg

SEQ ID NO: 58371 - RNA, 64 nt, hsa
ucuuucuugaggguugguccuguccccaccuccacccucccacccccuggaagaggaagggccc

SEQ ID NO: 58372 - RNA, 64 nt, hsa
acuggcccccaugauucaauuaccucccccgggucccucccacaacacaugggaauucugagag

SEQ ID NO: 58373 - RNA, 64 nt, hsa
cuggccccccugauucgaugaccucccccugggucccucccacaacaugugggaauuccagaag

SEQ ID NO: 58374 - RNA, 64 nt, hsa
agggagcugaggagcccuuacccucccaccacuccccucccaagacccagccgccgccguugag

SEQ ID NO: 58375 - RNA, 64 nt, hsa
cugggaguccagggagggagcugaggagcccuuacccucccaccacuccccucccaagacccag

SEQ ID NO: 58376 - RNA, 64 nt, hsa
auucacaguuuaauagagacuuccugccuuuauucccucccagggagaggcugaaggaauggaa

SEQ ID NO: 58377 - RNA, 64 nt, hsa
gcagcaucagugggacaagauggacacugggccacccucccaggcaccagacacagggcacggu

SEQ ID NO: 58378 - RNA, 64 nt, hsa
agugacagugggcccagccaccuauuuuaacaagcccucccagugauugugauacauacuaaag

SEQ ID NO: 58379 - RNA, 64 nt, hsa
ucuccaggauccucaugugccucuccucaaagcucccucccaucuguaggagauuagugaggca

SEQ ID NO: 58380 - RNA, 64 nt, hsa
cccuccagacugggucucagagccgugccacccacccucccacacagccggccacagggagaac

SEQ ID NO: 58381 - RNA, 64 nt, hsa
aacaugacgcagcucaauaagggugagggucacucccucccagaagccccgucuggacgagccu

SEQ ID NO: 58382 - RNA, 64 nt, hsa
uggccugggcacccuccugggagcaggccuuccucccucccacccccaauguccuguugguagg

SEQ ID NO: 58383 - RNA, 64 nt, hsa
gcugcccacccuaccugcccugccugccugcugccccucccagccugccaagaaaacgguaggg

SEQ ID NO: 58384 - RNA, 64 nt, hsa
gccugcucgugccuucauucugcagcggcauggucccucccauucuggcuccaccugcagccuc

SEQ ID NO: 58385 - RNA, 64 nt, hsa
ucccaaaugccaccggaaccccagcccuuagcuccccucccaggccucugugggcccuugucgg

SEQ ID NO: 58386 - RNA, 64 nt, hsa
ucaccccgggaccgugggccgaggugacugcagacccucccagggaggcugugcacagacuguc

SEQ ID NO: 58387 - RNA, 64 nt, hsa
cauguggggccugggugggcaggcaggaccugggcccucccacccaucagagcccacucaggac

SEQ ID NO: 58388 - RNA, 64 nt, hsa
ccucccccuucauaaaggccucccuugucaccuucccucccaccccgucucagcccugugcucc

SEQ ID NO: 58389 - RNA, 64 nt, hsa
aggcucagcccuagggaaaggcugcucuugcucucccucccagggcuugaggcucccuauacuu

SEQ ID NO: 58390 - RNA, 64 nt, hsa
uccgcaggccuccaggaguauggguccugcccugcccucccaggaguccagccaggggcugccu

SEQ ID NO: 58391 - RNA, 64 nt, hsa
cuuuacuuuacuuugucccagguuggagucccuacccucccaccucccaccugauaugcagugc

SEQ ID NO: 58392 - RNA, 64 nt, hsa
guuucccagcugcuuccugcucagcugggccacccccucccacccugggguuggggaggagcag

SEQ ID NO: 58393 - RNA, 64 nt, hsa
gcaucuguagugccuugugggguauccaggaacacccucccagcaggggaugggaacccugucc

SEQ ID NO: 58394 - RNA, 64 nt, hsa
ccucccuccuggccucgaccccuaagggcuucgccccucccaggggccuguaacuaagucgggu

SEQ ID NO: 58395 - RNA, 64 nt, hsa
gacaggcagggagggcuuggggcugcaccuccuacccucccaccagaacgcaccccacugggag

SEQ ID NO: 58396 - RNA, 64 nt, hsa
ccaggggcaccuaugagauggccaugcucaaccccccucccagacaggcccucccugucuccag

SEQ ID NO: 58397 - RNA, 64 nt, hsa
uacggucccugcuuagccagcuucuguguguccgcccucccagcuccagcccugcaggccgucu

SEQ ID NO: 58398 - RNA, 64 nt, hsa
agcuggcccaguguaaaaaugucccaaguguagccccucccaccgcagagccuguuucuaacgu

SEQ ID NO: 58399 - RNA, 64 nt, hsa
ucaaaguuugggcugauguaagacuagaggcuggcccucccagauaacagagaaaagggagccc

SEQ ID NO: 58400 - RNA, 64 nt, hsa
gaauacugagcugauggugucauccagcagccuccccucccaagcaaagcuucuaaaacugggg

SEQ ID NO: 58401 - RNA, 64 nt, hsa
uccccgauccaaguuccuagaccucauggcuguccccucccaccagucaccuccacugcacaac

SEQ ID NO: 58402 - RNA, 64 nt, hsa
ccgucucacccccgagcccccuuggagacacccccccucccaaaagccauguccauccagcccu

SEQ ID NO: 58403 - RNA, 64 nt, hsa
uccucuucuccccguacugaccucaacccugaaccccucccauucaacuccccaccuccagccg

SEQ ID NO: 58404 - RNA, 64 nt, hsa
accccucccccauuauucuuucuguccagccccucccucccacuggagcagcuccagagccauu

SEQ ID NO: 58405 - RNA, 64 nt, hsa
gcuaaagaguccggggggaaccaagagccugggucccucccacuacuaucuugggagggagaag

SEQ ID NO: 58406 - RNA, 64 nt, hsa
cccagacucucuucuagggcuucccaccaucagccccucccacuugagacuggucuuugggagg

SEQ ID NO: 58407 - RNA, 64 nt, hsa
uuccaaaggcugggaaaaacuaagcugucccagccccucccauuucuugggcagggcucuuuuc

SEQ ID NO: 58408 - RNA, 64 nt, hsa
gaaggagaagcccagccagccucuacccaucccucccucccaauuaggcugcacuggggccgaa

SEQ ID NO: 58409 - RNA, 64 nt, hsa
agagcagaugggacugucaaaguugugcugcccucccucccacaaacaaaugaauccagcgugg

SEQ ID NO: 58410 - RNA, 64 nt, hsa
ccucaaaccuccucuucugacgugccuuuugcaccccucccauuaggacaaucaguccccuccc

SEQ ID NO: 58411 - RNA, 64 nt, hsa
gccuuuugcaccccucccauuaggacaaucaguccccucccaucugggaguccccuuuucuuuu

SEQ ID NO: 58412 - RNA, 64 nt, hsa
ucuucucuuuccccuccaaccaguucaaucucaucccucccagcagcuccccuuccaccccccg

SEQ ID NO: 58413 - RNA, 64 nt, hsa
cugcucugccccugcccguccccacccagucuugcccucccauccucucaucuauucccccgcu

SEQ ID NO: 58414 - RNA, 64 nt, hsa
uggccacagcccugccuccgcccucaccuacaugcccucccagccccucccaucucuggacgag

SEQ ID NO: 58415 - RNA, 64 nt, hsa
ccugccuccgcccucaccuacaugcccucccagccccucccaucucuggacgaggccuccuucc

SEQ ID NO: 58416 - RNA, 64 nt, hsa
guacuuacugugcugagagcuuuccucgcagaggcccucccaacgaacagcucucucagaagca

SEQ ID NO: 58417 - RNA, 64 nt, hsa
acuguacucucucuccuaccugccucccugcagucccucccauggaugacucaggccucccaga

SEQ ID NO: 58418 - RNA, 64 nt, hsa
aguggccuuggcaaugucugugccaccuccugagcccucccagcauguccucacaugcucaugc

SEQ ID NO: 58419 - RNA, 64 nt, hsa
uuccccuaagcacacagggguuaaagcugugugucccucccaguggcuguggcagugacaguga

SEQ ID NO: 58420 - RNA, 64 nt, hsa
agagagaacgugugugugugugucggugaucacacccucccauccuuccugccuccugccccaa

SEQ ID NO: 58421 - RNA, 64 nt, hsa
cucccuucagcucugggaggcaggcgcagugccccccucccaugggcuggcccaggaccguggg

SEQ ID NO: 58422 - RNA, 64 nt, hsa
cugcccucagcccccgaccuuauuuauuacccuccccucccacacccccaaucuaccuggugau

SEQ ID NO: 58423 - RNA, 64 nt, hsa
caucucaggcacuucugcaucacggaagaccuggcccucccagccguccuggggaugcucaggg

SEQ ID NO: 58424 - RNA, 64 nt, hsa
uauauauauauauauauacacaaaugcacagucccccucccacuccguuaccuaacuguacguc

SEQ ID NO: 58425 - RNA, 64 nt, hsa
aaggcuucucuccaagugugccaggccaggacagcccucccagccaugaauccuuacucagcua

SEQ ID NO: 58426 - RNA, 64 nt, hsa
gcuccugguggggaauggcuggggcugggcaggacccucccacacaccugcacccuagcuucgu

SEQ ID NO: 58427 - RNA, 64 nt, hsa
auccugaggacagaaaaagcugggucuugcugugcccucccaggcuuaguguucccucccucaa

SEQ ID NO: 58428 - RNA, 64 nt, hsa
ccuugggugcaggcagggcugggacacgcggcuucccucccagucccugccuuggcaccgucac

SEQ ID NO: 58429 - RNA, 64 nt, hsa
auugccuuccacauauguaagucucugggcggcgcccucccagcucccugccucuguuucccca

SEQ ID NO: 58430 - RNA, 64 nt, hsa
acaaucaacucaagguacgcccacugcaaggccucccucccaccgcggccccugccuggccacc

SEQ ID NO: 58431 - RNA, 64 nt, hsa
aacccgcccagccucccgcggggccacacacuuccccucccaacacacacacacaccugccauc

SEQ ID NO: 58432 - RNA, 64 nt, hsa
gggacuugaggggggccccagggguucucaggaccccucccaccaccucccagugcuuccacgu

SEQ ID NO: 58433 - RNA, 64 nt, hsa
ccucuucugagcacagauguucccccaucucgcucccucccaggacucugaccccagcauucuc

SEQ ID NO: 58434 - RNA, 64 nt, hsa
ccggaaugccacccacaucuuccauuuccauguccccucccagagcugguggacccagggaaca

SEQ ID NO: 58435 - RNA, 64 nt, hsa
gcuggggaggggcacaggacccugcccucguguucccucccagcccgcaguauuucagggacag

SEQ ID NO: 58436 - RNA, 50 nt, hsa
uggugggagaccacgccugacccucccaucuccccucuguacauagguca

SEQ ID NO: 58437 - RNA, 64 nt, hsa
ccugcauccccacacuucacagcaucuuccaucccccucccaccuucuaggcgaauagucccca

SEQ ID NO: 58438 - RNA, 64 nt, hsa
ggauucccccucaccccaccucugcauggccacccccucccagcccuguggggaaacuguuccc

SEQ ID NO: 58439 - RNA, 64 nt, hsa
cuugccccugaccccccugccgugccucccgcagcccucccaugccguuccacuccucccugcc

SEQ ID NO: 58440 - RNA, 64 nt, hsa
aguugggagaagcccagccccucccccucgagaccccucccaugucccuuccuggccuggccgg

SEQ ID NO: 58441 - RNA, 64 nt, hsa
cccgaugggauggcuuggggggcuccagggggugcccucccagacccccuugcccaggccuccc

SEQ ID NO: 58442 - RNA, 64 nt, hsa
gcaaacagcacaaggcgugagcccaccccgccugcccucccacccccuccccgggcagcagaga

SEQ ID NO: 58443 - RNA, 64 nt, hsa
ccagugccucccucccuccuuccucuacucccaccccucccauguccccccauuccucaaaucc

SEQ ID NO: 58444 - RNA, 64 nt, hsa
cuuccucuuuccccacagccccccagccccucagcccucccagcccacuucugccuguuuuaaa

SEQ ID NO: 58445 - RNA, 64 nt, hsa
cagccugcacuggagucugaggccugggaccccccccucccacccccuaacccauguuucucau

SEQ ID NO: 58446 - RNA, 64 nt, hsa
ccuggcaagcugggggcccaucgccguggggagucccucccaccacccucgccgcaggcagcug

SEQ ID NO: 58447 - RNA, 64 nt, hsa
gccuggaauggcccagaccccagccuccccuccucccucccauccucacccaggccaaggccca

SEQ ID NO: 58448 - RNA, 64 nt, hsa
uuugcccccacaagccuggucaucagccaggcagcccucccagugcccaagggccaccaacccc

SEQ ID NO: 58449 - RNA, 64 nt, hsa
uuauuuuuaguucaguuuaaaauguugauaccuucccucccaggcuccuuaccuuggucuuuuc

SEQ ID NO: 58450 - RNA, 64 nt, hsa
gguggaauauuucauggacaaauuuuuuuuucuccccucccaaauuuaguuccucaucacaaaa

SEQ ID NO: 58451 - RNA, 64 nt, hsa
ccggacagugccucacucaccugggacugguauccccucccaggguccaccaagggcuccugcu

SEQ ID NO: 58452 - RNA, 64 nt, hsa
ggcggggggcgcagcaacgcaucguguggcccuccccucccaccucccuguguauaaauauuua

SEQ ID NO: 58453 - RNA, 64 nt, hsa
aggcagagcccaaucagggucucgugcugcccuucccucccacagccuggcagccauccagagg

SEQ ID NO: 58454 - RNA, 64 nt, hsa
gcucugcaggaugaggaagacaggccaaucccuucccucccagaagcuggccgcccagcaggag

SEQ ID NO: 58455 - RNA, 64 nt, hsa
cccugccgaggugugaccccaccugcucuuuccucccucccaguauggccccaccugcucuuuc

SEQ ID NO: 58456 - RNA, 64 nt, hsa
cggcccagucugcacggcccaucugcuucaccuucccucccagccacgugccaguggccacagc

SEQ ID NO: 58457 - RNA, 64 nt, hsa
cuguucccugggggccagccagggcccuuugugccccucccagcacaggccugaugcagguguc

SEQ ID NO: 58458 - RNA, 64 nt, hsa
gcuggccaugugagcaccccaugaagggaccgcccccucccaaggauggucccuuugggugcag

SEQ ID NO: 58459 - RNA, 64 nt, hsa
uaaccgucuguccuagccccucccuaaucccuggcccucccagcugucugggacuucaguggac

SEQ ID NO: 58460 - RNA, 64 nt, hsa
gcacccuuggccugaguaaacuuggaaaggggcucccucccagagaagggacuacucucuucac

SEQ ID NO: 58461 - RNA, 64 nt, hsa
gugccagggggcucagcugcuucagggaaugugucccucccaccaugggccagagcuucagccc

SEQ ID NO: 58462 - RNA, 64 nt, hsa
caaacuccugaccucaagagauccacucgccuugcccucccaaagugcugggauuacaggcuug

SEQ ID NO: 58463 - RNA, 64 nt, hsa
aagucaaaacuauagccauauccaaaucuuuucccccucccaagaguucucagugucuacaugu

SEQ ID NO: 58464 - RNA, 64 nt, hsa
cccccaccaacucucgcguguuggagagaaggggcccucccagcacaaaguugcauuccucccc

SEQ ID NO: 58465 - RNA, 64 nt, hsa
guggccugagggcugucgagugagcugccccagccccucccagcccuugcccagccugggggag

SEQ ID NO: 58466 - RNA, 64 nt, hsa
ggagggaaggcggagcugaggacagccagcuccgcccucccaaggcugugcguuccugagggcc

SEQ ID NO: 58467 - RNA, 64 nt, hsa
ccccccugcuucaggaacacccgccagggcccaccccucccaccccgucccagcauucgcacuu

SEQ ID NO: 58468 - RNA, 64 nt, hsa
uguuauucaugcuauaaagaguaaacguuugaugaauuagaagagaugcucuuuuccaagcuau

SEQ ID NO: 58469 - RNA, 64 nt, hsa
ucuguuacuguuuaauuucaauucuucuggugagaauuagaaaugaaauauuuuuuauucauug

SEQ ID NO: 58470 - RNA, 64 nt, hsa
cgaggagacagaaacugaaucccacaccuggugcaauuagaagcauaauuagaagcagaagaac

SEQ ID NO: 58471 - RNA, 64 nt, hsa
aacugaaucccacaccuggugcaauuagaagcauaauuagaagcagaagaacaaaaugccacgu

SEQ ID NO: 58472 - RNA, 64 nt, hsa
augaggcaaaagaacuaagacuuuuuucaaacuaaauuagaaaggagugucauuauuugacugu

SEQ ID NO: 58473 - RNA, 64 nt, hsa
uagcucauuacucuaccaccaagaaccuaaaaggaauuagaauacagcagaauuggccucagug

SEQ ID NO: 58474 - RNA, 64 nt, hsa
auuagaagucauuucuaguccucaaagcagaaauaauuagaaauguuaacauuuaagugcuuau

SEQ ID NO: 58475 - RNA, 64 nt, hsa
uaaauacgaauguuaaaacauuucaggucagcaaaauuagaagucauuucuaguccucaaagca

SEQ ID NO: 58476 - RNA, 64 nt, hsa
ggcaccaugguaucauauauuaaaacaauaaugcaauuagaauuugggagaagcaaauauaggu

SEQ ID NO: 58477 - RNA, 64 nt, hsa
aacauuuaugugagguaauuauugcucaacagacaauuagaaaaaaguccacacuugaagccua

SEQ ID NO: 58478 - RNA, 64 nt, hsa
gcuaaaaugcuaaucuuuacuaaauagugagcuaaauuagaauuucuaacucuuauauugugcu

SEQ ID NO: 58479 - RNA, 64 nt, hsa
uuuuaaaggauuguuauuuacuacuuuggauuguaauuagaacaaugcacaucugucuuccaag

SEQ ID NO: 58480 - RNA, 64 nt, hsa
ccuugcauaguguagucaucuauuauuauuguuuaauuagaauauuaaacccuacccuuuaacu

SEQ ID NO: 58481 - RNA, 64 nt, hsa
aaauccucaagcaauaacaagaaaaaaggcccacaauuagaaaaauuuacauuuaaaaaaaaug

SEQ ID NO: 58482 - RNA, 64 nt, hsa
auccuuuugaaaaaguuaagacuauaugaagguaaauuagaaauaaguaugaauauuaauaaaa

SEQ ID NO: 58483 - RNA, 64 nt, hsa
ugagaaauuuuucagaaaguccauuuuuguuuaaaauuagaacuuuucagaaugccaaaugaag

SEQ ID NO: 58484 - RNA, 64 nt, hsa
accuggagccgccgcucaaaaggaggugccuccgaauuagaaaucagaauaaguaaaagguuug

SEQ ID NO: 58485 - RNA, 64 nt, hsa
gacaaucucucuauaugcagagcccuuucaugauaauuagaaugguauggacaaaccaaugaaa

SEQ ID NO: 58486 - RNA, 64 nt, hsa
caagugcaaaacagguguucuuaucuaaaacgucaauuagaaaauuaucugcgguuguuaaucu

SEQ ID NO: 58487 - RNA, 64 nt, hsa
aacuggaauaagcucuaucauauucugaaacaagaauuagaaugacuugagaacgggcaaauaa

SEQ ID NO: 58488 - RNA, 64 nt, hsa
uuaaaugggguguucacagugacuuggauacaccaauuagaaauuaaauaagcaaauauauaua

SEQ ID NO: 58489 - RNA, 64 nt, hsa
uagcuucagaccaaauucaaauugaauuugaauaaauuagaaauacugugcauacauaaccuuc

SEQ ID NO: 58490 - RNA, 64 nt, hsa
aagaaauauauuuauaaagcuuagugaaacacaaaauuagaauguucaugucaggcacaagggu

SEQ ID NO: 58491 - RNA, 64 nt, hsa
cucagagauguuaauaucauguuuuucauguucuaauuagaauacuuuauuacuuacaaacuca

SEQ ID NO: 58492 - RNA, 64 nt, hsa
aagcagucuuaaagggucuuuugcagaugguacaaauuagaacaauuagaauauaguauuuuga

SEQ ID NO: 58493 - RNA, 64 nt, hsa
uaaagggucuuuugcagaugguacaaauuagaacaauuagaauauaguauuuugaguucuagua

SEQ ID NO: 58494 - RNA, 64 nt, hsa
cacaugcacgccgggauuccucugcugccauuugaauuagaagaaaauaauuuauaugcaugca

SEQ ID NO: 58495 - RNA, 64 nt, hsa
aucaucucaauuuuuucaaaugaaaggauucucuaauuagaaauuuauaugucagagcuguuau

SEQ ID NO: 58496 - RNA, 64 nt, hsa
auccagauucuggauccauaccccauaccuacugaauuagaaacucuaggggaugaauaguggu

SEQ ID NO: 58497 - RNA, 64 nt, hsa
agggaguccucagaguugcaguucaauucauuuuaauuagaaaaguaugaaagagguauaacac

SEQ ID NO: 58498 - RNA, 64 nt, hsa
agaucuaaccuggcuuguuuagggccauaccacuaauuagaaaaucugugcuagaaccuguguc

SEQ ID NO: 58499 - RNA, 64 nt, hsa
cuaaaauuuagaguauaaauugucuuauauuucaaauuagaaaaguucaaaugaaguuuaauug

SEQ ID NO: 58500 - RNA, 64 nt, hsa
cauaauuuuaaauuuucuauguuaauauaacauaaauuagaaaaaauaagugauucaaaaugaa

SEQ ID NO: 58501 - RNA, 64 nt, hsa
ucagaauauauuugccaccauggucaauuugauaaauuagaauugggcccaaagccagugagau

SEQ ID NO: 58502 - RNA, 64 nt, hsa
cacuuuacuaaauauaaguacaguaaugaugcauaauuagaaaaugagguauucuagguaaaau

SEQ ID NO: 58503 - RNA, 64 nt, hsa
uaacuuuuguaacuucacuugauaguuuuuaagcaauuagaauggaguuagggaaagaacauau

SEQ ID NO: 58504 - RNA, 64 nt, hsa
cuguauccauuaaaguaacuuuuuuaacuaugagaauuagaaaauaagggacaacagggguuaa

SEQ ID NO: 58505 - RNA, 64 nt, hsa
uuuccaaacaaaucuuucuacgcuuaaaugaucaaauuagaaaaaccaauuccuauaauuaaua

SEQ ID NO: 58506 - RNA, 64 nt, hsa
uuucuugugcuugcuucggcagcauauauacugaaauuagaaaaagaaaacuuuucuuuuuuau

SEQ ID NO: 58507 - RNA, 64 nt, hsa
uauucccaacucacaggcaagcaacuguuagaaaaauuagaaaauuuaaaauggaaauaacaaa

SEQ ID NO: 58508 - RNA, 64 nt, hsa
aauuuuaugacaucuauuauguaucaguuuuaaaaauuagaauuguaugaaauuaagaguuuca

SEQ ID NO: 58509 - RNA, 64 nt, hsa
agguuuuuauuaguaccauaguaccauuuauacaaauuagaaaauguuauuuaacagcugaauu

SEQ ID NO: 58510 - RNA, 64 nt, hsa
uauugcugagagaaauauggaacuuacauuguucaauuagaauaguguucugcaaaaauauuua

SEQ ID NO: 58511 - RNA, 64 nt, hsa
aaacuugaaaaucagcuuuggccaucuaccugagaauuagaaagucugauuuuuggaauuagaa

SEQ ID NO: 58512 - RNA, 64 nt, hsa
caucuaccugagaauuagaaagucugauuuuuggaauuagaaaucaugauuguaggcugggcac

SEQ ID NO: 58513 - RNA, 64 nt, hsa
cuacuuuacuaaauuaauacuccuccuuuuacagaauuagaaaaguuaacauuuaucuuuaggu

SEQ ID NO: 58514 - RNA, 64 nt, hsa
gcugauucacagcuuauuauccaauucaaaaauaaauuagaaaaauauaugcuuacauuuuuca

SEQ ID NO: 58515 - RNA, 64 nt, hsa
uugaaagaaaguguuaaaacugaaggccucacuuaauuagaaacgugauaaauauauggacaaa

SEQ ID NO: 58516 - RNA, 64 nt, hsa
aacuugucaaacuugucaagaaugagaaaagccaaauuagaaaauccuauguccuaguuuccuu

SEQ ID NO: 58517 - RNA, 64 nt, hsa
gcuuguguugcagacacuggagcgauugccuggcccucccuaagcccuauaugccucacucaua

SEQ ID NO: 58518 - RNA, 64 nt, hsa
caaguuggggacggagauggggagcaggucaggcccucccuaggccuguuugugugugauccuu

SEQ ID NO: 58519 - RNA, 64 nt, hsa
uuggauuuuugcaauugguuucaccucaugucucccucccuacaaagcacugccucuacugggc

SEQ ID NO: 58520 - RNA, 64 nt, hsa
ggagaauagucucauaccuugcagucugggacacccucccuacuuugagaauccaccuacagga

SEQ ID NO: 58521 - RNA, 64 nt, hsa
cucccugagagggccaagcagagaguacuggaaaccucccuaccaaaaagacagagacccgccc

SEQ ID NO: 58522 - RNA, 64 nt, hsa
cugucugucccagauaaaggcgcuguucucccauccucccuaccccauccucuccaccaaaucg

SEQ ID NO: 58523 - RNA, 64 nt, hsa
cccuagcacauggggaccccggccucgagggugaccucccuaccccgccccugccagccaccaa

SEQ ID NO: 58524 - RNA, 64 nt, hsa
ucuuuaccuccagggaucagcugugugugugugaccucccuaccgggcuaucggccucuuggga

SEQ ID NO: 58525 - RNA, 64 nt, hsa
ccgcucaggcuuuaucagucaggaaauccuuagcccucccuagaggauuggcuguccccucuau

SEQ ID NO: 58526 - RNA, 64 nt, hsa
gaacuccuggccacaagugugccucccgccuuggccucccuaaguguugggauuauagguguga

SEQ ID NO: 58527 - RNA, 64 nt, hsa
aucuguccucacccugugggaccgccuggcccucccucccuagcccuuccagccugggacacac

SEQ ID NO: 58528 - RNA, 64 nt, hsa
gcccagugccagcuccagugccgcuccugcuuccccucccuacccucggaaaucagugcgaugu

SEQ ID NO: 58529 - RNA, 64 nt, hsa
ucuugcucucgaccggcccugcauucuuccgcacccucccuagcucugaaaucaacucucuucg

SEQ ID NO: 58530 - RNA, 64 nt, hsa
gggcaaagaguaaagauuaaagauuacccccaguccucccuagcucuuccccaucucacucuua

SEQ ID NO: 58531 - RNA, 64 nt, hsa
gggcgugaggacacaaggaggccucugggccacgccucccuaccagaugcaggaacuccuggac

SEQ ID NO: 58532 - RNA, 64 nt, hsa
agccauccuugcacucuccagcgacacucucgcaccucccuaggggaagcuucccucccccugg

SEQ ID NO: 58533 - RNA, 64 nt, hsa
cacuccccgccguacaguucuccagaaucccaggcgaugacaagucugaacccacgaaaauacc

SEQ ID NO: 58534 - RNA, 64 nt, hsa
guguuguuguguuugaaguaaaacuaguuguuaucgaugacaauuuuuaccauaguuuucucag

SEQ ID NO: 58535 - RNA, 64 nt, hsa
auggacgagggcucuccaagggaaugccuggggauucacccagugguccccagaggugcuccau

SEQ ID NO: 58536 - RNA, 64 nt, hsa
agacccaaccccuagcugggccaacuccagugaauucacccauuuuucuucuucagaaggccuu

SEQ ID NO: 58537 - RNA, 64 nt, hsa
uucuagaaaguuauuuucaacugauaaaucuauauucacccaaauaaucaagggugaagguaaa

SEQ ID NO: 58538 - RNA, 64 nt, hsa
gucaggcuagucucgaacucgugaccgcaagcgauucacccaccucagccucccaaagugcugg

SEQ ID NO: 58539 - RNA, 64 nt, hsa
uauuggcuuuacguaacaauauuguuccuguccauucacccagccaaauuguguuaaagaggaa

SEQ ID NO: 58540 - RNA, 64 nt, hsa
gauaacucuguccuuccauuugcucacuucucucuucacccaucuuuuuuaaaaacaaauaaau

SEQ ID NO: 58541 - RNA, 64 nt, hsa
auuguuaacacacuugugaugugucagccacagauucacccaggaggucacagaaugacagcaa

SEQ ID NO: 58542 - RNA, 63 nt, hsa
ucuucauaaaacauuugaaaauaaaagaucauucuucacccauauguucuuuggauucuggca

SEQ ID NO: 58543 - RNA, 64 nt, hsa
cauccaacuucaugccaguucccuucuuuauagaagagugaagggaaagacuuccuggguuuga

SEQ ID NO: 58544 - RNA, 64 nt, hsa
ccuauauauucucugaaugcaauaaagggacuuaagagugaacaagaguaaugguguggaagug

SEQ ID NO: 58545 - RNA, 64 nt, hsa
cugagaaaugucauaaaauacaauccagguucugagagugaaugcauugggcacuuuaaguuga

SEQ ID NO: 58546 - RNA, 64 nt, hsa
ugugaagcaauuaaucgaauguuucagaaggagcagagugaauuaguagcacaaguaagugacu

SEQ ID NO: 58547 - RNA, 64 nt, hsa
acuugcuuauauugacaacaaaucaucucgcuaaagagugaauguaggccaggcgcgguggcuc

SEQ ID NO: 58548 - RNA, 64 nt, hsa
acuccgucucaaaaaaaaaaaaaaaaaaaaaaaaagagugaauguaauagucuugcagaaaaug

SEQ ID NO: 58549 - RNA, 64 nt, hsa
uuagaggacaaauaaggugacagguacuaagagaagagugaauuaagugaaaaucuucccuuug

SEQ ID NO: 58550 - RNA, 64 nt, hsa
agagaucgugccauugcacuccagccugggaacaagagugaaacucucaaaagcagaaacaaaa

SEQ ID NO: 58551 - RNA, 64 nt, hsa
aaaaauugcaaaucuacagcaaaaguaaaacaguagagugaacaccauguaacccucaccuggu

SEQ ID NO: 58552 - RNA, 64 nt, hsa
gcugagaugccaccaccacaccagccugggugacagagugaaacucguaucuccaaacaaacaa

SEQ ID NO: 58553 - RNA, 64 nt, hsa
gaagaaaaagauauguaaggucuuuuagcuccuuagagugaagcaaaagcaagacuucaaccuc

SEQ ID NO: 58554 - RNA, 64 nt, hsa
ucuacagauaauuaguggauuguguuguuuguugagagugaagguuucuuggcaucuggugccu

SEQ ID NO: 58555 - RNA, 64 nt, hsa
gguaggauaucuuggcuuugccacacacaguuacagagugaacacucuacuacaugugacuggc

SEQ ID NO: 58556 - RNA, 64 nt, hsa
uugcagggaagccccacuugaaggaagaagucuaagagugaaguaggugugacuugaacuagau

SEQ ID NO: 58557 - RNA, 64 nt, hsa
gaacacgcauacaggcucuagucaagaaugaauuagagugaaggaaagcugugugacaccuggc

SEQ ID NO: 58558 - RNA, 64 nt, hsa
acagaguuauauuuccucacaaacuucuuugugaagagugaaauguguuucuguaccucugggu

SEQ ID NO: 58559 - RNA, 59 nt, hsa
uuggauaccuguaucucuaaguguugcucagagugaagagugaagagcauuugguacac

SEQ ID NO: 58560 - RNA, 64 nt, hsa
ggauaccuguaucucuaaguguugcucagagugaagagugaagagcauuugguacacacuugac

SEQ ID NO: 58561 - RNA, 64 nt, hsa; identical to SEQ ID NO: 58558

SEQ ID NO: 58562 - RNA, 64 nt, hsa
gaacaggcauacaggcucuagucaagaaugaauuagagugaaggaaagcugugugacaccuggc

SEQ ID NO: 58563 - RNA, 64 nt, hsa
gcagaguuguauuuccucacaaacuucuuuacgaagagugaaauacguuuuuguaccucucauu

SEQ ID NO: 58564 - RNA, 64 nt, hsa
aaacaggcauacaggcucuagucaagaaugaauuagagugaaggaaagcugugugacaccuggc

SEQ ID NO: 58565 - RNA, 64 nt, hsa
cuucugcccugccugacgauguaucgaaaagaugagagugaaggagacuuugugcagcaggaaa

SEQ ID NO: 58566 - RNA, 64 nt, hsa
aagaucauacuacugcacuccagccugggcgacaagagugaaacuccaccucaaaaaaaaaaaa

SEQ ID NO: 58567 - RNA, 64 nt, hsa
cauucauaaacacagaguguagagugaaaacacuagagugaaaacacaugcuacaaugaggcag

SEQ ID NO: 58568 - RNA, 64 nt, hsa
uagcucaggcuauucauucauaaacacagaguguagagugaaaacacuagagugaaaacacaug

SEQ ID NO: 58569 - RNA, 64 nt, hsa
gaccagcaugggggcagguuaucuguuggccugaagagugaaaccuguaccaggccaaagguga

SEQ ID NO: 58570 - RNA, 64 nt, hsa
ugagggcgugagugagggcaggaguguuuauggcagagugaaguucugugcccaccacaagagg

SEQ ID NO: 58571 - RNA, 64 nt, hsa
ugcagaaccagggguuuauauugcagggaguguauuuucugaauucuaagucagaacaagcagu

SEQ ID NO: 58572 - RNA, 64 nt, hsa
uggagcaccucggccugggacccucaguguaggguuuucugacucuuaggcaacuuccuagggu

SEQ ID NO: 58573 - RNA, 64 nt, hsa
aacuuucuucucuuccccuuccccacccgaauucuuuucugaaguugcuggcauuugggucaag

SEQ ID NO: 58574 - RNA, 64 nt, hsa
caaauuuggaggaaacaacugaaguugugcaauauuuucugauaauugcuuuuuuuauucuugu

SEQ ID NO: 58575 - RNA, 51 nt, hsa
augaugaagcuaacacuugaauuuucugaagucuagcuuaacaucuuuggu

SEQ ID NO: 58576 - RNA, 64 nt, hsa
ccuuuuugaaucgagguuuuuuuguuuuguuuuguuuucugaaaaaaucauacaacuuugugcu

SEQ ID NO: 58577 - RNA, 64 nt, hsa
cgcaagcuuugagugggacaccauucugaauuuuuuuucugaauuuuuuuuuaacaucucuuuc

SEQ ID NO: 58578 - RNA, 64 nt, hsa
accucaucgggauugucuuuuuuuuuuuuaauuauuuucugagacuuggauuaauucaugguau

SEQ ID NO: 58579 - RNA, 64 nt, hsa
uagacauacagagauauacaaauauauuauauauuuuucugagauuuuugauaucucaaucugc

SEQ ID NO: 58580 - RNA, 64 nt, hsa
aagaagugaguugugucaauuauuguagauacaauuuucugauuaaaucuggaaaaauaaaagg

SEQ ID NO: 58581 - RNA, 64 nt, hsa
cuauauauaguaggaggggguaugugucucaggcuuuucugaaguugcaagacuuaaagaaaua

SEQ ID NO: 58582 - RNA, 64 nt, hsa
auuuaagacauccaaucaauaaugaaggaaauuuuuuucugaauguagguuugagugaggggca

SEQ ID NO: 58583 - RNA, 64 nt, hsa
aaaauaagcaaguuaagcuucaggguccuagaauuuuucugauuucuauaauccuucagcagaa

SEQ ID NO: 58584 - RNA, 64 nt, hsa
cuuuuuuccccucuuccccuucccgucuuguguuuuuucugaaccccacaucugccaucauuuc

SEQ ID NO: 58585 - RNA, 64 nt, hsa
ucaugguuaccccauuuguuaaugagcauuaauguuuucugaacacuuccaaagauuaaucaaa

SEQ ID NO: 58586 - RNA, 64 nt, hsa
acaugaaugaacaggaaaagauguaaaaacauuuuuuucugagaugaaaacauauuaauuaaac

SEQ ID NO: 58587 - RNA, 64 nt, hsa
guauaauuuuacacaguacucaaagcuuguuaucuuuucugaccauuuuaguacagaauuagua

SEQ ID NO: 58588 - RNA, 64 nt, hsa
aauguuuuguuccuuuguccugacuuaaaggcaguuuucugaagaacucuugacucuugcuccu

SEQ ID NO: 58589 - RNA, 64 nt, hsa
uaugaauuuuacauuuuuccucaccauuuagcaauuuucugaaugguaauaaugucuaaaucuu

SEQ ID NO: 58590 - RNA, 64 nt, hsa
uuuuuuauugcucugguggauuuuuguggcuggguuuucugaagucugaggaacaaugccuuaa

SEQ ID NO: 58591 - RNA, 64 nt, hsa
acugcuuuacauagaccucuacaaguagggaauguuuucugaagcagaaguuaaaauggacagc

SEQ ID NO: 58592 - RNA, 64 nt, hsa
uuuaccugaugucauuguuucuuauaauaaaaccuuuucugauugaaaacuuccaguguugcaa

SEQ ID NO: 58593 - RNA, 64 nt, hsa
caauuccacaagcaaaagcucuaauuuaaccagauuuucugacauugaaggcuuauuuucccca

SEQ ID NO: 58594 - RNA, 64 nt, hsa
gaaagcaucucacauugguuuucuuucuuguaucuuuucugaaacuccuugcuguaaggcagcu

SEQ ID NO: 58595 - RNA, 64 nt, hsa
uaaauccugaugcugaccaucugaaauguacuuuuuuucugaaugcuguuucaaucuaaaauag

SEQ ID NO: 58596 - RNA, 64 nt, hsa
uaaugacauuuuuauuuuguguauuaguuuuugcuuuucugagcuuuuuaaagucuaacaaauc

SEQ ID NO: 58597 - RNA, 64 nt, hsa
gcaauaguugauuuugaugccuuuguagaauauuuuuucugaauccuuaugcucuuuuaaagcc

SEQ ID NO: 58598 - RNA, 64 nt, hsa
uuuuggguuuuuuuuuuuuuaagaggggcaaguguuuucugaaaugaugcauauuuuaagacuc

SEQ ID NO: 58599 - RNA, 64 nt, hsa
auccacuuauccaucuuaagaucuguagcugggauuuucugacuuguaaugagcagggggauug

SEQ ID NO: 58600 - RNA, 64 nt, hsa
uauuugggauucuugcuuauuuuuccgccuguguuuuucugagaacuuauuccugaugaucaau

SEQ ID NO: 58601 - RNA, 64 nt, hsa
uuauccugacgucuugggucuuuuaaguauauacuuuucugaaagguauccauuuuguaggcuu

SEQ ID NO: 58602 - RNA, 64 nt, hsa
cuuuuguuuuauaaaagcucuagauaaaacuuucuuuucugaucaugaaucaaguaucuguggu

SEQ ID NO: 58603 - RNA, 64 nt, hsa
uacuacuuaaugauuuuggugcaggaaccugagauuuucugauuuauauuucaugauauuucac

SEQ ID NO: 58604 - RNA, 64 nt, hsa
auauuuuuuaccauaugaaaauugcaguagcuaauuuucugauuuccuauuuuauaaugauaca

SEQ ID NO: 58605 - RNA, 64 nt, hsa
ugggaucugagacuuuucuuuguuuagcaccccguuuucugaguacauacugaucuuucauaau

SEQ ID NO: 58606 - RNA, 64 nt, hsa
uaauauuucuccaucauggccuuuuacuucacaauuuucugaagucugaauucaauuacaauuu

SEQ ID NO: 58607 - RNA, 64 nt, hsa
caugcuuauguuuauaaguuuugagauuuuuuuuuuuucugaaaaggauaccaaagugcgauaa

SEQ ID NO: 58608 - RNA, 64 nt, hsa
caagacagaacuuugucacuucagugcaguacauuuuucugaaagcuacccauaaaaucacuuu

SEQ ID NO: 58609 - RNA, 64 nt, hsa
gcuuggggauuauuuuaaauaauugguuuuuguguuuucugaauuaccauuuuuucaagaaugu

SEQ ID NO: 58610 - RNA, 64 nt, hsa
auacuuuauguuaacaggguuauuacaaagcacauuuucugaaucugcaaucauuccuuugaca

SEQ ID NO: 58611 - RNA, 64 nt, hsa
aagaaauaucuaagcuguacaugguacacuagaauuuucugaaagcagaaaacguucagauuuu

SEQ ID NO: 58612 - RNA, 64 nt, hsa
auuuuaacacacagaagugcaacuuucugcuuuauuuucugaauuucacauuacuuuuacuuaa

SEQ ID NO: 58613 - RNA, 64 nt, hsa
gcucucaaacacuaaaguccuuaauggcaaggucuuuucugauagcuucauggauaguauugau

SEQ ID NO: 58614 - RNA, 64 nt, hsa
uuagcucagggccugacuguauuuuucauccaucuuuucugaagugucuuugggcaguauguag

SEQ ID NO: 58615 - RNA, 64 nt, hsa
cuacuuugauuugggguuuugauuaauucuuuauuuuucugaaaaaaaguuuaaauaaugucug

SEQ ID NO: 58616 - RNA, 64 nt, hsa
aaaggauauuaguuacccaagagauccaauuuguuuuucugaugaauaguguucaguaaaauga

SEQ ID NO: 58617 - RNA, 64 nt, hsa
cccuuuaacuucuagguuuuguucaagaaguucauuuucugaguaaaagguauuuucauauaug

SEQ ID NO: 58618 - RNA, 64 nt, hsa
ugccccugacucuuacauuuaucuuucuaaaucauuuucugaagcugacuugcucuagggugcu

SEQ ID NO: 58619 - RNA, 64 nt, hsa
uacuaaacucuaccaagaauggaaacaaagaauauuuucugaagauuuuuuugaagauuaauuu

SEQ ID NO: 58620 - RNA, 64 nt, hsa
aaaauuggggauucuuaaaguugaauuuauuggcuuuucugauccaguuuuguuuggaccaaaa

SEQ ID NO: 58621 - RNA, 64 nt, hsa
gaagugagugaguuggguguauugugcgcuaaacuuuucugauagaggaagccugauuaaagaa

SEQ ID NO: 58622 - RNA, 64 nt, hsa
uaagcuuuuaaaauaauucaauggauauacauuuuuuucugaagauuaagauuuuaauuauuca

SEQ ID NO: 58623 - RNA, 64 nt, hsa
auuuuucuuaauuguuauuuuuuauaaucauuauuuuucugaaccauucuucuggccucagaag

SEQ ID NO: 58624 - RNA, 64 nt, hsa
caguuagcugcugaacaguaugaugauuuggggauuuucugaaucauuuguacuuagauacugg

SEQ ID NO: 58625 - RNA, 64 nt, hsa
caugcuguccuugaagcagcuauuugaagauguguuuucugaggaaaacaggcuacaacuguuu

SEQ ID NO: 58626 - RNA, 64 nt, hsa
uuguuacaugaauaauuuguggaccagggauugcuuuucugaaggcaguauagggaacaugaau

SEQ ID NO: 58627 - RNA, 64 nt, hsa
uugaguaaaaugagaaaguuaauauguggccuccuuuucugaagccagaucaaacuguuaccuu

SEQ ID NO: 58628 - RNA, 64 nt, hsa
acgucuucucugccuuguuagugcauauuuuuacuuuucugauacuguaaagaauauauccagu

SEQ ID NO: 58629 - RNA, 64 nt, hsa
auuggaauguuuuuccccgauuguggaugacuucuuuucugauggagagaguccaggagggaug

SEQ ID NO: 58630 - RNA, 64 nt, hsa
uuaaguauaaccauguaagaauuauaaauuuuaguuuucugaacccuuaaacuuuuuuagcaug

SEQ ID NO: 58631 - RNA, 64 nt, hsa
uuuaaguauuuuaaguauauauuacuuauuuuaauuuucugacuuuacuauuuuaagggccaga

SEQ ID NO: 58632 - RNA, 64 nt, hsa
cagaaacaggacugcucaaaugauccuauuuguauuuucugaugcuaucagacucuaauguuuu

SEQ ID NO: 58633 - RNA, 64 nt, hsa
cugcgacugaaacaaacagguucauagagaugaauuuucugagaaacauauaucuacauguugu

SEQ ID NO: 58634 - RNA, 64 nt, hsa
cagcccucauuguuuuaggaaucucucucagguuuuuucugaccuaaaccagcaggaagucguc

SEQ ID NO: 58635 - RNA, 64 nt, hsa
cugggcuguaagcaccaucacuugcuuuuuuuuuuuuucugauuucacaagugugguguuuucc

SEQ ID NO: 58636 - RNA, 64 nt, hsa
aaggcccuuuccuuuggaacaagacagccuucacuuuucugaguucuugaagcauuucaaagcc

SEQ ID NO: 58637 - RNA, 64 nt, hsa
agcuuuacgcucaucaccuaaacuuguacuuuauuuuucugauagaaaugguuuccucuggauc

SEQ ID NO: 58638 - RNA, 64 nt, hsa
cuuucuucuuaaccuauuuauuucuuuguuaaauuuuucugauuguuuccuuuauagagugucu

SEQ ID NO: 58639 - RNA, 64 nt, hsa
gugugacauuccaggggucguuugcuuuucaggguuuucugagggaaagugcauaugaaauccu

SEQ ID NO: 58640 - RNA, 64 nt, hsa
aggaccaggagccuccauauccugacugaaaaccuuuucugagacuuagaguaacagugcuuuu

SEQ ID NO: 58641 - RNA, 64 nt, hsa
augugccuuaccuccagagagucuuuuuuuuuuuuuuucugagauggaguuucacucuuguugc

SEQ ID NO: 58642 - RNA, 64 nt, hsa
uuguuuucuuuggcguaucuaaccccuucuuuuguuuucugagaccugguaacccacgcucuug

SEQ ID NO: 58643 - RNA, 64 nt, hsa
agggauguaaccacauccacucagaggacacuacuuuucugaaagcucuggggugacuaaugau

SEQ ID NO: 58644 - RNA, 64 nt, hsa
uuuggcauccuacauaauaccccccuucuugacuuuuucugauaauuagcugauauucaugguu

SEQ ID NO: 58645 - RNA, 64 nt, hsa
uuuguauaagcacuccuugaagaauaucuaagcuuuuucugagaugggcuuuuaaaauuauaau

SEQ ID NO: 58646 - RNA, 64 nt, hsa
gugcuacaggaaacaagcacacucaagaaaguuuuuuucugaauaacauuuuuuuccaauuucu

SEQ ID NO: 58647 - RNA, 64 nt, hsa
uaaaagaaaaaaauguucaaaugagagagcuuucuuuucugagguuaauauaaagaguaucaaa

SEQ ID NO: 58648 - RNA, 64 nt, hsa
agauucaggugguuuauuaauuacauuuaaaaaguuuucugaaaaaacuuuugcaauaaaaaaa

SEQ ID NO: 58649 - RNA, 64 nt, hsa
auaacucauguggacuucaaugcagacuucacauuuuucugaccuuuacuccuacgguaaauca

SEQ ID NO: 58650 - RNA, 64 nt, hsa
uacuguccgguggacaaaaugacaauugauauguuuuucugauauaauuacuuuagcugcacua

SEQ ID NO: 58651 - RNA, 64 nt, hsa
agaagcaaaucccuguggagacuauaccacuauuuuuucugagauuaauguacucuuggagccc

SEQ ID NO: 58652 - RNA, 64 nt, hsa
uagcaccuuagcuaauuaaucugcauaugaagcauuuucugauauauuuaauaagagguauaga

SEQ ID NO: 58653 - RNA, 64 nt, hsa
uccauggauuauuuuuauaugauuuguacaaauuuuuucugaaauuuaaauugacaagcaaugu

SEQ ID NO: 58654 - RNA, 64 nt, hsa
ucuugggcacaucuguggccaucgcuggguccauuuuucugacugugaaguaaggagagacguc

SEQ ID NO: 58655 - RNA, 64 nt, hsa
cagaaauagugugagccacauaugugacuuuaaauuuucugacagucacauuucaaaaaguaaa

SEQ ID NO: 58656 - RNA, 64 nt, hsa
uuuucccagauuuacaagccacuggagaccccuuuuuucugauacaaugcacgauucucugcgc

SEQ ID NO: 58657 - RNA, 64 nt, hsa
aauucuuaucucuagcuugguuuccacaugagguuuuucugagaagggcuugggacaagaaguc

SEQ ID NO: 58658 - RNA, 64 nt, hsa
uuuaaaagucaaguuuaauuucaaaaaaccuuuuuuuucugagauuacuuuugggguaauauuu

SEQ ID NO: 58659 - RNA, 64 nt, hsa
cguucauacaaaauggucuuacaucuauguaaaauuuucugauucaucuauuugaaaacauuac

SEQ ID NO: 58660 - RNA, 64 nt, hsa
auucauauuuauuuguccacuugaagccauauuauuuucugauuuauuuucuuaagugccaaug

SEQ ID NO: 58661 - RNA, 64 nt, hsa
uauucuggaaaaaccuauuguuuugaucuucuuguuuucugacuuggaaguauccuuucaaaaa

SEQ ID NO: 58662 - RNA, 64 nt, hsa
auuaaguagaguagcuucuuuaugauaaagacaauuuucugaaaagugaacaauucuguuaaaa

SEQ ID NO: 58663 - RNA, 64 nt, hsa
uugcaaauuaagggaaauuuaggucaucauuugauuuucugaaaucuaaaaggaacugaccauc

SEQ ID NO: 58664 - RNA, 64 nt, hsa
uuaauaaauauuuguuuaauaaugggauguuuuauuuucugauguacaaagcuugauuaccaua

SEQ ID NO: 58665 - RNA, 64 nt, hsa
cuuuugaguaagaguauugcuauaacauauauuuuuuucugaaauguuuuaaaauagaaguaca

SEQ ID NO: 58666 - RNA, 64 nt, hsa
gauaucaggcauuaguugccuuauuugugagaaauuuucugagggcuuuuuuuuuuuuuggugg

SEQ ID NO: 58667 - RNA, 64 nt, hsa
cagcuuuaagucauucaagagaaccucaggcuguuuuucugacagugaugauaugauauacaga

SEQ ID NO: 58668 - RNA, 64 nt, hsa
guguuccuaauuugguauuacauguauucuauuuuuuucugaaugauagcaugaaaagugucaa

SEQ ID NO: 58669 - RNA, 64 nt, hsa
gccuuaggcacaggugguuuugaaaucuggggcuuuuucugauuuauuuuucugacuuguuggg

SEQ ID NO: 58670 - RNA, 64 nt, hsa
gugguuuugaaaucuggggcuuuuucugauuuauuuuucugacuuguugggggagagaauauuc

SEQ ID NO: 58671 - RNA, 64 nt, hsa
cuuucugaaucuggacaaagucgacuuaacagauuuuucugaugagcauguuuuaugaauccuc

SEQ ID NO: 58672 - RNA, 64 nt, hsa
uuacuuaaucucuuccccuauccuucuaaauuaauuuucugaaguuggaguguagucuuuuccc

SEQ ID NO: 58673 - RNA, 64 nt, hsa
aauaaaugcuauggcuuaucacaguuacaauguguuuucugaaaguaaagauuauuuuaccuug

SEQ ID NO: 58674 - RNA, 64 nt, hsa
cuggaugaauuuuauaaaaugaauuuuguaauuuuuuucugagaaaaaaaaguucuuaaauaca

SEQ ID NO: 58675 - RNA, 64 nt, hsa
uguaaagaucuuuugccuucaaauuuggcuuauuuuuucugauuuaugaggguuugaaagaaag

SEQ ID NO: 58676 - RNA, 64 nt, hsa
uaaucaggguagcauuaaaauggagaaaagaaaguuuucugaaaaaaugcaguaaauauaagcc

SEQ ID NO: 58677 - RNA, 64 nt, hsa
cuaagagggaaaacugcaucucagcauuuucauuuuuucugaauauuaagugaaaagcaaguuc

SEQ ID NO: 58678 - RNA, 64 nt, hsa
aaugcagucauuugcacgugaguucucaucuuuguuuucugaaacagacguuucuuuuaguaag

SEQ ID NO: 58679 - RNA, 64 nt, hsa
ggacugugcuguuuccuccgcccccacucccguguuuucugaccuccugccugaguuuggggua

SEQ ID NO: 58680 - RNA, 64 nt, hsa
ccugccugaguuugggguauuuauagacuauuaauuuucugacugagccaauagugguugggga

SEQ ID NO: 58681 - RNA, 64 nt, hsa
ggauugaagaguucuaagcauaaaauaaguggcauuuucugacuucuuccuccuccuccuuccc

SEQ ID NO: 58682 - RNA, 64 nt, hsa
uuuaucucaaaaugccgaacgagaaaacuguccauuuucugagacccccagaaaggaaacugac

SEQ ID NO: 58683 - RNA, 64 nt, hsa
ugucaacuccuuggggugcugaucucgaguguuauuuucugauugugguguugagaguugcacu

SEQ ID NO: 58684 - RNA, 64 nt, hsa
cccugcucuugguucuccucuagauugaaguuuguuuucugaugcuguucuuaccagauuaaaa

SEQ ID NO: 58685 - RNA, 64 nt, hsa
ugguuuuaauaaaauaauaaaauuuccccuaaucuuuucugaaucuucugaaaccaaauguaac

SEQ ID NO: 58686 - RNA, 64 nt, hsa
uaucguccagugacuuucaggaauugcccauuguuuuucugauauguuuguacaagauugucau

SEQ ID NO: 58687 - RNA, 64 nt, hsa
gugcauaauugaguuuucuauaaaugccuucguguuuucugagcagaauguacgaggugugcca

SEQ ID NO: 58688 - RNA, 64 nt, hsa
aggauguuagaaaugucuuaguucaaggacauauuuuucugaauaccucccuuacugaagcauu

SEQ ID NO: 58689 - RNA, 64 nt, hsa
uuauccuguuaucacaccaacaguugauuauauauuuucugaauaucagccccuaauaggacaa

SEQ ID NO: 58690 - RNA, 64 nt, hsa
uaagcuauucacgacucaaaauauucuaaaauauuuuucugacaguauaguguauaaauguggu

SEQ ID NO: 58691 - RNA, 64 nt, hsa
ugaugccagucagagccaggccagauggaaauuguuuucugauguuacugguuuucuuuucccu

SEQ ID NO: 58692 - RNA, 64 nt, hsa
uuuguagaaagcacagauaagugguaaauggucuuuuucugacuuucauuauguggacuggaug

SEQ ID NO: 58693 - RNA, 64 nt, hsa; identical to SEQ ID NO: 53190

SEQ ID NO: 58694 - RNA, 64 nt, hsa; identical to SEQ ID NO: 53191

SEQ ID NO: 58695 - RNA, 64 nt, hsa; identical to SEQ ID NO: 53192

SEQ ID NO: 58696 - RNA, 64 nt, hsa; identical to SEQ ID NO: 53193

SEQ ID NO: 58697 - RNA, 64 nt, hsa; identical to SEQ ID NO: 53194

SEQ ID NO: 58698 - RNA, 64 nt, hsa; identical to SEQ ID NO: 53195

SEQ ID NO: 58699 - RNA, 64 nt, hsa; identical to SEQ ID NO: 53196

SEQ ID NO: 58700 - RNA, 64 nt, hsa; identical to SEQ ID NO: 53197

SEQ ID NO: 58701 - RNA, 64 nt, hsa; identical to SEQ ID NO: 53198

SEQ ID NO: 58702 - RNA, 64 nt, hsa; identical to SEQ ID NO: 53199

SEQ ID NO: 58703 - RNA, 64 nt, hsa; identical to SEQ ID NO: 53200

SEQ ID NO: 58704 - RNA, 64 nt, hsa; identical to SEQ ID NO: 53201

SEQ ID NO: 58705 - RNA, 64 nt, hsa; identical to SEQ ID NO: 53202

SEQ ID NO: 58706 - RNA, 64 nt, hsa; identical to SEQ ID NO: 53203

SEQ ID NO: 58707 - RNA, 64 nt, hsa; identical to SEQ ID NO: 53204

SEQ ID NO: 58708 - RNA, 64 nt, hsa; identical to SEQ ID NO: 53205

SEQ ID NO: 58709 - RNA, 64 nt, hsa; identical to SEQ ID NO: 53206

SEQ ID NO: 58710 - RNA, 64 nt, hsa; identical to SEQ ID NO: 53207

SEQ ID NO: 58711 - RNA, 64 nt, hsa; identical to SEQ ID NO: 53208

SEQ ID NO: 58712 - RNA, 64 nt, hsa; identical to SEQ ID NO: 53209

SEQ ID NO: 58713 - RNA, 64 nt, hsa; identical to SEQ ID NO: 53210

SEQ ID NO: 58714 - RNA, 64 nt, hsa; identical to SEQ ID NO: 53211

SEQ ID NO: 58715 - RNA, 64 nt, hsa; identical to SEQ ID NO: 53212

SEQ ID NO: 58716 - RNA, 64 nt, hsa; identical to SEQ ID NO: 53213

SEQ ID NO: 58717 - RNA, 64 nt, hsa; identical to SEQ ID NO: 53214

SEQ ID NO: 58718 - RNA, 64 nt, hsa; identical to SEQ ID NO: 53215

SEQ ID NO: 58719 - RNA, 64 nt, hsa; identical to SEQ ID NO: 53216

SEQ ID NO: 58720 - RNA, 64 nt, hsa; identical to SEQ ID NO: 53217

SEQ ID NO: 58721 - RNA, 64 nt, hsa; identical to SEQ ID NO: 53218

SEQ ID NO: 58722 - RNA, 64 nt, hsa; identical to SEQ ID NO: 53219

SEQ ID NO: 58723 - RNA, 64 nt, hsa; identical to SEQ ID NO: 53220

SEQ ID NO: 58724 - RNA, 64 nt, hsa; identical to SEQ ID NO: 53221

SEQ ID NO: 58725 - RNA, 64 nt, hsa; identical to SEQ ID NO: 53222

SEQ ID NO: 58726 - RNA, 64 nt, hsa; identical to SEQ ID NO: 53223

SEQ ID NO: 58727 - RNA, 64 nt, hsa; identical to SEQ ID NO: 53224

SEQ ID NO: 58728 - RNA, 64 nt, hsa; identical to SEQ ID NO: 53225

SEQ ID NO: 58729 - RNA, 64 nt, hsa; identical to SEQ ID NO: 53226

SEQ ID NO: 58730 - RNA, 64 nt, hsa; identical to SEQ ID NO: 53227

SEQ ID NO: 58731 - RNA, 64 nt, hsa; identical to SEQ ID NO: 53228

SEQ ID NO: 58732 - RNA, 64 nt, hsa; identical to SEQ ID NO: 53229

SEQ ID NO: 58733 - RNA, 64 nt, hsa; identical to SEQ ID NO: 53230

SEQ ID NO: 58734 - RNA, 64 nt, hsa
accauuuuucaaguuaucuuuuccccaacaucaacaucaacaugauauccuucauucagggcau

SEQ ID NO: 58735 - RNA, 64 nt, hsa
gccacuaccauuuuucaaguuaucuuuuccccaacaucaacaucaacaugauauccuucauuca

SEQ ID NO: 58736 - RNA, 64 nt, hsa
uguacaacgccuccaaggccaggagcaaaaccuacaucaacaugcgggaggugucccagcgcuu

SEQ ID NO: 58737 - RNA, 64 nt, hsa
uuuucaaacacuaugacacagaccaguccggcaccaucaacagcuacgagaugcgaaaugcagu

SEQ ID NO: 58738 - RNA, 64 nt, hsa
ccugaaacguauauguacuuuugguugcuguuaccaucaacaucuguuuuauuaccgaagacaa

SEQ ID NO: 58739 - RNA, 64 nt, hsa
uaugauuuuuaaaacauuuuaagauacagcuacucaucaacaucagcuaaauauagcugauaua

SEQ ID NO: 58740 - RNA, 60 nt, hsa
uguaaagcaauaugauuuguuacuauaauuaaccuguauaaaagauacauuuuauggugg

SEQ ID NO: 58741 - RNA, 60 nt, hsa
cugagacaaggcaagucccuuccacuuaugaaccuguaaaaucaaaaguaaacuaguuac

SEQ ID NO: 58742 - RNA, 60 nt, hsa
uguaaauagcacuaaacguuuucuuucugcaaccuguacuuacagauucuuccuguaaac

SEQ ID NO: 58743 - RNA, 60 nt, hsa
cagcacuaaagcaugagcuacuuucaucuaaaccuguaaaaauaugaaagauuuuuauau

SEQ ID NO: 58744 - RNA, 60 nt, hsa
ccuugaaguucuuugaccuccucaauucacaaccuguagcugacuuuagccacccacaag

SEQ ID NO: 58745 - RNA, 60 nt, hsa
acaguuuucuuaaucaaaaguggucuagguaaccuguaaagaaaggauuaaaaauuuaag

SEQ ID NO: 58746 - RNA, 64 nt, hsa
aguaggagggcguuggccaucucuacauuuugugaggugagagaaaacuaauguuuacuuucug

SEQ ID NO: 58747 - RNA, 64 nt, hsa
uuucuaaacugauuagaacuucuagcuaaugcucaggugagaucauagcuuaaauacauugaaa

SEQ ID NO: 58748 - RNA, 64 nt, hsa
acacacacauaugcauaucuugacauugcucuguaggugagagaggaccaugacgcccauguuu

SEQ ID NO: 58749 - RNA, 64 nt, hsa
gaucugagggcaggcgggcagcugcagggaggagaggugagaaaggaagcgucuucuagagaca

SEQ ID NO: 58750 - RNA, 64 nt, hsa
acuaucacaggaagaaauaaaaacagauuuuugaaggugagaugauaaacuugcaaaacucaca

SEQ ID NO: 58751 - RNA, 64 nt, hsa
uuggaaacuuaauccccaaagcaacagcuuugagaggugagaccuuuaaggguuacuaggcaga

SEQ ID NO: 58752 - RNA, 64 nt, hsa
auucugagauaggagaaaaccgcccuguggcuggaggugagauaugcuggcagcaauacugcuc

SEQ ID NO: 58753 - RNA, 64 nt, hsa
uggugcauuggaaaaggagucaggagccacugugaggugagaaugaaaguggaucucagcuggg

SEQ ID NO: 58754 - RNA, 64 nt, hsa
agaccagugggaguaaaccgaguguuaagugucaaggugagaaagccucacauucucucaagac

SEQ ID NO: 58755 - RNA, 64 nt, hsa
gaucaaaauucagauggaaugugggauggguaauaggugagaguagaaacccuucccuccagga

SEQ ID NO: 58756 - RNA, 64 nt, hsa
caguccaagugggguucccuguugccaguuagagaggugagaauguuuggacucuaacucaccg

SEQ ID NO: 58757 - RNA, 64 nt, hsa
acaggccucauccaccaggcaauagacaggagagaggugagaacuauuuuuagaaggaggaaaa

SEQ ID NO: 58758 - RNA, 64 nt, hsa
uauuuggguaggaggaagccuugccuugcgccuuaggugagaagcauaaguguaacucccaucc

SEQ ID NO: 58759 - RNA, 64 nt, hsa
aagaauauucccuuggguuuggacccauggucccaggugagagaaggaagugaggccauagaug

SEQ ID NO: 58760 - RNA, 64 nt, hsa
ucuuuuacuggacugucugaucaggguggagggaaggugagagguuugcauccacuucaggagc

SEQ ID NO: 58761 - RNA, 64 nt, hsa
ggggcgggugaugagaccugggguuuagaaccccaggugagaccucaaaucacugcauucauuc

SEQ ID NO: 58762 - RNA, 64 nt, hsa
aggcugauuaucuggguaaucuuuuacgggugggaggugagauugauagugcaauaaucaguga

SEQ ID NO: 58763 - RNA, 64 nt, hsa
acaacucuuaauugggccuagugaaaaugggggcaggugagaaguccauuuugagaaucagcau

SEQ ID NO: 58764 - RNA, 64 nt, hsa
cgugaagaaguaucucugaauguauccaggagaggaacugcauaaccaaaggggugaccagccc

SEQ ID NO: 58765 - RNA, 64 nt, hsa
ggguuuuuguuuguuuguuuguuuucuuaggcgggaacugcaaacagacucuuuucugagacua

SEQ ID NO: 58766 - RNA, 64 nt, hsa
ccuuugugacucaagguugaauuaaaaugccugugaacugcaaacuugcuuaugauugacuugg

SEQ ID NO: 58767 - RNA, 64 nt, hsa
ugcuaugcauuuugaaaauaaucugcaucaguuagaacugcagaaguuuuuuuaaugccacuuu

SEQ ID NO: 58768 - RNA, 64 nt, hsa
acccaccacuggaagcaggauggagcugacuacggaacugcacacucagugggcuguuucugcu

SEQ ID NO: 58769 - RNA, 64 nt, hsa
auggauauguauugggcagcagacuguguuucgugaacugcagugauguauacaucuuauagau

SEQ ID NO: 58770 - RNA, 64 nt, hsa
gaguggagcauguguguguugggaggggggcuaggaacugcacagcccuuguguaauuuucguu

SEQ ID NO: 58771 - RNA, 64 nt, hsa
ccccuuucuuauugcaagacggcuucucgcacaugaacugcauccuucucauucugucggaaau

SEQ ID NO: 58772 - RNA, 64 nt, hsa
agaacuugcagaaugcgugguguuaaucuacagagaacugcagcccuuauucagaauugagcag

SEQ ID NO: 58773 - RNA, 64 nt, hsa
ugagcugggccuugggagaagaauuuggccuucagaacugcaauaucacugagccugcgaucua

SEQ ID NO: 58774 - RNA, 64 nt, hsa
cuuucagguguuuucaacugaaaguauauauccagaacugcauccuuauagaaauacaaguaag

SEQ ID NO: 58775 - RNA, 64 nt, hsa
uauucuccuucagagcaacaucagaauugccugagaacugcaaugaacaaucugacaaauguga

SEQ ID NO: 58776 - RNA, 64 nt, hsa
gaauuuuuuuuuaagccacuuaauuguggccaaagcuauucagcugugauaauaguaucucaca

SEQ ID NO: 58777 - RNA, 64 nt, hsa
ugaccaugaccauuguugguugaauauuccaguugcuauucagaaauugucauaugucucaagu

SEQ ID NO: 58778 - RNA, 64 nt, hsa
uagucagguguggcggugcgugccuguaaucccagcuauucaggaggcugaggcaccagaauug

SEQ ID NO: 58779 - RNA, 64 nt, hsa
accucguuacucucaccucgugauauccacaaaugcuauucagauaaggcagaacuaggagucu

SEQ ID NO: 58780 - RNA, 64 nt, hsa
uuaauuauggauuuugugaaaaacaauagaacauguuaaugaguaauuuauauuaguucgaugu

SEQ ID NO: 58781 - RNA, 64 nt, hsa
aaguggacacgaagugauuuuuguaaccugagcaguuaaugaaugugccaacauuuucuaggaa

SEQ ID NO: 58782 - RNA, 64 nt, hsa
aaaaaaauucucauuauuugcaaagaaugaacaaguuaaugaacaaacaaacuagauuugguau

SEQ ID NO: 58783 - RNA, 54 nt, hsa
auauuucaggaggagaaugaguauguuaaugaagauaaaaagaagugacaucuc

SEQ ID NO: 58784 - RNA, 64 nt, hsa
uccuuuuccuauucuguauccuuaccuuggucauguuaaugacuuuggaguuauucaguuaaug

SEQ ID NO: 58785 - RNA, 64 nt, hsa
accuuggucauguuaaugacuuuggaguuauucaguuaaugacccuuuaauucucacaaccaac

SEQ ID NO: 58786 - RNA, 64 nt, hsa
auccuuaaguugucaaucugauccccagugugagguuaaugagcaaaauuggucuuuggggccc

SEQ ID NO: 58787 - RNA, 64 nt, hsa
aguucgcagcacugagggcacucuugaggguguuguuaaugaagauuuaauuuuuaaauacagg

SEQ ID NO: 58788 - RNA, 64 nt, hsa
uacugguuuuaaaccuugugcucuacuccuuccuguuaaugaauuaagaacacauucuaacaag

SEQ ID NO: 58789 - RNA, 64 nt, hsa; identical to SEQ ID NO: 58788

SEQ ID NO: 58790 - RNA, 64 nt, hsa
uguuuuuaaauuuuggguuuuuuuuuuuguuguuguuaaugagcagaaagagagacauaaugac

SEQ ID NO: 58791 - RNA, 64 nt, hsa
aaugaauaaugaauuuacucaaaauaaaacauagguuaaugagauaccuguguuugugaaaaaa

SEQ ID NO: 58792 - RNA, 64 nt, hsa
uccauugaagaagagaguuugaaaguuguauacuguuaaugacugucugcccauguccugccug

SEQ ID NO: 58793 - RNA, 64 nt, hsa
aucuuauuaccauuaguauuaaugguuaaugaugguuaaugauaaccauuaauaggcaaucauu

SEQ ID NO: 58794 - RNA, 64 nt, hsa
aauguguaaaaucuuauuaccauuaguauuaaugguuaaugaugguuaaugauaaccauuaaua

SEQ ID NO: 58795 - RNA, 64 nt, hsa
accugagaaugugccucucaguaucuuaaaauugguuaaugaaaaaucugaauuucuaaaaccc

SEQ ID NO: 58796 - RNA, 64 nt, hsa
aauaaguugaaugauaauagcucacagcacauuuguuaaugauucuugugucaucaaguaguag

SEQ ID NO: 58797 - RNA, 64 nt, hsa
uauuuaaguaaugcuagggguaguguacauaccaauuaguuauucagcuacuauacagaaaaag

SEQ ID NO: 58798 - RNA, 64 nt, hsa
aguaguguuuacaagauccaacagugcacucaucauuaguuaacaaagcaaauauguucaucac

SEQ ID NO: 58799 - RNA, 64 nt, hsa
ugaaucuuuucuuaagaaaucccaaaaagccaauauuaguuaaaauucuguuguuuaauuuggu

SEQ ID NO: 58800 - RNA, 64 nt, hsa
auauaaauauuuaccauauaaucuuggaauaaguauuaguuaauguuaccaaaaucuguauuaa

SEQ ID NO: 58801 - RNA, 64 nt, hsa
ugcaguuuaggaacuauuaggaaugucaggacuuuaucagcagggguaaaacuaccaccuggcc

SEQ ID NO: 58802 - RNA, 64 nt, hsa
aaguugagauuuguggggggacacaaccaaaccauaucagcauccuuucaagaauauuagauaa

SEQ ID NO: 58803 - RNA, 64 nt, hsa
gccaccucagccuggacuuuguuguccauauugcuaucagcauuuggggcaaagccauucaaca

SEQ ID NO: 58804 - RNA, 64 nt, hsa
caagaacaaauuguggaucaugguauaugcaggcuaucagcagaaggaucagacaauaaaauga

SEQ ID NO: 58805 - RNA, 64 nt, hsa
aaugaguuagugcaaaccauuuaguaaaaauaacuaucagcagaguuguuccagauuaaaaaua

SEQ ID NO: 58806 - RNA, 57 nt, hsa
accuggauaccaccaucuaagcuccuguaucagcaguccucaucaucacucaucugc

SEQ ID NO: 58807 - RNA, 64 nt, hsa
auagccaagaucccaucccuccauguacucuggguaucagcaacuguccucaucagucuccaua

SEQ ID NO: 58808 - RNA, 57 nt, hsa
accuggauagaaucaucuaagcuccuguaucagcacuccucaucaucacucaucugc

SEQ ID NO: 58809 - RNA, 64 nt, hsa
auagccaagaucccaucucuccauauacuuuggguaucagcaucuguccucaucagucuccaua

SEQ ID NO: 58810 - RNA, 64 nt, hsa
uugguagaaaucagguuacaaagcaaaaccacaauaucagcaacacuuccuaaucaaaauuaag

SEQ ID NO: 58811 - RNA, 64 nt, hsa
aaaucuuucacuucaagauaauuugacaguugaguaucagcauaauuuguuuagcucuaaggca

SEQ ID NO: 58812 - RNA, 65 nt, hsa
cagggaagauacauacauauaugagguacaguuuuugaauguacugguaaugccuaauguggucu

SEQ ID NO: 58813 - RNA, 65 nt, hsa
uuaaaaacuuguauaguugucuagauuucugcaccugaauguauguuugaugcuuugauuugaaa

SEQ ID NO: 58814 - RNA, 65 nt, hsa
aauguggguggaccccguccagucuguugaaggccugaauguaacaaaagggcuuauucuuccuc

SEQ ID NO: 58815 - RNA, 65 nt, hsa
cccaccucaggccucacacuuucccaugaaaagggugaauguauauaaccugagcccucuccauu

SEQ ID NO: 58816 - RNA, 65 nt, hsa
gugaagaugaaugaauguaacuccuggugugaagaugaauguaaacccuggcgacaguugagacc

SEQ ID NO: 58817 - RNA, 65 nt, hsa
accacggcagagagcagcgccgaugugaagaugaaugaauguaacuccuggugugaagaugaaug

SEQ ID NO: 58818 - RNA, 65 nt, hsa
uguuuaagauauguuuggugaccaaaacguaugugugaauguaguuauaaugcuuuugaaaaauu

SEQ ID NO: 58819 - RNA, 65 nt, hsa
ucagauuuagauucuuccuggggauuacacagcuaugaauguauuugcuucuaaaaccucccaaa

SEQ ID NO: 58820 - RNA, 65 nt, hsa
ggcucuaugaauguacauggaaugaccaggcucuaugaauguacauggaaaaccccuaaaaaucc

SEQ ID NO: 58821 - RNA, 65 nt, hsa
cgcaacaaggacuccucgcugcugaccaggcucuaugaauguacauggaaugaccaggcucuaug

SEQ ID NO: 58822 - RNA, 65 nt, hsa
cuuacauagcacuugauacguguuaaaugaacauaugaauguaauuuauauauuccuagaauuua

SEQ ID NO: 58823 - RNA, 65 nt, hsa
uuagcagcucaauuuguacuacuucagccaaucugugaauguaaaaacuacacuguugccuugcu

SEQ ID NO: 58824 - RNA, 65 nt, hsa
gagcgcaucaccugaaugucgugaagaaguaucucugaauguauccaggagaggaacugcauaac

SEQ ID NO: 58825 - RNA, 65 nt, hsa
agccaugcacccgcccagccaccacgucccccgcaugaauguacuguacacuuucaauccucccc

SEQ ID NO: 58826 - RNA, 65 nt, hsa
ggauaucuuuguccauauacccagguguccugauuugaauguacuauuugauccucauuguguuc

SEQ ID NO: 58827 - RNA, 65 nt, hsa
uuugcugucuuuuuacacuguaugcgguuuggaaaugaauguagaaacuuacugugggcauuuac

SEQ ID NO: 58828 - RNA, 65 nt, hsa
gaaggaaucauuggugaacuuuccaagguuauuucugaauguaacaauuuccuuaaaaaugacuu

SEQ ID NO: 58829 - RNA, 65 nt, hsa
uagaauagauuaauaaauuggcuauguuguuccaaugaauguacagcacuuccauuaacuuuuga

SEQ ID NO: 58830 - RNA, 65 nt, hsa
aaaacuuuauaaucgucauuguucaaccaagauuuugaauguaauaagaugaauauauuccuuac

SEQ ID NO: 58831 - RNA, 65 nt, hsa
uggcaaauaagaauguuugagcacacugcccacaaugaauguaacuauuuucuaaacacuuuacu

SEQ ID NO: 58832 - RNA, 65 nt, hsa
ucuaucagaaauuguaagagaauagauacauguuuugaauguaaaguugaaaagucugguuuacu

SEQ ID NO: 58833 - RNA, 65 nt, hsa
uccuaguaagugccacuuccacuaagaauacaguuugaauguauaaucaguaguguuuacaagau

SEQ ID NO: 58834 - RNA, 65 nt, hsa
gaugugauagugccgugaauguauucuacuggaaaugaauguaauaauacauuaaauuuuuaaaa

SEQ ID NO: 58835 - RNA, 65 nt, hsa
gccaguucaaaagaauaguagaugugauagugccgugaauguauucuacuggaaaugaauguaau

SEQ ID NO: 58836 - RNA, 65 nt, hsa
ucuucuguuugugaagaaaaaaacaaguuaaaaacugaauguacugauuuagaaaauauauauaa

SEQ ID NO: 58837 - RNA, 65 nt, hsa
aaaaaacacacauucagccaaccacuuauaugaauugaauguaucagaaguguacugaagggacu

SEQ ID NO: 58838 - RNA, 65 nt, hsa
gaacacuuaaaucuaacagaggauuuucagaguagugaauguaaggaaagcuuaauggaucucuc

SEQ ID NO: 58839 - RNA, 65 nt, hsa
cagcaucaaagaauucacacaggagagaaagcacaugaauguaaugaauguggaaaagcuuucag

SEQ ID NO: 58840 - RNA, 65 nt, hsa
cagcaucacaaaaugcauaggaaagagaaaucguaugaauguaaugaguaugagggcaguuucag

SEQ ID NO: 58841 - RNA, 65 nt, hsa
uucaacaucagagcauucauaccaaagagaacucaugaauguaaugaagaugggaagauauuuau

SEQ ID NO: 58842 - RNA, 65 nt, hsa
ugcuuauauugacaacaaaucaucucgcuaaagagugaauguaggccaggcgcgguggcucaugc

SEQ ID NO: 58843 - RNA, 65 nt, hsa
ccgucucaaaaaaaaaaaaaaaaaaaaaaaaagagugaauguaauagucuugcagaaaaugaaug

SEQ ID NO: 58844 - RNA, 65 nt, hsa
cuuuacaauuucaaauguuacccugauuguuuauaugaauguagaacaccuugacauuucuuuuu

SEQ ID NO: 58845 - RNA, 65 nt, hsa
agcaagccauuuaauccgguucuuggagaaacauaugaauguauucgggaggacaagggcuucca

SEQ ID NO: 58846 - RNA, 65 nt, hsa
auuugggauacuaaaguaguuuaagucuccuuuacugaauguaagggggggaucgaaaagaaggu

SEQ ID NO: 58847 - RNA, 65 nt, hsa
aggaccuagcuguuguaaagaauuggucuuaauguugaauguauuuugguugcugauguuuauaa

SEQ ID NO: 58848 - RNA, 65 nt, hsa
aucauuuggguuugaggguguguuauuuugagucaugaauguacaagcucugugaaucagaccag

SEQ ID NO: 58849 - RNA, 65 nt, hsa
gcguucuggcuaacacuguuggaccugacccacacugaauguagucuuucaguacgagacaaagu

SEQ ID NO: 58850 - RNA, 65 nt, hsa
gcagguaaauugucgggggagagaguuagcauguaugaauguaaggaugagggaagcgaagcaag

SEQ ID NO: 58851 - RNA, 65 nt, hsa
uaagugcccacauuugauggaggguggaaauaauuugaauguauuugauuuauaaguuuuuuuuu

SEQ ID NO: 58852 - RNA, 65 nt, hsa
aaaucuguugucauguuaguaaaugauuugaaaacugaauguaauacuugaguagauuuuuuuuu

SEQ ID NO: 58853 - RNA, 65 nt, hsa
ugacauagaguaaacaucuuaguaauauauuaaagugaauguaaauggugguuaaaauuacauua

SEQ ID NO: 58854 - RNA, 65 nt, hsa
gcuucuaaccccaguagaguagaacuaaauugcacugaauguauaguuaacucugucuugaauuc

SEQ ID NO: 58855 - RNA, 65 nt, hsa
aauaauuuuuugucauuugucuuuauguccagcuaugaauguagauuuugugucccgacagcccu

SEQ ID NO: 58856 - RNA, 65 nt, hsa
gaacaccagugaauuuacacugcaaagaaaaacuaugaauguauggaauuuuuuaaaaagaagua

SEQ ID NO: 58857 - RNA, 65 nt, hsa
uaauacucuuguaggagaaaaagcaacuguauaaaugaauguagagugacuuucugcaauauuuc

SEQ ID NO: 58858 - RNA, 65 nt, hsa
uguuacucugguucuuuguuuuaaaauaaaaauucugaauguacacgacauuaugggcuuauuua

SEQ ID NO: 58859 - RNA, 65 nt, hsa
gagucaaugugcaguguagcccacacuugagaggaugaauguaugugcacugucacuuugcucug

SEQ ID NO: 58860 - RNA, 65 nt, hsa
ugguuuauuuugaugaaaguucuuuuaacaugucuugaauguacacauaaaggaauccaaagcuu

SEQ ID NO: 58861 - RNA, 65 nt, hsa
uacagagcuauguaaagggacuuaggagaaaaugcugaauguaagauggucccauuucaauuucc

SEQ ID NO: 58862 - RNA, 65 nt, hsa
uuuuuuuuaauacauauccaauaaugccuuccaucugaauguaaaauaaguacccaugauuucua

SEQ ID NO: 58863 - RNA, 65 nt, hsa
uuggcuacgcagggaugggcaguugcacgaaggcaugaauguauuguaaauaaguaacuuugacu

SEQ ID NO: 58864 - RNA, 65 nt, hsa
uauaauuuguuaacacuagaaaccuauuaguauugugaauguagauuuuacugugaagcuaucug

SEQ ID NO: 58865 - RNA, 65 nt, hsa
cugccauuuuaccagcauuauuguaguuuaaugauugaauguagacagggauaugcguauaguuu

SEQ ID NO: 58866 - RNA, 65 nt, hsa
ucauuagggcuugcagacaaugucaccuaaauugcugaauguacucauuauaauaugauaucuga

SEQ ID NO: 58867 - RNA, 65 nt, hsa
acuuugcaguaaguaucauguaaauaugcaaauguugaauguaauauagauuguguccucauuga

SEQ ID NO: 58868 - RNA, 65 nt, hsa
gggaaaggaguuugaaugugucuauuuuuuucuagugaauguauuuuaaccacaguguccuaaac

SEQ ID NO: 58869 - RNA, 65 nt, hsa
aaugaaguagaggugacucucucugugguacacauugaauguacuauguauguucaaguauucag

SEQ ID NO: 58870 - RNA, 65 nt, hsa
ccugcggcucagccuugcacacccacugccccgugugaauguagcuuccaccucauggauugcca

SEQ ID NO: 58871 - RNA, 65 nt, hsa
gacaucuacauuuuuuaaaacugaaucuuaaucgaugaauguaaacucgggggugcuggggccag

SEQ ID NO: 58872 - RNA, 65 nt, hsa
auucugaauagaugaaagcauaaaaugugagaaacugaauguauuauucaggaagaauacugagu

SEQ ID NO: 58873 - RNA, 65 nt, hsa
aggaagaauacugagugccuucauuuaacuaaaguugaauguaaaagucaauuugcacuucuuua

SEQ ID NO: 58874 - RNA, 65 nt, hsa
cagaucuuaacaauuccaauagaagagaagacauaugaauguaaggaaugugggaaaaucuuggc

SEQ ID NO: 58875 - RNA, 65 nt, hsa
auucagcugugaucucacaagugugaaaaaucuuaugaauguaaaauguguggagauucuucuuu

SEQ ID NO: 58876 - RNA, 65 nt, hsa
uuucauaaaaggacacacacuggagagaaacccugugaauguaagaaauguagaaaagcauucca

SEQ ID NO: 58877 - RNA, 65 nt, hsa
auacaugaaaggaugcacagaggagagaagcucugugaauguaagcauugugggaaagcauucau

SEQ ID NO: 58878 - RNA, 65 nt, hsa
auacaugcaagaacacacaauggagagaaacccuaugaauguaaagaaugcagaaaagcauucag

SEQ ID NO: 58879 - RNA, 65 nt, hsa
augcauggaaggacucacacuggagaaaaacccuaugaauguaagcaguaugggaaagcguucag

SEQ ID NO: 58880 - RNA, 65 nt, hsa
guucagaccugacaagauucuuugaauacagauaaugaauguaaacaauuaacuguuuauaauaa

SEQ ID NO: 58881 - RNA, 65 nt, hsa
auuuaugaaaggacacacacuggagagaaacccuaugaauguaagaaauguggaaaagcguucca

SEQ ID NO: 58882 - RNA, 65 nt, hsa
gaauacaugcaaaacacacacuggagagaaaccuaugaauguaaggaaugcaaacaagcauucaa

SEQ ID NO: 58883 - RNA, 65 nt, hsa
auacaugaaaggacucauacgagagagaauccguaugaauguaaggauugugggaaagcauucag

SEQ ID NO: 58884 - RNA, 65 nt, hsa
auagacauguaaagacacaccagaaggaaacccuaugaauguaagcaauguggcaaaagcuuuca

SEQ ID NO: 58885 - RNA, 65 nt, hsa
augcauggaagcacucacacuuggcagaaacucuaugaauguaagcaguaugggaaagccuucag

SEQ ID NO: 58886 - RNA, 65 nt, hsa
cuucagaucggcuaggauucuuugaauacaaauaaugaauguaaacaauuaacuguuuauaauaa

SEQ ID NO: 58887 - RNA, 65 nt, hsa
cagcaaagccauucuuaagagucgugagguccuucugaauguaaaacuggagcccaggagaagcu

SEQ ID NO: 58888 - RNA, 65 nt, hsa
cauaauuaacuuaauuggagaugcauuaggucacuugaauguauaagcaagcaccuaugguaggc

SEQ ID NO: 58889 - RNA, 59 nt, hsa
augcgaaaucauacagcugagaaacccuaugaauguaaggaauguggaaaagccuucag

SEQ ID NO: 58890 - RNA, 65 nt, hsa
cuucaugugagaagucacacaggggagaaacccuaugaauguaauaaaugugggaaagccuuuuc

SEQ ID NO: 58891 - RNA, 65 nt, hsa
auacauaugagaagucauacuggugagaaacccuuugaauguaaugaaugugggaaagcauucuc

SEQ ID NO: 58892 - RNA, 65 nt, hsa
aaacacaucagaaaucucacuggagagaaacuguaugaauguagagaaucugggaauaccuuucu

SEQ ID NO: 58893 - RNA, 65 nt, hsa
cugaagacaugaaaacucacuggggagaaacccuaugaauguaaaaauguggaagcaacuuugua

SEQ ID NO: 58894 - RNA, 65 nt, hsa
auacaugaacgaauucauacuggagagaaacccuaugaauguaaagaauguggaaaacccuucag

SEQ ID NO: 58895 - RNA, 65 nt, hsa
auacaugaaagaacccacacuggagagaaaccuuaugaauguaaacagugugguaaagccuucag

SEQ ID NO: 58896 - RNA, 65 nt, hsa
agacaugaaaggaugcacacugcaaagaaacaguaugaauguaaaaaaugugggaaaacauacau

SEQ ID NO: 58897 - RNA, 65 nt, hsa
aaacaugagaggaaucacacugcacagaaacacuaugaauguaaacugugugggaaaacuuacuu

SEQ ID NO: 58898 - RNA, 65 nt, hsa
gcacaugaaagaacucacacuggagaaaaacccuaugaauguaaaaaaugugggaaaguguucgu

SEQ ID NO: 58899 - RNA, 65 nt, hsa
gcacaugaaaggaaucacacuguacagaaacgcuaugaauguaaacaauguggaaaaaccuacau

SEQ ID NO: 58900 - RNA, 65 nt, hsa
cagauagaaauaauucucauuggagauaaacccuaugaauguaaacacauaguaaagccuuaauu

SEQ ID NO: 58901 - RNA, 65 nt, hsa
guacaugaaaggauucacucuggagagaagucauaugaauguaagaaauguagaaaagcauugag

SEQ ID NO: 58902 - RNA, 65 nt, hsa
aaaaaauaaaaaaaaagaaaaagaaauaaacucuaugaauguaaaccauguggugaaggcuuaag

SEQ ID NO: 58903 - RNA, 65 nt, hsa
ggacaugaaagaacucauaccgcaaagaagcuaugugaauguaaggaauguggaaaagcauugag

SEQ ID NO: 58904 - RNA, 65 nt, hsa
caacaugaaaggauucacacuggagagaagccguaugaauguaaggaaugcaggaaagcauucuc

SEQ ID NO: 58905 - RNA, 65 nt, hsa
aaucaugagacaacucauaugggagagaagccauaugaauguaaauaaugugggaaagcauuugg

SEQ ID NO: 58906 - RNA, 65 nt, hsa
agacgugaaaccacucacagugcagagaaaccccaugaauguaagcaaugugggaaagcauuuga

SEQ ID NO: 58907 - RNA, 65 nt, hsa
agacaugaaagaacacguacuggggagaaacuguaugaauguaagcaguguucuaaagccuuccc

SEQ ID NO: 58908 - RNA, 65 nt, hsa
augcaugaaagaacucacucuggagagaaacuauaugaauguaagcaguguucuaaagccuuuca

SEQ ID NO: 58909 - RNA, 65 nt, hsa
aacauaauuuauucuagguaaaauuuagauuguagugaauguaggaaguucuucagcacuugagc

SEQ ID NO: 58910 - RNA, 65 nt, hsa
uaucuucagcaaauuccuaugagagaauaauguaaugaauguaggaaaaucuuuagccuuaucug

SEQ ID NO: 58911 - RNA, 65 nt, hsa
agaauagcauauagagaauaaucauguugacuuugugaauguagaaaagcuuuuaucuauuacac

SEQ ID NO: 58912 - RNA, 65 nt, hsa
caacaucaaagaauuccuacuggugagaaacccuaugaauguaaugaaugugagaaggccucuuc

SEQ ID NO: 58913 - RNA, 65 nt, hsa
aaacaucagacaauucacacuggugacaaacccuaugaauguaaagauuguaaaaaagcuuuucu

SEQ ID NO: 58914 - RNA, 65 nt, hsa
caacaucaaagaauucauaccagugugaaacccuaugaauguaaggaauguguaaagaccuuuac

SEQ ID NO: 58915 - RNA, 65 nt, hsa
agacaucagagaauucacaguggggagaaacccuaugaauguaaugaaugugggaaugccuucau

SEQ ID NO: 58916 - RNA, 65 nt, hsa
cugagcccccuuuucuggacaccaacuguguccugugaauguaucgcuacugugagcuguucccg

SEQ ID NO: 58917 - RNA, 65 nt, hsa
ucagugucggggcugagccccuugagcugcuucagugaauguacagugcccggcacgagcugaac

SEQ ID NO: 58918 - RNA, 65 nt, hsa
gccagagucguaauugaaaucuaggaagucucgcuugaauguaugcgauacauauuuucacuacg

SEQ ID NO: 58919 - RNA, 65 nt, hsa
uuuaaagguagaguuaacagaauauacugguggacugaauguagguugagagaggaagcgagaag

SEQ ID NO: 58920 - RNA, 65 nt, hsa
ccgcccccuccggggcugagccugggucugaagacugaauguaacaggggccgcuggcacuccug

SEQ ID NO: 58921 - RNA, 65 nt, hsa
aguguuguuuuuguaucaauauguuugugcagugaugaauguauuuauuucucagacuuggggcg

SEQ ID NO: 58922 - RNA, 65 nt, hsa
uucuaacaacuguggagauuugagggaauguguggugaauguaaaauaccuaguuuacuugccag

SEQ ID NO: 58923 - RNA, 65 nt, hsa
uuuuugguguuccaaugaaucugggauguaaacucugaauguauuuauaacuauuuauuucugga

SEQ ID NO: 58924 - RNA, 65 nt, hsa
gcacagaaugagcuucgagcuuuguucagacuaaaugaauguaucugggaggggucgggggcacg

SEQ ID NO: 58925 - RNA, 65 nt, hsa
caucugccuuucuuucccccagcccccacccgcuuugaauguagagacccgugggcacuuuuccu

SEQ ID NO: 58926 - RNA, 64 nt, hsa
uuguauauugucagugaagaacuguuaguugguugucagugaacaauaacuuuauuauaugagu

SEQ ID NO: 58927 - RNA, 64 nt, hsa
cugaaggcucgaaggcacugcacacuuguauauugucagugaagaacuguuaguugguugucag

SEQ ID NO: 58928 - RNA, 64 nt, hsa
ucucagacggggcccucccgucgagaagcugguagucagugagugagaacaagagaacaagaac

SEQ ID NO: 58929 - RNA, 64 nt, hsa
acccauuuuccuuguuuucagugcugcgguaucagucagugaucugaggaaauccuguagggga

SEQ ID NO: 58930 - RNA, 64 nt, hsa
aauauccuaaaguaucacauaguuaaauuuuucagucagugaagaccgggagggaaugucagug

SEQ ID NO: 58931 - RNA, 64 nt, hsa
uaaauuuuucagucagugaagaccgggagggaaugucagugaauuggcuugaauguucuguggc

SEQ ID NO: 58932 - RNA, 64 nt, hsa
cccacagguuucuguggacagcgauacagcaggagucagugaaaucaacuggggagcucacuug

SEQ ID NO: 58933 - RNA, 64 nt, hsa
uauuugcaauguggaguuuccgccccgaucucacgucagugagggucuccugucucucaagugu

SEQ ID NO: 58934 - RNA, 64 nt, hsa
aaggucuguugaugcaugccagugcugguuacuagucagugacagagaacacagagagggacaa

SEQ ID NO: 58935 - RNA, 64 nt, hsa
gcaccaagguaagagguggggcugcccaggcaaagucagugaacaugaaaacucagacaaagca

SEQ ID NO: 58936 - RNA, 64 nt, hsa
guucauguuaaguuagagugaggguguagguagugucagugaguggcucuugugccugcuguag

SEQ ID NO: 58937 - RNA, 64 nt, hsa
cuuuuaggaagucugagaugauaaauauuucaaggucagugaagucuaucaaucauucuccccu

SEQ ID NO: 58938 - RNA, 64 nt, hsa
ucaagcgaggcaugcaugaggccuccagccgguggucagugagggaguuaaguggcuucuccgu

SEQ ID NO: 58939 - RNA, 64 nt, hsa
cgaccuccagugagcuuggaagaggacccugggugucagugagaucucagcccugaugacaccc

SEQ ID NO: 58940 - RNA, 63 nt, hsa
cagccagggacgccaggacauagcugcuccuggucaguggaggucagccggguaucaaaagcc

SEQ ID NO: 58941 - RNA, 63 nt, hsa
auuuccaagaagcugaaucuuugggacugauucucaguggagggcuuagaucauacaaaaauc

SEQ ID NO: 58942 - RNA, 63 nt, hsa
caaauaacugauguuuuaaccagaguaaugaccucaguggauuugcuuuaacccucacauuuu

SEQ ID NO: 58943 - RNA, 63 nt, hsa
ccagagcuagcgucccuacugccucccgacuccucaguggaggaggagcugcggucccucugg

SEQ ID NO: 58944 - RNA, 63 nt, hsa
gggguccaggucggguguggacuguccucacugucaguggagccccagaagcuagauggguac

SEQ ID NO: 58945 - RNA, 63 nt, hsa
aaccuugucacauguagcugagucugggaugacucaguggaucaguggaugcguggaagguuu

SEQ ID NO: 58946 - RNA, 63 nt, hsa
cacauguagcugagucugggaugacucaguggaucaguggaugcguggaagguuuugguguuu

SEQ ID NO: 58947 - RNA, 63 nt, hsa
gauacccagaggucccccaggucaucacuuggcucaguggaagcccucuuuccccaaauccua

SEQ ID NO: 58948 - RNA, 63 nt, hsa
aaguggauacauaagauuaacuaucacagugacucaguggaauuuuuuguuugcuuuuguaca

SEQ ID NO: 58949 - RNA, 63 nt, hsa
auuugcuuauauguaaaaguuguuuuuguggagucaguggauauauuucuaaugaagugcuag

SEQ ID NO: 58950 - RNA, 63 nt, hsa
augaucuaaaagccaacuuuuucucaguuuuacucaguggaaagauaaacuaaguuuuaaugu

SEQ ID NO: 58951 - RNA, 63 nt, hsa
ggugacacacugagugaaagggacugggccagcucaguggaccguguggaacaggaacagcug

SEQ ID NO: 58952 - RNA, 63 nt, hsa
ggaaaagaugccuucuggaucuuaagccaguugucaguggagguccucagggcugcaaauguc

SEQ ID NO: 58953 - RNA, 63 nt, hsa
caaaccuuguagccuaagccauuugucuuuuucucaguggagggaguguauggaccuggcccc

SEQ ID NO: 58954 - RNA, 63 nt, hsa
acccaggauccugaucugcccugcacugagcacucaguggauaaacacuccuccagcccagac

SEQ ID NO: 58955 - RNA, 63 nt, hsa
cuaaacaucgacuucgguucacuucacggauguucaguggauaucggucacaugccagguccc

SEQ ID NO: 58956 - RNA, 63 nt, hsa
agucuagugcagacccgugaucaccuuagugcuucaguggauucacugguuagauuaaaaaga

SEQ ID NO: 58957 - RNA, 63 nt, hsa
gguuuauucauucauuaaacuacuuuggaagcgucaguggauauauuugaaagugguaauccu

SEQ ID NO: 58958 - RNA, 63 nt, hsa
acaaguuucuuguuauccugaaacuuucuaugcucaguggaaaguaucugccagccacagcau

SEQ ID NO: 58959 - RNA, 63 nt, hsa
ccauuuuccuuuccuugugguugaaaaccacagucaguggagagauguuuggaaaccacaguc

SEQ ID NO: 58960 - RNA, 63 nt, hsa
cacagucaguggagagauguuuggaaaccacagucaguggagccugggugguacccaggcuuu

SEQ ID NO: 58961 - RNA, 63 nt, hsa
aucaauuacggagauacagagccuugaggucuuucaguggaaaggugguucauguucauucuc

SEQ ID NO: 58962 - RNA, 63 nt, hsa
cagccugggggucugggcuggggcagggauugcucaguggaagcaggacugggggucuggcuu

SEQ ID NO: 58963 - RNA, 63 nt, hsa
gcuguaggcaagcuugcacauaaauaacccccgucaguggaguguucgggaugcagggggcac

SEQ ID NO: 58964 - RNA, 63 nt, hsa
cucauucccuuacccccggccagugcugcugcuucaguggaagagaugaagccaaaggacaga

SEQ ID NO: 58965 - RNA, 63 nt, hsa
gugccuucuucagggccugguugaagaagaugaucaguggacagucugcucuagaugagcugg

SEQ ID NO: 58966 - RNA, 63 nt, hsa
cccagaaucagcucuggauuuuaagcccagacuucaguggacccagauagaaaauauaaaguc

SEQ ID NO: 58967 - RNA, 63 nt, hsa
uaguuuacaaucuaagaguuauucuuaagaguuucaguggaauuuucuuaauuuuucuaaaga

SEQ ID NO: 58968 - RNA, 63 nt, hsa
aauuuguaguuuuauuaugcaguuaaaucuguaucaguggacuuuuaaaacuugguacuacua

SEQ ID NO: 58969 - RNA, 63 nt, hsa
ucaucaauccgucugggugccagaacucaagguucaguggacacaucccccuguuagagaccc

SEQ ID NO: 58970 - RNA, 63 nt, hsa
gguccuuuauucauuucugggacagaaagagggucaguggacuuuugugggccuccagcuucu

SEQ ID NO: 58971 - RNA, 63 nt, hsa
uagaagugguuuguagacuuccuuuauaauauuucaguggaauagaugucucaaaaauccuua

SEQ ID NO: 58972 - RNA, 63 nt, hsa
cauuuuuaaugauguuguguguccucccuuuguucaguggacgguuaaaccuucccccacuca

SEQ ID NO: 58973 - RNA, 63 nt, hsa
accugaaaccucagcgugaauuugggggauuuuucaguggaacccuugcccccaaaugucgac

SEQ ID NO: 58974 - RNA, 63 nt, hsa
acagugggcaagaggacacccccccccaccaccucaguggaacacaccauucucccccccuca

SEQ ID NO: 58975 - RNA, 63 nt, hsa
accucaaacacuggccugugagcccuuuccaagucaguggagagcccugaaaggaggcucacu

SEQ ID NO: 58976 - RNA, 63 nt, hsa
gaugcguaauauaauucuggugaaguaauaguuucaguggaugauugaaaacaacaacaacaa

SEQ ID NO: 58977 - RNA, 63 nt, hsa
cugcugauauuauggaaguauuuuuuuuaaucaucaguggaaauuuuuauucuucuuuagucu

SEQ ID NO: 58978 - RNA, 63 nt, hsa
cuaggaggacccaccaguggagcacaugcagccucaguggagaugcuugguguggggaucugg

SEQ ID NO: 58979 - RNA, 63 nt, hsa
aauagguuccauguguaaguguuuuguaaaauuucaguggaaaugcacagaaaaucuucuggc

SEQ ID NO: 58980 - RNA, 63 nt, hsa
ucaguuuccaaguuuauaucauauuaauacauuucaguggauaauuuauuuuaaaaaaaaaac

SEQ ID NO: 58981 - RNA, 63 nt, hsa
aauuguuugcccaaauauucuugucauuuggagucaguggaaaauccagcacaccaagcacca

SEQ ID NO: 58982 - RNA, 63 nt, hsa
guacuguuaauaucuggaaaguaucuugagauaucaguggaaagcuaaacagucuaaauuaac

SEQ ID NO: 58983 - RNA, 63 nt, hsa
agggggcuggucccggcuccacccccuccaagcucaguggacacugggucugaaaggaaggag

SEQ ID NO: 58984 - RNA, 63 nt, hsa
ccucagugggcccgaacucgccagccccagcuuucaguggagaaagcgguccucugaaauggu

SEQ ID NO: 58985 - RNA, 63 nt, hsa
gcccuuagcaguggccuggcacaaaacaaaugcucaguggauggaagcugccuauuauuauug

SEQ ID NO: 58986 - RNA, 63 nt, hsa
ucaaggcaauaguacauaauaguggaagaaaauucaguggaagguuauugcuauugucauuug

SEQ ID NO: 58987 - RNA, 63 nt, hsa
aucaaccugggagaccaccccggccgcggcgccucaguggacaggugggaggaaaagaaaacu

SEQ ID NO: 58988 - RNA, 63 nt, hsa
caucacaugucgauauuugcauaggagucauuuucaguggaauaacauuuuuaaugugugguu

SEQ ID NO: 58989 - RNA, 63 nt, hsa
ggaauguugcaugagucggaucccaguccauugucaguggagggugagggugaccccaucugc

SEQ ID NO: 58990 - RNA, 63 nt, hsa
ucuagcucucugauuccauacauuccagacuucucaguggauuuguaauaaacuauaaauaaa

SEQ ID NO: 58991 - RNA, 63 nt, hsa
uuuauaguuucucuauaaaaacugguuuuaaaaucaguggaaaagggcagguugaaucaaggu

SEQ ID NO: 58992 - RNA, 63 nt, hsa
guucuggcccuuccccaucuagaacugccauuaucaguggaguagugggucccuggucuccua

SEQ ID NO: 58993 - RNA, 63 nt, hsa
aggcuucuggaaccaaacugauuaaaguuuuacucaguggauaguucuauagaauuaaugaug

SEQ ID NO: 58994 - RNA, 63 nt, hsa
uguaugaguugcauuuguaaaaaugagacuuuuucaguggaacucuaaaccuugugaugacua

SEQ ID NO: 58995 - RNA, 63 nt, hsa
gauuuaugugaggucaaaaccaaacucuuauucucaguggaaaacuccaguuguaaugcauau

SEQ ID NO: 58996 - RNA, 63 nt, hsa
guuccauguggauccauacuaaguauucuucagucaguggauuuuagcaaggggagguaggag

SEQ ID NO: 58997 - RNA, 63 nt, hsa
uuaacuaacuguaaggcguggaauaggaguugcucaguggauugguucuauguuguggacuac

SEQ ID NO: 58998 - RNA, 63 nt, hsa
accucuugaaggugucgaauguauguuuauacaucaguggaacccauuuuucuagccuagcaa

SEQ ID NO: 58999 - RNA, 63 nt, hsa
auaaguugcagacugccuuuaaaauagauuuuaucaguggagaaauggugauaguuuuuucuu

SEQ ID NO: 59000 - RNA, 63 nt, hsa
aucuaagcccaggacaugagugucuguccagacucaguggaucugaagaaaaaaggaaaaaaa

SEQ ID NO: 59001 - RNA, 63 nt, hsa
cuacugaaguuguguggagggauggaaagugggucaguggagaagggauucagaaaaugacac

SEQ ID NO: 59002 - RNA, 63 nt, hsa
caagaggacugggugcugggcugcagaggccggucaguggagccccuagcacgugugaacuca

SEQ ID NO: 59003 - RNA, 63 nt, hsa
agguauuggagccucuguggccuuaaauguggcucaguggagggagacccagcauagccaggc

SEQ ID NO: 59004 - RNA, 63 nt, hsa
agugccccugugggggagccuguaaaugcgggcucaguggaccacuggugacugggcucaugc

SEQ ID NO: 59005 - RNA, 63 nt, hsa
gcagugagacuaugagccaagcaaagagaagucucaguggagcaugaggagggagcaguccag

SEQ ID NO: 59006 - RNA, 63 nt, hsa
aaaguucuaaacugccucugcaaugacuuguagucaguggaagaguaucacuuuccccugauc

SEQ ID NO: 59007 - RNA, 63 nt, hsa
auaaaaaucaaaaggcugccucuauuacaauccucaguggaauagauggcuaucuuucuuggc

SEQ ID NO: 59008 - RNA, 63 nt, hsa
uuguuaccaaacuuguaaaagcauuccauguauucaguggaggcagaauguauaauauuuuuu

SEQ ID NO: 59009 - RNA, 63 nt, hsa
aggaguuuguuuccugaguguggagugaggcugucaguggauccgugcuuugucggccagcgu

SEQ ID NO: 59010 - RNA, 63 nt, hsa
aacuccucacucccugaucaauggaaguccaggucaguggagucucuccuugauugaucaccc

SEQ ID NO: 59011 - RNA, 63 nt, hsa
cccuggagugggcaggcaggccagggcugcgcaucaguggacacauugcugccaggaagagcu

SEQ ID NO: 59012 - RNA, 63 nt, hsa
ugcuccauguucauucggagccaggagggguucucaguggagccuggcuuagggaacagggag

SEQ ID NO: 59013 - RNA, 63 nt, hsa
acaaaagcaaaauuuuuaaaacugcauuuuuaaucaguggaacucaauauauaguuagcuuua

SEQ ID NO: 59014 - RNA, 63 nt, hsa
agguuuuccuggacaccgccaacuucacauugcucaguggacucauucuaagggcaagacauu

SEQ ID NO: 59015 - RNA, 63 nt, hsa
ggaaggauuguuccuuagagcuucucugcagaaucaguggagauuuucaguuucccacccugc

SEQ ID NO: 59016 - RNA, 63 nt, hsa
guaaacggacuuguuaaccuaaccuaauuaugcucaguggacuucuauagaugguuuugaaaa

SEQ ID NO: 59017 - RNA, 63 nt, hsa
cuucugauugccuaauaaauaugacauggauguucaguggaacuucccaucuauuacgccuca

SEQ ID NO: 59018 - RNA, 63 nt, hsa
aauuaaaccuugcauuaaaauaauaucacaguaucaguggacuaaacauuaaaauguaccacu

SEQ ID NO: 59019 - RNA, 63 nt, hsa
acuacuguugacaguuuccgcagaaauccuauuucaguggaccaacauuguggcauggcagca

SEQ ID NO: 59020 - RNA, 63 nt, hsa
aaagaauuaaaccaaggcuuagccuuaagcagcucaguggaaggaugagcugcugcggaccac

SEQ ID NO: 59021 - RNA, 63 nt, hsa
gauguguggcugggcccucucccaccugccuguucaguggaggccagggcagcagcccagaac

SEQ ID NO: 59022 - RNA, 63 nt, hsa
cuuccuacugcaaaggacagugaauccagcaacucaguggauccaagcugggcucagaggucg

SEQ ID NO: 59023 - RNA, 63 nt, hsa
uaucugauggguuagagugccuuugagaagaaaucaguggauacuggauuugcuccugucaau

SEQ ID NO: 59024 - RNA, 63 nt, hsa
ccugggauggagcccaucucuccaguuccucccucaguggaggagaucccugugccuggggaa

SEQ ID NO: 59025 - RNA, 63 nt, hsa
uaacccaggaaacagacccagcugagguuauucucaguggauuacaguauacuuuugugugug

SEQ ID NO: 59026 - RNA, 63 nt, hsa
gucuggucaccagauauggaugagagauucuauucaguggaucagaaucaaacugguacauug

SEQ ID NO: 59027 - RNA, 63 nt, hsa
cagauauuuacugaaggaaucuagguuguauuuucaguggacaaugggaauaaagcauuucua

SEQ ID NO: 59028 - RNA, 63 nt, hsa
guaaguaaagaaaauauaauccuauauugagcuucaguggagaauaaaccagcugagaagaac

SEQ ID NO: 59029 - RNA, 63 nt, hsa
gugguugggugcaccuguaguucuguuuauuggucaguggaaaugaaaaaaaaaaaaaaaaaa

SEQ ID NO: 59030 - RNA, 63 nt, hsa
gauuaaauaaaacuuaaaucucacucuaggaguucaguggagagguuagagccagccacacuu

SEQ ID NO: 59031 - RNA, 63 nt, hsa
agaaguuuuuguucuuuuuuuuuuuuccaucacucaguggagaaaagcuuuguuaaugaaaga

SEQ ID NO: 59032 - RNA, 63 nt, hsa
cccaagagagacuuguuugggccuuuuguggugucaguggaauggauagguaacuuggguggg

SEQ ID NO: 59033 - RNA, 63 nt, hsa
agagauaacuuugaaauuucauaaguuugauauucaguggauacaaauagaacaugaauucua

SEQ ID NO: 59034 - RNA, 63 nt, hsa
guaagagcauaaucaaacaggaauuuucuuuucucaguggauaauacaacagagaaaacagag

SEQ ID NO: 59035 - RNA, 63 nt, hsa
aauaccccacacaaguucacuugauuaauugcaucaguggaaggggacauagcuucucucuua

SEQ ID NO: 59036 - RNA, 63 nt, hsa
uaaaauucauuuuccacuggaacucuaugacauucaguggagugguggaaaguuaaccucuua

SEQ ID NO: 59037 - RNA, 63 nt, hsa
acauuggaagugcuguagacuucuuuauguggcucaguggagagagggaaagaauguugcacc

SEQ ID NO: 59038 - RNA, 63 nt, hsa
cucuccucacugcucacagcaagggguucuguaucaguggauuucauuuuguagcugcugaga

SEQ ID NO: 59039 - RNA, 63 nt, hsa
aaucaaagugauucugggggaagcuaugcucuuucaguggauaauaaaauugguaacucuauu

SEQ ID NO: 59040 - RNA, 63 nt, hsa
ggcauaauauuaauagcgccaccuucuguugggucaguggagaugggugaggaacagcacaga

SEQ ID NO: 59041 - RNA, 63 nt, hsa
aaucaugaaugacaaugagauaacauacagaugucaguggagacaaaguuguggguuccuccu

SEQ ID NO: 59042 - RNA, 63 nt, hsa
ccagcagaaccacaggagagugcccugccugucucaguggaaguguauuauuguuuuaaggau

SEQ ID NO: 59043 - RNA, 63 nt, hsa
cacucgauuggagucaguugaauauuuguacccucaguggagcccuucuggucuuuucuucca

SEQ ID NO: 59044 - RNA, 63 nt, hsa
gacuggcaguaacaagggcuuuuacuguucuguucaguggaaccuucuuggucaaauuguaau

SEQ ID NO: 59045 - RNA, 63 nt, hsa
gucugcucacugccaggcuccucuccccuuuguucaguggagcuggcuuuucucccagccccu

SEQ ID NO: 59046 - RNA, 63 nt, hsa
aguauacuuuguaaggagcagauuuuuuuguucucaguggaacccugucaaaucgcauaaaag

SEQ ID NO: 59047 - RNA, 63 nt, hsa
augcccuauuccuaaauaauaacaauagcauugucaguggaggcugggccaccauggcagacc

SEQ ID NO: 59048 - RNA, 63 nt, hsa
ggagcgcucucuugauucugggauuucucccucucaguggagccuuauuaauauccaagacuu

SEQ ID NO: 59049 - RNA, 63 nt, hsa
gggggacggugcccccagcccaggaucgggcacucaguggagccgcacacggccccggcgcgc

SEQ ID NO: 59050 - RNA, 63 nt, hsa
aaaaaaaaagcucauauuuuguauauaucugcuucaguggagaauuauauagguugugcaaau

SEQ ID NO: 59051 - RNA, 63 nt, hsa
gguggggggagggguuggguugggcucuuaucuucaguggagcuuaggaaacgcucccacucc

SEQ ID NO: 59052 - RNA, 63 nt, hsa
cgcaccuagccucuuugaucauuucugugguguucaguggagguugacagcucccuaaagauu

SEQ ID NO: 59053 - RNA, 63 nt, hsa
aguggaauuggcaaacuagaauuuaguuuguacucaguggacagugcuguugaagauuugagg

SEQ ID NO: 59054 - RNA, 63 nt, hsa
gacaccagcuucaccuucuuaacaaggugcagcucaguggaagaugaugacaaccagaagaca

SEQ ID NO: 59055 - RNA, 63 nt, hsa
gagaggagacuguuugaugugguacaggggcagucaguggagggcgagugguuucggaaaaaa

SEQ ID NO: 59056 - RNA, 63 nt, hsa
gugugcauuuuuuuauucuaauauuccuucuagucaguggaaauuuguauucccauacaaacu

SEQ ID NO: 59057 - RNA, 63 nt, hsa
ccccuccuccauccacccugaggacccuggggcucaguggaggcagggcccugccccccuccc

SEQ ID NO: 59058 - RNA, 63 nt, hsa
gggcugcuagugaguuacauuaauuacugcaaaucaguggaauucucaagagacaagauaagc

SEQ ID NO: 59059 - RNA, 63 nt, hsa
ucuaauauauauaucauugagggugacuaaucuucaguggaccaaaucucuacccuuccccaa

SEQ ID NO: 59060 - RNA, 63 nt, hsa
cucaaugguaggagacauccagacuuguauauuucaguggaaauacaaaaccacuucagagac

SEQ ID NO: 59061 - RNA, 63 nt, hsa
aaagacucaagacacagaagaugaugagggagcucaguggaauuguaccgccuguacuuuuuu

SEQ ID NO: 59062 - RNA, 63 nt, hsa
ucagugccuccagccaaaugccuagcacagagcucaguggauuugauucuuccauucagauac

SEQ ID NO: 59063 - RNA, 63 nt, hsa
agaaugcaugaucucagagugauuaaaaaaaaaucaguggaaauaaaugaucauagaaggugc

SEQ ID NO: 59064 - RNA, 63 nt, hsa
auuucugguuuucuguccccauaguacaguucuucaguggacaugaccccacccagcccccug

SEQ ID NO: 59065 - RNA, 63 nt, hsa
aggcccaaggcuuggauaagguggccacuucccucaguggagucagucauguuagguaggagg

SEQ ID NO: 59066 - RNA, 63 nt, hsa
gcccccagagcccgucagcgugggggaaaggauucaguggaggcuggcagggucccuccagca

SEQ ID NO: 59067 - RNA, 63 nt, hsa
caagaaauaugugaauacccaccuaccaggugcucaguggaaucaaagaugaauccaaguuca

SEQ ID NO: 59068 - RNA, 63 nt, hsa
uuguccaccuagucagagcccaagaaagaauuuucaguggaaaaaucaauauauaacuuagug

SEQ ID NO: 59069 - RNA, 63 nt, hsa
aaauaaaccauuggacagauuucaguaaugucuucaguggaacacaaaugaaaaugaauagcu

SEQ ID NO: 59070 - RNA, 63 nt, hsa
guuuugguuguuuuaaacucaugaaguauggguucaguggaaauguuuggaacucugaaggau

SEQ ID NO: 59071 - RNA, 63 nt, hsa
ggcgugggggacaagaaggauacaagguaaguuucaguggagcucagaggacggggagauaga

SEQ ID NO: 59072 - RNA, 63 nt, hsa
ggggcgucugagcuccccaggcaugaccaaaccucaguggaggggccucugcuucaggccccg

SEQ ID NO: 59073 - RNA, 63 nt, hsa
acagcuaccugcauuguagaaccuuuucuuaucucaguggaaccuucuauaaccuaaauauac

SEQ ID NO: 59074 - RNA, 63 nt, hsa
ucagccuggacacccggcagcuucuggaguuugucaguggaggcagaggggauccggccaggc

SEQ ID NO: 59075 - RNA, 63 nt, hsa
cucagggaguguuuuccugugaggccucccccaucaguggaccagagggagaagcccgaugcc

SEQ ID NO: 59076 - RNA, 63 nt, hsa
aaaugauuagcccuaaaugaaacuguaauaauuucaguggaaacucaaucuguuuuuaccuuu

SEQ ID NO: 59077 - RNA, 63 nt, hsa
cagcuucuucggagaagugaaauauaacauuacucaguggacggagaaaucuguuuuguuaca

SEQ ID NO: 59078 - RNA, 63 nt, hsa
ccugcgguucaguucaggcugagauuuucuccuucaguggacugucugugucccccugccgaa

SEQ ID NO: 59079 - RNA, 63 nt, hsa
cuuaugggucuccagaaacucugccagccagccucaguggagaagcuuccucuaccaccagcu

SEQ ID NO: 59080 - RNA, 63 nt, hsa
gauacauacaguggaguucuauaaacucauaccucaguggacuuaaccaaaauuguguuaguc

SEQ ID NO: 59081 - RNA, 63 nt, hsa
auccuguuccgccuccugccaccuggaccucccucaguggaugucuucccucccccgacccca

SEQ ID NO: 59082 - RNA, 63 nt, hsa
uccugucugccacgugcugacggucgggaagcuucaguggagaggccuaacucuaaugucgcc

SEQ ID NO: 59083 - RNA, 63 nt, hsa
auauauagagguauauuuagccucuuuuagaagucaguggauugaaugucuuuuuauuuuaaa

SEQ ID NO: 59084 - RNA, 63 nt, hsa
cacauuuucuguucagggauuaagaccagaauaucaguggauuuguuuuccccaccaaguggc

SEQ ID NO: 59085 - RNA, 63 nt, hsa
ugcuuggaauucuggcagguuccccgggguguuucaguggacaggaggcccccgugccguggc

SEQ ID NO: 59086 - RNA, 63 nt, hsa
cuacuacaucuaggacgccuccggugagcagggucaguggaagccccaacgggaaaggaaacg

SEQ ID NO: 59087 - RNA, 63 nt, hsa
aucucuuguuuguguugaacugaaggcuaagucucaguggacauggaaaagacuuuuggguga

SEQ ID NO: 59088 - RNA, 63 nt, hsa
uacuuaaaggaauaauaaaugcauaauaugaggucaguggacgccauuuucuguuauaaucau

SEQ ID NO: 59089 - RNA, 63 nt, hsa
cgaagcauuguuucugagugugugaggauguuuucaguggacucagugaagaucugcccucag

SEQ ID NO: 59090 - RNA, 63 nt, hsa
ccaguccacagaggcccccaggagcacugccuuucaguggaccggguggggccuggugggagg

SEQ ID NO: 59091 - RNA, 63 nt, hsa
cacugaggacugguaccucgggaacgcaagcugucaguggaacugucccacaagaauucacag

SEQ ID NO: 59092 - RNA, 63 nt, hsa
acugucuugcauuauaaaauuagaaguguauuuucaguggaagaaacauuuuucaauaaauaa

SEQ ID NO: 59093 - RNA, 63 nt, hsa
gccauaaguaaucagcaaucuucaaaagcacuuucaguggauuggucaucuggguucuaaagg

SEQ ID NO: 59094 - RNA, 63 nt, hsa
aaaaguaguagcucucuguagcauuauggaguuucaguggaaccaaauuuuugccauuaaaaa

SEQ ID NO: 59095 - RNA, 63 nt, hsa
gcaagaauucuuaugcuuaugagagccaaguagucaguggaagagaguagagcucaaaacugg

SEQ ID NO: 59096 - RNA, 63 nt, hsa
uuuggaaaagaaugcaauaguuguacuccacagucaguggaacuguucccugaguccgaggcu

SEQ ID NO: 59097 - RNA, 63 nt, hsa
gcagaacacugcagucagauccuguuacuugcuucaguggaccgaaaucuguauucuguuugc

SEQ ID NO: 59098 - RNA, 63 nt, hsa
cgguuugcauucuuuuggaacucaaugugccgaucaguggagucaguaucgagccugaccacc

SEQ ID NO: 59099 - RNA, 63 nt, hsa
uauuuuuuauaaccaccaucauuccuugucucuucaguggaagauauucuuuccuguuuccca

SEQ ID NO: 59100 - RNA, 63 nt, hsa
aacaugaacaugaguaccuauuuaugugggccuucaguggaugggcagugccacucaggucuc

SEQ ID NO: 59101 - RNA, 63 nt, hsa
auuaacaaacccaaagugaagcggucacuccucucaguggaaagagcacgaggauguucucag

SEQ ID NO: 59102 - RNA, 63 nt, hsa
cucacugaugguuuuuuacugcucucugcucugucaguggagcuauccggggcaauuguagcg

SEQ ID NO: 59103 - RNA, 63 nt, hsa
ugagaaacuuugaaaauggaucuucauauagaaucaguggauggaaacaaggguuuaaacuug

SEQ ID NO: 59104 - RNA, 63 nt, hsa
agaugugcacucuggacucaagaaacucuuaguucaguggaggaaaugagcagauaaguagau

SEQ ID NO: 59105 - RNA, 63 nt, hsa
uguggacaccauggagggggaaguggagcguuuucaguggaguuggcuccuccccgcacugag

SEQ ID NO: 59106 - RNA, 63 nt, hsa
gggcccucgacaggacagcaggacgguuuguuuucaguggaaucccaucccuggguuccccug

SEQ ID NO: 59107 - RNA, 63 nt, hsa
uaauaguucaguaauuuaaaugcuuauuuauuuucaguggaaggauuuuuauuaaaaagaagc

SEQ ID NO: 59108 - RNA, 63 nt, hsa
uccuccgaaguuuuucaggggguaaaaguaacaucaguggaggguauuauuuuaaauaaauuu

SEQ ID NO: 59109 - RNA, 63 nt, hsa
aaaacauugacuguuaccauugaaugagauggaucaguggauauuaagaugagguuacaaauu

SEQ ID NO: 59110 - RNA, 63 nt, hsa
cucuuguuuugguuauuuuguguagcaguuuaaucaguggauaacugagccuguuuccucuua

SEQ ID NO: 59111 - RNA, 63 nt, hsa
auuuuacuaacauaaauauuuucuauguguguuucaguggaugacaaucgagcagcagaagaa

SEQ ID NO: 59112 - RNA, 63 nt, hsa
ugcuucuuccauagacagaagcuuagucuguuuucaguggaauuaauugaugaacugggaaaa

SEQ ID NO: 59113 - RNA, 63 nt, hsa
gucugagaaaauauuuuuuucuaaagaaggcagucaguggaucuuaaaaugacaaucuguuuu

SEQ ID NO: 59114 - RNA, 63 nt, hsa
ccagaagaaguuuuuccuugauugugcuauguuucaguggaagaaauucuuugaaguagaugu

SEQ ID NO: 59115 - RNA, 63 nt, hsa
aagaggcacauugcauagaagccauuggggaguucaguggaaguucuguaagaugugcaugua

SEQ ID NO: 59116 - RNA, 63 nt, hsa
acacucaagacuuuugacugccauuuuguuuguucaguggagacucccuggccaacagaaucc

SEQ ID NO: 59117 - RNA, 63 nt, hsa
aaaaucuaaaaauucugguuuuaaauaugagaaucaguggaaaauaaggguauaauuuuguag

SEQ ID NO: 59118 - RNA, 63 nt, hsa
auaauagggaaauauccauuuaaaacagguauaucaguggaaacacagaguuauuuuaaguga

SEQ ID NO: 59119 - RNA, 63 nt, hsa
ccccuuccugguugcuaccacucaggcugccacucaguggacuccaccccagggacacggcag

SEQ ID NO: 59120 - RNA, 63 nt, hsa
uagugcaucuuuuguaucucaggcguggcuucuucaguggaccaagcugcaaugcaguauuga

SEQ ID NO: 59121 - RNA, 63 nt, hsa
aacaugcaaguuuguacuuugaucuuuaccaggucaguggauugcuucaaaagcagaguuuug

SEQ ID NO: 59122 - RNA, 63 nt, hsa
acacaagaaaaacagagaaaagccugaucccugucaguggaaaagggguucaaugaauuacgg

SEQ ID NO: 59123 - RNA, 63 nt, hsa
gauaaaaauugugccuuuagccuucuauauacaucaguggaaacuuaagaugcaguaauuaug

SEQ ID NO: 59124 - RNA, 63 nt, hsa
ccagugcccagaauauacuagaaucaccgcauuucaguggacuccugaaguuguacuugugua

SEQ ID NO: 59125 - RNA, 63 nt, hsa
gaggaggggcugcccacucuguaaaugaagggcucaguggagucuggccaagcacagaggcug

SEQ ID NO: 59126 - RNA, 63 nt, hsa
aagugaagagaacgucaugaguguaagugcaaaucaguggaaggagcggcaaacugggacaug

SEQ ID NO: 59127 - RNA, 63 nt, hsa
acgcuguagauggaacauguuucugugaaccuaucaguggauuucauucucuugaguaauaaa

SEQ ID NO: 59128 - RNA, 63 nt, hsa
ggcucaggcuagcguaaacaggcuuucuccagcucaguggagcagugagcagccgacucugag

SEQ ID NO: 59129 - RNA, 63 nt, hsa
caacuuuuccagugcauuacaugguauuguauaucaguggagaaauguauuauuuccaugauc

SEQ ID NO: 59130 - RNA, 63 nt, hsa
gcuuauacauuauauuuauagaauauaaauuugucaguggaauaaaauuuccccuuuuuuuca

SEQ ID NO: 59131 - RNA, 63 nt, hsa
gacugcaucccuccugggccugagccucgggacucaguggacaccaaagucaagaccagcacc

SEQ ID NO: 59132 - RNA, 63 nt, hsa
auccgcguggugggcuggcagcugacggccugcucaguggagccaggagcuaacucagacccc

SEQ ID NO: 59133 - RNA, 63 nt, hsa
uguguuauucuuucuauaaugaucaguuuacuuucaguggauucagaauuguguagcaggaua

SEQ ID NO: 59134 - RNA, 63 nt, hsa
aagaccuucccuuccuugaucccuggaccagacucaguggacauuugugcaauugcucgcccu

SEQ ID NO: 59135 - RNA, 63 nt, hsa
cugcccucucugagucucaguuuuuccauuuguucaguggagagaauuaaccauugauaccuc

SEQ ID NO: 59136 - RNA, 62 nt, hsa
acauccugggccuggaauagugaugaagagcaucaguggaaaacccaccccacacgccaugg

SEQ ID NO: 59137 - RNA, 63 nt, hsa
caugacugacggccccuugugcaagcucauucuucaguggauccuucaguggaguggugacac

SEQ ID NO: 59138 - RNA, 63 nt, hsa
ccccuugugcaagcucauucuucaguggauccuucaguggaguggugacacgugccagcgguc

SEQ ID NO: 59139 - RNA, 63 nt, hsa
gugacuuccauuauggcuggacaggcggugagcucaguggauugcaguggugugcuggugauu

SEQ ID NO: 59140 - RNA, 63 nt, hsa
uaaucccauccucucacccauccauuuccucacucaguggagauuugccaaaugaauaaacga

SEQ ID NO: 59141 - RNA, 63 nt, hsa
aauuuagaggaaaucaaacaagcaucacuuuccucaguggaaaaacuuaugaaacuucuuaua

SEQ ID NO: 59142 - RNA, 63 nt, hsa
gauauuucuugaaaauaacgaccuugucuuguaucaguggaagaaguaaguugcuuagaaagg

SEQ ID NO: 59143 - RNA, 63 nt, hsa
aacaugugauuucaggguugccgcagugucaccucaguggaccagccugggggaaggagcuua

SEQ ID NO: 59144 - RNA, 63 nt, hsa
uugccucacucugauccuggccccauaauguccucaguggaaggugaugggggccggugcugu

SEQ ID NO: 59145 - RNA, 63 nt, hsa
gaagcuuauaaucuaauuuuaggaggaccaaauucaguggauggcaacuggaacauugauugu

SEQ ID NO: 59146 - RNA, 63 nt, hsa
guuuaagacgccaagggcauugcagaaucccucucaguggacaguaugcacucagcugaccac

SEQ ID NO: 59147 - RNA, 63 nt, hsa
ccacugagggacugggcugggaaguccugcguuucaguggagcguaugagcgucaaguccugc

SEQ ID NO: 59148 - RNA, 63 nt, hsa
ccaagcccagaaguaccuuugcacuccugguuuucaguggacagaggaagcuuuagauagaga

SEQ ID NO: 59149 - RNA, 63 nt, hsa
agaaaugggaaucuuuuuuuucucuuccaggagucaguggaagaauaguucucuagcuaagga

SEQ ID NO: 59150 - RNA, 63 nt, hsa
ggugucaaugaauuuugcuugguggaugaaaugucaguggaagaagcagaugagaaacucuug

SEQ ID NO: 59151 - RNA, 63 nt, hsa
ugaacucuuucaacucugcgcugcccagccuucucaguggacuugccccuccuaagcagagaa

SEQ ID NO: 59152 - RNA, 63 nt, hsa
agcauaaggguuauuugagcaaguaacauuaacucaguggaaggcauuguccugugaaauauu

SEQ ID NO: 59153 - RNA, 63 nt, hsa
gcucugaacuuuguguauuugaaaaaggaaaauucaguggaggcuuuuguuugugugugugug

SEQ ID NO: 59154 - RNA, 63 nt, hsa
uucagggucugucuaucuuaagcuuucuuuauaucaguggaaauccagcgagauauuagaaau

SEQ ID NO: 59155 - RNA, 63 nt, hsa
aaaaaauuagcacaucccuuuacuuacuuguuaucaguggauucucgggguuuggacuuaaug

SEQ ID NO: 59156 - RNA, 63 nt, hsa
gcuguugguagugcuuuccacagaugcugguccucaguggauuaggucagaagcucauguucu

SEQ ID NO: 59157 - RNA, 63 nt, hsa
ggccugagguagaggggagugguauguguuuucucaguggaagcagcacaugagugggugaca

SEQ ID NO: 59158 - RNA, 63 nt, hsa
uguccuaggugcuagguggaccgagcaaaagacucaguggaugaacuggugcagugccugaca

SEQ ID NO: 59159 - RNA, 63 nt, hsa
auuucaaauauuuagcaacaaaaguuuauuccuucaguggaagauuuauaauaaugauaggug

SEQ ID NO: 59160 - RNA, 63 nt, hsa
guuagaacuacuacucacaguuaccacuuggggucaguggaacaaaaugcauauaugguuuug

SEQ ID NO: 59161 - RNA, 63 nt, hsa
ugcuuucauuguuuuuucauaaucuuuucuccuucaguggaguacugauugcaugaaauuuga

SEQ ID NO: 59162 - RNA, 52 nt, hsa
agucucuuccagacucauagcaucaguggauaccauguggcugagaaaagaa

SEQ ID NO: 59163 - RNA, 63 nt, hsa
uagcugcucugagcaucaagaauuagaagucuuucaguggaauuguacaagagucccuuugaa

SEQ ID NO: 59164 - RNA, 63 nt, hsa
ugacugccgugugugcuuagacccguaguuuccucaguggauagcacucaauuuauuccguag

SEQ ID NO: 59165 - RNA, 63 nt, hsa
aaagguguugauuuuuguauaugaaguuaagccucaguggagucucauuuguuaguuuuuagu

SEQ ID NO: 59166 - RNA, 63 nt, hsa
aaggcagggguuaaaucaggauaaaaacagacaucaguggaaucgaaaaccaauaguuaguua

SEQ ID NO: 59167 - RNA, 63 nt, hsa
guuuuaauguagaaccucaaacaggauggaacaucaguggauggcaggagguugggaauucuu

SEQ ID NO: 59168 - RNA, 63 nt, hsa
acuauuauagaauggaacucaaggaaaucugugucaguggaugcugcucugugguccgaaguc

SEQ ID NO: 59169 - RNA, 63 nt, hsa
aggauucuuugaacuuauuuccacuuuaauuucucaguggaaguuaagaggggugagaaaaca

SEQ ID NO: 59170 - RNA, 63 nt, hsa
gagaaagguaaguccauuuuccccuucagguccucaguggauuacuuaaccacugcugucccu

SEQ ID NO: 59171 - RNA, 63 nt, hsa
guuuccuagcaaucauuuuggaucacuggacuuucaguggacuaccuaaaacaggggacagcu

SEQ ID NO: 59172 - RNA, 63 nt, hsa
uauuaaaugacuccaccugcgcaguccuuguguucaguggaugaauaccugugggcucuugua

SEQ ID NO: 59173 - RNA, 63 nt, hsa
ugguauuuucaauuuucauuugcaagaaaaugaucaguggaaugaaauaacugaaguauaaca

SEQ ID NO: 59174 - RNA, 63 nt, hsa
cuuuuuauuucccuuguuucucauuuugcccugucaguggaugguagaugcuuuguauaucuu

SEQ ID NO: 59175 - RNA, 63 nt, hsa
ugcaauuuuuaaaaaacaaguuuggaauuuuuuucaguggagugguuuucgcuuaaaggaaaa

SEQ ID NO: 59176 - RNA, 63 nt, hsa
ucgguuaaugggucaguucuccuuggaacugaaucaguggaaagagaaugcuucccauagaaa

SEQ ID NO: 59177 - RNA, 63 nt, hsa
guacaaacuggccaagugcuucuguagauaacgucaguggaguaaauauucgacaggccauaa

SEQ ID NO: 59178 - RNA, 63 nt, hsa
uguggcugggaacauugcaucccaaagagcuucucaguggaggaggcuggggaaggcaugagg

SEQ ID NO: 59179 - RNA, 63 nt, hsa
uucauaacuugugggcuuuuuuuuuuuuuaacuucaguggaauuuacuuuagauauucauuca

SEQ ID NO: 59180 - RNA, 63 nt, hsa
uucagccucucaguuuuaauauagcuuuauuuuucaguggagaucauuguuuaggaugagaca

SEQ ID NO: 59181 - RNA, 63 nt, hsa
auuaauguuuacaguggaauugugaauaaguuuucaguggacuaucuuaucccuugacaaaaa

SEQ ID NO: 59182 - RNA, 63 nt, hsa
cauacugcauucugugcuacacaagccuuagccucaguggagcugugguucucuugguacuuu

SEQ ID NO: 59183 - RNA, 63 nt, hsa
cucugcugugcugcacauugagcccuuucucagucaguggaguaucaaguugggccaucuguc

SEQ ID NO: 59184 - RNA, 63 nt, hsa
aggcccaggcaggcccagccucugccccacccaucaguggaguccagauggcaggcuacaguu

SEQ ID NO: 59185 - RNA, 63 nt, hsa
agaugguuuagguguacagcaaauuuaaaauagucaguggauugugucuuacuacuucauguc

SEQ ID NO: 59186 - RNA, 63 nt, hsa
uuugcuuaguaucauguccauguuuccuucaccucaguggagcuucugaguuuuauacugcuc

SEQ ID NO: 59187 - RNA, 63 nt, hsa
gcacuggguucuacugcugugggguaaacuaacucaguggaauagggcugguuacuuugggcu

SEQ ID NO: 59188 - RNA, 63 nt, hsa
uauuuuaaaugcauuuaucuuuuuugacacuauucaguggaauguguaagcuagcuaauucuu

SEQ ID NO: 59189 - RNA, 63 nt, hsa
cauccacacaaacccacggcucccaguugacagucaguggaaugcucgucuccuuagcgucca

SEQ ID NO: 59190 - RNA, 63 nt, hsa
uacagacucccugggguuggcaggggcuccaucucaguggaccaggaagcaagaggggaagcg

SEQ ID NO: 59191 - RNA, 63 nt, hsa
acuuuucauuguaauuucgcuuagacccuuuuaucaguggagcuccaguuuucuuaccuagcu

SEQ ID NO: 59192 - RNA, 63 nt, hsa
agggccaacuuaguuccuacuguucugugcccuucaguggauggaacgugagugucugaucau

SEQ ID NO: 59193 - RNA, 63 nt, hsa
gaaacacaaacaauaguaauucucaggccaucaucaguggagccauguuaauguaaucugaug

SEQ ID NO: 59194 - RNA, 63 nt, hsa
guuuuaacaauccauucacaagccuccuguaccucaguggaucuucagaacugcccuugcugc

SEQ ID NO: 59195 - RNA, 63 nt, hsa
auagaaaccaaguaagaauaaaugagagauauuucaguggacaucuggacauauuuauggacu

SEQ ID NO: 59196 - RNA, 63 nt, hsa
uaaauaugacauugaauucgaacuguguguaugucaguggaaucaaaucaaaagccacuaaca

SEQ ID NO: 59197 - RNA, 63 nt, hsa
uaauacaauauuaaguccaaauccaaccuccugucaguggagcaguuauguuuuauacucuac

SEQ ID NO: 59198 - RNA, 63 nt, hsa
cauucagagagaacauggguccagaggacauucucaguggaaagaguuugaucugcagcaccc

SEQ ID NO: 59199 - RNA, 63 nt, hsa
cagaggcugggguccuccugggggacagcacagucaguggagagagccaggggcuggaggugg

SEQ ID NO: 59200 - RNA, 63 nt, hsa
uggcccgguggggacacaguugcucguggccacucaguggagcugggccugcagcagacucaa

SEQ ID NO: 59201 - RNA, 63 nt, hsa
ucuggucuuccaagacuuugccacucacuuaucucaguggacuccaaagcaaaagcucccgac

SEQ ID NO: 59202 - RNA, 63 nt, hsa
gaggcaauuggggguuucaggucaaagagagggucaguggaaacaagggugggccuugugagg

SEQ ID NO: 59203 - RNA, 63 nt, hsa
ggugcccacagcagguacccacuggcccccuccucaguggagaccccaaggagcugcagcuga

SEQ ID NO: 59204 - RNA, 63 nt, hsa
cugagaggacuuuucuuuguggcuuccuaaaauucaguggaaaauuaauuguuuggggaugag

SEQ ID NO: 59205 - RNA, 63 nt, hsa
ucaguccccaacggcuggcaagacucaggguccucaguggacauggugugggugacaucagaa

SEQ ID NO: 59206 - RNA, 63 nt, hsa
gcaaauuuuuaaguaauuuaugaaaaaccuagaucaguggaucuccucucuggcugcccauua

SEQ ID NO: 59207 - RNA, 63 nt, hsa
cccuuaacugauuguuauaugcuacaagggauuucaguggacugcagagugcgaacgucuugc

SEQ ID NO: 59208 - RNA, 63 nt, hsa
cugcccgcaaagcaagagcaucauuccuauucuucaguggaugccagccuucccugccccaac

SEQ ID NO: 59209 - RNA, 63 nt, hsa
uuuguggugggugcugugaagaguaaacauuacucaguggaaagcuaaguucagaagguacuu

SEQ ID NO: 59210 - RNA, 63 nt, hsa
cccugcacccaccccugcccaggcagucuuugcucaguggaucacacacauggaaggugaugg

SEQ ID NO: 59211 - RNA, 63 nt, hsa
guggccuggaggccuauuaagcacgacacaguaucaguggaauugauccauaaaccucccugu

SEQ ID NO: 59212 - RNA, 63 nt, hsa
ucacugugcuagcaauaguuggcuucuccccugucaguggaaaccccacuucugcccggcccu

SEQ ID NO: 59213 - RNA, 63 nt, hsa
caggccgccaggaauggaccaugcagaucacugucaguggagggaagcugcugacugugauua

SEQ ID NO: 59214 - RNA, 63 nt, hsa
aucuaggaccucagccauguggccucuggggaaucaguggaugaagacgucccuccuccauca

SEQ ID NO: 59215 - RNA, 63 nt, hsa
cucuuucuuugcagaccgaacagugaaaagcuuucaguggaggacaaaggagggccucacugu

SEQ ID NO: 59216 - RNA, 63 nt, hsa; identical to SEQ ID NO: 59214

SEQ ID NO: 59217 - RNA, 63 nt, hsa
uauauguuaaaccaaucaaggaacuuacucuauucaguggaaacaauaaucaucucuauugcu

SEQ ID NO: 59218 - RNA, 63 nt, hsa
caacugcugagaccucuucuccaucccccuuauucaguggaagaugacgggggaucugaggcu

SEQ ID NO: 59219 - RNA, 63 nt, hsa
uugugcuauuuggaagcaaagcuauuuuuuuugucaguggaaugcaguuuuuuuacuauucca

SEQ ID NO: 59220 - RNA, 63 nt, hsa
uauucaccuuaagcgauuucaauuuguaaaugaucaguggauaaaaucacagaaaauugucag

SEQ ID NO: 59221 - RNA, 63 nt, hsa
cggaguccuagcauccccuugggagcagcagcgucaguggacccagugcugagaaaagccccc

SEQ ID NO: 59222 - RNA, 63 nt, hsa
agaacaaagcccauucauccauuggauucacugucaguggagauacuaccucucguggcaacc

SEQ ID NO: 59223 - RNA, 63 nt, hsa
cugaaccuugaggagggaaagcuugccuucuauucaguggacaaucaggagaagcuucuguau

SEQ ID NO: 59224 - RNA, 63 nt, hsa
guaaaguucccuucuugggacuuauuccuggagucaguggauacaaguagugcagaagguuca

SEQ ID NO: 59225 - RNA, 63 nt, hsa
aggcagcgacuccuuggacagaggccugggcccucaguggacugccugcucccacagccuggg

SEQ ID NO: 59226 - RNA, 63 nt, hsa
aggcugcugacccucagcagggccagacaaggcucaguggaucuggucugaguuucaaucugc

SEQ ID NO: 59227 - RNA, 63 nt, hsa
agccacauuacaagcugccauccccuccccguuucaguggacccuguggccaggugcuuuucc

SEQ ID NO: 59228 - RNA, 63 nt, hsa
uaccugacucuguguuguaauuucaggggagcaucaguggaggaggcagugggggcagcagca

SEQ ID NO: 59229 - RNA, 53 nt, hsa
uucggacccaaaagaggugacugucaguggaggggucucugcagccaacugag

SEQ ID NO: 59230 - RNA, 63 nt, hsa
gggguguccugggcugaauuuccugggcacuucucaguggaacucucuagccuccugguucgg

SEQ ID NO: 59231 - RNA, 63 nt, hsa
uccugagcuuggccagaagggggccaugaggccucaguggacuuuccacccccucccuggccu

SEQ ID NO: 59232 - RNA, 63 nt, hsa
aucuuuuuuagcugagggggacaagaggagaagucaguggacacauggaaguuacucgugacc

SEQ ID NO: 59233 - RNA, 63 nt, hsa
cugcacugguuugucgaucuaguucaguucaacucaguggauguucucugaaugcuuacuggg

SEQ ID NO: 59234 - RNA, 63 nt, hsa
ugugauucuuaacauuauagcacaaguauuaucucaguggauuauccggaauaacaucugaaa

SEQ ID NO: 59235 - RNA, 63 nt, hsa
gaucaaagaacucugacugcagaacugccgcucucaguggacagggcaucuguuacccugaga

SEQ ID NO: 59236 - RNA, 63 nt, hsa
ccugagaccuuagaaaccagaagagccauacagucaguggaaggcgggggggcccuggccucu

SEQ ID NO: 59237 - RNA, 63 nt, hsa
caccaucugugggucauccuuucccuggaccguucaguggacagcuuucaagcagugcuuguu

SEQ ID NO: 59238 - RNA, 63 nt, hsa
aacaaacaaaaaacugccuuugauacaggcaauucaguggacuauaauaauaguggaggguug

SEQ ID NO: 59239 - RNA, 63 nt, hsa
gacacccccagcucugucagagucacacggggcucaguggacggccuuggacugaacgugggc

SEQ ID NO: 59240 - RNA, 63 nt, hsa
uuuucuucucagaaaaaccauaauacuuccuuuucaguggacuguagcuucuuaaaaaaaaaa

SEQ ID NO: 59241 - RNA, 63 nt, hsa
ugaccauucagcuauaaccaacugcaguuugaaucaguggaugccuauagcuuccugaagcug

SEQ ID NO: 59242 - RNA, 63 nt, hsa
ugccuguuuccuaguaaugggcugaucaaaugaucaguggaauucuugguuugaugauaaccu

SEQ ID NO: 59243 - RNA, 63 nt, hsa
cauguaucuguaguccaugaguuauauccuggcucaguggagugauauuuauguauuauuuuu

SEQ ID NO: 59244 - RNA, 63 nt, hsa
cacacaggcaguggccaggccccacggugcuucucaguggacaaugaugccuccuccgggaag

SEQ ID NO: 59245 - RNA, 63 nt, hsa
uauauuuaggucccagaacaaggaagucacuuuucaguggauccaaagaaucuacuccuuaaa

SEQ ID NO: 59246 - RNA, 63 nt, hsa
aucacaucagggagugauuaguccuggggaaauucaguggaggcacaagccugaagcacucuu

SEQ ID NO: 59247 - RNA, 63 nt, hsa
uaauauauuuauuaauauuugaaaggcauucauucaguggacagugggaauuaacucucccaa

SEQ ID NO: 59248 - RNA, 53 nt, hsa
uacuuuuauuauuuggaugaauaucaguggagaaaauggagacucagaagagg

SEQ ID NO: 59249 - RNA, 63 nt, hsa
agguaauaccacuaucaggccuguaggagauacucaguggagccucugcccuucuuuuucuua

SEQ ID NO: 59250 - RNA, 63 nt, hsa
ucaucucgcccagagugcucaaggcugguaugaucaguggaucaggaaugcaauugugaauuc

SEQ ID NO: 59251 - RNA, 63 nt, hsa
agagcaaagccacagacgaugacuuguccauucucaguggaugcuccaggcugugccuacaca

SEQ ID NO: 59252 - RNA, 63 nt, hsa
gcuggagcugcagccugcucgccaucuggaggcucaguggaguggggaguugggguucucaua

SEQ ID NO: 59253 - RNA, 63 nt, hsa
caauaugcuuuggguggacggucuccuacauguucaguggaggccaccaggagcauccaugag

SEQ ID NO: 59254 - RNA, 63 nt, hsa
cugaaucacgagaauguggagggguggggggugucaguggaaaggcauaaggcugagcugaga

SEQ ID NO: 59255 - RNA, 63 nt, hsa
guagguggugguuuuaggucuugucacccucacucaguggaacugccucugggagcuuuggcg

SEQ ID NO: 59256 - RNA, 63 nt, hsa
agugucuaggaaaaaacaaaaacuccaaacccuucaguggaugaggacaaggucgcagaaagg

SEQ ID NO: 59257 - RNA, 63 nt, hsa
cugaagggagaggaguaacagccagaccccccaucaguggacaaggggagaguccccuacucc

SEQ ID NO: 59258 - RNA, 63 nt, hsa
uguccuccucuuucugugagaguccugagucccucaguggagcaaguuccugcuggcguuucu

SEQ ID NO: 59259 - RNA, 63 nt, hsa
cgacuggagcaagguuugcuggcagaugaggccucaguggaagugacggcuacuguggagaug

SEQ ID NO: 59260 - RNA, 63 nt, hsa
aacccagugagacagaccgccaaauaaacggacucaguggacacucagaccagcucccagaug

SEQ ID NO: 59261 - RNA, 63 nt, hsa
aggaggaagggagggcagagggggcuguggccgucaguggaaugcagcugucaggccugaagg

SEQ ID NO: 59262 - RNA, 63 nt, hsa
gcucauguggguguccccucucucacucugccuucaguggagcuagaccugccaggagcacuu

SEQ ID NO: 59263 - RNA, 63 nt, hsa
uugagggaagaccacccuccugucacccggaccucaguggaagcccguuccccccaucccugg

SEQ ID NO: 59264 - RNA, 63 nt, hsa
ucuccuggggccuucgaugggcuuuucuucuugucaguggagggagcagcuccccacucagcc

SEQ ID NO: 59265 - RNA, 63 nt, hsa
aagaugcccagggcccagaagccaucagaauuaucaguggagaagcaccuuuugacucuuccc

SEQ ID NO: 59266 - RNA, 63 nt, hsa
cuggagacaacaccucagaccaucugaaccccaucaguggacgaaaauggggcuguuaauaua

SEQ ID NO: 59267 - RNA, 63 nt, hsa
agagauguuauguaauaugcugagguggcgaccucaguggagaaauguaaagacugaauugaa

SEQ ID NO: 59268 - RNA, 63 nt, hsa
ccccagggcacauaagagcaaaggcuccaauggucaguggaugacucugcaaaagugaccccc

SEQ ID NO: 59269 - RNA, 63 nt, hsa
uggggagcuguccggugcuaccacaccgugcccucaguggacuaaccacagcagcagccaggg

SEQ ID NO: 59270 - RNA, 63 nt, hsa
gagauaagcugcaaggggcgaagcaacuuuaugucaguggaaaacgugucucuuuaaagcugc

SEQ ID NO: 59271 - RNA, 63 nt, hsa
uauauauauacagugccuuuuugguguugugagucaguggaacacugaaauacagcgguugug

SEQ ID NO: 59272 - RNA, 61 nt, hsa
cauaacagaagagacuagaguggaacagauacgucaguggauaaagcucaaagcaaacaac

SEQ ID NO: 59273 - RNA, 63 nt, hsa
cacaaaauauaguaauuucauuuuuaccuuucuucaguggacugaauuguauggaaggaaauu

SEQ ID NO: 59274 - RNA, 63 nt, hsa
agcuucccagggcugcccccgacaggcuggcucucaguggaggccagagaucuggaaucgggg

SEQ ID NO: 59275 - RNA, 63 nt, hsa
aagaaauaaaugaguauuacugaaacuuaaagaucaguggaaaaaaaaaacauuuaaaaaugu

SEQ ID NO: 59276 - RNA, 63 nt, hsa
aggccucgaggagucaauuugccucugugugccucaguggagacaagugggaaaacauggucc

SEQ ID NO: 59277 - RNA, 63 nt, hsa
cugggaaguuuuucagugacgucucuggggcacucaguggauugucuguaggaaacuugcagc

SEQ ID NO: 59278 - RNA, 63 nt, hsa
ccuaaucccuggcccucccagcugucugggacuucaguggacccccagccccugcccccacuc

SEQ ID NO: 59279 - RNA, 63 nt, hsa
ccgcuggcgucaaguucagcuccacgugugccaucaguggauccgauccguccagccauggcu

SEQ ID NO: 59280 - RNA, 63 nt, hsa
caggcuuaguaacgccguggacugcagcgacaaucaguggauggugcugucuaugcacaggug

SEQ ID NO: 59281 - RNA, 63 nt, hsa
ccuugcaugcaccuugcuaccugcuugcggcuuucaguggagggcaggggucuggcacaggug

SEQ ID NO: 59282 - RNA, 56 nt, hsa
auguuggccacgauccaugaagucauucaguggaaagaugcacguugauacuauuu

SEQ ID NO: 59283 - RNA, 63 nt, hsa
ucggccugagagcugugccgcuccucugucuugucaguggaggugccuggguggggagcaggu

SEQ ID NO: 59284 - RNA, 63 nt, hsa
gcccccggccaggcccugaggaaaugcucagccucaguggagauggggagguuagagagaugg

SEQ ID NO: 59285 - RNA, 63 nt, hsa
ccaacucagggacauccccucuccugggcgacgucaguggaccuuccugcacccccagccugg

SEQ ID NO: 59286 - RNA, 63 nt, hsa
aaacauuauuucauuuuuuuccucucaguaaugucaguggaaguuagggaaaagauucuugga

SEQ ID NO: 59287 - RNA, 63 nt, hsa
cuucuuccuuguccccguguuucuugagagcacucaguggaugacuauggagaagagccugca

SEQ ID NO: 59288 - RNA, 63 nt, hsa
auccuuuuacacgcacaaaagcaauagauucauucaguggacaaguuccuuguuuaacuacac

SEQ ID NO: 59289 - RNA, 63 nt, hsa
gguuauauuucaaccacaccuaaauuaacaaauucaguggacauuuguucuggguuaacagua

SEQ ID NO: 59290 - RNA, 63 nt, hsa
ccuaggucuugggagcucuuggaggugucuguaucaguggauuucccauccccugugggaaau

SEQ ID NO: 59291 - RNA, 55 nt, hsa
gugcccggaaaaaugauuaaagcauucaguggaaguauaucuauuuuuguauuuu

SEQ ID NO: 59292 - RNA, 63 nt, hsa
uuuuuucuuuuucccuucucuucuuaggaaccaucaguggacaugaauguuucuacaaugcau

SEQ ID NO: 59293 - RNA, 63 nt, hsa
guucagcagaauaaacucuuuacaauuaauaacucaguggaaaaugauguucagauggugaaa

SEQ ID NO: 59294 - RNA, 63 nt, hsa
ugaugaggucaugucacagaccauuuuaucccuucaguggaaaccauguuaugucgacuauua

SEQ ID NO: 59295 - RNA, 63 nt, hsa
uggcuucucucccuccagguauaugaccggguaucaguggaagcuguguugccaauggacaaa

SEQ ID NO: 59296 - RNA, 63 nt, hsa
cuagcaaugccacgauuuagauuuaaugaugcuucaguggaaaucaaucagaagguauucuga

SEQ ID NO: 59297 - RNA, 63 nt, hsa
gaaauguuaauugcauuuuuacacaugaugcauucaguggacacucuuuuuuccuaauuauaa

SEQ ID NO: 59298 - RNA, 63 nt, hsa
gugcugaaagaaacauugaugugaacccagugaucaguggaauugucaaguacaggugagcac

SEQ ID NO: 59299 - RNA, 63 nt, hsa
cuuuuaugugucuuucuacaaagggguuauuggucaguggaagaacaaaguacacuugauaaa

SEQ ID NO: 59300 - RNA, 63 nt, hsa
uggugucggaauuguuguauuuuccuuaggaauucaguggaacuuaucuucauuaaauuuagc

SEQ ID NO: 59301 - RNA, 63 nt, hsa; identical to SEQ ID NO: 59293

SEQ ID NO: 59302 - RNA, 63 nt, hsa
ucaaaagcagaauuuuuaaaacugcauuuuuaaucaguggaacucaauguauaguuagcuuua

SEQ ID NO: 59303 - RNA, 63 nt, hsa; identical to SEQ ID NO: 59302

SEQ ID NO: 59304 - RNA, 64 nt, hsa
ccagccagggacgccaggacauagcugcuccuggucaguggaggucagccggguaucaaaagcc

SEQ ID NO: 59305 - RNA, 64 nt, hsa
uauuuccaagaagcugaaucuuugggacugauucucaguggagggcuuagaucauacaaaaauc

SEQ ID NO: 59306 - RNA, 64 nt, hsa
acaaauaacugauguuuuaaccagaguaaugaccucaguggauuugcuuuaacccucacauuuu

SEQ ID NO: 59307 - RNA, 64 nt, hsa
gccagagcuagcgucccuacugccucccgacuccucaguggaggaggagcugcggucccucugg

SEQ ID NO: 59308 - RNA, 64 nt, hsa
ugggguccaggucggguguggacuguccucacugucaguggagccccagaagcuagauggguac

SEQ ID NO: 59309 - RNA, 64 nt, hsa
caaccuugucacauguagcugagucugggaugacucaguggaucaguggaugcguggaagguuu

SEQ ID NO: 59310 - RNA, 64 nt, hsa
ucacauguagcugagucugggaugacucaguggaucaguggaugcguggaagguuuugguguuu

SEQ ID NO: 59311 - RNA, 64 nt, hsa
agauacccagaggucccccaggucaucacuuggcucaguggaagcccucuuuccccaaauccua

SEQ ID NO: 59312 - RNA, 64 nt, hsa
uaaguggauacauaagauuaacuaucacagugacucaguggaauuuuuuguuugcuuuuguaca

SEQ ID NO: 59313 - RNA, 64 nt, hsa
aauuugcuuauauguaaaaguuguuuuuguggagucaguggauauauuucuaaugaagugcuag

SEQ ID NO: 59314 - RNA, 64 nt, hsa
uaugaucuaaaagccaacuuuuucucaguuuuacucaguggaaagauaaacuaaguuuuaaugu

SEQ ID NO: 59315 - RNA, 64 nt, hsa
uggugacacacugagugaaagggacugggccagcucaguggaccguguggaacaggaacagcug

SEQ ID NO: 59316 - RNA, 64 nt, hsa
uggaaaagaugccuucuggaucuuaagccaguugucaguggagguccucagggcugcaaauguc

SEQ ID NO: 59317 - RNA, 64 nt, hsa
ccaaaccuuguagccuaagccauuugucuuuuucucaguggagggaguguauggaccuggcccc

SEQ ID NO: 59318 - RNA, 64 nt, hsa
cacccaggauccugaucugcccugcacugagcacucaguggauaaacacuccuccagcccagac

SEQ ID NO: 59319 - RNA, 64 nt, hsa
acuaaacaucgacuucgguucacuucacggauguucaguggauaucggucacaugccagguccc

SEQ ID NO: 59320 - RNA, 64 nt, hsa
gagucuagugcagacccgugaucaccuuagugcuucaguggauucacugguuagauuaaaaaga

SEQ ID NO: 59321 - RNA, 64 nt, hsa
agguuuauucauucauuaaacuacuuuggaagcgucaguggauauauuugaaagugguaauccu

SEQ ID NO: 59322 - RNA, 64 nt, hsa
aacaaguuucuuguuauccugaaacuuucuaugcucaguggaaaguaucugccagccacagcau

SEQ ID NO: 59323 - RNA, 64 nt, hsa
uccauuuuccuuuccuugugguugaaaaccacagucaguggagagauguuuggaaaccacaguc

SEQ ID NO: 59324 - RNA, 64 nt, hsa
ccacagucaguggagagauguuuggaaaccacagucaguggagccugggugguacccaggcuuu

SEQ ID NO: 59325 - RNA, 64 nt, hsa
aaucaauuacggagauacagagccuugaggucuuucaguggaaaggugguucauguucauucuc

SEQ ID NO: 59326 - RNA, 64 nt, hsa
ccagccugggggucugggcuggggcagggauugcucaguggaagcaggacugggggucuggcuu

SEQ ID NO: 59327 - RNA, 64 nt, hsa
agcuguaggcaagcuugcacauaaauaacccccgucaguggaguguucgggaugcagggggcac

SEQ ID NO: 59328 - RNA, 64 nt, hsa
gcucauucccuuacccccggccagugcugcugcuucaguggaagagaugaagccaaaggacaga

SEQ ID NO: 59329 - RNA, 64 nt, hsa
ggugccuucuucagggccugguugaagaagaugaucaguggacagucugcucuagaugagcugg

SEQ ID NO: 59330 - RNA, 64 nt, hsa
gcccagaaucagcucuggauuuuaagcccagacuucaguggacccagauagaaaauauaaaguc

SEQ ID NO: 59331 - RNA, 64 nt, hsa
uuaguuuacaaucuaagaguuauucuuaagaguuucaguggaauuuucuuaauuuuucuaaaga

SEQ ID NO: 59332 - RNA, 64 nt, hsa
caauuuguaguuuuauuaugcaguuaaaucuguaucaguggacuuuuaaaacuugguacuacua

SEQ ID NO: 59333 - RNA, 64 nt, hsa
cucaucaauccgucugggugccagaacucaagguucaguggacacaucccccuguuagagaccc

SEQ ID NO: 59334 - RNA, 64 nt, hsa
ggguccuuuauucauuucugggacagaaagagggucaguggacuuuugugggccuccagcuucu

SEQ ID NO: 59335 - RNA, 64 nt, hsa
cuagaagugguuuguagacuuccuuuauaauauuucaguggaauagaugucucaaaaauccuua

SEQ ID NO: 59336 - RNA, 64 nt, hsa
ccauuuuuaaugauguuguguguccucccuuuguucaguggacgguuaaaccuucccccacuca

SEQ ID NO: 59337 - RNA, 64 nt, hsa
gaccugaaaccucagcgugaauuugggggauuuuucaguggaacccuugcccccaaaugucgac

SEQ ID NO: 59338 - RNA, 64 nt, hsa
gacagugggcaagaggacacccccccccaccaccucaguggaacacaccauucucccccccuca

SEQ ID NO: 59339 - RNA, 64 nt, hsa
uaccucaaacacuggccugugagcccuuuccaagucaguggagagcccugaaaggaggcucacu

SEQ ID NO: 59340 - RNA, 64 nt, hsa
agaugcguaauauaauucuggugaaguaauaguuucaguggaugauugaaaacaacaacaacaa

SEQ ID NO: 59341 - RNA, 64 nt, hsa
gcugcugauauuauggaaguauuuuuuuuaaucaucaguggaaauuuuuauucuucuuuagucu

SEQ ID NO: 59342 - RNA, 64 nt, hsa
ccuaggaggacccaccaguggagcacaugcagccucaguggagaugcuugguguggggaucugg

SEQ ID NO: 59343 - RNA, 64 nt, hsa
aaauagguuccauguguaaguguuuuguaaaauuucaguggaaaugcacagaaaaucuucuggc

SEQ ID NO: 59344 - RNA, 64 nt, hsa
aucaguuuccaaguuuauaucauauuaauacauuucaguggauaauuuauuuuaaaaaaaaaac

SEQ ID NO: 59345 - RNA, 64 nt, hsa
caauuguuugcccaaauauucuugucauuuggagucaguggaaaauccagcacaccaagcacca

SEQ ID NO: 59346 - RNA, 64 nt, hsa
aguacuguuaauaucuggaaaguaucuugagauaucaguggaaagcuaaacagucuaaauuaac

SEQ ID NO: 59347 - RNA, 64 nt, hsa
uagggggcuggucccggcuccacccccuccaagcucaguggacacugggucugaaaggaaggag

SEQ ID NO: 59348 - RNA, 64 nt, hsa
cccucagugggcccgaacucgccagccccagcuuucaguggagaaagcgguccucugaaauggu

SEQ ID NO: 59349 - RNA, 64 nt, hsa
agcccuuagcaguggccuggcacaaaacaaaugcucaguggauggaagcugccuauuauuauug

SEQ ID NO: 59350 - RNA, 64 nt, hsa
uucaaggcaauaguacauaauaguggaagaaaauucaguggaagguuauugcuauugucauuug

SEQ ID NO: 59351 - RNA, 64 nt, hsa
aaucaaccugggagaccaccccggccgcggcgccucaguggacaggugggaggaaaagaaaacu

SEQ ID NO: 59352 - RNA, 64 nt, hsa
acaucacaugucgauauuugcauaggagucauuuucaguggaauaacauuuuuaaugugugguu

SEQ ID NO: 59353 - RNA, 64 nt, hsa
aggaauguugcaugagucggaucccaguccauugucaguggagggugagggugaccccaucugc

SEQ ID NO: 59354 - RNA, 64 nt, hsa
aucuagcucucugauuccauacauuccagacuucucaguggauuuguaauaaacuauaaauaaa

SEQ ID NO: 59355 - RNA, 64 nt, hsa
cuuuauaguuucucuauaaaaacugguuuuaaaaucaguggaaaagggcagguugaaucaaggu

SEQ ID NO: 59356 - RNA, 64 nt, hsa
uguucuggcccuuccccaucuagaacugccauuaucaguggaguagugggucccuggucuccua

SEQ ID NO: 59357 - RNA, 64 nt, hsa
caggcuucuggaaccaaacugauuaaaguuuuacucaguggauaguucuauagaauuaaugaug

SEQ ID NO: 59358 - RNA, 64 nt, hsa
guguaugaguugcauuuguaaaaaugagacuuuuucaguggaacucuaaaccuugugaugacua

SEQ ID NO: 59359 - RNA, 64 nt, hsa
ggauuuaugugaggucaaaaccaaacucuuauucucaguggaaaacuccaguuguaaugcauau

SEQ ID NO: 59360 - RNA, 64 nt, hsa
gguuccauguggauccauacuaaguauucuucagucaguggauuuuagcaaggggagguaggag

SEQ ID NO: 59361 - RNA, 64 nt, hsa
guuaacuaacuguaaggcguggaauaggaguugcucaguggauugguucuauguuguggacuac

SEQ ID NO: 59362 - RNA, 64 nt, hsa
caccucuugaaggugucgaauguauguuuauacaucaguggaacccauuuuucuagccuagcaa

SEQ ID NO: 59363 - RNA, 64 nt, hsa
gauaaguugcagacugccuuuaaaauagauuuuaucaguggagaaauggugauaguuuuuucuu

SEQ ID NO: 59364 - RNA, 64 nt, hsa
caucuaagcccaggacaugagugucuguccagacucaguggaucugaagaaaaaaggaaaaaaa

SEQ ID NO: 59365 - RNA, 64 nt, hsa
ccuacugaaguuguguggagggauggaaagugggucaguggagaagggauucagaaaaugacac

SEQ ID NO: 59366 - RNA, 64 nt, hsa
gcaagaggacugggugcugggcugcagaggccggucaguggagccccuagcacgugugaacuca

SEQ ID NO: 59367 - RNA, 64 nt, hsa
cagguauuggagccucuguggccuuaaauguggcucaguggagggagacccagcauagccaggc

SEQ ID NO: 59368 - RNA, 64 nt, hsa
cagugccccugugggggagccuguaaaugcgggcucaguggaccacuggugacugggcucaugc

SEQ ID NO: 59369 - RNA, 64 nt, hsa
agcagugagacuaugagccaagcaaagagaagucucaguggagcaugaggagggagcaguccag

SEQ ID NO: 59370 - RNA, 64 nt, hsa
aaaaguucuaaacugccucugcaaugacuuguagucaguggaagaguaucacuuuccccugauc

SEQ ID NO: 59371 - RNA, 64 nt, hsa
uauaaaaaucaaaaggcugccucuauuacaauccucaguggaauagauggcuaucuuucuuggc

SEQ ID NO: 59372 - RNA, 64 nt, hsa
auuguuaccaaacuuguaaaagcauuccauguauucaguggaggcagaauguauaauauuuuuu

SEQ ID NO: 59373 - RNA, 64 nt, hsa
caggaguuuguuuccugaguguggagugaggcugucaguggauccgugcuuugucggccagcgu

SEQ ID NO: 59374 - RNA, 64 nt, hsa
uaacuccucacucccugaucaauggaaguccaggucaguggagucucuccuugauugaucaccc

SEQ ID NO: 59375 - RNA, 64 nt, hsa
gcccuggagugggcaggcaggccagggcugcgcaucaguggacacauugcugccaggaagagcu

SEQ ID NO: 59376 - RNA, 64 nt, hsa
augcuccauguucauucggagccaggagggguucucaguggagccuggcuuagggaacagggag

SEQ ID NO: 59377 - RNA, 64 nt, hsa
cacaaaagcaaaauuuuuaaaacugcauuuuuaaucaguggaacucaauauauaguuagcuuua

SEQ ID NO: 59378 - RNA, 64 nt, hsa
gagguuuuccuggacaccgccaacuucacauugcucaguggacucauucuaagggcaagacauu

SEQ ID NO: 59379 - RNA, 64 nt, hsa
uggaaggauuguuccuuagagcuucucugcagaaucaguggagauuuucaguuucccacccugc

SEQ ID NO: 59380 - RNA, 64 nt, hsa
uguaaacggacuuguuaaccuaaccuaauuaugcucaguggacuucuauagaugguuuugaaaa

SEQ ID NO: 59381 - RNA, 64 nt, hsa
acuucugauugccuaauaaauaugacauggauguucaguggaacuucccaucuauuacgccuca

SEQ ID NO: 59382 - RNA, 64 nt, hsa
aaauuaaaccuugcauuaaaauaauaucacaguaucaguggacuaaacauuaaaauguaccacu

SEQ ID NO: 59383 - RNA, 64 nt, hsa
uacuacuguugacaguuuccgcagaaauccuauuucaguggaccaacauuguggcauggcagca

SEQ ID NO: 59384 - RNA, 64 nt, hsa
uaaagaauuaaaccaaggcuuagccuuaagcagcucaguggaaggaugagcugcugcggaccac

SEQ ID NO: 59385 - RNA, 64 nt, hsa
agauguguggcugggcccucucccaccugccuguucaguggaggccagggcagcagcccagaac

SEQ ID NO: 59386 - RNA, 64 nt, hsa
ucuuccuacugcaaaggacagugaauccagcaacucaguggauccaagcugggcucagaggucg

SEQ ID NO: 59387 - RNA, 64 nt, hsa
cuaucugauggguuagagugccuuugagaagaaaucaguggauacuggauuugcuccugucaau

SEQ ID NO: 59388 - RNA, 64 nt, hsa
gccugggauggagcccaucucuccaguuccucccucaguggaggagaucccugugccuggggaa

SEQ ID NO: 59389 - RNA, 64 nt, hsa
auaacccaggaaacagacccagcugagguuauucucaguggauuacaguauacuuuugugugug

SEQ ID NO: 59390 - RNA, 64 nt, hsa
agucuggucaccagauauggaugagagauucuauucaguggaucagaaucaaacugguacauug

SEQ ID NO: 59391 - RNA, 64 nt, hsa
acagauauuuacugaaggaaucuagguuguauuuucaguggacaaugggaauaaagcauuucua

SEQ ID NO: 59392 - RNA, 64 nt, hsa
uguaaguaaagaaaauauaauccuauauugagcuucaguggagaauaaaccagcugagaagaac

SEQ ID NO: 59393 - RNA, 64 nt, hsa
cgugguugggugcaccuguaguucuguuuauuggucaguggaaaugaaaaaaaaaaaaaaaaaa

SEQ ID NO: 59394 - RNA, 64 nt, hsa
agauuaaauaaaacuuaaaucucacucuaggaguucaguggagagguuagagccagccacacuu

SEQ ID NO: 59395 - RNA, 64 nt, hsa
cagaaguuuuuguucuuuuuuuuuuuuccaucacucaguggagaaaagcuuuguuaaugaaaga

SEQ ID NO: 59396 - RNA, 64 nt, hsa
ucccaagagagacuuguuugggccuuuuguggugucaguggaauggauagguaacuuggguggg

SEQ ID NO: 59397 - RNA, 64 nt, hsa
cagagauaacuuugaaauuucauaaguuugauauucaguggauacaaauagaacaugaauucua

SEQ ID NO: 59398 - RNA, 64 nt, hsa
uguaagagcauaaucaaacaggaauuuucuuuucucaguggauaauacaacagagaaaacagag

SEQ ID NO: 59399 - RNA, 64 nt, hsa
uaauaccccacacaaguucacuugauuaauugcaucaguggaaggggacauagcuucucucuua

SEQ ID NO: 59400 - RNA, 64 nt, hsa
auaaaauucauuuuccacuggaacucuaugacauucaguggagugguggaaaguuaaccucuua

SEQ ID NO: 59401 - RNA, 64 nt, hsa
uacauuggaagugcuguagacuucuuuauguggcucaguggagagagggaaagaauguugcacc

SEQ ID NO: 59402 - RNA, 64 nt, hsa
ucucuccucacugcucacagcaagggguucuguaucaguggauuucauuuuguagcugcugaga

SEQ ID NO: 59403 - RNA, 64 nt, hsa
aaaucaaagugauucugggggaagcuaugcucuuucaguggauaauaaaauugguaacucuauu

SEQ ID NO: 59404 - RNA, 64 nt, hsa
aggcauaauauuaauagcgccaccuucuguugggucaguggagaugggugaggaacagcacaga

SEQ ID NO: 59405 - RNA, 64 nt, hsa
gaaucaugaaugacaaugagauaacauacagaugucaguggagacaaaguuguggguuccuccu

SEQ ID NO: 59406 - RNA, 64 nt, hsa
gccagcagaaccacaggagagugcccugccugucucaguggaaguguauuauuguuuuaaggau

SEQ ID NO: 59407 - RNA, 64 nt, hsa
acacucgauuggagucaguugaauauuuguacccucaguggagcccuucuggucuuuucuucca

SEQ ID NO: 59408 - RNA, 64 nt, hsa
ggacuggcaguaacaagggcuuuuacuguucuguucaguggaaccuucuuggucaaauuguaau

SEQ ID NO: 59409 - RNA, 64 nt, hsa
ggucugcucacugccaggcuccucuccccuuuguucaguggagcuggcuuuucucccagccccu

SEQ ID NO: 59410 - RNA, 64 nt, hsa
aaguauacuuuguaaggagcagauuuuuuuguucucaguggaacccugucaaaucgcauaaaag

SEQ ID NO: 59411 - RNA, 64 nt, hsa
gaugcccuauuccuaaauaauaacaauagcauugucaguggaggcugggccaccauggcagacc

SEQ ID NO: 59412 - RNA, 64 nt, hsa
gggagcgcucucuugauucugggauuucucccucucaguggagccuuauuaauauccaagacuu

SEQ ID NO: 59413 - RNA, 64 nt, hsa
ggggggacggugcccccagcccaggaucgggcacucaguggagccgcacacggccccggcgcgc

SEQ ID NO: 59414 - RNA, 64 nt, hsa
aaaaaaaaaagcucauauuuuguauauaucugcuucaguggagaauuauauagguugugcaaau

SEQ ID NO: 59415 - RNA, 64 nt, hsa
ggguggggggagggguuggguugggcucuuaucuucaguggagcuuaggaaacgcucccacucc

SEQ ID NO: 59416 - RNA, 64 nt, hsa
ucgcaccuagccucuuugaucauuucugugguguucaguggagguugacagcucccuaaagauu

SEQ ID NO: 59417 - RNA, 64 nt, hsa
aaguggaauuggcaaacuagaauuuaguuuguacucaguggacagugcuguugaagauuugagg

SEQ ID NO: 59418 - RNA, 64 nt, hsa
agacaccagcuucaccuucuuaacaaggugcagcucaguggaagaugaugacaaccagaagaca

SEQ ID NO: 59419 - RNA, 64 nt, hsa
ggagaggagacuguuugaugugguacaggggcagucaguggagggcgagugguuucggaaaaaa

SEQ ID NO: 59420 - RNA, 64 nt, hsa
agugugcauuuuuuuauucuaauauuccuucuagucaguggaaauuuguauucccauacaaacu

SEQ ID NO: 59421 - RNA, 64 nt, hsa
accccuccuccauccacccugaggacccuggggcucaguggaggcagggcccugccccccuccc

SEQ ID NO: 59422 - RNA, 64 nt, hsa
ugggcugcuagugaguuacauuaauuacugcaaaucaguggaauucucaagagacaagauaagc

SEQ ID NO: 59423 - RNA, 64 nt, hsa
uucuaauauauauaucauugagggugacuaaucuucaguggaccaaaucucuacccuuccccaa

SEQ ID NO: 59424 - RNA, 64 nt, hsa
ccucaaugguaggagacauccagacuuguauauuucaguggaaauacaaaaccacuucagagac

SEQ ID NO: 59425 - RNA, 64 nt, hsa
caaagacucaagacacagaagaugaugagggagcucaguggaauuguaccgccuguacuuuuuu

SEQ ID NO: 59426 - RNA, 64 nt, hsa
gucagugccuccagccaaaugccuagcacagagcucaguggauuugauucuuccauucagauac

SEQ ID NO: 59427 - RNA, 64 nt, hsa
aagaaugcaugaucucagagugauuaaaaaaaaaucaguggaaauaaaugaucauagaaggugc

SEQ ID NO: 59428 - RNA, 64 nt, hsa
cauuucugguuuucuguccccauaguacaguucuucaguggacaugaccccacccagcccccug

SEQ ID NO: 59429 - RNA, 64 nt, hsa
gaggcccaaggcuuggauaagguggccacuucccucaguggagucagucauguuagguaggagg

SEQ ID NO: 59430 - RNA, 64 nt, hsa
cgcccccagagcccgucagcgugggggaaaggauucaguggaggcuggcagggucccuccagca

SEQ ID NO: 59431 - RNA, 64 nt, hsa
ucaagaaauaugugaauacccaccuaccaggugcucaguggaaucaaagaugaauccaaguuca

SEQ ID NO: 59432 - RNA, 64 nt, hsa
auuguccaccuagucagagcccaagaaagaauuuucaguggaaaaaucaauauauaacuuagug

SEQ ID NO: 59433 - RNA, 64 nt, hsa
gaaauaaaccauuggacagauuucaguaaugucuucaguggaacacaaaugaaaaugaauagcu

SEQ ID NO: 59434 - RNA, 64 nt, hsa
uguuuugguuguuuuaaacucaugaaguauggguucaguggaaauguuuggaacucugaaggau

SEQ ID NO: 59435 - RNA, 64 nt, hsa
aggcgugggggacaagaaggauacaagguaaguuucaguggagcucagaggacggggagauaga

SEQ ID NO: 59436 - RNA, 64 nt, hsa
cggggcgucugagcuccccaggcaugaccaaaccucaguggaggggccucugcuucaggccccg

SEQ ID NO: 59437 - RNA, 64 nt, hsa
gacagcuaccugcauuguagaaccuuuucuuaucucaguggaaccuucuauaaccuaaauauac

SEQ ID NO: 59438 - RNA, 64 nt, hsa
uucagccuggacacccggcagcuucuggaguuugucaguggaggcagaggggauccggccaggc

SEQ ID NO: 59439 - RNA, 64 nt, hsa
gcucagggaguguuuuccugugaggccucccccaucaguggaccagagggagaagcccgaugcc

SEQ ID NO: 59440 - RNA, 64 nt, hsa
caaaugauuagcccuaaaugaaacuguaauaauuucaguggaaacucaaucuguuuuuaccuuu

SEQ ID NO: 59441 - RNA, 64 nt, hsa
gcagcuucuucggagaagugaaauauaacauuacucaguggacggagaaaucuguuuuguuaca

SEQ ID NO: 59442 - RNA, 64 nt, hsa
uccugcgguucaguucaggcugagauuuucuccuucaguggacugucugugucccccugccgaa

SEQ ID NO: 59443 - RNA, 64 nt, hsa
gcuuaugggucuccagaaacucugccagccagccucaguggagaagcuuccucuaccaccagcu

SEQ ID NO: 59444 - RNA, 64 nt, hsa
ggauacauacaguggaguucuauaaacucauaccucaguggacuuaaccaaaauuguguuaguc

SEQ ID NO: 59445 - RNA, 64 nt, hsa
uauccuguuccgccuccugccaccuggaccucccucaguggaugucuucccucccccgacccca

SEQ ID NO: 59446 - RNA, 64 nt, hsa
auccugucugccacgugcugacggucgggaagcuucaguggagaggccuaacucuaaugucgcc

SEQ ID NO: 59447 - RNA, 64 nt, hsa
aauauauagagguauauuuagccucuuuuagaagucaguggauugaaugucuuuuuauuuuaaa

SEQ ID NO: 59448 - RNA, 64 nt, hsa
gcacauuuucuguucagggauuaagaccagaauaucaguggauuuguuuuccccaccaaguggc

SEQ ID NO: 59449 - RNA, 64 nt, hsa
uugcuuggaauucuggcagguuccccgggguguuucaguggacaggaggcccccgugccguggc

SEQ ID NO: 59450 - RNA, 64 nt, hsa
ucuacuacaucuaggacgccuccggugagcagggucaguggaagccccaacgggaaaggaaacg

SEQ ID NO: 59451 - RNA, 64 nt, hsa
uaucucuuguuuguguugaacugaaggcuaagucucaguggacauggaaaagacuuuuggguga

SEQ ID NO: 59452 - RNA, 64 nt, hsa
guacuuaaaggaauaauaaaugcauaauaugaggucaguggacgccauuuucuguuauaaucau

SEQ ID NO: 59453 - RNA, 64 nt, hsa
gcgaagcauuguuucugagugugugaggauguuuucaguggacucagugaagaucugcccucag

SEQ ID NO: 59454 - RNA, 64 nt, hsa
accaguccacagaggcccccaggagcacugccuuucaguggaccggguggggccuggugggagg

SEQ ID NO: 59455 - RNA, 64 nt, hsa
ucacugaggacugguaccucgggaacgcaagcugucaguggaacugucccacaagaauucacag

SEQ ID NO: 59456 - RNA, 64 nt, hsa
uacugucuugcauuauaaaauuagaaguguauuuucaguggaagaaacauuuuucaauaaauaa

SEQ ID NO: 59457 - RNA, 64 nt, hsa
agccauaaguaaucagcaaucuucaaaagcacuuucaguggauuggucaucuggguucuaaagg

SEQ ID NO: 59458 - RNA, 64 nt, hsa
aaaaaguaguagcucucuguagcauuauggaguuucaguggaaccaaauuuuugccauuaaaaa

SEQ ID NO: 59459 - RNA, 64 nt, hsa
ggcaagaauucuuaugcuuaugagagccaaguagucaguggaagagaguagagcucaaaacugg

SEQ ID NO: 59460 - RNA, 64 nt, hsa
uuuuggaaaagaaugcaauaguuguacuccacagucaguggaacuguucccugaguccgaggcu

SEQ ID NO: 59461 - RNA, 64 nt, hsa
agcagaacacugcagucagauccuguuacuugcuucaguggaccgaaaucuguauucuguuugc

SEQ ID NO: 59462 - RNA, 64 nt, hsa
gcgguuugcauucuuuuggaacucaaugugccgaucaguggagucaguaucgagccugaccacc

SEQ ID NO: 59463 - RNA, 64 nt, hsa
guauuuuuuauaaccaccaucauuccuugucucuucaguggaagauauucuuuccuguuuccca

SEQ ID NO: 59464 - RNA, 64 nt, hsa
uaacaugaacaugaguaccuauuuaugugggccuucaguggaugggcagugccacucaggucuc

SEQ ID NO: 59465 - RNA, 64 nt, hsa
cauuaacaaacccaaagugaagcggucacuccucucaguggaaagagcacgaggauguucucag

SEQ ID NO: 59466 - RNA, 64 nt, hsa
ucucacugaugguuuuuuacugcucucugcucugucaguggagcuauccggggcaauuguagcg

SEQ ID NO: 59467 - RNA, 64 nt, hsa
augagaaacuuugaaaauggaucuucauauagaaucaguggauggaaacaaggguuuaaacuug

SEQ ID NO: 59468 - RNA, 64 nt, hsa
aagaugugcacucuggacucaagaaacucuuaguucaguggaggaaaugagcagauaaguagau

SEQ ID NO: 59469 - RNA, 64 nt, hsa
auguggacaccauggagggggaaguggagcguuuucaguggaguuggcuccuccccgcacugag

SEQ ID NO: 59470 - RNA, 64 nt, hsa
ggggcccucgacaggacagcaggacgguuuguuuucaguggaaucccaucccuggguuccccug

SEQ ID NO: 59471 - RNA, 64 nt, hsa
auaauaguucaguaauuuaaaugcuuauuuauuuucaguggaaggauuuuuauuaaaaagaagc

SEQ ID NO: 59472 - RNA, 64 nt, hsa
cuccuccgaaguuuuucaggggguaaaaguaacaucaguggaggguauuauuuuaaauaaauuu

SEQ ID NO: 59473 - RNA, 64 nt, hsa
gaaaacauugacuguuaccauugaaugagauggaucaguggauauuaagaugagguuacaaauu

SEQ ID NO: 59474 - RNA, 64 nt, hsa
ccucuuguuuugguuauuuuguguagcaguuuaaucaguggauaacugagccuguuuccucuua

SEQ ID NO: 59475 - RNA, 64 nt, hsa
cauuuuacuaacauaaauauuuucuauguguguuucaguggaugacaaucgagcagcagaagaa

SEQ ID NO: 59476 - RNA, 64 nt, hsa
gugcuucuuccauagacagaagcuuagucuguuuucaguggaauuaauugaugaacugggaaaa

SEQ ID NO: 59477 - RNA, 64 nt, hsa
agucugagaaaauauuuuuuucuaaagaaggcagucaguggaucuuaaaaugacaaucuguuuu

SEQ ID NO: 59478 - RNA, 64 nt, hsa
uccagaagaaguuuuuccuugauugugcuauguuucaguggaagaaauucuuugaaguagaugu

SEQ ID NO: 59479 - RNA, 64 nt, hsa
aaagaggcacauugcauagaagccauuggggaguucaguggaaguucuguaagaugugcaugua

SEQ ID NO: 59480 - RNA, 64 nt, hsa
gacacucaagacuuuugacugccauuuuguuuguucaguggagacucccuggccaacagaaucc

SEQ ID NO: 59481 - RNA, 64 nt, hsa
aaaaaucuaaaaauucugguuuuaaauaugagaaucaguggaaaauaaggguauaauuuuguag

SEQ ID NO: 59482 - RNA, 64 nt, hsa
aauaauagggaaauauccauuuaaaacagguauaucaguggaaacacagaguuauuuuaaguga

SEQ ID NO: 59483 - RNA, 64 nt, hsa
accccuuccugguugcuaccacucaggcugccacucaguggacuccaccccagggacacggcag

SEQ ID NO: 59484 - RNA, 64 nt, hsa
guagugcaucuuuuguaucucaggcguggcuucuucaguggaccaagcugcaaugcaguauuga

SEQ ID NO: 59485 - RNA, 64 nt, hsa
aaacaugcaaguuuguacuuugaucuuuaccaggucaguggauugcuucaaaagcagaguuuug

SEQ ID NO: 59486 - RNA, 64 nt, hsa
uacacaagaaaaacagagaaaagccugaucccugucaguggaaaagggguucaaugaauuacgg

SEQ ID NO: 59487 - RNA, 64 nt, hsa
ugauaaaaauugugccuuuagccuucuauauacaucaguggaaacuuaagaugcaguaauuaug

SEQ ID NO: 59488 - RNA, 64 nt, hsa
cccagugcccagaauauacuagaaucaccgcauuucaguggacuccugaaguuguacuugugua

SEQ ID NO: 59489 - RNA, 64 nt, hsa
agaggaggggcugcccacucuguaaaugaagggcucaguggagucuggccaagcacagaggcug

SEQ ID NO: 59490 - RNA, 64 nt, hsa
caagugaagagaacgucaugaguguaagugcaaaucaguggaaggagcggcaaacugggacaug

SEQ ID NO: 59491 - RNA, 64 nt, hsa
uacgcuguagauggaacauguuucugugaaccuaucaguggauuucauucucuugaguaauaaa

SEQ ID NO: 59492 - RNA, 64 nt, hsa
gggcucaggcuagcguaaacaggcuuucuccagcucaguggagcagugagcagccgacucugag

SEQ ID NO: 59493 - RNA, 64 nt, hsa
ccaacuuuuccagugcauuacaugguauuguauaucaguggagaaauguauuauuuccaugauc

SEQ ID NO: 59494 - RNA, 64 nt, hsa
ggcuuauacauuauauuuauagaauauaaauuugucaguggaauaaaauuuccccuuuuuuuca

SEQ ID NO: 59495 - RNA, 64 nt, hsa
ggacugcaucccuccugggccugagccucgggacucaguggacaccaaagucaagaccagcacc

SEQ ID NO: 59496 - RNA, 64 nt, hsa
uauccgcguggugggcuggcagcugacggccugcucaguggagccaggagcuaacucagacccc

SEQ ID NO: 59497 - RNA, 64 nt, hsa
auguguuauucuuucuauaaugaucaguuuacuuucaguggauucagaauuguguagcaggaua

SEQ ID NO: 59498 - RNA, 64 nt, hsa
uaagaccuucccuuccuugaucccuggaccagacucaguggacauuugugcaauugcucgcccu

SEQ ID NO: 59499 - RNA, 64 nt, hsa
ccugcccucucugagucucaguuuuuccauuuguucaguggagagaauuaaccauugauaccuc

SEQ ID NO: 59500 - RNA, 62 nt, hsa; identical to SEQ ID NO: 59136

SEQ ID NO: 59501 - RNA, 64 nt, hsa
ccaugacugacggccccuugugcaagcucauucuucaguggauccuucaguggaguggugacac

SEQ ID NO: 59502 - RNA, 64 nt, hsa
gccccuugugcaagcucauucuucaguggauccuucaguggaguggugacacgugccagcgguc

SEQ ID NO: 59503 - RNA, 64 nt, hsa
agugacuuccauuauggcuggacaggcggugagcucaguggauugcaguggugugcuggugauu

SEQ ID NO: 59504 - RNA, 64 nt, hsa
cuaaucccauccucucacccauccauuuccucacucaguggagauuugccaaaugaauaaacga

SEQ ID NO: 59505 - RNA, 64 nt, hsa
aaauuuagaggaaaucaaacaagcaucacuuuccucaguggaaaaacuuaugaaacuucuuaua

SEQ ID NO: 59506 - RNA, 64 nt, hsa
cgauauuucuugaaaauaacgaccuugucuuguaucaguggaagaaguaaguugcuuagaaagg

SEQ ID NO: 59507 - RNA, 64 nt, hsa
gaacaugugauuucaggguugccgcagugucaccucaguggaccagccugggggaaggagcuua

SEQ ID NO: 59508 - RNA, 64 nt, hsa
cuugccucacucugauccuggccccauaauguccucaguggaaggugaugggggccggugcugu

SEQ ID NO: 59509 - RNA, 64 nt, hsa
ggaagcuuauaaucuaauuuuaggaggaccaaauucaguggauggcaacuggaacauugauugu

SEQ ID NO: 59510 - RNA, 64 nt, hsa
uguuuaagacgccaagggcauugcagaaucccucucaguggacaguaugcacucagcugaccac

SEQ ID NO: 59511 - RNA, 64 nt, hsa
uccacugagggacugggcugggaaguccugcguuucaguggagcguaugagcgucaaguccugc

SEQ ID NO: 59512 - RNA, 64 nt, hsa
gccaagcccagaaguaccuuugcacuccugguuuucaguggacagaggaagcuuuagauagaga

SEQ ID NO: 59513 - RNA, 64 nt, hsa
aagaaaugggaaucuuuuuuuucucuuccaggagucaguggaagaauaguucucuagcuaagga

SEQ ID NO: 59514 - RNA, 64 nt, hsa
uggugucaaugaauuuugcuugguggaugaaaugucaguggaagaagcagaugagaaacucuug

SEQ ID NO: 59515 - RNA, 64 nt, hsa
cugaacucuuucaacucugcgcugcccagccuucucaguggacuugccccuccuaagcagagaa

SEQ ID NO: 59516 - RNA, 64 nt, hsa
gagcauaaggguuauuugagcaaguaacauuaacucaguggaaggcauuguccugugaaauauu

SEQ ID NO: 59517 - RNA, 64 nt, hsa
ggcucugaacuuuguguauuugaaaaaggaaaauucaguggaggcuuuuguuugugugugugug

SEQ ID NO: 59518 - RNA, 64 nt, hsa
uuucagggucugucuaucuuaagcuuucuuuauaucaguggaaauccagcgagauauuagaaau

SEQ ID NO: 59519 - RNA, 64 nt, hsa
aaaaaaauuagcacaucccuuuacuuacuuguuaucaguggauucucgggguuuggacuuaaug

SEQ ID NO: 59520 - RNA, 64 nt, hsa
ggcuguugguagugcuuuccacagaugcugguccucaguggauuaggucagaagcucauguucu

SEQ ID NO: 59521 - RNA, 64 nt, hsa
aggccugagguagaggggagugguauguguuuucucaguggaagcagcacaugagugggugaca

SEQ ID NO: 59522 - RNA, 64 nt, hsa
cuguccuaggugcuagguggaccgagcaaaagacucaguggaugaacuggugcagugccugaca

SEQ ID NO: 59523 - RNA, 64 nt, hsa
aauuucaaauauuuagcaacaaaaguuuauuccuucaguggaagauuuauaauaaugauaggug

SEQ ID NO: 59524 - RNA, 64 nt, hsa
uguuagaacuacuacucacaguuaccacuuggggucaguggaacaaaaugcauauaugguuuug

SEQ ID NO: 59525 - RNA, 64 nt, hsa
gugcuuucauuguuuuuucauaaucuuuucuccuucaguggaguacugauugcaugaaauuuga

SEQ ID NO: 59526 - RNA, 52 nt, hsa; identical to SEQ ID NO: 59162

SEQ ID NO: 59527 - RNA, 64 nt, hsa
uuagcugcucugagcaucaagaauuagaagucuuucaguggaauuguacaagagucccuuugaa

SEQ ID NO: 59528 - RNA, 64 nt, hsa
gugacugccgugugugcuuagacccguaguuuccucaguggauagcacucaauuuauuccguag

SEQ ID NO: 59529 - RNA, 64 nt, hsa
caaagguguugauuuuuguauaugaaguuaagccucaguggagucucauuuguuaguuuuuagu

SEQ ID NO: 59530 - RNA, 64 nt, hsa
gaaggcagggguuaaaucaggauaaaaacagacaucaguggaaucgaaaaccaauaguuaguua

SEQ ID NO: 59531 - RNA, 64 nt, hsa
uguuuuaauguagaaccucaaacaggauggaacaucaguggauggcaggagguugggaauucuu

SEQ ID NO: 59532 - RNA, 64 nt, hsa
gacuauuauagaauggaacucaaggaaaucugugucaguggaugcugcucugugguccgaaguc

SEQ ID NO: 59533 - RNA, 64 nt, hsa
uaggauucuuugaacuuauuuccacuuuaauuucucaguggaaguuaagaggggugagaaaaca

SEQ ID NO: 59534 - RNA, 64 nt, hsa
ugagaaagguaaguccauuuuccccuucagguccucaguggauuacuuaaccacugcugucccu

SEQ ID NO: 59535 - RNA, 64 nt, hsa
aguuuccuagcaaucauuuuggaucacuggacuuucaguggacuaccuaaaacaggggacagcu

SEQ ID NO: 59536 - RNA, 64 nt, hsa
auauuaaaugacuccaccugcgcaguccuuguguucaguggaugaauaccugugggcucuugua

SEQ ID NO: 59537 - RNA, 64 nt, hsa
cugguauuuucaauuuucauuugcaagaaaaugaucaguggaaugaaauaacugaaguauaaca

SEQ ID NO: 59538 - RNA, 64 nt, hsa
gcuuuuuauuucccuuguuucucauuuugcccugucaguggaugguagaugcuuuguauaucuu

SEQ ID NO: 59539 - RNA, 64 nt, hsa
cugcaauuuuuaaaaaacaaguuuggaauuuuuuucaguggagugguuuucgcuuaaaggaaaa

SEQ ID NO: 59540 - RNA, 64 nt, hsa
uucgguuaaugggucaguucuccuuggaacugaaucaguggaaagagaaugcuucccauagaaa

SEQ ID NO: 59541 - RNA, 64 nt, hsa
uguacaaacuggccaagugcuucuguagauaacgucaguggaguaaauauucgacaggccauaa

SEQ ID NO: 59542 - RNA, 64 nt, hsa
auguggcugggaacauugcaucccaaagagcuucucaguggaggaggcuggggaaggcaugagg

SEQ ID NO: 59543 - RNA, 64 nt, hsa
auucauaacuugugggcuuuuuuuuuuuuuaacuucaguggaauuuacuuuagauauucauuca

SEQ ID NO: 59544 - RNA, 64 nt, hsa
guucagccucucaguuuuaauauagcuuuauuuuucaguggagaucauuguuuaggaugagaca

SEQ ID NO: 59545 - RNA, 64 nt, hsa
uauuaauguuuacaguggaauugugaauaaguuuucaguggacuaucuuaucccuugacaaaaa

SEQ ID NO: 59546 - RNA, 64 nt, hsa
acauacugcauucugugcuacacaagccuuagccucaguggagcugugguucucuugguacuuu

SEQ ID NO: 59547 - RNA, 64 nt, hsa
ccucugcugugcugcacauugagcccuuucucagucaguggaguaucaaguugggccaucuguc

SEQ ID NO: 59548 - RNA, 64 nt, hsa
caggcccaggcaggcccagccucugccccacccaucaguggaguccagauggcaggcuacaguu

SEQ ID NO: 59549 - RNA, 64 nt, hsa
aagaugguuuagguguacagcaaauuuaaaauagucaguggauugugucuuacuacuucauguc

SEQ ID NO: 59550 - RNA, 64 nt, hsa
cuuugcuuaguaucauguccauguuuccuucaccucaguggagcuucugaguuuuauacugcuc

SEQ ID NO: 59551 - RNA, 64 nt, hsa
agcacuggguucuacugcugugggguaaacuaacucaguggaauagggcugguuacuuugggcu

SEQ ID NO: 59552 - RNA, 64 nt, hsa
uuauuuuaaaugcauuuaucuuuuuugacacuauucaguggaauguguaagcuagcuaauucuu

SEQ ID NO: 59553 - RNA, 64 nt, hsa
ucauccacacaaacccacggcucccaguugacagucaguggaaugcucgucuccuuagcgucca

SEQ ID NO: 59554 - RNA, 64 nt, hsa
cuacagacucccugggguuggcaggggcuccaucucaguggaccaggaagcaagaggggaagcg

SEQ ID NO: 59555 - RNA, 64 nt, hsa
gacuuuucauuguaauuucgcuuagacccuuuuaucaguggagcuccaguuuucuuaccuagcu

SEQ ID NO: 59556 - RNA, 64 nt, hsa
cagggccaacuuaguuccuacuguucugugcccuucaguggauggaacgugagugucugaucau

SEQ ID NO: 59557 - RNA, 64 nt, hsa
ugaaacacaaacaauaguaauucucaggccaucaucaguggagccauguuaauguaaucugaug

SEQ ID NO: 59558 - RNA, 64 nt, hsa
aguuuuaacaauccauucacaagccuccuguaccucaguggaucuucagaacugcccuugcugc

SEQ ID NO: 59559 - RNA, 64 nt, hsa
uauagaaaccaaguaagaauaaaugagagauauuucaguggacaucuggacauauuuauggacu

SEQ ID NO: 59560 - RNA, 64 nt, hsa
auaaauaugacauugaauucgaacuguguguaugucaguggaaucaaaucaaaagccacuaaca

SEQ ID NO: 59561 - RNA, 64 nt, hsa
auaauacaauauuaaguccaaauccaaccuccugucaguggagcaguuauguuuuauacucuac

SEQ ID NO: 59562 - RNA, 64 nt, hsa
ccauucagagagaacauggguccagaggacauucucaguggaaagaguuugaucugcagcaccc

SEQ ID NO: 59563 - RNA, 64 nt, hsa
acagaggcugggguccuccugggggacagcacagucaguggagagagccaggggcuggaggugg

SEQ ID NO: 59564 - RNA, 64 nt, hsa
guggcccgguggggacacaguugcucguggccacucaguggagcugggccugcagcagacucaa

SEQ ID NO: 59565 - RNA, 64 nt, hsa
aucuggucuuccaagacuuugccacucacuuaucucaguggacuccaaagcaaaagcucccgac

SEQ ID NO: 59566 - RNA, 64 nt, hsa
ggaggcaauuggggguuucaggucaaagagagggucaguggaaacaagggugggccuugugagg

SEQ ID NO: 59567 - RNA, 64 nt, hsa
aggugcccacagcagguacccacuggcccccuccucaguggagaccccaaggagcugcagcuga

SEQ ID NO: 59568 - RNA, 64 nt, hsa
ucugagaggacuuuucuuuguggcuuccuaaaauucaguggaaaauuaauuguuuggggaugag

SEQ ID NO: 59569 - RNA, 64 nt, hsa
cucaguccccaacggcuggcaagacucaggguccucaguggacauggugugggugacaucagaa

SEQ ID NO: 59570 - RNA, 64 nt, hsa
ugcaaauuuuuaaguaauuuaugaaaaaccuagaucaguggaucuccucucuggcugcccauua

SEQ ID NO: 59571 - RNA, 64 nt, hsa
gcccuuaacugauuguuauaugcuacaagggauuucaguggacugcagagugcgaacgucuugc

SEQ ID NO: 59572 - RNA, 64 nt, hsa
ccugcccgcaaagcaagagcaucauuccuauucuucaguggaugccagccuucccugccccaac

SEQ ID NO: 59573 - RNA, 64 nt, hsa
uuuuguggugggugcugugaagaguaaacauuacucaguggaaagcuaaguucagaagguacuu

SEQ ID NO: 59574 - RNA, 64 nt, hsa
ccccugcacccaccccugcccaggcagucuuugcucaguggaucacacacauggaaggugaugg

SEQ ID NO: 59575 - RNA, 64 nt, hsa
uguggccuggaggccuauuaagcacgacacaguaucaguggaauugauccauaaaccucccugu

SEQ ID NO: 59576 - RNA, 64 nt, hsa
gucacugugcuagcaauaguuggcuucuccccugucaguggaaaccccacuucugcccggcccu

SEQ ID NO: 59577 - RNA, 64 nt, hsa
ccaggccgccaggaauggaccaugcagaucacugucaguggagggaagcugcugacugugauua

SEQ ID NO: 59578 - RNA, 64 nt, hsa
caucuaggaccucagccauguggccucuggggaaucaguggaugaagacgucccuccuccauca

SEQ ID NO: 59579 - RNA, 64 nt, hsa
ccucuuucuuugcagaccgaacagugaaaagcuuucaguggaggacaaaggagggccucacugu

SEQ ID NO: 59580 - RNA, 64 nt, hsa; identical to SEQ ID NO: 59578

SEQ ID NO: 59581 - RNA, 64 nt, hsa
auauauguuaaaccaaucaaggaacuuacucuauucaguggaaacaauaaucaucucuauugcu

SEQ ID NO: 59582 - RNA, 64 nt, hsa
ccaacugcugagaccucuucuccaucccccuuauucaguggaagaugacgggggaucugaggcu

SEQ ID NO: 59583 - RNA, 64 nt, hsa
cuugugcuauuuggaagcaaagcuauuuuuuuugucaguggaaugcaguuuuuuuacuauucca

SEQ ID NO: 59584 - RNA, 64 nt, hsa
uuauucaccuuaagcgauuucaauuuguaaaugaucaguggauaaaaucacagaaaauugucag

SEQ ID NO: 59585 - RNA, 64 nt, hsa
gcggaguccuagcauccccuugggagcagcagcgucaguggacccagugcugagaaaagccccc

SEQ ID NO: 59586 - RNA, 64 nt, hsa
gagaacaaagcccauucauccauuggauucacugucaguggagauacuaccucucguggcaacc

SEQ ID NO: 59587 - RNA, 64 nt, hsa
gcugaaccuugaggagggaaagcuugccuucuauucaguggacaaucaggagaagcuucuguau

SEQ ID NO: 59588 - RNA, 64 nt, hsa
gguaaaguucccuucuugggacuuauuccuggagucaguggauacaaguagugcagaagguuca

SEQ ID NO: 59589 - RNA, 64 nt, hsa
gaggcagcgacuccuuggacagaggccugggcccucaguggacugccugcucccacagccuggg

SEQ ID NO: 59590 - RNA, 64 nt, hsa
caggcugcugacccucagcagggccagacaaggcucaguggaucuggucugaguuucaaucugc

SEQ ID NO: 59591 - RNA, 64 nt, hsa
aagccacauuacaagcugccauccccuccccguuucaguggacccuguggccaggugcuuuucc

SEQ ID NO: 59592 - RNA, 64 nt, hsa
cuaccugacucuguguuguaauuucaggggagcaucaguggaggaggcagugggggcagcagca

SEQ ID NO: 59593 - RNA, 53 nt, hsa; identical to SEQ ID NO: 59229

SEQ ID NO: 59594 - RNA, 64 nt, hsa
ggggguguccugggcugaauuuccugggcacuucucaguggaacucucuagccuccugguucgg

SEQ ID NO: 59595 - RNA, 64 nt, hsa
uuccugagcuuggccagaagggggccaugaggccucaguggacuuuccacccccucccuggccu

SEQ ID NO: 59596 - RNA, 64 nt, hsa
uaucuuuuuuagcugagggggacaagaggagaagucaguggacacauggaaguuacucgugacc

SEQ ID NO: 59597 - RNA, 64 nt, hsa
gcugcacugguuugucgaucuaguucaguucaacucaguggauguucucugaaugcuuacuggg

SEQ ID NO: 59598 - RNA, 64 nt, hsa
gugugauucuuaacauuauagcacaaguauuaucucaguggauuauccggaauaacaucugaaa

SEQ ID NO: 59599 - RNA, 64 nt, hsa
ugaucaaagaacucugacugcagaacugccgcucucaguggacagggcaucuguuacccugaga

SEQ ID NO: 59600 - RNA, 64 nt, hsa
uccugagaccuuagaaaccagaagagccauacagucaguggaaggcgggggggcccuggccucu

SEQ ID NO: 59601 - RNA, 64 nt, hsa
acaccaucugugggucauccuuucccuggaccguucaguggacagcuuucaagcagugcuuguu

SEQ ID NO: 59602 - RNA, 64 nt, hsa
aaacaaacaaaaaacugccuuugauacaggcaauucaguggacuauaauaauaguggaggguug

SEQ ID NO: 59603 - RNA, 64 nt, hsa
ggacacccccagcucugucagagucacacggggcucaguggacggccuuggacugaacgugggc

SEQ ID NO: 59604 - RNA, 64 nt, hsa
cuuuucuucucagaaaaaccauaauacuuccuuuucaguggacuguagcuucuuaaaaaaaaaa

SEQ ID NO: 59605 - RNA, 64 nt, hsa
augaccauucagcuauaaccaacugcaguuugaaucaguggaugccuauagcuuccugaagcug

SEQ ID NO: 59606 - RNA, 64 nt, hsa
uugccuguuuccuaguaaugggcugaucaaaugaucaguggaauucuugguuugaugauaaccu

SEQ ID NO: 59607 - RNA, 64 nt, hsa
ucauguaucuguaguccaugaguuauauccuggcucaguggagugauauuuauguauuauuuuu

SEQ ID NO: 59608 - RNA, 64 nt, hsa
acacacaggcaguggccaggccccacggugcuucucaguggacaaugaugccuccuccgggaag

SEQ ID NO: 59609 - RNA, 64 nt, hsa
cuauauuuaggucccagaacaaggaagucacuuuucaguggauccaaagaaucuacuccuuaaa

SEQ ID NO: 59610 - RNA, 64 nt, hsa
aaucacaucagggagugauuaguccuggggaaauucaguggaggcacaagccugaagcacucuu

SEQ ID NO: 59611 - RNA, 64 nt, hsa
guaauauauuuauuaauauuugaaaggcauucauucaguggacagugggaauuaacucucccaa

SEQ ID NO: 59612 - RNA, 53 nt, hsa; identical to SEQ ID NO: 59248

SEQ ID NO: 59613 - RNA, 64 nt, hsa
uagguaauaccacuaucaggccuguaggagauacucaguggagccucugcccuucuuuuucuua

SEQ ID NO: 59614 - RNA, 64 nt, hsa
uucaucucgcccagagugcucaaggcugguaugaucaguggaucaggaaugcaauugugaauuc

SEQ ID NO: 59615 - RNA, 64 nt, hsa
aagagcaaagccacagacgaugacuuguccauucucaguggaugcuccaggcugugccuacaca

SEQ ID NO: 59616 - RNA, 64 nt, hsa
ugcuggagcugcagccugcucgccaucuggaggcucaguggaguggggaguugggguucucaua

SEQ ID NO: 59617 - RNA, 64 nt, hsa
ccaauaugcuuuggguggacggucuccuacauguucaguggaggccaccaggagcauccaugag

SEQ ID NO: 59618 - RNA, 64 nt, hsa
ucugaaucacgagaauguggagggguggggggugucaguggaaaggcauaaggcugagcugaga

SEQ ID NO: 59619 - RNA, 64 nt, hsa
gguagguggugguuuuaggucuugucacccucacucaguggaacugccucugggagcuuuggcg

SEQ ID NO: 59620 - RNA, 64 nt, hsa
aagugucuaggaaaaaacaaaaacuccaaacccuucaguggaugaggacaaggucgcagaaagg

SEQ ID NO: 59621 - RNA, 64 nt, hsa
gcugaagggagaggaguaacagccagaccccccaucaguggacaaggggagaguccccuacucc

SEQ ID NO: 59622 - RNA, 64 nt, hsa
guguccuccucuuucugugagaguccugagucccucaguggagcaaguuccugcuggcguuucu

SEQ ID NO: 59623 - RNA, 64 nt, hsa
ccgacuggagcaagguuugcuggcagaugaggccucaguggaagugacggcuacuguggagaug

SEQ ID NO: 59624 - RNA, 64 nt, hsa
aaacccagugagacagaccgccaaauaaacggacucaguggacacucagaccagcucccagaug

SEQ ID NO: 59625 - RNA, 64 nt, hsa
caggaggaagggagggcagagggggcuguggccgucaguggaaugcagcugucaggccugaagg

SEQ ID NO: 59626 - RNA, 64 nt, hsa
ggcucauguggguguccccucucucacucugccuucaguggagcuagaccugccaggagcacuu

SEQ ID NO: 59627 - RNA, 64 nt, hsa
cuugagggaagaccacccuccugucacccggaccucaguggaagcccguuccccccaucccugg

SEQ ID NO: 59628 - RNA, 64 nt, hsa
cucuccuggggccuucgaugggcuuuucuucuugucaguggagggagcagcuccccacucagcc

SEQ ID NO: 59629 - RNA, 64 nt, hsa
gaagaugcccagggcccagaagccaucagaauuaucaguggagaagcaccuuuugacucuuccc

SEQ ID NO: 59630 - RNA, 64 nt, hsa
acuggagacaacaccucagaccaucugaaccccaucaguggacgaaaauggggcuguuaauaua

SEQ ID NO: 59631 - RNA, 64 nt, hsa
gagagauguuauguaauaugcugagguggcgaccucaguggagaaauguaaagacugaauugaa

SEQ ID NO: 59632 - RNA, 64 nt, hsa
gccccagggcacauaagagcaaaggcuccaauggucaguggaugacucugcaaaagugaccccc

SEQ ID NO: 59633 - RNA, 64 nt, hsa
guggggagcuguccggugcuaccacaccgugcccucaguggacuaaccacagcagcagccaggg

SEQ ID NO: 59634 - RNA, 64 nt, hsa
ggagauaagcugcaaggggcgaagcaacuuuaugucaguggaaaacgugucucuuuaaagcugc

SEQ ID NO: 59635 - RNA, 64 nt, hsa
auauauauauacagugccuuuuugguguugugagucaguggaacacugaaauacagcgguugug

SEQ ID NO: 59636 - RNA, 62 nt, hsa
ccauaacagaagagacuagaguggaacagauacgucaguggauaaagcucaaagcaaacaac

SEQ ID NO: 59637 - RNA, 64 nt, hsa
ucacaaaauauaguaauuucauuuuuaccuuucuucaguggacugaauuguauggaaggaaauu

SEQ ID NO: 59638 - RNA, 64 nt, hsa
uagcuucccagggcugcccccgacaggcuggcucucaguggaggccagagaucuggaaucgggg

SEQ ID NO: 59639 - RNA, 64 nt, hsa
gaagaaauaaaugaguauuacugaaacuuaaagaucaguggaaaaaaaaaacauuuaaaaaugu

SEQ ID NO: 59640 - RNA, 64 nt, hsa
caggccucgaggagucaauuugccucugugugccucaguggagacaagugggaaaacauggucc

SEQ ID NO: 59641 - RNA, 64 nt, hsa
acugggaaguuuuucagugacgucucuggggcacucaguggauugucuguaggaaacuugcagc

SEQ ID NO: 59642 - RNA, 64 nt, hsa
cccuaaucccuggcccucccagcugucugggacuucaguggacccccagccccugcccccacuc

SEQ ID NO: 59643 - RNA, 64 nt, hsa
gccgcuggcgucaaguucagcuccacgugugccaucaguggauccgauccguccagccauggcu

SEQ ID NO: 59644 - RNA, 64 nt, hsa
gcaggcuuaguaacgccguggacugcagcgacaaucaguggauggugcugucuaugcacaggug

SEQ ID NO: 59645 - RNA, 64 nt, hsa
accuugcaugcaccuugcuaccugcuugcggcuuucaguggagggcaggggucuggcacaggug

SEQ ID NO: 59646 - RNA, 56 nt, hsa; identical to SEQ ID NO: 59282

SEQ ID NO: 59647 - RNA, 64 nt, hsa
gucggccugagagcugugccgcuccucugucuugucaguggaggugccuggguggggagcaggu

SEQ ID NO: 59648 - RNA, 64 nt, hsa
ugcccccggccaggcccugaggaaaugcucagccucaguggagauggggagguuagagagaugg

SEQ ID NO: 59649 - RNA, 64 nt, hsa
accaacucagggacauccccucuccugggcgacgucaguggaccuuccugcacccccagccugg

SEQ ID NO: 59650 - RNA, 64 nt, hsa
caaacauuauuucauuuuuuuccucucaguaaugucaguggaaguuagggaaaagauucuugga

SEQ ID NO: 59651 - RNA, 64 nt, hsa
ucuucuuccuuguccccguguuucuugagagcacucaguggaugacuauggagaagagccugca

SEQ ID NO: 59652 - RNA, 64 nt, hsa
uauccuuuuacacgcacaaaagcaauagauucauucaguggacaaguuccuuguuuaacuacac

SEQ ID NO: 59653 - RNA, 64 nt, hsa
ugguuauauuucaaccacaccuaaauuaacaaauucaguggacauuuguucuggguuaacagua

SEQ ID NO: 59654 - RNA, 64 nt, hsa
cccuaggucuugggagcucuuggaggugucuguaucaguggauuucccauccccugugggaaau

SEQ ID NO: 59655 - RNA, 55 nt, hsa; identical to SEQ ID NO: 59291

SEQ ID NO: 59656 - RNA, 64 nt, hsa
uuuuuuucuuuuucccuucucuucuuaggaaccaucaguggacaugaauguuucuacaaugcau

SEQ ID NO: 59657 - RNA, 64 nt, hsa
gguucagcagaauaaacucuuuacaauuaauaacucaguggaaaaugauguucagauggugaaa

SEQ ID NO: 59658 - RNA, 64 nt, hsa
uugaugaggucaugucacagaccauuuuaucccuucaguggaaaccauguuaugucgacuauua

SEQ ID NO: 59659 - RNA, 64 nt, hsa
uuggcuucucucccuccagguauaugaccggguaucaguggaagcuguguugccaauggacaaa

SEQ ID NO: 59660 - RNA, 64 nt, hsa
gcuagcaaugccacgauuuagauuuaaugaugcuucaguggaaaucaaucagaagguauucuga

SEQ ID NO: 59661 - RNA, 64 nt, hsa
ugaaauguuaauugcauuuuuacacaugaugcauucaguggacacucuuuuuuccuaauuauaa

SEQ ID NO: 59662 - RNA, 64 nt, hsa
ugugcugaaagaaacauugaugugaacccagugaucaguggaauugucaaguacaggugagcac

SEQ ID NO: 59663 - RNA, 64 nt, hsa
gcuuuuaugugucuuucuacaaagggguuauuggucaguggaagaacaaaguacacuugauaaa

SEQ ID NO: 59664 - RNA, 64 nt, hsa
auggugucggaauuguuguauuuuccuuaggaauucaguggaacuuaucuucauuaaauuuagc

SEQ ID NO: 59665 - RNA, 64 nt, hsa; identical to SEQ ID NO: 59657

SEQ ID NO: 59666 - RNA, 64 nt, hsa
cucaaaagcagaauuuuuaaaacugcauuuuuaaucaguggaacucaauguauaguuagcuuua

SEQ ID NO: 59667 - RNA, 64 nt, hsa; identical to SEQ ID NO: 59666

SEQ ID NO: 59668 - RNA, 64 nt, hsa
acaugcuggccucagagauucaugucacauauugaaauagcaaauagaaaugugcaggagcgga

SEQ ID NO: 59669 - RNA, 64 nt, hsa
ggcugcagacagaggaagaaaguuuauggauuuaaaauagcaaagcaacuuguggaucugugug

SEQ ID NO: 59670 - RNA, 64 nt, hsa
auguguagugcuacacaccuaacuuauggggccaaaauagcauguccuaaugcuugcugcugau

SEQ ID NO: 59671 - RNA, 64 nt, hsa
uaauuccuguuuuuauuauuaacaaaacaguccuaaauagcagcccucaauugugaaaaaauuu

SEQ ID NO: 59672 - RNA, 64 nt, hsa
uuauuagcaugucauuuguacauaaacuaguagaaaauagcaguuuuaaaaguuuucuauuuca

SEQ ID NO: 59673 - RNA, 64 nt, hsa
uguaugagacaaaaguugaggacuuggugaaaggaaauagcaguuacagcaaaaccucagugau

SEQ ID NO: 59674 - RNA, 64 nt, hsa
cuagcauaacuuuuuacauuuaauuuuucauaugaaauagcaauuaguuacugcuguguuacau

SEQ ID NO: 59675 - RNA, 64 nt, hsa
uguuuuaaaugucuagguucuguauuuuuuucuuaaauagcaagaaaauacagauugcuaguau

SEQ ID NO: 59676 - RNA, 64 nt, hsa
ugaccaaauauaucagcaucuaauugaaaugaccaaauagcauucuuagacuucuguauuauga

SEQ ID NO: 59677 - RNA, 64 nt, hsa
uguaugguauuuuauuuaaaggagauaaacagccaaauagcaaauaggucacugaaugauaaga

SEQ ID NO: 59678 - RNA, 64 nt, hsa
ugccucacucauuacuccugugugacaguuauauaaauagcaugcagcucacaucuguuuuaga

SEQ ID NO: 59679 - RNA, 64 nt, hsa
aaucagaauauuucaucuaacugcuuagaacuauaaauagcauucuaaauuugaguaaauacaa

SEQ ID NO: 59680 - RNA, 64 nt, hsa
aucucaaacaaaagacuugcuucaagguguuuuuaaauagcagugauucagaauuuuuuuuaau

SEQ ID NO: 59681 - RNA, 64 nt, hsa
accaagugcuggaaucuaaucugcugugccccuaaaauagcauuuagaaguuuuggauaugaaa

SEQ ID NO: 59682 - RNA, 64 nt, hsa
accagaaauuauagaaaucuguguuuuccuguaaaaauagcacuauaguaucacuugaacaauu

SEQ ID NO: 59683 - RNA, 64 nt, hsa
aaacagauuuugggcaggacauuccaugcacuggaaauagcaugaacaaaugcaugaaaauugc

SEQ ID NO: 59684 - RNA, 64 nt, hsa
ccuggauuggucucaaaaacauaaugcucagugaaaauagcaaguuguagaaaguuauauacaa

SEQ ID NO: 59685 - RNA, 64 nt, hsa
gacuuuggcaugaaauguuaagcauccgacaucuaaauagcaauauuuugaauacuggaaacuc

SEQ ID NO: 59686 - RNA, 64 nt, hsa
cagagguuugagugaacccucuuucaaagacaauaaauagcacagaauuguccgugcuucugug

SEQ ID NO: 59687 - RNA, 64 nt, hsa
ccuaguguuuuaauuaccugugugcagcuauuuuaaauagcauuuuacuugaauaauauguaug

SEQ ID NO: 59688 - RNA, 64 nt, hsa
uagaaaaauucuacuuuaauuuccauuaaaaagcaaauagcauugacacauuuaaagcuuuuca

SEQ ID NO: 59689 - RNA, 64 nt, hsa
ucugcugcuguuauuuauaugcaauucuucugguaaauagcaauagaauaaaacauauuucaau

SEQ ID NO: 59690 - RNA, 64 nt, hsa
uuaauuucaguaguacaguauggaauaguuaaauaaauagcaaaucacugaauucagaaucuca

SEQ ID NO: 59691 - RNA, 64 nt, hsa
ugaauaagaggugauggaccaguuuacugcuuagaaauagcaagaggcacugcaguaaaacuug

SEQ ID NO: 59692 - RNA, 64 nt, hsa
uggguaccuuugaaagaaucucaaauuucaaaagaaauagcaugauugaagauacaucucuguu

SEQ ID NO: 59693 - RNA, 64 nt, hsa
aagggaauuuaggauccaccaucgguggccaggaaaauagcagugacaauaaacaaaguacuac

SEQ ID NO: 59694 - RNA, 64 nt, hsa
aguagugggguggguggcgaguaaguaaaauuucaaauagcauuuuagugaaugcaauucagua

SEQ ID NO: 59695 - RNA, 64 nt, hsa
uaguauuuaagaaaauguugaaauaauuuuuuuaaaauagcauuacagacugaggcgguccuga

SEQ ID NO: 59696 - RNA, 64 nt, hsa
gaagccucuauuguuccccagauaauguucccucaaauagcacggggaagcaacugccuuucaa

SEQ ID NO: 59697 - RNA, 64 nt, hsa
uauuaaucauuggagaagggggaagaggaaaugaaaauagcacaaaaauuaaaauuggaacgaa

SEQ ID NO: 59698 - RNA, 64 nt, hsa
cuaacuugaagccacauccuacagauggcagcccaaauagcacaugggcaauuggcaccaucuu

SEQ ID NO: 59699 - RNA, 64 nt, hsa
aaaaacuuugccucugaugcucagccccacccccaaauagcacacaagcuuguuaaccccaccu

SEQ ID NO: 59700 - RNA, 64 nt, hsa
aucuuuuguuuuuaaaaaaugcaauuaaaacuagaaauagcacucuugguuucuuuugaugaaa

SEQ ID NO: 59701 - RNA, 64 nt, hsa
uggagauagguaggucauuaugauugcagagccaaaauagcaaaacaaacauauuaaguguguu

SEQ ID NO: 59702 - RNA, 64 nt, hsa
uuccuugaauuaugcaaugcaacauuuuacauguaaauagcacuggucauauacugauguauau

SEQ ID NO: 59703 - RNA, 64 nt, hsa
uuucaauggagauagggcuagaaauacuuuugccaaauagcauucuuauucacuuuaugccggu

SEQ ID NO: 59704 - RNA, 64 nt, hsa
aauuuguucuuaccaaaaaauaaaauuacuuuguaaauagcaguucacauuuuuccacaguaua

SEQ ID NO: 59705 - RNA, 64 nt, hsa
uuuuguuaaggcaugacagaugauuuaaacaaauaaauagcaugcaacaaaaugucuuuauuga

SEQ ID NO: 59706 - RNA, 64 nt, hsa
gacccagccugaaagauacaggggaucauguuaaaaauagcaguauuauuuuucgucucaaugg

SEQ ID NO: 59707 - RNA, 64 nt, hsa
aggaauggggggcgggccagggugggaagagaagaaauagcagagccuauuuuggugagguuuu

SEQ ID NO: 59708 - RNA, 64 nt, hsa
guuugauguucagugcauacuuauuaacuuaaaaaaauagcaaauuuauuguaaagugcucccu

SEQ ID NO: 59709 - RNA, 64 nt, hsa
aucucuugauuugcuuuuguaaucagcaauaauaaaauagcagguagauggaugacaguugcuc

SEQ ID NO: 59710 - RNA, 64 nt, hsa
uucuugcuggaagaauaucucugccuucuuaccuuaaauuaaaaagagcacuaagauaacaccu

SEQ ID NO: 59711 - RNA, 64 nt, hsa
aaggcauuugaaugaauguuugacucagguuuguuaaauuaaccuucaguaacugcaguaccaa

SEQ ID NO: 59712 - RNA, 64 nt, hsa
cuuggacauaauuaauauuauaguaagcugcaucuaaauuaaaaauaaacuauucaucauauaa

SEQ ID NO: 59713 - RNA, 64 nt, hsa
ugaaaguuuaaguuuuagacacuccccaaauuucuaaauuaaucuuuuucagaaauaucgaagg

SEQ ID NO: 59714 - RNA, 64 nt, hsa
aguaacugaaccaaaggaaaaagaagcucuuugcuaaauuaaggucuuuuauaaauuuaguaaa

SEQ ID NO: 59715 - RNA, 64 nt, hsa
ugauguugagauuauuauauacuguauuuucuucuaaauuaacccuaauguuuaaaaacucacu

SEQ ID NO: 59716 - RNA, 64 nt, hsa
ugaaauauauaugaugaaaagaauugagaaguucuaaauuaagacauuucaguuaagcucauaa

SEQ ID NO: 59717 - RNA, 64 nt, hsa
gcucuucauguuaauauggcagaguuuuguaaacuaaauuaaaacuuacugauauauuggacuu

SEQ ID NO: 59718 - RNA, 64 nt, hsa
uaaaguuuugccccaugauaaaauaaguaacauauaaauuaauacauaaguuaauauuggaagu

SEQ ID NO: 59719 - RNA, 64 nt, hsa
uaaaauggcuauuccucuuuuuacuuggaaauaauaaauuaacauuauauuuuaaacauaaauu

SEQ ID NO: 59720 - RNA, 64 nt, hsa
auuucuaacuugguucaucacauuauaagauaaauaaauuaaauuaaugaaaaugugacuuaga

SEQ ID NO: 59721 - RNA, 64 nt, hsa
uaacuugguucaucacauuauaagauaaauaaauuaaauuaaugaaaaugugacuuagaguagg

SEQ ID NO: 59722 - RNA, 64 nt, hsa
aaucugccagaucugugaaugauagagauuaugcuaaauuaaugcugauucuuugugugugugg

SEQ ID NO: 59723 - RNA, 64 nt, hsa
uuucuuaucagaauaucuggcuggcccuguaauuuaaauuaaaauaaaauuuuggagaaacagc

SEQ ID NO: 59724 - RNA, 64 nt, hsa
auucauuuuauucuuauuaaggaaauacuuugcauaaauuaaucagccccagagugcuuuaaaa

SEQ ID NO: 59725 - RNA, 64 nt, hsa
uuacuuuuuuucugauguuuccuacaacuaaaaauaaauuaauaaauuuauauaaauucuauuu

SEQ ID NO: 59726 - RNA, 64 nt, hsa
ccucggggauuuuuuccauuuugcaguaaaauguuaaauuaauguagccugccucuauuuguug

SEQ ID NO: 59727 - RNA, 64 nt, hsa
uggcauaaacccuuugaaguuccuuuuucauuguuaaauuaaaauuuuuuuuuuuacuuggaug

SEQ ID NO: 59728 - RNA, 64 nt, hsa
ugaaaaguugaaauuuaugagcuuugaagauugcuaaauuaaauaauuuauagcuccaaaaaca

SEQ ID NO: 59729 - RNA, 64 nt, hsa
uguuguuuaccuuucacugauuucuuauaugguauaaauuaaaguucaggcauuuauggggaga

SEQ ID NO: 59730 - RNA, 64 nt, hsa
aauuuuaaguauaauguuuugccuuugguacaacuaaauuaaaacucuugguggucacauauug

SEQ ID NO: 59731 - RNA, 64 nt, hsa
gcaaauucaauaaacucaaauuuaaaauaauuuuuaaauuaacaguuaugauaaauuuuauauu

SEQ ID NO: 59732 - RNA, 64 nt, hsa
auuauauucaucuacuuagaaauuguuuuauuuuuaaauuaauuugcuuagcuguuuguuuuga

SEQ ID NO: 59733 - RNA, 64 nt, hsa
ucauguuuugaagauuguuuaaaauucauuuuccuaaauuaaugugcaaguaauguuuugagga

SEQ ID NO: 59734 - RNA, 64 nt, hsa
ggaaugggggugauauagauaaacuuacuagauauaaauuaaaauuuuauaaauauuucauauu

SEQ ID NO: 59735 - RNA, 64 nt, hsa
uuuugagguuaugcacacuaaauuaaaugugacauaaauuaauuuguacaaaaagaacucuuua

SEQ ID NO: 59736 - RNA, 64 nt, hsa
uggaauaauaccucaguuuugagguuaugcacacuaaauuaaaugugacauaaauuaauuugua

SEQ ID NO: 59737 - RNA, 64 nt, hsa
cagaaaugauggaguaaacagcaaggcuuuaaauuaaauuaauaguuacaagguagguuggcuc

SEQ ID NO: 59738 - RNA, 64 nt, hsa
uuuggcagaaaugauggaguaaacagcaaggcuuuaaauuaaauuaauaguuacaagguagguu

SEQ ID NO: 59739 - RNA, 64 nt, hsa
uggcuuggaaaagagguacccauucauauauuuauaaauuaaaacauaguuaucuaguaguagg

SEQ ID NO: 59740 - RNA, 64 nt, hsa
auuucuuuaauaaguuuuuaaaauugaucaacuuuaaauuaagcacaguaaauguguauaaaua

SEQ ID NO: 59741 - RNA, 64 nt, hsa
aucuucgaauuccauggacaaaauuaggcucacuuaaauuaauuuuuguaaacccaaguaaguu

SEQ ID NO: 59742 - RNA, 64 nt, hsa
aguuuaguacaggagugacauuaacuaaugacaauaaauuaaacaaagccuacauuaguucaau

SEQ ID NO: 59743 - RNA, 64 nt, hsa
aauacuaaaauauuuucucuuccucauaagcuucuaaauuaaucucugccuuuucugaccucau

SEQ ID NO: 59744 - RNA, 64 nt, hsa
uuuucaggcaugguaacagaaauuuaccuuuuaauaaauuaaaaaaucuaaauuuuaaccuacu

SEQ ID NO: 59745 - RNA, 64 nt, hsa
uguaaacuuuugagucugguuucauuguuuuaaauaaauuaaggggacacuaaaguccuaucau

SEQ ID NO: 59746 - RNA, 64 nt, hsa
uaugaucauagaaacaucuauuuucaaaacaauauaaauuaagcuuuuccccuugauuccuguu

SEQ ID NO: 59747 - RNA, 64 nt, hsa
uagacucguuuaaaaacaaguauauuaaauggguuaaauuaagcuuuuacagaacaugcuuaau

SEQ ID NO: 59748 - RNA, 64 nt, hsa
uaaaaauuaaauaaacguauuaaguuuaacauauuaaauuaauuuaacauuuagacuaacauua

SEQ ID NO: 59749 - RNA, 64 nt, hsa
aaauuaauuuaacauuuagacuaacauuaacauuuaaauuaauauguuaagugaauauacuuaa

SEQ ID NO: 59750 - RNA, 64 nt, hsa
acggggcaugcaauagcuuaagaauugcuaggauuaaauuaaggaaaguaaagcuacucagagc

SEQ ID NO: 59751 - RNA, 64 nt, hsa
uguuuuuuguaaagcuaucauucaauauauauuauaaauuaauauaaauuuaagggaagcucua

SEQ ID NO: 59752 - RNA, 64 nt, hsa
ucucaaaauucuuuaagucaauauuuaucauauguaaauuaaacaugaauacauucucaucuua

SEQ ID NO: 59753 - RNA, 64 nt, hsa
uucaguaggaaacugaacucagcacucagaauuuuaaauuaaaucaaugaucuucaaguauuug

SEQ ID NO: 59754 - RNA, 64 nt, hsa
ugcaguguuuggauuguauauauggugcuaaaaauaaauuaauuuacuuuauaaaccuuaucug

SEQ ID NO: 59755 - RNA, 64 nt, hsa
ccauacauguuaauauucuacauucuugcuuccuuaaauuaauauguuuguguguauauaugug

SEQ ID NO: 59756 - RNA, 64 nt, hsa
uccucucaauuuugcugugaaccugaaauggcuuuaaauuaauacucuuauuuuuuauuuaauu

SEQ ID NO: 59757 - RNA, 64 nt, hsa
uuaauacucuuauuuuuuauuuaauuuaauuacauaaauuaaaccuuaccaugaccaaauugug

SEQ ID NO: 59758 - RNA, 64 nt, hsa
uucaauugcuauuaaacaaguugagauccaguuauaaauuaaccuuguuuuuaguagaugacau

SEQ ID NO: 59759 - RNA, 64 nt, hsa
aauggaaaauguacucuagaccacaggacuaauguaaauuaauauacagucauucauuauuugu

SEQ ID NO: 59760 - RNA, 64 nt, hsa
aggcuacaucacccaaaguagauguuagaaaaccuaaauuaaugaaccauauuuuuaaaauccu

SEQ ID NO: 59761 - RNA, 64 nt, hsa
caaccucuuugggagaaguaugaaugcgugugucuaaauuaaaagaaaaaaauauuuaaacguu

SEQ ID NO: 59762 - RNA, 64 nt, hsa
uaggaauacagcuuuuugaaaaagcuauaaaguuuaaauuaacuaaaaauaugcauuuucuuac

SEQ ID NO: 59763 - RNA, 64 nt, hsa
acugugaccaaauuucuguauuacgauuuuauguuaaauuaaacuaauauggcagguuauaaug

SEQ ID NO: 59764 - RNA, 64 nt, hsa
uauuuugacauuuaaaauacuucccucaauucuguaaauuaaaagaauaguuauuuuacaguuc

SEQ ID NO: 59765 - RNA, 64 nt, hsa
uuucuauauguugcguugugaugacauuaucuuuuaaauuaaaaagagauuuggcuaguugugu

SEQ ID NO: 59766 - RNA, 64 nt, hsa
uuguacacugauauauuggguaaauuuuguugaauaaauuaagcucaacuauuuguauuucaau

SEQ ID NO: 59767 - RNA, 64 nt, hsa
gguaauaugcuccaccuacacacaauuuuagaaauaaauuaaaaauuaaauaaaacuaauauga

SEQ ID NO: 59768 - RNA, 64 nt, hsa
gaauaugaaaccaaaggaagaauuuccauguagauaaauuaagaauagggaaaaacaucuaccu

SEQ ID NO: 59769 - RNA, 64 nt, hsa
uucaaagacugucaaguggaaagcuaucauuuccuaaauuaaggaacuuaggucaaaguuaaau

SEQ ID NO: 59770 - RNA, 64 nt, hsa
gaaacaucaauuucuauuuucugaccucuaagccuaaauuaagauauuguauauguaaugauga

SEQ ID NO: 59771 - RNA, 64 nt, hsa
uuaucauuaauaauauaaaacacuuauuugagauuaaauuaaauuuuucaugagccccucuuug

SEQ ID NO: 59772 - RNA, 64 nt, hsa
cgaacauauuuauugguacugaaaagagacguaguaaauuaaauagaagaaauauauuuauaaa

SEQ ID NO: 59773 - RNA, 64 nt, hsa
aaaaaagucacuaacuuuguguaccuauaaucccuaaauuaaaauuaaauuuuaauuggcuggc

SEQ ID NO: 59774 - RNA, 64 nt, hsa
uuuuagaugacauucuacaaauuauuuuuuucuuuaaauuaaaagaaccuagccaauaagauag

SEQ ID NO: 59775 - RNA, 64 nt, hsa
aagagauauacauucuggauacuugggaggggaauaaauuaaaguuuucacacuguguacugug

SEQ ID NO: 59776 - RNA, 64 nt, hsa
uccaaccugggcgacagagcaagacuccaucucauaaauuaaaaggaaaguaugauaguguuau

SEQ ID NO: 59777 - RNA, 64 nt, hsa
ucucuggguggaugaucuucuaguacuguauuuuuaaauuaaggaguuuuaguuauaaugaaau

SEQ ID NO: 59778 - RNA, 64 nt, hsa
cauuuuuaaaguuuucaaaaagccaucggaauguuaaauuaauguaaagggaacagcuaaucua

SEQ ID NO: 59779 - RNA, 64 nt, hsa
auuuauuuuucagaccauuuuugaacaucacuccuaaauuaauaaaguauuccucuguugcuuu

SEQ ID NO: 59780 - RNA, 64 nt, hsa
aauguuuagugaaacauuugugaaaaaagaagacuaaauuaagaccugagcugaaauaaaguga

SEQ ID NO: 59781 - RNA, 64 nt, hsa
aaucugaaaaguggaggaagaguacaaauagaccuaaauuaagcucauuuuuaggcuuugauuu

SEQ ID NO: 59782 - RNA, 64 nt, hsa
aaauaaaagauauugaggucuuccuaguguuacuuaaauuaagaucaagguaagaaacauugua

SEQ ID NO: 59783 - RNA, 64 nt, hsa
aaaucuuuguaucuggggaaaaaaaacuuuuuuuuaaauuaaaaaggaaaauaaaagauauuga

SEQ ID NO: 59784 - RNA, 64 nt, hsa
ccuuauugauuuuuuuccaaaaaaaaaaaacuacuaaauuaaauaauuuuuuaaaagucauauu

SEQ ID NO: 59785 - RNA, 64 nt, hsa
aagccaucccuauggggaaauugguuuuacuggguaaauuaauacuuuuauuucuuccccuauc

SEQ ID NO: 59786 - RNA, 64 nt, hsa
uacuucaguaaauuauucuuagugaauuauuuucuaaauuaaaaaaaaugacuuggcuuuuggu

SEQ ID NO: 59787 - RNA, 64 nt, hsa
ccucccccccucucauuuucugguucaaucuuaguaaauuaacauucuggauuuaauuaguagu

SEQ ID NO: 59788 - RNA, 64 nt, hsa
agcuaauguuguauuguuuuauuaaaaguaguuuuaaauuaauggauuuaauggaauuguaauu

SEQ ID NO: 59789 - RNA, 64 nt, hsa
cuggggaaguaacguuugcggaugcacaccgaccuaaauuaaaugaaggguauguacuggaaac

SEQ ID NO: 59790 - RNA, 64 nt, hsa
ggauuucuuauugaccuauauucaugaaagcauauaaauuaaaauauuuaaaauuagauaugau

SEQ ID NO: 59791 - RNA, 64 nt, hsa
ugguuuugugaauacuggcaaaagcaauuguuuuuaaauuaacaauggagagaaugauaagaug

SEQ ID NO: 59792 - RNA, 64 nt, hsa
uaugucagucuaaucucuuguuugccaagguuccuaaauuaauucacuuaaccaugaugcaaau

SEQ ID NO: 59793 - RNA, 64 nt, hsa
auguucuauauagccuuugcuaaagagcaacuaauaaauuaaaccuauucuuucugugugugug

SEQ ID NO: 59794 - RNA, 64 nt, hsa
ucuucugggcgcagggaguaaguuacugcuaaauuaaauuaaaugugugccaggccgggugcgg

SEQ ID NO: 59795 - RNA, 64 nt, hsa
cuaccucuucugggcgcagggaguaaguuacugcuaaauuaaauuaaaugugugccaggccggg

SEQ ID NO: 59796 - RNA, 64 nt, hsa
cuuuuuccuaguggugucauuuuugaaugccucauaaauuaaugauucugaagcuuauguuucu

SEQ ID NO: 59797 - RNA, 64 nt, hsa
cccuaucacugacacaucagcauguuuucugcuuuaaauuaaaauuuuaugacaguaucgaggc

SEQ ID NO: 59798 - RNA, 64 nt, hsa
uuaauauuaaauuaaaaccuuuacuuuuguauaauaaauuaaaacucagaauaaaccugugacc

SEQ ID NO: 59799 - RNA, 64 nt, hsa
cacacguaagaaaguguuuuucuacuauuaauauuaaauuaaaaccuuuacuuuuguauaauaa

SEQ ID NO: 59800 - RNA, 64 nt, hsa
agaagccauuaaaauuuuacuaaaauugugcauguaaauuaauugucagcauuccaugucucaa

SEQ ID NO: 59801 - RNA, 64 nt, hsa
augucucaagauuuucuuaauuuaguucgcuguuuaaauuaauucauguccuguaaaguucuga

SEQ ID NO: 59802 - RNA, 64 nt, hsa
cauaccacaucaaaauacaguaacauuucuauacuaaauuaacaguaauaccucaaaacugcuc

SEQ ID NO: 59803 - RNA, 64 nt, hsa
auuuuucauaacuuuguaguacauccaucuugaguaaauuaagccacaauuugguaccuagggu

SEQ ID NO: 59804 - RNA, 64 nt, hsa
uguccaauuuguguaauuuguuuaaaauuguaaauaaauuaaacuuuucugguuucugugggaa

SEQ ID NO: 59805 - RNA, 64 nt, hsa
gaaaguuuuggaaaagaaacaaugaagacugaauuaaauuaaaaauguugcagcucauaaagaa

SEQ ID NO: 59806 - RNA, 64 nt, hsa
acaauggcucuuuagagaguuaucugaguguaaguaaauuaauguucucauuuagauuuaucuc

SEQ ID NO: 59807 - RNA, 64 nt, hsa
guuaccuacaauauuuacuagagauuuaugaaauuaaauuaagagauaauguaagaaaauacau

SEQ ID NO: 59808 - RNA, 64 nt, hsa
caggguuuuuuuguuuuauuuguuugcuuauuuuuaaauuaacuguuuugagcuuugaauacuu

SEQ ID NO: 59809 - RNA, 64 nt, hsa
guauuuuuuagucaauguguuccaugauuuugcuuaaauuaauacuuuuaaguaauggaacuuu

SEQ ID NO: 59810 - RNA, 64 nt, hsa
uuucauugaacauguuagccuaggauacguacaguaaauuaacaaugauagcagcagaugccua

SEQ ID NO: 59811 - RNA, 64 nt, hsa
uucucaaggaggaaaauuggucuaggaagccuucuaaauuaaacucugggaaauauaguaauga

SEQ ID NO: 59812 - RNA, 64 nt, hsa
cagauuuccauuuuuuguauuuuaacuacuuuacuaaauuaauacuccuccuuuuacagaauua

SEQ ID NO: 59813 - RNA, 64 nt, hsa
ccuaugaaugaaauucuuuuauaaauauuaggcauaaauuaaaauguaaaacuccauucauagu

SEQ ID NO: 59814 - RNA, 64 nt, hsa
caucauuuacuugagguucaaaaauaauucauuuuaaauuaaguaguuuuaaucagcuuaaaag

SEQ ID NO: 59815 - RNA, 64 nt, hsa
ggugcagaaauaauacauuaaaagauuuucacuuuaaauuaauuaguaauauugagcgcucacc

SEQ ID NO: 59816 - RNA, 64 nt, hsa
ggucagacggcauuaguuuuucccuuaguuaagcuaaauuaaagggacuccauccuguuaugau

SEQ ID NO: 59817 - RNA, 64 nt, hsa
uccucaauagauugcauguugcuuauuaggauaauaaauuaauauuaaaugcaauauaugucuu

SEQ ID NO: 59818 - RNA, 64 nt, hsa
gcaaugccuuugaaaagggauauuguauccaugguaaauuaauuguauaccuaaacagagauag

SEQ ID NO: 59819 - RNA, 64 nt, hsa
uuucucuaggaacuaaccuaccccaacucugcccuucucccauccaagagaaaccagcaaaaug

SEQ ID NO: 59820 - RNA, 64 nt, hsa
aagggcagugagcaagagaaaugucuaaagcugcuucucccaacaccguccaaagucuccacug

SEQ ID NO: 59821 - RNA, 64 nt, hsa
aggucuguaaugugaaacaacuucuugucuuuuuuucucccacuguuguaaauaacuuuuaaug

SEQ ID NO: 59822 - RNA, 64 nt, hsa
gccacguucccuuuccuccucucccuccuguggauucucccaucagccaucugguucuccucuu

SEQ ID NO: 59823 - RNA, 64 nt, hsa
guacucagaaaagaacuguuuauaccacucaccuuucucccagcauguacucacugugggcaga

SEQ ID NO: 59824 - RNA, 64 nt, hsa
uuggucuuaauguagcuacugugcgggucacaguuucucccaaugauuaugacugggacauucu

SEQ ID NO: 59825 - RNA, 64 nt, hsa
ccaggggaaagaugagcuuuucuaggcuacaauuuucucccaggaagcuuugauuuuuaccguu

SEQ ID NO: 59826 - RNA, 64 nt, hsa
cccuccgauccuuccucccaccucccccucccccuucucccaccccugcccccacuuccuguuu

SEQ ID NO: 59827 - RNA, 64 nt, hsa
aguuuuuuagcuuuauaaagagguuuuuucaaauuucucccauuuuucucuccacccacauaaa

SEQ ID NO: 59828 - RNA, 64 nt, hsa
cugugcuaaagaaaugauauuuuauugcuuugauuucucccaaagaauaacuuggagguugacu

SEQ ID NO: 59829 - RNA, 64 nt, hsa
auuggaaauaaaaaugguuugagcgucagugauauucucccagaauguacuuaucuuaccucgg

SEQ ID NO: 59830 - RNA, 64 nt, hsa
caacuuuaugauuugaaagcuuuaaaggagauucuucucccacccccaacuuuauuugcaaugg

SEQ ID NO: 59831 - RNA, 64 nt, hsa
cacuccuaccagcaagcagcaccaucccgcaggcuucucccaccugauggcuguucucccaccg

SEQ ID NO: 59832 - RNA, 64 nt, hsa
caccaucccgcaggcuucucccaccugauggcuguucucccaccgggucugggcucuggaagga

SEQ ID NO: 59833 - RNA, 64 nt, hsa
uggcugggggugaauccgaaugacagugcagacguucucccauccaccaugucugagcuugggg

SEQ ID NO: 59834 - RNA, 64 nt, hsa
aagaucaauuucucccaaggccaagauuguccuuuucucccauuucuugcuagcuauugcaaau

SEQ ID NO: 59835 - RNA, 64 nt, hsa
aaagagauagcuucucuucuuucugaagaucaauuucucccaaggccaagauuguccuuuucuc

SEQ ID NO: 59836 - RNA, 64 nt, hsa
agcugcugguucucccagguggauuuugcuggaauucucccaugucaucaccccaccaccguca

SEQ ID NO: 59837 - RNA, 64 nt, hsa
gagauccacucuguccguggaguggagcugcugguucucccagguggauuuugcuggaauucuc

SEQ ID NO: 59838 - RNA, 64 nt, hsa
cugucaaacucaaugaucauuuaguacuuuugucuucucccaugugcuugaaggaaaaauaaag

SEQ ID NO: 59839 - RNA, 64 nt, hsa
uugcauggcuuggacccuaucugugaccaugcucuucucccaauuuaagugguucuguaccaca

SEQ ID NO: 59840 - RNA, 64 nt, hsa
cccuggcagccccccaugugggagaaauaccugauucucccaaucugcagugggagagcuuugc

SEQ ID NO: 59841 - RNA, 64 nt, hsa
gccucacugcgccagccuccccgcccgcucucuuuucucccaagcgaaaccaaaugcgccccuu

SEQ ID NO: 59842 - RNA, 64 nt, hsa
gcccugguaucuccccaucccuacucccagccccuucucccaggguccagagccaggaccccuu

SEQ ID NO: 59843 - RNA, 64 nt, hsa
cccgcaccagcauuuuggaaccugcagagagccuuucucccagcuuugccgccugugcugccau

SEQ ID NO: 59844 - RNA, 64 nt, hsa
gccacccucccuucauuacccccacuccauacccuucucccaacuuuuugaugucccuguaggg

SEQ ID NO: 59845 - RNA, 64 nt, hsa
uccuguuccauucaucugcccaaacccuuucucuuucucccaggcagggcucugcagguccaua

SEQ ID NO: 59846 - RNA, 64 nt, hsa
uagccuggagcuccaugguggcuucaugccucccuucucccagcucagguggcccugagggcuc

SEQ ID NO: 59847 - RNA, 64 nt, hsa
uuuauagagauuuucuauugcugggaagguguguuucucccacaauuuguuugugaauauucac

SEQ ID NO: 59848 - RNA, 64 nt, hsa
uguuugcuaccuccugcuauuuuugugguuuugguucucccacuaugguaggaccccuggccag

SEQ ID NO: 59849 - RNA, 64 nt, hsa
uccaacuccugaugcccucuucuccuugccuugcuucucccauuuccugaucuagcacuccuca

SEQ ID NO: 59850 - RNA, 64 nt, hsa
uacccaacaaauaaccuguuugaacucucuuauauucucccacuagccugaagcaaugaccuca

SEQ ID NO: 59851 - RNA, 64 nt, hsa
cucucugcuguguguggaugaaugauggaauuacuucucccauguugccauuuuugagguguac

SEQ ID NO: 59852 - RNA, 64 nt, hsa
ccccacuuuuucucuugguucucccacauucuuauucucccacaucccuacccacguuugagcu

SEQ ID NO: 59853 - RNA, 64 nt, hsa
aacuccacucucccagccccacuuuuucucuugguucucccacauucuuauucucccacauccc

SEQ ID NO: 59854 - RNA, 64 nt, hsa
caucacguuugucacugccguuuauuacauugacuucucccaagaugaaucuuccuuccaaaug

SEQ ID NO: 59855 - RNA, 64 nt, hsa
ggugaucgucuuugaaguucagcaaagcugcuuguucucccauggauuccugucccaagcuacc

SEQ ID NO: 59856 - RNA, 64 nt, hsa
uucuaccaacuccaccuccacccccucauuccccuucucccaaaguacuacugcuguugcauga

SEQ ID NO: 59857 - RNA, 64 nt, hsa
cucacugcaaccucugccuccuggguucaagcaauucucccaccucagccucccaaguagcugg

SEQ ID NO: 59858 - RNA, 64 nt, hsa
uuauaauuucaaaaugcaucacuuacauagguauuucucccacagaaaugaugaaagugaccag

SEQ ID NO: 59859 - RNA, 64 nt, hsa
ccuguagguauaaaccucuguaugaagagaagauuucucccaggaaaucuuuguacagcuuuaa

SEQ ID NO: 59860 - RNA, 64 nt, hsa
ccgaccgcaucacugucuuccggagucccccuucuucucccagacucugucuucaauaaaaacu

SEQ ID NO: 59861 - RNA, 64 nt, hsa
cgcgggugccgcccucgcgcgggcuagggggagguucucccagccugaguccguagccccgccc

SEQ ID NO: 59862 - RNA, 64 nt, hsa
ccugccccgucaccaucucaggccaccugcccccuucucccacacugcuaggugggccagcccc

SEQ ID NO: 59863 - RNA, 64 nt, hsa
gaaggaauugacuucgacugugaccuguggggauuucucccagcucuagacaacccugcaaagg

SEQ ID NO: 59864 - RNA, 64 nt, hsa
cccuaagugacgguccuaagugggauggcucuccuucucccaagcugcaguacuggggaagggc

SEQ ID NO: 59865 - RNA, 64 nt, hsa
gaugggggauacccaccuuucugaaguguccccuuucucccaucuuaaggggcucuccucccuc

SEQ ID NO: 59866 - RNA, 64 nt, hsa
cagcuucccagacccucaugcaguugguuguaaauucucccaggagcuguuuuacugucuacuu

SEQ ID NO: 59867 - RNA, 64 nt, hsa
gguuggggggcuccuucccuucagaacuugaaguuucucccacugccuccucuccaguggucuc

SEQ ID NO: 59868 - RNA, 64 nt, hsa
uaacccuuuaucagguauacagcuugcaacuauuuucucccauuucugaguugucucuucauuc

SEQ ID NO: 59869 - RNA, 64 nt, hsa
aaaaaaccuugcccggaccaacgucuugaagcuuuucucccacccauuuuuguauaugggauaa

SEQ ID NO: 59870 - RNA, 64 nt, hsa
accacugauuguagggaugccguuccccccucccuucucccaugggcaucaucuuauuuauuua

SEQ ID NO: 59871 - RNA, 64 nt, hsa
agagagcugggcuugaguggaguuuauuguagauuucucccaaggggaucacuuagcuucucac

SEQ ID NO: 59872 - RNA, 64 nt, hsa
acuggccugaccugggccuugucuuccaguuccuuucucccauucccagccucauuucuuaaau

SEQ ID NO: 59873 - RNA, 64 nt, hsa
gcucccccacuuugcauguucccagagucccuccuucucccagguuuggucucagggggacccc

SEQ ID NO: 59874 - RNA, 64 nt, hsa
ccgucagcguccaacguggaaaaggcguuaccucuucucccagcgcuggccgccuggccacuga

SEQ ID NO: 59875 - RNA, 64 nt, hsa
uuaguuaccacagccugcccagagagaaacuaucuucucccaacauuuacuaacauccacuggu

SEQ ID NO: 59876 - RNA, 64 nt, hsa; identical to SEQ ID NO: 24669

SEQ ID NO: 59877 - RNA, 64 nt, hsa; identical to SEQ ID NO: 24670

SEQ ID NO: 59878 - RNA, 64 nt, hsa; identical to SEQ ID NO: 24671

SEQ ID NO: 59879 - RNA, 64 nt, hsa; identical to SEQ ID NO: 24672

SEQ ID NO: 59880 - RNA, 64 nt, hsa; identical to SEQ ID NO: 24673

SEQ ID NO: 59881 - RNA, 64 nt, hsa; identical to SEQ ID NO: 24674

SEQ ID NO: 59882 - RNA, 64 nt, hsa; identical to SEQ ID NO: 24675

SEQ ID NO: 59883 - RNA, 64 nt, hsa; identical to SEQ ID NO: 24676

SEQ ID NO: 59884 - RNA, 64 nt, hsa; identical to SEQ ID NO: 24677

SEQ ID NO: 59885 - RNA, 64 nt, hsa; identical to SEQ ID NO: 24678

SEQ ID NO: 59886 - RNA, 64 nt, hsa; identical to SEQ ID NO: 24679

SEQ ID NO: 59887 - RNA, 64 nt, hsa; identical to SEQ ID NO: 24680

SEQ ID NO: 59888 - RNA, 64 nt, hsa; identical to SEQ ID NO: 24681

SEQ ID NO: 59889 - RNA, 64 nt, hsa; identical to SEQ ID NO: 24682

SEQ ID NO: 59890 - RNA, 64 nt, hsa
ucaagucuaaccagccucagcagugugcauagaccauuuccaggagggucuguccccagaugcu

SEQ ID NO: 59891 - RNA, 64 nt, hsa
gaaaacagccagaagccaccuugacacuuuugaacauuuccaguucuguagaguuuauugucaa

SEQ ID NO: 59892 - RNA, 64 nt, hsa
aaucaguguguuuagacuuuucaaguaucuaacucauuuccaaacauguaccauguuuuauaaa

SEQ ID NO: 59893 - RNA, 64 nt, hsa
caugaauacuuuuguauugcugcuugcaaauaugcauuuccaaacuugaaauauaggugugaac

SEQ ID NO: 59894 - RNA, 64 nt, hsa
aaaagacaagaggaagggcagguacuagguguuucauuuccagaauuaaaaaaaaaauccauuu

SEQ ID NO: 59895 - RNA, 64 nt, hsa
gacugaaaauaaugucuacaguccacagcuucagcauuuccagagaccacaugugagcuucuuu

SEQ ID NO: 59896 - RNA, 64 nt, hsa
uuaguuuuucagaaaaugcaucccugauuucauucauuuccagcuugaaagccagccauauuac

SEQ ID NO: 59897 - RNA, 64 nt, hsa
uuacucuagucccuaccaaacugcucuagaaggucauuuccauuuuguuugugauauuuagacg

SEQ ID NO: 59898 - RNA, 64 nt, hsa
uccaccauggacucaaucugagaacaacagcauucauuuccauucauuuccauacuggcuuuug

SEQ ID NO: 59899 - RNA, 64 nt, hsa
acucaaucugagaacaacagcauucauuuccauucauuuccauacuggcuuuugauuauaugca

SEQ ID NO: 59900 - RNA, 64 nt, hsa
cucaacuuuucuuccuuauggggcuacauuuguucauuuccagcaguagcauaaacuuacggug

SEQ ID NO: 59901 - RNA, 64 nt, hsa
aucuugaggguagagccacaaauuucaauucuuacauuuccauuugcaaagugacuagagaaaa

SEQ ID NO: 59902 - RNA, 64 nt, hsa
uccccugcagcaaacguuugccugggcauugaggcauuuccauacaucuucugaaaacuaggcg

SEQ ID NO: 59903 - RNA, 64 nt, hsa
augugauugaacacuuuaguaaugcaaaauaacucauuuccaacuacugcugcagcauuuuggu

SEQ ID NO: 59904 - RNA, 64 nt, hsa
uuuaauguuuuuuucacuuaauauuuuauauauacauuuccauguauugauguaguuaguccac

SEQ ID NO: 59905 - RNA, 64 nt, hsa
aaauguuuucauaggcuauuauauauucucgcagcauuuccaguuaagaggauauuagguauau

SEQ ID NO: 59906 - RNA, 64 nt, hsa
agauguuacccaaacucaucuucuaaaaucugugcauuuccaugguggcugacacacuugucau

SEQ ID NO: 59907 - RNA, 64 nt, hsa
cacaaagugagcauuucuuuuuaaauuuucuugacauuuccaagcuuauuaugaauaauauugc

SEQ ID NO: 59908 - RNA, 64 nt, hsa
uuccuuagauaucaguuaggauacaucacuaaaacauuuccacuaacuccacuguuucuauaau

SEQ ID NO: 59909 - RNA, 64 nt, hsa
aggagaaaagauaucacaacucuauggaaaaugacauuuccauuugccuuauugcuacuucaag

SEQ ID NO: 59910 - RNA, 64 nt, hsa
cacaucccaacuucauuucccccucacuguagcccauuuccaccccaccacaaaguugccacag

SEQ ID NO: 59911 - RNA, 64 nt, hsa
gaaacuggaagugcaugaggcagagcguccguagcauuuccaguuuguucuguauaggaacaga

SEQ ID NO: 59912 - RNA, 64 nt, hsa
caccaaccagauucaugagcuuucucacauuuuccauuuccaaauaacuguuguguugaaucag

SEQ ID NO: 59913 - RNA, 64 nt, hsa
aggcacugggcuuuaaagagcgaaaugagugugucauuuccacaugaaggagaggcaaggaaaa

SEQ ID NO: 59914 - RNA, 64 nt, hsa
cuccuaccugcgcagucuaaacauagcuguggaucauuuccaacuuucaacuucacuccgggcc

SEQ ID NO: 59915 - RNA, 64 nt, hsa
agcgaggcugguuuccugugcagcagguggaguucauuuccaacccagagguccgugcacagaa

SEQ ID NO: 59916 - RNA, 64 nt, hsa
aauggauaaaccaaggauuuuguguuuaacaauccauuuccagugucuucgccacauaaaauag

SEQ ID NO: 59917 - RNA, 64 nt, hsa
uuuaaaaggauaguuuaugaguaaucuuuaaaaccauuuccauaccaucuguauauaaccauuu

SEQ ID NO: 59918 - RNA, 64 nt, hsa
cugggauuccaggcgugagccacugcggccagcacauuuccacuuuuagauccuacuccauacc

SEQ ID NO: 59919 - RNA, 64 nt, hsa
aucccugugcuccuuaagccucauggccuuccuacauuuccacuuuauuuguuuguuuguuuau

SEQ ID NO: 59920 - RNA, 64 nt, hsa
ccagaaaaugggcagagagagaugaccucggaagcauuuccacagauggugucaggguuucaag

SEQ ID NO: 59921 - RNA, 64 nt, hsa
cugccaacuguggucaaaguucauaggugucguacauuuccauuauuugcuaaaaucaugcaau

SEQ ID NO: 59922 - RNA, 64 nt, hsa
guagucuuugcaucagcuuaccuuguaccagaaacauuuccaauuuacuaucaaauuauaguaa

SEQ ID NO: 59923 - RNA, 64 nt, hsa
ugagaaugcccagaaagugccagaagcaucguggcauuuccagaaccauggauucugccuuugg

SEQ ID NO: 59924 - RNA, 64 nt, hsa
gaacagauccaaaguuagcaguauauggcugcuacauuuccauuuucauuuucgagccaucagu

SEQ ID NO: 59925 - RNA, 64 nt, hsa
aagguucauuguuuaaugaaauauuuuauucuugcauuuccauaaggaaagggaaagucaugau

SEQ ID NO: 59926 - RNA, 64 nt, hsa
uuuugggcaaccuccuucgacgugggggaggucccauuuccacuucaucacuguuggagaucau

SEQ ID NO: 59927 - RNA, 60 nt, hsa
aaagacuuggcaugaacugaaacaggcuuucauuuccacagaauucacaggagcaugguu

SEQ ID NO: 59928 - RNA, 64 nt, hsa
auaaguguucugaccagggagugacagguuaugacauuuccaugucaacucuaaaugaagucuu

SEQ ID NO: 59929 - RNA, 64 nt, hsa
cuuguauauacuuugccacuggaaaggacaaauacauuuccagaucuuuucagugaucuggaua

SEQ ID NO: 59930 - RNA, 64 nt, hsa
aaaucguccauucuuuuaaauguugucucacuugcauuuccagucuuggccaucaaaucaauga

SEQ ID NO: 59931 - RNA, 64 nt, hsa
guacaaaguggcaucucauggugguuuuaauuugcauuuccauaauaucuaauuagguugagcu

SEQ ID NO: 59932 - RNA, 64 nt, hsa
aaaaauuuaauuuugaaaaaggugacucaccccucauuuccagaguguaggcaauuauguccug

SEQ ID NO: 59933 - RNA, 64 nt, hsa
accgaaaaaagaaaagaaaucuguuucuaccaaacauuuccagaaacguauuuauagcaugaag

SEQ ID NO: 59934 - RNA, 64 nt, hsa
cacgccuguaauaccagcuacucagguggcugaggcauaagaauugcuugagccugggaggcag

SEQ ID NO: 59935 - RNA, 64 nt, hsa
cgugccuguaaucccagcuacuugggaggcugaggcauaagaauuguuugagcccgggagacag

SEQ ID NO: 59936 - RNA, 64 nt, hsa
agccugggggaaggagaaaggaggggagaaagcgggcucucacccccucaggagugggcacggg

SEQ ID NO: 59937 - RNA, 64 nt, hsa
agugcugggauuacaggcgugagccacugcacccggcucucacuggucuuacgccaccuucugg

SEQ ID NO: 59938 - RNA, 64 nt, hsa
cacccucccccgccacuccugaaccccgucgaggggcucucagcucagcgccagccugucccau

SEQ ID NO: 59939 - RNA, 64 nt, hsa
gggaaccaugaagacaggaugggggcuggccucuggcucucaugggguccaaguuuuguguauu

SEQ ID NO: 59940 - RNA, 64 nt, hsa
auucucuuccugcuucugcucugggccgguggguggcucucagaaaauacuugcugcuggcaaa

SEQ ID NO: 59941 - RNA, 64 nt, hsa
uucuuuuccccucuaaccuaggacccucauuaccggcucucauagcacagucuacugcuuugua

SEQ ID NO: 59942 - RNA, 64 nt, hsa
uucccuguuccuucugggucaggcugucacuuccggcucucagcccuaucuccugcaaccucag

SEQ ID NO: 59943 - RNA, 64 nt, hsa
uuugccaaagguuuacuuccagcaucugagcucuggcucucaccccugaagcucaguuauagug

SEQ ID NO: 59944 - RNA, 64 nt, hsa
ccuuaaaaaguaaacuuauuuuuucuaacuagaaggcucucauaaguuucuguuaugauugcca

SEQ ID NO: 59945 - RNA, 64 nt, hsa
uuagcauucuggaauucucaucuaaugguucacuggcucucaucuauuguuuaacucacuaguu

SEQ ID NO: 59946 - RNA, 64 nt, hsa
cuaggaaaggcgagcuggacucugucuccaugguggcucucaccccagggaccuaggaacagcc

SEQ ID NO: 59947 - RNA, 64 nt, hsa
caucccaggacuccaaacagggaucugucucuuuggcucucagcucugcuuucauuugaguugg

SEQ ID NO: 59948 - RNA, 64 nt, hsa
ccugccacaucugcacugcagcggaugaccaccaggcucucaucugggacauccagcaaaugcc

SEQ ID NO: 59949 - RNA, 64 nt, hsa
ucccacuggcagcaugguagagcugagagaaacaggcucucaggguaccugacuugaggggaau

SEQ ID NO: 59950 - RNA, 64 nt, hsa
uguccaauacauggcucugcccuccagaacuucaggcucucagugacccuucgacauccugcuu

SEQ ID NO: 59951 - RNA, 64 nt, hsa
gguccaauacauggcucugccccccagaacuuaaggcucucacugccccuucgccauccuagag

SEQ ID NO: 59952 - RNA, 64 nt, hsa
aguagacuccccuuuaaaugcacauuguguggauggcucucaccauuuccuaagagauacauug

SEQ ID NO: 59953 - RNA, 64 nt, hsa
caagaugucagaauaagacuccccaucaugaugaggcucucaccccucuuagcuguccuugcuu

SEQ ID NO: 59954 - RNA, 64 nt, hsa
gccagccucagauacuucugugggcccugaagugggcucucaaggucagaccaagguugcugau

SEQ ID NO: 59955 - RNA, 64 nt, hsa
aaagccaaaggugccaggccuuagagcagacaagggcucucagcccuggcaugcccccuaaagg

SEQ ID NO: 59956 - RNA, 64 nt, hsa
ccuccaucccacucuuguuaugacuccacaguguccagacuaauuugugcaugaacugaaauaa

SEQ ID NO: 59957 - RNA, 64 nt, hsa
ggugggggccauauccuagaccucucuguaucccccagacuaucuguaacagugccaggcacac

SEQ ID NO: 59958 - RNA, 64 nt, hsa
ugccacccucucccuugccaaagaagaaacucuccccccaaauccuccaaccucuggggccaca

SEQ ID NO: 59959 - RNA, 64 nt, hsa
cacagcccugccccuccaguuccuuggcaguucucccccaaaccaggucuguacagguguucuu

SEQ ID NO: 59960 - RNA, 64 nt, hsa
cggugagggggcagaaggacucagcgccccuggacccccaaaugcugcaugaacacauuuucag

SEQ ID NO: 59961 - RNA, 64 nt, hsa
agucuggguucugguguccacucacccaccccaccccccaaaaucagacaaaugcuacuuuguc

SEQ ID NO: 59962 - RNA, 64 nt, hsa
ccucaugcagaccugggguccuccugggcccuggcccccaaaccucuuggcacccgguuguuac

SEQ ID NO: 59963 - RNA, 64 nt, hsa
cuuggcacccgguuguuacccccuggcagcuucucccccaaacucuccuaccauguggcccugc

SEQ ID NO: 59964 - RNA, 64 nt, hsa
aaagagcccuggagcaucagguuccccagauaggcccccaaauaaagaccugucuauggcucuc

SEQ ID NO: 59965 - RNA, 64 nt, hsa
aggagaucagaaaaucccucugacaucuccacugcccccaaagaccuccguugaacauucugua

SEQ ID NO: 59966 - RNA, 64 nt, hsa
uucaguggaacccuugcccccaaaugucgaccagcccccaaaugucgaagaauuuucuucuugc

SEQ ID NO: 59967 - RNA, 64 nt, hsa
cgugaauuugggggauuuuucaguggaacccuugcccccaaaugucgaccagcccccaaauguc

SEQ ID NO: 59968 - RNA, 64 nt, hsa
agaccagugcagccagagagaccaccaaacagagcccccaaaagacagacaucucugcuagcug

SEQ ID NO: 59969 - RNA, 64 nt, hsa
agucagacaugauccuccagauugacagacaagucccccaaaugaguacacaucuccagcuauu

SEQ ID NO: 59970 - RNA, 64 nt, hsa
ggacaccaagcagaauucugcauggugacagucucccccaaacauggccugcugggcccaagug

SEQ ID NO: 59971 - RNA, 64 nt, hsa
cccguuucucccucaaguuugaguauuucgggagcccccaaaacagccugagcaaaaagaccag

SEQ ID NO: 59972 - RNA, 64 nt, hsa
auccaccaguuuuucuaagcuagaaccuuugagucccccaaacugccugaagacuuaaguuuug

SEQ ID NO: 59973 - RNA, 64 nt, hsa
aaccuugacgaggauacaaaagugaaagcaucaucccccaaaggaucacugcacaguccuacua

SEQ ID NO: 59974 - RNA, 64 nt, hsa
cugcucugaaaucuccuuuagccaucaccccaaccccccaaaauuaguuuguguuacuuaugga

SEQ ID NO: 59975 - RNA, 64 nt, hsa
acucaaagaguauauguucccuccaggucagcugcccccaaacccccuccuuacgcuuugucac

SEQ ID NO: 59976 - RNA, 64 nt, hsa
ccucaacgugcgaggauuccuggaccgcuacugccccccaaacugccccccgagcuucuucccc

SEQ ID NO: 59977 - RNA, 64 nt, hsa
ucuagguagcaacagguaucgaggacucuccaaacccccaaagcagagagagggcugaucccau

SEQ ID NO: 59978 - RNA, 64 nt, hsa
ccuggaccccugcccccaaaauauuuucaucuuucccccaaaccuccuuuaaaggagcaugcau

SEQ ID NO: 59979 - RNA, 64 nt, hsa
gauuccaaaaauguuucugagcccuggaccccugcccccaaaauauuuucaucuuucccccaaa

SEQ ID NO: 59980 - RNA, 64 nt, hsa
uggagccaaagccucucacagugcugauuuaccucccccaaaaugcccccaaacccccaugcaa

SEQ ID NO: 59981 - RNA, 64 nt, hsa
ccucucacagugcugauuuaccucccccaaaaugcccccaaacccccaugcaaguuuacagcca

SEQ ID NO: 59982 - RNA, 64 nt, hsa
gggcuugcagcagcagcaguguggccaucuccaucccccaaagcacacuugcucucucaauaug

SEQ ID NO: 59983 - RNA, 64 nt, hsa
acuuuuuuaaaggggauuaaaaaacacagccucucccccaaaggguguccguucuuaauuccca

SEQ ID NO: 59984 - RNA, 64 nt, hsa
gggaggagcagcuguguguccccggcaccucacucccccaaaaugacacccaccgucgucaggg

SEQ ID NO: 59985 - RNA, 64 nt, hsa
cagcccaugcuugaugccagcaacccagauccugcccccaaagccaagaagaucaagucucagc

SEQ ID NO: 59986 - RNA, 64 nt, hsa
ucuuccgaggucucccugaaaugaauguauuucucccccaaaagagcugauauuuaauguuuua

SEQ ID NO: 59987 - RNA, 64 nt, hsa
gaaacaugcacacugcaaauaucaaaaggagacacccccaaaucccacucuaaauuccaaagcc

SEQ ID NO: 59988 - RNA, 64 nt, hsa
gcaugcauugcucuuaaccgcagaauggcaauaacccccaaaaggucaaaugggcacaccacag

SEQ ID NO: 59989 - RNA, 64 nt, hsa
uauugaggaaagucagucuacucccuucuuccuccccccaaacacguguucucuuuugucagga

SEQ ID NO: 59990 - RNA, 64 nt, hsa
aggaaaggaaaaucagguagauggugcuuuuuuucccccaaaucuaaguauucuaugucauggu

SEQ ID NO: 59991 - RNA, 64 nt, hsa
aauucagaagcaucaccaugcaugguggcgaaugcccccaaacucucccccaaauguauuucuc

SEQ ID NO: 59992 - RNA, 64 nt, hsa
ucaccaugcaugguggcgaaugcccccaaacucucccccaaauguauuucucccuucgcugggu

SEQ ID NO: 59993 - RNA, 64 nt, hsa
uggcaaagagcuugacccaggaaauagauggugccccccaaauugucuccacaugaagauguac

SEQ ID NO: 59994 - RNA, 64 nt, hsa
cuagcuuaacccuuugagacucugagauuuuuuucccccaaauuuguguaaaacaguuucaucu

SEQ ID NO: 59995 - RNA, 64 nt, hsa
uacaaccuuuuccuuaaggucuuuuaccaccucccccccaaaaaaaucccccaaaacugauuca

SEQ ID NO: 59996 - RNA, 64 nt, hsa
uuaaggucuuuuaccaccucccccccaaaaaaaucccccaaaacugauucagauuuucauacuu

SEQ ID NO: 59997 - RNA, 64 nt, hsa
ugauuggauaaauauuucccaucccacccaccuccccccaaaaaauagcucacaaggggagagc

SEQ ID NO: 59998 - RNA, 64 nt, hsa
aguccagggcagggaaauauuggcccuaucuugacccccaaauccagugagcuccagauucuuc

SEQ ID NO: 59999 - RNA, 64 nt, hsa
uuuaaaugauagagguuuuugugggaaucaaaaucccccaaauguuaagguauaugguaaaaaa

SEQ ID NO: 60000 - RNA, 64 nt, hsa
auaaacuuuguuuuaacauaauuaguacuguuuucccccaaaaguacaaguuuuugaguagcaa

SEQ ID NO: 60001 - RNA, 64 nt, hsa
ccccuagaagaccccaaugccguaacuccuaggacccccaaaucauggaaucccaaauccccag

SEQ ID NO: 60002 - RNA, 64 nt, hsa
cccuuaaguccucuugaaauaaacauaggucacacccccaaagcaaaagaguaacagacauuca

SEQ ID NO: 60003 - RNA, 64 nt, hsa
gaggccccauuauuaacagauacucccauaauaacccccaaauacagaccccaugucacccaga

SEQ ID NO: 60004 - RNA, 64 nt, hsa
gcuuggcgcuccuccuccguccuaucccaacucacccccaaacccccaucccuuccccaccucc

SEQ ID NO: 60005 - RNA, 64 nt, hsa
gacccccggcccggcccggaacuuuucuccccaacccccaaacccacgacucacuuccacaccg

SEQ ID NO: 60006 - RNA, 64 nt, hsa
ucucuauuggaggugagaucacagccuccagggccccccaaaucccagggaaggacuuggagag

SEQ ID NO: 60007 - RNA, 64 nt, hsa
gcaccccagcuaccccuucuuugcagggcuaaggcccccaaacauagccccugccccggaggaa

SEQ ID NO: 60008 - RNA, 64 nt, hsa
acauauacaugagaacuuagacacaagggaccaucccccaaacucuacucuuauacccagaaaa

SEQ ID NO: 60009 - RNA, 64 nt, hsa
cuacacaguaucaaaugaaugggucaauucagcacccccaaauuuaauucuguggggaaaaauu

SEQ ID NO: 60010 - RNA, 64 nt, hsa
ccacuuucuggggaucauuuugauguugaauguucccccaaagcauucugacaaguuuggucca

SEQ ID NO: 60011 - RNA, 64 nt, hsa
guacuauucauugauucagugaugugaaauugagcccccaaaagguuguuucugaagcucgagu

SEQ ID NO: 60012 - RNA, 64 nt, hsa
ggaguggaagagaggugugaagaaaccucuccgaacaaaugaaccagcaguaaguuucuaaaaa

SEQ ID NO: 60013 - RNA, 64 nt, hsa
agccuuaguaaaguugugauugaagaaacuuaauacaaaugaacuagagguuuguaaucaugcc

SEQ ID NO: 60014 - RNA, 64 nt, hsa
gaauagaaucccugccuacuuaaguaacuguuggacaaaugauauauauuucuucuaaggaaaa

SEQ ID NO: 60015 - RNA, 64 nt, hsa
cuaaggaaaaaguuuauuauuuacucuuuacuagacaaaugaguagcauauagaagaaaguuaa

SEQ ID NO: 60016 - RNA, 64 nt, hsa
aaucccugaaaccaugauuggcauauguuagauaacaaaugaggaugucuaagaggcauaugcu

SEQ ID NO: 60017 - RNA, 64 nt, hsa
aaaaauacuuauauauuucuauuacaaagcagugacaaaugaugcccugugugacuuggaguua

SEQ ID NO: 60018 - RNA, 64 nt, hsa
agaggacugugcauuuuugcuauuuaaaggaaucacaaaugaucauacuuaagugagcaaaaau

SEQ ID NO: 60019 - RNA, 64 nt, hsa
cuugugcucaugcaacuuagaguaacauauacagacaaaugauugcaugaggccauguuuauau

SEQ ID NO: 60020 - RNA, 64 nt, hsa
auuuccacuugcaggccagcuuaaccucugaaacacaaaugaucuugagaccacuuuaguguac

SEQ ID NO: 60021 - RNA, 64 nt, hsa
guaaaguuagauguugaaacccaguuuaucuuauacaaaugagccucugcuuguucuacaaagg

SEQ ID NO: 60022 - RNA, 64 nt, hsa
uugugccagucucuaaguuggcaacuuuggcugaacaaaugaguaguggcuucaguguccuugc

SEQ ID NO: 60023 - RNA, 64 nt, hsa
gaaaaacauucucacauagccucuauguaaucagacaaaugacauuugauuucaagagcagagg

SEQ ID NO: 60024 - RNA, 64 nt, hsa
cuggccucauuuuuuaaaacaaaugaauaaauggacaaaugaguaaaugagaaagucucacacc

SEQ ID NO: 60025 - RNA, 64 nt, hsa
gcaugagucaccaugccuggccucauuuuuuaaaacaaaugaauaaauggacaaaugaguaaau

SEQ ID NO: 60026 - RNA, 64 nt, hsa
aaacauuuugcuauacaguacuucauagaugcauacaaaugagcucacuuauuacaaagacaaa

SEQ ID NO: 60027 - RNA, 64 nt, hsa
cuugauguauuccacuguuauuacuguuaccugcacaaaugaaaaacaauacucaacaguaauu

SEQ ID NO: 60028 - RNA, 64 nt, hsa
aaaaauguauguaaacauucaaaugauuaucugaacaaaugagauuuugugguguuuucuuuaa

SEQ ID NO: 60029 - RNA, 64 nt, hsa
aaguaaauggagagguaaaagaaaggcauuggggacaaaugaaagagaugauguagauuuuucg

SEQ ID NO: 60030 - RNA, 64 nt, hsa
ggggcagauccugacuacacuaagucaggguuugacaaaugacaguccaucagacagaucuggc

SEQ ID NO: 60031 - RNA, 64 nt, hsa
gucagggcagccagcuguagacauccaaaagcucacaaaugagaagcuccuugaguaucuagaa

SEQ ID NO: 60032 - RNA, 64 nt, hsa
augcgacugcgaacacugaacucuacgccacuccacaaaugauguuuucaggugucauggacug

SEQ ID NO: 60033 - RNA, 64 nt, hsa
ccugcuuugcaaacaucaaccuggcaaaaaugcaacaaaugaauuuuccacgcaguucuuucca

SEQ ID NO: 60034 - RNA, 64 nt, hsa
cugcuuugcaaauucaagagccuccccuggguuaacaaaugagccauccccagggcccaccccc

SEQ ID NO: 60035 - RNA, 64 nt, hsa
acccaaagggcuuauugacucuuucuauuguuaaacaaaugauuuccacaaacagaucaggaag

SEQ ID NO: 60036 - RNA, 64 nt, hsa
cuagaaacuucuuuaaagugccacauuuggcaguacaaaugagucugaguguaauagcccagag

SEQ ID NO: 60037 - RNA, 64 nt, hsa
accuuaaaauuguauaaggcugaaugaacuucauacaaaugaaaaaaaucucauaaaaauacau

SEQ ID NO: 60038 - RNA, 64 nt, hsa
gagaauucagguucuaaggacuagaggucucccuacaaaugaagacuuaucagggcccuagaaa

SEQ ID NO: 60039 - RNA, 64 nt, hsa
accuggcucugagaaacucgcaauccuaguuugcacaaaugaauaguuuguucuuuugugaaac

SEQ ID NO: 60040 - RNA, 64 nt, hsa
ucuaagauuuugugaauugguugaauaguucuauacaaaugaaguauggagguguguauguuua

SEQ ID NO: 60041 - RNA, 64 nt, hsa
gugacucaaauuuuucacccauuuacacauauccacaaaugacugcaaaagugccacggauauc

SEQ ID NO: 60042 - RNA, 64 nt, hsa
uuugaagugucauuuuuauggcaauauugauaacacaaaugaccacaaacuaaaucauaaaaua

SEQ ID NO: 60043 - RNA, 64 nt, hsa
ucuauggaagaaaacccaauaguacuuauaauauacaaaugaauuauacuauuagauaagaauu

SEQ ID NO: 60044 - RNA, 64 nt, hsa
agucuagggaccaugaaugaauaggccagcugggacaaaugaauuuaaaaaaucagaaaaaugc

SEQ ID NO: 60045 - RNA, 64 nt, hsa
agggcaauacaacugucacaucagaaacaagaaaacaaaugauaaaggaacucauuuaucaaua

SEQ ID NO: 60046 - RNA, 64 nt, hsa
ccaagagagcugucaguuuucagcugucaguaacacaaaugaguuuaugguaacacaaaugagu

SEQ ID NO: 60047 - RNA, 64 nt, hsa
cagcugucaguaacacaaaugaguuuaugguaacacaaaugaguuuugcuaucucucugagaag

SEQ ID NO: 60048 - RNA, 64 nt, hsa
uuauguaguuauucuaaaguuuaaggagcguuguugaccauaauauugcuuaguuuucuuacug

SEQ ID NO: 60049 - RNA, 64 nt, hsa
uuaugcuugaaguauuuggugaaaagauguugguugaccauaauuugcaacauugucucauuaa

SEQ ID NO: 60050 - RNA, 64 nt, hsa
ugguuuaaaaaaagggucagacuuuuaaacacucugaccauagaaauguuuuucaaaauggcaa

SEQ ID NO: 60051 - RNA, 64 nt, hsa
uguuaaauaaaaaaucaguaucauggaaaagauaugaccauaauuuagucuccucaagugaaaa

SEQ ID NO: 60052 - RNA, 64 nt, hsa
cuuacaaugagaauuaagauuuuuaaacugaaguugaccauacagguugcauuagcccuaacug

SEQ ID NO: 60053 - RNA, 64 nt, hsa
aauacuuguuucaacuuagagaacaguuaugaugugaccauagcauggcacaacuaaaaaucua

SEQ ID NO: 60054 - RNA, 64 nt, hsa
cccuguuuuaaauuauaagaugucauccccuugugucagagacagaccccuuggcuuuugcuug

SEQ ID NO: 60055 - RNA, 64 nt, hsa
aucccccagcacugauguuguuacugauucuccugucagagaucugggaggucuccacugagga

SEQ ID NO: 60056 - RNA, 64 nt, hsa
ggugccccguguaggcaucgucggucgguuugccgucagagauggcgcaucucgcugcaucccc

SEQ ID NO: 60057 - RNA, 64 nt, hsa
ugaucgucuuuccuuuguauuggagaaggacugggucagagaucuguuggagagagagaauaaa

SEQ ID NO: 60058 - RNA, 64 nt, hsa
gcagaacugggguggauuuggguuggaagugagggucagagaggagucagagagaaucccuagu

SEQ ID NO: 60059 - RNA, 64 nt, hsa
guggauuuggguuggaagugagggucagagaggagucagagagaaucccuagucuucaagcaga

SEQ ID NO: 60060 - RNA, 64 nt, hsa
ccugggcuggccggcgccguacugccugcguugugucagagaauaggaaaagcagcuuuguuug

SEQ ID NO: 60061 - RNA, 64 nt, hsa
gcucggguuugagcagggagcaggcagagcugcagucagagacauuagaaaaccagucugaauu

SEQ ID NO: 60062 - RNA, 64 nt, hsa
augugcaccuccccgaggugcagcugccgaaagugucagagauucggcugccggaaaugcaagu

SEQ ID NO: 60063 - RNA, 64 nt, hsa
aggugcggcuuccagagguacagcugccgaaagugucagagaugaaacucccagaggugucaga

SEQ ID NO: 60064 - RNA, 64 nt, hsa
aggugcggcuuccagagguagagcugcccaaagugucagagaugaaacucccaaaggugccaga

SEQ ID NO: 60065 - RNA, 64 nt, hsa
agguucgacucccagagguggagcuccccaaggugucagagaugaaacucccaaaggugccaga

SEQ ID NO: 60066 - RNA, 64 nt, hsa
acucccuucccuuguuuuuuaaagauaccgugcuucuccacauccucauccuucaaggagcaua

SEQ ID NO: 60067 - RNA, 64 nt, hsa
uauuuaugccacuaccuccaccagggagaguccuucuccacaggcuugauaaauucaaucacca

SEQ ID NO: 60068 - RNA, 64 nt, hsa
cauugaguucccauguggaucauucugaaggugaucuccacaagaggguguguguguguguguu

SEQ ID NO: 60069 - RNA, 64 nt, hsa
uuuuaaaauauuauuuuaacaaaaguuacauuccucuccacaaugaggcuaaaugucacccacg

SEQ ID NO: 60070 - RNA, 64 nt, hsa
caucucuaguacuaccugaaggcucuccuaacccucuccacacauuccauuuacagaguaugag

SEQ ID NO: 60071 - RNA, 64 nt, hsa
guggcuuucucacauucggucuacuugcaggguaucuccacagcaugcaccauucuggguacag

SEQ ID NO: 60072 - RNA, 64 nt, hsa
ugagaaacauuucuguugcgcuacugacucuccuucuccacauuuguuguguuccuagggcuuc

SEQ ID NO: 60073 - RNA, 64 nt, hsa
aucuugggguguguccuaugaagauccuuucuggucuccacaguaggccagaguugggggcucu

SEQ ID NO: 60074 - RNA, 64 nt, hsa
uccagucaaguaggaaucagugcagccuguaaguucuccacauugacacacacacacacacaca

SEQ ID NO: 60075 - RNA, 64 nt, hsa
gaguuuccagcuaagccugaugauggaagggccuucuccacagggacacagucuggugcccaga

SEQ ID NO: 60076 - RNA, 64 nt, hsa
gcuguguaacacacucaccgagaggaaaaaggcuucuccacaaccuccuccuccaguucugaug

SEQ ID NO: 60077 - RNA, 59 nt, hsa
acccuggcucaggagguugaugccaugggaaccugaaccugaaacacuucaugguagua

SEQ ID NO: 60078 - RNA, 59 nt, hsa
gcucaggagguugaugccaugggaaccugaaccugaaacacuucaugguaguaauuucc

SEQ ID NO: 60079 - RNA, 59 nt, hsa
uguauguguuguuuaagaaauguauaaaaaaccugaaaaaaaugaguaagaacuggcag

SEQ ID NO: 60080 - RNA, 59 nt, hsa
uucacuaaaggucaguuguuuuaauuugaaaccugaaaugccucuuuagcaaaagccug

SEQ ID NO: 60081 - RNA, 59 nt, hsa
aaaauauaaaaguaaaacaaacaaaaacaaaccugaaaacugcuuggcauuugaguagc

SEQ ID NO: 60082 - RNA, 59 nt, hsa
aauuugaagcuauucuguaauuaaaauauaaccugaauucagcuugcagaauggaagcu

SEQ ID NO: 60083 - RNA, 59 nt, hsa
acuuaaacguuaauuuuugugcaaaaacaaaccugaaaaauaugcuucggaaacugugc

SEQ ID NO: 60084 - RNA, 59 nt, hsa
guuucuuuuuccacgguagucagugacuuaaccugaauuguaaauguuuguaaaggguu

SEQ ID NO: 60085 - RNA, 59 nt, hsa
auguccuuauaggucacuaccccuaaauaaaccugaagcagguguuuucucuuggacau

SEQ ID NO: 60086 - RNA, 59 nt, hsa
cucaccuccuuuucucucagugacucuggaaccugaaugcagcuuacaagacaagccug

SEQ ID NO: 60087 - RNA, 59 nt, hsa
uuuaauugccuauuacuucucucaaagagaaccugaagucagaacacaugagcagggug

SEQ ID NO: 60088 - RNA, 59 nt, hsa
cagagaacaauaguagucucaagaauggaaaccugaaugucugagggaaugggcuggua

SEQ ID NO: 60089 - RNA, 59 nt, hsa
agcugauuucuuugauucccuagcugcaaaaccugaaauugaccacuaggugacagaau

SEQ ID NO: 60090 - RNA, 59 nt, hsa
aaacauuuugccagacuuucuccaaaugaaaccugaaucaauuuuucuaaaucuagguu

SEQ ID NO: 60091 - RNA, 59 nt, hsa
cagaagugcaauguauuuuucuccugugaaaccugaaucuacaaguuuuccugccaagc

SEQ ID NO: 60092 - RNA, 59 nt, hsa
gcaaacguugacuucugggcaaaccugaaaaccugaaaaugccacuuucaugcaguuug

SEQ ID NO: 60093 - RNA, 59 nt, hsa
caagcccagcaaacguugacuucugggcaaaccugaaaaccugaaaaugccacuuucau

SEQ ID NO: 60094 - RNA, 59 nt, hsa
ugaauuuaugcuugggaagccugaucccaaaccugaagggaagggacuuggaucuccuu

SEQ ID NO: 60095 - RNA, 59 nt, hsa
aaucucuuagauguggaaauauuuuuucgaaccugaaaaugcagcugguagaauuucaa

SEQ ID NO: 60096 - RNA, 59 nt, hsa
uaauaauacaagaacuguuucccccucaaaaccugaaccugaauuauuuguaaaaacug

SEQ ID NO: 60097 - RNA, 59 nt, hsa
uacaagaacuguuucccccucaaaaccugaaccugaauuauuuguaaaaacugaaauuu

SEQ ID NO: 60098 - RNA, 59 nt, hsa
accagcuaaaugccagugagcgacuugguaaccugaacugaugccauguagaauggaag

SEQ ID NO: 60099 - RNA, 59 nt, hsa
gacaauguauuguaguccaucaucacucaaaccugaaacuucagcauauuuguucuaaa

SEQ ID NO: 60100 - RNA, 59 nt, hsa
ucaaacuauaaagcaaaaacauuuauuaaaaccugaauuaauccuuuuuggagggagga

SEQ ID NO: 60101 - RNA, 59 nt, hsa
ccuuuuuggagggaggaguagagauauauaaccugaaaauacuuauucuuucuuaucga

SEQ ID NO: 60102 - RNA, 64 nt, hsa
uuuggagaugugaaagccaaaagccccuggcagugguggggaauguugacugaguguucagcag

SEQ ID NO: 60103 - RNA, 64 nt, hsa
aaaccccaaccaaaaaaaauaauaaggcaugauugguggggagggaauguguauuuaggggcau

SEQ ID NO: 60104 - RNA, 64 nt, hsa
gcgagagccucggaccucccaaccccuugugucugguggggaucccuccugggaugaggaagac

SEQ ID NO: 60105 - RNA, 64 nt, hsa
ugugacucguggcgcaugccccagcccugccugagguggggagcuggcgguccugccgcaugca

SEQ ID NO: 60106 - RNA, 64 nt, hsa
ggggugggggagcaucugcuguuugaggacgggggguggggaaggaaggaacaugaucccucca

SEQ ID NO: 60107 - RNA, 64 nt, hsa
aggaagugggggcuacccauacccucauuccucugguggggagcugccugcagagaggccugcc

SEQ ID NO: 60108 - RNA, 64 nt, hsa
cccaggcucaggaacugccagggagggaagaugagguggggagucuguacugagauggaacugu

SEQ ID NO: 60109 - RNA, 64 nt, hsa
gcacaucccaccccauccccugaacuacuugggagguggggagggguacgaguccacuguugcu

SEQ ID NO: 60110 - RNA, 64 nt, hsa
agagagagccacggagaggaaaagcagaugcagggguggggagcgcagcucggcggaggcugcg

SEQ ID NO: 60111 - RNA, 64 nt, hsa
cucugacaugacuuauguguguguguguuuuugggguggggagggagggagagaagagggggcu

SEQ ID NO: 60112 - RNA, 64 nt, hsa
cacaagaaaauaaucccacauauacaaggucagggguggggaagaguauuaaugguaucuuaau

SEQ ID NO: 60113 - RNA, 64 nt, hsa
caccgcuggccauuacacagguuuuguuguuugggguggggagggggcuuuuguucccuuuuga

SEQ ID NO: 60114 - RNA, 64 nt, hsa
ccagcauccuccauaucaaagacccuaagaaucagguggggaaggaggugaucugccaggugcu

SEQ ID NO: 60115 - RNA, 64 nt, hsa
gcacugagcucacagacugacuugggcuccuacugguggggaccucuguuagucacuuuaccuc

SEQ ID NO: 60116 - RNA, 64 nt, hsa
uccgaggcccuggggaucaaaggucaaugaguuagguggggagaaagaucccugggggcuccug

SEQ ID NO: 60117 - RNA, 64 nt, hsa
gggaagguuugcagagagaggaagaagagggcaggguggggaggagcucugggccagaggaugc

SEQ ID NO: 60118 - RNA, 64 nt, hsa
ugccgguggccugagccagggugcuggggcugcggguggggaaaggaggccccagcacuucaga

SEQ ID NO: 60119 - RNA, 64 nt, hsa
uagagcuucuccgaaugacaaucagcucgugccagguggggaccaggauaugacuccuggugcc

SEQ ID NO: 60120 - RNA, 64 nt, hsa
ucugaacuccagggaccagcccuggugggcaugggguggggagcagggaguugcccuuccccuc

SEQ ID NO: 60121 - RNA, 64 nt, hsa
acaauuggcccagcacccuggggcacgggagaaggguggggaccguugcugucacuacucaggc

SEQ ID NO: 60122 - RNA, 64 nt, hsa
uaaaagaugugauuuaucuggggggcucagguaugguggggaaguggauucaggaaucugggga

SEQ ID NO: 60123 - RNA, 64 nt, hsa
ggaguuuggcuaacaguccuguguccagggugccgguggggauguuauagauguugcugggauc

SEQ ID NO: 60124 - RNA, 64 nt, hsa
ugaggagcaucacagggcuccuucuggagcauuugguggggacagcugcagagaagaggccugg

SEQ ID NO: 60125 - RNA, 64 nt, hsa
gcucuguauggaggcugcucaccccacagacacugguggggagaccauggcucagaggaagggu

SEQ ID NO: 60126 - RNA, 64 nt, hsa
gaagucuacuugaucugaggccacuuaagcaugggguggggagcuucucccagaguggccccag

SEQ ID NO: 60127 - RNA, 64 nt, hsa
acgcccccuaucgccaccugccagccagcagggugguggggacuccugagcccagccugggggc

SEQ ID NO: 60128 - RNA, 64 nt, hsa
uugugcacaugcgugugggaagggguugcuaggggguggggacggcuaaccaggguaagaaugu

SEQ ID NO: 60129 - RNA, 64 nt, hsa
ggugucuugcccuggggggcuuggaaccucugaagguggggagcggaacaccuggcauccuucc

SEQ ID NO: 60130 - RNA, 64 nt, hsa
cccagcacuugcauuaccgucccugcucuucccagguggggacaguggcccaagcaaggccuca

SEQ ID NO: 60131 - RNA, 64 nt, hsa
agaggaggauuggugguagggggcaggcagaggggguggggagaaguuuccugggcuccaucaa

SEQ ID NO: 60132 - RNA, 64 nt, hsa
gcacuugauuguguggggaaacaaaggugggagggguggggaauacuggaaauaaucagggcaa

SEQ ID NO: 60133 - RNA, 64 nt, hsa
cagaccuggacacuagggucaggcggggugcugugguggggagaggcauggcuggggugggggu

SEQ ID NO: 60134 - RNA, 64 nt, hsa
gugcugugguggggagaggcauggcugggguggggguggggagaccugguuggccgugguccag

SEQ ID NO: 60135 - RNA, 64 nt, hsa
auaaguaauagcagccauuugggaguaggggguagguggggaagauguacuccguaucaaauaa

SEQ ID NO: 60136 - RNA, 64 nt, hsa
gaugucuggagacauguuggguugucaaaacugggguggggaaaagguugcuacugugcaaugc

SEQ ID NO: 60137 - RNA, 64 nt, hsa
cuguuacacgcaugaauggggguuaugggguggggguggggacucagggcuggaccgacguccu

SEQ ID NO: 60138 - RNA, 64 nt, hsa
gggcacuguggggagugcaugccuggggccucuggguggggaccauggacaggcccuggucacu

SEQ ID NO: 60139 - RNA, 64 nt, hsa
uccacugggugaagccagcugggcuccugagucugguggggacuuggagaaccuuuaugucuag

SEQ ID NO: 60140 - RNA, 64 nt, hsa
augcaccaauccacacucuguaucuggcuacucugguggggacuuggagaaccuuuguguccac

SEQ ID NO: 60141 - RNA, 64 nt, hsa
acccaguccugcuucagagccaagacuaggccaggguggggacccccccaguacccucccuaca

SEQ ID NO: 60142 - RNA, 64 nt, hsa
ccccucccaccuuuguagugcaguuccuaggugugguggggaaugugccgugcucucagcagac

SEQ ID NO: 60143 - RNA, 64 nt, hsa
caguccacuggggagugcuggaauggggaccugggguggggaggcagagggucacuuuacauag

SEQ ID NO: 60144 - RNA, 64 nt, hsa
gaggcagaaccugguggcuggaggcauucccagagguggggaagagagccugcccggccggaga

SEQ ID NO: 60145 - RNA, 64 nt, hsa
uuuauucuucggaggagguggacauuucggaagugguggggacuaagggaagaacucucuaguu

SEQ ID NO: 60146 - RNA, 64 nt, hsa
uuaaucuggggaagaacagagccagggaaagaaugguggggaccccuguacuugggggagacac

SEQ ID NO: 60147 - RNA, 64 nt, hsa
uggugauggagcagagucugggggaagggucguggguggggaauuuaucaccaacauccauugu

SEQ ID NO: 60148 - RNA, 64 nt, hsa
aggcuccccccaugcuccugguuucugcuuaggagguggggacuugggcugggauggggacggc

SEQ ID NO: 60149 - RNA, 64 nt, hsa
gguaagcaggaggccaggggguccccagggcugagguggggagccuucuacggcgaaagccugc

SEQ ID NO: 60150 - RNA, 64 nt, hsa
cuccacugcgcgccucucccaggucucagcucuggguggggagcaguggccgcuaccgacagcg

SEQ ID NO: 60151 - RNA, 64 nt, hsa
cugugccuugcuagcugaccuggagaugcugccugguggggaucagacagagauuggagagaag

SEQ ID NO: 60152 - RNA, 64 nt, hsa
gagaccugagucugcaugugcacgguggcgagaagguggggaucgugggccgcacuggggcugg

SEQ ID NO: 60153 - RNA, 64 nt, hsa
ccggcccugccaccaaguugagagcuggaggggagguggggagagaacaucacagagcagccag

SEQ ID NO: 60154 - RNA, 64 nt, hsa
gcaugccuguaaucccagcuacuuuggaggcugagguggggagaauugcuugaaccugggaggu

SEQ ID NO: 60155 - RNA, 64 nt, hsa
aacgcuggagccaagagaagcccugggaaggagggguggggaacgacaugcaugugagggaugg

SEQ ID NO: 60156 - RNA, 64 nt, hsa
cccucacccccccaccaccccuucccauuucaucgguggggacguggagaggguggggcgggcu

SEQ ID NO: 60157 - RNA, 64 nt, hsa
agcuuaugaggaagugaggagguggcgucacaaggguggggagggggccuuggggaagggcggc

SEQ ID NO: 60158 - RNA, 64 nt, hsa
gaaaccaucugauuggcuuucugagguuuggcuggguggggacugcucauuuggccacucugca

SEQ ID NO: 60159 - RNA, 64 nt, hsa
cauuuuguucagaaccaugcugggcuagcuaaaggguggggagagggaagaugggccccaccac

SEQ ID NO: 60160 - RNA, 64 nt, hsa
ccgaccccaucugccuccuuaagccacaguccuugguggggaacucuaagggggacggagucag

SEQ ID NO: 60161 - RNA, 64 nt, hsa
uucccagccucugcugacagcaccucagcuaccagguggggaguggaaauucagccugcuuaga

SEQ ID NO: 60162 - RNA, 64 nt, hsa
ugacuacagacauuaaauaaucgaaguaauuuuggguggggagaagaggcagauucaauuuucu

SEQ ID NO: 60163 - RNA, 64 nt, hsa
aaucccuguucauuguaagcacuuuuacggggcggguggggaggggugcucugcuggucuucaa

SEQ ID NO: 60164 - RNA, 64 nt, hsa
uuuuguuggcuuguuugccaugaagguagauguggguggggagaagacacaaggcaguuuguuc

SEQ ID NO: 60165 - RNA, 64 nt, hsa
ucuuguuaaaccggagugaaaacuucaggggaaggguggggagucagccaagugccucagugug

SEQ ID NO: 60166 - RNA, 64 nt, hsa
guggcgacgucccugaggggccagucuccucacugguggggaacgcaagagaaucugcguagau

SEQ ID NO: 60167 - RNA, 64 nt, hsa
cucuuuucgaaaugccccucugagucaggagccugguggggacaagauggaggauguccacaga

SEQ ID NO: 60168 - RNA, 64 nt, hsa
cacugggccagcagcccccccagcccccagccuugguggggaccaagcagccuuucccgucccc

SEQ ID NO: 60169 - RNA, 64 nt, hsa
uccccugcagggccuuuuccugccacucaucugggguggggagcagcccuaggcagguccuggu

SEQ ID NO: 60170 - RNA, 64 nt, hsa
gacccccaccucccacccugacccccgaccccuggguggggaaggggcucacaugggcccaggc

SEQ ID NO: 60171 - RNA, 64 nt, hsa
caugguccuggggcagcaaggaagaagcucagaggguggggagaagcaugaagcagugagcaga

SEQ ID NO: 60172 - RNA, 64 nt, hsa
uuacuaauuguaugauaguguuuuuauauggaagaauguacagcuuauggacaaauguacaccu

SEQ ID NO: 60173 - RNA, 64 nt, hsa
guuuuuauauggaagaauguacagcuuauggacaaauguacaccuuuuuguuacuuuaauaaaa

SEQ ID NO: 60174 - RNA, 64 nt, hsa
ccugaggauggugguuaaggaaacaggagcaggaaauguacacacagauuccugucccuuugcc

SEQ ID NO: 60175 - RNA, 64 nt, hsa
agaauaaguauagcuagagaaauugcuucucugaaauguacaugagcccuuaagguaagagaug

SEQ ID NO: 60176 - RNA, 64 nt, hsa
ucuaugaauguacauggaaugaccaggcucuaugaauguacauggaaaaccccuaaaaaucccc

SEQ ID NO: 60177 - RNA, 64 nt, hsa
aacaaggacuccucgcugcugaccaggcucuaugaauguacauggaaugaccaggcucuaugaa

SEQ ID NO: 60178 - RNA, 64 nt, hsa
cuuccauaauggaugggacagagagcugggaucuaauguacaagugaagggcuuggucuucccu

SEQ ID NO: 60179 - RNA, 64 nt, hsa
agucauguaaauaaaauagacauaaaaagguagcaauguacagauaaagaguacuuuaacgccc

SEQ ID NO: 60180 - RNA, 64 nt, hsa
agugcaauuaauacaaguuauugugcuuuucaaaaauguacacggaaaucuggacagugcucca

SEQ ID NO: 60181 - RNA, 64 nt, hsa
uauguauaucuucuagccuuuauucuguacuuuuaauguacauauuucugucuugcgugauuug

SEQ ID NO: 60182 - RNA, 64 nt, hsa
uuccccucauuuuaguuuaauauaauuugcaauaaauguacauauuguuguuuguuucauaaag

SEQ ID NO: 60183 - RNA, 64 nt, hsa
uuccuuuucacaugaccacaaguccucugauggaaauguacagcagaaacucuugagagagagg

SEQ ID NO: 60184 - RNA, 64 nt, hsa
aauacaaaaaacaaaaacaaaaaaaaaagaggguaauguacaaguuucuguauguauaaaguca

SEQ ID NO: 60185 - RNA, 64 nt, hsa
auaaaaucuuuauauguuccacauguuaagaauaaauguacauuaaaucuuguuaagcacugug

SEQ ID NO: 60186 - RNA, 64 nt, hsa
caucuguuguaccuuuggggaaaauuuguauguaaauguacagaaauaaaaacguugccccauu

SEQ ID NO: 60187 - RNA, 64 nt, hsa
gagcguuuccgggacugcauuuuagacggagugaaauguacaugaauuuggcuuuugcuagagu

SEQ ID NO: 60188 - RNA, 64 nt, hsa
auguagcugugaaggccauuaaaaagacaaacuuaauguacagagcauuuauucagaucaagua

SEQ ID NO: 60189 - RNA, 64 nt, hsa
cuguauuuagauauuuuauuucuggaaaaaaugaaauguacauaaaaauaaaacacuuaaaguu

SEQ ID NO: 60190 - RNA, 64 nt, hsa
agucuggcuaggaaaccagaucugggguaaagucaauguacacuuccuccuuauuggaauauuu

SEQ ID NO: 60191 - RNA, 64 nt, hsa
uaaacuaaaacuaguauaauuuagucuuuucaugaauguacauacauaaaauuauacauaaaaa

SEQ ID NO: 60192 - RNA, 64 nt, hsa
aaugagcaggaaaaggcacauacucaguuuuuuaaauguacaaucaacaaguaaaaauaaccuc

SEQ ID NO: 60193 - RNA, 64 nt, hsa
gaagccuuuuaaaaaaugacuuacacauauucucaauguacaguaaaacagacagaagugagcu

SEQ ID NO: 60194 - RNA, 64 nt, hsa
aaaggcuacuuguauaauaacccuugucauuuuuaauguacaaaacgcuauuaaguggcuuaga

SEQ ID NO: 60195 - RNA, 64 nt, hsa
cugaauacugaaaacugugaaauguacuaaauaaaauguacaucugaagaugauuauugugaaa

SEQ ID NO: 60196 - RNA, 64 nt, hsa
ucuuauuuucaagagaauuuauggacguuguagaaauguacaaaugcauuuccaaacugccuua

SEQ ID NO: 60197 - RNA, 64 nt, hsa
auugugaagugugcuauauuuagaacagucuuaaaauguacaguguauuuuauagaauugaagu

SEQ ID NO: 60198 - RNA, 64 nt, hsa
gcaaaauaaguacuaaauucauuaucguuaagcaaauguacaauaugcucaggcaccgcagaga

SEQ ID NO: 60199 - RNA, 64 nt, hsa
uuuuuuggucucuuuuucuuauauucaaguuacaaauguacaaguauccuuacuaagagugcuc

SEQ ID NO: 60200 - RNA, 64 nt, hsa
ccgcuucgcuuucuguuuaucacuuuucugcugaaauguacauguuuggcucuacuccuugguu

SEQ ID NO: 60201 - RNA, 64 nt, hsa
uggcagcuuuaauagccauggguucuuuugggguaauguacacaccuaacugcauuuguuuuga

SEQ ID NO: 60202 - RNA, 64 nt, hsa
cacugucaaauucuuuuccuuaaggugcacaguaaauguacagauaguuauaggccacuguuuu

SEQ ID NO: 60203 - RNA, 64 nt, hsa
uacaugagacugcagauuauauugaaucauauuaaauguacagaaauaaaauauuagauuuaua

SEQ ID NO: 60204 - RNA, 64 nt, hsa
agcuuacuucuuucuccuaaauuuaauguacaaaaauguacauggaugauauuaucacuuguug

SEQ ID NO: 60205 - RNA, 64 nt, hsa
gcaauuccauagcuuacuucuuucuccuaaauuuaauguacaaaaauguacauggaugauauua

SEQ ID NO: 60206 - RNA, 64 nt, hsa
uacaaccucagugugucauugggcaguuuaaaugaauguacauuccugaggcaucagaacuuug

SEQ ID NO: 60207 - RNA, 64 nt, hsa
uuacauuucuuuguacaucuguacauuuuguccaaauguacaucuguacgucugucaucauugu

SEQ ID NO: 60208 - RNA, 64 nt, hsa
uuaaauuguuuuaauagugauuuauuugucaucaaauguacaacuuauucuaaauauuuucauu

SEQ ID NO: 60209 - RNA, 64 nt, hsa
caaagcaucaccauuacaaguccaugaauguuaaaauguacaggugggauugugaagauuuacu

SEQ ID NO: 60210 - RNA, 64 nt, hsa
uuuuucuuugggguggaucugaugccauugauauaucuaaaaugugggauaaaacuucuuuaau

SEQ ID NO: 60211 - RNA, 64 nt, hsa
cagacuuguaaauagaacuauuucaauguaguuaaucuaaaaacaaaaaagaaaaccccaguca

SEQ ID NO: 60212 - RNA, 64 nt, hsa
ccuuguccuuguuaagaauuucuugaagugauuuaucuaaaauaaagguuggcaaacuuuuucu

SEQ ID NO: 60213 - RNA, 64 nt, hsa
auuuggccccugggcuguaguuugcugaccccucaucuaaaaaauaggcuauacuacaauugca

SEQ ID NO: 60214 - RNA, 64 nt, hsa
accugucuuucacuuuuugagacagacugaauauaucuaaaauuuccagcaauaaaaaaaaaag

SEQ ID NO: 60215 - RNA, 64 nt, hsa
uuuucacuugguuagcuaaagaagauguaaaaauaucuaaaauaauguucauggugaaucuuau

SEQ ID NO: 60216 - RNA, 64 nt, hsa
aaauaaaacuggaaaaaaauuucuggaaguuuauaucuaaaaauguuaauagugcguaccucua

SEQ ID NO: 60217 - RNA, 64 nt, hsa
acagggaagggguuggggacaggucugccaaucuaucuaaaagccacaauauggaagaaguauu

SEQ ID NO: 60218 - RNA, 64 nt, hsa
gaagugagaggaccaaguauaguaaaaugcugacaucuaaaacuaaauaaauagaaaacaccag

SEQ ID NO: 60219 - RNA, 64 nt, hsa
cauuccugcaagcauugauugagacauuugcacaaucuaaaauguaagcaaaguagucauuaaa

SEQ ID NO: 60220 - RNA, 64 nt, hsa
augaacuguauuuuaaauuuguuaggucugaagaaucuaaaacuguuaauuuaacccuuaacuu

SEQ ID NO: 60221 - RNA, 64 nt, hsa
uugaaugcuuuaaaauguucugucuguagguaacaucuaaaacacaaguggguuuauuuaaauu

SEQ ID NO: 60222 - RNA, 64 nt, hsa
aaaaucauguauacccucacccaucuaaguugauaucuaaaauuuuaucuaaguugguaucuaa

SEQ ID NO: 60223 - RNA, 64 nt, hsa
cuaaguugauaucuaaaauuuuaucuaaguugguaucuaaaauuuuucaugggaaguuaaauag

SEQ ID NO: 60224 - RNA, 64 nt, hsa
guggcaauuccauacauauuuuagaguuuuuucuaucuaaaauuaguuaaauacuuagaauguu

SEQ ID NO: 60225 - RNA, 64 nt, hsa
uaaaucaaucuaugcuguucuguccuucuugagaaucuaaaacauaccacaaaaauacaucccc

SEQ ID NO: 60226 - RNA, 64 nt, hsa
ccaaauuuuaaguuucuaaauaaucuucgcugaaaucuaaaauauacuauaacaaccguguuuu

SEQ ID NO: 60227 - RNA, 64 nt, hsa
cuagcaauaaagucuccuugguacugaaaucauuaucuaaaauaaaggaaauguuaucaaaaga

SEQ ID NO: 60228 - RNA, 64 nt, hsa
gggaaaucaaaucaguaacuggucauggucaugcaucuaaaagugcauggaagaucauuuauua

SEQ ID NO: 60229 - RNA, 64 nt, hsa
uuauuucuaacuauuaggaggaaugugcuuuuccaucuaaaauacucaccaaaauauaguuaau

SEQ ID NO: 60230 - RNA, 64 nt, hsa
ugguggccgcaaccacuugcuagugauacacuguaucuaaaaaauaacugugcacuauaaggga

SEQ ID NO: 60231 - RNA, 64 nt, hsa
uaaagaucuaaauacaaaggauauacagucuugaaucuaaaauaauuugcuaacuaacuauuuu

SEQ ID NO: 60232 - RNA, 64 nt, hsa
uauuuugauucuucagagagaacuacuaauaaaaaucuaaaagguaugucuuggugugauaacu

SEQ ID NO: 60233 - RNA, 64 nt, hsa
uguuacuauuauuccuuugaaaaaaagacaaaauaucuaaaaaauguuuauaguguucauguaa

SEQ ID NO: 60234 - RNA, 64 nt, hsa
ucuucccucaaaauuuucauggacaugcaaucuuaucuaaaagccugcuucagggcugggcgcg

SEQ ID NO: 60235 - RNA, 64 nt, hsa
agaagcuccuucuguuggaaguugaguaccugugaucuaaaauguccuggaggcagaugacauc

SEQ ID NO: 60236 - RNA, 64 nt, hsa
accugugaucuaaaauguccuggaggcagaugacaucuaaaauaugugcuuuccaaccagcaca

SEQ ID NO: 60237 - RNA, 64 nt, hsa
uauaguugaauuucuuuaaaaaguuuucuauuuuaucuaaaaucuuuccauuauaucuaaauua

SEQ ID NO: 60238 - RNA, 64 nt, hsa
aaacuggacuuagcuugaguuaaaggcaaagaaaaucuaaaaacauaaauguuauauuucacaa

SEQ ID NO: 60239 - RNA, 64 nt, hsa
auagcaucuuuaggauauauuuacauuuucacucaucuaaaaaguauacaaaaauaaaaagugg

SEQ ID NO: 60240 - RNA, 64 nt, hsa
uuaucauacuaaaguuguucuuuuaauuuagcauaucuaaaauaggauuuaguucaguuuagcu

SEQ ID NO: 60241 - RNA, 64 nt, hsa
aacaucgagaaacuaugggaaaaaaaauugcaaaaucuaaaauaaaaaaugcaaaaucuaaaau

SEQ ID NO: 60242 - RNA, 64 nt, hsa
aaaaaauugcaaaaucuaaaauaaaaaaugcaaaaucuaaaauaaaaaauggaaaggaaacuuu

SEQ ID NO: 60243 - RNA, 64 nt, hsa
ucuauuuaucuuauaucguagaucugauaacccuaucuaaaagaaagucacacgcuaaauguau

SEQ ID NO: 60244 - RNA, 64 nt, hsa
guaauuuuauagaauaauucugggauuugagaggaucuaaaacuauuuuucuguauaaauauua

SEQ ID NO: 60245 - RNA, 64 nt, hsa
ggagacaggugcagaugaggugaagaucacugucaucuaaaagcaggccaccaaauuuaaaaaa

SEQ ID NO: 60246 - RNA, 64 nt, hsa
cugagcucaggagagcaagaugaagguaacaaucaucuaaaagccagccacugucagcaaagcc

SEQ ID NO: 60247 - RNA, 64 nt, hsa
aaauaugcaauauauguucauaucuaugggaaaaaucuaaaaugugugccagaugcccuguugg

SEQ ID NO: 60248 - RNA, 64 nt, hsa
augcuuaagcuuuggggaauuuuuuuuuaaggggaucuaaaaaaauguuuuuagaacauguaaa

SEQ ID NO: 60249 - RNA, 64 nt, hsa
ggaauuuaucccaggaauucaagguugguucaacaucuaaaaaucaaauaagcuaauauacagu

SEQ ID NO: 60250 - RNA, 64 nt, hsa
agcaguuagguuaggaauucaagguuuguucaacaucuaaaaaucaaauaagcuaauaaagaaa

SEQ ID NO: 60251 - RNA, 64 nt, hsa
aauccucccuaacaauucguuguguggacuucucaucuaaaagguuaguggcuuuugcuuggga

SEQ ID NO: 60252 - RNA, 64 nt, hsa
uucuugcauguugaagauauuugagcuauuuuucaucuaaaagaguaagguauuaggcccuuuu

SEQ ID NO: 60253 - RNA, 64 nt, hsa
aaauguguaaucuaaaauauaccagcgaauuuaaaucuaaaaaugcuccuacuuuaaguaccuu

SEQ ID NO: 60254 - RNA, 64 nt, hsa
uuuauccuaggugauuuuuaaaugaaaauguguaaucuaaaauauaccagcgaauuuaaaucua

SEQ ID NO: 60255 - RNA, 64 nt, hsa
ggaccagggagaugccacuaccccuugauuuuccaucuaaaaauauacauguuuauguaaacaa

SEQ ID NO: 60256 - RNA, 64 nt, hsa
agggaaauugagcugcuuuuuuugaaacuuugagaucuaaaaauaacuguaauuauuugaauga

SEQ ID NO: 60257 - RNA, 60 nt, hsa
acagcccuauggaauuugcaaucugugauugccuuguaaaaaggagagugcauauggcac

SEQ ID NO: 60258 - RNA, 60 nt, hsa
caagugcaauguauaugaaaaccaaucugagccuuguaucucuuaaauauuuauuuuuuu

SEQ ID NO: 60259 - RNA, 60 nt, hsa
uauuuucaguucuuaugcugugaccacuuugccuuguagcuuuuucuaucuuuccaaaau

SEQ ID NO: 60260 - RNA, 60 nt, hsa
aucccaccaucuuaccuggaauauaaggcugccuuguaccccuuuucugagcacaagucu

SEQ ID NO: 60261 - RNA, 64 nt, hsa
uaaagauuugacauucaacuguaguauccauauguugcuuaaauuuccuuaugagccccaugau

SEQ ID NO: 60262 - RNA, 64 nt, hsa
gauuaucagguucuguuaaauuguuacauguaucuugcuuaaauuucuguuuauuaauuuauau

SEQ ID NO: 60263 - RNA, 64 nt, hsa
ucuucuauauacauuuuauaauaaauacgugaaauugcuuaaaaccucuuuuuggaauuuuuaa

SEQ ID NO: 60264 - RNA, 64 nt, hsa
ugagcauugccccagccacacuuucucccugguuuugcuuaauuccacuuaugcaucagucauu

SEQ ID NO: 60265 - RNA, 64 nt, hsa
gaacuccaacccagaguucuucgggaccuaaauuuugcuuaaggaaggccuuuaucaugcugaa

SEQ ID NO: 60266 - RNA, 64 nt, hsa
agucccagcuacucaggaggcugagacaggaggauugcuuaagcccaggagcucaagucccacc

SEQ ID NO: 60267 - RNA, 64 nt, hsa
ugcgugugcauuuuuuuaacuugagagcugacuguugcuuaagaaguuuucuuauggcaaaaau

SEQ ID NO: 60268 - RNA, 64 nt, hsa
uuuuucaucauuuguuuuaugaauuuauccauguuugcuuaaugcuucugcuaaguguuagcca

SEQ ID NO: 60269 - RNA, 64 nt, hsa
agacuauaaaugcuuugcaaaaaugguuucacguuugcuuaaaugcuucaucacagucacauuc

SEQ ID NO: 60270 - RNA, 64 nt, hsa
uauuauguaaucacaacuuacuuucugcuuguaguugcuuaaaauuauguauuuugucuugggc

SEQ ID NO: 60271 - RNA, 64 nt, hsa
augguaucgugauuucuauugaguucaaauuaacuugcuuaagugucauacuuuacuggcuuug

SEQ ID NO: 60272 - RNA, 64 nt, hsa
ugcacauauauuaacuugugacuaaagacagacauugcuuaaaccuguuccaauuuuaacuuuu

SEQ ID NO: 60273 - RNA, 64 nt, hsa
uugauuggcaaaaagcaagauauaagagauucauuugcuuaacauuucuacauaauauuuaugg

SEQ ID NO: 60274 - RNA, 64 nt, hsa
uuuagaucuauuucuuuauacuuuuucuaaucaauugcuuaauaguacuuuggaugauuaucac

SEQ ID NO: 60275 - RNA, 64 nt, hsa
acaucucccacauucauaccaauauacgucagguuugcuuaaccauugauuuuuuuuuuuuuuu

SEQ ID NO: 60276 - RNA, 64 nt, hsa
auaaugacaugcauuuaucaucauugagauugguuugcuuaaaauuaacuuauuuuguagaaga

SEQ ID NO: 60277 - RNA, 64 nt, hsa
ggauuauaccacacacauccugucacuugcuuuuuugcuuaagaguauaucuaagagaauccuu

SEQ ID NO: 60278 - RNA, 64 nt, hsa
cacacucaacuguugugugaaugagccagacacauugcuuaaccugaguccgagauggacaaug

SEQ ID NO: 60279 - RNA, 64 nt, hsa
uauguugauacaaagucugcuuuugcuauucuuuuugcuuaaauacuccuaucauuuucugaau

SEQ ID NO: 60280 - RNA, 64 nt, hsa
ugguauuuuuaauuuacuucaaugauuagcucaguugcuuaacuggaguuuuaauccugugaua

SEQ ID NO: 60281 - RNA, 64 nt, hsa
ugcaggcuguuucuguauuauuuucacacucauauugcuuaaauauuacauauuagggauugua

SEQ ID NO: 60282 - RNA, 64 nt, hsa
uucaaaccaggaaggauuugacuaucauuagauuuugcuuaacuuuaugaaagcuaaaauauuc

SEQ ID NO: 60283 - RNA, 64 nt, hsa
ggugaucauuucucaugaagaugcuuauaaaugguugcuuaacccauucuagauguagggucug

SEQ ID NO: 60284 - RNA, 64 nt, hsa
gguugggagaauauuuuuuuuuuauucauucuguuugcuuaauucagaguacaguuugugcuau

SEQ ID NO: 60285 - RNA, 64 nt, hsa
uguuuugaaccucaaacuagauaaacccuaggaauugcuuaacugcaacaaguaauuuucauuc

SEQ ID NO: 60286 - RNA, 64 nt, hsa
ucucugcaacuaaguuuaaagcagugugacuguguugcuuaaauaucaaguauuguuuauaacc

SEQ ID NO: 60287 - RNA, 64 nt, hsa
ccuuaauguuaaaaucugaauuucuuuuagcauuuugcuuaaaagcaauaugcuauuugcuuau

SEQ ID NO: 60288 - RNA, 64 nt, hsa
caugugauuguuuguguguccccuuuccucuucuuugcuuaacacaauuaucuuguguuaagga

SEQ ID NO: 60289 - RNA, 64 nt, hsa
ugauguaaagaaacugaacagugaaguggcuugauugcuuaaacuauugacuugguaagucuac

SEQ ID NO: 60290 - RNA, 64 nt, hsa; identical to SEQ ID NO: 60289

SEQ ID NO: 60291 - RNA, 64 nt, hsa
ugaguguuuggggguucaacacacacaugcaauuuugcuuaacaaaaguauuuuauaauacagu

SEQ ID NO: 60292 - RNA, 64 nt, hsa
uaucucuugccacuguguggugguuauaucaaguuugcuuaauaaaagcuaugagacaaauagu

SEQ ID NO: 60293 - RNA, 64 nt, hsa
aaaaugugugcuugcugcugcugugagugaaccauugcuuaagauaaaaaacuuaacuagaucu

SEQ ID NO: 60294 - RNA, 64 nt, hsa
uuuaacagauuguauuccuuucaaguuucuauacuugcuuaagcaaucuugauuugaguaaggg

SEQ ID NO: 60295 - RNA, 64 nt, hsa
uuuuacuuuugaaacaggaaugauuucuccuuaauugcuuaaggccggggagcaaagugucuua

SEQ ID NO: 60296 - RNA, 64 nt, hsa
uaccaguguuaacccuucugcaguuagcaaacuuuugcuuaagccuuuuuccucuagauacucc

SEQ ID NO: 60297 - RNA, 64 nt, hsa
gcugaaaaguagagcucaaaaacaguaguucaauuugcuuaauuauugcuuaaaauaaugguac

SEQ ID NO: 60298 - RNA, 64 nt, hsa
gagcucaaaaacaguaguucaauuugcuuaauuauugcuuaaaauaaugguacuauguaaaauu

SEQ ID NO: 60299 - RNA, 64 nt, hsa
agagaaauguaauuugccugagaucaaauuaagguugcuuaagaucaaacugcuaagaaggggc

SEQ ID NO: 60300 - RNA, 64 nt, hsa
ccucugcaugaaguuucugugagcuuucuuuaucuugcuuaacuuauccuccuuuccuucccca

SEQ ID NO: 60301 - RNA, 64 nt, hsa
aggagcugagccugccucucuccuuuagaugacagaccuucaucugggaacgugcugagccagc

SEQ ID NO: 60302 - RNA, 64 nt, hsa
cuagacacacucaggaggacuacugaggcucugcgaccuucaggagcugagccugccucucucc

SEQ ID NO: 60303 - RNA, 64 nt, hsa
caguuagagaagaggaguggugauaaagcccacugaccuucacacauucuaaaaauugguuggc

SEQ ID NO: 60304 - RNA, 64 nt, hsa
ccuggacuuuggacccuuggccuaggagccuaaggaccuucaccccugugcaccacccaagaaa

SEQ ID NO: 60305 - RNA, 64 nt, hsa
uguucagagaggucccccucugccacuugacagggaccuucaaaccucgacagugaugcaagga

SEQ ID NO: 60306 - RNA, 64 nt, hsa
aaccagauaccccaggugggccggagggaccccagaccuucagagggcugcccugguguucucc

SEQ ID NO: 60307 - RNA, 64 nt, hsa
gguugggaaaacaccucauuugaccuugccagcugaccuucaaacccugcauuugaaccgacca

SEQ ID NO: 60308 - RNA, 64 nt, hsa
auuucuuaacauuguguucuaugauuauuuguaagaccuucaccaaguucugauaucuuuuaaa

SEQ ID NO: 60309 - RNA, 64 nt, hsa
uccucgcuguccccucucuguagugacuggcccugaccuucaggagugcacuuuccacucuacc

SEQ ID NO: 60310 - RNA, 64 nt, hsa
ugggcaaucuuaacaucuuuacucuuauugucuggaccuucaaagggcuuuguauuuuacaccu

SEQ ID NO: 60311 - RNA, 64 nt, hsa
ugccuucagaugucauugauguuucuccuguuggaaagcugauguguccagcucaaccuuugug

SEQ ID NO: 60312 - RNA, 64 nt, hsa
ccuuaguucuuacagaaccucauaguuugagaacaaagcugaugcaacugauuuauacaaaaug

SEQ ID NO: 60313 - RNA, 64 nt, hsa
ucaauucggugggcaauuuuuggacaugaaccagaaagcugaaagcugaggcugacacggacug

SEQ ID NO: 60314 - RNA, 64 nt, hsa
ggugggcaauuuuuggacaugaaccagaaagcugaaagcugaggcugacacggacuguaggugc

SEQ ID NO: 60315 - RNA, 64 nt, hsa
agaguaucaugaaguaaacuacaaacuucagaagaaagcugacauuuuaaugaauuuuuuaaaa

SEQ ID NO: 60316 - RNA, 64 nt, hsa
uccagcuuuguguaauucucuuugccagcugcacaaagcugauuuuuuccaaagucuaaagacu

SEQ ID NO: 60317 - RNA, 64 nt, hsa
gugugucaccgaggugcgggaggggaggagcauuaaagcugaaagaucgcucugcucggggagc

SEQ ID NO: 60318 - RNA, 64 nt, hsa
guauuuggggagcaggggaggggaggguguugagaaagcugaacuggagucaaucacccuuccc

SEQ ID NO: 60319 - RNA, 64 nt, hsa
gccgguuagucagguuuguugaaaauacaguagaaaagcugauucugguuaucucuuuaaggac

SEQ ID NO: 60320 - RNA, 64 nt, hsa
guaacuaaaaaagugaagauaagaaaauacucuuaaagcugaguauuuccuaauuguauagaau

SEQ ID NO: 60321 - RNA, 64 nt, hsa
cacccacccacacacacacacacagaagaaaaugaaagcugacacaccucgaagccuucuuucc

SEQ ID NO: 60322 - RNA, 64 nt, hsa
auuuagagauggcagagagugagguaguggcgagaaagcugacuccauucaucagauccaguuu

SEQ ID NO: 60323 - RNA, 64 nt, hsa
gugggcagggaggcaccauucaggaaccuggaccaaagcugacgaggcugggccaagccaggga

SEQ ID NO: 60324 - RNA, 64 nt, hsa
ggaacucccaagaacagcaggcccaccuaccuucaaagcugaagccgccaggaccgccaaagaa

SEQ ID NO: 60325 - RNA, 64 nt, hsa
accccaauucacucaaccaagaagaaaaaagcugaaagcugaguccugcaggaagcugccuuuc

SEQ ID NO: 60326 - RNA, 64 nt, hsa
acucgacaccccaauucacucaaccaagaagaaaaaagcugaaagcugaguccugcaggaagcu

SEQ ID NO: 60327 - RNA, 64 nt, hsa
ugaaugccacugaagagcugugauagcauguuucaaagcugaacucuacagagcgagugcugag

SEQ ID NO: 60328 - RNA, 64 nt, hsa
uugcauaaagguauugagagggaacaaaaaacauaaagcugagaaucuugagagagcucaucua

SEQ ID NO: 60329 - RNA, 64 nt, hsa
cucuagacuguuccaaagcugaacccuagaaagcaaagcugauacagaagcauccaggcugcag

SEQ ID NO: 60330 - RNA, 64 nt, hsa
ggaaaauuaaccuccugcuucucuagacuguuccaaagcugaacccuagaaagcaaagcugaua

SEQ ID NO: 60331 - RNA, 64 nt, hsa
caucacugaccuggugguggggcugugaccugggcagcucaagacuggugccccuugcugaucu

SEQ ID NO: 60332 - RNA, 64 nt, hsa
gcuaauuagaccccuccccuugugucaacuccggcagcucaagacccccgagcaacauuuguag

SEQ ID NO: 60333 - RNA, 64 nt, hsa
gguggcucugaggugccugucccacccccacccccagcucaauggacuggaaggggaagggaca

SEQ ID NO: 60334 - RNA, 64 nt, hsa
cacaagaagaagggcacccuaguucuaccucaggcagcucaagcagcgaccgcccccuccucua

SEQ ID NO: 60335 - RNA, 64 nt, hsa
uccacaguuaucuuagcuggauauaauguauuuucagcucaauuguuaaugugauggauggcac

SEQ ID NO: 60336 - RNA, 64 nt, hsa
gcgcgcccgcaggguggagaucgcugcaucccugcagcucaacgagacccaagugaagaucugg

SEQ ID NO: 60337 - RNA, 64 nt, hsa
aauagggucuuuucaaaccuuaguggaggagggucagcucaauuugggcaaugcauuuguuccc

SEQ ID NO: 60338 - RNA, 64 nt, hsa
ugagaggcagcucugaugcacuauugugugucagcagcucaaaggcccuaaaacacugaagguu

SEQ ID NO: 60339 - RNA, 64 nt, hsa
uggaagggaaaaaagaaagugguaccaguguuaccagcucaacuaaaaccugcaauucugcauu

SEQ ID NO: 60340 - RNA, 64 nt, hsa
aaagagacaguaggacauuguggcugagucuacccagcucaagguaaaggagaauguugcuaau

SEQ ID NO: 60341 - RNA, 64 nt, hsa
aaccgcaguuuuacuacauucugguguuuggccuauaugagaaaccaucuucucacagauuaag

SEQ ID NO: 60342 - RNA, 64 nt, hsa
uuugaguaaagaaacaauaaggaccuauacaaucauaugagaacaaaaauaugaaaucuugcua

SEQ ID NO: 60343 - RNA, 64 nt, hsa
ugggacaccucagaaaacuuauuaacaacugugaauaugagaaauacagaagaaaauaauaagc

SEQ ID NO: 60344 - RNA, 64 nt, hsa
uacuuacuguuaacugucuugagagaaaagaaaaauaugagagaacuauuguuuggggaaguuc

SEQ ID NO: 60345 - RNA, 64 nt, hsa
uuuauuuagaaaaaucuaaaaauucugguuuuaaauaugagaaucaguggaaaauaaggguaua

SEQ ID NO: 60346 - RNA, 64 nt, hsa
gcucaugcaguugcuuagaauaaucauuacuguuauaugagaaacauuuuaguaauuuaauaaa

SEQ ID NO: 60347 - RNA, 64 nt, hsa
ugaguguacauuuaugugugaagcaaauuucuagauaugagaaauauaaaaauaauuaaaacaa

SEQ ID NO: 60348 - RNA, 64 nt, hsa
cugagcaaguuuucaccuaucuggaaaaaaaaaaauaugagauuggaaaaaauuagacaagucu

SEQ ID NO: 60349 - RNA, 64 nt, hsa
gaaaaugggcagucagaauuagggacuagaauguauaugagaaacccccacucuacuaaaaaua

SEQ ID NO: 60350 - RNA, 64 nt, hsa
uaaacuuugucauguauagguaaggguacuauaaauaugagauuccccuacauucuccuugucu

SEQ ID NO: 60351 - RNA, 64 nt, hsa
uauuuauaaacuuugcuaugaaaaagacauuaaaauaugagauguaugaugaaaaucuaaguga

SEQ ID NO: 60352 - RNA, 64 nt, hsa
ugugaaagcaugugaucaauuguugcugcaucagauaugagagauucuuuuuuauuaggugagc

SEQ ID NO: 60353 - RNA, 64 nt, hsa
aaaauucuuggaaaaguggcaagaccaaaaugacaaugaugaugauaaugaugaugacgacgac

SEQ ID NO: 60354 - RNA, 64 nt, hsa
aaaguggcaagaccaaaaugacaaugaugaugauaaugaugaugacgacgacaacgaugaugcu

SEQ ID NO: 60355 - RNA, 64 nt, hsa
aaguauaauuagcuuguuccuggacuucauuuucaaugaugaaccaaauuccugaauuauuuau

SEQ ID NO: 60356 - RNA, 64 nt, hsa
auagccaagaccacaagcaaaagcacauacuggaaaugaugaguuagaaucugauuugacuggg

SEQ ID NO: 60357 - RNA, 64 nt, hsa
uauuugcaucuggcuggucauagccuuuguuacuaaugaugacauucaguucucuuuuguuuuu

SEQ ID NO: 60358 - RNA, 64 nt, hsa
ugauauaucaauucauguguuuggcauaccagugaaugaugaagaacaugagauuaauuuaauu

SEQ ID NO: 60359 - RNA, 64 nt, hsa
cucaucuucguacuugaugcucacagaggaagaaaaugaugaugguuuuuauuccuggcaucca

SEQ ID NO: 60360 - RNA, 64 nt, hsa
acuuggauucuuuccuauaaaagugggaccaagcaaugaugaucuucuguggugcuuaaggaaa

SEQ ID NO: 60361 - RNA, 64 nt, hsa
uauauucucauuucucuguucacauugcauuaauaaugaugauaaacauuugcauucuuauucu

SEQ ID NO: 60362 - RNA, 64 nt, hsa
cuauuugaauucugagcauuauuuauaaguauaaaaugaugauauauaagugaauuuugugcuc

SEQ ID NO: 60363 - RNA, 64 nt, hsa
auuaugugaaaccaauauuggcaaauaguacuuuaaugaugaaguaaaugaccagaaauuauag

SEQ ID NO: 60364 - RNA, 64 nt, hsa
uaagugucagauacuaggcagguguuagggaugaaaugaugaaugaggcauggaccuguuccuc

SEQ ID NO: 60365 - RNA, 64 nt, hsa
uuuucaacuauguuuauccagacuccuucuccacaaugaugaauccacaguugguuaucugcua

SEQ ID NO: 60366 - RNA, 64 nt, hsa
ugacgucccuccucaagagcuggauggcauugcaaaugaugacagcacuucugguggaugaauu

SEQ ID NO: 60367 - RNA, 64 nt, hsa
caguuuugcuuuaguacaauaguauacauuuuauaaugaugaacuuauaaugauuaagggacau

SEQ ID NO: 60368 - RNA, 64 nt, hsa
agauuuuucaaaaucgccaggacuggugaauauaaaugaugauugaacuggaauaauauugggg

SEQ ID NO: 60369 - RNA, 64 nt, hsa
auuuuuaaaaggaccuggauuugaagagauggcaaaugaugagccaucagaaaacuuaauuugg

SEQ ID NO: 60370 - RNA, 64 nt, hsa
uuaacaaagggagccugcugaauaacaaaauuaaaaugaugaaacaaaaguuugacagugauau

SEQ ID NO: 60371 - RNA, 64 nt, hsa
ucauuuucugucacucagugaguuucuuacuggaaaugaugacuccugacaacagaauuuccac

SEQ ID NO: 60372 - RNA, 64 nt, hsa
caacauaaauuuaucaaauuugcagcacuuuguaaaugaugagauugcuuccuaccuuuaugga

SEQ ID NO: 60373 - RNA, 64 nt, hsa
uugucagaaaaaucuauaagucugcccuuuuuacaaugaugauuuaaaaaaaacaacagcguaa

SEQ ID NO: 60374 - RNA, 64 nt, hsa
uuuccaugcacuuguuauuuuauuaauuugccugaaugaugagaccagaccagugucuacagau

SEQ ID NO: 60375 - RNA, 64 nt, hsa
auacuuucacaauuucccuucauauggauaugauuccagucaaaaauaaaaugcacaccaaaau

SEQ ID NO: 60376 - RNA, 64 nt, hsa
agaaagaggccuaggagagcagcccuguaauguauccagucagcugcaugguacugacugagcu

SEQ ID NO: 60377 - RNA, 64 nt, hsa
gucagucuuuguucaaacaucuguuuguucuaucuccagucauuaaaucagugcugcugcauga

SEQ ID NO: 60378 - RNA, 64 nt, hsa
gcugcaugacacucuuaacuccugacuuuuuauauccagucauaaaguugacuuucagcacaaa

SEQ ID NO: 60379 - RNA, 64 nt, hsa
ggacucagaccuuuaaacaggagaguugagcacuuccagucaguuuuuaagcaaggcaugggga

SEQ ID NO: 60380 - RNA, 64 nt, hsa
ccggcaguuccuccagcuacccuugugaccuaaguccagucacacauuucccaaaguuucucuu

SEQ ID NO: 60381 - RNA, 64 nt, hsa
gccaggggaccccccggagauccugaccagcuccuccagucaugcucuugucccucacugcccc

SEQ ID NO: 60382 - RNA, 64 nt, hsa
uauguauauaaguauauacaccacauuuucuuuauccagucaucucuugauggacccuuagguu

SEQ ID NO: 60383 - RNA, 64 nt, hsa
uauguguauguauauaaguauauacaccacauuauccagucaucuggauauguauauaaguaua

SEQ ID NO: 60384 - RNA, 64 nt, hsa
uaauagcuuauuaaaggaaauggucuuuguuaauuccagucagauaauggcauuguacagacau

SEQ ID NO: 60385 - RNA, 64 nt, hsa
uguggauuaauuguagcauuucacugaucuucacuccagucacuagggacaauagaaaccugca

SEQ ID NO: 60386 - RNA, 64 nt, hsa
uggaucaggguucuuuuuuucccccauacaaguauccagucauuguaacacuguuuauugaaag

SEQ ID NO: 60387 - RNA, 64 nt, hsa
uauucauguaccugugauccagcaagaagggaguuccagucaagagucacuacaacugauuagu

SEQ ID NO: 60388 - RNA, 64 nt, hsa
gccaggggucucuacugcccaugccgggcggccuuccagucauugcacagcaaagccaugugca

SEQ ID NO: 60389 - RNA, 64 nt, hsa
ugagaggucuugggucugccacguucucuagcucuccagucacccacucauccaggguaggagg

SEQ ID NO: 60390 - RNA, 64 nt, hsa
uucugggaaacagggacugaggccacacaucauuuccagucaucuguguguuuuuaaggccagc

SEQ ID NO: 60391 - RNA, 64 nt, hsa
gaccaguuagcuggcagguuguccagcuuuuuauuccagucauaauaggugacaguguuaaccg

SEQ ID NO: 60392 - RNA, 64 nt, hsa
gggugagccaggucuagcccaacagucuaaacuauccagucaauaccgagugaaguggcagcca

SEQ ID NO: 60393 - RNA, 64 nt, hsa
agcuuccuggaaggagacugcgucuucucucaauuccagucaucucagucguugucguuaggug

SEQ ID NO: 60394 - RNA, 64 nt, hsa
gcucagaacuauuacaacaugcagaaacaacaaauccagucaugugugcauuuaauuuggcaua

SEQ ID NO: 60395 - RNA, 64 nt, hsa
uugcaggcuguccagccucauccccugccugauauccagucagccuuggaggccucugccuaga

SEQ ID NO: 60396 - RNA, 64 nt, hsa
gagucaggagccagggacugugcagccuggaaccuccagucacugugcccagcagggugggcug

SEQ ID NO: 60397 - RNA, 64 nt, hsa
cuccugugagccggggaccaugcagcccgaaaccuccagucacugcgcccggcaggagucagga

SEQ ID NO: 60398 - RNA, 64 nt, hsa
caacaucaguuuuugacccaacuaaccuugacuguauucaaacuuaugagaguauaaaggaucu

SEQ ID NO: 60399 - RNA, 64 nt, hsa
gcuuugagaauccugggauuugugcugcugcuguuauucaaagaucaaaggaguaaaacauagu

SEQ ID NO: 60400 - RNA, 64 nt, hsa
uaguauuacuuaccuaguccauccauacucauauuauucaaauauauaggugguacuuuugaaa

SEQ ID NO: 60401 - RNA, 64 nt, hsa
cauugguucucuugguuuaacugagguuuaugaauauucaaaccuuugcugggggaaagaaaug

SEQ ID NO: 60402 - RNA, 64 nt, hsa
uguauaauguauuuauaauauucaucgauaccauuauucaaauauugcucaauacagcaaauua

SEQ ID NO: 60403 - RNA, 64 nt, hsa
acaucauugaagacaagggauagcaguuuguuuuuauucaaagacauugcuguguucucuuuca

SEQ ID NO: 60404 - RNA, 64 nt, hsa
gauguguguggacaucucugaccauccaucgcuguauucaaauggauuguuuuauuccauucug

SEQ ID NO: 60405 - RNA, 64 nt, hsa
uguauuuaugcaagcaaaauugaugagaaaauuauauucaaauaaagcaaaaauuaaaaaaaaa

SEQ ID NO: 60406 - RNA, 64 nt, hsa
ccuugcauuaaaauauggaaagcagagcaguacauauucaaauguauucagaaagucaaaagau

SEQ ID NO: 60407 - RNA, 64 nt, hsa
auaacagguccaaguuagagugauguguguauauuauucaaaaaaauguacuggugugauaucu

SEQ ID NO: 60408 - RNA, 64 nt, hsa
aagcucuuuuguagucuauugaauauuuuauagauauucaaaauuuccuacaaacuauaauuuu

SEQ ID NO: 60409 - RNA, 64 nt, hsa
uauuccucaaguguuaauauacugacuuaugcaguauucaaaccaucuagugcaauguuuuugu

SEQ ID NO: 60410 - RNA, 64 nt, hsa
agaccuuagaauguuacauagccaguagguucuuuauucaaauuuuaaguaucuuaagaauagu

SEQ ID NO: 60411 - RNA, 64 nt, hsa
uuugcaaaauuuuccagcccagauacucuucaucuauucaaauggauugucuuauucugagcaa

SEQ ID NO: 60412 - RNA, 64 nt, hsa
guuuucaugauuuuaggaauuacugcuuuguugauauucaaagugugaaacuaaaacuuuaugg

SEQ ID NO: 60413 - RNA, 64 nt, hsa
aguaaaaguuaacuuuuugguuuugauguacacauauucaaaaaguacaucuuccccccccccc

SEQ ID NO: 60414 - RNA, 64 nt, hsa
agcuaauuuggucauucuuugccauagcuuacucuauucaaauaaacauauauucuugcuugca

SEQ ID NO: 60415 - RNA, 64 nt, hsa
gaaauucauauauccaggcaacacaaaacuccuuuauucaaaaucacugcuaucuuugggacua

SEQ ID NO: 60416 - RNA, 64 nt, hsa
uggaacucuuuauuuaaauauguguguuuuucaguauucaaauaagaucaggaagccaauuuuc

SEQ ID NO: 60417 - RNA, 64 nt, hsa
gccaccugcaacucacugcaugacccuuucuguauauucaaacccaagcuaagugcuuccguug

SEQ ID NO: 60418 - RNA, 64 nt, hsa
ucaaccuucuagguuucucuugucuuaaaauggguauucaaaaauggggaucugugguguaugu

SEQ ID NO: 60419 - RNA, 64 nt, hsa
uaugagacccuuacgugauuguuaguuaaguuuuuauucaaagcagcuguaauuuaguuaauaa

SEQ ID NO: 60420 - RNA, 64 nt, hsa
uccagaauauuuuuaaguaaaaaaccaucuuaaguauucaaaauuuccuugguuuuuuaaaggu

SEQ ID NO: 60421 - RNA, 64 nt, hsa
uuuuaagagaaaguaaauuuucacauuagauuucuauucaaaguacuaauaucuacauggucca

SEQ ID NO: 60422 - RNA, 64 nt, hsa
uuuucaaaacugcuaaauuuuucuuaaucaagaauauucaaauguaauuaugaggugaaacaau

SEQ ID NO: 60423 - RNA, 64 nt, hsa
gcuuaaaaccuagaacuucaaaauguucguauucuauucaaaaggaaauauauauauauauaua

SEQ ID NO: 60424 - RNA, 64 nt, hsa
cucugaggccuguauggccccuuucaucaauaucuauucaaauauacaggugcauauauacuug

SEQ ID NO: 60425 - RNA, 64 nt, hsa
uaucauauaacuuuguagaacuuaaauacuugaauauucaaauuuaaaagacacuguauccccu

SEQ ID NO: 60426 - RNA, 64 nt, hsa
auuuuauucaaguguuucaaaauucaaagcauuguauucaaaguugcagugaaggcaucaacuu

SEQ ID NO: 60427 - RNA, 64 nt, hsa
uaaaauaagguuuacucugaaagaggaggaauuuuauucaaagcauucaaacauuuuauucaag

SEQ ID NO: 60428 - RNA, 64 nt, hsa
cuuguucauacucaaauaguaguuauuuugaagauauucaaacuuauauugaagaagugacuuu

SEQ ID NO: 60429 - RNA, 64 nt, hsa
acuuuaguuccucuuguuuuaagcuucuuucauguauucaaaucagcauuuuuuucuaagaaau

SEQ ID NO: 60430 - RNA, 64 nt, hsa
aauucuucaucuuuaaagggaauuuguaaugugcuauucaaacuuguuuccuugaugagcccug

SEQ ID NO: 60431 - RNA, 64 nt, hsa
gaauuuuaauacuaauggaauguuucaaagguuuuauucaaaccacaaauuauagaauccaccc

SEQ ID NO: 60432 - RNA, 64 nt, hsa
uccuggggagcuuuggucuauuaguuugugacaauauucaaaggccaaaacacuacucagacac

SEQ ID NO: 60433 - RNA, 64 nt, hsa
ucucaaauuuauaaauauuugcuuacaguuuuccuauucaaacaauuuguuaggccaauauuuu

SEQ ID NO: 60434 - RNA, 64 nt, hsa
agucauuaauuacuguccuccuuucacugagcuuuauucaaauuuugacaaucagagcacuggg

SEQ ID NO: 60435 - RNA, 64 nt, hsa
uuuggcuuuauugcagugacuuuccaaguuuaauuauucaaaacuuuuugaacugacugaauua

SEQ ID NO: 60436 - RNA, 64 nt, hsa
accucucuuaguagaaacaaagggagaguuagguuauucaaaaauuaguaugggacaauugaau

SEQ ID NO: 60437 - RNA, 64 nt, hsa
ggacauucugccaugacauacacuuaaccaaaacuauucaaaaugaaaaccggauuucaaauaa

SEQ ID NO: 60438 - RNA, 64 nt, hsa
ccacacugaccaaaucuggaucuuuggacuaaaguauucaaaauagcauagcaaagcucacugu

SEQ ID NO: 60439 - RNA, 64 nt, hsa
aagcaauauguugucacuccuaauucucaaguacuauucaaauuguaguaaaucuuaaaguuuu

SEQ ID NO: 60440 - RNA, 64 nt, hsa
cuaguagcuagcagagagccuggcacauaguauguauucaaaacaaguguguuaauuaauaaaa

SEQ ID NO: 60441 - RNA, 64 nt, hsa
cagaauaaaagggugaggacaucagaucacucuguauucaaagcuuacuagacgaacaaucuuu

SEQ ID NO: 60442 - RNA, 64 nt, hsa
auucaguaaaauaacauuaccuuauuuuuuuucuuauucaaauucuggaacuauagcaaauaau

SEQ ID NO: 60443 - RNA, 64 nt, hsa
cuggaacuauagcaaauaauucguuaaauugucauauucaaaacaaauguggauacagucuugg

SEQ ID NO: 60444 - RNA, 64 nt, hsa
uacauauuuuccuuaauagaggaaugcuucauauuauucaaaaauuauauccugaucaccuuuu

SEQ ID NO: 60445 - RNA, 64 nt, hsa
uguuuaauagaugaauuuauuuuauuucuaaagguauucaaauguuucagcaccauauaauaga

SEQ ID NO: 60446 - RNA, 64 nt, hsa
uguucucuuauuucugaggcccuucagucuccuuuauucaaagcacucagcaugccaaagcacc

SEQ ID NO: 60447 - RNA, 64 nt, hsa
gggaaacuucuuagggcaaacccaccucccacucuauucaaaguuaucucucugcucacugaga

SEQ ID NO: 60448 - RNA, 64 nt, hsa
aucuuccuauuuaacuagcuuggggacuucaguugaaaauuagguucuaaguuguucuugcagg

SEQ ID NO: 60449 - RNA, 64 nt, hsa
aggcucucaagucuucccaaggccagaaucgaaagaaaauuaaaauuugaaugcugaauauucu

SEQ ID NO: 60450 - RNA, 64 nt, hsa
aaaaaauuccaaagacugauauuuugugucacaugaaaauuauaugaaauucaaauugcagugu

SEQ ID NO: 60451 - RNA, 64 nt, hsa
gggagguuuuuuuuuucuauuuuuauuuuuucaugaaaauuauuggugggccacugaaaguccc

SEQ ID NO: 60452 - RNA, 64 nt, hsa
caaauaaugcauuuuauuuauaaaaauacagacagaaaauuagggagaaaccucuaguuuugcc

SEQ ID NO: 60453 - RNA, 64 nt, hsa
auaaauguaguuucaucugucgucaauuacugcagaaaauuauguguauccacaaccuaguuau

SEQ ID NO: 60454 - RNA, 64 nt, hsa
uuuaucugaaugaaaauggugguacuaagacugugaaaauuaugugaaaccuaaaguaguugcc

SEQ ID NO: 60455 - RNA, 64 nt, hsa
guauuagcauacucuauaguuucaaacacaacuugaaaauuaaaagugcccucuuaaaaauaca

SEQ ID NO: 60456 - RNA, 64 nt, hsa
ucaguguuucuaagaaugagucugaaugguucuugaaaauuagccaggaucaaaugcuauugca

SEQ ID NO: 60457 - RNA, 64 nt, hsa
ucccugauacucaaagucuaacaagaaagacauggaaaauuagcagcccauuuucagaaagauc

SEQ ID NO: 60458 - RNA, 64 nt, hsa
uguuuagugagcaguaugauuuguacaugccauugaaaauuauuaaucagaagaaaauuaagca

SEQ ID NO: 60459 - RNA, 64 nt, hsa
auuuguacaugccauugaaaauuauuaaucagaagaaaauuaagcagggucuuugcuauacaaa

SEQ ID NO: 60460 - RNA, 64 nt, hsa
ggugccaaaauucauuuucuaacaccauguguuagaaaauuauaaaaaauaaaauaauuuuaga

SEQ ID NO: 60461 - RNA, 64 nt, hsa
auauagaggaaauguagacaaaauggauauaaaugaaaauuaccauguuguaaaaccuugaaaa

SEQ ID NO: 60462 - RNA, 64 nt, hsa
aaaugcagaacuaagauuuuugacucuaaagagagaaaauuacaaggguguugccuuauagcaa

SEQ ID NO: 60463 - RNA, 64 nt, hsa
auuuacagaucauauuuauuuuacuauuuuuguagaaaauuauuaauuuugauuguauuuuugu

SEQ ID NO: 60464 - RNA, 64 nt, hsa
uaaguacuccuaaagugaccauuauuagggaccagaaaauuauaucuuggcuaaguaauagagg

SEQ ID NO: 60465 - RNA, 64 nt, hsa
ggaaauauucaauugagacuugaggggaauaauagaaaauuaagguagauccccaauauuuugg

SEQ ID NO: 60466 - RNA, 64 nt, hsa
uauaaaacuuugaagauaacuuuuacuuaaauaugaaaauuauaguuugaaaauuaggcucaag

SEQ ID NO: 60467 - RNA, 64 nt, hsa
gauaacuuuuacuuaaauaugaaaauuauaguuugaaaauuaggcucaagcaaauaucaaauac

SEQ ID NO: 60468 - RNA, 64 nt, hsa
gaauauuuuguuucuuggaacccaaugauccuaagaaaauuauguacuuuuaccugaaaauuaa

SEQ ID NO: 60469 - RNA, 64 nt, hsa
ccaaugauccuaagaaaauuauguacuuuuaccugaaaauuaaaaccaauauuuauaaaaagug

SEQ ID NO: 60470 - RNA, 64 nt, hsa
aauaaguuauaaugaacaguuaaaaaugcucauugaaaauuaaauaaaacaaaaaggcaguuau

SEQ ID NO: 60471 - RNA, 64 nt, hsa
aauccucaagaaaauugacuucauuauuuggaaggaaaauuaguauuuuuuuuaauauuauaug

SEQ ID NO: 60472 - RNA, 64 nt, hsa
auauaaagaugaggacagaagcaucucuacagaugaaaauuacauaaauaaaacauucuccauc

SEQ ID NO: 60473 - RNA, 64 nt, hsa
uaugguuaaaagauuuuuuuuuuaaucaugaagagaaaauuaguagcauuucuuucucucccca

SEQ ID NO: 60474 - RNA, 64 nt, hsa
uugaauuuaaaggguguacaggucuuucuguagggaaaauuauuccauguaaacauuucaacuc

SEQ ID NO: 60475 - RNA, 64 nt, hsa
uuaaaacuacuaauuugcugcuuguacagaaagugaaaauuaguuggcaaucauaagaaacauc

SEQ ID NO: 60476 - RNA, 64 nt, hsa
caguucauguacaaggccccucugcaacuggagagaaaauuaauuccuaucccgugaguggauu

SEQ ID NO: 60477 - RNA, 64 nt, hsa
cccaagugaagcauggcauauagugcccuuggaagaaaauuaggccucaaaugacaguagcauu

SEQ ID NO: 60478 - RNA, 64 nt, hsa
guaaguugagaaaaauuuauaagccaaagguucagaaaauuaaacuacagaauauuaaauauua

SEQ ID NO: 60479 - RNA, 64 nt, hsa
uauuccuuacaacuggaguggguagaagccuuaugaaaauuauacugagaaccugaucucguuu

SEQ ID NO: 60480 - RNA, 64 nt, hsa
guugucuuuuuuauauuuuuaugaaaaagcaguagaaaauuacuuuugaagaaaacaggcuauu

SEQ ID NO: 60481 - RNA, 64 nt, hsa
gggggaaagguaggaagaagagguaauuuuuacugaaaauuagggcaauguuggucgccuuuua

SEQ ID NO: 60482 - RNA, 64 nt, hsa
guuccuuaaguuuuucaaguuauccuuuucugaggaaaauuauucuagaggaaccuaaaaaggg

SEQ ID NO: 60483 - RNA, 64 nt, hsa
auguuuucucuuguuuguaauuauuugcuccuuugaaaauuaaaucacuauuaauuacauuaaa

SEQ ID NO: 60484 - RNA, 64 nt, hsa
cauaaauugagagaagaagaaggugauaaguguugaaaauuaaaugugauaaccuuugaaccuu

SEQ ID NO: 60485 - RNA, 64 nt, hsa
auuuguacuuuuaguaacuaccauucuuugauuagaaaauuaagagaaugcauaucuuacuuug

SEQ ID NO: 60486 - RNA, 64 nt, hsa
uaauucuuuagaugaauguuucuuaggauuguaggaaaauuaucuaguuaaucauaauauuuga

SEQ ID NO: 60487 - RNA, 64 nt, hsa
uuacagugggcagguauuugcuuuugcuugcacugaaaauuaaauugcuaucaagaauaaacca

SEQ ID NO: 60488 - RNA, 64 nt, hsa
agugagcagguauguguuugcuuuugcuugcacugaaaauuaaauugcuaucaagagcaaacua

SEQ ID NO: 60489 - RNA, 64 nt, hsa
uuguguauuuuguuuauuucucagaauauggaaagaaaauuaaaaugugucaauaaauauuuuc

SEQ ID NO: 60490 - RNA, 64 nt, hsa
auaacuguuauuuaaauacuuaaccacuaauuuugaaaauuaccagugugauacauaggaauca

SEQ ID NO: 60491 - RNA, 64 nt, hsa
augauaagcaaaaugaaagaaauaaugauuaagggaaaauuaagugacuguguuacacugcuuc

SEQ ID NO: 60492 - RNA, 64 nt, hsa
agucguugaaaaaaauuuuguaucaaaauguuuggaaaauuagaagcuucuccuuaaccuguau

SEQ ID NO: 60493 - RNA, 64 nt, hsa
gcaaaacagguguucuuaucuaaaacgucaauuagaaaauuaucugcgguuguuaaucuacugu

SEQ ID NO: 60494 - RNA, 64 nt, hsa
aguauaaauuccuuugaaacuauaagucuuugaggaaaauuauaagguaaaauuuuccuguuuu

SEQ ID NO: 60495 - RNA, 64 nt, hsa
auuauucaccauuuugaagcucacccuagacuaugaaaauuauauucacugcagagcaauuacu

SEQ ID NO: 60496 - RNA, 64 nt, hsa
agaggacguagucauuucauuuaucaaauauaaggaaaauuauucaccauuuugaagcucaccc

SEQ ID NO: 60497 - RNA, 64 nt, hsa
uugaaaauuaguaugguaauuaaauguacuuuuugaaaauuaauagaauuauuuaaauuacagu

SEQ ID NO: 60498 - RNA, 64 nt, hsa
aagauuacuucugacauuccauugcucuucuuuugaaaauuaguaugguaauuaaauguacuuu

SEQ ID NO: 60499 - RNA, 64 nt, hsa
augaguccugcuucuagcuccauuguggaauacagaaaauuaaauauaccuguuaaguucguau

SEQ ID NO: 60500 - RNA, 64 nt, hsa
cagcaauucauaaaaacugcuuacuuaugccauagaaaauuaaacacaaaguguauacauguau

SEQ ID NO: 60501 - RNA, 64 nt, hsa
aaagcucguuguaguagaaaggguggaauguauugaaaauuauuagaagcagggaaguauuguu

SEQ ID NO: 60502 - RNA, 64 nt, hsa
agaggaaaacugaccaaaacagaagcaaaaauaagaaaauuaaaauaaucucuaauccuacuac

SEQ ID NO: 60503 - RNA, 64 nt, hsa
auugcugaaucgcacagcagucaugucauaaucagaaaauuacugccaaauaauuguaaaauuu

SEQ ID NO: 60504 - RNA, 64 nt, hsa
gaagauacacgaggaugaaguagaggauauggaagaaaauuaagugugauccaguuugauauuu

SEQ ID NO: 60505 - RNA, 64 nt, hsa
gauuugaagucauauuaggaaauauuuagacaaugaaaauuaucaagagauaauuuaccuuuca

SEQ ID NO: 60506 - RNA, 64 nt, hsa
aaucaacuaaaaauucgucuaucgaauuagggcugaaaauuacuguuaaagaguguugcaguau

SEQ ID NO: 60507 - RNA, 64 nt, hsa
uacauuuacauuuaugcaaauuuuuuaaauaggagaaaauuaagaaauuguguuaaaggccuaa

SEQ ID NO: 60508 - RNA, 64 nt, hsa
ccacguuugguagcaucaguuguugaguuaaaaagaaaauuauugcauuugaucuggauggauu

SEQ ID NO: 60509 - RNA, 64 nt, hsa
uuggaaugagauggaaaguagaugaaacuacuuugaaaauuacgacaguuaagggcugggugcg

SEQ ID NO: 60510 - RNA, 64 nt, hsa
gaggucagcaguugagaccagccaaaaggaaaaagaaaauuaugagaguuacuuaaagguaaca

SEQ ID NO: 60511 - RNA, 64 nt, hsa
uuagagaggaaucuuguuuuugugugcaacauaagaaaauuaugaaaacuaauagccaaaaaac

SEQ ID NO: 60512 - RNA, 64 nt, hsa
aucuagaacuaggcauaaccuuacauaauacuaggaaaauuaugagaaaggggaaauuuuuggu

SEQ ID NO: 60513 - RNA, 64 nt, hsa
cuguaaauuaugcauuauaaagaguucauuuaaggaaaauuacuugguacaauaauuauuguaa

SEQ ID NO: 60514 - RNA, 64 nt, hsa
uggcugugagcaacugcgacaaaacauuuugaaggaaaauuaaaccaaugaagaagacaaaguc

SEQ ID NO: 60515 - RNA, 64 nt, hsa
guuuuuuuaugguacucgaaaaaucaaaccuucugaaaauuaugauauuuguacuucauuugug

SEQ ID NO: 60516 - RNA, 64 nt, hsa
uuuuccacaguaaagccgaacaguauucuuuuuugaaaauuagcaauuauaaagauuguuuaaa

SEQ ID NO: 60517 - RNA, 64 nt, hsa
augugaauguaaggugaugugaccuuguuggugagaaaauuaaacuuuacauuugacuugauuu

SEQ ID NO: 60518 - RNA, 64 nt, hsa
ggguugaaaaaagugaaaagaauauuuucaacaugaaaauuauaugaaauuuaaguuuuggugu

SEQ ID NO: 60519 - RNA, 64 nt, hsa
caauaagcuauauuuauucuuauuugauguggaugaaaauuaucaaaauuggccaggcuuggug

SEQ ID NO: 60520 - RNA, 64 nt, hsa
cacauuauaaaaauucaaaaauuaccaaaaaugugaaaauuaauucuccccuaacauccaguuc

SEQ ID NO: 60521 - RNA, 64 nt, hsa
uuguaaucaagauuuuauguaacauuuguaaagggaaaauuagcacuuuugugguucuuaaggg

SEQ ID NO: 60522 - RNA, 64 nt, hsa
gugccccccacuuaauauggauagauuuuaaugggaaaauuauaauucagauuaaauaaaaaac

SEQ ID NO: 60523 - RNA, 64 nt, hsa
uugaauugagaaaauuacaggaaauggugccuuugaaaauuagaaaacuugcuuacagagcugu

SEQ ID NO: 60524 - RNA, 64 nt, hsa
uuuagccuaacccucauguccuuuuuugaauugagaaaauuacaggaaauggugccuuugaaaa

SEQ ID NO: 60525 - RNA, 64 nt, hsa
guauguucucucugucacugacuuauuuguaagagaaaauuaguuggacuuguuuauuuucuag

SEQ ID NO: 60526 - RNA, 64 nt, hsa
aauaaacuauucuuugaaacuuguuggguagaaugaaaauuaaagccauaaugguagaagaugg

SEQ ID NO: 60527 - RNA, 64 nt, hsa
aggugccuccauuuaucaaggguuaugaaacucagaaaauuaaauucuugaugcugaccuuuuu

SEQ ID NO: 60528 - RNA, 64 nt, hsa
cagugagcauuacuuuuaaauaggaccuucucuggaaaauuauuuugguuaauguaauaauccu

SEQ ID NO: 60529 - RNA, 64 nt, hsa
auugcguuggcauguacgugggugggaagaaaaagaaaauuaacaggauuuacacaauuauaau

SEQ ID NO: 60530 - RNA, 64 nt, hsa
agcugcuaaauacgugucuggcagguaaaagcuggaaaauuacuuaaaacaggaaagugucaau

SEQ ID NO: 60531 - RNA, 64 nt, hsa
uaagcauauugguguuuucucaauuagucacugagaaaauuaacacuuuaggcaguggcuauuu

SEQ ID NO: 60532 - RNA, 64 nt, hsa
aaccaauaugguuuucuuuaugucuuggcugcuugaaaauuaaaaaaaaaaaagguuuguucaa

SEQ ID NO: 60533 - RNA, 64 nt, hsa
ucuuuacuucugggaauuuguauguaacagccuagaaaauuaaaaggagguggaugcauccaaa

SEQ ID NO: 60534 - RNA, 64 nt, hsa
ugucacacacacaaaaaauccuuuucaauccugagaaaauuaaaggcguuuuacucacauggcu

SEQ ID NO: 60535 - RNA, 64 nt, hsa; identical to SEQ ID NO: 60533

SEQ ID NO: 60536 - RNA, 64 nt, hsa
gucacacacacaaaaaaauccuuuucaauccugagaaaauuaaagguguuuuacucacauggau

SEQ ID NO: 60537 - RNA, 64 nt, hsa
uucaagguaguaggucucuuucaacugagugcaacauugagaauaaugauuugguucagggcaa

SEQ ID NO: 60538 - RNA, 64 nt, hsa
aaaggacacugucaggcaaauuugaaaauauacacauugagaauaauuuuuuauuauuauaucc

SEQ ID NO: 60539 - RNA, 64 nt, hsa
auacauuagaacuuaaugcagacauauaaaguaacauugagaaugacaacuaaaacauuccauu

SEQ ID NO: 60540 - RNA, 64 nt, hsa
auuucacauuuuauauggcugaucaauuuucauacauugagaaaccaagucaaucaagcaggaa

SEQ ID NO: 60541 - RNA, 64 nt, hsa
gcaaaacaggaaaguuuccagauagguauuguaucauugagaaugcagcacagauagugugggc

SEQ ID NO: 60542 - RNA, 64 nt, hsa
gaguuguguuuucagcacuauauuggucaagauagccaagcaguuuguauaauuucugucacua

SEQ ID NO: 60543 - RNA, 64 nt, hsa
uggucaacaugugugaucuuugugucuccuuuuugccaagcacauucugauuuucuuguuggaa

SEQ ID NO: 60544 - RNA, 64 nt, hsa
uaauaggaucaucuugugaauuuguuuacgugaugccaagcaucaagucauguuuucuuuagug

SEQ ID NO: 60545 - RNA, 64 nt, hsa
ugcucacugauuguuaacuguagcuucagcgcgugccaagcaguugacuuaauaggaucaucuu

SEQ ID NO: 60546 - RNA, 64 nt, hsa
ccuuccagccagaaaagugguaagcggagcaagugccaagcagaacagaccuuaucaucugggu

SEQ ID NO: 60547 - RNA, 64 nt, hsa
caauuugaaugccuacaauaaguucaggagcugugccaagcacuuuccucuuuuacagcuggag

SEQ ID NO: 60548 - RNA, 64 nt, hsa
ucaaagaccccugagcugccaaccacggagaugugccaagcaucucaucucuccugcacacuuu

SEQ ID NO: 60549 - RNA, 64 nt, hsa
cucuaguucaauggccagucauagcagaagggaggccaagcaccaguccaucaccccucccagg

SEQ ID NO: 60550 - RNA, 64 nt, hsa
gacacaagcacaggcuguagcauggugaaaauaagccaagcagugcagaaugccucagaaaggg

SEQ ID NO: 60551 - RNA, 64 nt, hsa
cagcucuccuugagcugaccacuccaguuaggaugccaagcagccacgucuccaagagcucccg

SEQ ID NO: 60552 - RNA, 64 nt, hsa
gcaggcaagguacccgaagaagcagaggcugagggcaggcaaagccugugugacuguggcagug

SEQ ID NO: 60553 - RNA, 64 nt, hsa
uggcccaacagaaaaacccugccccaaugcaccugcaggcaagguacccgaagaagcagaggcu

SEQ ID NO: 60554 - RNA, 64 nt, hsa
guguuuugcguuuacuuccucuagaaaagaauuugcaggcaaccauguuuaauuugaacuaucu

SEQ ID NO: 60555 - RNA, 64 nt, hsa
ugacgcagaauaguuuugcaauguguauauaguugcaggcaaaaaaaaaaccaccucacugcaa

SEQ ID NO: 60556 - RNA, 64 nt, hsa
ucauccacuugagggcgccugagggccaggagcagcaggcaaggagccugggucuaggcuaagg

SEQ ID NO: 60557 - RNA, 64 nt, hsa
cgggggggacucaacagcagagcucugagcagcagcaggcaacuucgagaacggauccagaaau

SEQ ID NO: 60558 - RNA, 64 nt, hsa
cagguccaggggaguccagugggcaggacccuuggcaggcaagccccucccuucacucccagga

SEQ ID NO: 60559 - RNA, 64 nt, hsa
ggcagcaaggcagggcagcccagagguggcagcggcaggcaaucuggucacuaggucuuuguga

SEQ ID NO: 60560 - RNA, 64 nt, hsa
gcuccagcuccuccaaaguucuggcuuagcagcugcaggcaagcauuaugcugcuauugaagaa

SEQ ID NO: 60561 - RNA, 64 nt, hsa
cuuuccacaucaagaguccuuauguuauugggaugcaggcaaaccucugugguccuaagaccug

SEQ ID NO: 60562 - RNA, 64 nt, hsa
gagcuggcuuggacccauuugaggacugaacuaggcaggcaauggcuccagugcccucccucug

SEQ ID NO: 60563 - RNA, 64 nt, hsa
gcaugguggugcccugggccgucccugugugaacgcaggcaaaagcagcccagucccccucacu

SEQ ID NO: 60564 - RNA, 64 nt, hsa
cgugcaugcuuuaaaaaacacagucacgcaccaagcaggcaaauagcuuuaguccuucucaccu

SEQ ID NO: 60565 - RNA, 64 nt, hsa
cggauaguaagaaaacaaacagcccaagugaaaagcaggcaaaagacuugaauagacacuucac

SEQ ID NO: 60566 - RNA, 64 nt, hsa
auagagccaaguccaaacuggcaagcucaaugaugcaggcaauaaaccgccuuuuuggcagccu

SEQ ID NO: 60567 - RNA, 64 nt, hsa
cccugacgucccccagcaaaggaagacguugcaagcaggcaaaaugcgucgauuuuuuuuuuuu

SEQ ID NO: 60568 - RNA, 64 nt, hsa
cucagccauggcaaguccaucuggaguccaggaagcaggcaacuggccugacccaugagaccgu

SEQ ID NO: 60569 - RNA, 64 nt, hsa
ucaaagaaaaucaaccucugugguggucaacuaaagguauuaggaaacuaagucuguggcucuu

SEQ ID NO: 60570 - RNA, 64 nt, hsa
ugccacacaguaucuccuggcguucuaggagucuagguauuauggaaaguacccaagucugugu

SEQ ID NO: 60571 - RNA, 64 nt, hsa
cuuaaaugagguauuaaguaauguuuagagucguagguauuaacuagaauauaaauccuuagaa

SEQ ID NO: 60572 - RNA, 64 nt, hsa
aaagugacuagagaaaaagaaaucagcuuaaaugagguauuaaguaauguuuagagucguaggu

SEQ ID NO: 60573 - RNA, 64 nt, hsa
auauugauugggaaaacauuugcugccauuacagagguauuaaaacuaaauuucacuacuagau

SEQ ID NO: 60574 - RNA, 64 nt, hsa
uaaaaguuuuauaugcuuuauuaauguuuucaaaagguauuauacaugugauacauuuuuuaag

SEQ ID NO: 60575 - RNA, 64 nt, hsa
caucuguguccuguugucauuuauguuaaccuucagguauuaaacuugcugcauaucuugacau

SEQ ID NO: 60576 - RNA, 64 nt, hsa
gugguguguagugcugcuguguaucaaaagaccaagguauuaugggaccugguuucagaauggg

SEQ ID NO: 60577 - RNA, 64 nt, hsa
uagauacccaccaugagguguucugggcaucugaagguauuaagaguucagugggaaaaaucuc

SEQ ID NO: 60578 - RNA, 64 nt, hsa
guuuccagaagaguggagagugugguuucaggcaagguauuaaugauacaauuccgugguauac

SEQ ID NO: 60579 - RNA, 64 nt, hsa
aaaagguguuugugugugugugugugagagagaaagguauuaauuuauuuuuuuaauuuuaauu

SEQ ID NO: 60580 - RNA, 64 nt, hsa
gauucaggauauauauuauuugaucugaauuuugagguauuauuuuaaaacaucugguuuucau

SEQ ID NO: 60581 - RNA, 64 nt, hsa
cagaauuugauuuugaacuugaguaauucauccuuacagcuaucuguagaauuagucaucuuuu

SEQ ID NO: 60582 - RNA, 64 nt, hsa
caaaguccagguuagcacagguuuuuauuuuuccuacagcuacauugagauauaguucacauaa

SEQ ID NO: 60583 - RNA, 64 nt, hsa; identical to SEQ ID NO: 44500

SEQ ID NO: 60584 - RNA, 64 nt, hsa; identical to SEQ ID NO: 44501

SEQ ID NO: 60585 - RNA, 64 nt, hsa; identical to SEQ ID NO: 44502

SEQ ID NO: 60586 - RNA, 64 nt, hsa; identical to SEQ ID NO: 44503

SEQ ID NO: 60587 - RNA, 64 nt, hsa; identical to SEQ ID NO: 44504

SEQ ID NO: 60588 - RNA, 64 nt, hsa; identical to SEQ ID NO: 44505

SEQ ID NO: 60589 - RNA, 64 nt, hsa; identical to SEQ ID NO: 44506

SEQ ID NO: 60590 - RNA, 64 nt, hsa; identical to SEQ ID NO: 44507

SEQ ID NO: 60591 - RNA, 64 nt, hsa; identical to SEQ ID NO: 44508

SEQ ID NO: 60592 - RNA, 64 nt, hsa; identical to SEQ ID NO: 44509

SEQ ID NO: 60593 - RNA, 64 nt, hsa; identical to SEQ ID NO: 44510

SEQ ID NO: 60594 - RNA, 64 nt, hsa; identical to SEQ ID NO: 44511

SEQ ID NO: 60595 - RNA, 64 nt, hsa; identical to SEQ ID NO: 44512

SEQ ID NO: 60596 - RNA, 64 nt, hsa; identical to SEQ ID NO: 44513

SEQ ID NO: 60597 - RNA, 64 nt, hsa; identical to SEQ ID NO: 44514

SEQ ID NO: 60598 - RNA, 64 nt, hsa; identical to SEQ ID NO: 44515

SEQ ID NO: 60599 - RNA, 64 nt, hsa; identical to SEQ ID NO: 44516

SEQ ID NO: 60600 - RNA, 64 nt, hsa; identical to SEQ ID NO: 44517

SEQ ID NO: 60601 - RNA, 64 nt, hsa; identical to SEQ ID NO: 44518

SEQ ID NO: 60602 - RNA, 64 nt, hsa; identical to SEQ ID NO: 44519

SEQ ID NO: 60603 - RNA, 64 nt, hsa; identical to SEQ ID NO: 44520

SEQ ID NO: 60604 - RNA, 64 nt, hsa; identical to SEQ ID NO: 44521

SEQ ID NO: 60605 - RNA, 64 nt, hsa; identical to SEQ ID NO: 44522

SEQ ID NO: 60606 - RNA, 64 nt, hsa; identical to SEQ ID NO: 44523

SEQ ID NO: 60607 - RNA, 64 nt, hsa; identical to SEQ ID NO: 44524

SEQ ID NO: 60608 - RNA, 64 nt, hsa; identical to SEQ ID NO: 44525

SEQ ID NO: 60609 - RNA, 64 nt, hsa; identical to SEQ ID NO: 44526

SEQ ID NO: 60610 - RNA, 64 nt, hsa; identical to SEQ ID NO: 44527

SEQ ID NO: 60611 - RNA, 64 nt, hsa; identical to SEQ ID NO: 44528

SEQ ID NO: 60612 - RNA, 64 nt, hsa; identical to SEQ ID NO: 44529

SEQ ID NO: 60613 - RNA, 64 nt, hsa; identical to SEQ ID NO: 44530

SEQ ID NO: 60614 - RNA, 64 nt, hsa; identical to SEQ ID NO: 44531

SEQ ID NO: 60615 - RNA, 64 nt, hsa; identical to SEQ ID NO: 44532

SEQ ID NO: 60616 - RNA, 64 nt, hsa; identical to SEQ ID NO: 44533

SEQ ID NO: 60617 - RNA, 64 nt, hsa; identical to SEQ ID NO: 44534

SEQ ID NO: 60618 - RNA, 64 nt, hsa; identical to SEQ ID NO: 44535

SEQ ID NO: 60619 - RNA, 64 nt, hsa; identical to SEQ ID NO: 44536

SEQ ID NO: 60620 - RNA, 64 nt, hsa; identical to SEQ ID NO: 44537

SEQ ID NO: 60621 - RNA, 64 nt, hsa; identical to SEQ ID NO: 44538

SEQ ID NO: 60622 - RNA, 64 nt, hsa; identical to SEQ ID NO: 44539

SEQ ID NO: 60623 - RNA, 64 nt, hsa; identical to SEQ ID NO: 44540

SEQ ID NO: 60624 - RNA, 64 nt, hsa; identical to SEQ ID NO: 44541

SEQ ID NO: 60625 - RNA, 64 nt, hsa; identical to SEQ ID NO: 44542

SEQ ID NO: 60626 - RNA, 64 nt, hsa; identical to SEQ ID NO: 44543

SEQ ID NO: 60627 - RNA, 64 nt, hsa; identical to SEQ ID NO: 44544

SEQ ID NO: 60628 - RNA, 64 nt, hsa; identical to SEQ ID NO: 44545

SEQ ID NO: 60629 - RNA, 64 nt, hsa; identical to SEQ ID NO: 44546

SEQ ID NO: 60630 - RNA, 64 nt, hsa; identical to SEQ ID NO: 44547

SEQ ID NO: 60631 - RNA, 64 nt, hsa; identical to SEQ ID NO: 44548

SEQ ID NO: 60632 - RNA, 64 nt, hsa; identical to SEQ ID NO: 44549

SEQ ID NO: 60633 - RNA, 64 nt, hsa; identical to SEQ ID NO: 44550

SEQ ID NO: 60634 - RNA, 64 nt, hsa; identical to SEQ ID NO: 44551

SEQ ID NO: 60635 - RNA, 64 nt, hsa; identical to SEQ ID NO: 44552

SEQ ID NO: 60636 - RNA, 64 nt, hsa; identical to SEQ ID NO: 44553

SEQ ID NO: 60637 - RNA, 64 nt, hsa; identical to SEQ ID NO: 44554

SEQ ID NO: 60638 - RNA, 64 nt, hsa; identical to SEQ ID NO: 44555

SEQ ID NO: 60639 - RNA, 64 nt, hsa; identical to SEQ ID NO: 44556

SEQ ID NO: 60640 - RNA, 64 nt, hsa; identical to SEQ ID NO: 44557

SEQ ID NO: 60641 - RNA, 64 nt, hsa; identical to SEQ ID NO: 44558

SEQ ID NO: 60642 - RNA, 64 nt, hsa; identical to SEQ ID NO: 44559

SEQ ID NO: 60643 - RNA, 64 nt, hsa; identical to SEQ ID NO: 44560

SEQ ID NO: 60644 - RNA, 64 nt, hsa; identical to SEQ ID NO: 44561

SEQ ID NO: 60645 - RNA, 64 nt, hsa; identical to SEQ ID NO: 44562

SEQ ID NO: 60646 - RNA, 64 nt, hsa; identical to SEQ ID NO: 44563

SEQ ID NO: 60647 - RNA, 64 nt, hsa; identical to SEQ ID NO: 44564

SEQ ID NO: 60648 - RNA, 64 nt, hsa; identical to SEQ ID NO: 44565

SEQ ID NO: 60649 - RNA, 64 nt, hsa; identical to SEQ ID NO: 44566

SEQ ID NO: 60650 - RNA, 64 nt, hsa; identical to SEQ ID NO: 44567

SEQ ID NO: 60651 - RNA, 64 nt, hsa; identical to SEQ ID NO: 44568

SEQ ID NO: 60652 - RNA, 64 nt, hsa; identical to SEQ ID NO: 44569

SEQ ID NO: 60653 - RNA, 64 nt, hsa; identical to SEQ ID NO: 44570

SEQ ID NO: 60654 - RNA, 64 nt, hsa; identical to SEQ ID NO: 44571

SEQ ID NO: 60655 - RNA, 64 nt, hsa; identical to SEQ ID NO: 44572

SEQ ID NO: 60656 - RNA, 64 nt, hsa; identical to SEQ ID NO: 44573

SEQ ID NO: 60657 - RNA, 64 nt, hsa; identical to SEQ ID NO: 44574

SEQ ID NO: 60658 - RNA, 64 nt, hsa; identical to SEQ ID NO: 44575

SEQ ID NO: 60659 - RNA, 64 nt, hsa; identical to SEQ ID NO: 44576

SEQ ID NO: 60660 - RNA, 64 nt, hsa; identical to SEQ ID NO: 44577

SEQ ID NO: 60661 - RNA, 64 nt, hsa; identical to SEQ ID NO: 44578

SEQ ID NO: 60662 - RNA, 64 nt, hsa; identical to SEQ ID NO: 44579

SEQ ID NO: 60663 - RNA, 64 nt, hsa; identical to SEQ ID NO: 44580

SEQ ID NO: 60664 - RNA, 64 nt, hsa; identical to SEQ ID NO: 44581

SEQ ID NO: 60665 - RNA, 64 nt, hsa; identical to SEQ ID NO: 44582

SEQ ID NO: 60666 - RNA, 64 nt, hsa; identical to SEQ ID NO: 44583

SEQ ID NO: 60667 - RNA, 64 nt, hsa; identical to SEQ ID NO: 44584

SEQ ID NO: 60668 - RNA, 64 nt, hsa; identical to SEQ ID NO: 44585

SEQ ID NO: 60669 - RNA, 64 nt, hsa; identical to SEQ ID NO: 44586

SEQ ID NO: 60670 - RNA, 64 nt, hsa; identical to SEQ ID NO: 44587

SEQ ID NO: 60671 - RNA, 64 nt, hsa; identical to SEQ ID NO: 44588

SEQ ID NO: 60672 - RNA, 64 nt, hsa; identical to SEQ ID NO: 44589

SEQ ID NO: 60673 - RNA, 64 nt, hsa; identical to SEQ ID NO: 44590

SEQ ID NO: 60674 - RNA, 64 nt, hsa; identical to SEQ ID NO: 44591

SEQ ID NO: 60675 - RNA, 64 nt, hsa; identical to SEQ ID NO: 44592

SEQ ID NO: 60676 - RNA, 64 nt, hsa; identical to SEQ ID NO: 44593

SEQ ID NO: 60677 - RNA, 64 nt, hsa; identical to SEQ ID NO: 44594

SEQ ID NO: 60678 - RNA, 64 nt, hsa; identical to SEQ ID NO: 44595

SEQ ID NO: 60679 - RNA, 64 nt, hsa; identical to SEQ ID NO: 44596

SEQ ID NO: 60680 - RNA, 64 nt, hsa; identical to SEQ ID NO: 44597

SEQ ID NO: 60681 - RNA, 64 nt, hsa; identical to SEQ ID NO: 44598

SEQ ID NO: 60682 - RNA, 64 nt, hsa; identical to SEQ ID NO: 44599

SEQ ID NO: 60683 - RNA, 64 nt, hsa; identical to SEQ ID NO: 44600

SEQ ID NO: 60684 - RNA, 64 nt, hsa; identical to SEQ ID NO: 44601

SEQ ID NO: 60685 - RNA, 64 nt, hsa; identical to SEQ ID NO: 44602

SEQ ID NO: 60686 - RNA, 64 nt, hsa; identical to SEQ ID NO: 44603

SEQ ID NO: 60687 - RNA, 64 nt, hsa; identical to SEQ ID NO: 44604

SEQ ID NO: 60688 - RNA, 64 nt, hsa; identical to SEQ ID NO: 44605

SEQ ID NO: 60689 - RNA, 64 nt, hsa; identical to SEQ ID NO: 44606

SEQ ID NO: 60690 - RNA, 64 nt, hsa; identical to SEQ ID NO: 44607

SEQ ID NO: 60691 - RNA, 64 nt, hsa; identical to SEQ ID NO: 44608

SEQ ID NO: 60692 - RNA, 64 nt, hsa; identical to SEQ ID NO: 44609

SEQ ID NO: 60693 - RNA, 64 nt, hsa; identical to SEQ ID NO: 44610

SEQ ID NO: 60694 - RNA, 56 nt, hsa; identical to SEQ ID NO: 44611

SEQ ID NO: 60695 - RNA, 64 nt, hsa; identical to SEQ ID NO: 44612

SEQ ID NO: 60696 - RNA, 64 nt, hsa; identical to SEQ ID NO: 44613

SEQ ID NO: 60697 - RNA, 64 nt, hsa; identical to SEQ ID NO: 44614

SEQ ID NO: 60698 - RNA, 64 nt, hsa; identical to SEQ ID NO: 44615

SEQ ID NO: 60699 - RNA, 64 nt, hsa; identical to SEQ ID NO: 44616

SEQ ID NO: 60700 - RNA, 64 nt, hsa; identical to SEQ ID NO: 44617

SEQ ID NO: 60701 - RNA, 64 nt, hsa; identical to SEQ ID NO: 44618

SEQ ID NO: 60702 - RNA, 64 nt, hsa; identical to SEQ ID NO: 44619

SEQ ID NO: 60703 - RNA, 64 nt, hsa; identical to SEQ ID NO: 44620

SEQ ID NO: 60704 - RNA, 64 nt, hsa; identical to SEQ ID NO: 44621

SEQ ID NO: 60705 - RNA, 64 nt, hsa; identical to SEQ ID NO: 44622

SEQ ID NO: 60706 - RNA, 64 nt, hsa; identical to SEQ ID NO: 44623

SEQ ID NO: 60707 - RNA, 64 nt, hsa; identical to SEQ ID NO: 44624

SEQ ID NO: 60708 - RNA, 64 nt, hsa; identical to SEQ ID NO: 44625

SEQ ID NO: 60709 - RNA, 64 nt, hsa; identical to SEQ ID NO: 44626

SEQ ID NO: 60710 - RNA, 64 nt, hsa; identical to SEQ ID NO: 44627

SEQ ID NO: 60711 - RNA, 64 nt, hsa; identical to SEQ ID NO: 44628

SEQ ID NO: 60712 - RNA, 64 nt, hsa; identical to SEQ ID NO: 44629

SEQ ID NO: 60713 - RNA, 64 nt, hsa; identical to SEQ ID NO: 44630

SEQ ID NO: 60714 - RNA, 64 nt, hsa; identical to SEQ ID NO: 44631

SEQ ID NO: 60715 - RNA, 64 nt, hsa; identical to SEQ ID NO: 44632

SEQ ID NO: 60716 - RNA, 64 nt, hsa; identical to SEQ ID NO: 44633

SEQ ID NO: 60717 - RNA, 64 nt, hsa; identical to SEQ ID NO: 44634

SEQ ID NO: 60718 - RNA, 64 nt, hsa; identical to SEQ ID NO: 44635

SEQ ID NO: 60719 - RNA, 64 nt, hsa; identical to SEQ ID NO: 44636

SEQ ID NO: 60720 - RNA, 64 nt, hsa; identical to SEQ ID NO: 44637

SEQ ID NO: 60721 - RNA, 64 nt, hsa; identical to SEQ ID NO: 44638

SEQ ID NO: 60722 - RNA, 64 nt, hsa; identical to SEQ ID NO: 44639

SEQ ID NO: 60723 - RNA, 64 nt, hsa; identical to SEQ ID NO: 44640

SEQ ID NO: 60724 - RNA, 64 nt, hsa; identical to SEQ ID NO: 44641

SEQ ID NO: 60725 - RNA, 64 nt, hsa; identical to SEQ ID NO: 44642

SEQ ID NO: 60726 - RNA, 64 nt, hsa; identical to SEQ ID NO: 44643

SEQ ID NO: 60727 - RNA, 64 nt, hsa; identical to SEQ ID NO: 44644

SEQ ID NO: 60728 - RNA, 64 nt, hsa; identical to SEQ ID NO: 44645

SEQ ID NO: 60729 - RNA, 64 nt, hsa; identical to SEQ ID NO: 44646

SEQ ID NO: 60730 - RNA, 64 nt, hsa; identical to SEQ ID NO: 44647

SEQ ID NO: 60731 - RNA, 64 nt, hsa; identical to SEQ ID NO: 44648

SEQ ID NO: 60732 - RNA, 64 nt, hsa; identical to SEQ ID NO: 44649

SEQ ID NO: 60733 - RNA, 64 nt, hsa; identical to SEQ ID NO: 44650

SEQ ID NO: 60734 - RNA, 64 nt, hsa; identical to SEQ ID NO: 44651

SEQ ID NO: 60735 - RNA, 64 nt, hsa; identical to SEQ ID NO: 44652

SEQ ID NO: 60736 - RNA, 64 nt, hsa; identical to SEQ ID NO: 44653

SEQ ID NO: 60737 - RNA, 64 nt, hsa; identical to SEQ ID NO: 44654

SEQ ID NO: 60738 - RNA, 64 nt, hsa; identical to SEQ ID NO: 44655

SEQ ID NO: 60739 - RNA, 64 nt, hsa; identical to SEQ ID NO: 44656

SEQ ID NO: 60740 - RNA, 64 nt, hsa; identical to SEQ ID NO: 44657

SEQ ID NO: 60741 - RNA, 64 nt, hsa; identical to SEQ ID NO: 44658

SEQ ID NO: 60742 - RNA, 64 nt, hsa; identical to SEQ ID NO: 44659

SEQ ID NO: 60743 - RNA, 64 nt, hsa; identical to SEQ ID NO: 44660

SEQ ID NO: 60744 - RNA, 64 nt, hsa; identical to SEQ ID NO: 44661

SEQ ID NO: 60745 - RNA, 64 nt, hsa; identical to SEQ ID NO: 44662

SEQ ID NO: 60746 - RNA, 64 nt, hsa; identical to SEQ ID NO: 44663

SEQ ID NO: 60747 - RNA, 64 nt, hsa; identical to SEQ ID NO: 44664

SEQ ID NO: 60748 - RNA, 64 nt, hsa; identical to SEQ ID NO: 44665

SEQ ID NO: 60749 - RNA, 64 nt, hsa; identical to SEQ ID NO: 44666

SEQ ID NO: 60750 - RNA, 64 nt, hsa; identical to SEQ ID NO: 44667

SEQ ID NO: 60751 - RNA, 64 nt, hsa; identical to SEQ ID NO: 44668

SEQ ID NO: 60752 - RNA, 64 nt, hsa; identical to SEQ ID NO: 44669

SEQ ID NO: 60753 - RNA, 64 nt, hsa; identical to SEQ ID NO: 44670

SEQ ID NO: 60754 - RNA, 64 nt, hsa; identical to SEQ ID NO: 44671

SEQ ID NO: 60755 - RNA, 64 nt, hsa; identical to SEQ ID NO: 44672

SEQ ID NO: 60756 - RNA, 64 nt, hsa; identical to SEQ ID NO: 44673

SEQ ID NO: 60757 - RNA, 64 nt, hsa; identical to SEQ ID NO: 44674

SEQ ID NO: 60758 - RNA, 64 nt, hsa; identical to SEQ ID NO: 44675

SEQ ID NO: 60759 - RNA, 64 nt, hsa; identical to SEQ ID NO: 44676

SEQ ID NO: 60760 - RNA, 64 nt, hsa; identical to SEQ ID NO: 44677

SEQ ID NO: 60761 - RNA, 64 nt, hsa; identical to SEQ ID NO: 44678

SEQ ID NO: 60762 - RNA, 64 nt, hsa; identical to SEQ ID NO: 44679

SEQ ID NO: 60763 - RNA, 64 nt, hsa; identical to SEQ ID NO: 44680

SEQ ID NO: 60764 - RNA, 64 nt, hsa; identical to SEQ ID NO: 44681

SEQ ID NO: 60765 - RNA, 64 nt, hsa; identical to SEQ ID NO: 44682

SEQ ID NO: 60766 - RNA, 64 nt, hsa; identical to SEQ ID NO: 44683

SEQ ID NO: 60767 - RNA, 64 nt, hsa; identical to SEQ ID NO: 44684

SEQ ID NO: 60768 - RNA, 64 nt, hsa; identical to SEQ ID NO: 44685

SEQ ID NO: 60769 - RNA, 64 nt, hsa; identical to SEQ ID NO: 44686

SEQ ID NO: 60770 - RNA, 64 nt, hsa; identical to SEQ ID NO: 44687

SEQ ID NO: 60771 - RNA, 64 nt, hsa; identical to SEQ ID NO: 44688

SEQ ID NO: 60772 - RNA, 64 nt, hsa; identical to SEQ ID NO: 44689

SEQ ID NO: 60773 - RNA, 64 nt, hsa; identical to SEQ ID NO: 44690

SEQ ID NO: 60774 - RNA, 64 nt, hsa; identical to SEQ ID NO: 44691

SEQ ID NO: 60775 - RNA, 64 nt, hsa; identical to SEQ ID NO: 44692

SEQ ID NO: 60776 - RNA, 64 nt, hsa; identical to SEQ ID NO: 44693

SEQ ID NO: 60777 - RNA, 64 nt, hsa; identical to SEQ ID NO: 44694

SEQ ID NO: 60778 - RNA, 64 nt, hsa; identical to SEQ ID NO: 44695

SEQ ID NO: 60779 - RNA, 64 nt, hsa; identical to SEQ ID NO: 44696

SEQ ID NO: 60780 - RNA, 64 nt, hsa; identical to SEQ ID NO: 44697

SEQ ID NO: 60781 - RNA, 64 nt, hsa; identical to SEQ ID NO: 44698

SEQ ID NO: 60782 - RNA, 64 nt, hsa; identical to SEQ ID NO: 44699

SEQ ID NO: 60783 - RNA, 64 nt, hsa; identical to SEQ ID NO: 44700

SEQ ID NO: 60784 - RNA, 64 nt, hsa; identical to SEQ ID NO: 44701

SEQ ID NO: 60785 - RNA, 64 nt, hsa; identical to SEQ ID NO: 44702

SEQ ID NO: 60786 - RNA, 64 nt, hsa; identical to SEQ ID NO: 44703

SEQ ID NO: 60787 - RNA, 64 nt, hsa; identical to SEQ ID NO: 44704

SEQ ID NO: 60788 - RNA, 64 nt, hsa; identical to SEQ ID NO: 44705

SEQ ID NO: 60789 - RNA, 64 nt, hsa; identical to SEQ ID NO: 44706

SEQ ID NO: 60790 - RNA, 64 nt, hsa; identical to SEQ ID NO: 44707

SEQ ID NO: 60791 - RNA, 64 nt, hsa; identical to SEQ ID NO: 44708

SEQ ID NO: 60792 - RNA, 64 nt, hsa; identical to SEQ ID NO: 44709

SEQ ID NO: 60793 - RNA, 64 nt, hsa; identical to SEQ ID NO: 44710

SEQ ID NO: 60794 - RNA, 64 nt, hsa; identical to SEQ ID NO: 44711

SEQ ID NO: 60795 - RNA, 64 nt, hsa; identical to SEQ ID NO: 44712

SEQ ID NO: 60796 - RNA, 64 nt, hsa; identical to SEQ ID NO: 44713

SEQ ID NO: 60797 - RNA, 64 nt, hsa; identical to SEQ ID NO: 44714

SEQ ID NO: 60798 - RNA, 64 nt, hsa; identical to SEQ ID NO: 44715

SEQ ID NO: 60799 - RNA, 64 nt, hsa; identical to SEQ ID NO: 44716

SEQ ID NO: 60800 - RNA, 64 nt, hsa; identical to SEQ ID NO: 44717

SEQ ID NO: 60801 - RNA, 64 nt, hsa; identical to SEQ ID NO: 44718

SEQ ID NO: 60802 - RNA, 64 nt, hsa; identical to SEQ ID NO: 44719

SEQ ID NO: 60803 - RNA, 64 nt, hsa; identical to SEQ ID NO: 44720

SEQ ID NO: 60804 - RNA, 64 nt, hsa; identical to SEQ ID NO: 44721

SEQ ID NO: 60805 - RNA, 64 nt, hsa; identical to SEQ ID NO: 44722

SEQ ID NO: 60806 - RNA, 64 nt, hsa; identical to SEQ ID NO: 44723

SEQ ID NO: 60807 - RNA, 64 nt, hsa; identical to SEQ ID NO: 44724

SEQ ID NO: 60808 - RNA, 64 nt, hsa; identical to SEQ ID NO: 44725

SEQ ID NO: 60809 - RNA, 64 nt, hsa; identical to SEQ ID NO: 44726

SEQ ID NO: 60810 - RNA, 64 nt, hsa; identical to SEQ ID NO: 44727

SEQ ID NO: 60811 - RNA, 64 nt, hsa; identical to SEQ ID NO: 44728

SEQ ID NO: 60812 - RNA, 64 nt, hsa; identical to SEQ ID NO: 44729

SEQ ID NO: 60813 - RNA, 64 nt, hsa; identical to SEQ ID NO: 44730

SEQ ID NO: 60814 - RNA, 64 nt, hsa; identical to SEQ ID NO: 44731

SEQ ID NO: 60815 - RNA, 64 nt, hsa; identical to SEQ ID NO: 44732

SEQ ID NO: 60816 - RNA, 64 nt, hsa; identical to SEQ ID NO: 44733

SEQ ID NO: 60817 - RNA, 64 nt, hsa; identical to SEQ ID NO: 44734

SEQ ID NO: 60818 - RNA, 64 nt, hsa; identical to SEQ ID NO: 44735

SEQ ID NO: 60819 - RNA, 64 nt, hsa; identical to SEQ ID NO: 44736

SEQ ID NO: 60820 - RNA, 64 nt, hsa; identical to SEQ ID NO: 44737

SEQ ID NO: 60821 - RNA, 64 nt, hsa; identical to SEQ ID NO: 44738

SEQ ID NO: 60822 - RNA, 64 nt, hsa; identical to SEQ ID NO: 44739

SEQ ID NO: 60823 - RNA, 64 nt, hsa; identical to SEQ ID NO: 44740

SEQ ID NO: 60824 - RNA, 64 nt, hsa; identical to SEQ ID NO: 44741

SEQ ID NO: 60825 - RNA, 64 nt, hsa; identical to SEQ ID NO: 44742

SEQ ID NO: 60826 - RNA, 64 nt, hsa; identical to SEQ ID NO: 44743

SEQ ID NO: 60827 - RNA, 64 nt, hsa; identical to SEQ ID NO: 44744

SEQ ID NO: 60828 - RNA, 64 nt, hsa; identical to SEQ ID NO: 44745

SEQ ID NO: 60829 - RNA, 64 nt, hsa; identical to SEQ ID NO: 44746

SEQ ID NO: 60830 - RNA, 64 nt, hsa; identical to SEQ ID NO: 44747

SEQ ID NO: 60831 - RNA, 64 nt, hsa; identical to SEQ ID NO: 44748

SEQ ID NO: 60832 - RNA, 64 nt, hsa; identical to SEQ ID NO: 44749

SEQ ID NO: 60833 - RNA, 64 nt, hsa; identical to SEQ ID NO: 44750

SEQ ID NO: 60834 - RNA, 64 nt, hsa; identical to SEQ ID NO: 44751

SEQ ID NO: 60835 - RNA, 64 nt, hsa; identical to SEQ ID NO: 44752

SEQ ID NO: 60836 - RNA, 64 nt, hsa; identical to SEQ ID NO: 44753

SEQ ID NO: 60837 - RNA, 64 nt, hsa; identical to SEQ ID NO: 44754

SEQ ID NO: 60838 - RNA, 64 nt, hsa; identical to SEQ ID NO: 44755

SEQ ID NO: 60839 - RNA, 64 nt, hsa; identical to SEQ ID NO: 44756

SEQ ID NO: 60840 - RNA, 64 nt, hsa; identical to SEQ ID NO: 44757

SEQ ID NO: 60841 - RNA, 64 nt, hsa; identical to SEQ ID NO: 44758

SEQ ID NO: 60842 - RNA, 64 nt, hsa; identical to SEQ ID NO: 44759

SEQ ID NO: 60843 - RNA, 64 nt, hsa; identical to SEQ ID NO: 44760

SEQ ID NO: 60844 - RNA, 64 nt, hsa; identical to SEQ ID NO: 44761

SEQ ID NO: 60845 - RNA, 64 nt, hsa; identical to SEQ ID NO: 44762

SEQ ID NO: 60846 - RNA, 64 nt, hsa; identical to SEQ ID NO: 44763

SEQ ID NO: 60847 - RNA, 64 nt, hsa; identical to SEQ ID NO: 44764

SEQ ID NO: 60848 - RNA, 64 nt, hsa; identical to SEQ ID NO: 44765

SEQ ID NO: 60849 - RNA, 64 nt, hsa; identical to SEQ ID NO: 44766

SEQ ID NO: 60850 - RNA, 64 nt, hsa; identical to SEQ ID NO: 44767

SEQ ID NO: 60851 - RNA, 64 nt, hsa; identical to SEQ ID NO: 44768

SEQ ID NO: 60852 - RNA, 64 nt, hsa; identical to SEQ ID NO: 44769

SEQ ID NO: 60853 - RNA, 64 nt, hsa; identical to SEQ ID NO: 44770

SEQ ID NO: 60854 - RNA, 64 nt, hsa; identical to SEQ ID NO: 44771

SEQ ID NO: 60855 - RNA, 64 nt, hsa; identical to SEQ ID NO: 44772

SEQ ID NO: 60856 - RNA, 64 nt, hsa; identical to SEQ ID NO: 44773

SEQ ID NO: 60857 - RNA, 64 nt, hsa; identical to SEQ ID NO: 44774

SEQ ID NO: 60858 - RNA, 64 nt, hsa; identical to SEQ ID NO: 44775

SEQ ID NO: 60859 - RNA, 64 nt, hsa; identical to SEQ ID NO: 44776

SEQ ID NO: 60860 - RNA, 57 nt, hsa; identical to SEQ ID NO: 44777

SEQ ID NO: 60861 - RNA, 64 nt, hsa; identical to SEQ ID NO: 44778

SEQ ID NO: 60862 - RNA, 64 nt, hsa; identical to SEQ ID NO: 44779

SEQ ID NO: 60863 - RNA, 64 nt, hsa; identical to SEQ ID NO: 44780

SEQ ID NO: 60864 - RNA, 64 nt, hsa; identical to SEQ ID NO: 44781

SEQ ID NO: 60865 - RNA, 64 nt, hsa; identical to SEQ ID NO: 44782

SEQ ID NO: 60866 - RNA, 64 nt, hsa; identical to SEQ ID NO: 44783

SEQ ID NO: 60867 - RNA, 64 nt, hsa; identical to SEQ ID NO: 44784

SEQ ID NO: 60868 - RNA, 64 nt, hsa; identical to SEQ ID NO: 44785

SEQ ID NO: 60869 - RNA, 64 nt, hsa; identical to SEQ ID NO: 44786

SEQ ID NO: 60870 - RNA, 64 nt, hsa; identical to SEQ ID NO: 44773

SEQ ID NO: 60871 - RNA, 64 nt, hsa; identical to SEQ ID NO: 44788

SEQ ID NO: 60872 - RNA, 63 nt, hsa
uuucauacccuuguaaguggguuaugugguggguauggucaguuuuuucuuuuuucuuuucuu

SEQ ID NO: 60873 - RNA, 63 nt, hsa
gccaccacgccuggccaguuucuucauuuuacauauggucacauuggcgccuagaacaguuag

SEQ ID NO: 60874 - RNA, 63 nt, hsa
aacuuccucuaaggauaauguauaaucauaguauauggucaaguccaagaaaucgauguuacc

SEQ ID NO: 60875 - RNA, 63 nt, hsa
accaaaaaugaaagaggccaucacagcuaauccuauggucaccaaaaggauuagaaagaaaca

SEQ ID NO: 60876 - RNA, 63 nt, hsa
accaaaagugaaagaggccaucauagcugauccuauggucaccaaaaggauuagaaagaaaua

SEQ ID NO: 60877 - RNA, 63 nt, hsa
agcuuccucuaaggauaauauauaaucauaguauauggucaaguccaagaaaucgauguuacc

SEQ ID NO: 60878 - RNA, 64 nt, hsa
aaauccaguuuccauggcccuggauggucuggcccaccuccagccucagcuagcauuacccuuc

SEQ ID NO: 60879 - RNA, 64 nt, hsa
ggcaacagaauuugaauaucuaggauaggaugaucaccuccaguccuucggacuuaaaccugcc

SEQ ID NO: 60880 - RNA, 64 nt, hsa
acgcccauguuugcagcugauacuuguuugggcacaccuccaaguucucgggauuagaaggaca

SEQ ID NO: 60881 - RNA, 64 nt, hsa
gaggcaauucacuugccagcacagauggccaacccaccuccagauuccccagugcuuccacacc

SEQ ID NO: 60882 - RNA, 64 nt, hsa
aacaccucaucauccuucucaucgcuaacaccaccaccuccaucggcacccaagcgggcaucau

SEQ ID NO: 60883 - RNA, 64 nt, hsa
ucugggucccagaccuggcccgaccccucugcuucaccuccagcucugcugcuccucuacucuu

SEQ ID NO: 60884 - RNA, 64 nt, hsa
gucagaggagguguggucagaggugacuuguucccaccuccagggaggacgcuucgucuucggc

SEQ ID NO: 60885 - RNA, 64 nt, hsa
uccacacccacaagcuaccuggagggacaggacccaccuccauccuucggaaggccuuccugga

SEQ ID NO: 60886 - RNA, 64 nt, hsa
ggccagggccaugcagauggaggccucugggagccaccuccaaucccucaccacucacucaacc

SEQ ID NO: 60887 - RNA, 64 nt, hsa
aggaauugagcucaugaagcaggcaaggaccgaacaccuccaccccaacguagaccugcaggug

SEQ ID NO: 60888 - RNA, 64 nt, hsa
aauuaagauuuuuacuucaucuuucuugggccugcaccuccaagauaacaaagaagaagcaaug

SEQ ID NO: 60889 - RNA, 64 nt, hsa
acccagagcuuaagccacaguccugcucaggcuacaccuccaagggugggaccaggcccaccuu

SEQ ID NO: 60890 - RNA, 64 nt, hsa
aucaauucaucaguaaggucagaugcuguuugcacaccuccagcaauagggugcucacugccuc

SEQ ID NO: 60891 - RNA, 64 nt, hsa
gccaucggguagcgauggucuaugccauggggaacaccuccauugguguggccaagcugccccc

SEQ ID NO: 60892 - RNA, 64 nt, hsa
cuucccagcccugagaccacuggucacaguuggccaccuccaacgggagaccuuguccuuggcc

SEQ ID NO: 60893 - RNA, 64 nt, hsa
cagcacaccggugcuggccacaccagcccccuuucaccuccagugccacaauaaaccuguaccc

SEQ ID NO: 60894 - RNA, 64 nt, hsa
gccagccggccacgcccacgccgcugcagagccgcaccuccauugugcaggcagcugccggagg

SEQ ID NO: 60895 - RNA, 64 nt, hsa
aaagugccaagccauuugugaaggcucugccagacaccuccaagcuugagagcucagcaccaug

SEQ ID NO: 60896 - RNA, 64 nt, hsa
caguucauauaccugccugagauaggcugguccucaccuccagagccagccagccccgucaggg

SEQ ID NO: 60897 - RNA, 64 nt, hsa
cuuagagcgagagcagagcaaacugcgcagcaggcaccuccagaaagguaaugguggcagaacc

SEQ ID NO: 60898 - RNA, 64 nt, hsa
guguucuuagaauucgcauuuugccagcucagcgcaccuccacaacgaaugaaaugcuccguau

SEQ ID NO: 60899 - RNA, 64 nt, hsa
auggaagggggugccucucggaggagccuguguccaccuccagucucggcuuuccccggggggc

SEQ ID NO: 60900 - RNA, 64 nt, hsa
ggccaggugccugaggacagcacugaaggccgugcaccuccaccuccagccuccagucaccuca

SEQ ID NO: 60901 - RNA, 64 nt, hsa
gugccugaggacagcacugaaggccgugcaccuccaccuccagccuccagucaccucaccuagc

SEQ ID NO: 60902 - RNA, 64 nt, hsa
uggacaaggccagaccaaagcaagcagggccuggcaccuccauccugaggugcugccccuccau

SEQ ID NO: 60903 - RNA, 64 nt, hsa
cccagagcugcccaaguucacugggcuccacccccaccuccaggaggggaggagaggaccugac

SEQ ID NO: 60904 - RNA, 64 nt, hsa
caggcagggccucucaguccuugugggucugugucaccuccaucucagucuuggccuggcuaug

SEQ ID NO: 60905 - RNA, 64 nt, hsa
ccaggaaggcugugugggucuggagcccacgucccaccuccacacccuuggcuugggcccaugc

SEQ ID NO: 60906 - RNA, 64 nt, hsa
ggacaucuucugagccaggacgucccugaggcuccaccuccaagcucagacagggcccaggcuu

SEQ ID NO: 60907 - RNA, 64 nt, hsa
cuucuugauggguacaggcugaguggggcgcccucaccuccagccagccucuuccugcagagga

SEQ ID NO: 60908 - RNA, 64 nt, hsa
aaguguucagaagguucuuuuuuauauuguccuccaccuccaucauuuucaauaaaagauaggg

SEQ ID NO: 60909 - RNA, 64 nt, hsa
uuccuagaccucauggcuguccccucccaccagucaccuccacugcacaacucgggcgggggug

SEQ ID NO: 60910 - RNA, 64 nt, hsa
gaccucaacccugaaccccucccauucaacuccccaccuccagccgggacccaggcguccgggc

SEQ ID NO: 60911 - RNA, 64 nt, hsa
guggcagcgcccaggagggcauagggcagccuaccaccuccaagggggcaggcgcccucaucug

SEQ ID NO: 60912 - RNA, 64 nt, hsa
auggaagguggcugcaugccaaggggaggagcgacaccuccaggcuuccgggagcccagagagc

SEQ ID NO: 60913 - RNA, 64 nt, hsa
uggcuucuuuuaaguacccccuuuccuccucacccaccuccaaacugacuagcacucagaggga

SEQ ID NO: 60914 - RNA, 64 nt, hsa
cacauaucacuuuagcccuaacaagggcuccucccaccuccaccuguugccccaguugaaaagc

SEQ ID NO: 60915 - RNA, 64 nt, hsa
ucccucauuugcacugcucuguaagccucccccucaccuccauucauaacccagucucaaugcc

SEQ ID NO: 60916 - RNA, 64 nt, hsa
gaggcagggucaggccucagcaucucacauccaccaccuccaggaggggagaccacugguaagu

SEQ ID NO: 60917 - RNA, 64 nt, hsa
cuccuggcccccgccuuccacgcccuuccgauuccaccuccaccuccaccucccccugccacag

SEQ ID NO: 60918 - RNA, 64 nt, hsa
gcccccgccuuccacgcccuuccgauuccaccuccaccuccaccucccccugccacagagggga

SEQ ID NO: 60919 - RNA, 64 nt, hsa
uggggacaggauuugccaguucacccacagaucacaccuccauccccaaagagguagcacugca

SEQ ID NO: 60920 - RNA, 64 nt, hsa
ucagcagaccaggcccugucccuaccuggagccucaccuccaaggaaauucauguucuccuuaa

SEQ ID NO: 60921 - RNA, 64 nt, hsa
accugccccacucaccaccucugcuaguuccagacaccuccacgcccaccugguccucucccau

SEQ ID NO: 60922 - RNA, 64 nt, hsa
agucucccccgaccccgggucccagguaugcucccaccuccaccugccccacucaccaccucug

SEQ ID NO: 60923 - RNA, 64 nt, hsa
aggggccagccugccuccaccucccacccccuuccaccuccaucagucaugugugcagagucag

SEQ ID NO: 60924 - RNA, 64 nt, hsa
gcugcuggaaggggagagguucucagcaucaggccaccuccaccccaaugccaggauagaugua

SEQ ID NO: 60925 - RNA, 64 nt, hsa
aucccaacucacccccaaacccccaucccuuccccaccuccagcaguauuacuuguaacgcaau

SEQ ID NO: 60926 - RNA, 64 nt, hsa
cgcuuuugcaugcccgggcgaggaccgaagcacacaccuccacgcgcacgggcccuggcccccu

SEQ ID NO: 60927 - RNA, 64 nt, hsa
cacccagugccucaccuccagauccugcuggcaucaccuccagagcccugcaugcacuggcuga

SEQ ID NO: 60928 - RNA, 64 nt, hsa
caucuccgggugucugagaaaccacccagugccucaccuccagauccugcuggcaucaccucca

SEQ ID NO: 60929 - RNA, 64 nt, hsa
cacccacccagcccaguucuaggucguuccccagcaccuccagguuggcccacacagguaccau

SEQ ID NO: 60930 - RNA, 64 nt, hsa
aggcuggcccaacggacagacaggaccaggaucacaccuccaggcgccucugguuggacauucc

SEQ ID NO: 60931 - RNA, 64 nt, hsa
acuggcaaucuggacucgauggagaacauccccccaccuccauuuggcacuacccaaguggagu

SEQ ID NO: 60932 - RNA, 64 nt, hsa
uuugccccauuuccccaguccaguggacaugccccaccuccagacuugcucaugggagaaggcu

SEQ ID NO: 60933 - RNA, 64 nt, hsa
ucugcaacucuagcccuauauccagaagccugcccaccuccacccauucuguuugccccauuuc

SEQ ID NO: 60934 - RNA, 64 nt, hsa
gaaaacaaaguauugcuaaguacuauaacauauuggccacuaaaauucauauugagauuaucuu

SEQ ID NO: 60935 - RNA, 64 nt, hsa
gaggcuucaucaggcuguggugggcggggguguuggccacuaggcaaugguaugggcagggcuu

SEQ ID NO: 60936 - RNA, 64 nt, hsa
uuaagaagacuuagauucauuuauugcuaucugaggccacuagugagauuucagaucucucuuu

SEQ ID NO: 60937 - RNA, 64 nt, hsa
cucccaccuguauguccagcaaacucuugcauguggccacuaggaggaauguguaagaauguuc

SEQ ID NO: 60938 - RNA, 64 nt, hsa
ggcucugguuugagaucgugcuggggaggaacauggccacuaccccuuaucccaucggccaugu

SEQ ID NO: 60939 - RNA, 64 nt, hsa
cccucugagagaugauguccugcccaggcccgauggccacuaggacccugcaagcaacucugcu

SEQ ID NO: 60940 - RNA, 64 nt, hsa
aacccggacugcugcccguccucucccugcuccaggccacuaggccucccuugcagccaacucu

SEQ ID NO: 60941 - RNA, 64 nt, hsa
uugguccagauugaaaaguguccucuggcugaguggccacuaggcccagacccagcccagccug

SEQ ID NO: 60942 - RNA, 64 nt, hsa
gaauuccaggguugagagacuccccugagccagaggccacuagguauucuugcucccagaggcu

SEQ ID NO: 60943 - RNA, 64 nt, hsa
aacuauaugucuggucccuugcugcucuuguuuaggccacuaucauagauauauuucaaauauu

SEQ ID NO: 60944 - RNA, 64 nt, hsa
gguacuccuucucccagcccuguccucauccuagggccacuaggggaugaaggacccaucucaa

SEQ ID NO: 60945 - RNA, 64 nt, hsa
aauuuaagcaagaaauauuuuaauauagugaaauggccacuacuuuaaguauacaaucuuuaaa

SEQ ID NO: 60946 - RNA, 64 nt, hsa
gugucugugggagcgggcacagguccaugcugcaggccacuacggcugcucggcaggagggccg

SEQ ID NO: 60947 - RNA, 64 nt, hsa
uuuuuggaguccacuuaacuccccugcuuuccuaggccacuacuuuauacuuucucucuucugu

SEQ ID NO: 60948 - RNA, 64 nt, hsa
gguuuuuguucaagagccaggaccaaggcccuugggccacuacccugcuaggcucuggagcugu

SEQ ID NO: 60949 - RNA, 64 nt, hsa
gaauuuuuacagauauuucagaucagugguguugggccacuauuguuaccucaaauuuauuuuu

SEQ ID NO: 60950 - RNA, 64 nt, hsa
acggguguggcccuggauguggugguuuucccuuggccacuagcccaucuucaaugaccccuua

SEQ ID NO: 60951 - RNA, 64 nt, hsa
acauccuaggucuaagaguugaacgccucuccuaggccacuacaaacugaccccucagcagggc

SEQ ID NO: 60952 - RNA, 64 nt, hsa
aaaaugcacaaagaagaaggcagugcuguuacuuggccacuaagauguguaaaauggacugaaa

SEQ ID NO: 60953 - RNA, 64 nt, hsa
aaccauuacuaagagaaugcaacaggauacaaauggccacuagaggucauuauuucuuucuuuc

SEQ ID NO: 60954 - RNA, 64 nt, hsa
aaccaucaguguccacuauuuguuaccagaguugggccacuaucuuuuaaaauugcuggugaaa

SEQ ID NO: 60955 - RNA, 64 nt, hsa
uuucugaucacacagaauugagaaagaucucuuaggccacuaguuacuaguuguuuguugagau

SEQ ID NO: 60956 - RNA, 64 nt, hsa
uuuuauucaggaccuaguaucugcaguccauguuggccacuaacugcuacauaauuacuuucaa

SEQ ID NO: 60957 - RNA, 64 nt, hsa
ugccuucauugugaggaagggugcuccaagucacggccacuagguugucuucacccauguauuu

SEQ ID NO: 60958 - RNA, 64 nt, hsa
ugaaaagaaaaaucacagaagagagaaugcaaauggccacuaaguauaugaaaaaagucguauc

SEQ ID NO: 60959 - RNA, 64 nt, hsa
accuuccugcugagccucacagcagugagacuggggccacuacauuugcuccauccuccuggga

SEQ ID NO: 60960 - RNA, 64 nt, hsa
aacaacuucugccaucuucuggggccuguacacuggccacuaguagcugccauaucuuuuuccc

SEQ ID NO: 60961 - RNA, 64 nt, hsa
cuagaucguuuccugacagagaagccuucuuccaggccacuaagguagcauguuauccacugug

SEQ ID NO: 60962 - RNA, 64 nt, hsa
ccccuccccccauuuacaugcaugcaaucagacaggccacuaagguaaaagagucugcucuauc

SEQ ID NO: 60963 - RNA, 64 nt, hsa
gagcugaauuuucuggaaaaugcuucuuggcuggggccacuaccuccuuuccuaucuuuacauc

SEQ ID NO: 60964 - RNA, 64 nt, hsa
gagcugccuaggaucagagagccuucauggaaguggccacuacguggggaucccuucagagaua

SEQ ID NO: 60965 - RNA, 64 nt, hsa
gguaauaacacaucuuaguauuaagaguuuuacaggccacuaguauaagauaggcaucguggua

SEQ ID NO: 60966 - RNA, 64 nt, hsa
aaguccagccagcgugcagcugcauccagaaaccggccacuacccagcccaucucugccugugc

SEQ ID NO: 60967 - RNA, 64 nt, hsa
uuaacuggaggucccagcacauguguuuucaagaggccacuaggcauucuucacugagugcugc

SEQ ID NO: 60968 - RNA, 64 nt, hsa
ccacccacucccacaccuagcccagaaugcuguaggccacuaggcgcaggggcaucucuccccu

SEQ ID NO: 60969 - RNA, 64 nt, hsa
auacaccuguagcccuggagaggcccucuggaguggccacuaagcagaggaggggccgcugcca

SEQ ID NO: 60970 - RNA, 64 nt, hsa
agggcugcuucugugaguucucagccuaggcuguggccacuaagacguggguggggggauagac

SEQ ID NO: 60971 - RNA, 64 nt, hsa
gucaaaaaaaaaaaaaaaauuaauagauaaaacaggccacuagagggugcaguuauaaagaaau

SEQ ID NO: 60972 - RNA, 64 nt, hsa
acauuccucuucuggggcuucagaaagcuggcaaggccacuagcagagcuuuuguuaaugcccc

SEQ ID NO: 60973 - RNA, 64 nt, hsa
uauagaggucuuuggacucuaaagaccaauguuuggccacuaacuggacuaauauguaucuuuc

SEQ ID NO: 60974 - RNA, 64 nt, hsa
auauauuacguuuuuguuauuaaaaaacuucauuggccacuagugaaguuagucaauaaaagac

SEQ ID NO: 60975 - RNA, 64 nt, hsa
uguguauuagauaucaauguuaaugauaugucuuggccacuauggaccagggagcuuauuuuuc

SEQ ID NO: 60976 - RNA, 64 nt, hsa
gcccugccccgacaccagaacccuggugcuggugggccacuagcgucugcagccuaagcaggug

SEQ ID NO: 60977 - RNA, 64 nt, hsa
cagugaacucccuugggucaagacaguacucaacggccacuaccuccacgcuucccagagccug

SEQ ID NO: 60978 - RNA, 64 nt, hsa
ccaggugaugacugcaaagcaguguccaggagcaggccacuacugcccagagagcagaggagga

SEQ ID NO: 60979 - RNA, 64 nt, hsa
gcccccaccucgaaacccacaguccccaguggagggccacuacucauccccauugguuucccag

SEQ ID NO: 60980 - RNA, 64 nt, hsa
uucaggucuucuucacagccugcacugcccagugggccacuaggggcagucucuggaagggcug

SEQ ID NO: 60981 - RNA, 64 nt, hsa
cagaugaggugaagaucacugucaucuaaaagcuggccacuaaauuaaaaaaaaauuaaaaguu

SEQ ID NO: 60982 - RNA, 64 nt, hsa
ggcuaacugaugaauuagaagccaucugacagcaggccacuagugacaguuucuuuuguguucc

SEQ ID NO: 60983 - RNA, 64 nt, hsa
cuacccaaaugcuacagagaaauguuuucuacuuggccacuaucaggguucgucaucuauugug

SEQ ID NO: 60984 - RNA, 64 nt, hsa
aacccuucucacccuguggguuggagccgagucaggccacuauggggaagcaguugccccacaa

SEQ ID NO: 60985 - RNA, 64 nt, hsa
cacucuggguaccaaauuuaagcaagauauugauggccacuaaguguguauccagaagaagaga

SEQ ID NO: 60986 - RNA, 64 nt, hsa
auuuucuuuucaacuugaaagaaacuggacauuaggccacuauguguuguuacugccacuagug

SEQ ID NO: 60987 - RNA, 64 nt, hsa
aaaacucuugguuuuguuuuuuuggaaaugagugggccacuaagccacacuuucccuucauccu

SEQ ID NO: 60988 - RNA, 64 nt, hsa
gagagaacagcccauaaugcuccccgggagcagaggccacuaauggagagugggaagagccugg

SEQ ID NO: 60989 - RNA, 64 nt, hsa
ucacaaagcaguggggcaugagcuguguuucaggggccacuaaauaacagcugguacugacccc

SEQ ID NO: 60990 - RNA, 64 nt, hsa
cguuaccuacuguugucauuguuauuacagcuauggccacuauuauuaaagagcuguguaacau

SEQ ID NO: 60991 - RNA, 64 nt, hsa
cuuuaaacucugcacaagcaaguguguagcuuaaggccacuacugguaaggaaaccaagugucc

SEQ ID NO: 60992 - RNA, 64 nt, hsa
agaaauguggggucugaggaagccauuugagucuggccacuagacaucucaucagccacuugug

SEQ ID NO: 60993 - RNA, 64 nt, hsa
cuuucuucacuguguucaagugucauagcuaucaggccacuaucauggauaucauguauccuuc

SEQ ID NO: 60994 - RNA, 64 nt, hsa
uucauuccuguuuuucuuggcaggagagaagcaaggccacuaaaagaggagaugguggagacgg

SEQ ID NO: 60995 - RNA, 64 nt, hsa
ucagaaccucucaacccaacaaggcuggcuucagggccacuauggaacccugcuguucccccuu

SEQ ID NO: 60996 - RNA, 64 nt, hsa
agucuuuguugguuagaggacugccugugauccuggccacuaggccaagaggcccuaugaaggu

SEQ ID NO: 60997 - RNA, 64 nt, hsa
ggagaucuuccccuaaccuuugggccaauuuacuggccacuaauuucguuuaaauaccauugug

SEQ ID NO: 60998 - RNA, 64 nt, hsa
aaagggugugaaguagaggugcaguuaaguggggggccacuagucuaacagacggucacaacca

SEQ ID NO: 60999 - RNA, 64 nt, hsa
gaaaggcauuugccuucauaaggaucaagguucaggccacuacauguaaaaacuaugcaagugu

SEQ ID NO: 61000 - RNA, 64 nt, hsa
guuuacgguuucuuauaacucuccuuugcucucuggccacuauuaaguggguuugccccaucac

SEQ ID NO: 61001 - RNA, 64 nt, hsa
ggcccuggucaccuccagacagcugccuggccggggccacuaggcugcggcuggccacuguguc

SEQ ID NO: 61002 - RNA, 64 nt, hsa
uaguuaaagaacauaaguggaugauggcauuugaggccacuagugaaaguauguuuucucuaaa

SEQ ID NO: 61003 - RNA, 64 nt, hsa
augucggcuaccgugucuggccguucacaucuuuggccacuauuugcuugugaaaagguauaau

SEQ ID NO: 61004 - RNA, 64 nt, hsa
uauucucucauaucccugaaauauaaaaguaaguggccacuauuccuaagauuauuuaguuuau

SEQ ID NO: 61005 - RNA, 64 nt, hsa
auuucccugacccugccuucugccaugaccccagggccacuagucucuuccccuguuuuuaagu

SEQ ID NO: 61006 - RNA, 64 nt, hsa
uguaccaagaaaaaauuagucaccugaguaacuuggccacuaauaauuaaccaucuaccucugu

SEQ ID NO: 61007 - RNA, 64 nt, hsa
gcuuucuuggauauaaccaugaucagagugccauggccacuaccccacuguuugcucuccugca

SEQ ID NO: 61008 - RNA, 64 nt, hsa
ccuucuaguucaggacuccuguucuucccagcauggccacuauuuugaugauggcugaugugug

SEQ ID NO: 61009 - RNA, 64 nt, hsa
agucucacuugggacaggccacagccagggguccggccacuacccgcccgugggauaaaagcca

SEQ ID NO: 61010 - RNA, 64 nt, hsa
uccuuccgggccugagcugcccaucugccuagccggccacuagggcaccaucuucucaagggcu

SEQ ID NO: 61011 - RNA, 64 nt, hsa
auuugcauuccaucccuugggagggaguccucagggccacuagugaugagccaagaggaguggg

SEQ ID NO: 61012 - RNA, 64 nt, hsa; identical to SEQ ID NO: 61009

SEQ ID NO: 61013 - RNA, 64 nt, hsa
cuccaggcacuggugagagacaugaacacugacuggccacuagcuggccuggcccuguugaguc

SEQ ID NO: 61014 - RNA, 64 nt, hsa
uugaauugucuuuauuaacaaacaggauauccaaggccacuacauugaggaggggggagggggg

SEQ ID NO: 61015 - RNA, 64 nt, hsa
gggccugacacccccuccccgccccuguggcccuggccacuaaagcuucagacucaaguaccca

SEQ ID NO: 61016 - RNA, 64 nt, hsa
agaggucacagucacgaagcucaugguagacugaggccacuaaacacccgucuccugauuuuca

SEQ ID NO: 61017 - RNA, 64 nt, hsa
cuucaguaugaaaccaguuuccuugugcgaugauggccacuaaagcauaguacguggaugucag

SEQ ID NO: 61018 - RNA, 64 nt, hsa
agggacgcgcgucugcccaggcgggucuuugcggggccacuaggcacauggcgaauuuggcugc

SEQ ID NO: 61019 - RNA, 64 nt, hsa
uccccccugcccauggaguagagcccgagauccuggccacuaugccaguucugaccucgcaucc

SEQ ID NO: 61020 - RNA, 64 nt, hsa
guuuguuuguuuuuaaucugccuuaaugagcucaggccacuaucacaaaauaccacagaccaaa

SEQ ID NO: 61021 - RNA, 64 nt, hsa
acagagacgugaugugggaaaccuucaggaaccuggccacuauagguaaaaaugaaaucauucc

SEQ ID NO: 61022 - RNA, 64 nt, hsa
acccaccucagccucccaaagugcugggauuacaggccacuacaccuggcacauuugaguauuu

SEQ ID NO: 61023 - RNA, 64 nt, hsa
aaguuguucugcauaucauuguucuguuuuuauuggccacuaauaaucuaugauacgaauauac

SEQ ID NO: 61024 - RNA, 64 nt, hsa
gugacccaugacccacagugcuggccuccuguggggccacuauagcagccaccagaagccgcga

SEQ ID NO: 61025 - RNA, 64 nt, hsa
cugggccugagcugggugccccgucgcccucccaggccacuaggcucugacucuuccagcaccc

SEQ ID NO: 61026 - RNA, 64 nt, hsa
gugcaucaaccaggaagaguucuauccccaagcuggccacuaucacauaugcuuacucuugcuu

SEQ ID NO: 61027 - RNA, 64 nt, hsa
uccgaugaaggcagccccugcccuggcaugggggggccacuagaugcaccugggagcccccugg

SEQ ID NO: 61028 - RNA, 64 nt, hsa
acagacaaaaugcauuacaccuguaguguaaaguggccacuaugaaucccuauguaugagagga

SEQ ID NO: 61029 - RNA, 64 nt, hsa
ucaaccuuaccccaccccucuguuaauuugaaagggccacuauugcugaguggaugaguuuuuu

SEQ ID NO: 61030 - RNA, 64 nt, hsa
uuagaccaggcaggcaaaggcccccaucacacucggccacuagugggguccugaggccaagaaa

SEQ ID NO: 61031 - RNA, 64 nt, hsa
accccuucauagcugcauuuaaaaaugguguucaggccacuauggcugcugugguuugaauauu

SEQ ID NO: 61032 - RNA, 64 nt, hsa
cauggagcugcuuucuggggaacaguaagguucaggccacuauuuaggggacugagaaagcaca

SEQ ID NO: 61033 - RNA, 64 nt, hsa
ggccccacagccacggggucccuucccugggucaggccacuaggcggggcgugcauguugcccu

SEQ ID NO: 61034 - RNA, 64 nt, hsa
cagccucaggcccaggcacugauuguggcagaggggccacuacccaaggucuagcuaggcccaa

SEQ ID NO: 61035 - RNA, 64 nt, hsa
cgcugugccaggugggcaggcaggagcaaggccugcgagggaggaacgggccgcuccccgccag

SEQ ID NO: 61036 - RNA, 64 nt, hsa
ggcaucagaccuuaaccaccaggcccacagcccagcgagggagaggucgugaggccagcucccg

SEQ ID NO: 61037 - RNA, 64 nt, hsa
gaggcgggggauccuggagccccugugucggggggcgagggaggggagguggccgucgaguuga

SEQ ID NO: 61038 - RNA, 64 nt, hsa
cuggcccugcuggcccggguaucgggaaggaggagcgagggaaugacggagguagggugcaggg

SEQ ID NO: 61039 - RNA, 64 nt, hsa
ugcaacuguaaugagaauuuuucacacuaacacagcgagggacucaacacgcugauucuccucc

SEQ ID NO: 61040 - RNA, 64 nt, hsa
cugcugggaaagcagcccugaggaggaagaggaggcgagggaaucagaaauugaggacagcgau

SEQ ID NO: 61041 - RNA, 64 nt, hsa
uguggcuccaacuucaggaaauaaauuucccauugcgagggacccagcucuguuucugcugcuu

SEQ ID NO: 61042 - RNA, 64 nt, hsa
cuacuugggugguugaggcaggaggauuguuugagcgagggaaguugaggcugcagugaacuau

SEQ ID NO: 61043 - RNA, 64 nt, hsa
gaauggcacagcccaaagaaggaaaaggcagggagcgagggagaagacuauauuguacacaccu

SEQ ID NO: 61044 - RNA, 64 nt, hsa
uuccugaggcuucccuccugcugcuaccacugaugcgagggaaaggccaguggcuggagacccc

SEQ ID NO: 61045 - RNA, 64 nt, hsa
cugcagggggcccggccuccgcugccgcgacacugcgagggagcagccagccaagagccgggcg

SEQ ID NO: 61046 - RNA, 64 nt, hsa
accguccugugcugcucgagaggaccugggacgugcgagggaaacgugggugacggugccuagg

SEQ ID NO: 61047 - RNA, 64 nt, hsa
gaauuccuggucuuggcagauggcucugggaacagcgagggagcacagaagucguggccugagg

SEQ ID NO: 61048 - RNA, 64 nt, hsa
auacaggagaggaugaagggaggagcuccaggaggcgagggaagagcccuagcagggcggccau

SEQ ID NO: 61049 - RNA, 64 nt, hsa
ggauugagggacagaaggauucugagggggcucugcgagggacggugugugacaugucaugccu

SEQ ID NO: 61050 - RNA, 64 nt, hsa
acuccuaaggacuuuugggauuuugaugagaccugcgagggagaagacacugagaagccaguga

SEQ ID NO: 61051 - RNA, 64 nt, hsa
uuguaaaugcucuaacuggacaugaaggaaaggggcgagggaggggggugggauuuuuggugca

SEQ ID NO: 61052 - RNA, 64 nt, hsa
ggagacuccaagcugggcugagccagagcagaaggcgagggauucccagccggacggggguucu

SEQ ID NO: 61053 - RNA, 64 nt, hsa
ugaugauuuguuccaguucucccagggcagaggggcgagggagaggcuuuugcugugagaguag

SEQ ID NO: 61054 - RNA, 64 nt, hsa
cuuaagggcaaagugaguuaauguguagacaaaggcgagggacaagagagaguuaacaucuaga

SEQ ID NO: 61055 - RNA, 64 nt, hsa
uagaaacuagguuuugaaagauuacaugauucaagcgagggauuuuaaaguaaagauguauuua

SEQ ID NO: 61056 - RNA, 64 nt, hsa
gaaaagcagcccagucagaugugggaacgugccagcgagggagagaccuuuccacugcagagag

SEQ ID NO: 61057 - RNA, 64 nt, hsa
cgugggccgcuagggacuccuggggagcuggggggcgagggagagaugagcggaagguggaggu

SEQ ID NO: 61058 - RNA, 64 nt, hsa
cugcgaggacagguugucuuucucuccccaguuggcgagggacacgaaggcugcggccgggcug

SEQ ID NO: 61059 - RNA, 64 nt, hsa
ggaaagaucaaggaaccaagcgccuccacgggaggcgagggaggcucuguaugaaacagaagag

SEQ ID NO: 61060 - RNA, 64 nt, hsa
cuacuugggaggcugagguggaaggauugcuugagcgagggaggucgaggcugcagugagccac

SEQ ID NO: 61061 - RNA, 64 nt, hsa
ugcagggaccuuguaagcggagcuggguggcugcgcgagggaccgaguacuagagcugcuugca

SEQ ID NO: 61062 - RNA, 64 nt, hsa
ggaucucacggacugccgggucggcgccuccugcgcgagggagcagguucuccgcauucccaug

SEQ ID NO: 61063 - RNA, 64 nt, hsa
gcugggguaucagugagggcggccgggagggcgagcgagggagaggagggagagggggagggga

SEQ ID NO: 61064 - RNA, 64 nt, hsa
agcaggacugaugucuccuaagcaccuguaaugugcgagggacccagcuaauaacugaucucgu

SEQ ID NO: 61065 - RNA, 64 nt, hsa
uccccacacagcgcugggccagagaggcauuggugcgagggauugaauaaagaaacaaaugaau

SEQ ID NO: 61066 - RNA, 64 nt, hsa
uguacauuucccugugguucuccguccuucccuggcgagggagcugggacugaagcuuucccgc

SEQ ID NO: 61067 - RNA, 64 nt, hsa
cgagcucccggccagccgccggcccgcaggcagcgcgagggaggagcugcgccgccggcuccgc

SEQ ID NO: 61068 - RNA, 64 nt, hsa
agacgcggacccuggauagugguucuaugacucugcgagggacaggcccacgcguguggggaga

SEQ ID NO: 61069 - RNA, 64 nt, hsa
gguggcaacagcagcaggacagggcacggagggagcgagggagagaggaccggucccagcuuuu

SEQ ID NO: 61070 - RNA, 64 nt, hsa
uaggaggagccagggacuggggcggggggcgggggcgagggagggcgaacugucgaauguugcg

SEQ ID NO: 61071 - RNA, 64 nt, hsa
ucauuaaugcauugauaagaaaacuagguuaguugcgagggauguuucugguuucauuucaaau

SEQ ID NO: 61072 - RNA, 64 nt, hsa
ggguguccccccacacccugcuuuggccccagaggcgagggaccaguggaggugccagggaggc

SEQ ID NO: 61073 - RNA, 64 nt, hsa
gguaauacuaucaagagaagagccuaggagcacagcgagggaaugaaccuuacuugcacuuuau

SEQ ID NO: 61074 - RNA, 64 nt, hsa
cagaaaauuccuagcucacauagcccaaaagggugcgagggagagguggauuaccaguauuguu

SEQ ID NO: 61075 - RNA, 64 nt, hsa
gauuguaaguuuguguguuuaaacuuuuuuuugagcgagggaagaaaaagcuguaugcauuuca

SEQ ID NO: 61076 - RNA, 64 nt, hsa
uguagaugcagacucaccgaccgggaccucagacgcgagggaaaggagcacuaaguggggcucg

SEQ ID NO: 61077 - RNA, 64 nt, hsa
aaagcuaccacucuggcugcuagacagcuugguggcgagggagaugacuccuuguagcugauac

SEQ ID NO: 61078 - RNA, 64 nt, hsa
gggcaggggaaacuaagggcaagcaggauacagggcgagggauguggcaggugagggggcuccc

SEQ ID NO: 61079 - RNA, 64 nt, hsa
agaugagccagugccucgcaugauaccagaggaggcgagggacagagacagcaaggcagacagu

SEQ ID NO: 61080 - RNA, 64 nt, hsa
cugaauuccuguggacccacaggggcuggcuaaggcgagggauacccaaagagagaugcuuguu

SEQ ID NO: 61081 - RNA, 64 nt, hsa
cucuuguggggcagcccaccuuagaaccugacuagcgagggaccuccgcugcaucucagcaaag

SEQ ID NO: 61082 - RNA, 64 nt, hsa
uagaagugaagaccuuauuaauaggagcauaauugcgagggagaaucaugguucugcagucugg

SEQ ID NO: 61083 - RNA, 64 nt, hsa
ccuuccccugucggaagccguugcuugaccccgggcgagggaggcgguagccuccggguccggg

SEQ ID NO: 61084 - RNA, 64 nt, hsa
auauuuagcgaacucggucucccucagaucccccgcgagggaggcugcuggacccaccccgcug

SEQ ID NO: 61085 - RNA, 64 nt, hsa
ucuggagagggccucugagaaggcacugaaugaggcgagggacccuuccuacauugucaccauc

SEQ ID NO: 61086 - RNA, 64 nt, hsa; identical to SEQ ID NO: 61085

SEQ ID NO: 61087 - RNA, 64 nt, hsa
ccaugaccuucaccucuggagaguagggucuauggcgagggaaaaggguguucaccaugauaac

SEQ ID NO: 61088 - RNA, 64 nt, hsa
gaagaaugucaucucccgaauugcugucacuuuggcgagggaguggauauagggcaugucacaa

SEQ ID NO: 61089 - RNA, 64 nt, hsa
ggagccccuugggcaggucacacaaccugucccagcgagggacaccgaguggcccuucauguac

SEQ ID NO: 61090 - RNA, 64 nt, hsa
cuuggccuugcagcgagccccuggcccacgccgagcgagggaugcuucucccuacagcaugucc

SEQ ID NO: 61091 - RNA, 64 nt, hsa
cuuauggggugagaauauagacagugcccuuggugcgagggaagcaauugaaaaggaacuugcc

SEQ ID NO: 61092 - RNA, 50 nt, hsa
acaagugcaccauccagugagcgagggaugcuggggcggggcuuggccag

SEQ ID NO: 61093 - RNA, 64 nt, hsa
gggccaugcccggcugacggcugcuguggaugccgcgagggacggacacacguccggggcaccc

SEQ ID NO: 61094 - RNA, 64 nt, hsa
cuuggucuaccgugcugaccagggugaaggcacggcgagggacuccucccagacgugccucuug

SEQ ID NO: 61095 - RNA, 64 nt, hsa
ccuuugccaacaccucccaaggauggaggacugggcgagggacugggaaagaggcauauuuagu

SEQ ID NO: 61096 - RNA, 64 nt, hsa
auucauucugaacccuccaaaggaacucuagagggcgagggaugaugagggaagcaauagguag

SEQ ID NO: 61097 - RNA, 64 nt, hsa
ugagacguacuuggcuacagauuucugccuuguuuugcgacauugucccauucacacagauauu

SEQ ID NO: 61098 - RNA, 64 nt, hsa
ugugcgguuaccugcuugagugauccugaacuuguugcgacagagggacucacuggacucuguu

SEQ ID NO: 61099 - RNA, 64 nt, hsa
acaacccgggaucguuugcaaguaacugaauccauugcgacauugugaaggcuuaaaugaguuu

SEQ ID NO: 61100 - RNA, 64 nt, hsa
ugggacccccaguguucuugccugugaccucuuauugcgacaugcaggugguguuuuuuuuuuu

SEQ ID NO: 61101 - RNA, 64 nt, hsa
augccucccaggaaaaaaauacauauguauuuuuuugcgacagggucgugcucuugucucccag

SEQ ID NO: 61102 - RNA, 64 nt, hsa
gcaagacugcauggauaagggcugcaucauuuaauugcgacauaccaguggaaauuguauguau

SEQ ID NO: 61103 - RNA, 64 nt, hsa
ggcucuggacugugacugcgccuggauucugccauugcgacacauuuuugugccuuucagcccc

SEQ ID NO: 61104 - RNA, 64 nt, hsa
cccagguggaggggaccacccugcgaucagguguuugcgacagggguugggccagcugaggcaa

SEQ ID NO: 61105 - RNA, 64 nt, hsa
ugccuccucccugcauuuccucguggggcacuauuugcgacauaggccuacagaauuagacuuu

SEQ ID NO: 61106 - RNA, 64 nt, hsa
agauuaacuauuugcaccgaaaugucuuguuuuguugcgacauaggaaaauaaccaagcacaaa

SEQ ID NO: 61107 - RNA, 64 nt, hsa
cuuuggacccuacacacuucggcucucuggacacuugcgacaccucaagguguucucuguagcu

SEQ ID NO: 61108 - RNA, 64 nt, hsa
uaaggcaagcagguagcguguccauaguacuugguugcgacauuugcacuacauccacuuuagu

SEQ ID NO: 61109 - RNA, 64 nt, hsa
ggcugggcuccugggcugaacauggaccacgcaguugcgacaggaggccaggggaaaaaccccu

SEQ ID NO: 61110 - RNA, 64 nt, hsa
ggucaaagugcuuuuuguaaguucuauuuaauacuugcgacaacccugagauaguaaguauuau

SEQ ID NO: 61111 - RNA, 64 nt, hsa
agcuccccguacuggugccgccgcaguggccaaguugcgacacugcccacggccccucccucug

SEQ ID NO: 61112 - RNA, 64 nt, hsa
cagacaacacucuagaacuggagagagguccagauugcgacaggagccacaccagagugugcag

SEQ ID NO: 61113 - RNA, 64 nt, hsa
gggcggcgucugggucucuggcgcccccaugugguugcgacacucccaaagccguaagggccga

SEQ ID NO: 61114 - RNA, 64 nt, hsa
cugccugugcguccgcccaccgcugcccugucuguugcgacacccucccccccacauacacacg

SEQ ID NO: 61115 - RNA, 64 nt, hsa
aacuuuuccccaagcccaccaacuuggauucagauugcgacaugcaggacaggccagucauucu

SEQ ID NO: 61116 - RNA, 64 nt, hsa
aacuauaugcagauuuuaaaaucuagucaguacuagcaucuauaaagggcuuuucugaaauuua

SEQ ID NO: 61117 - RNA, 64 nt, hsa
agcgguucaucggcuguuugggaaauggcaugaaagcaucuacuguggcggcggcuccucuucu

SEQ ID NO: 61118 - RNA, 64 nt, hsa
gaauugaacuaggggcuggaagaagugaaagggaagcaucuaaaaaugaaaggugaguaaccag

SEQ ID NO: 61119 - RNA, 64 nt, hsa
ggcuugauguagcagucauagcaaguuuguaaauagcaucuauguuacacucuccuagaguaua

SEQ ID NO: 61120 - RNA, 64 nt, hsa
uacauguguauauguaaagaauuucaaucaaaugaaacguuauccuauuggauagacuaggcaa

SEQ ID NO: 61121 - RNA, 64 nt, hsa
cauuguacagaaauuaacagccauauuggucuagaaacguuaaacuuaauuuuuuuccauuugu

SEQ ID NO: 61122 - RNA, 64 nt, hsa
ucuugcaauuguaugugugauuauggaguuuugaaaacguuacauuuuuuaaaucuuaaaacug

SEQ ID NO: 61123 - RNA, 64 nt, hsa
aguccauguaguucucuacagauagacuucaaagaaacguuaccuuaucaaagacuaaucugug

SEQ ID NO: 61124 - RNA, 64 nt, hsa
uuggcuacuguaauuguaaauagcgaccuuuggaaaacguuagcgguguaacaguccaggaaac

SEQ ID NO: 61125 - RNA, 64 nt, hsa
aacaggguuggaaggauuuccugaauuagaagacaaacguuagcauacccaguaaggaaaauga

SEQ ID NO: 61126 - RNA, 64 nt, hsa
aauagcuguugacguuugcucauuuaagaauuugaaacguuaugaugaccuggcaacaaaaagu

SEQ ID NO: 61127 - RNA, 64 nt, hsa
uuucuuuauauacuauucccaccauggggagcgaaaacguuaaaaucacaaggaauugcccaau

SEQ ID NO: 61128 - RNA, 64 nt, hsa
aaucucuugccauucauuaguguuauuucauuguaaacguuauugugccaaauguacuguauuc

SEQ ID NO: 61129 - RNA, 64 nt, hsa
uugaagcuugaaagaagagucuuugguauuuuguaaacguuagcagacuuuccugccaguguca

SEQ ID NO: 61130 - RNA, 64 nt, hsa
acaggucaggaaaagccugcugaauuuauguuguaaacguuacuuaacacaguauaaagaugaa

SEQ ID NO: 61131 - RNA, 64 nt, hsa
auacaaaaaucaauucaagauggauuaaagacuuaaacguuagaccuaaaaccauaaaaacccu

SEQ ID NO: 61132 - RNA, 64 nt, hsa
gucagacacuggacaauguaauguaugcaacugcaaacguuacaacugcagccagaacaauggc

SEQ ID NO: 61133 - RNA, 64 nt, hsa
agaauauaagauauacuauauacauuuuguccauaaacguuaugcugaauaguuguugaaacag

SEQ ID NO: 61134 - RNA, 64 nt, hsa
gacgucaaacaagcugaaugaaggggcgcuuagaaaacguuaauagaaguucuaagcgggagau

SEQ ID NO: 61135 - RNA, 64 nt, hsa
guuauguuacaaauucauauucuguuacuacaguaaacguuaagaguuuuaaacaguuaagauu

SEQ ID NO: 61136 - RNA, 64 nt, hsa
aggaaauuauugacaguuuugcacagguucuugaaaacguuauuuauaaugaaaucaacuaaaa

SEQ ID NO: 61137 - RNA, 64 nt, hsa
uaaucucuagagagguccacuuuguugcugaaguaaacguuacuuguugcaacccgaggauggg

SEQ ID NO: 61138 - RNA, 64 nt, hsa
gguaguuauaguacuccaaaucaaggaccaacuuaaacguuaauuuuugugcaaaaacaaaccu

SEQ ID NO: 61139 - RNA, 64 nt, hsa
uaucaucuccuaaucuuacccugacccuuuugucaaacguuaucuagauuaaaccucaguauag

SEQ ID NO: 61140 - RNA, 64 nt, hsa
ggcuuaugccaaauggaagauagaauauaaaauaaaacguuacuuguauauugguaagugguuu

SEQ ID NO: 61141 - RNA, 64 nt, hsa
uauguguaaaugccaccuauuaauacgggacugaaaacguuagagacacacugcauugcagaua

SEQ ID NO: 61142 - RNA, 64 nt, hsa
cugagcuuccauaagucagcugaguuuuaaagguaaacguuauggcugaaauaguaaagcaccu

SEQ ID NO: 61143 - RNA, 64 nt, hsa
acauccacaacccuaagccuuuuaaagcggaggcaaacguuaacaaaccccaucgugguccaug

SEQ ID NO: 61144 - RNA, 64 nt, hsa
guaacuaaaguuagaaaguugauuuuaagaauccaaacguuaagaauuguuaaaggcuaugauu

SEQ ID NO: 61145 - RNA, 64 nt, hsa
uuguguuuguauauaaauggugagaauuaaaauaaaacguuaucucauugcaaaaauauuuuau

SEQ ID NO: 61146 - RNA, 64 nt, hsa
cuuaguuuaaaaaaaaaaagacuuauuuucuagaaaacguuaaugggucuugaagauuuuuggc

SEQ ID NO: 61147 - RNA, 64 nt, hsa
acagccgucucccagggaaucccuucugcaaaccaaacguuacuuagacugcaagcuagaaagc

SEQ ID NO: 61148 - RNA, 64 nt, hsa
ucauuguaugugcuucacuacgggggggagaaggaaacguuagcaucauguuucccauuuaggg

SEQ ID NO: 61149 - RNA, 64 nt, hsa
auaucaagaugugaaggacuaauucaggaugcaaaaacguuauugggggguuguaaauaucaac

SEQ ID NO: 61150 - RNA, 64 nt, hsa
ucuugacuugccuguuuuggccauuagcugccuuaaacguuaacagcacauuugaaugccuuau

SEQ ID NO: 61151 - RNA, 64 nt, hsa
guguggagaaagcaauaaacauuaugagaauguuaaacguuaugcaaaauuauacuuuuaaaua

SEQ ID NO: 61152 - RNA, 64 nt, hsa
acagacuguuuacuaaggagcuaaaccacugagaaaacguuauuaaaauuguaauaccuaggua

SEQ ID NO: 61153 - RNA, 64 nt, hsa
agaaagucuaauguuaaaaacaacuuugccuuugaaacguuaauaaauggauuuacuuugcuaa

SEQ ID NO: 61154 - RNA, 64 nt, hsa
uccuucccuguuugucaauguuuuauucugaaguaaacguuagcucuacauauaaauccuggaa

SEQ ID NO: 61155 - RNA, 64 nt, hsa
uuuugaauagguuggaauugaaaaaacaauuaucaaacguuaagaacaaagacagggauaaauu

SEQ ID NO: 61156 - RNA, 64 nt, hsa
uacuuuuaaagggauuuugcaguauguuguaguuaaacguuaauaaaauuauauuuguaauuag

SEQ ID NO: 61157 - RNA, 64 nt, hsa
gaucccagcgaugucagacacucuugaguugucaaaacguuaauuuucaguuuuaaauaaucag

SEQ ID NO: 61158 - RNA, 64 nt, hsa
aguacuucccuuugucugugccauaagugcuugaaaacguuaagguuuucuguuuuguuuuguu

SEQ ID NO: 61159 - RNA, 64 nt, hsa
gaaauggacagcaugcaauucauccuaauguacaaaacguuauaugcacucaaauguuauaauu

SEQ ID NO: 61160 - RNA, 64 nt, hsa
uaccuugguacagcuuuucacuuguuuaguuuuuaaacguuaguauaaucugaauaaauaaaau

SEQ ID NO: 61161 - RNA, 64 nt, hsa
auuuuuaugagggagcaaaaguuagacugagaacaaacguuagaaaaucacuucagauuguguu

SEQ ID NO: 61162 - RNA, 64 nt, hsa
gcaugagaaaacacagggcauuucuaggacaguaaaacguuaaaguacuggauuaagaaaacaa

SEQ ID NO: 61163 - RNA, 64 nt, hsa
guuucacuggaaaggaaagaugaugcucaguuuuaaacguuaaaaguguacaaguugcuuuguu

SEQ ID NO: 61164 - RNA, 64 nt, hsa
uauaaauuagaaugacaagugggaaucauaaauuaaacguuaaugguuucuuaugcucuuuuua

SEQ ID NO: 61165 - RNA, 64 nt, hsa
uggggaaggacaguguggugugacuauuggcuugaaacguuauggauaugguuggagucaccca

SEQ ID NO: 61166 - RNA, 64 nt, hsa
uuuagcugaguucaguuaauacaaaauguacauaaaacguuaguccuuugagacugacaugauu

SEQ ID NO: 61167 - RNA, 64 nt, hsa
aaacugcucauaaagacuaaaaguugaccuguuaaaacguuaauguacuaagauaguuuuaaga

SEQ ID NO: 61168 - RNA, 64 nt, hsa
ugacuuuucuucuuacaugcugaaucacugguggaaacguuaggauaagcaagaauugccagaa

SEQ ID NO: 61169 - RNA, 64 nt, hsa
aaaggacuuaagaauuuggggggaagugagggaaaaacguuaggugcuaaccaccugcccagaa

SEQ ID NO: 61170 - RNA, 64 nt, hsa
ggagcugagaggccucccuuggagagauggaaggaaacguuauaccuuguaccccucggucucc

SEQ ID NO: 61171 - RNA, 64 nt, hsa
uucaugaagccuuuaagugcugcuucugucagucaaacguuaaaaacuuuaacauuuucaaagu

SEQ ID NO: 61172 - RNA, 64 nt, hsa
cuuaagugccaaugggcccaccuuuuaaacaagaaaacguuaaauaacuugggccauccuauca

SEQ ID NO: 61173 - RNA, 64 nt, hsa
uuuucuccaugguguuaaugauauuagagaugaaaaacguuagcaguugauuuuuguccaaaag

SEQ ID NO: 61174 - RNA, 64 nt, hsa
gguuuuuuaugaugagcaaauauaaguuaaugccaaacguuauguuaaaguuauuuuuucaaau

SEQ ID NO: 61175 - RNA, 64 nt, hsa
ggaacugaaggacgcgguuaaugccuaaaaauggaaacguuaagaaguuggaauguuggagaug

SEQ ID NO: 61176 - RNA, 64 nt, hsa
aaaaacuccucuucacgauugauagcaaaaucagaaacguuagggcaccagugaguugaaaaaa

SEQ ID NO: 61177 - RNA, 64 nt, hsa
auuaaccuucuaaacaguauauucuaaaaagucaaaacguuaacaauaguuuuuaucuaauaaa

SEQ ID NO: 61178 - RNA, 64 nt, hsa
aaggauuaccacuguacacaaaucuaaucaauaaaaacguuagaaccuucugcuuagaguacuu

SEQ ID NO: 61179 - RNA, 64 nt, hsa
aaucuccugcuaauagguaugcauauugugagaaaaacguuaggagcugguaguaaaaaaugag

SEQ ID NO: 61180 - RNA, 64 nt, hsa
uuagaccaguaauugugcuacugaaauugucacaaaacguuauuccuugauuugguuuuuaaau

SEQ ID NO: 61181 - RNA, 64 nt, hsa
agauuaaauuuaauuaauuaauucaaaacauguuaaacguuacuuucauguacuauggaaaagu

SEQ ID NO: 61182 - RNA, 64 nt, hsa
gacuccggacacugacagccgcgugguacagaauaaacguuauuuauuuuuuuauuuaugauac

SEQ ID NO: 61183 - RNA, 64 nt, hsa
auggacuguaaccaguugcuguaacgugauguaaaaacguuacuguaaacagcaugaggauaug

SEQ ID NO: 61184 - RNA, 64 nt, hsa
ugcaacuuaauuuuuuuuuuuaaugcuaucuucaaaacguuagagaaaguucuucaaaagugca

SEQ ID NO: 61185 - RNA, 64 nt, hsa
aaguugucaucuuacuuacucacaaaggaggggaaaacguuauuuucauagcugcuuuuagaaa

SEQ ID NO: 61186 - RNA, 64 nt, hsa
agaauacacaggauauuuuggggggcagagaauaaaacguuaguuaaucccuuugucugucaau

SEQ ID NO: 61187 - RNA, 64 nt, hsa
aucauuucuugggcccuccugaaacuuacacacaaaacguuaagugaugaacauuaaauagcaa

SEQ ID NO: 61188 - RNA, 64 nt, hsa
caaguuuucaaucuuggacuuugaaaacaggauuaaacguuaguauucgugugaaucagacuaa

SEQ ID NO: 61189 - RNA, 64 nt, hsa
guauauugcuguaucuacuuuaacuuccagaaauaaacguuauauaggaaccgucugauagcau

SEQ ID NO: 61190 - RNA, 64 nt, hsa
uaaacugagguuucauugacgugucccuauuaauaaacguuauuugccccacaauguuucuuaa

SEQ ID NO: 61191 - RNA, 64 nt, hsa
agaguuggcguuuccuguucugggugcuacugccaaacguuaugguacuuagagucgggaugca

SEQ ID NO: 61192 - RNA, 64 nt, hsa
uauuuauacugguggaccauucagaaaaagugggaaacguuauuacuuaaugguuacagcacug

SEQ ID NO: 61193 - RNA, 64 nt, hsa
ccaaaaauaaauuguuuaaaacuuuucuuauuaaaaacguuacaaaguauucaauugucuguuc

SEQ ID NO: 61194 - RNA, 64 nt, hsa
gagacguugucccggagaucaaaacguccgcucaaaacguuacccugucgcucgaacccgaucu

SEQ ID NO: 61195 - RNA, 64 nt, hsa
guguucaaccguaaaaccuuguuguaaaugugagaaacguuauuuauguagagcauguaggaaa

SEQ ID NO: 61196 - RNA, 62 nt, hsa
gguaauacugaagaaaaauaaaaauagauuuugaaaacguuacuuacauuucuaugauuaug

SEQ ID NO: 61197 - RNA, 64 nt, hsa
auuuccccaguugcccuuuaaguucuucuauuucaaacguuaauuuugcuucucuuucuaaaaa

SEQ ID NO: 61198 - RNA, 64 nt, hsa
agccaucccaaacaacuaccagaauaauggauuaaaacguuaacuguuuuaagucacuaaguuu

SEQ ID NO: 61199 - RNA, 64 nt, hsa
cucaagauguauggugugucauuugugaaaauagaaacguuauuuuuccuaguuuaguaucaac

SEQ ID NO: 61200 - RNA, 64 nt, hsa
gcucaggcguuaauaauggacauaaaaagucauaaaacguuagagcuggaaggaaucuuaacua

SEQ ID NO: 61201 - RNA, 64 nt, hsa
gcgagcuggccucugccccacagucucaucuguacaccgacaggguugaugccucccucacagg

SEQ ID NO: 61202 - RNA, 64 nt, hsa
ugacagucuccuuccagcucucccuaaucgacuccaccgacaaggucccuaccccagagcuucc

SEQ ID NO: 61203 - RNA, 64 nt, hsa
gccaaaagagggugcugccccuagccugggcccccaccgacagacugcagcugcguuacugugc

SEQ ID NO: 61204 - RNA, 64 nt, hsa
auuggccuuccuuaggcuggcuacuugucaccaucaccgacaucacuguugccugcaaggacac

SEQ ID NO: 61205 - RNA, 64 nt, hsa
uucuuggcagcacuccacucaccuucagcuccugcaccgacaucaggaacccacggccaccacc

SEQ ID NO: 61206 - RNA, 64 nt, hsa
gucgggggguggcugccagggggcaaggagaaagcaccgacaaucuuugauuacugaaaguauu

SEQ ID NO: 61207 - RNA, 64 nt, hsa
aauaagcaugaaucaaaugguaaugcccaauauccaccgacacugcuuuucuugaaugaacagc

SEQ ID NO: 61208 - RNA, 64 nt, hsa
caaagcaaauuuuuuuaaaagcagcguauguaagcaccgacacccacucaaaacagcucuuucu

SEQ ID NO: 61209 - RNA, 64 nt, hsa
gagucucccacagggaggccauuccccuucuacucaccgacaucccucccagcaccacacaccc

SEQ ID NO: 61210 - RNA, 64 nt, hsa
aaauuuuuuaugaucucuaaaccauaaaagaaaacaccgacagcuguaaaauguucuaagauaa

SEQ ID NO: 61211 - RNA, 64 nt, hsa
caucaacuccuucuagcauccagcaagucaaugucaccgacagugaugaggaggaagaagaaaa

SEQ ID NO: 61212 - RNA, 64 nt, hsa
cagucucggcagcagcuccgcucccggcgccacccaccgacacccccagaacccucugggggcc

SEQ ID NO: 61213 - RNA, 64 nt, hsa
uauagaagcucagccuggccugcuccccucuggucaccgacaccccuguccucgcugggacaag

SEQ ID NO: 61214 - RNA, 64 nt, hsa
aaucuacaucuggaccauuccuuaaguuuuuccucaccgacaguaccaucaugccuugaguguu

SEQ ID NO: 61215 - RNA, 64 nt, hsa
gcugcacaucacaacauuuacuuaacagaacagucaccgacaacaugcugugugcuggagacac

SEQ ID NO: 61216 - RNA, 64 nt, hsa
agcaggagcagcuccuacagugaacuauuggcaccaccgacagugacaccagggcacauggcug

SEQ ID NO: 61217 - RNA, 64 nt, hsa
gacggcugugacgcagccggagggaggcacuagucaccgacagcggccuugaagacagagcaaa

SEQ ID NO: 61218 - RNA, 64 nt, hsa
gacccagcgaaaauguggcccuucugagucacaucaccgacacugagcaguggaaaggggcuau

SEQ ID NO: 61219 - RNA, 64 nt, hsa
agggcacgucacugcagacacgcucugcagcauucaccgacagucugucaugcacccaccacgu

SEQ ID NO: 61220 - RNA, 64 nt, hsa
ugggcuagccccacccagagcgcagaggagggggcaccgacagcgcugcgagccaggcucuggg

SEQ ID NO: 61221 - RNA, 64 nt, hsa
gcaaagggguuuuagcugcagccuuggaaggaggcaccgacacgacaccaggcaggagugagcc

SEQ ID NO: 61222 - RNA, 64 nt, hsa
ugccucugcccugaucgucacaacccucaggaaccaccgacagaaagaaagaaacacaaaaaca

SEQ ID NO: 61223 - RNA, 64 nt, hsa
aaaaaggaauccauaccaugaugcguuuuaaaaccaccgacagcccuuggguuggcaagaaggc

SEQ ID NO: 61224 - RNA, 64 nt, hsa
gccaccaccaccaccaacacaacagcaauggcaacaccgacagcaaccaaucagauauauacaa

SEQ ID NO: 61225 - RNA, 64 nt, hsa
caacuggcagcugcgggacccuuggcuugucccccaccgacaagucccaccugcugggugagga

SEQ ID NO: 61226 - RNA, 64 nt, hsa
gcugcccggccugccuggggcugggagccccagacaccgacacccugaggacguguggagcuaa

SEQ ID NO: 61227 - RNA, 64 nt, hsa
ugacccugcagcuggugcucugugucuucgcuuccaccgacagccgucagacaucaggcucccc

SEQ ID NO: 61228 - RNA, 64 nt, hsa
acgcugugcucccucccaacaacggccgagccugcaccgacaacccccuggaggaggaguaccu

SEQ ID NO: 61229 - RNA, 64 nt, hsa
cauccacccacagagaaaugccucugugcgagugcaccgacagaaaacugucagcucugcuuuc

SEQ ID NO: 61230 - RNA, 64 nt, hsa
ccgagugcacccgcuuagccuuuacauuccucuccaccgacaaaaggaaggggaaacucaauca

SEQ ID NO: 61231 - RNA, 64 nt, hsa
cugugccuuugucagcucuucuuucaaaagaccccaccgacagaccgcauuccacccccaacau

SEQ ID NO: 61232 - RNA, 64 nt, hsa
gcagaggaaacagaaacucccaacuguccuuacccaccgacaucacagccccuaugaagaaagu

SEQ ID NO: 61233 - RNA, 64 nt, hsa
gagccuucaggugccaaagccauacucaggcccccaccgacauuguccacccuggccagaaggg

SEQ ID NO: 61234 - RNA, 64 nt, hsa
accuagccuaggugagacacugcagccaggcaaccaccgacacacgccccuucucaaagccaga

SEQ ID NO: 61235 - RNA, 64 nt, hsa
ccaacuugccacccgcgucccugguaccugagaccaccgacauccucagguuccugaccguggc

SEQ ID NO: 61236 - RNA, 64 nt, hsa
gcggucugugguagagaacucucuuccuucuuuccaccgacaggggcgagggcugcuuccucgc

SEQ ID NO: 61237 - RNA, 64 nt, hsa
gggcuucggugccgcgugggcaguacgcaggucccaccgacacucaccugggagcacggcgccu

SEQ ID NO: 61238 - RNA, 64 nt, hsa
uuagagcuuguggcuugaauguuaaaggugugaccaccgacaccacucaugucaauggcugaaa

SEQ ID NO: 61239 - RNA, 59 nt, hsa
aggucaucuucuacaccuaggcugcccgacaccgacaccgcccucccuccguggggaua

SEQ ID NO: 61240 - RNA, 64 nt, hsa
gcccacccccacugacccccgcugccucccccaacaccgacacccuccucggccuccuccucuu

SEQ ID NO: 61241 - RNA, 64 nt, hsa
ucgcucucacacccccuccagcuuuccgaccccacaccgacaacuccccggcuuccagacccua

SEQ ID NO: 61242 - RNA, 64 nt, hsa
gggacacgcccuucagagcccgucucuaugacgucaccgacagccaucaccuccuucuuggaac

SEQ ID NO: 61243 - RNA, 64 nt, hsa
acuuccacaaggugcaaccucaggaaccaaaggucaccgacacugaguacucagaaaucaagau

SEQ ID NO: 61244 - RNA, 64 nt, hsa
cuugaaagguguagguuugauuacuaggagauaccaccgacauuuuucaauaaaguacugcaaa

SEQ ID NO: 61245 - RNA, 64 nt, hsa
cugcgauggcguucauguccgucucgcucaucaucaccgacauguccuucuuaucuggaaagag

SEQ ID NO: 61246 - RNA, 64 nt, hsa
cuggacaucagggacuuuugcccacagcacaugacaccgacagcugcccagccuguucacaugc

SEQ ID NO: 61247 - RNA, 64 nt, hsa
caucaccaacacggccucccugcagcugcccugccaccgacagaccccgauuaaacccacaccu

SEQ ID NO: 61248 - RNA, 64 nt, hsa
auuccauauuuuuuuaagaaaagguuacacugugcaccgacauguggagcuagaaggaaaagcu

SEQ ID NO: 61249 - RNA, 64 nt, hsa
aaaugcucaugccaguuaaugccaggaaaaaaaucaccgacacacuacuaguacuuuguuccug

SEQ ID NO: 61250 - RNA, 64 nt, hsa; identical to SEQ ID NO: 45231

SEQ ID NO: 61251 - RNA, 64 nt, hsa; identical to SEQ ID NO: 45232

SEQ ID NO: 61252 - RNA, 64 nt, hsa; identical to SEQ ID NO: 45233

SEQ ID NO: 61253 - RNA, 64 nt, hsa; identical to SEQ ID NO: 45234

SEQ ID NO: 61254 - RNA, 64 nt, hsa; identical to SEQ ID NO: 45235

SEQ ID NO: 61255 - RNA, 64 nt, hsa; identical to SEQ ID NO: 45236

SEQ ID NO: 61256 - RNA, 64 nt, hsa; identical to SEQ ID NO: 45237

SEQ ID NO: 61257 - RNA, 64 nt, hsa; identical to SEQ ID NO: 45238

SEQ ID NO: 61258 - RNA, 64 nt, hsa; identical to SEQ ID NO: 45239

SEQ ID NO: 61259 - RNA, 64 nt, hsa; identical to SEQ ID NO: 45240

SEQ ID NO: 61260 - RNA, 64 nt, hsa; identical to SEQ ID NO: 45241

SEQ ID NO: 61261 - RNA, 64 nt, hsa; identical to SEQ ID NO: 45242

SEQ ID NO: 61262 - RNA, 64 nt, hsa; identical to SEQ ID NO: 45243

SEQ ID NO: 61263 - RNA, 64 nt, hsa; identical to SEQ ID NO: 45244

SEQ ID NO: 61264 - RNA, 64 nt, hsa; identical to SEQ ID NO: 45245

SEQ ID NO: 61265 - RNA, 64 nt, hsa; identical to SEQ ID NO: 45246

SEQ ID NO: 61266 - RNA, 64 nt, hsa; identical to SEQ ID NO: 45247

SEQ ID NO: 61267 - RNA, 64 nt, hsa; identical to SEQ ID NO: 45248

SEQ ID NO: 61268 - RNA, 64 nt, hsa; identical to SEQ ID NO: 45249

SEQ ID NO: 61269 - RNA, 64 nt, hsa; identical to SEQ ID NO: 45250

SEQ ID NO: 61270 - RNA, 64 nt, hsa; identical to SEQ ID NO: 45251

SEQ ID NO: 61271 - RNA, 64 nt, hsa; identical to SEQ ID NO: 45252

SEQ ID NO: 61272 - RNA, 64 nt, hsa; identical to SEQ ID NO: 45253

SEQ ID NO: 61273 - RNA, 64 nt, hsa; identical to SEQ ID NO: 45254

SEQ ID NO: 61274 - RNA, 64 nt, hsa; identical to SEQ ID NO: 45255

SEQ ID NO: 61275 - RNA, 64 nt, hsa; identical to SEQ ID NO: 45256

SEQ ID NO: 61276 - RNA, 64 nt, hsa; identical to SEQ ID NO: 45257

SEQ ID NO: 61277 - RNA, 64 nt, hsa; identical to SEQ ID NO: 45258

SEQ ID NO: 61278 - RNA, 64 nt, hsa; identical to SEQ ID NO: 45259

SEQ ID NO: 61279 - RNA, 64 nt, hsa; identical to SEQ ID NO: 45260

SEQ ID NO: 61280 - RNA, 64 nt, hsa; identical to SEQ ID NO: 45261

SEQ ID NO: 61281 - RNA, 64 nt, hsa; identical to SEQ ID NO: 45262

SEQ ID NO: 61282 - RNA, 64 nt, hsa; identical to SEQ ID NO: 45263

SEQ ID NO: 61283 - RNA, 64 nt, hsa; identical to SEQ ID NO: 45264

SEQ ID NO: 61284 - RNA, 64 nt, hsa; identical to SEQ ID NO: 45265

SEQ ID NO: 61285 - RNA, 64 nt, hsa; identical to SEQ ID NO: 45266

SEQ ID NO: 61286 - RNA, 64 nt, hsa; identical to SEQ ID NO: 45267

SEQ ID NO: 61287 - RNA, 64 nt, hsa; identical to SEQ ID NO: 45268

SEQ ID NO: 61288 - RNA, 64 nt, hsa; identical to SEQ ID NO: 45269

SEQ ID NO: 61289 - RNA, 64 nt, hsa; identical to SEQ ID NO: 45270

SEQ ID NO: 61290 - RNA, 64 nt, hsa; identical to SEQ ID NO: 45271

SEQ ID NO: 61291 - RNA, 64 nt, hsa; identical to SEQ ID NO: 45272

SEQ ID NO: 61292 - RNA, 64 nt, hsa; identical to SEQ ID NO: 45273

SEQ ID NO: 61293 - RNA, 64 nt, hsa; identical to SEQ ID NO: 45274

SEQ ID NO: 61294 - RNA, 64 nt, hsa; identical to SEQ ID NO: 45275

SEQ ID NO: 61295 - RNA, 64 nt, hsa; identical to SEQ ID NO: 45276

SEQ ID NO: 61296 - RNA, 64 nt, hsa; identical to SEQ ID NO: 45277

SEQ ID NO: 61297 - RNA, 64 nt, hsa; identical to SEQ ID NO: 45278

SEQ ID NO: 61298 - RNA, 64 nt, hsa; identical to SEQ ID NO: 45279

SEQ ID NO: 61299 - RNA, 64 nt, hsa; identical to SEQ ID NO: 45280

SEQ ID NO: 61300 - RNA, 64 nt, hsa
gggaaaauggggccuucgaccccagcgggcuaccugaaccaaggcgucucuuuaaguggggcgc

SEQ ID NO: 61301 - RNA, 64 nt, hsa
caucgucuuauauaugaagcgccuugagugugcaugaaccaaaggaaauaacauugaagaagga

SEQ ID NO: 61302 - RNA, 64 nt, hsa
gggauuacaggugugagccaccacgccuggcccaugaaccaaguguuuuuaaggaaacaaaacu

SEQ ID NO: 61303 - RNA, 64 nt, hsa
gauagcaaauaucuaucugcuauuaaaugguaaaugaaccaaguguuuuuuuuuguuuuuuuuu

SEQ ID NO: 61304 - RNA, 64 nt, hsa
gugccuucuuaaggaaaccauuugauaggaaagaugaaccaaauaacucaaugauggaugagcu

SEQ ID NO: 61305 - RNA, 64 nt, hsa
augauggaugagcugguagaaaaaaagcugguggugaaccaaggucaaacuggaaauuauaguc

SEQ ID NO: 61306 - RNA, 64 nt, hsa
uaauaugcuuuggccaaauuugcuguuuauagagugaaccaagaugucaguuuuguauugggga

SEQ ID NO: 61307 - RNA, 64 nt, hsa
auaaauaauagagcagaugguugccuuugggucuugaaccaaaauaagacuuacuaaaggaaga

SEQ ID NO: 61308 - RNA, 64 nt, hsa
gcagcuuucucuggaaaaugaaugcuaauuagugugaaccaaaagaguaaguaagagucugaag

SEQ ID NO: 61309 - RNA, 64 nt, hsa
uccccuccgcacaggaaagguacccaguagauaaugaaccaaauuaaguucccucccuccagcc

SEQ ID NO: 61310 - RNA, 64 nt, hsa
gcccaugugcaagaaaaugagggcuugagucgccugaaccaagagcaggaagagguugcuggag

SEQ ID NO: 61311 - RNA, 56 nt, hsa
ggaagaaaaugagggcuugagucaccugaaccaagagcaggaagagguugcucagg

SEQ ID NO: 61312 - RNA, 64 nt, hsa
uguaguugacuccaagucucugugagcagugacuugaaccaaacacaccaggaauaauccauuc

SEQ ID NO: 61313 - RNA, 64 nt, hsa
ccacuguccuuagaagaaagggcauuuuuacuuuugaaccaaaaagagaaaaaaaaaucagaag

SEQ ID NO: 61314 - RNA, 64 nt, hsa
aauaaauuccuugaaagauauaaccccccaagauugaaccaagaagaaauugcaucccugaaca

SEQ ID NO: 61315 - RNA, 64 nt, hsa
guugcauuucuauacaccaguaauguccaagcuaugaaccaaaucaagaauggaaucccauuca

SEQ ID NO: 61316 - RNA, 64 nt, hsa
cguuuugacaccuuuccuauagaugauauaggaaugaaccaauacgcuuuuauuacccuuucua

SEQ ID NO: 61317 - RNA, 64 nt, hsa
auguauguaguccuacaacugcaaaacgucuuacugaaccaacaaucaaaaaaugguucuguuu

SEQ ID NO: 61318 - RNA, 64 nt, hsa
uaucugugagauuugacacuaaguuuuuguuagagauuggaaauuauacuaguccuuuuaaggg

SEQ ID NO: 61319 - RNA, 64 nt, hsa
auucaaauaaacauauauucuugcuugcauccuagauuggaaauuaaaauuuuucaaagaacaa

SEQ ID NO: 61320 - RNA, 64 nt, hsa
ccuguaauccuuguacuguucggcugaauuugaagauuggaagacuuauauugagaccaguaac

SEQ ID NO: 61321 - RNA, 64 nt, hsa
aagaccccucauuaaaagccaaggacguucuuaagauuggaacugacauaauuagucuugacuu

SEQ ID NO: 61322 - RNA, 64 nt, hsa
auaacccucaagccaguugauuuuuaauauauuugauuggaaaagaacucucugguauuauuaa

SEQ ID NO: 61323 - RNA, 64 nt, hsa
uugcucaacaucauauaguaaguagcagaguugggauuggaauucaggcaugacucaaaccugg

SEQ ID NO: 61324 - RNA, 64 nt, hsa
auugcauagcuggauacccaucaucuguuucucugauuggaagcugcuguuguacagaaagacc

SEQ ID NO: 61325 - RNA, 64 nt, hsa
cugagauacagacuuguucauagguguggggccugauuggaacaggaucugccauuggucacaa

SEQ ID NO: 61326 - RNA, 64 nt, hsa
acugaguugccugccauccaaaggggaugggcgggauuggaagaagcuguggcagcucuuuucc

SEQ ID NO: 61327 - RNA, 64 nt, hsa
uuuucuagcauuugccagucccugugccuggacugauuggaacacuuuguuuuucucccugugc

SEQ ID NO: 61328 - RNA, 64 nt, hsa
agcgauuuuauuaucuugggggaugagaccaugagauuggaaaauguacauuacuucuaguuuu

SEQ ID NO: 61329 - RNA, 64 nt, hsa
cugggauuuuaugugccuuuuuguaccuuuuucagauuggaauuaguuuucuguuuaaggcuuu

SEQ ID NO: 61330 - RNA, 64 nt, hsa
cuugguaaagaauaacccacaaacaccugaucuugauuggaaagcauuguaggucauuagggaa

SEQ ID NO: 61331 - RNA, 64 nt, hsa
aacaaagaaaauuuaccaccuugucugauacauagauuggaaggcgcucuugguaaagaauaac

SEQ ID NO: 61332 - RNA, 64 nt, hsa
uugccaugcuguuggccuggaaguccaccugucugguccauagugacguccugaagagccaguc

SEQ ID NO: 61333 - RNA, 64 nt, hsa
cugaaagaccugcuccuuccacaagaagugcauagguccauaauauuucauaaaaugaagaaaa

SEQ ID NO: 61334 - RNA, 64 nt, hsa
auacacagacaaaaacacaaaaacucugaggggaucuggugaaucuccaaauuauugugggugu

SEQ ID NO: 61335 - RNA, 64 nt, hsa
cacaaauguuccacaaggcgggaguguuucacuuucuggugauaaacuugauggucauuguuau

SEQ ID NO: 61336 - RNA, 64 nt, hsa
uauuuucuuagucugaaaaaaacagcaguaguaaucuggugaauguuauuauuaggaguguucu

SEQ ID NO: 61337 - RNA, 64 nt, hsa
uggaaugagaauggggauacccccaaaauaagauucuggugaagaaaaagucuuguacuaaguu

SEQ ID NO: 61338 - RNA, 64 nt, hsa
acuagagcugaaaagaagcugagaaaucaccuugucuggugauuuucugccugguggggccauu

SEQ ID NO: 61339 - RNA, 64 nt, hsa
aaaccccuuagaacucucccuacuagcuggaaacucuggugacgugaugaaugugggaagggcu

SEQ ID NO: 61340 - RNA, 64 nt, hsa
ccgcagcacagccuuccauucaugugcacgugagucuggugaaaauggccuugugaaguccagu

SEQ ID NO: 61341 - RNA, 64 nt, hsa
ccaggucuucauggggcccugagcuucugcugccucuggugagagggagagcccuucccauccu

SEQ ID NO: 61342 - RNA, 64 nt, hsa
ccuuguaggaaauuccaagggccuuucuacugaaucuggugaugggguggggccguggcacuuu

SEQ ID NO: 61343 - RNA, 64 nt, hsa
ccuguccugccaaguggcaagaguguggggacugucuggugaugaugucuuucauggcaucuga

SEQ ID NO: 61344 - RNA, 64 nt, hsa
aaagggaggcgugccugagaagguagccugugcaucuggugagugugucacgagcuuuguuacu

SEQ ID NO: 61345 - RNA, 64 nt, hsa
agaggcauacaagucuguuugcugcauacacauuucuggugagggcgacugggugggugaagca

SEQ ID NO: 61346 - RNA, 64 nt, hsa
auacauacacaugaacaaagaauggcagcauauuucuggugagaacuaugcaagcuauaagaca

SEQ ID NO: 61347 - RNA, 64 nt, hsa
uauuugaauaaauaauggcuaaagauuuuccaaaucuggugaaaacaauacccccacauauuca

SEQ ID NO: 61348 - RNA, 64 nt, hsa
ugcucccugccccucccccugccuuuccacucugucuggugagcucugcuuuuucagugcacca

SEQ ID NO: 61349 - RNA, 64 nt, hsa
cuuuguguuccuagaagagcuucauuucagugaaucuggugaccuccaucugcuugcugucaua

SEQ ID NO: 61350 - RNA, 64 nt, hsa
gcacuuauucagauguaucuucaaccucuguuauucuggugacugacaaaagaacuugaaccua

SEQ ID NO: 61351 - RNA, 64 nt, hsa
augucgacuauuagugauaacaaaugggucacuaucuggugaaaaaauaugguauuucaugauc

SEQ ID NO: 61352 - RNA, 64 nt, hsa
ggagucaaaaaacuugauuucagguccuagcucuagcacuuacagcugugugaucuugggcaag

SEQ ID NO: 61353 - RNA, 64 nt, hsa
auauuuugauuuuacccagcuuaaucuguaaaguagcacuuaaauauaucugauagcaacacuu

SEQ ID NO: 61354 - RNA, 64 nt, hsa
ugauaaucaguauaauaauuugccuuguguggucagcacuuaacuguuuacaaagcccuuucac

SEQ ID NO: 61355 - RNA, 64 nt, hsa
cccaccuguggccccuaaacccagagugacugagagcacuuaacauucagcuugucucaucccc

SEQ ID NO: 61356 - RNA, 64 nt, hsa
uuguuuuaaauuaauuuuuuagcagauagcaguuagcacuuaaucuguaaauugaauaauuuau

SEQ ID NO: 61357 - RNA, 64 nt, hsa
uuaaucaauuaguaauggcggaaacugucgcugaagcacuuaagaaauaaagguacuuuacagc

SEQ ID NO: 61358 - RNA, 64 nt, hsa
gaaagcuaaaacaacccauuugcuacccauccaaagcacuuacaguuuagcaaauauuaaagag

SEQ ID NO: 61359 - RNA, 64 nt, hsa
ccauaaaagagaaaaaaauucggaaagugaucagagcacuuauucaaaauacagugauagaagu

SEQ ID NO: 61360 - RNA, 64 nt, hsa
cauuuuacaauagauaaaugcuugugcuaccuaaagcacuuagcacacaguuaaauuauauuua

SEQ ID NO: 61361 - RNA, 64 nt, hsa
aauaaaucacuauacugauauuuugauacaagcaagcacuuacaugguaaucacuauauagauc

SEQ ID NO: 61362 - RNA, 64 nt, hsa
acucuacucaucuuuagagaugaaucaucuauuaagcacuuaccaaaacauaucauuaaacuga

SEQ ID NO: 61363 - RNA, 64 nt, hsa
uguauuauaauuaguuuugugaauagaaaaauaaagcacuuauguuuaaauuuguuacagugac

SEQ ID NO: 61364 - RNA, 64 nt, hsa
aaaagugagguguggaacuccaggcaacgacccaagcacuuauuuuuuaagagggaaaggacuu

SEQ ID NO: 61365 - RNA, 64 nt, hsa
agauuaucgaucuaugagacaucuugauauguaaagcacuuaauauuaaaggcauaaaagugaa

SEQ ID NO: 61366 - RNA, 64 nt, hsa
agauuucggcaucgacacggacguuguugcacaaagcacuuaaagaacgagagcaucuuguuca

SEQ ID NO: 61367 - RNA, 64 nt, hsa
cacccccucaauagccagcacccacagugagcugagcacuuacagcaacaauuguaagucgacu

SEQ ID NO: 61368 - RNA, 64 nt, hsa
aaauauuuuuaugccuacuuaggaaaaaaaggguagcacuuauucauuccaaguacuuuuuuuu

SEQ ID NO: 61369 - RNA, 56 nt, hsa
auggaaaaccuaaagaguaaaaccuuagcacuuagcacaauuaaauagaaauaggu

SEQ ID NO: 61370 - RNA, 64 nt, hsa
cugcugcuccuauauuuuuuaagaaauauaauaaagcacuuagggcaggggaaaucaucucggu

SEQ ID NO: 61371 - RNA, 64 nt, hsa
uuucuaggauuaacugagagauuaaaggaacagcagcacuuaggcucaaaaucgccccuacaaa

SEQ ID NO: 61372 - RNA, 64 nt, hsa
gugcagguaguguuuaguuaucuacugcauuaugagcacuuaaaguacugcuagcuguagaacu

SEQ ID NO: 61373 - RNA, 64 nt, hsa
caacuuucuauuuuuagccuauauuuggaaagaaagcacuuaacauuuuaggaauucuuuuuaa

SEQ ID NO: 61374 - RNA, 64 nt, hsa
cugcuguuauuuucuacauuuguauuuuauccauagcacuuauucacauuuaggaaaagacaua

SEQ ID NO: 61375 - RNA, 64 nt, hsa
caauauuuuugaaaauuuaguacaguuuagaaagagcacuuauuuuguuuauauccauuuuuuc

SEQ ID NO: 61376 - RNA, 64 nt, hsa
cugccauauccugcuggcuccuugcuugauuucccucagcaaacccuugaacuugcuaggccau

SEQ ID NO: 61377 - RNA, 64 nt, hsa
aaggcaaguggugauggcgccacugcacuccuaccucagcaacagaguaagacucugucccaaa

SEQ ID NO: 61378 - RNA, 64 nt, hsa
ccugggggcccacgacucaccuggugggccugggcucagcaaacagcccucccucccaguauuu

SEQ ID NO: 61379 - RNA, 64 nt, hsa
cacaauuugcacuccccucagcuagacgcacagacucagcaauaaaccuuugcaucaggcucca

SEQ ID NO: 61380 - RNA, 64 nt, hsa
uuucagcaucggcucuucagcagauccaaacccccucagcaacuugcagaggaccuguccccuc

SEQ ID NO: 61381 - RNA, 64 nt, hsa
ccgacacuugugaaacuccgagaagugcuguggucucagcaaugcaccuguuuuguacaugauu

SEQ ID NO: 61382 - RNA, 64 nt, hsa
gcccauagacuacaguucuucagaggccauaugucucagcaaguacugguuauauucuuuuuuu

SEQ ID NO: 61383 - RNA, 64 nt, hsa
guauucuuagaccaaaaaucauaaccugcuguuucucagcaaagccuugcucucuggagcuuac

SEQ ID NO: 61384 - RNA, 64 nt, hsa
gggaugacacagcaaggaugacucagcacugccccucagcaaggaugacucagcacugccgcuc

SEQ ID NO: 61385 - RNA, 64 nt, hsa; identical to SEQ ID NO: 61384

SEQ ID NO: 61386 - RNA, 64 nt, hsa
gugaugacacagcaaggaugacucagcacugccccucagcaaggaugacucagcacugccgcuc

SEQ ID NO: 61387 - RNA, 64 nt, hsa
gacaugacucagcagggaugacucagcaccgccccucagcaaggaugacucagcagggaugauu

SEQ ID NO: 61388 - RNA, 64 nt, hsa
gcugccuugaaaucaagagacaauaacuuugaaccucagcaagaccuugaaccgccgguucauu

SEQ ID NO: 61389 - RNA, 64 nt, hsa
aaaguguggcauagcuaccugcccauccccaacccucagcaaaguagaaucucuuuucugguaa

SEQ ID NO: 61390 - RNA, 64 nt, hsa
caggguugaugcaggucugcaggucuucugcaccccccucaaugaggagucccucccagaaagg

SEQ ID NO: 61391 - RNA, 64 nt, hsa
uuccuggcucgucucaaaggccaggacccuggggccccucaacugcagucagagagcaagcccc

SEQ ID NO: 61392 - RNA, 64 nt, hsa
cuuugcguuagggugaagacccuagcguccagcuccccucaacgcuauauuuugacacuaaaaa

SEQ ID NO: 61393 - RNA, 64 nt, hsa
gccuggacccucaaccccugcaaccuucccuagcccccucaauagaugagcaggucaggcugug

SEQ ID NO: 61394 - RNA, 64 nt, hsa
uuauuuauacagugccuugcucggcgcccaccacccccucaagccccagcagcccucaacaggc

SEQ ID NO: 61395 - RNA, 64 nt, hsa
uggauauggugcagagaagcuggacuucugugggccccucaacagccaagugugaccccacugc

SEQ ID NO: 61396 - RNA, 64 nt, hsa
ucaucagucaucaggugugcucaggggacaaucuccccucaaccgcacaugugccacuguucag

SEQ ID NO: 61397 - RNA, 64 nt, hsa
gcuguuaggacagcaaagcagcaguguccagagaccccucaauccccaaagguccgcacccugu

SEQ ID NO: 61398 - RNA, 64 nt, hsa
uuaaugaacaagguggaccaaagggcugaaccagccccucaaccaggacccuggggggccugcu

SEQ ID NO: 61399 - RNA, 64 nt, hsa
ccaucucugaccagcugggaaccugcuuggggucccccucaaaccugugucuggggugugggcu

SEQ ID NO: 61400 - RNA, 64 nt, hsa
agucauugcacagcaaagccaugugcagggcgucccccucaacccugcccugaacaugccccag

SEQ ID NO: 61401 - RNA, 64 nt, hsa
ugagucuccucacagcagagagacccaccggagcccccucaacuuugcagaugcccaccuggaa

SEQ ID NO: 61402 - RNA, 64 nt, hsa
gaccagagcgcccucugaugagcccacugcccacccccucaagccaauccccuccuugggcacu

SEQ ID NO: 61403 - RNA, 64 nt, hsa
ugcccugguggagaaagcacugaccugucaugccccccucaaaccuccucuucugacgugccuu

SEQ ID NO: 61404 - RNA, 64 nt, hsa
ucuucugcccauagacggggaugacucagcacuaccccucaacagagaugacuuugaugacucu

SEQ ID NO: 61405 - RNA, 64 nt, hsa
agcacuaccccuuaacagggaugacuccgcacugccccucaacagggaugacucagcagagaug

SEQ ID NO: 61406 - RNA, 64 nt, hsa
acagggaugacucagcagggaugacucagcaccgccccucaacaggcaugacucugcagagaug

SEQ ID NO: 61407 - RNA, 64 nt, hsa
ucaacagggaugacucagggauggcuuaguacugccccucaacagggaugacucagcagggaug

SEQ ID NO: 61408 - RNA, 64 nt, hsa; identical to SEQ ID NO: 61406

SEQ ID NO: 61409 - RNA, 64 nt, hsa
aguacugccccucagcagggaugacucagcacugccccucaacagggaugacucagcagggaug

SEQ ID NO: 61410 - RNA, 64 nt, hsa
aguacugccccucagcagggaugacucagcaccgccccucaacagggaugacucagcacugccc

SEQ ID NO: 61411 - RNA, 64 nt, hsa
agcaccgccccucaacagggaugacucagcacugccccucaacagggaugacucagcagggaug

SEQ ID NO: 61412 - RNA, 64 nt, hsa
gcagggaugacucagcagggaugacucagcaccaccccucaacagggaugacucagcagggaug

SEQ ID NO: 61413 - RNA, 64 nt, hsa
acagggaugacucagcagggaugacucagcacugccccucaacagggaugacugcagggaugac

SEQ ID NO: 61414 - RNA, 64 nt, hsa
gcagggaugacucagcagggaugacucagcaccgccccucaacaggcaugacucugcagagaug

SEQ ID NO: 61415 - RNA, 64 nt, hsa
gcagggauggcucagcagggaugacucagcauugccccucaacagggaugacucagcagacuca

SEQ ID NO: 61416 - RNA, 64 nt, hsa
acucagcagacucagcagggaugacucagcacugccccucaacagacaugacucagcagggaug

SEQ ID NO: 61417 - RNA, 62 nt, hsa
ugucaucacuucuauagauuuccuaacuccaccaugccuauuucugguuauauaauugcucu

SEQ ID NO: 61418 - RNA, 62 nt, hsa
gaggcuggaaacuccaagauuaaggcagauuucaugccuauugagggccugcuuucugauua

SEQ ID NO: 61419 - RNA, 62 nt, hsa
ccuuuggguuccauguuuuccuuguucccucccaugccuagcuggauugcagaguuaaguuu

SEQ ID NO: 61420 - RNA, 62 nt, hsa
cuacaaaaaauaauuagccuggccugguggugcaugccuaguccuagcugaucuggaggcug

SEQ ID NO: 61421 - RNA, 62 nt, hsa
uaaaaauacaaaauuggcagggugugguggcacaugccuauaaucccagcuacuugggaggc

SEQ ID NO: 61422 - RNA, 62 nt, hsa
aaaaguaaaauaauaggccaggcaugguggcucaugccuauaagcacccugggaggccgagg

SEQ ID NO: 61423 - RNA, 62 nt, hsa
uaaaggagaauaacuggccgggcacgguggcucaugccuauaaaauuccagcacuuugggag

SEQ ID NO: 61424 - RNA, 64 nt, hsa
uagcauuaacauaaaauaccagaaacaaacuuuaucucccuauucuuacauuuagugcaaauug

SEQ ID NO: 61425 - RNA, 64 nt, hsa
guuugucuuuauauuuuaucuucauccuaaauuuucucccuaucaaaacagcaggaaauuuuua

SEQ ID NO: 61426 - RNA, 64 nt, hsa
aaggcucucaaaacagcagaacaaugaaacauacucucccuacacuugcuuagccaagagauac

SEQ ID NO: 61427 - RNA, 64 nt, hsa
ggaggagaggcaguagagucaggcugcaguggaaucucccuaggaugccaaaguggcauuaugu

SEQ ID NO: 61428 - RNA, 64 nt, hsa
guuuaucauuauuuugauauccauuacccucaccucucccuaguucauaaauaggucuauagca

SEQ ID NO: 61429 - RNA, 64 nt, hsa
ucccagccagggacacuguguggaguucgcacacucucccuaugucuccgggugcuccaguuuc

SEQ ID NO: 61430 - RNA, 64 nt, hsa
acucccaacccuaccaugcuccaucauacucaggucucccuacuccugccuuagauuccucaau

SEQ ID NO: 61431 - RNA, 64 nt, hsa
gaacccucaacuauugacugcugcagacagcuuaucucccuaacccugaaaugcugugagcuug

SEQ ID NO: 61432 - RNA, 64 nt, hsa
cuggcaucugucucuugcuaccuaagccugugccucucccuaaagagcugccucccugcugccg

SEQ ID NO: 61433 - RNA, 64 nt, hsa
gcuuuugagagaggcugugaccaccccccauccuucucccuacacucccagccaaccuagugcc

SEQ ID NO: 61434 - RNA, 63 nt, hsa
aaggagcccaugugguuggauaaaaucaagaaaaggcugaaugagcacgguuacccccaagug

SEQ ID NO: 61435 - RNA, 63 nt, hsa
auaaggauuuuggccaaaugggacuuagacuggaggcugaauuugagaaggauuucaaggaag

SEQ ID NO: 61436 - RNA, 63 nt, hsa
ugaauuuuggcaugaugacuguacucucaauaaaggcugaaaauguuguauaacugaccugug

SEQ ID NO: 61437 - RNA, 63 nt, hsa
augaauaaugaccuuaugaaguaugcuaucuguaggcugaaauuauagguacaucuguuuuca

SEQ ID NO: 61438 - RNA, 63 nt, hsa
ucaaccaauggguggccuugugacuguucuuuaaggcugaagauauccaggaaagggggcuug

SEQ ID NO: 61439 - RNA, 63 nt, hsa
guaaguagcgcagcagccucugugggggaggauaggcugaaaaaaaaaagugggcucguauuu

SEQ ID NO: 61440 - RNA, 63 nt, hsa
ucacuauucacaggacauuggcauuaucuacuaaggcugaaaaugugcauauuccaugacuca

SEQ ID NO: 61441 - RNA, 63 nt, hsa
aaauaauaacagacaaggucaaaaaauagaugcaggcugaaaagaaaaggaagugggcuaaga

SEQ ID NO: 61442 - RNA, 63 nt, hsa
uacgacgcaauaaaauaacaucaauagauuuuuaggcugaauuaauuugaaagcagcaauuug

SEQ ID NO: 61443 - RNA, 63 nt, hsa
cucuaccccacccuacaaaaugcauauggagguaggcugaaaagaauguaauuuuuauuuucu

SEQ ID NO: 61444 - RNA, 63 nt, hsa
aucaguuaucaguacaagugccgcauagugcauaggcugaaaugucucaagauuccccacacu

SEQ ID NO: 61445 - RNA, 63 nt, hsa
cugaggccaggaaaagaagcacuggaaagcagcaggcugaacaauuccuggaacucaugcagg

SEQ ID NO: 61446 - RNA, 63 nt, hsa
agauugugaugucauauuucacucucaaaacauaggcugaaagcacgaauuacucaaaaagua

SEQ ID NO: 61447 - RNA, 63 nt, hsa
uuaauauugcacacccaaaccagucuaucagggaggcugaagcaagggcgcagugugauauuu

SEQ ID NO: 61448 - RNA, 63 nt, hsa
ggcccuccgagguggagcagcagcuacaagcagaggcugaacaccugcggaaggagcuggaga

SEQ ID NO: 61449 - RNA, 63 nt, hsa
ggcccuccgagguggaacagcagcuacaagcagaggcugaacaccugcggaaggagcuggaga

SEQ ID NO: 61450 - RNA, 63 nt, hsa
gcagccucuucaaaaugagcccuguccugccuaaggcugaacuuguuuucugggaacaccaua

SEQ ID NO: 61451 - RNA, 63 nt, hsa
ccuccuggacuccugcacacgcuccuuccucugaggcugaaauucagaauauuagugaccuca

SEQ ID NO: 61452 - RNA, 63 nt, hsa
gguggcaugagccuguguucccagcugcuuaggaggcugaagcaggaggauugauugagccug

SEQ ID NO: 61453 - RNA, 63 nt, hsa
ggucacaaccugagguacucugcugagugggcaaggcugaagaagaggccuguggaaugcagc

SEQ ID NO: 61454 - RNA, 63 nt, hsa
aagcaggguggccuccagagccuugccauaaaaaggcugaaggcagccgggcgcaguggcuca

SEQ ID NO: 61455 - RNA, 63 nt, hsa
gacuccgucucaaaaaaaaaaaaaaaacaaaaaaggcugaaggcagcuguagcuccacacaga

SEQ ID NO: 61456 - RNA, 63 nt, hsa
uuaagagguuuguauauaaaucuguuauagaacaggcugaaauuucuuguucauaagauuaug

SEQ ID NO: 61457 - RNA, 63 nt, hsa
caccuaacauuauacuucauggugauagacugaaggcugaauguuuuccccuuaagauuggga

SEQ ID NO: 61458 - RNA, 63 nt, hsa
gacacagggcccagcacccagguugcugucggcaggcugaagacacuagaauccugaccugua

SEQ ID NO: 61459 - RNA, 63 nt, hsa
caggccuggugguggcaguggaggaggcugaggaggcugaagaggcugacaggucggggggcu

SEQ ID NO: 61460 - RNA, 64 nt, hsa
ggucucuucccgaugccaguggcugggcugggccugcccugaauugagagagaagaaggggaga

SEQ ID NO: 61461 - RNA, 64 nt, hsa
ccaccccccaagugaaacgguuugagagacgcagugcccugaccuggacaagcugugcacgucu

SEQ ID NO: 61462 - RNA, 64 nt, hsa
acuacuucuguagcaggggccuccuaagccaggcugcccugaugcuaggaagccagcucugggg

SEQ ID NO: 61463 - RNA, 64 nt, hsa
gggucugguauaaaaacacuccuggaaacgccuuugcccugauccaaauguuagcacuugcuag

SEQ ID NO: 61464 - RNA, 64 nt, hsa
augccccaucucgacucccauccccaucuaucugugcccugagcauggcucugcccccaggucg

SEQ ID NO: 61465 - RNA, 64 nt, hsa
aaggaagagcccuggaggugguugggggcaaaugugcccugaguccuuggggugguucugcuua

SEQ ID NO: 61466 - RNA, 64 nt, hsa
agugcaugauccccauguugcaauauggagucucugcccugagaucuuccccaucucaguuuuc

SEQ ID NO: 61467 - RNA, 64 nt, hsa
gauuuucaaggccuuaacaaaguuaaaggaccacugcccugagguuacugcacugaggccaagu

SEQ ID NO: 61468 - RNA, 64 nt, hsa
cuugaauuucaagcucagaggaaacuuugucucaugcccugacaugaaguggcaaacacggaag

SEQ ID NO: 61469 - RNA, 64 nt, hsa
uaguaugaggacauuuguuugaauuauagaaauuugcccugagcugaacuggguuguguuaaca

SEQ ID NO: 61470 - RNA, 64 nt, hsa
gcucuugcugucuucagcagcaucucaggguagcugcccugaccucggagcagucugucgcccc

SEQ ID NO: 61471 - RNA, 64 nt, hsa
gcccugggcuucagccuuugugcaguacucucgaugcccugaacacacaccuucccuuugccca

SEQ ID NO: 61472 - RNA, 64 nt, hsa
ccguaguccugcaaaguguccuuuguggggcugaugcccugaucccaguccagacgggugcugc

SEQ ID NO: 61473 - RNA, 64 nt, hsa
cccggugcaggcucccgaccagugcugcccuguuugcccugagaaacaagaugucagagacuug

SEQ ID NO: 61474 - RNA, 64 nt, hsa
agagcgagcugacagcagcaacacugucagaaggugcccugagacggccggcucagccuucccu

SEQ ID NO: 61475 - RNA, 64 nt, hsa
cugcaggcagagccccucagugcucugagaaaccugcccugaacucaccgccuccccugccugg

SEQ ID NO: 61476 - RNA, 64 nt, hsa
gaggaagccaagguggccaaggcccucgguccccugcccugauagggcuuaccugugggugggg

SEQ ID NO: 61477 - RNA, 64 nt, hsa
ccccccacucuccuuuagggagcugagguucuucugcccugagcccugcagcagcggcagucac

SEQ ID NO: 61478 - RNA, 64 nt, hsa
uuggccugacccugugggagucagaagccauggcugcccugaaguggggacggaauagacucac

SEQ ID NO: 61479 - RNA, 64 nt, hsa
cccguugagccacgcugucuggugggugauucucugcccugagccaccacccuggacuggccca

SEQ ID NO: 61480 - RNA, 64 nt, hsa
gggacuggucacugccucaggacccccaagccuaugcccugagccauggcugcugacugacucc

SEQ ID NO: 61481 - RNA, 64 nt, hsa
uuucaucucucaucucucuuucuucucucccuucugcccugacguagccaugguugggugggug

SEQ ID NO: 61482 - RNA, 64 nt, hsa
acuuacugcccagagccucguaguuuucuuccccugcccugaugguuggguguuuuuccuuuaa

SEQ ID NO: 61483 - RNA, 64 nt, hsa
agcaaagccaugugcagggcgucccccucaacccugcccugaacaugccccagggcacugaggg

SEQ ID NO: 61484 - RNA, 64 nt, hsa
ccuggcucucugcggcuggugggaaaacacacccugcccugaggggcuguccaggccuucuccc

SEQ ID NO: 61485 - RNA, 64 nt, hsa
ggccggaggaaccgagguguugccagugcuaagcugcccugaggguuuccuucggggaccagcc

SEQ ID NO: 61486 - RNA, 64 nt, hsa
agccuguucccacucagcagugagaguuccucuuugcccugaggcucagucucucucguauuuu

SEQ ID NO: 61487 - RNA, 64 nt, hsa
ggagaauuauauaaagguuuucuuagaacaauuuugcccugauuacugaagcgucaaauaaagc

SEQ ID NO: 61488 - RNA, 64 nt, hsa
gaagaaaguugaccuugugucacuauuuauuuuaugcccugaucagacuagcaacuuagauaag

SEQ ID NO: 61489 - RNA, 64 nt, hsa
cccccagcacugccagggacugcccugucugcugugcccugaccacaggcugcuucauggcguu

SEQ ID NO: 61490 - RNA, 64 nt, hsa
ucccagcgucccgagcccagcacugucucuucagugcccugauuucucacccagagguuucacc

SEQ ID NO: 61491 - RNA, 64 nt, hsa
gagaggagggcuacugccucacaucacugcagagugcccugagcuacguggagcugcugccccg

SEQ ID NO: 61492 - RNA, 64 nt, hsa
ucugccccaggagcgugcaccgagcccgggaggcugcccugagcaggagcauggagcucuacag

SEQ ID NO: 61493 - RNA, 64 nt, hsa
gagacgaggagggcucuggucccgucacucuccaugcccugacaacagugcuuguagcuuugau

SEQ ID NO: 61494 - RNA, 64 nt, hsa
gacgcugugaucuccaccuugaagccaggcaggcugcccugagacgaggagggcucuggucccg

SEQ ID NO: 61495 - RNA, 64 nt, hsa
cagucaacacucauuugacaaauagaguccagcugccucugagccaauccugggaccauaauag

SEQ ID NO: 61496 - RNA, 64 nt, hsa
uugaugguuauagcgggugggguuguauuuggaagccucugaagagaccaugucuuuuuaaaau

SEQ ID NO: 61497 - RNA, 64 nt, hsa
cucucuuugaguuuggguucuccccagccccuuggccucugaggcugaggguggcuuccuccca

SEQ ID NO: 61498 - RNA, 64 nt, hsa
ccugccugguuggcagcgggggccaucaccuguggccucugagaccgccccauuuacaggaauc

SEQ ID NO: 61499 - RNA, 64 nt, hsa
cuccaguuaaaucaaacauugguugaacacaucagccucugaaaagguagcucugacucuuguc

SEQ ID NO: 61500 - RNA, 64 nt, hsa
ccucaagauaaauauggguuaaugccugcaugaugccucugaauucaggaauugcagggaaaac

SEQ ID NO: 61501 - RNA, 64 nt, hsa
gagcagcagggaucaucacaugcagccaaacuuggccucugaagggggaagguagugggaauag

SEQ ID NO: 61502 - RNA, 64 nt, hsa
cacgaugcucagacacagaagggacugcagucgugccucugacuguuaucccgguuccaagccu

SEQ ID NO: 61503 - RNA, 64 nt, hsa
caggaugcucagacaagaauagggcuguggccgcgccucugacuauuaucccgguuccaagacg

SEQ ID NO: 61504 - RNA, 64 nt, hsa
gacaggcuuucuggaggaaucaggcccugggacagccucugagcuccuggggguguuucucuga

SEQ ID NO: 61505 - RNA, 64 nt, hsa
gagggacccaggaaacuaagauuugagauucagugccucugaaagacuaccaaaaucuaaguug

SEQ ID NO: 61506 - RNA, 64 nt, hsa
gagcguggccuacgugagccaacaagaagcaggggccucugagugccaagcgacguggcgggcu

SEQ ID NO: 61507 - RNA, 64 nt, hsa
ccuacucuccucccuugcucccagcagcggaagcgccucugacccuuggcuugagucccacgug

SEQ ID NO: 61508 - RNA, 64 nt, hsa
ggggcuccugugccggugggcggggggcaugcuggccucugagcgaucaggcgaggccagcgag

SEQ ID NO: 61509 - RNA, 64 nt, hsa
uuggccaacagauuucuuguccugccuucuagaugccucugagcuccaaacccagggcagccau

SEQ ID NO: 61510 - RNA, 64 nt, hsa
ggaggaacacgucauaucagaugagaggaagauggccucugauggacagaauuuuucucuuaac

SEQ ID NO: 61511 - RNA, 64 nt, hsa
gugugcggccgccgcgcugucugcacagcugggggccucugagccuggugggcuuccuggacuc

SEQ ID NO: 61512 - RNA, 64 nt, hsa
cugcccgucucccagagaugcuucaccagcaccugccucugagaccucgcucucuguuccagca

SEQ ID NO: 61513 - RNA, 64 nt, hsa
uuuauuuuucuaugccaggcaguagagucucucugccucugaggagcaggcuacccgcauccca

SEQ ID NO: 61514 - RNA, 64 nt, hsa
cagcuugccaguaccugagccggucgggucaucugccucugagggaccguccucaccgagcucc

SEQ ID NO: 61515 - RNA, 64 nt, hsa
guguugaucaggaggcguccacagcauuguucucgccucugaaugaugcuucuuucuguguugg

SEQ ID NO: 61516 - RNA, 64 nt, hsa
ccucagagcugguggggcuccagaucaggccuuggccucugagcccugccugcucugggccaug

SEQ ID NO: 61517 - RNA, 64 nt, hsa
uuucuggacaagaccucuggccgaccuggggauggccucugaucccuggagcaguggcccacuu

SEQ ID NO: 61518 - RNA, 64 nt, hsa
guccuuccaggccucuuccccuuuccuccaucucuggcaacaguucuugggguuuggcaauugu

SEQ ID NO: 61519 - RNA, 64 nt, hsa
ggggaagagaauuacauuuccagggucagaaacuuggcaacaguuuuccuagagugacucagac

SEQ ID NO: 61520 - RNA, 64 nt, hsa
ugaaugucagccuaagaggccaagcugcagaucguggcaacagaugagcucuguuaaccuccug

SEQ ID NO: 61521 - RNA, 64 nt, hsa
gcuauucugaaccuugcuuuuuucagauauauguuggcaacaguuccaugucaguacauaguuu

SEQ ID NO: 61522 - RNA, 64 nt, hsa
uuucagccccaggccuuugcugcaagugacccuguggcaacaguggauucucagacaugauacu

SEQ ID NO: 61523 - RNA, 64 nt, hsa
guugaccuucucagcaucucccuuuugccuuagauggcaacacccuccagucuguagcagagca

SEQ ID NO: 61524 - RNA, 64 nt, hsa
aaacuggagagaaaccuuacaaaugugaugaguguggcaacaccuuuggucaaaauucauaccu

SEQ ID NO: 61525 - RNA, 64 nt, hsa
auaguggagagaaaccuuaaaaguguaaugaguguggcaacaccuuccaucacaauucaacccu

SEQ ID NO: 61526 - RNA, 57 nt, hsa
uagaagaaaagccugaaacugaguugaauagagaagugugacccugugacaaaauga

SEQ ID NO: 61527 - RNA, 57 nt, hsa
acugaugaaggauucauaaucacaaauauagagaauuccuauuuaaaaaaauagaaa

SEQ ID NO: 61528 - RNA, 57 nt, hsa
gaaaaaacugaagguacuuuacucccuauagagaaaccauugccaucauuguagcaa

SEQ ID NO: 61529 - RNA, 57 nt, hsa
cuuuuaucaacuguauacugguguuuaauagagaaugauugucuuccgaguuuuuug

SEQ ID NO: 61530 - RNA, 57 nt, hsa
cauuuaacaauaaucugauacacauaaauagagaaagagcaauugauaaaguaaaug

SEQ ID NO: 61531 - RNA, 57 nt, hsa
uagauagauagauagauagauagauagauagagaaaugagaagguuucucuuuugca

SEQ ID NO: 61532 - RNA, 57 nt, hsa
uggaaccuuaaauacuucugguaaaccauagagaauggaggauggcugugaugaagc

SEQ ID NO: 61533 - RNA, 57 nt, hsa
cagaacaaauacauaaaauaacuucccauagagaacaggauauagcaauaauagcuc

SEQ ID NO: 61534 - RNA, 57 nt, hsa
gauuuacuuuucugaucucuuugagaaauagagaaauauaaaaguguguucuuaacu

SEQ ID NO: 61535 - RNA, 57 nt, hsa
ugaauuauuuucauauaaauauagaaaauagagaaaaggcuaugccuguaauuuuua

SEQ ID NO: 61536 - RNA, 57 nt, hsa
uuuaagguguauuggcauguaauuugcauagagaagguccucugguuagucucucaa

SEQ ID NO: 61537 - RNA, 57 nt, hsa
acaacauaaauuuagaccauaacuuuuauagagaaaggguuuugucaaauguuuucu

SEQ ID NO: 61538 - RNA, 57 nt, hsa
uuuuauuugacuuauagagaauagcauauagagaauaaucauguugacuuugugaau

SEQ ID NO: 61539 - RNA, 57 nt, hsa
cauuaccacuaaaauuuuauuugacuuauagagaauagcauauagagaauaaucaug

SEQ ID NO: 61540 - RNA, 65 nt, hsa
uacuaaauugggcagggcuuuuuaguaucaaaucacuacuagaccauuuaauuuguuaaauuauc

SEQ ID NO: 61541 - RNA, 65 nt, hsa
agaaggagggggucugggcaucuguggauuuuuggcuacuagaagugucccagaagucacuguau

SEQ ID NO: 61542 - RNA, 64 nt, hsa
uaccugaugaagagcauaauuucugcauauccauccucaauaccaugguaaauucuggggcaau

SEQ ID NO: 61543 - RNA, 64 nt, hsa
caauagagaagcaacagaacugccacaaaguauaccucaauauaauuccucuaguucugcuucu

SEQ ID NO: 61544 - RNA, 64 nt, hsa
aacaccugcucucaccugagccccaggugaaggggcccgggaacaccugcucucaccugagccc

SEQ ID NO: 61545 - RNA, 64 nt, hsa
aacaccugcucucaccugagccccaggugaaggggcccgggaacaccugcucucaccugaaccc

SEQ ID NO: 61546 - RNA, 64 nt, hsa; identical to SEQ ID NO: 61544

SEQ ID NO: 61547 - RNA, 64 nt, hsa; identical to SEQ ID NO: 61545

SEQ ID NO: 61548 - RNA, 64 nt, hsa; identical to SEQ ID NO: 61544

SEQ ID NO: 61549 - RNA, 64 nt, hsa
aacaccuccugucaccugagccccaggugaaggggcccgggaacaccucucaccugaacccggg

SEQ ID NO: 61550 - RNA, 64 nt, hsa
cggaaggagacugugguuuuuguguguguggacagcccgggagcuuugagacaggugccugggg

SEQ ID NO: 61551 - RNA, 64 nt, hsa
gggcacuguggucaggcccagccucucuggcucagcccgggauccugauggcacccacacagag

SEQ ID NO: 61552 - RNA, 64 nt, hsa
gcgugcugcuccuuugcuucggaccuccgccucugcccgggagaaagcccaggccagccugcug

SEQ ID NO: 61553 - RNA, 64 nt, hsa
aauuaguggaggccacaguuguagcaggcgcuaggcccgggaggagagugcauggugcagaggg

SEQ ID NO: 61554 - RNA, 64 nt, hsa
ccugcugacccccuccuccagagcagccagcccagcccgggaacaagacggacuuccucucccu

SEQ ID NO: 61555 - RNA, 64 nt, hsa
uacgccaagggcagguuucuggagacucccuugugcccgggauggcaagggcaccgggcuggcg

SEQ ID NO: 61556 - RNA, 64 nt, hsa
guauauucuggcaaacugucucuuacuggucagaaugucauagaagugaugucggcugcuagcu

SEQ ID NO: 61557 - RNA, 64 nt, hsa
gugaugucggcugcuagcuuccuucagaugacugaugucauaaguguauguaagacuuuuauua

SEQ ID NO: 61558 - RNA, 64 nt, hsa
aaauuuugaccugccuauguaagauuaagugguaaugucauagugguggguuuuuaagucuuaa

SEQ ID NO: 61559 - RNA, 64 nt, hsa
guuaaucccaccccaucaaaagguauuccuagaaaugucauagaccuagguaacuuugaauuga

SEQ ID NO: 61560 - RNA, 64 nt, hsa
acaauaauugaugcccuuaaaaugcugaagacagaugucauacccacuguguagccuguguaug

SEQ ID NO: 61561 - RNA, 64 nt, hsa
auucuaugcuuuaaaaugaggauggaaaaguuucaugucauaagucaccaccuggacaauaauu

SEQ ID NO: 61562 - RNA, 64 nt, hsa
aaccaauuggaagggaaguuagacaagcuuuggggaagagaaaaggaauauaguccauuuccaa

SEQ ID NO: 61563 - RNA, 64 nt, hsa
gagcaggaacucccaaccuuaaguuaauuucacugaagagaauuuucccuuuuuuuuuuuuuuu

SEQ ID NO: 61564 - RNA, 64 nt, hsa
gcuuaaaggggcuagagugaacuugggccacugugaagagaaccauaucaagacucuuuggaca

SEQ ID NO: 61565 - RNA, 64 nt, hsa
guuuagcccaaaaccaagucaagugaaaaaggaggaagagaaaaaauauuuuccugccaggcau

SEQ ID NO: 61566 - RNA, 64 nt, hsa
auuugguagaagaaauauuuuucaccugagagaggaagagaaauuucucuaguaacacaaagag

SEQ ID NO: 61567 - RNA, 64 nt, hsa
caaguaacuggugaacuuuggagguuuggagcuugaagagaauggcuaagaagauuugaauuau

SEQ ID NO: 61568 - RNA, 64 nt, hsa
auaaauucauuguauguuagaauugcaauagaaugaagagaaacauuuagcuaguaacgugauc

SEQ ID NO: 61569 - RNA, 64 nt, hsa
uucucaggcaacauuugcuuuuaaaaauaaucaugaagagaaggcuguuaaagcaaaaauuuuu

SEQ ID NO: 61570 - RNA, 64 nt, hsa
uuaaagaacuucaacauaguuucggaauuguggggaagagaagagugacugagcugagaaguaa

SEQ ID NO: 61571 - RNA, 64 nt, hsa
aagccuuaucucagucuauuuggaagagagggaggaagagaaggaaguaacccaaaguacuacu

SEQ ID NO: 61572 - RNA, 64 nt, hsa
aagagaacauggcauuaaaagaaucacaucuucagaagagaagacacuaauauuauuacccaua

SEQ ID NO: 61573 - RNA, 64 nt, hsa
agugcugcuacaaucuaagucaggucaccagagggaagagaacauggcauuaaaagaaucacau

SEQ ID NO: 61574 - RNA, 64 nt, hsa
acaacagugauucugaagagaaggacaagucuaagaagagaaagcuucaugaagaacuuucuag

SEQ ID NO: 61575 - RNA, 64 nt, hsa
aaacaaguguucagggcauaacaacagugauucugaagagaaggacaagucuaagaagagaaag

SEQ ID NO: 61576 - RNA, 64 nt, hsa
gugugaggauuucccaguacuggauggagaaugagaagagaaagucagccuuucuggggcuuuc

SEQ ID NO: 61577 - RNA, 64 nt, hsa
gauaaaggcaacccaaugaaaccacagagaggcagaagagaacgggcagaaguacagaacagaa

SEQ ID NO: 61578 - RNA, 64 nt, hsa
auucugugaauuuuugaaagucaacaguucaggagaagagaaggaauuugaagagaaaaaggaa

SEQ ID NO: 61579 - RNA, 64 nt, hsa
gaaagucaacaguucaggagaagagaaggaauuugaagagaaaaaggaaaauuaaaauuacuaa

SEQ ID NO: 61580 - RNA, 64 nt, hsa
ucucugaaagcagaaaaaggcacugauauaaagggaagagaaggaggcucaccggagggaagag

SEQ ID NO: 61581 - RNA, 64 nt, hsa
gauauaaagggaagagaaggaggcucaccggagggaagagaacauagugaagauucccgccuuu

SEQ ID NO: 61582 - RNA, 64 nt, hsa
aaugcaaaugaacuagacaugccaacagcuuggggaagagaauuccauacugaaagaagagcaa

SEQ ID NO: 61583 - RNA, 64 nt, hsa
caaacuauacacggucguccaucaaaauccuggggaagagaauaacucauuuaauauucugaca

SEQ ID NO: 61584 - RNA, 64 nt, hsa
acucaccucccaaucaccccaaacaaauggaagagaagagaaaggacauggcguauuuuguauu

SEQ ID NO: 61585 - RNA, 64 nt, hsa
uuaaaacucaccucccaaucaccccaaacaaauggaagagaagagaaaggacauggcguauuuu

SEQ ID NO: 61586 - RNA, 64 nt, hsa
uugaaaggaaaguauguccuagcuuagccauucagaagagaaaaauggaauaucagaguuacag

SEQ ID NO: 61587 - RNA, 64 nt, hsa
uacuacgucggccauaaacagcuauccugcuuuggaagagaagcaucaugagccaauuugauag

SEQ ID NO: 61588 - RNA, 64 nt, hsa
cuauuuauauauuguaucagauggagagaccagagaagagaacaagcuguugauuccuaagcag

SEQ ID NO: 61589 - RNA, 64 nt, hsa
uucauaccuacuugaacaucagaggguccaucaugaagagaaagccuaugaguaugaugaauau

SEQ ID NO: 61590 - RNA, 64 nt, hsa
gcaaaugguacuguccacagugcacugcugcaaugaagagaagaggcagcagacacaaauaaag

SEQ ID NO: 61591 - RNA, 64 nt, hsa
cuucagcugaagauuuuauauaggacuuuaaaaagaagagaagagaaagaagaaacaaugcauu

SEQ ID NO: 61592 - RNA, 64 nt, hsa
gcugaagauuuuauauaggacuuuaaaaagaagagaagagaaagaagaaacaaugcauuuccag

SEQ ID NO: 61593 - RNA, 64 nt, hsa
cguuuaaauccuguacagguuccuuucagaccuggaagagaacuuugagaacaauaucuucucc

SEQ ID NO: 61594 - RNA, 64 nt, hsa
ucacccgccucaaacugcugcuccagaacauucugaagagaacacagccuggcuccucggagga

SEQ ID NO: 61595 - RNA, 64 nt, hsa
uucagggugauaaacagaauauucuucuguagaggaagagaaaggagugaaaguuuagcccacu

SEQ ID NO: 61596 - RNA, 64 nt, hsa
caagaaugagaagcuugaaugggcaguagaugaugaagagaaaaaaaagucucccucagaaagu

SEQ ID NO: 61597 - RNA, 64 nt, hsa
aucuugucguuucuuggaagucacagggaagauugaagagaacgcuugagcauccuuggcaaca

SEQ ID NO: 61598 - RNA, 64 nt, hsa
cauacguuuucucaagaacuucaguuuauaauuggaagagaaauuuuugcuguuaaugccagaa

SEQ ID NO: 61599 - RNA, 64 nt, hsa
ccuuuuagaaggucugauaaggauauuuaaggaagaagagaaugacucuguuauuaaagguggc

SEQ ID NO: 61600 - RNA, 64 nt, hsa
cccuguucacuuuuucucuuccacuuccaauuaugaagagaaaauauuuguucaggguuguccc

SEQ ID NO: 61601 - RNA, 64 nt, hsa
uuucuggggaaaggggacaaggaaggaaaagaaagaagagaaggggagaaacccuaaaaagaga

SEQ ID NO: 61602 - RNA, 64 nt, hsa
aaaagagcucagacauuuucuuuuuuuaacuggugaagagaaaaaggcugaaaagaaggaauau

SEQ ID NO: 61603 - RNA, 64 nt, hsa
uuauuuuagccuuagagccuuacacuuguuucaugaagagaaaggacuugcauaaccaaaauaa

SEQ ID NO: 61604 - RNA, 64 nt, hsa
cggagcaacauaaugcucauagaaucuucuagaagaagagaaacaaagggauugauaaaaugcu

SEQ ID NO: 61605 - RNA, 64 nt, hsa
aaccaaacaaugacuccucauuccagcggugacagaagagaaagggucauuuacaucaggaaag

SEQ ID NO: 61606 - RNA, 64 nt, hsa
uucucaguggaaagaguuugaucugcagcacccagaagagaagccaaacucggugucauucuga

SEQ ID NO: 61607 - RNA, 64 nt, hsa
gaagagaaugcccaaaggaacguuuauuuccgaggaagagaaugcugagccaggguuuaaguca

SEQ ID NO: 61608 - RNA, 64 nt, hsa
gugucuuuaacguagaugagacgagacuugauuggaagagaaugcccaaaggaacguuuauuuc

SEQ ID NO: 61609 - RNA, 64 nt, hsa
ggaagacuugaaagaaaggggcaggagcucagaugaagagaaauccuaaguuaccuuucuaggu

SEQ ID NO: 61610 - RNA, 64 nt, hsa
gaagggaagaaaaggugaaaaauuagaaauguucgaagagaacugaugacacugagaacagauc

SEQ ID NO: 61611 - RNA, 64 nt, hsa
uuaccgaagaggggccaagaaauuagaguccucagaagagaacuuaucuagugaggaugaagag

SEQ ID NO: 61612 - RNA, 64 nt, hsa
auuugucaauccuagccuuccaagagaagaaaaagaagagaaacuagaaacaguuaaagugucu

SEQ ID NO: 61613 - RNA, 64 nt, hsa
acuaagagaauaucucuuggugucauaucuaggggaagagaauuaacuagaauuaaauuuaaug

SEQ ID NO: 61614 - RNA, 64 nt, hsa
ccaaaggaagucaaggaagaaaaagcauggaaaggaagagaacugauuccuacugaaaauucaa

SEQ ID NO: 61615 - RNA, 64 nt, hsa
agaggaaacaucuuaccaucuggucauucauacugaagagaaacuccauaaguaucaucucugu

SEQ ID NO: 61616 - RNA, 64 nt, hsa
agggacauucaaacaaaggaggaggagucauagggaagagaaagaaauggaagcacagcuucuu

SEQ ID NO: 61617 - RNA, 64 nt, hsa
aaagggaacaucuuaccaucuggccauucacacugaagagaaacuucauaagcauccucucuuu

SEQ ID NO: 61618 - RNA, 64 nt, hsa
agggauauuuaaacaaaggaagaggaaauauagggaagagaaagaaaccacagcuucuuuuaga

SEQ ID NO: 61619 - RNA, 64 nt, hsa
auucacacuacagagaaacuugaaauauaaagaagaagagaaagccuucagugaugccucugug

SEQ ID NO: 61620 - RNA, 64 nt, hsa
aaauagcauucaguaacuccuauuaauucacucugaagagaaaccuuuugaggacaaucuguau

SEQ ID NO: 61621 - RNA, 64 nt, hsa
ucccaaacuaucagccuugauuaauuucuaguaggaagagaauaauuacauuugcggggggggg

SEQ ID NO: 61622 - RNA, 64 nt, hsa
guauuuuguuugggaaaaaaacuaucaaaaugaggaagagaauuuccccuauuuaugcacuagg

SEQ ID NO: 61623 - RNA, 62 nt, hsa
ugaaaauccucaauaaaauacuggcaaaccgaauccagcagcacaucaaaaagcuuauccac

SEQ ID NO: 61624 - RNA, 62 nt, hsa
gcugguucaacauacgcaaaucaauaaauguaauccagcauauaaacagaaccaaagacaga

SEQ ID NO: 61625 - RNA, 64 nt, hsa
caucacugaggcugcgggcaccacgcgggguccggccugggauccaggcuaagggccggcggaa

SEQ ID NO: 61626 - RNA, 64 nt, hsa
aaucccggcgcggguuccgcugacgcagcgccccgccugggagccgcgggcaggcgagacuggc

SEQ ID NO: 61627 - RNA, 64 nt, hsa
cccagaccucccaguggggacggggcagggccuggccugggaagagcacagcugcagaucccag

SEQ ID NO: 61628 - RNA, 64 nt, hsa
guuaacuacccuacaccucugggcccugcaggaggccugggagggcaaggguccuacggaggga

SEQ ID NO: 61629 - RNA, 64 nt, hsa
acacuagacaugccaacucgggagcauucugccugccugggaacgggguggacgagggaguguc

SEQ ID NO: 61630 - RNA, 64 nt, hsa
gugugcacacguguguaugagugcgcagaucugugccugggaucgugcauuugaggggccaggg

SEQ ID NO: 61631 - RNA, 64 nt, hsa
gggucugcccugcccauacugagccugccaaagugccugggaagcccacccagauucugaaaca

SEQ ID NO: 61632 - RNA, 64 nt, hsa
cucuuggucccuggucccucguccacaggggcaggccugggacccagcuacucuguccaggcca

SEQ ID NO: 61633 - RNA, 64 nt, hsa
cuaagcccucgaaccaaggcagccuccagagccagccugggacucccagugaacuuacacuugg

SEQ ID NO: 61634 - RNA, 64 nt, hsa
uguguugagccugggauggaggagcccuaggccagccugggauaagagucccacagucuaggga

SEQ ID NO: 61635 - RNA, 64 nt, hsa
cacaguuccuccccuaaucugguuucuguguugagccugggauggaggagcccuaggccagccu

SEQ ID NO: 61636 - RNA, 64 nt, hsa
aguuuaggcuuucgcggaggggaggagacauggagccugggaacuccuuguucuccccucugcu

SEQ ID NO: 61637 - RNA, 64 nt, hsa
gugggugcuggcugagcuuugggccgggaaggcagccugggaaucugaggcuggagacaggggu

SEQ ID NO: 61638 - RNA, 64 nt, hsa
ggauggagcaucaacagcagggugggcuuguggggccugggaggggcaauccucaaaugcgggg

SEQ ID NO: 61639 - RNA, 64 nt, hsa
uccgcuuggagcuauuuuccaggcuucugcuggggccugggacaacugcucccaccuccugaca

SEQ ID NO: 61640 - RNA, 64 nt, hsa
gcuuaggauauucucauguuucugagggauuacagccugggaggauuccaccgaucuucacuuc

SEQ ID NO: 61641 - RNA, 64 nt, hsa
uggggaucugggugaaggggguugaguagcgacugccugggagauggcuguuaguaggucugug

SEQ ID NO: 61642 - RNA, 64 nt, hsa
aaaaauaaaaaauuaaccaggugugguggcacgugccugggagucccagcgacuugggaggcug

SEQ ID NO: 61643 - RNA, 64 nt, hsa
cgacuugggaggcugaggugggaggauuguuugagccugggaggucgaggcuguagugagcccu

SEQ ID NO: 61644 - RNA, 64 nt, hsa
gcccuggggaagaggccuugggggucugcucugugccugggaucaguggggccccaaagcccag

SEQ ID NO: 61645 - RNA, 64 nt, hsa
ugucugcauggcagaagcgucucccuuggccacggccugggagggugguuccuguucucagcau

SEQ ID NO: 61646 - RNA, 64 nt, hsa
aggggucccagaaagggacagggaaauaaauggugccugggaugagauucaaucuauauuuguc

SEQ ID NO: 61647 - RNA, 64 nt, hsa
gaagggaugugaggcacuguggggcaggacaagggccugggauuugguucguuugcucuucugg

SEQ ID NO: 61648 - RNA, 64 nt, hsa
gagcacucgcggcgugggugggcugaguggaggugccugggagcugccuaaauucagaagccuc

SEQ ID NO: 61649 - RNA, 64 nt, hsa
uucugugagggagaaucagggcucgggaagccacgccugggaaggcaggacacaggacacagca

SEQ ID NO: 61650 - RNA, 64 nt, hsa
aggugcgguguggccaccgccacccucauccccugccugggaggcucucccaggggcugauggg

SEQ ID NO: 61651 - RNA, 64 nt, hsa
cccuguauuaggccauuaugauuagagauaagcagccugggagaaacauacaagaccuguggcu

SEQ ID NO: 61652 - RNA, 64 nt, hsa
caggggcuucugggaaauacagguuuuggauucugccugggaagagagucauaguaugaagaag

SEQ ID NO: 61653 - RNA, 64 nt, hsa
uuuucugcagcaagcacugucaagacagcggcaggccugggauggagcccaucucuccaguucc

SEQ ID NO: 61654 - RNA, 64 nt, hsa
gccugcgccugaguucgcggguccuccgcaggccgccugggaaccggagccuggcgugccggag

SEQ ID NO: 61655 - RNA, 64 nt, hsa
guugcucuggcaggggcagaauccucacaggaucgccugggaggugaggugugugugacccacu

SEQ ID NO: 61656 - RNA, 64 nt, hsa
gugugugcucucagggaagggcccaggaucccaugccugggaggagcugccagagagaagcaaa

SEQ ID NO: 61657 - RNA, 64 nt, hsa
uaaacuuuccugaguuuagaaauuuaguccuuuggccugggagguccaggcugcaaugagccaa

SEQ ID NO: 61658 - RNA, 64 nt, hsa
cugcaaugagccaagaucacgccacugaacuccagccugggagacagcaagacccugucugaaa

SEQ ID NO: 61659 - RNA, 64 nt, hsa
uccuucacuguucccucuggcuucccauaguggggccugggaggguuccccuggccuuaaaagg

SEQ ID NO: 61660 - RNA, 64 nt, hsa
ccucuucacuguggccacagcccccuugcccuccgccugggaucugaguacauauuguggugau

SEQ ID NO: 61661 - RNA, 64 nt, hsa
aaguuggccugcccggccuuugggacaucugugugccugggaggcugccaggggguggggcuuc

SEQ ID NO: 61662 - RNA, 64 nt, hsa
aucugaaccuggucucagcaggcagguggcuggggccugggagaggccaggugaaugggaggcc

SEQ ID NO: 61663 - RNA, 64 nt, hsa
ccaggaguauggcugaggccuugcccacccaccugccugggaagugcagaguggauggacgggu

SEQ ID NO: 61664 - RNA, 64 nt, hsa
cugaguccucugccccuuccaaggacacuaaugagccugggaggguggcagggaggaggggaca

SEQ ID NO: 61665 - RNA, 64 nt, hsa
uccgccagugcuuucaguaggaagagcugaggcugccugggaggcccggggcgaccggaaaagg

SEQ ID NO: 61666 - RNA, 64 nt, hsa
gaagucucugggaucccgcugugggucugagauggccugggaaggaccuuguggacaaugguuu

SEQ ID NO: 61667 - RNA, 64 nt, hsa
uguggacauauguuuucauuucucuuugguauaugccugggagcagauuugcuggaucauauga

SEQ ID NO: 61668 - RNA, 64 nt, hsa
ugcuugccaucucuagggauugggggauuggcuagccugggaggaucagucuguccaggucagc

SEQ ID NO: 61669 - RNA, 64 nt, hsa
gcugggcucccgugucuucucacagggcucgcacgccugggagguggcccuuggggggcugcag

SEQ ID NO: 61670 - RNA, 64 nt, hsa
gacgggcugguauagucccaggcuggagcuggaugccugggaaccacucaccuccuucugugcc

SEQ ID NO: 61671 - RNA, 64 nt, hsa
uuuuuucggaggggguugguggggaggucgggaugccugggaucccuuccuggagaggcaggcu

SEQ ID NO: 61672 - RNA, 64 nt, hsa
cgccagggagcaccuggugagucugccggcgguggccugggauuggcugugaggucccuccgca

SEQ ID NO: 61673 - RNA, 64 nt, hsa
cuguccaggaagagcuguguggccuggcaagcaagccugggagccggcgggaggucugccaggc

SEQ ID NO: 61674 - RNA, 64 nt, hsa
gccccuggagggccuggcauguuuguccugcucugccugggacugagcgaguggacuuagggcu

SEQ ID NO: 61675 - RNA, 64 nt, hsa
acuggggucugaagaucagggucaguguggcugugccugggaauuccagaccugagguugggaa

SEQ ID NO: 61676 - RNA, 64 nt, hsa
uucuaccuaggacucuucccuggagucaugggcugccugggacccaggacccaugagggggcug

SEQ ID NO: 61677 - RNA, 64 nt, hsa
uggcugggcccacggaaggucggccugggauguggccugggacugcugcucugcuggcugcugu

SEQ ID NO: 61678 - RNA, 64 nt, hsa
gcucauagggaauggcugggcccacggaaggucggccugggauguggccugggacugcugcucu

SEQ ID NO: 61679 - RNA, 64 nt, hsa
accgucuuuucaaauggccugggagagucaaauggccugggagagggggccugcccuucucugc

SEQ ID NO: 61680 - RNA, 64 nt, hsa
aaugguaugugaagaugcaccgucuuuucaaauggccugggagagucaaauggccugggagagg

SEQ ID NO: 61681 - RNA, 64 nt, hsa
gagaggguccaagggugauggagaaggaagcauggccugggagcuuggaagggagggguggugg

SEQ ID NO: 61682 - RNA, 64 nt, hsa
gugccugugugugaaccugggggccauccugguggccugggagcgugaggagaggcccccugug

SEQ ID NO: 61683 - RNA, 64 nt, hsa
ccaacaaauucagccuccucucccaggggccucagccugggaagucaccaagcagaucccuccu

SEQ ID NO: 61684 - RNA, 64 nt, hsa
uauagugcggggcccugcgacugguaccgugagcgccugggaugagguuugggcggauuucggg

SEQ ID NO: 61685 - RNA, 64 nt, hsa
caccaucugcauguccccacugggccugagucuagccugggagccaggauacugggguccuuuu

SEQ ID NO: 61686 - RNA, 64 nt, hsa
gcaauuacuuuguucacuguaugcacccgcgggggccugggaguccccauuugcagguggguag

SEQ ID NO: 61687 - RNA, 64 nt, hsa
auuuacuuauuaguuuuuaaaaauugcgcuacuugccugggaaacauagcagaccucguuucua

SEQ ID NO: 61688 - RNA, 64 nt, hsa
uuacagugagcaaagauugugccacuacacuccagccugggagacagagcgagacucuugucuc

SEQ ID NO: 61689 - RNA, 64 nt, hsa
ugucacuggcuucagugaacacagacacugcagagccugggagcaggggaggggaauaguugag

SEQ ID NO: 61690 - RNA, 64 nt, hsa
gaaucggucucauuagagugacucuuagaagguggccugggacuagacagccccucugagcaca

SEQ ID NO: 61691 - RNA, 64 nt, hsa
ggauggcugggucccccagccccugccagcagcugccugggaaggccguguuucagcccugaug

SEQ ID NO: 61692 - RNA, 64 nt, hsa
uccaggagacccuagaugugcucguacucccucggccugggauuucagagcuggaaauauagaa

SEQ ID NO: 61693 - RNA, 64 nt, hsa
cuauccaugcacuuggguggaggggagucucugugccugggaauuaggaccccugcuccaacca

SEQ ID NO: 61694 - RNA, 64 nt, hsa
cagccuggauccuuccagagcaucccuccuggaggccugggaugggguaggucugcagcuagcc

SEQ ID NO: 61695 - RNA, 64 nt, hsa
agggacuggaaaccuuccuccucgggaaagaaaugccugggaggaagggaagccugauauucag

SEQ ID NO: 61696 - RNA, 64 nt, hsa
guccugagguacagagccacugccaccacuggcggccugggaccagcugggugucagccacgga

SEQ ID NO: 61697 - RNA, 64 nt, hsa
ugagggucuggcacauccuuaauccugugccccugccugggacagaaauguggcuccaguugcu

SEQ ID NO: 61698 - RNA, 64 nt, hsa
ccuggagcuacagggacagggagccaucauuccugccugggaauccuggaagacuuccugcagg

SEQ ID NO: 61699 - RNA, 64 nt, hsa
ccucugcagagacucccuucaccucgcacuuacugccugggaaccacggcccuucucuucugug

SEQ ID NO: 61700 - RNA, 64 nt, hsa
cucuggccaggguugcuuggagaaggcucagugugccugggacagggcuuaccaccugccacca

SEQ ID NO: 61701 - RNA, 64 nt, hsa
uccucauagguagguggccuuggccuucaucccagccugggaugcuccauugcauuugucaccu

SEQ ID NO: 61702 - RNA, 64 nt, hsa
aaagcaccccugaguuccaucuuccugacauguugccugggaugugacgggccugacaucuccc

SEQ ID NO: 61703 - RNA, 64 nt, hsa
cacucaagguguucguggggcuggcuccugaagggccugggaggguccaucagcugccuccagc

SEQ ID NO: 61704 - RNA, 64 nt, hsa
cccgagcgcagaggcggagcugugcucagcacaggccugggaccucccccggcaggcaccugug

SEQ ID NO: 61705 - RNA, 64 nt, hsa
agccagucugccucuuccuccuacuucugcuguagccugggaccagaccuggccaaggucagcc

SEQ ID NO: 61706 - RNA, 64 nt, hsa
agucucuuucugugaaggcuuuuuuuuuccuuuggccugggaauuuuucccauuuuuaugaagg

SEQ ID NO: 61707 - RNA, 64 nt, hsa
cuaccugggaggcugagguaugaggauugcuugagccugggaguuugaggcugcagugagcuau

SEQ ID NO: 61708 - RNA, 64 nt, hsa
ccaccuuuccagcaagacccccaguggcugcccagccugggagcaccucuuugcuuuucacacc

SEQ ID NO: 61709 - RNA, 64 nt, hsa
ccuucuccagaggcugucacugcaggagccgugggccugggaagacuuggaagcggccucucuc

SEQ ID NO: 61710 - RNA, 64 nt, hsa
ucccacccucuggaggccugggaaccuggcugcagccugggaaggcuggagaggcagacggugg

SEQ ID NO: 61711 - RNA, 64 nt, hsa
cuaccugcaccugcuguggucccacccucuggaggccugggaaccuggcugcagccugggaagg

SEQ ID NO: 61712 - RNA, 64 nt, hsa
gagccuuggcccacacugaggcuuaggccucucugccugggaugggcucccacccuccccugag

SEQ ID NO: 61713 - RNA, 64 nt, hsa
cgaucgcccaggcuggagcuggccccgcuugguggccugggaucuggcacacucccucuccuug

SEQ ID NO: 61714 - RNA, 64 nt, hsa
ccacucaagaggcacaggcgggaggaucacuugagccugggagguugugguugcagugagcuau

SEQ ID NO: 61715 - RNA, 64 nt, hsa
gcacagccaacagccaccagcagccaggagacaggccugggacgggcucucccucacagccucc

SEQ ID NO: 61716 - RNA, 64 nt, hsa
uccagcggccaguucacuacgcaguaucucuggggccugggaccagccacgugccgagcuguca

SEQ ID NO: 61717 - RNA, 64 nt, hsa
auggccuuucccuucugcaggugcgggcaggugggccugggaccggugcuggggccucuccuug

SEQ ID NO: 61718 - RNA, 64 nt, hsa
guggugccgggggcagggugcgugggaggacggagccugggagcggggcggggccgccgcgcaa

SEQ ID NO: 61719 - RNA, 64 nt, hsa
ugggcuccugcccaggacaggcaccagggucauggccugggaccuggacacuggccccuccacc

SEQ ID NO: 61720 - RNA, 64 nt, hsa
guaaacguucaggaggaccagggcagcaucuggggccugggauggccacagaaggggcaggcca

SEQ ID NO: 61721 - RNA, 64 nt, hsa
gucucugcgaagucaaaggccugacagcucuguggccugggaauccauuuuccugcggcagagc

SEQ ID NO: 61722 - RNA, 64 nt, hsa
uugcucccaagaggaggagagggaggcugcagaugccugggacucagaccaggaagcugugggc

SEQ ID NO: 61723 - RNA, 64 nt, hsa
guucuucguucucuuccccgugaucuucccugcagccugggauggccagggucugauggcugga

SEQ ID NO: 61724 - RNA, 64 nt, hsa
caggcucuuggggaggcagagaagccaccuucaggccugggaaggaagacacugggaggaggag

SEQ ID NO: 61725 - RNA, 64 nt, hsa
agagucuuaucugagcugagccaggcuagcuggagccugggauuucuaugcaguggccccuuag

SEQ ID NO: 61726 - RNA, 64 nt, hsa
agcuaacccagguccccucauuccuucaacuugugccugggagugugugguguuagggugcagc

SEQ ID NO: 61727 - RNA, 64 nt, hsa
aaagcaggaugcaggaugggaggacaggaaggcagccugggacauuuaaaaaaauaaaaaugaa

SEQ ID NO: 61728 - RNA, 64 nt, hsa
cuguguccaugaucugagugauagcugcacugcugccugggauugcagcugaggugggagugga

SEQ ID NO: 61729 - RNA, 64 nt, hsa
uuuuacuaaugcauucaucgcucaucuucauugcucaugguaugucaaaccuuugggguuugac

SEQ ID NO: 61730 - RNA, 64 nt, hsa
aaaaauauaauuucuuucuuuacuuauauucaccucaugguagguuauauugaaggcugacaug

SEQ ID NO: 61731 - RNA, 64 nt, hsa
augcaaguucaugguaucgugcauguucgugguaucaugguaucauucaugcguguuugaauag

SEQ ID NO: 61732 - RNA, 64 nt, hsa
cuacacauacguagcccggcaccgugaugcaaguucaugguaucgugcauguucgugguaucau

SEQ ID NO: 61733 - RNA, 64 nt, hsa
aaggaaacuuugaaggguuaaauagagauuuaaaaaaauaaaauaaaaaggcugggcuagggug

SEQ ID NO: 61734 - RNA, 64 nt, hsa
aacuuugaaggguuaaauagagauuuaaaaaaauaaaauaaaaaggcugggcuagggugcuuuu

SEQ ID NO: 61735 - RNA, 64 nt, hsa
uuauuuguguucuaacaggaggaugaacuugcugaaaauaaaacuuugcuauguauuuacucuu

SEQ ID NO: 61736 - RNA, 64 nt, hsa
agcaccaguauauugcuggcagcuauuguauuaaaaaauaaaguauauuuucacuaucauaaag

SEQ ID NO: 61737 - RNA, 64 nt, hsa
aaguuacuguuguuuacagugaguuuggggaaaaaaaauaaaauaaaaauggcuuucccagucc

SEQ ID NO: 61738 - RNA, 64 nt, hsa
acuguuguuuacagugaguuuggggaaaaaaaauaaaauaaaaauggcuuucccaguccuugca

SEQ ID NO: 61739 - RNA, 64 nt, hsa
caugcuaucagaaacaguauuuucuucccaaaucaaaauaaaagaaauaugaucagagcuugaa

SEQ ID NO: 61740 - RNA, 64 nt, hsa
aauaugaucagagcuugaacacaggcuuauuuuuaaaauaaaaauauuuuuaacauggguuucc

SEQ ID NO: 61741 - RNA, 64 nt, hsa
augcuagcaugauuuuuuuauauauagaaguuuaaaaauaaaccaggucagguuuguauaugua

SEQ ID NO: 61742 - RNA, 64 nt, hsa
uuucagccaucaguucaagagccaaugccuuuuuaaaauaaagcuucuguggucuuguuuuuaa

SEQ ID NO: 61743 - RNA, 64 nt, hsa
uuuguaguggaguucauaucacauuauguuuugcaaaauaaaacuuguuuugucacaauauuuu

SEQ ID NO: 61744 - RNA, 64 nt, hsa
uaauuuuaauaaauuauauaauuauacauauuguaaaauaaagaccgguauuuuauuuucugcu

SEQ ID NO: 61745 - RNA, 64 nt, hsa
uggauagaacccauacaugaauuaaaugaugcacaaaauaaauggcuguugaaauuuggaaaug

SEQ ID NO: 61746 - RNA, 64 nt, hsa
gagcuaaugauagauagaaaugcccacucaaagaaaaauaaacagagacaaauguuaaaauugc

SEQ ID NO: 61747 - RNA, 64 nt, hsa
auacagacuguuuuucccccuguuguuucacuuuaaaauaaaaagaaauccuugauuaaucaga

SEQ ID NO: 61748 - RNA, 64 nt, hsa
uauggacugccuuauugcuguugcuuaucauuugaaaauaaaauccagcucagguuguaacuug

SEQ ID NO: 61749 - RNA, 64 nt, hsa
cccauagaaacauucucguuuaaacaacaacaacaaaauaaauuuaucagcacuagauauuaga

SEQ ID NO: 61750 - RNA, 64 nt, hsa
gcucuguagcuaacccuuauaaacuaggcucaguaaaauaaagcacucuuauuuuuugaucugg

SEQ ID NO: 61751 - RNA, 64 nt, hsa
aguguauuuuuucagguuucuggaaauaaauaguaaaauaaauggcacaaauaguuucaauaaa

SEQ ID NO: 61752 - RNA, 64 nt, hsa
cuaaagaaauuauauuuuguucuauugcuaggguaaaauaaauacauuuguguccaacugaaau

SEQ ID NO: 61753 - RNA, 64 nt, hsa
ucuagugaacaaaaggugccuauucuuuuuuaaaaaaauaaaauaaaacauaaauauuacucuu

SEQ ID NO: 61754 - RNA, 64 nt, hsa
ugaacaaaaggugccuauucuuuuuuaaaaaaauaaaauaaaacauaaauauuacucuuccaua

SEQ ID NO: 61755 - RNA, 64 nt, hsa
caauagccuagggcugaauuuuugucagauaaauaaaauaaaucauucauccuuuuuuuugauu

SEQ ID NO: 61756 - RNA, 64 nt, hsa
cuaaauguauuuuagacuuccuguagggggcgauaaaauaaaaugcuaaacaacuggguauaca

SEQ ID NO: 61757 - RNA, 64 nt, hsa
aaaaaucaugucaucuucuauuuguacagaaaugaaaauaaaauaugaaaauaaugaaagaaau

SEQ ID NO: 61758 - RNA, 64 nt, hsa
ugggcaaaugucauuguuaccucuguguguuaagaaaauaaaaauauuuucuaaaggucuguau

SEQ ID NO: 61759 - RNA, 64 nt, hsa
ugaacauuuuucuuuuauuguuuuaucuucacagaaaauaaaagguguuaauuugcuuuuuaaa

SEQ ID NO: 61760 - RNA, 64 nt, hsa
gcugaguugauuuucuagguucuuacguauuugaaaaauaaaauugcaauucgagauaagugcu

SEQ ID NO: 61761 - RNA, 64 nt, hsa
gauccugucucaaaaauuaauuaauuaauuaauuaaaauaaacuagguaaacuuggauaggcag

SEQ ID NO: 61762 - RNA, 64 nt, hsa
uaccuugugucuucucuuguaaaaaugaaacucaaaaauaaaauaaaugugucaaauuuugaaa

SEQ ID NO: 61763 - RNA, 64 nt, hsa
ugugucuucucuuguaaaaaugaaacucaaaaauaaaauaaaugugucaaauuuugaaaaaaaa

SEQ ID NO: 61764 - RNA, 64 nt, hsa
cgcuucccucaguucaccaaaguuaccaaaauguaaaauaaaauaagacuggcucagguaagua

SEQ ID NO: 61765 - RNA, 64 nt, hsa
uuaaaucuagaaaccauuaguuugagaucucucaaaaauaaaaauaaaaauugcuuucagagag

SEQ ID NO: 61766 - RNA, 64 nt, hsa
cuagaaaccauuaguuugagaucucucaaaaauaaaaauaaaaauugcuuucagagaguagccc

SEQ ID NO: 61767 - RNA, 64 nt, hsa
aaaagcuaaauauggcacacuuguucuuuacagaaaaauaaagauauuuuaaacaaaauacuag

SEQ ID NO: 61768 - RNA, 64 nt, hsa
agguagcugugcagauguggaucaacauuuguuuaaaauaaaguauuaauacuuuaaagucaaa

SEQ ID NO: 61769 - RNA, 64 nt, hsa
uaucggcggcacaaucacuuuguagaaacuguaaaaaauaaaaguaucuccuagucccuuaauu

SEQ ID NO: 61770 - RNA, 64 nt, hsa
uuuauuuauucacacuugaauugcauuugugaucaaaauaaauguuuaaaucgcuaaaggaaaa

SEQ ID NO: 61771 - RNA, 64 nt, hsa
gcacuggaagaguuuaguguuucuuguaugcuugaaaauaaaguauguacuguuuugaaugugu

SEQ ID NO: 61772 - RNA, 64 nt, hsa
cagccuaggagacaaaacgagacuucauuuaaaaaaaauaaaaauaaaaauaaaaauaaaguca

SEQ ID NO: 61773 - RNA, 64 nt, hsa
aggagacaaaacgagacuucauuuaaaaaaaauaaaaauaaaaauaaaaauaaagucaucuugc

SEQ ID NO: 61774 - RNA, 64 nt, hsa
caaaacgagacuucauuuaaaaaaaauaaaaauaaaaauaaaaauaaagucaucuugccaccca

SEQ ID NO: 61775 - RNA, 64 nt, hsa
gagacuucauuuaaaaaaaauaaaaauaaaaauaaaaauaaagucaucuugccacccacccccu

SEQ ID NO: 61776 - RNA, 64 nt, hsa
auugaaguauauucaaccaaauacuuuaauguauaaaauaaauauuauacaauauacuuguaua

SEQ ID NO: 61777 - RNA, 64 nt, hsa
ucauuuuuuaaaaaauggacucuugaaaucuguuaaaauaaaauuguacauuuggagauguuuc

SEQ ID NO: 61778 - RNA, 64 nt, hsa
uccacccugggcaacagagcaagaccccaucucaaaaauaaauaaauauauauaaaaaauaaaa

SEQ ID NO: 61779 - RNA, 64 nt, hsa
agaccccaucucaaaaauaaauaaauauauauaaaaaauaaaaagcuauuucuaguuuauuuca

SEQ ID NO: 61780 - RNA, 64 nt, hsa
acuagagucauauaagaaauaaaaauugggcaauaaaauaaaaugauucaguguuucuuuucua

SEQ ID NO: 61781 - RNA, 64 nt, hsa
gcugcaaaagggaucuucgaaacugggcagagaaaaaauaaaguggaauauuaaguaaaaguug

SEQ ID NO: 61782 - RNA, 64 nt, hsa
ccauauugucaccuguaccugucacacaucuugaaaaauaaaacgauaauagaacuagugacua

SEQ ID NO: 61783 - RNA, 64 nt, hsa
ugauugaagugcagagaaaaaucccuuagauugcaaaauaaaauaguugaacucucugucuuca

SEQ ID NO: 61784 - RNA, 64 nt, hsa
ucaaaaaauaaaauaaaauaaaauaaaauaaaauaaaauaaaauaaaauaaaauaaaauaaaau

SEQ ID NO: 61785 - RNA, 64 nt, hsa
cugucucaaaaaauaaaauaaaauaaaauaaaauaaaauaaaauaaaauaaaauaaaauaaaau

SEQ ID NO: 61786 - RNA, 64 nt, hsa
acacucugucucaaaaaauaaaauaaaauaaaauaaaauaaaauaaaauaaaauaaaauaaaau

SEQ ID NO: 61787 - RNA, 64 nt, hsa
gagugacacucugucucaaaaaauaaaauaaaauaaaauaaaauaaaauaaaauaaaauaaaau

SEQ ID NO: 61788 - RNA, 64 nt, hsa
caacagagugacacucugucucaaaaaauaaaauaaaauaaaauaaaauaaaauaaaauaaaau

SEQ ID NO: 61789 - RNA, 64 nt, hsa
cugggcaacagagugacacucugucucaaaaaauaaaauaaaauaaaauaaaauaaaauaaaau

SEQ ID NO: 61790 - RNA, 64 nt, hsa
ccagccugggcaacagagugacacucugucucaaaaaauaaaauaaaauaaaauaaaauaaaau

SEQ ID NO: 61791 - RNA, 64 nt, hsa
uaaugagacucagucuccgaaaaauaaaaauuaaaaaauaaaggguauuucccuccuugccugu

SEQ ID NO: 61792 - RNA, 64 nt, hsa
cagucuaagcaacauaaugagacucagucuccgaaaaauaaaaauuaaaaaauaaaggguauuu

SEQ ID NO: 61793 - RNA, 64 nt, hsa
gauccacuuagagcaauaaccacuuuuuaaauguaaaauaaaaagacaaaugaaaaggcacauc

SEQ ID NO: 61794 - RNA, 64 nt, hsa
aaggaggcugcacuacaaacccaaauucugcaaaaaaauaaaaauaagccacaaaacuaaaagg

SEQ ID NO: 61795 - RNA, 64 nt, hsa
guagugccaaaaacuuuuuaaaagguaaaaaaauaaaauaaaauuacaacaugaagauucagau

SEQ ID NO: 61796 - RNA, 64 nt, hsa
accuuguagugccaaaaacuuuuuaaaagguaaaaaaauaaaauaaaauuacaacaugaagauu

SEQ ID NO: 61797 - RNA, 64 nt, hsa
gguuucuuuuacugauuuaaaaacaaaacaaaaaaaaauaaaaaaguugugccugaaaugaauc

SEQ ID NO: 61798 - RNA, 64 nt, hsa
ccaguuuuaacaccuuccucguguuauguuuaaaaaaauaaauaaauuuaagaaaaccauuuua

SEQ ID NO: 61799 - RNA, 64 nt, hsa
aaaaauaauguucuuuuuaugcaaauccccugugaaaauaaaauuuucaauguuuuuuuggucu

SEQ ID NO: 61800 - RNA, 64 nt, hsa
ucauaauuuaaccauuagcaucuuuggccaaaccaaaauaaagaaaagcaucuucuccuaguug

SEQ ID NO: 61801 - RNA, 64 nt, hsa
ccaauuugaauaagucaugcuuuccuagaauuuaaaaauaaaaaagucuuccucuggaaagaga

SEQ ID NO: 61802 - RNA, 64 nt, hsa
uagaaggaaacauauguucuccccuacauuaguaaaaauaaaaauggaauuuuuuacccauaca

SEQ ID NO: 61803 - RNA, 64 nt, hsa
agccuggacaacauagugagaccuugucuccacaaaaauaaaaaagaaacuauccaggaguggu

SEQ ID NO: 61804 - RNA, 64 nt, hsa
ugccacuguagcgccuuuuuaaaauaaauaaaauaaaauaaagcaccauuuuguuucccuuuca

SEQ ID NO: 61805 - RNA, 64 nt, hsa
cguccugccacuguagcgccuuuuuaaaauaaauaaaauaaaauaaagcaccauuuuguuuccc

SEQ ID NO: 61806 - RNA, 64 nt, hsa
ccccagcagcguccugccacuguagcgccuuuuuaaaauaaauaaaauaaaauaaagcaccauu

SEQ ID NO: 61807 - RNA, 64 nt, hsa
cagagugagacucugucucaaaaaauaaauaaauaaaauaaaaugaaauagaucuuauuauucu

SEQ ID NO: 61808 - RNA, 64 nt, hsa
ccagucugggugacagagugagacucugucucaaaaaauaaauaaauaaaauaaaaugaaauag

SEQ ID NO: 61809 - RNA, 64 nt, hsa
caacaugaccaauguuuuucaucugccacaucucaaaauaaaacuucuggugaaacaaauuaaa

SEQ ID NO: 61810 - RNA, 64 nt, hsa
caugacccauaguauuaaauacauaucauuuuuaaaaauaaaaaaaaacccaaaaauaaugcau

SEQ ID NO: 61811 - RNA, 64 nt, hsa
uaccauuuugcuaccaguuacauugaacugcuuuaaaauaaauaauaaaauuauuucuaaugau

SEQ ID NO: 61812 - RNA, 64 nt, hsa
uguugccuuuuuaaaauaauuauacuugcacaugaaaauaaaauauaaagucaauaauaguccu

SEQ ID NO: 61813 - RNA, 52 nt, hsa
gggaggaaacucaacuuugauaaaaauaaaaugagaaacuuuuuuccuacaa

SEQ ID NO: 61814 - RNA, 64 nt, hsa
auuuuuuugcuuccuaauaacaaugacaacaaaaaaaauaaaugaccaguuuuguguugggggg

SEQ ID NO: 61815 - RNA, 64 nt, hsa
guucugcugagguuugaacuccuguuuuuauuguaaaauaaauugccccccauucugguccccu

SEQ ID NO: 61816 - RNA, 64 nt, hsa
cgauucacucuuuucuccuguuuuguaaaaaauaaaaauaaauaauaacaauaauacgggggaa

SEQ ID NO: 61817 - RNA, 64 nt, hsa
ccaacccgauucacucuuuucuccuguuuuguaaaaaauaaaaauaaauaauaacaauaauacg

SEQ ID NO: 61818 - RNA, 64 nt, hsa
acagagcaagacucugucucaaaaaauaaaaauaaaaauaaauuugguucuaauagaacucagu

SEQ ID NO: 61819 - RNA, 64 nt, hsa
ugggugacagagcaagacucugucucaaaaaauaaaaauaaaaauaaauuugguucuaauagaa

SEQ ID NO: 61820 - RNA, 64 nt, hsa
ccagccugggugacagagcaagacucugucucaaaaaauaaaaauaaaaauaaauuugguucua

SEQ ID NO: 61821 - RNA, 64 nt, hsa
aagcuauuguuauaguagcugcccuauaguuacaaaaauaaaaacuauaaaaacccauccccua

SEQ ID NO: 61822 - RNA, 64 nt, hsa
ugccccguaaaaggguuaacagcacaauuuuuuaaaaauaaauuaagaaguauuuauaggauua

SEQ ID NO: 61823 - RNA, 64 nt, hsa
uggguacaagugguccaaacuaagauaagagacuaaaauaaaaugcuaaaucuuaaaagaaacu

SEQ ID NO: 61824 - RNA, 64 nt, hsa
agauaaagucgcacauuuuccacaauacauugcuaaaauaaagaggagaaaggcuuaggaaguu

SEQ ID NO: 61825 - RNA, 64 nt, hsa
uuuuuuuaugagaaaaauacuguauuuaaaauguaaaauaaacuuuuaaaaagcaggcacuaau

SEQ ID NO: 61826 - RNA, 64 nt, hsa
uacaugagcuacauguuaaauauuuaaagucuccaaaauaaaacaccccaacguugaccuuacc

SEQ ID NO: 61827 - RNA, 64 nt, hsa
augaauuuucuuuucuguccaaacaaguaaaauaaaaauaaaagucuauuuagauguugauucu

SEQ ID NO: 61828 - RNA, 64 nt, hsa
aagcugaugaauuuucuuuucuguccaaacaaguaaaauaaaaauaaaagucuauuuagauguu

SEQ ID NO: 61829 - RNA, 64 nt, hsa
ucuuguuaagagugcaauauuauauuuuuauguaaaaauaaaaauuaauuuggggggauuauuu

SEQ ID NO: 61830 - RNA, 64 nt, hsa
cuguaccaaauauuuuauggaauaucuaaauacuaaaauaaacuaugaaugaaucucaaaauua

SEQ ID NO: 61831 - RNA, 64 nt, hsa
uggauuaaacaaguauaaaauaaaauacauuuauaaaauaaaaaggaaaacagacuuaaauuuu

SEQ ID NO: 61832 - RNA, 64 nt, hsa
gaugugcuaggucuaagauggauuaaacaaguauaaaauaaaauacauuuauaaaauaaaaagg

SEQ ID NO: 61833 - RNA, 64 nt, hsa
cuggguccaaagugauuuacauaaauuuauaaugaaaauaaacauguauaaaauuuaaaaaaac

SEQ ID NO: 61834 - RNA, 64 nt, hsa
uagaaggauuuuauucucaacagaugcaaaaugcaaaauaaaauauuggcaaacaauacagcaa

SEQ ID NO: 61835 - RNA, 64 nt, hsa
agccgaauauaauggaaauaggaaaaauuagucgaaaauaaagguugauuuagaaaugaagaaa

SEQ ID NO: 61836 - RNA, 64 nt, hsa
cuccagcuuggcgacagagcaagacccccucucaaaaauaaauaaaauaaaguaaaauaaauau

SEQ ID NO: 61837 - RNA, 64 nt, hsa
ggcgacagagcaagacccccucucaaaaauaaauaaaauaaaguaaaauaaauauaaauaauug

SEQ ID NO: 61838 - RNA, 64 nt, hsa
caagacccccucucaaaaauaaauaaaauaaaguaaaauaaauauaaauaauuguggccgggug

SEQ ID NO: 61839 - RNA, 64 nt, hsa
gugagaccccugucuauauauuuuuuuaauuuaaaaaauaaaagaauaaaauuguguagcucag

SEQ ID NO: 61840 - RNA, 64 nt, hsa
uuauuguagauacaauuuucugauuaaaucuggaaaaauaaaaggcagccuguuuuuucugcuu

SEQ ID NO: 61841 - RNA, 64 nt, hsa
auuguauuaacagcugagguagcuaaaguuauuuaaaauaaaauuaaauuuaugauccaaguag

SEQ ID NO: 61842 - RNA, 64 nt, hsa
uauguacagauuaaaauuauugcuacauuugaggaaaauaaaauugcuugcuucuauguaauuc

SEQ ID NO: 61843 - RNA, 64 nt, hsa
guaccauuuauugguuuggggaccaucuuaauuaaaaauaaaugcccaaaauguagaacuuuaa

SEQ ID NO: 61844 - RNA, 64 nt, hsa
ugggucuuuuuucuugagcuuauaauguaccuggaaaauaaaccucuugagaaaaagaaaaguu

SEQ ID NO: 61845 - RNA, 64 nt, hsa
aauaguaccauacaugaguuauuucuaaguuugaaaaauaaaaagaaauugcaucacacuaauu

SEQ ID NO: 61846 - RNA, 64 nt, hsa
cuaaauuaacaugaaauacuucauuuugauugagaaaauaaaaucagauuuuuucaaagucaau

SEQ ID NO: 61847 - RNA, 64 nt, hsa
cgggagcaucuguauuuuuauguuaaaagcccacaaaauaaaaauaaaaaguaacugagaugaa

SEQ ID NO: 61848 - RNA, 64 nt, hsa
caucuguauuuuuauguuaaaagcccacaaaauaaaaauaaaaaguaacugagaugaauuuacc

SEQ ID NO: 61849 - RNA, 64 nt, hsa
uggcgcaauauuuaugggagugggagggauggggaaaauaaacuuaacucuacaaaagcaaacu

SEQ ID NO: 61850 - RNA, 64 nt, hsa
uaucuaauauaccauuguauucacuaacuaacucaaaauaaacacauuuaaucuugacaucuca

SEQ ID NO: 61851 - RNA, 64 nt, hsa
uuuuuaaaugcuacuuuguaaaggugaccuuuaaaaaauaaaaggaaaauaaagaauguuaguu

SEQ ID NO: 61852 - RNA, 64 nt, hsa
uacuuuguaaaggugaccuuuaaaaaauaaaaggaaaauaaagaauguuaguuucauucugccg

SEQ ID NO: 61853 - RNA, 64 nt, hsa
uacauagugaauuuuaaaauguagaagaaagcaaaaaauaaaauaaguccuaaagugaagaagc

SEQ ID NO: 61854 - RNA, 64 nt, hsa
gaacaaaaugaaguuaacuuaguguuuagcauuaaaaauaaaaguuguaccuugacccuagaau

SEQ ID NO: 61855 - RNA, 64 nt, hsa
aguagaccugauuuucaaaaucugcccucagaugaaaauaaaauaaacgaaacauuuagacaau

SEQ ID NO: 61856 - RNA, 64 nt, hsa
accugauuuucaaaaucugcccucagaugaaaauaaaauaaacgaaacauuuagacaauggcua

SEQ ID NO: 61857 - RNA, 64 nt, hsa
agagcgagaccuugucucuaaaaauaauaguaauaaaauaaaaauaacguuuuaugacuauuua

SEQ ID NO: 61858 - RNA, 64 nt, hsa
ugcuaaguuaaaauacaguuuaguuauuugcuuuaaaauaaacucuucuuuuuuucuuuaaagu

SEQ ID NO: 61859 - RNA, 64 nt, hsa
aggugaauuggcucucauggaaauuuggaauuacaaaauaaacguccuggggguuacccagaau

SEQ ID NO: 61860 - RNA, 64 nt, hsa
ccagaauacagauuuaaaaguuugccuguagagcaaaauaaaacagucaguuguagucauuaau

SEQ ID NO: 61861 - RNA, 64 nt, hsa
ugaauaaaguuauguucugauaguuuguacagaaaaaauaaaauggaugcccauguuuuauugc

SEQ ID NO: 61862 - RNA, 64 nt, hsa
acacuucacugccauuuucuauucacauaaaagaaaaauaaauguggaaauuucauccuuggaa

SEQ ID NO: 61863 - RNA, 64 nt, hsa
uaaccagauaaaaguagcacaugugcuuuuguuaaaaauaaaguuaaaaguuaaaguuaaaaaa

SEQ ID NO: 61864 - RNA, 64 nt, hsa
uuggaugucucgcuucacaauaaaacacagcuuaaaaauaaaauaacugaaagaaauagaauuc

SEQ ID NO: 61865 - RNA, 64 nt, hsa
auaaaagcaauagcuggaauauacucccaguuuuaaaauaaaugccugauugauuuaaagcaag

SEQ ID NO: 61866 - RNA, 64 nt, hsa
uuauguauguuccuaaugcuuauggaacuccuccaaaauaaaguuacucaaagagagcaaauau

SEQ ID NO: 61867 - RNA, 64 nt, hsa
uuuuugcaucauuuaaacaugcagaagauguuuaaaaauaaaaaaaaaacugcuuuauccuccu

SEQ ID NO: 61868 - RNA, 64 nt, hsa
uucuuuucaaauauuuguaggacaacuuugaaucaaaauaaauuauguuccuucuccaauuuga

SEQ ID NO: 61869 - RNA, 64 nt, hsa
gccccucaggggaauucggagcuagaggacauggaaaauaaagccaggaaagucaaaaaaacga

SEQ ID NO: 61870 - RNA, 64 nt, hsa
aaagcgcaaagaggagaaugaagauccagaaaggaaaauaaagaagaagggcuucggcgccaug

SEQ ID NO: 61871 - RNA, 64 nt, hsa
gaauaauuauuaaugaaagauuuuugaaauauaaaaaauaaauuaggcccaauccaagaaauug

SEQ ID NO: 61872 - RNA, 64 nt, hsa
uuucaauauaaccagcaauuuagguggcaucuauaaaauaaaaaauuucuacuguggacauccc

SEQ ID NO: 61873 - RNA, 64 nt, hsa
ucaaagacuauuaaaggagcuguacagagguaaaaaaauaaauguggaacauuauuaacuuacu

SEQ ID NO: 61874 - RNA, 64 nt, hsa
guuuuaaaaugacuugacuauaaaaaaaaauuaaaaaauaaaaauaaaugacuuggcuguaaua

SEQ ID NO: 61875 - RNA, 64 nt, hsa
aaaugacuugacuauaaaaaaaaauuaaaaaauaaaaauaaaugacuuggcuguaauaaggcau

SEQ ID NO: 61876 - RNA, 64 nt, hsa
cugaucauguuuugcuacaguuugcaggugaaaaaaaauaaauauuauaaaauaugcuauuguu

SEQ ID NO: 61877 - RNA, 64 nt, hsa
ugggggcucuuacugacuuuaaauuagcgcuuauaaaauaaaaauguuuaguucaagaagagac

SEQ ID NO: 61878 - RNA, 64 nt, hsa
ugcagccugggcgacagagcgagauucugccucaaaaauaaacaaauaaauuuuaaaaauaaau

SEQ ID NO: 61879 - RNA, 64 nt, hsa
agauucugccucaaaaauaaacaaauaaauuuuaaaaauaaauaaauaauaaaaggaaguguua

SEQ ID NO: 61880 - RNA, 64 nt, hsa
gcauaagauaugagauacaugaaccugaacuauuaaaauaaaauauuauauuuaacccuuaguu

SEQ ID NO: 61881 - RNA, 64 nt, hsa
gccuggccaacauggcaaaaccacaucucuacuaaaaauaaaaaaauuagcugggugugguggu

SEQ ID NO: 61882 - RNA, 64 nt, hsa
cuccagccggggugacagagugagacuccgacugaaaauaaauaaauaaauaaauaaauaaaua

SEQ ID NO: 61883 - RNA, 64 nt, hsa
uuuguuaugaaauaaaaaaaagauggguuuuguaaaaauaaaaaaaaaauauuuuuagcagaac

SEQ ID NO: 61884 - RNA, 64 nt, hsa
gggguauaucuauuucugaagagguaagcugaucaaaauaaauagaguguaaauucuuuuuaau

SEQ ID NO: 61885 - RNA, 64 nt, hsa
agaaauuguucuuuuaaaauauguguaacuucuaaaaauaaaacuuaaaauuuauauguauuaa

SEQ ID NO: 61886 - RNA, 64 nt, hsa
uuaguuuggguucauuucuauaacauuuuguaagaaaauaaaaguuugagcaccugauuauauu

SEQ ID NO: 61887 - RNA, 64 nt, hsa
ugcuacagagcacccagugauuuuacugaggauuaaaauaaaaaaccguaggaaugggcucaac

SEQ ID NO: 61888 - RNA, 64 nt, hsa
aaaaauauguuuacauuggauaaaggauuaggcaaaaauaaaauguuucaaggauuccugacca

SEQ ID NO: 61889 - RNA, 64 nt, hsa
acugcuuuacuuugauguaucauauuuuuaaauaaaaauaaauauuccuuuagaagaucacucu

SEQ ID NO: 61890 - RNA, 64 nt, hsa
uauacuauugagaaaucuauggggaggauaugagaaaauaaauuccuucuaaaccacauuggaa

SEQ ID NO: 61891 - RNA, 64 nt, hsa
ccuguucauacacccauuuugucccuuuauugaaaaaauaaaaaaaauuaaaguacacauugua

SEQ ID NO: 61892 - RNA, 64 nt, hsa
cuuuucucuaaucagagauacagagguugaguauaaaauaaaccugcucagauaggacaauuaa

SEQ ID NO: 61893 - RNA, 64 nt, hsa
acucucugagagaaaaggguguuuuaaauuuaaaaaaauaaaaacaaaaaaguuugauugagac

SEQ ID NO: 61894 - RNA, 64 nt, hsa
gaugagguuaggucaugaggacaccaaaaaccuaaaaauaaacaaaaagccaaacaagccuuag

SEQ ID NO: 61895 - RNA, 64 nt, hsa
ccuuaucggggcgaaccuuuuaggauuccaugugaaaauaaaauaugaggaaaaguuuaaccua

SEQ ID NO: 61896 - RNA, 64 nt, hsa
uuuauacaauaauuuaaauauuuuuuaaaaccauaaaauaaauuuuuauaaggaauacuguuau

SEQ ID NO: 61897 - RNA, 64 nt, hsa
uguacuccacaaguauguacaauuaaguauuuuaaaaauaaauggcaaacauuaaaaacaagag

SEQ ID NO: 61898 - RNA, 64 nt, hsa
uuuuuucaauugccagcuacugcuuuuauucaucaaaauaaaauaacuuguucugaaguugucu

SEQ ID NO: 61899 - RNA, 64 nt, hsa
aauaaaaucuugucuagcacaguuaaagucauuaaaaauaaaaaugacagcuuuagcacaauuu

SEQ ID NO: 61900 - RNA, 64 nt, hsa
agaguuauguuggauaguuuuauuucuguggcugaaaauaaaaucuugucuagcacaguuaaag

SEQ ID NO: 61901 - RNA, 64 nt, hsa
uaaccuaaaugaccuaaauaagaacacuguaccuaaaauaaagaggcaacuuuauuaaugccua

SEQ ID NO: 61902 - RNA, 64 nt, hsa
cccuuuugucuuuuaaaauaaucccagaacaccaaaaauaaaaacaaacaauaacauguuuauc

SEQ ID NO: 61903 - RNA, 64 nt, hsa
acaauuucccuucauauggauaugauuccagucaaaaauaaaaugcacaccaaaauguauacau

SEQ ID NO: 61904 - RNA, 64 nt, hsa
aauguuuugaaaguguuuuauuaagaaucacacaaaaauaaauguauuaaaauuaaauucauuc

SEQ ID NO: 61905 - RNA, 64 nt, hsa
cuuauuuuaagcuuguaaaauacacuguggugauaaaauaaaagagcuggguuugacuuuugag

SEQ ID NO: 61906 - RNA, 64 nt, hsa
uuaguuuugagguaacugcauucauuaggggcugaaaauaaauguuaaaaauguuuaauuuggu

SEQ ID NO: 61907 - RNA, 64 nt, hsa
agagcaagacucuaucucaaaaauaaaauaaaauaaaauaaaauaauuaauaaaaugguguagu

SEQ ID NO: 61908 - RNA, 64 nt, hsa
gcaacagagcaagacucuaucucaaaaauaaaauaaaauaaaauaaaauaauuaauaaaauggu

SEQ ID NO: 61909 - RNA, 64 nt, hsa
ccugagcaacagagcaagacucuaucucaaaaauaaaauaaaauaaaauaaaauaauuaauaaa

SEQ ID NO: 61910 - RNA, 64 nt, hsa
uccagccugagcaacagagcaagacucuaucucaaaaauaaaauaaaauaaaauaaaauaauua

SEQ ID NO: 61911 - RNA, 64 nt, hsa
uauaauuguuggaccuccuugagauaguaacaacaaaauaaagcaagcuaucugcaccucaaaa

SEQ ID NO: 61912 - RNA, 64 nt, hsa
caaugagccacagcaaaaaguaaagaacaacaacaaaauaaagcuguuguuaaauuuuaaacaa

SEQ ID NO: 61913 - RNA, 64 nt, hsa
aauucauuucacuuuaaagucuuuccgucucccuaaaauaaaaaccagaaucauaauuuucaag

SEQ ID NO: 61914 - RNA, 64 nt, hsa
cuuauguauuauuuucuauagcucuucuauuuaaaaaauaaaaaaauacaguaaaguuuaaaaa

SEQ ID NO: 61915 - RNA, 64 nt, hsa
gcauuuguuggcucuauuuuaauuuuuuucuuuuaaaauaaacagcugggaccaucccaaaaga

SEQ ID NO: 61916 - RNA, 64 nt, hsa
gauggugcuaaaauucuuccuauaaaauuccuuaaaaauaaagaugguuuaaucacuaccauug

SEQ ID NO: 61917 - RNA, 64 nt, hsa
ugcauuguuaggcuguuagaauuuuuugguuguuaaaauaaacgcauucaauaaauaugacuuu

SEQ ID NO: 61918 - RNA, 64 nt, hsa
gcuuaauggguaauuuuugagguauguauuuaacaaaauaaacgacacugccgaaaaaaaaaaa

SEQ ID NO: 61919 - RNA, 64 nt, hsa
uugagauugugguuuuuucuuccuaauguaaaauaaaauaaaacacaucugccuucuugauauu

SEQ ID NO: 61920 - RNA, 64 nt, hsa
uugcuuugagauugugguuuuuucuuccuaauguaaaauaaaauaaaacacaucugccuucuug

SEQ ID NO: 61921 - RNA, 64 nt, hsa
acuaaacacaggcuacuuucuguuuacuccuaacaaaauaaagcaagcaaauuugagucaaaua

SEQ ID NO: 61922 - RNA, 64 nt, hsa
aguaauauauuagaauauacaaauauguguguauaaaauaaacauacacacacacacacacccc

SEQ ID NO: 61923 - RNA, 64 nt, hsa
cuuggauuugcauuuuuguauuuuguacaaaguaaaaauaaacuguuaugaguaguaaaaauaa

SEQ ID NO: 61924 - RNA, 64 nt, hsa
guuguuguuguuuuauauaaugcauguauucacuaaaauaaaauuuaaaaaacuccugucuugc

SEQ ID NO: 61925 - RNA, 64 nt, hsa
cuauaauaaauuaacaagauucaccuaaccuuugaaaauaaaguaguauugaagacuuacaugg

SEQ ID NO: 61926 - RNA, 64 nt, hsa
ucacauuuuucuacuauuugaccaaaaggaaaagaaaauaaagaagaacucuggaguggucuaa

SEQ ID NO: 61927 - RNA, 64 nt, hsa
ugucucguuagaguauuugaugucaugcaccaaaaaaauaaaaccccaccuuguugcaaaagcu

SEQ ID NO: 61928 - RNA, 64 nt, hsa
ucauuaucacacaaagagaccaauaaaaauaaaaaaaauaaaaaaaaaaaaagacgaacuauug

SEQ ID NO: 61929 - RNA, 64 nt, hsa
auguguaggucauuaucacacaaagagaccaauaaaaauaaaaaaaauaaaaaaaaaaaaagac

SEQ ID NO: 61930 - RNA, 64 nt, hsa
auucugaugagcacugacaaaggauaugguacuaaaaauaaaaugugaaaugucaaagacaugu

SEQ ID NO: 61931 - RNA, 64 nt, hsa
uguaauaaauuuauugugguacaguaauaugcauaaaauaaacccauuuuaaugugcauucuga

SEQ ID NO: 61932 - RNA, 64 nt, hsa
uucaggaaucacuauguauuuccuucuugugauaaaaauaaaauuacgagaaggcaaugugagg

SEQ ID NO: 61933 - RNA, 64 nt, hsa
uuuuguucuuguauugcuuucuuucaacaguuucaaaauaaaauaucauauaaauauugaggga

SEQ ID NO: 61934 - RNA, 64 nt, hsa
ucauauauuuuaugaaucagaauaaccuucaaauaaaauaaaucuaagucgguuaaaauggauu

SEQ ID NO: 61935 - RNA, 64 nt, hsa
auaaauauauuuuuauagaaaaacaaaucuacauaaaauaaaucuacuguuuagugagcaguau

SEQ ID NO: 61936 - RNA, 64 nt, hsa
ugcauaaucaaggcacuguaaaucuuauaauuuuaaaauaaauuacuuaagaacaguugucauu

SEQ ID NO: 61937 - RNA, 64 nt, hsa
aauaauucuugcauuuuuuccccauaaccugguuaaaauaaauacgccauuggcaauacuucau

SEQ ID NO: 61938 - RNA, 64 nt, hsa
cugugucugauguuucuucucauguaagaaauaaaaaauaaaaauaaaauaaaauauauuggua

SEQ ID NO: 61939 - RNA, 64 nt, hsa
cugauguuucuucucauguaagaaauaaaaaauaaaaauaaaauaaaauauauugguauguaac

SEQ ID NO: 61940 - RNA, 64 nt, hsa
guuucuucucauguaagaaauaaaaaauaaaaauaaaauaaaauauauugguauguaacuacag

SEQ ID NO: 61941 - RNA, 64 nt, hsa
aaaauaaaauauauugguauguaacuacaggaaaaaaauaaaaaauauauaguggacaguaacc

SEQ ID NO: 61942 - RNA, 64 nt, hsa
aaaaaaaagauguuauacaaccaucaaaguggcaaaaauaaaaaaaaucaaguauuggcaaaga

SEQ ID NO: 61943 - RNA, 64 nt, hsa
aauaaaaaugacaacaaaguaaaaggguaucccaaaaauaaaacuauccuuuuggaaaaaaaaa

SEQ ID NO: 61944 - RNA, 64 nt, hsa
aaaucaccaagaaaaacagcuucucaguuaagugaaaauaaaccaguuaaaacagaaccuuuaa

SEQ ID NO: 61945 - RNA, 64 nt, hsa
aaaccacaaggcuugagaauagaaauuaaaagcaaaaauaaaguucggccugggucucucuuug

SEQ ID NO: 61946 - RNA, 64 nt, hsa
agccugggcaacaagagcgaaacucuugucugaaaaaauaaaguucaucccaacuuucaagucu

SEQ ID NO: 61947 - RNA, 64 nt, hsa
uggguaacacggggagacccgucuuuaguaaauaaaaauaaauuuauuaauaaaacuaaaaauu

SEQ ID NO: 61948 - RNA, 64 nt, hsa
acaggcauagaguucagacuuuuuuuaaauaguaaaaauaaaauuaaagcugaaaacugcaacu

SEQ ID NO: 61949 - RNA, 64 nt, hsa
aauguaaauacuguuuuuaacaacuaugauuuggaaaauaaaucaaugcuauaacuauguugau

SEQ ID NO: 61950 - RNA, 64 nt, hsa
aauggaucacacgauuucuuuaagggaauuaaaaaaaauaaaagaauuacggcuuuuacagcaa

SEQ ID NO: 61951 - RNA, 64 nt, hsa
uucuggacggacuuauuaaaauacaaacagacaaaaaauaaaacaaaacuugaguucuauuuac

SEQ ID NO: 61952 - RNA, 64 nt, hsa
uuuuaaauuacaaccacaguugaauaauaaccuaaaaauaaauuuuaguuugcuaaaaauuuac

SEQ ID NO: 61953 - RNA, 64 nt, hsa
acaguuaaucuaaagucuuauuauuucuucuaguaaaauaaaauauuguuagauuaguucucau

SEQ ID NO: 61954 - RNA, 64 nt, hsa
ugauaauuacuuauuuguguuuuucaugguuaaaaaaauaaaagaagcacaaugaccaguacau

SEQ ID NO: 61955 - RNA, 64 nt, hsa
uuuacuauaguguagcuacuggcuucauuuaauaaaaauaaaugauuuugaaauuaaauauaau

SEQ ID NO: 61956 - RNA, 64 nt, hsa
gaacuccuuucauaucaagacaaguuauuuguaaaaaauaaagaagggguuuuaauacaaaccu

SEQ ID NO: 61957 - RNA, 64 nt, hsa
uuuggauuaaaauguugacaugauuucacauuugaaaauaaacucaucucuuauuuugaaguua

SEQ ID NO: 61958 - RNA, 64 nt, hsa
uuugaaggugagaugauaaacuugcaaaacucacaaaauaaagagucaaacuuuuagaaugaca

SEQ ID NO: 61959 - RNA, 64 nt, hsa
ccuggacaacagagcaagacucugucucaaaaaaaaaauaaaaaauaaaaaauaaaaaauaaaa

SEQ ID NO: 61960 - RNA, 64 nt, hsa
aacagagcaagacucugucucaaaaaaaaaauaaaaaauaaaaaauaaaaaauaaaagaaacau

SEQ ID NO: 61961 - RNA, 64 nt, hsa
caagacucugucucaaaaaaaaaauaaaaaauaaaaaauaaaaaauaaaagaaacauaagauaa

SEQ ID NO: 61962 - RNA, 64 nt, hsa
cugucucaaaaaaaaaauaaaaaauaaaaaauaaaaaauaaaagaaacauaagauaaguaccuc

SEQ ID NO: 61963 - RNA, 64 nt, hsa
gucugagcaacauggcaaaacccugugucuacaaaaaauaaaaaauuagcugggcaugacggcc

SEQ ID NO: 61964 - RNA, 64 nt, hsa
uuuuuuaguucuuaaaaauuuauuuuuaaguucuaaaauaaaauaaaaauaaguucuuaaaauu

SEQ ID NO: 61965 - RNA, 64 nt, hsa
uaguucuuaaaaauuuauuuuuaaguucuaaaauaaaauaaaaauaaguucuuaaaauuuauuu

SEQ ID NO: 61966 - RNA, 64 nt, hsa
aaacucauccauagauaauucaagauuuguauucaaaauaaacauaguuuucacaguuacaaaa

SEQ ID NO: 61967 - RNA, 64 nt, hsa
uuguauucaaaauaaacauaguuuucacaguuacaaaauaaaucaccuauuuuaucuuuuccuu

SEQ ID NO: 61968 - RNA, 64 nt, hsa
auuauuuuuuuuaauuuaaguccuaaauauaguuaaaauaaauaauguuuuaguaaaaugauac

SEQ ID NO: 61969 - RNA, 64 nt, hsa
uccagccaggugacauagcgagauccugucuaaaaaaauaaaaaauaaauaauggaacacagca

SEQ ID NO: 61970 - RNA, 64 nt, hsa
aggugacauagcgagauccugucuaaaaaaauaaaaaauaaauaauggaacacagcaaguccua

SEQ ID NO: 61971 - RNA, 64 nt, hsa
aauugcuguaggauccuguucuuucagcaggugaaaaauaaaacgcaguucaaauuucaugguu

SEQ ID NO: 61972 - RNA, 64 nt, hsa
auuauuacugcaguaguugacuuugcuguauggaaaaauaaagugaaauugcccuaauaaaacu

SEQ ID NO: 61973 - RNA, 64 nt, hsa
uauagguaaucaaugaauauugaaguuucagcuuaaaauaaacaguugugaaccaagaucuaua

SEQ ID NO: 61974 - RNA, 64 nt, hsa
agaaauuuuuaucaguuuccagucucaaaaauacaaaauaaaaacaaacguuuuuaauacuauu

SEQ ID NO: 61975 - RNA, 64 nt, hsa
uaagccccauggaucaauacauaaacuaugcauaaaaauaaaauuucauauuuucgcucguaaa

SEQ ID NO: 61976 - RNA, 64 nt, hsa
gguaagccucucuuacuccuguuaugcacuuuuuaaaauaaauacugaauuccagaaagaauuu

SEQ ID NO: 61977 - RNA, 64 nt, hsa
uuaccucucugugccucaguuuucccaugcaugaaaaauaaaauaaaauaaaacggggauucua

SEQ ID NO: 61978 - RNA, 64 nt, hsa
ucucugugccucaguuuucccaugcaugaaaaauaaaauaaaauaaaacggggauucuaauguu

SEQ ID NO: 61979 - RNA, 64 nt, hsa
gugccucaguuuucccaugcaugaaaaauaaaauaaaauaaaacggggauucuaauguuuguaa

SEQ ID NO: 61980 - RNA, 64 nt, hsa
auaacuauauauauugccaucacacacgaacaauaaaauaaaguguucuauuaaccugaucucu

SEQ ID NO: 61981 - RNA, 64 nt, hsa
caccaaacaggaaagaacuaugucugaaauauaaaaaauaaaaauaaaaaaacaacuaugaaua

SEQ ID NO: 61982 - RNA, 64 nt, hsa
acaggaaagaacuaugucugaaauauaaaaaauaaaaauaaaaaaacaacuaugaauaugcaca

SEQ ID NO: 61983 - RNA, 64 nt, hsa
ccauuuugccugacaauugcaaaucagagcauacaaaauaaaacugugcaguuuuguuugguuu

SEQ ID NO: 61984 - RNA, 64 nt, hsa
gccugggcaacauagugagaccuugucucuacaaaaaauaaaauaaaauaaaaaccaaauuagc

SEQ ID NO: 61985 - RNA, 64 nt, hsa
ggcaacauagugagaccuugucucuacaaaaaauaaaauaaaauaaaaaccaaauuagccagac

SEQ ID NO: 61986 - RNA, 64 nt, hsa
cauagugagaccuugucucuacaaaaaauaaaauaaaauaaaaaccaaauuagccagacauggu

SEQ ID NO: 61987 - RNA, 64 nt, hsa
gaauguacuaaaaaccaaugaacuuuaaaaaauaaaaauaaacaaaaaaaauucaacagaugaa

SEQ ID NO: 61988 - RNA, 64 nt, hsa
uuuugagaauguacuaaaaaccaaugaacuuuaaaaaauaaaaauaaacaaaaaaaauucaaca

SEQ ID NO: 61989 - RNA, 64 nt, hsa
uauaaauaacucuuauaacacaacaauaaggagaaaaauaaaucaauuuaaaaaaugggcuaac

SEQ ID NO: 61990 - RNA, 64 nt, hsa
gcaaaauuacucuacuguuaaaauugugcaaaauaaaauaaacauuuaaaaugacauuuuacag

SEQ ID NO: 61991 - RNA, 64 nt, hsa
ccacagcaaaauuacucuacuguuaaaauugugcaaaauaaaauaaacauuuaaaaugacauuu

SEQ ID NO: 61992 - RNA, 64 nt, hsa
ucucuuaaaauaaaauccauuuccuauuucucuuaaaauaaaauccauuauucuuaauauggcc

SEQ ID NO: 61993 - RNA, 64 nt, hsa
ugauuaugcuuaacagcuguuuccuguuucucuuaaaauaaaauccauuuccuauuucucuuaa

SEQ ID NO: 61994 - RNA, 64 nt, hsa
ugcugcugaguuaugcacagacuuuuuguugaccaaaauaaaauauaaaggguuuucuucuguu

SEQ ID NO: 61995 - RNA, 64 nt, hsa
aacaauguuuguacuuaugcauuccccauggguaaaaauaaauaauagcauuguuaaagauagu

SEQ ID NO: 61996 - RNA, 64 nt, hsa
cuuuauccaauuuuuacugaacuuuuuauguaaaaaaauaaaaucaauuaaagaacuuggcaug

SEQ ID NO: 61997 - RNA, 64 nt, hsa
aggucaagagagagagacccagacaagcaaacucaaaauaaagagaaaaggaaacgaagaagcu

SEQ ID NO: 61998 - RNA, 64 nt, hsa
ccagccgccauccuucuccagaauucuuguaaauaaaauaaaucccucuuuguuuaaaccauug

SEQ ID NO: 61999 - RNA, 64 nt, hsa
caggugaggguuacacugaagaugcacaaucccuaaaauaaagaucaccacuuccccaaagaag

SEQ ID NO: 62000 - RNA, 64 nt, hsa
aucuuauucuucauguaaucccaccuucuaacaaaaaauaaauaaauauuuaaauuccaaggag

SEQ ID NO: 62001 - RNA, 64 nt, hsa
aaugaagacauuuaacgguugugcuguuuauaguaaaauaaaacucccuaccuugcuucaguua

SEQ ID NO: 62002 - RNA, 64 nt, hsa
uguauauuaggauuuaaauuuaugccacaauuuaaaaauaaaaccagagguuauauacaauuua

SEQ ID NO: 62003 - RNA, 64 nt, hsa
ugauuuaauuccuuuuuagaaagaaauuuagggcaaaauaaaguguauauuaggauuuaaauuu

SEQ ID NO: 62004 - RNA, 64 nt, hsa
gcuaguacugugccgcuucccccuccccccacacaaaauaaaaacaguaucugccuucuggcuc

SEQ ID NO: 62005 - RNA, 64 nt, hsa
caaucaguguaacuaggggcuguguuucugcauuaaaauaaauguuucaggcuuugugguccug

SEQ ID NO: 62006 - RNA, 64 nt, hsa
auaaguaugcuuuauuuuaccucuguuaaaaauuaaaauaaaugauucuauucauauuugucag

SEQ ID NO: 62007 - RNA, 64 nt, hsa
gaacuaaggcauuaaagaaaauagcaaauauuaaaaaauaaaacuguuacuuuuuuccuucuuu

SEQ ID NO: 62008 - RNA, 64 nt, hsa
gacccugucucaaaaaauauauauuuaaaaaauaaaaauaaaagcugaccccaaagacaaauaa

SEQ ID NO: 62009 - RNA, 64 nt, hsa
gagagagacccugucucaaaaaauauauauuuaaaaaauaaaaauaaaagcugaccccaaagac

SEQ ID NO: 62010 - RNA, 64 nt, hsa
cugaauguguuugaacauguuuugagauuuuuuuaaaauaaauuauuauuugacaacaauccaa

SEQ ID NO: 62011 - RNA, 64 nt, hsa
gaccgagugagacuguuucuaaaaauaaaaacaaaaaauaaauuucuucuugagguggggugga

SEQ ID NO: 62012 - RNA, 64 nt, hsa
cuccagccugggugaccgagugagacuguuucuaaaaauaaaaacaaaaaauaaauuucuucuu

SEQ ID NO: 62013 - RNA, 64 nt, hsa
cucuuuagugucaguuaaauuaugaacuaacuugaaaauaaaaguuguuugacugaaagugauu

SEQ ID NO: 62014 - RNA, 64 nt, hsa
uuuauuuuauccaaguaccccagugaauaggggaaaaauaaacacagugaaaaaaaaaaucaaa

SEQ ID NO: 62015 - RNA, 64 nt, hsa
auuuuauuauuuucaucuuuauugaucaaauuugaaaauaaaauucacaauguaauacuacuac

SEQ ID NO: 62016 - RNA, 64 nt, hsa
caaaaauaauaauaauaauaauaaaguaaaaauaaaaauaaaaaaguaaucagaagcuaaagua

SEQ ID NO: 62017 - RNA, 64 nt, hsa
ccaucucaaaaauaauaauaauaauaauaaaguaaaaauaaaaauaaaaaaguaaucagaagcu

SEQ ID NO: 62018 - RNA, 64 nt, hsa
cagcccucauauaauagguuugaaaguacuccuuaaaauaaaacacuguuucccuuuggaacua

SEQ ID NO: 62019 - RNA, 64 nt, hsa
aagugagacccugucacuaacaaaauuaaaaaauaaaauaaauauaaaauauaggcuuuaaaaa

SEQ ID NO: 62020 - RNA, 64 nt, hsa
caauaaagugagacccugucacuaacaaaauuaaaaaauaaaauaaauauaaaauauaggcuuu

SEQ ID NO: 62021 - RNA, 64 nt, hsa
uuauguuauguauauuuuaccacaauaaaugcaaaaaauaaaaagucuguguucuaaacaauuc

SEQ ID NO: 62022 - RNA, 64 nt, hsa
uuguuauauuucaauaagaagcuuaaaauguuuaaaaauaaaugguuaaaagguuuuauguuau

SEQ ID NO: 62023 - RNA, 64 nt, hsa
ugcacaaagauuagcacacuuaaaagcaaaggaaaaaauaaaucagaacuccauaaauauuaaa

SEQ ID NO: 62024 - RNA, 64 nt, hsa
ccauuuccuuccaguaaauccacccaaggagaggaaaauaaaaugacaacgcaagaccuagugg

SEQ ID NO: 62025 - RNA, 64 nt, hsa
uccacuugcagguuuauggaaacagcaguauuugaaaauaaauaaaaagugggagaauuccuug

SEQ ID NO: 62026 - RNA, 64 nt, hsa
guacacugggcagacuucagagcaguuuuuuaaaaaaauaaauauucuaauguagcuaucucgc

SEQ ID NO: 62027 - RNA, 64 nt, hsa
cuguuuguuaguaugaaaaguuaacuuuuuuuccaaaauaaaagagugaauuuuucauguuaag

SEQ ID NO: 62028 - RNA, 64 nt, hsa
guuaaguuaaaaaucuuugucuuguacuauuucaaaaauaaaaagacagcaaugacuuuauauc

SEQ ID NO: 62029 - RNA, 64 nt, hsa
acugauguucuucacuaaauggauggccacaagaaaaauaaaguaaaugucuuaaauaauuuaa

SEQ ID NO: 62030 - RNA, 64 nt, hsa
aguauggauacauccauucacugugguacauuuuaaaauaaaauauuuuagcagugaauaugga

SEQ ID NO: 62031 - RNA, 64 nt, hsa
ugaauucaccacagcuggaauagcuguggaaaacaaaauaaaacaacaaaauuaauaaugaaau

SEQ ID NO: 62032 - RNA, 64 nt, hsa
uugccuuuuauuccuuuaaaauuucgccuggcaaaaaauaaauaaauggaacuaucacuuuaua

SEQ ID NO: 62033 - RNA, 64 nt, hsa
aguaaugcaaacaaauuauuuuuuacaaaaaaacaaaauaaauaaaauuagacuuccuucccuc

SEQ ID NO: 62034 - RNA, 64 nt, hsa
ugaaauauugaaaauauugaaaauauuauuauugaaaauaaaaucuugaucucaacuauccccc

SEQ ID NO: 62035 - RNA, 64 nt, hsa
uauuugguuaguaccuucacugagcaauaguggaaaaauaaaaaaauaaguaaacagaaaaaac

SEQ ID NO: 62036 - RNA, 64 nt, hsa
acccauauuaugaagaaauacucugcaacucuuaaaaauaaauguaaugugccaggcgcaaugg

SEQ ID NO: 62037 - RNA, 64 nt, hsa
cauagugagacuuggucucuaaaaaagaaaaaaaaaaauaaaacugauguaaugaauauauaau

SEQ ID NO: 62038 - RNA, 64 nt, hsa
ucuacaaugaacauguuuuauuuuuacuuuuguuaaaauaaauaacauuuaauuugacggaaaa

SEQ ID NO: 62039 - RNA, 64 nt, hsa
aaaagaaacaagagagaaaaaaaucaaaauaauuaaaauaaauuguuagagaaaaguuacuuua

SEQ ID NO: 62040 - RNA, 64 nt, hsa
augucaacugaagaucugacuguacuaaauaugaaaaauaaagcagcacauacuuucucuacug

SEQ ID NO: 62041 - RNA, 64 nt, hsa
uccuuaaccuccagcagacuccugcucucuauccaaaauaaagaucacagagcagcaaguucau

SEQ ID NO: 62042 - RNA, 64 nt, hsa
uguucuccucuaucuuagagggguauucuucuugaaaauaaaaaauauugaaaugcuguauuuu

SEQ ID NO: 62043 - RNA, 64 nt, hsa
guauauuuuagaaauuuguuaaugagaguaaaagaaaauaaauguguauagcucaguuuggaua

SEQ ID NO: 62044 - RNA, 64 nt, hsa
uuguuuaaauguccauuuuuauucuuuauguuugaaaauaaauuauggggauccuauuuagcuc

SEQ ID NO: 62045 - RNA, 64 nt, hsa
aaugacuuuagugacauuauaaaacugaaacuggaaaauaaaauggcuuaucugcugauguuua

SEQ ID NO: 62046 - RNA, 64 nt, hsa
aaauaaaauggcuuaucugcugauguuuaucuuuaaaauaaauaaaaucuugcuagugugaaua

SEQ ID NO: 62047 - RNA, 64 nt, hsa
uuuaaauggaugcauacaguccacaucauacaauaaaauaaaagguaauucagggucccaaaga

SEQ ID NO: 62048 - RNA, 64 nt, hsa
aagaauaacuauaaaauaugaaagcucuaaauuuaaaauaaauuuagagauagaaucaugguac

SEQ ID NO: 62049 - RNA, 64 nt, hsa
uuuuauggucacaaguuaucccuccucaguaugaaaaauaaauuagauauugaaaaaugucuaa

SEQ ID NO: 62050 - RNA, 64 nt, hsa
cuguagaauuuauuuuaacuaugaccuuuaauugaaaauaaauaauuaaaauaucagacauguu

SEQ ID NO: 62051 - RNA, 64 nt, hsa
cuauauauuuaugauaaaucuuuuccauuuguacaaaauaaaauuccauuucauugugaccuac

SEQ ID NO: 62052 - RNA, 64 nt, hsa
ccuauauuuauguaacuguauacugaauucugacaaaauaaaaaaagauaccuuauugacgaaa

SEQ ID NO: 62053 - RNA, 57 nt, hsa
auaacauccauaguguuuagagagaaaaaaauaaaccaauaaccuaccuacugacaa

SEQ ID NO: 62054 - RNA, 64 nt, hsa
uucaucucuagggauguuuaacauuuauaauugcaaaauaaaccaacuauaaaaaaagaaacua

SEQ ID NO: 62055 - RNA, 64 nt, hsa
ucuuaauucuggguugcuuguuuuuuaggugacaaaaauaaaauauuguauuuuaauucauggg

SEQ ID NO: 62056 - RNA, 64 nt, hsa
uaccuuuccucugccugaaagacgugucucaagaaaaauaaauucuauuuuagaugcagguacu

SEQ ID NO: 62057 - RNA, 64 nt, hsa
uaaaucaggagauggcugauucauaauggguaauaaaauaaauagcacuuucgagcugaugucg

SEQ ID NO: 62058 - RNA, 64 nt, hsa
aacauucuaguaacuggccacuggaaaauaaauaaaaauaaaaacuaggguuuuaaaaguaucu

SEQ ID NO: 62059 - RNA, 64 nt, hsa
aaaaaauaaaaacauucuaguaacuggccacuggaaaauaaauaaaaauaaaaacuaggguuuu

SEQ ID NO: 62060 - RNA, 64 nt, hsa
uucaaaccacagagaaaauauuuauaacaugcaaaaaauaaaaacauucuaguaacuggccacu

SEQ ID NO: 62061 - RNA, 64 nt, hsa
uuuugaaagugagcauucauuuaaggauaaauaaaaaauaaaguaguaauaaagaauaaaauac

SEQ ID NO: 62062 - RNA, 64 nt, hsa
uuucuuuauguuuuaugaaaguguugcagucccuaaaauaaaaauauugaggaacauugcuugu

SEQ ID NO: 62063 - RNA, 64 nt, hsa
aacacauuaaccagaaagcuuaaacauuauuauuaaaauaaauuauuucauuugcacacaauga

SEQ ID NO: 62064 - RNA, 64 nt, hsa
aaauguuuuuaaauauaaacaaauauucuuuacuaaaauaaaaacucuguguaauuuuuccauu

SEQ ID NO: 62065 - RNA, 64 nt, hsa
cuuauuugucuucuuuuugcauugugaaaaaaacaaaauaaauuuugugugauaauuuugauga

SEQ ID NO: 62066 - RNA, 64 nt, hsa
aaacaaaacagauaugcuuacucuaguuaaaaagaaaauaaaucucaugucagacccagaaagg

SEQ ID NO: 62067 - RNA, 64 nt, hsa
ucucccaaauauguucaauucuuaugucgcucaaaaaauaaaauuuaauuuaaaaaguaucuga

SEQ ID NO: 62068 - RNA, 64 nt, hsa
guggaagcuaaaaaaauugauaucauagaaguaaaaaauaaaacagaggauacuacaggcuggg

SEQ ID NO: 62069 - RNA, 64 nt, hsa
cagccugggugacagagugagacugucucaaaauaaaauaaaaauaacauauuggugaagaugc

SEQ ID NO: 62070 - RNA, 64 nt, hsa
cacuccagccugggugacagagugagacugucucaaaauaaaauaaaaauaacauauuggugaa

SEQ ID NO: 62071 - RNA, 64 nt, hsa
caaauguaaaagucaccaaaaacuuaaaggcauuaaaauaaacuaaaaaaguacucauuucuuc

SEQ ID NO: 62072 - RNA, 64 nt, hsa
gaauugaccuuaauuuguuuuccagaaucaaaagaaaauaaaauauaaauuuugaaacuaugag

SEQ ID NO: 62073 - RNA, 64 nt, hsa
ugucucaaaaaaaaaaaaaaaaaaaggagagaagaaaauaaagaaggcuaauauauaauuuuuc

SEQ ID NO: 62074 - RNA, 64 nt, hsa
auugugcuuuaaaaaaauaaccucuuguaguuauaaaauaaaacguuugacuucuaaacucugu

SEQ ID NO: 62075 - RNA, 64 nt, hsa
ugauuuuuuuaaaagucacaaaaacaauucacuaaaaauaaauaugucauugugcuuuaaaaaa

SEQ ID NO: 62076 - RNA, 64 nt, hsa
uuucauauauaaaaguauauuuauugacuguaauaaaauaaaauaugauguaaacaaaaaaaau

SEQ ID NO: 62077 - RNA, 64 nt, hsa
gauuuauucuauuaaauuguaagcuugcaaacucaaaauaaauuggcagauuuaccucucaugu

SEQ ID NO: 62078 - RNA, 64 nt, hsa
uguuuugucgacaguaucuuuuaaaugagucuuaaaaauaaaggcauauuguucauguuuuucu

SEQ ID NO: 62079 - RNA, 64 nt, hsa
uaacuucuagcuaaaauuguaucauugguccuaaaaaauaaaaaucuuuacuaauaggcaauug

SEQ ID NO: 62080 - RNA, 64 nt, hsa
aaauguugaaaccaacugaacugccaacaaaauaaaaauaaaaagucuucacuauguagcauac

SEQ ID NO: 62081 - RNA, 64 nt, hsa
cucaauaaauguugaaaccaacugaacugccaacaaaauaaaaauaaaaagucuucacuaugua

SEQ ID NO: 62082 - RNA, 64 nt, hsa
uuaauuuucugaaagauaauucuaagugaaauuuaaaauaaauaaauuuuuaaugaccuggguc

SEQ ID NO: 62083 - RNA, 64 nt, hsa
acaaaaagaaaauacauaugcagucuagucagacaaaauaaaguuuugaagugcuacuauaaua

SEQ ID NO: 62084 - RNA, 64 nt, hsa
cugguggaauauauggagagaucuugaaagagguaaaauaaaccuucacugcuccacuccaggu

SEQ ID NO: 62085 - RNA, 64 nt, hsa
uagaaaguaauaaauucuguaugaauaagcauaaaaaauaaauaaauaugcaauaacauuaaau

SEQ ID NO: 62086 - RNA, 64 nt, hsa
auguguucuaaagucuuuuuguaaaauaaacacaaaaauaaauuuauguugaauuggcacuuuc

SEQ ID NO: 62087 - RNA, 64 nt, hsa
cuaguguuccucauguguucuaaagucuuuuuguaaaauaaacacaaaaauaaauuuauguuga

SEQ ID NO: 62088 - RNA, 64 nt, hsa
uaaacaauaaagaagauucagacacugagggaaaaaaauaaagcuuuuuacuuaaauaaugcau

SEQ ID NO: 62089 - RNA, 64 nt, hsa
ggacguaacuuagcauggaucaccaaucaaucaaaaaauaaauaaaucacuaaggauuggagaa

SEQ ID NO: 62090 - RNA, 64 nt, hsa
caaaacaaaauuuccaaaaacaaugaaggaaaccaaaauaaauauuucugcauuucaggugagu

SEQ ID NO: 62091 - RNA, 64 nt, hsa
gaucauguugggauuaacuugccuuuuuccccaaaaaauaaacucucaggcaagcauuucuuua

SEQ ID NO: 62092 - RNA, 64 nt, hsa
cuuugaaugcucaaacuaugggaaaucuuugguaaaaauaaagacaauaaaaucuucacaauaa

SEQ ID NO: 62093 - RNA, 64 nt, hsa
ccucggugacaagagcgagacuccaucucaaaaaaaaauaaaaagaaucuuaaaauaggaacau

SEQ ID NO: 62094 - RNA, 64 nt, hsa
acauuucuaaugaggauucacauuaauauaauauaaaauaaauaggucaguuacuggucucuuu

SEQ ID NO: 62095 - RNA, 64 nt, hsa
cuccgaauguuauguuuugcuuuuaucucacaguaaaauaaauauaauuaaugguuugcaugug

SEQ ID NO: 62096 - RNA, 64 nt, hsa
ucugaagggaaagggcucuuuuccugcuguuucaaaaauaaaagaacacauuagauguuacugu

SEQ ID NO: 62097 - RNA, 64 nt, hsa
cuagcuaaucucgguagaugucauuacaaccuggaaaauaaaucacccuaagugacacaaauug

SEQ ID NO: 62098 - RNA, 64 nt, hsa
uauuugaagugauauauuugguuaaacauuucuaaaaauaaacuaccaauacuaaauaguaaga

SEQ ID NO: 62099 - RNA, 64 nt, hsa
auaaaaccacuaauuguuccguuaagcuucacagaaaauaaaaccucuauuacuagacauuuau

SEQ ID NO: 62100 - RNA, 64 nt, hsa
cgagauugcaccacugcacuccagcuugggugauaaaauaaaauaaaauagucgugaaucuugu

SEQ ID NO: 62101 - RNA, 64 nt, hsa
uugcaccacugcacuccagcuugggugauaaaauaaaauaaaauagucgugaaucuuguucaaa

SEQ ID NO: 62102 - RNA, 64 nt, hsa
agaugcacaacaaaagaaacaucagaaguuuauaaaaauaaaucugacuauaugcauccucauu

SEQ ID NO: 62103 - RNA, 64 nt, hsa
augucuucgagauguagaaauaaggaauauucugaaaauaaaaauuauacaguaguaaagauaa

SEQ ID NO: 62104 - RNA, 64 nt, hsa
aaccaucuuuauuauggucauauuucacagcaccaaaauaaaucaucuuuauuaaguagaugaa

SEQ ID NO: 62105 - RNA, 64 nt, hsa
uagggauucacugacuagauuuuacugaacuaugaaaauaaauacacauaauuuuucacaaaau

SEQ ID NO: 62106 - RNA, 64 nt, hsa
acuccagccugggcgacagagugagacuaucucaaaaauaaauaaauaaauaaauaaauaguau

SEQ ID NO: 62107 - RNA, 64 nt, hsa
uuucauucuuuaaauauuauugacuuacaguuuaaaaauaaauaaauaaaagcauacuauaguu

SEQ ID NO: 62108 - RNA, 64 nt, hsa
augaauauuugcucauguuuucuaaauuccuuauaaaauaaaauuaauucgaauucaaucugca

SEQ ID NO: 62109 - RNA, 64 nt, hsa
guucuauuuucccuguauugguaucuccuuaaauaaaauaaaauauuccuauuguaagugauau

SEQ ID NO: 62110 - RNA, 64 nt, hsa
agugauaugagaaaucuuuaaccagccuuaucuaaaaauaaaaagagaagccauuguaagacau

SEQ ID NO: 62111 - RNA, 64 nt, hsa
acuccagccugggcaauaagagcaaaacuccaucaaaauaaaauaaaauaaaauauaaaauaac

SEQ ID NO: 62112 - RNA, 64 nt, hsa
agccugggcaauaagagcaaaacuccaucaaaauaaaauaaaauaaaauauaaaauaacuuaaa

SEQ ID NO: 62113 - RNA, 64 nt, hsa
gggcaauaagagcaaaacuccaucaaaauaaaauaaaauaaaauauaaaauaacuuaaaaagaa

SEQ ID NO: 62114 - RNA, 64 nt, hsa
auauguaacuuaaaucuagacaccaucaaagcauaaaauaaaaauaaaaagcguugcugaaucu

SEQ ID NO: 62115 - RNA, 64 nt, hsa
aacuuaaaucuagacaccaucaaagcauaaaauaaaaauaaaaagcguugcugaaucugggucg

SEQ ID NO: 62116 - RNA, 64 nt, hsa
uguuuuuggauugucaaagaggaugcuuagucuuaaaauaaaaauaaauuuaaaaaucaucuua

SEQ ID NO: 62117 - RNA, 64 nt, hsa
uggauugucaaagaggaugcuuagucuuaaaauaaaaauaaauuuaaaaaucaucuuauaauua

SEQ ID NO: 62118 - RNA, 64 nt, hsa
augucuagauuauauagguuuagguugaaguuauaaaauaaaauaaaauucauuuuccacugga

SEQ ID NO: 62119 - RNA, 64 nt, hsa
uagauuauauagguuuagguugaaguuauaaaauaaaauaaaauucauuuuccacuggaacucu

SEQ ID NO: 62120 - RNA, 64 nt, hsa
auccaccaauaucauguguagauauuauguauagaaaauaaaauaaauuauggcucuaacuucu

SEQ ID NO: 62121 - RNA, 64 nt, hsa
ccaauaucauguguagauauuauguauagaaaauaaaauaaauuauggcucuaacuucuguguu

SEQ ID NO: 62122 - RNA, 64 nt, hsa
cauuaucccucaaaaaguuaccaccacaucagaaaaaauaaaaaaaaaauaguaaaguaggcag

SEQ ID NO: 62123 - RNA, 64 nt, hsa
uuacagaguaauuacauggugauuuuugcaauguaaaauaaaguguuucugauuauuuucuaug

SEQ ID NO: 62124 - RNA, 64 nt, hsa
uauacuucuccauacacagaccucugcagaaugcaaaauaaaacuugcagugaaugaauuuagc

SEQ ID NO: 62125 - RNA, 64 nt, hsa
ugccaauuagcuucuacuaaccacgguucaacagaaaauaaauguguauuugugaauaacaaac

SEQ ID NO: 62126 - RNA, 64 nt, hsa
ucccaucucugucaccuagccaggagggguagcaaaaauaaagucacgaggacauaguggucac

SEQ ID NO: 62127 - RNA, 64 nt, hsa
auaggugccuaguaaauguuaacuguucuuggaaaaaauaaaaacaucaguaacaaaagaaauu

SEQ ID NO: 62128 - RNA, 64 nt, hsa
accaguuuucuuuaugaugauacaguguuaaaagaaaauaaauuacaauugaucugucauccau

SEQ ID NO: 62129 - RNA, 64 nt, hsa
agaccaccaguaaauaauccuccuucaaaaaauaaaaauaaaagaaaaaggaaaaucauucagg

SEQ ID NO: 62130 - RNA, 64 nt, hsa
ucuuuuagaccaccaguaaauaauccuccuucaaaaaauaaaaauaaaagaaaaaggaaaauca

SEQ ID NO: 62131 - RNA, 64 nt, hsa
uuguuuguucagucugaauuaaaauuagacuuugaaaauaaagcuuaaauaguuguuuccucua

SEQ ID NO: 62132 - RNA, 64 nt, hsa
uaugcaacuuuaauuuuguuuaacacuaucugccaaaauaaacuuuauucccuauaacuuaaaa

SEQ ID NO: 62133 - RNA, 64 nt, hsa
cccccacagagugccuagaaucuuaauaaugaauaaaauaaaaagcagcaauaugucauuaaca

SEQ ID NO: 62134 - RNA, 64 nt, hsa
guaaagaucagaugguaaucuuucaaauaagaaaaaaauaaagacguauguuugaccaaguagu

SEQ ID NO: 62135 - RNA, 64 nt, hsa
ggacaaguuuauaucaaguuaaauguaaauggauaaaauaaaaucauuuucaguaugugauaua

SEQ ID NO: 62136 - RNA, 64 nt, hsa
ugacccauuuugauaagucuuuauaaggaagaauaaaauaaacguguaagcaaaauuuucuuuu

SEQ ID NO: 62137 - RNA, 64 nt, hsa
cuuuguuacuuuuguccccccagauuugggggacaaaauaaaauuaaucuuuuaaaauguguca

SEQ ID NO: 62138 - RNA, 64 nt, hsa
acagcaaaaugccugcaccaugacuguggcuuuuaaaauaaagaaauguguuuuuaucguaauu

SEQ ID NO: 62139 - RNA, 64 nt, hsa
aaacuuggggcaauugaugcuaaaugguauuuuuaaaauaaauguuuuuauucuuuacucuuga

SEQ ID NO: 62140 - RNA, 64 nt, hsa
gaaaaaaauauacaugcuuacucaggcuuucuuaaaaauaaauuuuuauagagauccuugagua

SEQ ID NO: 62141 - RNA, 64 nt, hsa
guuacagcaucaucacauuaccuguuugauguaaaaaauaaaaaauagaaagguguaaguauau

SEQ ID NO: 62142 - RNA, 64 nt, hsa
aaaaauuauuucuaggguuuaaguaacuacaaguaaaauaaauuuauuucuuaaaaauaagugu

SEQ ID NO: 62143 - RNA, 64 nt, hsa
uaauuguuuuacccucaagcugggaauauuuuucaaaauaaauacuauaauauagauaucaaau

SEQ ID NO: 62144 - RNA, 64 nt, hsa
gcuaaucaacuacccuuucuuuuaucaaguaauuaaaauaaaucuacauaaagaaccaaaaagg

SEQ ID NO: 62145 - RNA, 64 nt, hsa
uuauuaucgaggaguuuuaaaguacuguaacuuuaaaauaaauaacuacaaagcuucuuugucc

SEQ ID NO: 62146 - RNA, 64 nt, hsa
uuucuguuugcagauaugauugauguauuucaccaaaauaaaauauuuuuauguuuauaaagug

SEQ ID NO: 62147 - RNA, 64 nt, hsa
uugagcaugcauggauauacccaauaguacacacaaaauaaauguuuacuuaagagccauucua

SEQ ID NO: 62148 - RNA, 64 nt, hsa
ggaagaggucccaaauuuggaguaaagaugggagaaaauaaauaugugcuauuuccuuggcgag

SEQ ID NO: 62149 - RNA, 64 nt, hsa
ccuuuugcugucuuucucuaaauaugauuacuuuaaaauaaaaaaguaacaaggugucuuuucc

SEQ ID NO: 62150 - RNA, 64 nt, hsa
augccguauaggaugucagacaauaccacugguuaaaauaaagccuauuuuucaaauuuaguga

SEQ ID NO: 62151 - RNA, 64 nt, hsa
guuaauaguaugaucuuuaaaguuuugacaauauaaaauaaacuugguaacuguuuuacaaaua

SEQ ID NO: 62152 - RNA, 64 nt, hsa
cuguuggucauaaguuaacuguauuaagaacaguaaaauaaauaaaaaccaauaguacuaauuu

SEQ ID NO: 62153 - RNA, 64 nt, hsa
uccaaagaauuugcuuuauguuuuuagcuauuuaaaaauaaauccaucaaaaauaaaguaugca

SEQ ID NO: 62154 - RNA, 64 nt, hsa
uuauguuuuuagcuauuuaaaaauaaauccaucaaaaauaaaguaugcaaauguaucuuuuaaa

SEQ ID NO: 62155 - RNA, 64 nt, hsa
gucauguugugacaaauugaucacuuguguacgaaaaauaaaucuccuuaaaaacuaaauaaaa

SEQ ID NO: 62156 - RNA, 64 nt, hsa
aauuaauacaguaguaguaaucauuuucuaggggaaaauaaaagaauaaaucacuauacugaua

SEQ ID NO: 62157 - RNA, 64 nt, hsa
gaaaguguaggugaaaaaacuuguaacuguauugaaaauaaauaccauuaaacugugaucaguu

SEQ ID NO: 62158 - RNA, 64 nt, hsa
cuuuguuuugguacauuugguugugcuuguggggaaaauaaaaacgcagagauccuuauauauu

SEQ ID NO: 62159 - RNA, 64 nt, hsa
cuccagccugggugacaaagcaagacugugucucaaaauaaauaaauaaaauaaaauaaaauga

SEQ ID NO: 62160 - RNA, 64 nt, hsa
gacaaagcaagacugugucucaaaauaaauaaauaaaauaaaauaaaaugacguacagagauuc

SEQ ID NO: 62161 - RNA, 64 nt, hsa
agcaagacugugucucaaaauaaauaaauaaaauaaaauaaaaugacguacagagauucuauau

SEQ ID NO: 62162 - RNA, 64 nt, hsa
gguuuuaugcuauuccuguguucuccaaaacaagaaaauaaaaagacaugacuuauucucuguu

SEQ ID NO: 62163 - RNA, 64 nt, hsa
auguaugcuuuaaauagagaauuuauuucuuuuaaaaauaaagcuaucuuuccuuauccauguu

SEQ ID NO: 62164 - RNA, 64 nt, hsa
cuucuuggauuucacccaacuaaaaggauuuuuaaaaauaaauaacagucuuaccuaaauuauu

SEQ ID NO: 62165 - RNA, 64 nt, hsa
uugagauaugacgguguacuuacugccuuguagcaaaauaaagaugugcccuuauuuuaccuac

SEQ ID NO: 62166 - RNA, 64 nt, hsa
gauaaguuuacacacugugcaaucucacaaucugaaaauaaaguugaguuggcuguguuuucuc

SEQ ID NO: 62167 - RNA, 64 nt, hsa
aaaauauauauggaacugaaacauuaacuuagcuaaaauaaaagcaaucuguguuugagaugaa

SEQ ID NO: 62168 - RNA, 64 nt, hsa
aauuaaaaaaauaguuaugaaaucuuagccacaaaaaauaaaucagguaaacauuuuaaccugu

SEQ ID NO: 62169 - RNA, 64 nt, hsa
ugaagauuuuuuugaagauuaauuuauacccuauaaaauaaaacuuguuagcuucgaugaaguc

SEQ ID NO: 62170 - RNA, 64 nt, hsa
ugucaguuuagcauuacauugucuugagcaccagaaaauaaaauccauauauuaauaaaaaccu

SEQ ID NO: 62171 - RNA, 64 nt, hsa
caugcuauaaguauguacauacaguuucacuucaaaaauaaaaaaaaaaucccuaaaaacucuc

SEQ ID NO: 62172 - RNA, 64 nt, hsa
auaguuguggccaccugcugacuauuugugguuuaaaauaaaagguuuacuugucugcagaaua

SEQ ID NO: 62173 - RNA, 64 nt, hsa
ucaugcuuuuuggaaauuuacaucauccucaaguaaaauaaauaucaguuaaauauuggaagcu

SEQ ID NO: 62174 - RNA, 64 nt, hsa
agagaaucaauugcugaaaguguuaaaauuucugaaaauaaaugcuuaauuacauauacaggaa

SEQ ID NO: 62175 - RNA, 64 nt, hsa
acugcaguuaaaucauauaauguuuguaugauuaaaaauaaauuucucagaauugugauuuuag

SEQ ID NO: 62176 - RNA, 64 nt, hsa
aaaauguguauuuagaauauuuguauaacuguguaaaauaaaaaaggaauuauguggucagugc

SEQ ID NO: 62177 - RNA, 64 nt, hsa
uguuacaaaccugugggccuguugcaauacuuuaaaaauaaaaaauuuuauuccauuugcuugu

SEQ ID NO: 62178 - RNA, 64 nt, hsa
aaagugucacuaccguauuucuuguuuucaucaaaaaauaaaaauaauuuaaaaaauucugugu

SEQ ID NO: 62179 - RNA, 64 nt, hsa
uaguacuuuugucuucucccaugugcuugaaggaaaaauaaagugucacuaccguauuucuugu

SEQ ID NO: 62180 - RNA, 64 nt, hsa
uuuuggauuaaauuaguuugugaaggauuauggaaaaauaaaacugucacuguuggacgucagc

SEQ ID NO: 62181 - RNA, 64 nt, hsa
aauauucucuauuugaauuauuucugucacaguaaaaauaaaauacuuugaguuuugagcuacu

SEQ ID NO: 62182 - RNA, 64 nt, hsa
uaucauguuaaccucugcuuuuaucucagauguuaaaauaaaugguuuggugcuuuuuauaaaa

SEQ ID NO: 62183 - RNA, 64 nt, hsa
aaaaaaaaaaacaaaaaaaaaaaaacaaaagaaaaaaauaaaaauacgguggcaauauuaugua

SEQ ID NO: 62184 - RNA, 64 nt, hsa
uacauuauguguaacagauugauuuucucagcacaaaauaaaaagcaucuguauuaauguaaag

SEQ ID NO: 62185 - RNA, 64 nt, hsa
uuaucuugguacauaccuauuugaaaaugcuacuaaaauaaaaauaaaucuuugccaaaaauuu

SEQ ID NO: 62186 - RNA, 64 nt, hsa
ugguacauaccuauuugaaaaugcuacuaaaauaaaaauaaaucuuugccaaaaauuuuuuuuc

SEQ ID NO: 62187 - RNA, 64 nt, hsa
uguuauggaaaaugucaaccuuuguaagaaaaccaaaauaaaaauugaaaaauaaaaaccauaa

SEQ ID NO: 62188 - RNA, 64 nt, hsa
ucaaccuuuguaagaaaaccaaaauaaaaauugaaaaauaaaaaccauaaacauuugcaccacu

SEQ ID NO: 62189 - RNA, 64 nt, hsa
cagccuggauaacagagcgagacccugucucaaaaaaauaaaauaaaaaauaaaaacacccuug

SEQ ID NO: 62190 - RNA, 64 nt, hsa
uggauaacagagcgagacccugucucaaaaaaauaaaauaaaaaauaaaaacacccuugccugc

SEQ ID NO: 62191 - RNA, 64 nt, hsa
cagagcgagacccugucucaaaaaaauaaaauaaaaaauaaaaacacccuugccugcgcuccau

SEQ ID NO: 62192 - RNA, 64 nt, hsa
agaagcacuaagacugcuucuaggcuuuauuuauaaaauaaacaccuuaucccuaacaugggca

SEQ ID NO: 62193 - RNA, 64 nt, hsa
aucauguacauuugaaaauauuugcacacauuuaaaaauaaauguaaaguugucuuuuaaacua

SEQ ID NO: 62194 - RNA, 64 nt, hsa
ggucugcauuucuacuguaaaaugcaauuugaaaaaaauaaaacgcaaaaaaagaaacuguaaa

SEQ ID NO: 62195 - RNA, 64 nt, hsa
aaauuaaauggaaugaaugauauguauauuacucaaaauaaaguuucuuucacuuuaauaauca

SEQ ID NO: 62196 - RNA, 64 nt, hsa
guauuugcuggugucguguaaauauugguauuuuaaaauaaaaacuguuacaucacuauuuuaa

SEQ ID NO: 62197 - RNA, 64 nt, hsa
aucacaacaauuugacacccuucauucauuuauaaaaauaaaugagcuaguucuuuaguaguua

SEQ ID NO: 62198 - RNA, 64 nt, hsa
uaccuuuaaacccauaaauuaauuuuauaucaauaaaauaaaauacuuucucuaguuuuggagc

SEQ ID NO: 62199 - RNA, 64 nt, hsa
uuuuauuuauauuucacauaauguaaaguucuacaaaauaaagcuaguaggcaagaccccucag

SEQ ID NO: 62200 - RNA, 64 nt, hsa
cagauuccuaauucuaugacaguguacauauaugaaaauaaaugaugaaaaaagaacuauaaua

SEQ ID NO: 62201 - RNA, 64 nt, hsa
uuacaguuuugugauauaaaauaaagcugaguauaaaauaaaaccaaucaaacacagaauuuga

SEQ ID NO: 62202 - RNA, 64 nt, hsa
auaaccuuauaccugaauuacaguuuugugauauaaaauaaagcugaguauaaaauaaaaccaa

SEQ ID NO: 62203 - RNA, 62 nt, hsa
gaaaucacauuuaaaauaaacugccucugacccaaaaauaaauauggcucuuuauuuuccuu

SEQ ID NO: 62204 - RNA, 64 nt, hsa
aaagcugcuuauaaauguaaaugaaaucacauuuaaaauaaacugccucugacccaaaaauaaa

SEQ ID NO: 62205 - RNA, 64 nt, hsa
agcucuagguucuucagcacauuucccccaaaacaaaauaaaauugagggcauguugcauauug

SEQ ID NO: 62206 - RNA, 64 nt, hsa
cuagaaacucuaaaaacaaaaauaauaauaaagaaaaauaaauaaaaaggagaggcagacaaug

SEQ ID NO: 62207 - RNA, 64 nt, hsa
ugcuuguuacaauucgaccuaauaugugcauuguaaaauaaaugccauauuucaaacaaaacac

SEQ ID NO: 62208 - RNA, 64 nt, hsa
gcccuucccaguauacuugaaaagcuuucuuguuaaaauaaaaggugucacugugguaggcauu

SEQ ID NO: 62209 - RNA, 64 nt, hsa
uuggggagggcauggaagauccagcggaaaguugaaaauaaacuggaaugaucaucuuggcuug

SEQ ID NO: 62210 - RNA, 64 nt, hsa
caacacacacacacacacaccccucacauacuauaaaauaaaucuucacugcccuaucaaaaua

SEQ ID NO: 62211 - RNA, 64 nt, hsa
acauuuuacauaaaaugcuaaaauuuauuauaggaaaauaaaucaaacccaaagaaaguuuauu

SEQ ID NO: 62212 - RNA, 64 nt, hsa
cauaagaaguccauauacugaagagcguuugauuaaaauaaagugacuauuaaccagaaaagaa

SEQ ID NO: 62213 - RNA, 64 nt, hsa
ugaagaauuuauauuuggaaaguaaaaaaguaaaaaaauaaaucauccaacuucuuugcauuac

SEQ ID NO: 62214 - RNA, 64 nt, hsa
cacaauuuuaaauaauucaucuuacaagucagguaaaauaaaaucgauucccagauuccauaca

SEQ ID NO: 62215 - RNA, 64 nt, hsa
uaauuaguuaaaauauauuaaaaauauuauuaguaaaauaaaauuucacacaauaaaaaacaac

SEQ ID NO: 62216 - RNA, 64 nt, hsa
uuacaugaagcucaaguguuaggauugacuuaugaaaauaaauuuuauuucuauccaaauuuga

SEQ ID NO: 62217 - RNA, 64 nt, hsa
uuuguaacucaacugguaacaguaguaaucauacaaaauaaaaaccugcuucagugucuuaaug

SEQ ID NO: 62218 - RNA, 64 nt, hsa
caauaaagucuccuugguacugaaaucauuaucuaaaauaaaggaaauguuaucaaaagauguu

SEQ ID NO: 62219 - RNA, 64 nt, hsa
uacuucuguaaagagaauaucaauauaaauaaggaaaauaaaucaaugaaauguuucaaugaua

SEQ ID NO: 62220 - RNA, 64 nt, hsa
uugcaucagaucauggaugcauuuuuauuaugaaaaaauaaaaugacuuuucaaauuauaauga

SEQ ID NO: 62221 - RNA, 64 nt, hsa
ucucaugcuaaaaauacaacaaaagacaaagcaaaaaauaaaccuuugcuuuuuuuuuuuuuuu

SEQ ID NO: 62222 - RNA, 64 nt, hsa
aagaaugaaaacugcugacguauuacaaaacagaaaaauaaaugauuuaaaaucaaaucaaaaa

SEQ ID NO: 62223 - RNA, 64 nt, hsa
aucuuaguucagaaauacauaaugucauauguuaaaaauaaagagauguagaaaucuaaaugaa

SEQ ID NO: 62224 - RNA, 64 nt, hsa
cguuauuagcugauuuuacucauuuuauauuugcaaaauaaauuucuaauauuuauugaaauug

SEQ ID NO: 62225 - RNA, 64 nt, hsa
cagaaaaggguguguuuggaugaaaguaaaaaaaaaaauaaaaucuuucacugucucuaauggc

SEQ ID NO: 62226 - RNA, 64 nt, hsa
auuuauuauuucaaaagaauaugucuuaaaagggaaaauaaaaacuuucuguugaaucacaaca

SEQ ID NO: 62227 - RNA, 64 nt, hsa
caaagcaaccugucuuacauucuuacauuaucuuaaaauaaauauuucugcccuugaaucaaga

SEQ ID NO: 62228 - RNA, 64 nt, hsa
cuagccugggcaacggugagacccugccucaaaaaaaauaaaaauaaaaauaaaacacuuuaau

SEQ ID NO: 62229 - RNA, 64 nt, hsa
ugggcaacggugagacccugccucaaaaaaaauaaaaauaaaaauaaaacacuuuaauuagaau

SEQ ID NO: 62230 - RNA, 64 nt, hsa
acggugagacccugccucaaaaaaaauaaaaauaaaaauaaaacacuuuaauuagaaucuauuu

SEQ ID NO: 62231 - RNA, 60 nt, hsa
auggaucccuuacuauuuagaauaaggaacaaaauaaacccuuguguauguaucacccaa

SEQ ID NO: 62232 - RNA, 64 nt, hsa
uaaagaaacauaaggacacauuuucaaauuaauaaaaauaaaggcauuuuaaggauggccugug

SEQ ID NO: 62233 - RNA, 64 nt, hsa
cgagcacaauggucuuacauuggauuuuuguaaaaaaauaaaaauaaauggagacuuuaacuca

SEQ ID NO: 62234 - RNA, 64 nt, hsa
caauggucuuacauuggauuuuuguaaaaaaauaaaaauaaauggagacuuuaacucaagcagc

SEQ ID NO: 62235 - RNA, 64 nt, hsa
gaaaccaaaguuuauuaauaauuuuuauauaacuaaaauaaaauagauguggagggaucuguga

SEQ ID NO: 62236 - RNA, 64 nt, hsa
cccagacuagugaguuaaguacaagaucucucuaaaaauaaacagaugaaaaucuauccccauu

SEQ ID NO: 62237 - RNA, 64 nt, hsa
ggcagaaugaaguauguuuguuuauuuuucuuuaaaaauaaaggauuuuggaacucuggagagu

SEQ ID NO: 62238 - RNA, 64 nt, hsa
uaccuaggcaacauggugaaaccuugucucuaccaaaauaaaaauuagcugggcaugguggcac

SEQ ID NO: 62239 - RNA, 64 nt, hsa
ugcuauaguggaaucuuugguuuugcaucauaguaaaauaaaauaaacccaucacauuuggaac

SEQ ID NO: 62240 - RNA, 64 nt, hsa
uaguggaaucuuugguuuugcaucauaguaaaauaaaauaaacccaucacauuuggaacauaac

SEQ ID NO: 62241 - RNA, 64 nt, hsa
aauauucauucagacaaaucagaaagggcacuugaaaauaaauuuugauucugagccaggagaa

SEQ ID NO: 62242 - RNA, 64 nt, hsa
ccuauggugugaaauccuuuguuauuuuucuaaaaaaauaaaauuuaaaaagaaagaaaacuaa

SEQ ID NO: 62243 - RNA, 64 nt, hsa
gguauuucaaagcucuuuuccuaacugguuaaguaaaauaaaaaauugagcuuucuagaauauu

SEQ ID NO: 62244 - RNA, 64 nt, hsa
aaaaaaagagagaguaacuacagaagaacuuuaaaaaauaaaaaauaagcuuaccuuggauucu

SEQ ID NO: 62245 - RNA, 64 nt, hsa
aguuuuguuuuucacaaagcucuuauuaugaagcaaaauaaaaauucuaguuucuuguaugauu

SEQ ID NO: 62246 - RNA, 64 nt, hsa
agaguauuugcacugcugaagagucacuaugagcaaaauaaaacaaauaagacucaaacugcuc

SEQ ID NO: 62247 - RNA, 64 nt, hsa
uagcagaaaggcauggcuaauaauguugguggugaaaauaaauaaauaaguaaacaaaaugaag

SEQ ID NO: 62248 - RNA, 64 nt, hsa
caaaugcauauaaaucuugauaaacaaagucuauaaaauaaaacaugggacauuagcuuuggga

SEQ ID NO: 62249 - RNA, 64 nt, hsa
uguuaaaauguuugauuccuugggaauggccuuaaaaauaaauguaauaaagucagaguggugg

SEQ ID NO: 62250 - RNA, 64 nt, hsa
aucucaguuuaauauaaaaugagcuaaguuuuuaaaaauaaauuauaaacuuggagauuagaaa

SEQ ID NO: 62251 - RNA, 64 nt, hsa
uuuuuaaaaauaaauuauaaacuuggagauuagaaaaauaaagcaguugcuguagaauaggcug

SEQ ID NO: 62252 - RNA, 64 nt, hsa
guuuuaaccagacuuucucuuaaaaacauuagauaaaauaaaagauucaccggauggauucuga

SEQ ID NO: 62253 - RNA, 64 nt, hsa
uguguaggagugaagacaggaucccgugcuuaaaaaaauaaaaaauaaaaaaauaaaaaaaaaa

SEQ ID NO: 62254 - RNA, 64 nt, hsa
gagugaagacaggaucccgugcuuaaaaaaauaaaaaauaaaaaaauaaaaaaaaaauaagacu

SEQ ID NO: 62255 - RNA, 64 nt, hsa
acaggaucccgugcuuaaaaaaauaaaaaauaaaaaaauaaaaaaaaaauaagacuuuaacugc

SEQ ID NO: 62256 - RNA, 64 nt, hsa
uuugcuucucgggaaagcaaagaagcugcuuuaaaaaauaaaaaggggacuaaaaauuuguuuu

SEQ ID NO: 62257 - RNA, 64 nt, hsa
aauauugugaaaaugaaucuguuaugauaaagaaaaaauaaaguggaaacuuuuagaguauuac

SEQ ID NO: 62258 - RNA, 64 nt, hsa
auuugcauguaaacaaugauuucaaaauacuugaaaaauaaaauuuuaacccaaaugaauaacu

SEQ ID NO: 62259 - RNA, 64 nt, hsa
uuuaaaaccccauuuuccuaaagaacaaaguaguaaaauaaaaaaaaauuuaaaaaauuaaaaa

SEQ ID NO: 62260 - RNA, 64 nt, hsa
aaguaguaaaauaaaaaaaaauuuaaaaaauuaaaaaauaaaaaaaagaggucacuaaaagacc

SEQ ID NO: 62261 - RNA, 64 nt, hsa
uagugucucuauuuaugagaucacugaacuuuucaaaauaaagcuuuugcauagaauaaugaag

SEQ ID NO: 62262 - RNA, 64 nt, hsa
cacugcuguaaagcaaaauauuugugaaagugccaaaauaaagucugucaugccaaaaguaaau

SEQ ID NO: 62263 - RNA, 64 nt, hsa
uaguguguuaugaaugacuaagauucugauaaaaaaaauaaauuauuuacacaggguuuauaca

SEQ ID NO: 62264 - RNA, 64 nt, hsa
uuuuuaaacccccaugaacacgaauacucugaaaaaaauaaaaagcuuucuggaagaagacacc

SEQ ID NO: 62265 - RNA, 64 nt, hsa
gcaauauacuauauguaauagggaauaccuugcuaaaauaaaacuuaggauauagugguaaugg

SEQ ID NO: 62266 - RNA, 64 nt, hsa
agagaacugugauuuaaaaguacuguuaauguaaaaaauaaagcaaguguaauuaauucuuuca

SEQ ID NO: 62267 - RNA, 64 nt, hsa
auugcauuuuauuaccauuucaaacuauuuuuuaaaaauaaauacaguuaacauagagugguuu

SEQ ID NO: 62268 - RNA, 64 nt, hsa
uaggcuuauuaugauacuagugaguacauuaaguaaaauaaaauggaccagaaaagaaaagaaa

SEQ ID NO: 62269 - RNA, 64 nt, hsa
uauacaaaguaaaauguuauaaaugugaaguuauaaaauaaauauaugcuaauaaaauccugag

SEQ ID NO: 62270 - RNA, 64 nt, hsa
agucaaaaaaaaaaauaccuuuuguaauguuugaaaaauaaagcuguuugacuugucagguguu

SEQ ID NO: 62271 - RNA, 64 nt, hsa
agguaaacaaagaaaugacaaaaauaaaauaaauaaaauaaaaauggauagguggugacccacu

SEQ ID NO: 62272 - RNA, 64 nt, hsa
aaaaaggauagguaaacaaagaaaugacaaaaauaaaauaaauaaaauaaaaauggauaggugg

SEQ ID NO: 62273 - RNA, 64 nt, hsa
auuuaaaaaaggauagguaaacaaagaaaugacaaaaauaaaauaaauaaaauaaaaauggaua

SEQ ID NO: 62274 - RNA, 64 nt, hsa
aauugcuuacuuuggaauacauuucuccuuugauaaaauaaaugagcuauguauuaacacugcc

SEQ ID NO: 62275 - RNA, 64 nt, hsa
aaaaaggacaauuucaaaaaaauaaaauaaaauaaaaauaaauucaccuagucuaaggaugcua

SEQ ID NO: 62276 - RNA, 64 nt, hsa
acaugaaaaaaggacaauuucaaaaaaauaaaauaaaauaaaaauaaauucaccuagucuaagg

SEQ ID NO: 62277 - RNA, 64 nt, hsa
uuuugacaugaaaaaaggacaauuucaaaaaaauaaaauaaaauaaaaauaaauucaccuaguc

SEQ ID NO: 62278 - RNA, 64 nt, hsa
aaauguuuugacaugaaaaaaggacaauuucaaaaaaauaaaauaaaauaaaaauaaauucacc

SEQ ID NO: 62279 - RNA, 64 nt, hsa
gaaaaauaaauaacaagauaauugagaaaaaaauaaaauaaauucccaauuccauugggaaaaa

SEQ ID NO: 62280 - RNA, 64 nt, hsa
auugagaaaaauaaauaacaagauaauugagaaaaaaauaaaauaaauucccaauuccauuggg

SEQ ID NO: 62281 - RNA, 64 nt, hsa
aacuugagccaaucugagagcaaaauaauugagaaaaauaaauaacaagauaauugagaaaaaa

SEQ ID NO: 62282 - RNA, 64 nt, hsa
uuggaaccaugcgagugauaccuauuuauaaaauaaaauaaaccaagcacaaguacgaacuuag

SEQ ID NO: 62283 - RNA, 64 nt, hsa
cgcauuuggaaccaugcgagugauaccuauuuauaaaauaaaauaaaccaagcacaaguacgaa

SEQ ID NO: 62284 - RNA, 64 nt, hsa
ugucuauacacuucacacuuuauauaauaccucaaaaauaaaaauaugaaaacaguacacuguu

SEQ ID NO: 62285 - RNA, 64 nt, hsa
acacuuuucuaaggacugaagauuggcaaaaacuaaaauaaauuaaaacugcuuacaccagaag

SEQ ID NO: 62286 - RNA, 64 nt, hsa
aagaauacuauuuccaaacucauauuacaaaaacaaaauaaaauaauaaaaaaagaaagcauga

SEQ ID NO: 62287 - RNA, 64 nt, hsa
auccacuaugccuuaaugguuuccuccauuugagaaaauaaagcuauucacauuguuaagaaaa

SEQ ID NO: 62288 - RNA, 64 nt, hsa
agugucuauaaaagaaacacuuugaagucuauaaaaaauaaaauaauuauaaauaucauuguac

SEQ ID NO: 62289 - RNA, 64 nt, hsa
uuuucugccaaaauaaaccuguucuuccuuuuuuaaaauaaaauaaguucuuaaaaaauuuaua

SEQ ID NO: 62290 - RNA, 64 nt, hsa
aaauuuugcauauucucuauuuuacuuuucugccaaaauaaaccuguucuuccuuuuuuaaaau

SEQ ID NO: 62291 - RNA, 64 nt, hsa
cuuuuaagccauuuccucuucacuaugucuuauuaaaauaaaaccugucaaguucuuuucaaaa

SEQ ID NO: 62292 - RNA, 64 nt, hsa
ugcccuggcaguggcuacauuugacacuuuagaaaaaauaaacauauuuaauaauuuuuguuuc

SEQ ID NO: 62293 - RNA, 64 nt, hsa
gugugaaaaaguaaagauaacuaaaaaauuuagaaaaauaaauccaguauuuguaaagugaaua

SEQ ID NO: 62294 - RNA, 64 nt, hsa
cauuguucugucaauaauuguuaccaaagagauaaaaauaaaagcagaauguauaucaucccau

SEQ ID NO: 62295 - RNA, 64 nt, hsa
agccugggugacagagugagacucugucucaaaaaaaauaaaauaaaaagucaauuuagaaugu

SEQ ID NO: 62296 - RNA, 64 nt, hsa
gggugacagagugagacucugucucaaaaaaaauaaaauaaaaagucaauuuagaaugugaaau

SEQ ID NO: 62297 - RNA, 64 nt, hsa
agaauugaugguuguauaagaacuagcucauguaaaaauaaaauaacauuauuacauugccuca

SEQ ID NO: 62298 - RNA, 64 nt, hsa
ggucgauugaauuggaccuuuucaguuguucagaaaaauaaaaauaauuucucauauuaaauac

SEQ ID NO: 62299 - RNA, 64 nt, hsa
uacgauuuuuaaguaaguuggggaccaucaguuuaaaauaaaugcaauacuauuucaugauaaa

SEQ ID NO: 62300 - RNA, 64 nt, hsa
uguuuuugucgugucuauaaaggaagaacaaaacaaaauaaaaacagagcccuagagaaaugcu

SEQ ID NO: 62301 - RNA, 64 nt, hsa
gcuuuuuuaguaauagguccagauaugagugcuaaaaauaaagaugauagcauguucuucuguc

SEQ ID NO: 62302 - RNA, 64 nt, hsa
agucauuuaccaggauucccguagggcguuuuguaaaauaaacuauaauauuaaugaaaaguau

SEQ ID NO: 62303 - RNA, 64 nt, hsa
aacuguaaauacauuuguaccucucuuguauucuaaaauaaaaauuacuuggaacauuuaucau

SEQ ID NO: 62304 - RNA, 64 nt, hsa
ccaguaaaacaaauguguauucaacaaaagaaaaaaaauaaaacaguaacacuuuaaaacaaga

SEQ ID NO: 62305 - RNA, 64 nt, hsa
gaggcauuuuaaucugcacaguuuaucuucugccaaaauaaaaauuuacuauuuccuuuauaua

SEQ ID NO: 62306 - RNA, 64 nt, hsa
caauguacucuuuuacuuuuauauuaaaaaaaauaaaauaaauaugugccuaaaaccuccaguu

SEQ ID NO: 62307 - RNA, 64 nt, hsa
cucaacaauguacucuuuuacuuuuauauuaaaaaaaauaaaauaaauaugugccuaaaaccuc

SEQ ID NO: 62308 - RNA, 64 nt, hsa
aagaguuguaggaugcagggcuaaauugcaaaauaaaauaaaauagccagcguacacaaugaga

SEQ ID NO: 62309 - RNA, 64 nt, hsa
uuaucaagaguuguaggaugcagggcuaaauugcaaaauaaaauaaaauagccagcguacacaa

SEQ ID NO: 62310 - RNA, 64 nt, hsa
aguacauuugaauugaauauauaauaaauauugcaaaauaaaauccaucuaaauagaaggguuc

SEQ ID NO: 62311 - RNA, 64 nt, hsa
cagauagucucauauuuaggaaaacuuuccaaauaaaauaaauguuauucucugauaaagagcu

SEQ ID NO: 62312 - RNA, 64 nt, hsa
uuuuuuuucuccuacaaggagauauggcuggaccaaaauaaaaugacaugaaacugcaaaaaug

SEQ ID NO: 62313 - RNA, 64 nt, hsa
aacaaugacuguaacguguuauagauguaaagacaaaauaaagguuaaagagggcauaaaggag

SEQ ID NO: 62314 - RNA, 64 nt, hsa
guauguaauauauguaacaucuuccaauucuuuuaaaauaaaauuaauauuuauaauggauauu

SEQ ID NO: 62315 - RNA, 64 nt, hsa
agccucuuaaaaaaaaaaaaccugcuaggauuuaaaaauaaaaaucagaggccuaucuccacuu

SEQ ID NO: 62316 - RNA, 64 nt, hsa
aaaucuguauuaaaaauaaaauuaauaaaaguaaaaaauaaaaauagaaacacaacucuacuag

SEQ ID NO: 62317 - RNA, 64 nt, hsa
gguugaaaaugccccuuacugaaaaucuguauuaaaaauaaaauuaauaaaaguaaaaaauaaa

SEQ ID NO: 62318 - RNA, 64 nt, hsa
accagucaacucuaagaagacuagauauuccuagaaaauaaagaagcaaaucucuuuaccggga

SEQ ID NO: 62319 - RNA, 64 nt, hsa
acacagcaagacucugucucaaaaauaaaugaauaaaauaaaaaccugccaccaaauuauuucu

SEQ ID NO: 62320 - RNA, 64 nt, hsa
accagccugggcaacacagcaagacucugucucaaaaauaaaugaauaaaauaaaaaccugcca

SEQ ID NO: 62321 - RNA, 64 nt, hsa
ccagucugggugacagagcaagacuccaucucaaaaaauaaauaaauagaaagagagagagagg

SEQ ID NO: 62322 - RNA, 64 nt, hsa
gauuuaccaauguuguuuuuuuuuaacaagaaaaaaaauaaaagcacauugucauuuuuuuucc

SEQ ID NO: 62323 - RNA, 64 nt, hsa
aagacaaaugaagccuaaucguuuuucuagaaggaaaauaaauucuaauugauaaugaauuucg

SEQ ID NO: 62324 - RNA, 64 nt, hsa
acacacacacacacacacacacacacacacacacaaaauaaauccgggugugccugaaccucag

SEQ ID NO: 62325 - RNA, 64 nt, hsa
ggcuuuuugacagcuuuuugagaccucuuaagaaaaaauaaaaaguaaaaaaugaaaggaaucu

SEQ ID NO: 62326 - RNA, 64 nt, hsa
ucgguuucugcuguauuaaugacaauuauucaugaaaauaaaaaaugaaauauuuuguauacua

SEQ ID NO: 62327 - RNA, 64 nt, hsa
ccucaaacugaggcuuaaaguauucccuuuuauaaaaauaaaugcuugggguaggguggagugg

SEQ ID NO: 62328 - RNA, 64 nt, hsa
aggguggaguggggagggauuaaaacccauccaaaaaauaaauaaaaacuauauaggugcuaug

SEQ ID NO: 62329 - RNA, 64 nt, hsa
gcaguacagaggaaaacaggaaccugauuuuuuuaaaauaaauuuuaaauaaaauagaauuacu

SEQ ID NO: 62330 - RNA, 64 nt, hsa
aguauaaaaaagcaaauacuuggugagugauuuaaaaauaaaaccaaaacaaaacacaaaaaga

SEQ ID NO: 62331 - RNA, 64 nt, hsa
caguuugaagcaguucuucaugccacuuaguuugaaaauaaaauucuagauaugcaaaugauuu

SEQ ID NO: 62332 - RNA, 64 nt, hsa
uagauaugcaaaugauuuucuuagaaaacuucacaaaauaaaagaucuuguuuuuuuuuccaua

SEQ ID NO: 62333 - RNA, 64 nt, hsa
uuugacaauugguagaaggugcacauuuuaagcaaaaauaaaaguuuuauaguuuuaaauacau

SEQ ID NO: 62334 - RNA, 64 nt, hsa
aaauguuuucucucuuaaaauauuucuccuguguaaaauaaaucauuguuguuaguaaugguug

SEQ ID NO: 62335 - RNA, 64 nt, hsa
aaagaagugcuuuuuggauauggcagcacuuguaaaaauaaagcaguaagcaaaauccuuuuaa

SEQ ID NO: 62336 - RNA, 64 nt, hsa
gggugacagagcgagacucugucucaaaaaaaaaaaaauaaagccgggcgugguggcucacgcc

SEQ ID NO: 62337 - RNA, 64 nt, hsa
gcaacaagagcgaaacugucucaaaaaaaagaagaaaauaaauaaauaaaaaucagagcacaag

SEQ ID NO: 62338 - RNA, 64 nt, hsa
aagccaacuucuguauaccuucacccauuucaugaaaauaaaaucaaaagggaaaucaaaaaua

SEQ ID NO: 62339 - RNA, 64 nt, hsa
ccauuucaugaaaauaaaaucaaaagggaaaucaaaaauaaagaaaacgcuaaagaaaaaacaa

SEQ ID NO: 62340 - RNA, 64 nt, hsa
uaacacuugugucaaaaugauauagcuuaguauaaaaauaaaauucaacguuuuggccaaaaug

SEQ ID NO: 62341 - RNA, 64 nt, hsa
uuuuugguuuacaguguaauaauaccucauuuaaaaaauaaaaaccacuacuguuacauuuuau

SEQ ID NO: 62342 - RNA, 64 nt, hsa
aguuuauaguaguuugagcagaggaugauuugcaaaaauaaaaauaaaguuauuuuacucuccu

SEQ ID NO: 62343 - RNA, 64 nt, hsa
uaguaguuugagcagaggaugauuugcaaaaauaaaaauaaaguuauuuuacucuccucuugca

SEQ ID NO: 62344 - RNA, 64 nt, hsa
aaagggaaggauuuaaggaggugaagucgggucaaaaauaaaauauauauacauauauacauug

SEQ ID NO: 62345 - RNA, 64 nt, hsa
gaagguuacugagugaguuauugggagucuuaauaaaauaaacuagauauuagguccauucauu

SEQ ID NO: 62346 - RNA, 64 nt, hsa
augaacccuuccugagcuuuaugguccuaaaagcaaaauaaaaacuauucgaaugaaaagacaa

SEQ ID NO: 62347 - RNA, 64 nt, hsa
uuuuauguuuagauagggcugggcaaggaaaaagaaaauaaagacaaccauauuuagcagugca

SEQ ID NO: 62348 - RNA, 64 nt, hsa
uaaguaagaagcuauguaaacugacaaggaugcuaaaauaaaagucucugaaguauuccaugcc

SEQ ID NO: 62349 - RNA, 64 nt, hsa
auaucuguuuugguauauuguacacaaaccuacaaaaauaaacugaacuugcaauauuuuugca

SEQ ID NO: 62350 - RNA, 64 nt, hsa
agcugcaucuauaugucacugacauaaaguugaaaaaauaaaugcaggcaaauaacuagagacu

SEQ ID NO: 62351 - RNA, 64 nt, hsa
uguuuuuuucucacuuccuacaaaaugcaaaugcaaaauaaauaacuaagcagcuuuuguuugg

SEQ ID NO: 62352 - RNA, 64 nt, hsa
uaagacauuuccuaauuuauggggauuuuaauugaaaauaaacuugagucccaauagagcuguu

SEQ ID NO: 62353 - RNA, 64 nt, hsa
aaaaaguuuucugaaaaaacuuuugcaauaaaaaaaaauaaauugcccaucaauaaguuugaua

SEQ ID NO: 62354 - RNA, 64 nt, hsa
auccauuaccuggcacuagcaacauuagaauuuuaaaauaaaauaauugggaaagaaggugggu

SEQ ID NO: 62355 - RNA, 64 nt, hsa
uuuuuguccuuuccuucacugauuugcuuuaaaaaaaauaaaagauaaugauuuauugcagaau

SEQ ID NO: 62356 - RNA, 64 nt, hsa
gcaacagagcaagacucugccucaaaaaaaaauuaaaauaaauuuaaauacaaaaaaaaauagc

SEQ ID NO: 62357 - RNA, 64 nt, hsa
gcaaauuagcaucccauggcaaauauauuuugaaaaaauaaagaacuaucaggauugaaaacag

SEQ ID NO: 62358 - RNA, 64 nt, hsa
auuuuaaaaauauuguuugauuuuucuauuuucaaaaauaaaauucuguuucuaacuaaaaugu

SEQ ID NO: 62359 - RNA, 64 nt, hsa
acaacauagcaagauuccaucucuaaaaaaaaugaaaauaaacauaagccacaaggaaugggug

SEQ ID NO: 62360 - RNA, 64 nt, hsa
auuuauuagagggagcauggccauaaaauaaaauaaaauaaaauuuagauuuaagucgagcuca

SEQ ID NO: 62361 - RNA, 64 nt, hsa
uuuagauuuauuagagggagcauggccauaaaauaaaauaaaauaaaauuuagauuuaagucga

SEQ ID NO: 62362 - RNA, 64 nt, hsa
uaaaauuuagauuuauuagagggagcauggccauaaaauaaaauaaaauaaaauuuagauuuaa

SEQ ID NO: 62363 - RNA, 64 nt, hsa
uaaaacacuuuagaaucagcuagucaauuuccacaaaauaaagugcuagaauuugauuggauuu

SEQ ID NO: 62364 - RNA, 64 nt, hsa
cuaucauuauuccaaaauacaaaauaaagaagauaaaauaaauuauauacccgagccauuaacc

SEQ ID NO: 62365 - RNA, 64 nt, hsa
auuuucagaugcagcuaucauuauuccaaaauacaaaauaaagaagauaaaauaaauuauauac

SEQ ID NO: 62366 - RNA, 64 nt, hsa
aucaaaaugcacuuuuuaauaaaaacugauacuuaaaauaaauggcuguuauuucuacuguguu

SEQ ID NO: 62367 - RNA, 64 nt, hsa
uauggucaguaggcaaucuuaaauguuuuuauuuaaaauaaaguauuccuugaaaauauaaaua

SEQ ID NO: 62368 - RNA, 64 nt, hsa
gaagugcuaagaacuccaugagagaagaugccauaaaauaaacaccucccuaauccuauuaucu

SEQ ID NO: 62369 - RNA, 64 nt, hsa
gucuuuagucaaaucucugcauuguuucaugcagaaaauaaagauacaauuaaggcugacauua

SEQ ID NO: 62370 - RNA, 64 nt, hsa
ucacauugugcuacuacgacuuuauuuuuucuugaaaauaaagccuugaggaugugaacauaaa

SEQ ID NO: 62371 - RNA, 64 nt, hsa
acuaagauaguuuuaagauuuuugguuguauaacaaaauaaaaguuuacccaaaaguauaagau

SEQ ID NO: 62372 - RNA, 64 nt, hsa
ucucauugugcuuucccuucccuucuuuauaaugaaaauaaaucuugagucguugacuuuugua

SEQ ID NO: 62373 - RNA, 64 nt, hsa
uagauuguaggagaugacagacauaagguauuucaaaauaaaucucaggugcuauaacauguag

SEQ ID NO: 62374 - RNA, 64 nt, hsa
uuaucuuugucuauaacugacagauguuuauauuaaaauaaaauauuguauuaaaaauuuaaaa

SEQ ID NO: 62375 - RNA, 64 nt, hsa
uuguccuuuaagucugcuaggcucucaguacccuaaaauaaacuagauuguguugcuauuuuuu

SEQ ID NO: 62376 - RNA, 64 nt, hsa
uguuguauuuaaaagguagccauguagagacacaaaaauaaaugaagaagcuggacaugguggg

SEQ ID NO: 62377 - RNA, 64 nt, hsa
gguuuuuaaaagacugacaguguuuauuauuauuaaaauaaacaggguugguuauauugcaaua

SEQ ID NO: 62378 - RNA, 64 nt, hsa
uaaaggaaaucaaauguuauuuuuaagaaaauggaaaauaaaaacuuuauaaacaccaucugcu

SEQ ID NO: 62379 - RNA, 64 nt, hsa
agguggaugucagaucugguagguugcagcagagaaaauaaaugugccuugagagaccacucag

SEQ ID NO: 62380 - RNA, 64 nt, hsa
ccauucuauuguguucuacuucaccuaaaaaaauaaaauaaaaauguugaucaagacauggagu

SEQ ID NO: 62381 - RNA, 64 nt, hsa
uugagccauucuauuguguucuacuucaccuaaaaaaauaaaauaaaaauguugaucaagacau

SEQ ID NO: 62382 - RNA, 64 nt, hsa
ugugcuuuaugugguaguguuguacccauucuuaaaaauaaaucacaucauauauauguguaaa

SEQ ID NO: 62383 - RNA, 64 nt, hsa
aaacacauuugccuaucuucuuacccugaaacagaaaauaaauauugugcuuuaugugguagug

SEQ ID NO: 62384 - RNA, 64 nt, hsa
auaugaacaugauuuuucuuuauguacaaaaacuaaaauaaagucaauaaagacaauucugacu

SEQ ID NO: 62385 - RNA, 64 nt, hsa
auaaaagcuuuggaaacucuguaaaaugaacaauaaaauaaagcauauagcuacuuucaguuga

SEQ ID NO: 62386 - RNA, 64 nt, hsa
cugugucuacuuuaaaaaacuggaaauggaaaaaaaaauaaaucuuugccaaauccuucagauu

SEQ ID NO: 62387 - RNA, 64 nt, hsa
ugauaauaaaaucgcuacuuuaagggguuuguccaaaauaaauauuguggccuuauauaucaca

SEQ ID NO: 62388 - RNA, 64 nt, hsa
auuuguucuguaaaugcugcguuccuaauuuaguaaaauaaaagaauagacacuaaaaucaugu

SEQ ID NO: 62389 - RNA, 64 nt, hsa
gccuggccaacauggcgaaaacccaucucuacuaaaaauaaaauuagccaugcguggugcuugu

SEQ ID NO: 62390 - RNA, 64 nt, hsa
aaacacaaaauugguuucaaaauguuuucauguaaaaauaaauuaacuuuucuguaauuagauu

SEQ ID NO: 62391 - RNA, 64 nt, hsa
ccugggcuacagagagcaagacucugucucaaaaaaaauaaaauaaaauaaauaaaaaaagaua

SEQ ID NO: 62392 - RNA, 64 nt, hsa
gcuacagagagcaagacucugucucaaaaaaaauaaaauaaaauaaauaaaaaaagauauagua

SEQ ID NO: 62393 - RNA, 64 nt, hsa
agagagcaagacucugucucaaaaaaaauaaaauaaaauaaauaaaaaaagauauaguauuaau

SEQ ID NO: 62394 - RNA, 64 nt, hsa
gaauaaaauuuucuacaucaaaguaagacuugagaaaauaaacuuauguguauauauguuuaaa

SEQ ID NO: 62395 - RNA, 64 nt, hsa
uccagccugggcgacagagcaagacuccaucucaaaaauaaaauaaaaaaagaaagaaagaaaa

SEQ ID NO: 62396 - RNA, 64 nt, hsa
ccugggcgacagagcaagacuccaucucaaaaauaaaauaaaaaaagaaagaaagaaaagaaga

SEQ ID NO: 62397 - RNA, 64 nt, hsa
uggugggaaaugggggaucuucaauguuuauuuuaaaauaaaauaaaauaaguucuugacuuuu

SEQ ID NO: 62398 - RNA, 64 nt, hsa
ggaaaugggggaucuucaauguuuauuuuaaaauaaaauaaaauaaguucuugacuuuucucau

SEQ ID NO: 62399 - RNA, 64 nt, hsa
aaacacuggccauggccgugggaguacugggaguaaaauaaaaauaucgagguauagacuagca

SEQ ID NO: 62400 - RNA, 64 nt, hsa
cuuuguuuucucuuauucuagguaaggcauauuaaaaauaaauauguaaagaagaaaaauaaaa

SEQ ID NO: 62401 - RNA, 64 nt, hsa
guaaggcauauuaaaaauaaauauguaaagaagaaaaauaaaaguugucuucauggaagcaacu

SEQ ID NO: 62402 - RNA, 64 nt, hsa
aagugucaaauaaaaaauuaccaucauuaucauuaaaauaaauuuucacuguauuugagauggg

SEQ ID NO: 62403 - RNA, 64 nt, hsa
caacuacuuugucgguugcucugaggguuaaaugaaaauaaaaagaaaaugugaaacagcacca

SEQ ID NO: 62404 - RNA, 64 nt, hsa
uccagcccggccuacaagaacaaaacuccaucucaaaauaaauaaaaaaauaaauaaaaauaaa

SEQ ID NO: 62405 - RNA, 64 nt, hsa
uacaagaacaaaacuccaucucaaaauaaauaaaaaaauaaauaaaaauaaaaauagacuauau

SEQ ID NO: 62406 - RNA, 64 nt, hsa
aaacuccaucucaaaauaaauaaaaaaauaaauaaaaauaaaaauagacuauauauagucuuug

SEQ ID NO: 62407 - RNA, 64 nt, hsa
agucuuugaauucauuuauuuuaaauaaaugaauaaaauaaaauaaaaaagaauauucagucgu

SEQ ID NO: 62408 - RNA, 64 nt, hsa
uugaauucauuuauuuuaaauaaaugaauaaaauaaaauaaaaaagaauauucagucguuggca

SEQ ID NO: 62409 - RNA, 64 nt, hsa
aaaauuuccuuaggagugcagagggcucauugggaaaauaaaaauaauaaaaauaaauaaaacu

SEQ ID NO: 62410 - RNA, 64 nt, hsa
gugcagagggcucauugggaaaauaaaaauaauaaaaauaaauaaaacuuccuaaaagaaaaga

SEQ ID NO: 62411 - RNA, 64 nt, hsa
cucccacauuuuaagauuuuaaaaaugaaaccaaaaaauaaauugaagaaaacuguaaacuuua

SEQ ID NO: 62412 - RNA, 64 nt, hsa
gcagccuaggugacagucagacccugucucaaaaaaaauaaaaaaaauuuaaaauaaucuuggg

SEQ ID NO: 62413 - RNA, 64 nt, hsa
acauuucagagcaaucugcauauuuaacagaccuaaaauaaauccuauuaggcaagucaguuga

SEQ ID NO: 62414 - RNA, 64 nt, hsa
ugucuacaauacaauaccuguauucaaaauaacaaaaauaaagccugauucuuuguuucuagaa

SEQ ID NO: 62415 - RNA, 64 nt, hsa
agagcaagacuccgucucacaaaaaugaauaaauaaaauaaaaauaaaaauguuacuuuuuaaa

SEQ ID NO: 62416 - RNA, 64 nt, hsa
agacuccgucucacaaaaaugaauaaauaaaauaaaaauaaaaauguuacuuuuuaaaaaguaa

SEQ ID NO: 62417 - RNA, 64 nt, hsa
cauguaacaagccugcacauguaccccagaaucuaaaauaaaaauaaaaagaaaaacaaagaau

SEQ ID NO: 62418 - RNA, 64 nt, hsa
acaagccugcacauguaccccagaaucuaaaauaaaaauaaaaagaaaaacaaagaauguacuc

SEQ ID NO: 62419 - RNA, 64 nt, hsa
agccugggugacagagcaagacccugucucaaaaaaaauaaaauaaaaggcuuucugccuucau

SEQ ID NO: 62420 - RNA, 64 nt, hsa
gggugacagagcaagacccugucucaaaaaaaauaaaauaaaaggcuuucugccuucauugccu

SEQ ID NO: 62421 - RNA, 64 nt, hsa
aggccaucagagcaaauuuggggguuucucaaauaaaauaaaaauaaaaacaaauacuguguuu

SEQ ID NO: 62422 - RNA, 64 nt, hsa
ucagagcaaauuuggggguuucucaaauaaaauaaaaauaaaaacaaauacuguguuucagaag

SEQ ID NO: 62423 - RNA, 64 nt, hsa
cagaacugagaugucuguaugacagccacuccuaaaaauaaacaacaacaaaaacaaaaaaaga

SEQ ID NO: 62424 - RNA, 64 nt, hsa
aacaacaaaaacaaaaaaagaagaaaacuaaauaaaaauaaaaauaaaaauaagauccacuucu

SEQ ID NO: 62425 - RNA, 64 nt, hsa
aaaaacaaaaaaagaagaaaacuaaauaaaaauaaaaauaaaaauaagauccacuucucucugc

SEQ ID NO: 62426 - RNA, 64 nt, hsa
aaaguaaccuuauauuuaaaagaugauuuugcaaaaaauaaaaaauaaaaaauaugccuucugg

SEQ ID NO: 62427 - RNA, 64 nt, hsa
ccuuauauuuaaaagaugauuuugcaaaaaauaaaaaauaaaaaauaugccuucuggagugaug

SEQ ID NO: 62428 - RNA, 64 nt, hsa
uuguaugguuugcaaaagggcuuccuaaaaauaaaaaauaaaauuuaaaaaacugugccuccgu

SEQ ID NO: 62429 - RNA, 64 nt, hsa
uuauaucuuguaugguuugcaaaagggcuuccuaaaaauaaaaaauaaaauuuaaaaaacugug

SEQ ID NO: 62430 - RNA, 64 nt, hsa
aaaaccuucaucuaauacuuuggaucauugugaaaaaauaaauuccugaaguauaaagcaucua

SEQ ID NO: 62431 - RNA, 64 nt, hsa
aaauauguauauuuauuauuugucaauuaaaagcaaaauaaaacaaaaaaccuucaucuaauac

SEQ ID NO: 62432 - RNA, 64 nt, hsa
ucccuuuuaaaaaauaaaaauacuuuguagauuaaaaauaaaucagaauuucaaauuuaaaauu

SEQ ID NO: 62433 - RNA, 64 nt, hsa
auaagauuucaauaaugaaaugguucccuuuuaaaaaauaaaaauacuuuguagauuaaaaaua

SEQ ID NO: 62434 - RNA, 64 nt, hsa
gcaggaguauucuggaaucuuuuuacuuagauauaaaauaaaccucgaauauuaaaaaguugua

SEQ ID NO: 62435 - RNA, 64 nt, hsa
auuuuugcuauucugaucauuugucccccuuuuaaaaauaaacuucccaugucuuccauuugug

SEQ ID NO: 62436 - RNA, 64 nt, hsa
auuuucucuaggaaauauacuuuuacaaguaacaaaaauaaaaacucuuauaaauuucuauuuu

SEQ ID NO: 62437 - RNA, 64 nt, hsa
uucucauaacuugagaccuaaucucuguaaagcuaaaauaaagaaauagaacaaggcugaggau

SEQ ID NO: 62438 - RNA, 64 nt, hsa
gagucgagagaucugaauagagaaaucagcaguuaaaauaaaauuaaaauagcucugaacauuu

SEQ ID NO: 62439 - RNA, 64 nt, hsa
ggcacaccuuucugaaauccaagaaauggaauccaaaauaaauuuuccaauugcaaccaaacgu

SEQ ID NO: 62440 - RNA, 64 nt, hsa
aacauuuauaggaggaaaaaaaucacuuugggagaaaauaaaauucaacucaagcauaaagcuu

SEQ ID NO: 62441 - RNA, 64 nt, hsa
ugagccuacucuaguucaagaggcuaccugaaaaaaaauaaauaagauaaagggucagcaacaa

SEQ ID NO: 62442 - RNA, 64 nt, hsa
aaaagaaaauuucucucgggaauaauuuuauagaaaaauaaagcuucugugucuaaggcaacua

SEQ ID NO: 62443 - RNA, 64 nt, hsa
ccagcaaaacacacacacacacacacacacacacaaaauaaagacacacaaggacgucugcgca

SEQ ID NO: 62444 - RNA, 64 nt, hsa
aacccauuaggcaugccuaauauuuaggcaagagaaaauaaaccaagauagauccauuuggaca

SEQ ID NO: 62445 - RNA, 64 nt, hsa
ucaagaacaccuuuguuuugcacugacaagauggaaaauaaauuauauuaauuuuugaaaccca

SEQ ID NO: 62446 - RNA, 64 nt, hsa
aaaggaaaaaagguacuucuauuuugaaaaaauaaaaauaaaagccuuuggguucuugaaugga

SEQ ID NO: 62447 - RNA, 64 nt, hsa
auaauaaaaggaaaaaagguacuucuauuuugaaaaaauaaaaauaaaagccuuuggguucuug

SEQ ID NO: 62448 - RNA, 64 nt, hsa
uuaauuuaaggauauauauuaauagaguauguuuaaaauaaauauuguuuucaucacugacuuu

SEQ ID NO: 62449 - RNA, 64 nt, hsa
aaaaaugaauuacacuguaucuuauaugaaguaaaaaauaaaucagaggugagaauauuguuac

SEQ ID NO: 62450 - RNA, 64 nt, hsa
ucuugggacuuauguauauauauaccuuuuaaauaaaauaaauuuucuaaauaaaaaguugaaa

SEQ ID NO: 62451 - RNA, 64 nt, hsa
gauuuuuuuuuacuguaaguauggaucaaauugcaaaauaaagaaaaaugccaaccuuagaaaa

SEQ ID NO: 62452 - RNA, 64 nt, hsa
acagagugagacuccaucucaaaaacugaaaauaaaaauaaaaauauguauucuccuaacugaa

SEQ ID NO: 62453 - RNA, 64 nt, hsa
ugggugacagagugagacuccaucucaaaaacugaaaauaaaaauaaaaauauguauucuccua

SEQ ID NO: 62454 - RNA, 64 nt, hsa
ugggcaacaacagcaaaacuccaucucaaaaaauaaaauaaauaaauaaacaaauaaaaaauuc

SEQ ID NO: 62455 - RNA, 64 nt, hsa
uagccugggcaacaacagcaaaacuccaucucaaaaaauaaaauaaauaaauaaacaaauaaaa

SEQ ID NO: 62456 - RNA, 64 nt, hsa
ucaguuggaaaaccuuuucaggcccucagucuaaaaaauaaaaaauaugagcaccauugaauuc

SEQ ID NO: 62457 - RNA, 64 nt, hsa
agaaggacucauccagcaaaguugccugggauucaaaauaaaggcauugcagaccgcacaggug

SEQ ID NO: 62458 - RNA, 64 nt, hsa
uguguauacacuacauuuguuuauaaccagaagcaaaauaaacucagcccacaaagcuagaauc

SEQ ID NO: 62459 - RNA, 64 nt, hsa
ccuuaaagauuaacuacaaagauaaacauggccaaaaauaaauaaauaaauauggccauauguc

SEQ ID NO: 62460 - RNA, 50 nt, hsa
agaagagguugaagagguaaaaaauaaauaaauacauaaaaagcaaacaa

SEQ ID NO: 62461 - RNA, 64 nt, hsa
aaucuuuuaugcaccaaaguuggucuugaaaaggaaaauaaaaucacuuucuugcuugguaagc

SEQ ID NO: 62462 - RNA, 64 nt, hsa
cgagagcaaaucaaaaccucuauccagacaagacaaaauaaaacucaccaucuccugaagaccu

SEQ ID NO: 62463 - RNA, 64 nt, hsa
cuauaggccauaaagaaugggacugcauuggaccaaaauaaaugggaaaaucgugguuugaaaa

SEQ ID NO: 62464 - RNA, 64 nt, hsa
uuacauacuuuugcaaaauaaguaaauaauaaauaaaauaaaagccaaccuucaaagaaacuug

SEQ ID NO: 62465 - RNA, 64 nt, hsa
gugcguuaaauaagcaaauaaacaguggcucauaaaaauaaaagucgcauuccauaucuuugga

SEQ ID NO: 62466 - RNA, 64 nt, hsa
cugagaaguagauuguuacccaguaaugaaauaaaaaauaaaaauaaaaggauuuuuuucucua

SEQ ID NO: 62467 - RNA, 64 nt, hsa
aguagauuguuacccaguaaugaaauaaaaaauaaaaauaaaaggauuuuuuucucuauuguuu

SEQ ID NO: 62468 - RNA, 64 nt, hsa
uaauuguaaguuguuaacuccuguauauaucauuaaaauaaaucugaaguugaaguaguguuuu

SEQ ID NO: 62469 - RNA, 64 nt, hsa
uaaccuuaggauuccugaaaagaauuucaaaaaaaaaauaaagacacuguugccaaugugaccc

SEQ ID NO: 62470 - RNA, 64 nt, hsa
gaacauacuaauggcauauauuuguuacaauuaaaaaauaaauuuacuacuuaauccuauguug

SEQ ID NO: 62471 - RNA, 64 nt, hsa
acugaguauuuaugugaaaacucucuagaagguaaaaauaaagauaauucuucaaaugaagucu

SEQ ID NO: 62472 - RNA, 64 nt, hsa
uuugguggugaggaggaagaacaaauaauagaagaaaauaaaaaugagauagaagaaaaguaag

SEQ ID NO: 62473 - RNA, 64 nt, hsa
aaaauuuuaacauuggcaucuaaaguguuauuugaaaauaaaauuauuuuccuguucauugauu

SEQ ID NO: 62474 - RNA, 64 nt, hsa
gaacuuauugugaaaguugugcuguuuucuaaguaaaauaaaaaauaaaaaauuagcaauuuau

SEQ ID NO: 62475 - RNA, 64 nt, hsa
uugugaaaguugugcuguuuucuaaguaaaauaaaaaauaaaaaauuagcaauuuaugauagcc

SEQ ID NO: 62476 - RNA, 64 nt, hsa
uguaaguuauuaaaugguuaaucauggccuuuuaaaaauaaaauaaagugauaccuuuacaaug

SEQ ID NO: 62477 - RNA, 64 nt, hsa
guuauuaaaugguuaaucauggccuuuuaaaaauaaaauaaagugauaccuuuacaaugaagac

SEQ ID NO: 62478 - RNA, 64 nt, hsa
guuuucgacacuggacuggaagaacaagucuauaaaaauaaaaauggacaauuaacagugguga

SEQ ID NO: 62479 - RNA, 64 nt, hsa
agguuggagaacgaaugaauacaaauuuuauuguaaaauaaaaauguauauaaagcauaugagc

SEQ ID NO: 62480 - RNA, 64 nt, hsa
uuuaaaaaauaauaauaaaaauuuaaaaaaauuaaaaauaaaaaaaaccacagaaaacaacuuu

SEQ ID NO: 62481 - RNA, 64 nt, hsa
uuuguagaagagauugagaaugguacucuaaucaaaaauaaaguuuuguagugggaccagaaau

SEQ ID NO: 62482 - RNA, 64 nt, hsa
aacgaugugcaauacauuuuuuucucuuuccuugaaaauaaaaagagaaacaaguauuuugcua

SEQ ID NO: 62483 - RNA, 64 nt, hsa
uauaugauauuuuucaugcuccacuauuuuauuaaaaauaaaauauguucuuuaguuugcugcu

SEQ ID NO: 62484 - RNA, 64 nt, hsa
uugcuacuguuuuuccuuuuuuuacuaugacaggaaaauaaaugcaauuuuaguggaauugauu

SEQ ID NO: 62485 - RNA, 64 nt, hsa
uuaaagggcauugauagcauaccaaacaaaaggcaaaauaaagugaccuuuuuauauauuuuuu

SEQ ID NO: 62486 - RNA, 64 nt, hsa
aucacugaaauauuuaugacagugcauaauuugcaaaauaaaaaauguacacuagcauaauauu

SEQ ID NO: 62487 - RNA, 64 nt, hsa
auaauuguuaauauggaauaagcucaaauaugucaaaauaaauguaaaaaaugaguguugccca

SEQ ID NO: 62488 - RNA, 64 nt, hsa
uguaaccccuuuuuccuuucuucuguuuaaaauaaaaauaaaauuuaucucagcuucuguuagc

SEQ ID NO: 62489 - RNA, 64 nt, hsa
uaaaaauguaaccccuuuuuccuuucuucuguuuaaaauaaaaauaaaauuuaucucagcuucu

SEQ ID NO: 62490 - RNA, 64 nt, hsa
acuuguuucaugaagagaaaggacuugcauaaccaaaauaaacaaagcaagacaaauuaaaaau

SEQ ID NO: 62491 - RNA, 64 nt, hsa
gauaaagcaagucuaucaacauuaaaaauacuaaaaaauaaagacacacacagagcauuuuagu

SEQ ID NO: 62492 - RNA, 64 nt, hsa
auccuuuugauaaauuuaaaauguuacuuauuuuaaaauaaaugaagugagauggcauggugag

SEQ ID NO: 62493 - RNA, 64 nt, hsa
aagucugauccauauuuaauaaugcuuuaaaauaaaaauaaaaacaauccuuuugauaaauuua

SEQ ID NO: 62494 - RNA, 64 nt, hsa
cuuuucaagucugauccauauuuaauaaugcuuuaaaauaaaaauaaaaacaauccuuuugaua

SEQ ID NO: 62495 - RNA, 64 nt, hsa
gaugaaauaauuuuucuaggguaaugccguaggaaaaauaaaacuucacauuuauguggcuugu

SEQ ID NO: 62496 - RNA, 64 nt, hsa
auuaaauuuaacucugguuucuaccagcucauacaaaauaaaugguuucugaaaauguuuaagu

SEQ ID NO: 62497 - RNA, 63 nt, hsa
uuacuaggguauugaauaaaucuagucuuacuagaaaauaaaaggagcuguuuuguggcuuug

SEQ ID NO: 62498 - RNA, 64 nt, hsa
gaacacacucgauuaaaaauguuaagcuaucugaaaaauaaaaugugcaagucuucaggauggc

SEQ ID NO: 62499 - RNA, 64 nt, hsa
agagcaagacuccaucucaaaaaauaaauagauaaaaauaaaaacccauggaaaugguuuaaga

SEQ ID NO: 62500 - RNA, 64 nt, hsa
ccagccugggcaacagagcaagacuccaucucaaaaaauaaauagauaaaaauaaaaacccaug

SEQ ID NO: 62501 - RNA, 64 nt, hsa
ucuucaacuccuuuuggcaagaaaacuguaacagaaaauaaauuuugaauguguacuuaagucu

SEQ ID NO: 62502 - RNA, 64 nt, hsa
aagucuuuuccucccagaacuuaaaguaaaauaaaaaauaaauaaauaaauaaaaucuuuucca

SEQ ID NO: 62503 - RNA, 64 nt, hsa
auuaaagaagucuuuuccucccagaacuuaaaguaaaauaaaaaauaaauaaauaaauaaaauc

SEQ ID NO: 62504 - RNA, 64 nt, hsa
aauagcaauaaaaguuagacgaaguguagaaaauaaaauaaauuucauaauguuagucuuauug

SEQ ID NO: 62505 - RNA, 64 nt, hsa
gcuauaauagcaauaaaaguuagacgaaguguagaaaauaaaauaaauuucauaauguuagucu

SEQ ID NO: 62506 - RNA, 64 nt, hsa
cauuaaggaaguauaugaucugacuuuucagaagaaaauaaacaaaugcauuauguaaggucag

SEQ ID NO: 62507 - RNA, 64 nt, hsa
aucuuggacuccucagccuuuggacucauaagccaaaauaaaucuguuuucuuuauaaauugcc

SEQ ID NO: 62508 - RNA, 64 nt, hsa
uaucacauaagacaucaugauaacauuugaagaaaaaauaaaacuguagacccuaacaguugug

SEQ ID NO: 62509 - RNA, 64 nt, hsa
auaaagugcuaaaguguaaaaaaaaauaaaaauaaaaauaaauaaauaaauaaaauuaaaaaaa

SEQ ID NO: 62510 - RNA, 64 nt, hsa
cagggaauaaagugcuaaaguguaaaaaaaaauaaaaauaaaaauaaauaaauaaauaaaauua

SEQ ID NO: 62511 - RNA, 64 nt, hsa
uaacuucagggaauaaagugcuaaaguguaaaaaaaaauaaaaauaaaaauaaauaaauaaaua

SEQ ID NO: 62512 - RNA, 64 nt, hsa
auauuuacauuuucacucaucuaaaaaguauacaaaaauaaaaaguggaaaaagguaucuucug

SEQ ID NO: 62513 - RNA, 64 nt, hsa
acuguuuuugucaaggaugguuguguauguguuuaaaauaaaaccuguggugcacauuucuacc

SEQ ID NO: 62514 - RNA, 64 nt, hsa
ucccauugucccuuuauuuaggauauugaaagaaaaaauaaacuuuauguauuaguguccuuua

SEQ ID NO: 62515 - RNA, 64 nt, hsa
aaucuguucauauuuaacuuuguguguggucugcaaaauaaacagcaggacagaaauuguguug

SEQ ID NO: 62516 - RNA, 64 nt, hsa
aaaauuuguuguaaacugcauguuuuauaaaauaaaaauaaaauaucguuuguuauuuaucuca

SEQ ID NO: 62517 - RNA, 64 nt, hsa
uuuuuaaaaauuuguuguaaacugcauguuuuauaaaauaaaaauaaaauaucguuuguuauuu

SEQ ID NO: 62518 - RNA, 64 nt, hsa
ugggugacagagcgagaccaugucucaaaaaauaaaaauaaaaaaaaauuguuuucauuaccuc

SEQ ID NO: 62519 - RNA, 64 nt, hsa
ccagccugggugacagagcgagaccaugucucaaaaaauaaaaauaaaaaaaaauuguuuucau

SEQ ID NO: 62520 - RNA, 64 nt, hsa
cuaagccauaaaauaaauuuuauuccaaaauaacaaaauaaauaaucuacuguacacaaucuga

SEQ ID NO: 62521 - RNA, 64 nt, hsa
ccucucaaggcaggggucauagauccuaagccauaaaauaaauuuuauuccaaaauaacaaaau

SEQ ID NO: 62522 - RNA, 64 nt, hsa
uaaaaauaauaaugcagugguuguuucugucaggaaaauaaaucuuacagaacaacugguggaa

SEQ ID NO: 62523 - RNA, 64 nt, hsa
cagauauggaugccuucuaacaauugcuguuuguaaaauaaaucaggaugguagaaagugauua

SEQ ID NO: 62524 - RNA, 64 nt, hsa
uccccauuuuacugcaaaguugacaagcucagggaaaauaaauaguuggccagaauuaagcaac

SEQ ID NO: 62525 - RNA, 64 nt, hsa
guaauuuuuauuuucagaaccauuuuacagauuuaaaauaaacagguuugaggaauuaguuuaa

SEQ ID NO: 62526 - RNA, 64 nt, hsa
uccauuaacuagucuugaaaugccuuuguuuguaaaaauaaaauaaugguacuuucauuuuaua

SEQ ID NO: 62527 - RNA, 64 nt, hsa
aucuuugaaacaauauuauuuugaaauuggcuuuaaaauaaaaccauucagauugaaauucuaa

SEQ ID NO: 62528 - RNA, 64 nt, hsa
ggucccauuucaauuuccaccaugggagagccuaaaaauaaauuaugacauuuaguaucuaagg

SEQ ID NO: 62529 - RNA, 64 nt, hsa
uuuccuuuuguauuuguaauguugauuaagauguaaaauaaaaagugugccugauuauuuuugc

SEQ ID NO: 62530 - RNA, 64 nt, hsa
ugaugcuccugucaaaagggaaaugaggcuuuuaaaaauaaaguaccuuaauucuuuauugacu

SEQ ID NO: 62531 - RNA, 64 nt, hsa
aauuuaaggaaauucuuuaggauaaccauuucaaaaaauaaaauugcuaugcaaucuugaauau

SEQ ID NO: 62532 - RNA, 64 nt, hsa
uauguaaaauuuuuacuaaugucauuauuuugaaaaaauaaauuuaaaaauacauucaaaauua

SEQ ID NO: 62533 - RNA, 64 nt, hsa
uuuaguaaagcuuuucuuuuuuaauuuccaggaaaaaauaaaaagaguaugagucuucuguaau

SEQ ID NO: 62534 - RNA, 64 nt, hsa
uaaccuggcaaaaucuuguuaaugucauugcuaaaaaauaaauaaaagcuagauacuggaaacc

SEQ ID NO: 62535 - RNA, 64 nt, hsa
aauccacacaaccaaguucaugggaauuuuguguaaaauaaaagauaacaugccugagggagag

SEQ ID NO: 62536 - RNA, 64 nt, hsa
cuuugauacgccucaucuuauccuacauuauuggaaaauaaaugagauguccacacaaauggau

SEQ ID NO: 62537 - RNA, 64 nt, hsa
uaguuagaccucaucucuacaaaaauaaaaaauaaaaauaaaaaaaacuuagcuaggcauguug

SEQ ID NO: 62538 - RNA, 64 nt, hsa
gaaacauaguuagaccucaucucuacaaaaauaaaaaauaaaaauaaaaaaaacuuagcuaggc

SEQ ID NO: 62539 - RNA, 64 nt, hsa
cagccuggaaacauaguuagaccucaucucuacaaaaauaaaaaauaaaaauaaaaaaaacuua

SEQ ID NO: 62540 - RNA, 64 nt, hsa
gauaauauaaaauaaaaacuuaaaaaaaauuuaaaaaauaaaaaaaguuuuaaaaacugaucaa

SEQ ID NO: 62541 - RNA, 64 nt, hsa
guuaagggaaaaacuuuuacuuuguagauaauauaaaauaaaaacuuaaaaaaaauuuaaaaaa

SEQ ID NO: 62542 - RNA, 64 nt, hsa
aaaagcuggugacauauuuauacguuuuugugcaaaaauaaaugaauggcaauagauuuuaaaa

SEQ ID NO: 62543 - RNA, 64 nt, hsa
cccaauucuaagcagaaaaagaaaaaaaacacaaaaaauaaaaaaccccuacaaaaaaacuuua

SEQ ID NO: 62544 - RNA, 64 nt, hsa
ucgcagugaacuuaaagcaaagaccucuuaguaaaaaauaaaaaaaaauaaaaaauaaaaauaa

SEQ ID NO: 62545 - RNA, 64 nt, hsa
cuuaaagcaaagaccucuuaguaaaaaauaaaaaaaaauaaaaaauaaaaauaaaaaaaguuaa

SEQ ID NO: 62546 - RNA, 64 nt, hsa
caaagaccucuuaguaaaaaauaaaaaaaaauaaaaaauaaaaauaaaaaaaguuaaauuuauu

SEQ ID NO: 62547 - RNA, 64 nt, hsa
ccucuuaguaaaaaauaaaaaaaaauaaaaaauaaaaauaaaaaaaguuaaauuuauuuauaga

SEQ ID NO: 62548 - RNA, 64 nt, hsa
ucgagaaacuaugggaaaaaaaauugcaaaaucuaaaauaaaaaaugcaaaaucuaaaauaaaa

SEQ ID NO: 62549 - RNA, 64 nt, hsa
aauugcaaaaucuaaaauaaaaaaugcaaaaucuaaaauaaaaaauggaaaggaaacuuugaac

SEQ ID NO: 62550 - RNA, 64 nt, hsa
gcaacaagagcaaaacuccgucucaaaaaagaugaaaauaaaauaaaauauauauuuacaggcc

SEQ ID NO: 62551 - RNA, 64 nt, hsa
aagagcaaaacuccgucucaaaaaagaugaaaauaaaauaaaauauauauuuacaggccuacaa

SEQ ID NO: 62552 - RNA, 64 nt, hsa
auauuguuguuuaucuuguuuggaaguguguuucaaaauaaacaugucuagaauuuaaaguuuu

SEQ ID NO: 62553 - RNA, 64 nt, hsa
aaaacugguuccaauuuuuuggucauuucucagaaaaauaaaauacuuauaaauccuauauuuu

SEQ ID NO: 62554 - RNA, 64 nt, hsa
ucauggaguuuuuaaaaauuguuauaauuaaguaaaaauaaagcugaauugugucauuugugua

SEQ ID NO: 62555 - RNA, 64 nt, hsa
acuccaaucaaggucuuguugauauuauauaguaaaaauaaaaccaaaaauaaauauuauucaa

SEQ ID NO: 62556 - RNA, 64 nt, hsa
gucuuguugauauuauauaguaaaaauaaaaccaaaaauaaauauuauucaaguggcucuucua

SEQ ID NO: 62557 - RNA, 64 nt, hsa
aaugguaucuaauuaauaacuagucugacaucagaaaauaaaauugaggcugauuuuuaaaaau

SEQ ID NO: 62558 - RNA, 64 nt, hsa
agaaacccacuguuaaaauuuaaaaaggugcuuuaaaauaaaacgccuauaaagauugugcagu

SEQ ID NO: 62559 - RNA, 64 nt, hsa
gaaaaugugggaauaccaaauguccuuuauaagaaaaauaaauuuuauuuuaagggacauacua

SEQ ID NO: 62560 - RNA, 64 nt, hsa
aucuaacuauucagggacauuuuuccauuuccaaaaaauaaaauuuauuaugcuuuauaaccuc

SEQ ID NO: 62561 - RNA, 64 nt, hsa
aucucacguugugaggguuuuuuuuuucucauuuaaaauaaaaaaggaagaaagaaaauaauuu

SEQ ID NO: 62562 - RNA, 64 nt, hsa
acagcuacauuuucaacaaaaaagcaaacagagaaaaauaaaugaacuuuaacacuguaaguuc

SEQ ID NO: 62563 - RNA, 64 nt, hsa
ggagucuuugaagcugaaaauauaaaacaaauaaaaaauaaaaaaauaaaaacccacaaaaaug

SEQ ID NO: 62564 - RNA, 64 nt, hsa
ugaagcugaaaauauaaaacaaauaaaaaauaaaaaaauaaaaacccacaaaaauguugaacca

SEQ ID NO: 62565 - RNA, 64 nt, hsa
auuuguuaguuccuguaugaaagauugugggggaaaaauaaacgucgugccguuagcuuuuucc

SEQ ID NO: 62566 - RNA, 64 nt, hsa
aucaaaggcaagauaucauuuauuggacuucuugaaaauaaaaguuacaaaauccaacaacaac

SEQ ID NO: 62567 - RNA, 64 nt, hsa
agcauucuuauucacuuuaugccgguauuuagaaaaaauaaauuauagcaaguaugauuucuaa

SEQ ID NO: 62568 - RNA, 64 nt, hsa
auaauuucuuuuuuuaaaggaaauuaauauuaguaaaauaaacaccucuuuaauggaagcugca

SEQ ID NO: 62569 - RNA, 64 nt, hsa
cuaaaaauugagagguuuccuuuuauuaacuuuuaaaauaaagaaauaaguaguuucauuacga

SEQ ID NO: 62570 - RNA, 64 nt, hsa
uucagcaggaauuacacauuagaaagaagccagaaaaauaaauggcauauauccaaucacaagu

SEQ ID NO: 62571 - RNA, 64 nt, hsa
ggugacuacagucaacaauaacuuuauacauuuaaaaauaaaagaguguaauugggacguuugu

SEQ ID NO: 62572 - RNA, 64 nt, hsa
uguuuguuaggaaauggaauggucucuuugauuuaaaauaaauaaaaauagauuauuacgucuu

SEQ ID NO: 62573 - RNA, 64 nt, hsa
uuuuuccaaguguagcuaaaauauuuuugcagguaaaauaaagcugauaguacauguguuguuc

SEQ ID NO: 62574 - RNA, 64 nt, hsa
gccaaaagcuuucacugaagguuuuuuuuucuuaaaaauaaaaaaaaauauauaaguguaacau

SEQ ID NO: 62575 - RNA, 64 nt, hsa
gcagucagacauucgucaugggaaaguucagaaaaaaauaaaguccuuuuaagggaacuuccug

SEQ ID NO: 62576 - RNA, 64 nt, hsa
uccaaucuggcaacagagcgagaccuugucuuuaaaaauaaaaauaaaaacaucuuuacaacau

SEQ ID NO: 62577 - RNA, 64 nt, hsa
cuggcaacagagcgagaccuugucuuuaaaaauaaaaauaaaaacaucuuuacaacauuccugu

SEQ ID NO: 62578 - RNA, 64 nt, hsa
augagaauuagaaaauaagggacaacagggguuaaaaauaaacugauuuaauuugcucuauagu

SEQ ID NO: 62579 - RNA, 64 nt, hsa
uuugucacaaaguaguccauuccugaucucacuuaaaauaaaucacaaguaaauuugaauuuuc

SEQ ID NO: 62580 - RNA, 64 nt, hsa
uucugacgaacugccuggaggaggggaauauauaaaaauaaaauuggugucacuucuuuucugc

SEQ ID NO: 62581 - RNA, 64 nt, hsa
uccauacgcucauagucacauauggaauuuugagaaaauaaagcaugcugucuuuaggaauuuu

SEQ ID NO: 62582 - RNA, 64 nt, hsa
cacuuuggauuuuucuacaaaggcagugguguccaaaauaaaaucucugcccuaaauuuuacua

SEQ ID NO: 62583 - RNA, 64 nt, hsa
uuuuagaaacaucuuuagcccaaaguaacuaguaaaaauaaauggagugguauccuaucuucuu

SEQ ID NO: 62584 - RNA, 64 nt, hsa
gagauuuuuuuuuucacaguugaguuaguuugugaaaauaaagaacucuguagcucaccaaggu

SEQ ID NO: 62585 - RNA, 64 nt, hsa
uuuccaguuuugcuugacaguuucuaaacaaacaaaaauaaacucaaugaaaggaaagauguuu

SEQ ID NO: 62586 - RNA, 64 nt, hsa
aaauucauacaacaucagugguuacagcuauacuaaaauaaaacuuuauaugcuaauuaucuuc

SEQ ID NO: 62587 - RNA, 64 nt, hsa
acuuuauaugcuaauuaucuucaagggucuuucuaaaauaaaagggguuguuaggcuacugcaa

SEQ ID NO: 62588 - RNA, 64 nt, hsa
aacugcagaccucuaaacauaaguaggaaaaagaaaaauaaaagaauauuaccaauaauuaaag

SEQ ID NO: 62589 - RNA, 64 nt, hsa
ugaccucaucauuaauaagugaagaauacaucagaaaauaaaauauucacucuccauuagaaaa

SEQ ID NO: 62590 - RNA, 64 nt, hsa
acucaauguuucuggacauucucuuugauaacaaaaaauaaauuuuaaaaaggaauuuuguaaa

SEQ ID NO: 62591 - RNA, 64 nt, hsa
gaauuuaaauaucuuuuaaagaaaaaaacaccuaaaaauaaaucuuaacagaaaauucuguucu

SEQ ID NO: 62592 - RNA, 64 nt, hsa
uuuaaccaauacauuuaaaauuguacagaacaaaaaaauaaaaucaaagacugaucuuguacag

SEQ ID NO: 62593 - RNA, 64 nt, hsa
aauuuagucaucagagauacuuuccuaaaaaggaaaaauaaaaaacaaaauggugccacuuugg

SEQ ID NO: 62594 - RNA, 64 nt, hsa
uauuuugagaugucauacuguacacuguauuguaaaaauaaaaaguaaaauuauauuucaaauu

SEQ ID NO: 62595 - RNA, 64 nt, hsa
gcucuuuauugaagacaaacacucaccaaaaagaaaaauaaaaguuuucagagaaacuaauuuu

SEQ ID NO: 62596 - RNA, 64 nt, hsa
ucuguaccaaacugauuucaaaaguacuacauugaaaauaaaccggugacuguuuuucuucaua

SEQ ID NO: 62597 - RNA, 64 nt, hsa
auauauauauaauauauacauauauacauaguguaaaauaaaauguuucuuggacaagaaaucc

SEQ ID NO: 62598 - RNA, 64 nt, hsa
augcccuuuuuacccguugacguuuauuuuacguaaaauaaacuguuguuuccaaugcaaucaa

SEQ ID NO: 62599 - RNA, 64 nt, hsa
guggacacauuuggaucacauuuauacaguuauaaaaauaaagguuugauuuuggucguucuuc

SEQ ID NO: 62600 - RNA, 64 nt, hsa
ccuaaaaccucuuuaaaaacggucaguuaacuaaaaaauaaaaaucaagucuuuaggagaguag

SEQ ID NO: 62601 - RNA, 64 nt, hsa
uugccuaaaagagaagguaucuagaaaugccuuuaaaauaaauucagaguaccagaaaggguau

SEQ ID NO: 62602 - RNA, 64 nt, hsa
gcccuaaaaugcuagaauaauaauaaaaaggccaaaaauaaaauuguuucucucucaaccacuu

SEQ ID NO: 62603 - RNA, 64 nt, hsa
ggcaaauagguaucaucaaugaguuaaccaucuaaaaauaaaagaguggaagcccuaaaaugcu

SEQ ID NO: 62604 - RNA, 64 nt, hsa
uuuccuaagaggucuagaaaugcuuaaacuauugaaaauaaaucaaauuauucaaagacuggau

SEQ ID NO: 62605 - RNA, 64 nt, hsa
gaaaaauagcauagaaaucauauauuuauuucauaaaauaaauagaaacuuugucuccuguguu

SEQ ID NO: 62606 - RNA, 64 nt, hsa
aguauauugguucgaaaucccagggaaaaaaauaaaaauaaaaaauuaaaggauuguugauaac

SEQ ID NO: 62607 - RNA, 64 nt, hsa
gcuaggaguauauugguucgaaaucccagggaaaaaaauaaaaauaaaaaauuaaaggauuguu

SEQ ID NO: 62608 - RNA, 64 nt, hsa
aaguagaucaaaauagaacacaauagagaacuucaaaauaaaacaggugugagaauugugugug

SEQ ID NO: 62609 - RNA, 64 nt, hsa
agauugacuauaccaaacauuauauuaaaaacacaaaauaaaaacuauaaaaauguacuuuagg

SEQ ID NO: 62610 - RNA, 64 nt, hsa
gagccagaccuugucucaaaaaauaaaaaauaaaaaaauaaaaacaaaauaaggaauccuuuua

SEQ ID NO: 62611 - RNA, 64 nt, hsa
gagagagagagccagaccuugucucaaaaaauaaaaaauaaaaaaauaaaaacaaaauaaggaa

SEQ ID NO: 62612 - RNA, 64 nt, hsa
agccugagagagagagagccagaccuugucucaaaaaauaaaaaauaaaaaaauaaaaacaaaa

SEQ ID NO: 62613 - RNA, 64 nt, hsa
acuuaaaacuguggauuggccuaggcuaaggacaaaaauaaacuaaguaccuguaguguauuua

SEQ ID NO: 62614 - RNA, 64 nt, hsa
uuaguuuuucuaaauagacccuuaugggaguuugaaaauaaauacucacauauuucacuacuua

SEQ ID NO: 62615 - RNA, 64 nt, hsa
uguaugagauagaaaaauuuuuauuacucaaaguaaaauaaauggaaauaucacugagcaguug

SEQ ID NO: 62616 - RNA, 64 nt, hsa
ccuuaugauucagcagcuuggucacuugauuagaaaaauaaaccauuguuucuucaauugugac

SEQ ID NO: 62617 - RNA, 64 nt, hsa
ugguguugagauuuacguggaacccuaaagcaguaaaauaaaaaaccugguugcagcacauuca

SEQ ID NO: 62618 - RNA, 64 nt, hsa
ggaucuuuuguccauuccauuaauaacugaauaaaaaauaaauaaaauggauagaaaaaaacua

SEQ ID NO: 62619 - RNA, 64 nt, hsa
gaagcauucugugauccccugguuacugaguuaaaaaauaaaaaaguacgaguuagacauauga

SEQ ID NO: 62620 - RNA, 64 nt, hsa
caaauaauuuugccuucuaggcuguugcucuaacaaaauaaaccuuagacauaucacaccuaaa

SEQ ID NO: 62621 - RNA, 64 nt, hsa
ucucaggaccagccuagagagaucccaucucuaaaaaauaaaauauaagaaaauaaaacuuagg

SEQ ID NO: 62622 - RNA, 64 nt, hsa
agagagaucccaucucuaaaaaauaaaauauaagaaaauaaaacuuaggggauauacagauuua

SEQ ID NO: 62623 - RNA, 64 nt, hsa
gggauuguaggcaaacccaccuguggcaucacugaaaauaaauuugaucauaccuaagagguua

SEQ ID NO: 62624 - RNA, 64 nt, hsa
acugugugacuuggcuagaguugggaguucccccaaaauaaacguguccccauuuuaccagaac

SEQ ID NO: 62625 - RNA, 64 nt, hsa
ucuccccuaauuuuuauucccagugccgauguucaaaauaaacuuucuccagucugggaaccuu

SEQ ID NO: 62626 - RNA, 64 nt, hsa
uugugcuuaauguaaagccgcuuuauaaaacuguaaaauaaaguuuuuuucuuaaaaagaauau

SEQ ID NO: 62627 - RNA, 64 nt, hsa
cuaauaugaaauaacagacuaacauuuuaggggaaaaauaaauacaauuuagacucuaaaaagu

SEQ ID NO: 62628 - RNA, 64 nt, hsa
uucccuacaaugggaaaugucacaagaaugugcaaaaauaaaaaucugaggaaaaaacccacau

SEQ ID NO: 62629 - RNA, 64 nt, hsa
uaugugauguuguuaauuucuuuuauugcauuauaaaauaaaaggauuauguauuuuuaacuaa

SEQ ID NO: 62630 - RNA, 63 nt, hsa
aaggauuuggcaugcuguaaaacaaaacaaaacaaaauaaaacaaaaaaaaggaaggaaaaaa

SEQ ID NO: 62631 - RNA, 64 nt, hsa
uaucaggucuccuaacuaccccaguuuguaaggaaaaauaaaaguuuuuauaaaauuaaaaaaa

SEQ ID NO: 62632 - RNA, 64 nt, hsa
aaggaacacauaaguaaguugcuuuggugccaagaaaauaaaaaagcuauuaucaggucuccua

SEQ ID NO: 62633 - RNA, 64 nt, hsa
guuaaaauucuuggaaaauuuucagaauacuuuaaaaauaaaguuccaaguuacacaguuuggc

SEQ ID NO: 62634 - RNA, 64 nt, hsa
aguauuguugaaucaauuacuuugguuucaugaaaaaauaaacgauaaauaucuuuaaagagaa

SEQ ID NO: 62635 - RNA, 64 nt, hsa
ggauuaaaccaauugcagaucaaaaauauuagaaaaaauaaaaauaauacaaauaaaaauacag

SEQ ID NO: 62636 - RNA, 64 nt, hsa
ccauuugccuauaaauaccuguaaacgacuuuaaaaaauaaaugauuauugcuuugugacaauu

SEQ ID NO: 62637 - RNA, 64 nt, hsa
uuuucuguuuagcagcauuuuucacugcaauguuaaaauaaauaugacauugaauucgaacugu

SEQ ID NO: 62638 - RNA, 64 nt, hsa
uuauggguacaacguauguucauuauuuguacauaaaauaaaaccauuuaaaaaguaaugcuga

SEQ ID NO: 62639 - RNA, 64 nt, hsa
aacuaauggcaaaaauucauggcuagugauguauaaaauaaaauauucuuugcaguaaaauauu

SEQ ID NO: 62640 - RNA, 64 nt, hsa
acuuacugauuaauuuuuaacaagguagaauuuuaaaauaaaagauuuauaaauaacuuuuguu

SEQ ID NO: 62641 - RNA, 64 nt, hsa
guucuguugagggcaaaauauuauaaaucuauagaaaauaaacuguuugacuugaaucauuucu

SEQ ID NO: 62642 - RNA, 64 nt, hsa
ucgcuauuuaaguuaaauuuaaaugaaauaaaauaaaauaaaaucaguuccugagucacacaau

SEQ ID NO: 62643 - RNA, 64 nt, hsa
aagugucgcuauuuaaguuaaauuuaaaugaaauaaaauaaaauaaaaucaguuccugagucac

SEQ ID NO: 62644 - RNA, 64 nt, hsa
uauguucacugugcagagggauuguaccuuguacaaaauaaaacaaauuucucaaacuaauuua

SEQ ID NO: 62645 - RNA, 64 nt, hsa
cacaauacuuugggcaauaaucagaaaaagcaaaaaaauaaauaaaugaguacaucuccccuuc

SEQ ID NO: 62646 - RNA, 64 nt, hsa
ugggcaauagcaagacuccaucucaaaauaaaauaaaauaaaacuuagagcaaaguuuaaaacu

SEQ ID NO: 62647 - RNA, 64 nt, hsa
cagcuugggcaauagcaagacuccaucucaaaauaaaauaaaauaaaacuuagagcaaaguuua

SEQ ID NO: 62648 - RNA, 64 nt, hsa
cacuccagcuugggcaauagcaagacuccaucucaaaauaaaauaaaauaaaacuuagagcaaa

SEQ ID NO: 62649 - RNA, 64 nt, hsa
uguuucacaaguuuugggccaccuauuucaauaaaaaauaaaauauaaauuaaaaaaguugccg

SEQ ID NO: 62650 - RNA, 64 nt, hsa
uuuucuuuuuacacuaauaacuuuuaugccuuuuaaaauaaauuuauuuucauaaaugguuugc

SEQ ID NO: 62651 - RNA, 64 nt, hsa
uggucuuucugggccuuacugugcugguauaauuaaaauaaaauauauuuuguucuauugguag

SEQ ID NO: 62652 - RNA, 64 nt, hsa
ccaaauguaauuuuaugucugcuuuaaggaaaauaaaauaaaauauuaauaggaguugugagcc

SEQ ID NO: 62653 - RNA, 64 nt, hsa
uucuuccaaauguaauuuuaugucugcuuuaaggaaaauaaaauaaaauauuaauaggaguugu

SEQ ID NO: 62654 - RNA, 64 nt, hsa
auacuauaacucugaucuuccauugagaauaacaaaaauaaauaucaauuuuacaccucauaug

SEQ ID NO: 62655 - RNA, 64 nt, hsa
ugauuaauuuagauuagaaucauuaacaucaugaaaaauaaaaguacuacauuucuaacguauu

SEQ ID NO: 62656 - RNA, 64 nt, hsa
augauguauaaaaaaguggauucaccuguuuuuaaaaauaaaacauugauaaaagguguuugga

SEQ ID NO: 62657 - RNA, 64 nt, hsa
uauauauuuauauuuuugggggugggagaaauccaaaauaaaguaaaugcuuguuucauuuuua

SEQ ID NO: 62658 - RNA, 64 nt, hsa
cagacaaagcauugacuuuuaaauguagacuuuuaaaauaaacuguuuucuuuuggaacuacaa

SEQ ID NO: 62659 - RNA, 64 nt, hsa
uaugugaaguuagugagucuuuuuguguuacuccaaaauaaaggcaaugauuuauuuuuuuccc

SEQ ID NO: 62660 - RNA, 64 nt, hsa
ucagccuggaccacagagcaagacccuguguaaaaaaauaaaauaaaaaacagauuggaugucu

SEQ ID NO: 62661 - RNA, 64 nt, hsa
cuggaccacagagcaagacccuguguaaaaaaauaaaauaaaaaacagauuggaugucuuucuu

SEQ ID NO: 62662 - RNA, 64 nt, hsa
cgugagccacugugcccagccuaagccauuucuuaaaauaaaaaugcuaaaggacuaguaagua

SEQ ID NO: 62663 - RNA, 64 nt, hsa
ucuuaaaauaaaaaugcuaaaggacuaguaaguaaaaauaaaacuuccuaugggauuucccagu

SEQ ID NO: 62664 - RNA, 64 nt, hsa
aggacuuuuacuuuuuauuacauaaaaauauuaaaaaauaaauaaaaaaaauaaaauuuuaaac

SEQ ID NO: 62665 - RNA, 64 nt, hsa
uuuauuacauaaaaauauuaaaaaauaaauaaaaaaaauaaaauuuuaaacuaacuuaaccugc

SEQ ID NO: 62666 - RNA, 64 nt, hsa
agccuggaugacaagcaagacccucccuccaaagaaaauaaagcucaaaauaaaauaugauuug

SEQ ID NO: 62667 - RNA, 64 nt, hsa
aagcaagacccucccuccaaagaaaauaaagcucaaaauaaaauaugauuuguguucauguaga

SEQ ID NO: 62668 - RNA, 64 nt, hsa
ccugggcaacacagcgagacuccgucucaaggaaaaaauaaaaauaaaaagcgggcacgggccc

SEQ ID NO: 62669 - RNA, 64 nt, hsa
caacacagcgagacuccgucucaaggaaaaaauaaaaauaaaaagcgggcacgggcccgugaca

SEQ ID NO: 62670 - RNA, 64 nt, hsa
aaacaagcaacaccuuaaaagaguuuuauuucugaaaauaaauuaauuuuuuguaaauaaaaug

SEQ ID NO: 62671 - RNA, 64 nt, hsa
aaaauaaauuaauuuuuuguaaauaaaauguuuaaaaauaaaaaagaaacuaaaguuacuugua

SEQ ID NO: 62672 - RNA, 64 nt, hsa
caaagaaaacaaaauauaagggaaaaauaugagaaaaauaaaaauaaaaagagaauaauaggcc

SEQ ID NO: 62673 - RNA, 64 nt, hsa
aaacaaaauauaagggaaaaauaugagaaaaauaaaaauaaaaagagaauaauaggccaggcac

SEQ ID NO: 62674 - RNA, 64 nt, hsa
auguccguucaucccugagaggucugaaagaauaaaaauaaauucuaaaaaaagccucugucug

SEQ ID NO: 62675 - RNA, 64 nt, hsa
acucuauaacugcagaaauuagauaauguuuuauaaaauaaauuugccacauaauaugggaugc

SEQ ID NO: 62676 - RNA, 64 nt, hsa
acucuuuuguaaauuacaguuauuucaguauuguaaaauaaauguugacucauuucaugcaggu

SEQ ID NO: 62677 - RNA, 64 nt, hsa
cagcacucuggugcgggaagaagcagaagcaaaaaaaauaaaaauaaaaaaauaaauaaaaaua

SEQ ID NO: 62678 - RNA, 64 nt, hsa
ucuggugcgggaagaagcagaagcaaaaaaaauaaaaauaaaaaaauaaauaaaaauaaaaaaa

SEQ ID NO: 62679 - RNA, 64 nt, hsa
gggaagaagcagaagcaaaaaaaauaaaaauaaaaaaauaaauaaaaauaaaaaaaauaaaaaa

SEQ ID NO: 62680 - RNA, 64 nt, hsa
agaagcaaaaaaaauaaaaauaaaaaaauaaauaaaaauaaaaaaaauaaaaaaggaaaaaaaa

SEQ ID NO: 62681 - RNA, 64 nt, hsa
aaaaauaaaaauaaaaaaauaaauaaaaauaaaaaaaauaaaaaaggaaaaaaaaaaaagaaga

SEQ ID NO: 62682 - RNA, 64 nt, hsa
cuguguacaaagagaugugaaauacuuucaggcaaaaauaaacuguaagugacucaucaauguc

SEQ ID NO: 62683 - RNA, 64 nt, hsa
uugugugaauugacuaccguuguuugcaaacccgaaaauaaaagacguucauuauguaugaaaa

SEQ ID NO: 62684 - RNA, 64 nt, hsa
gaacauauagaaugcagagauuuuuuuuuccauuaaaauaaauggguauuggugguuaaaacug

SEQ ID NO: 62685 - RNA, 64 nt, hsa
gaguuucaggaaugaaguagaagguaguuauuuaaaaauaaaaaacacaguccgucccuaccaa

SEQ ID NO: 62686 - RNA, 64 nt, hsa
ugaaacuuccagugugaguugaccccaucauuuaaaaauaaaguccccggguuccuuaaugccu

SEQ ID NO: 62687 - RNA, 64 nt, hsa
uccagccugggcaacagagcuagacucugugucaaaaauaaaugacuagauaaaaaaaaaaauu

SEQ ID NO: 62688 - RNA, 64 nt, hsa
ucaguacugacuguguaagcuaaauugcugauccaaaauaaaaacccagacuagaauaggguuc

SEQ ID NO: 62689 - RNA, 64 nt, hsa
gcaacauagugagauucuguuaaaaaaauaaaauaaaauaaaaccaauuuuuaaaaagagaaua

SEQ ID NO: 62690 - RNA, 64 nt, hsa
ccugggcaacauagugagauucuguuaaaaaaauaaaauaaaauaaaaccaauuuuuaaaaaga

SEQ ID NO: 62691 - RNA, 64 nt, hsa
accaaccugggcaacauagugagauucuguuaaaaaaauaaaauaaaauaaaaccaauuuuuaa

SEQ ID NO: 62692 - RNA, 64 nt, hsa
gccuaggcaacauagugagacccugucucuacuaaaaauaaauuuaaaaaaaauuagcugagug

SEQ ID NO: 62693 - RNA, 64 nt, hsa
gauuuccauccuguauuugcauaauacuugucuuaaaauaaaagcuuuuaugauugggaauuua

SEQ ID NO: 62694 - RNA, 64 nt, hsa
uguaaaagggaaauuugaacaacaaaaaccaaaaaaaauaaaaauaaaaaacuucaaaaguuga

SEQ ID NO: 62695 - RNA, 64 nt, hsa
agggaaauuugaacaacaaaaaccaaaaaaaauaaaaauaaaaaacuucaaaaguugacaagaa

SEQ ID NO: 62696 - RNA, 64 nt, hsa
aaaguugcuugagccaagugcuuaaaaaguuaauaaaauaaaaugaucuguaugauaccugcaa

SEQ ID NO: 62697 - RNA, 64 nt, hsa
uaaaacuuuguguuuuggcaaucguuuuauaacuaaaauaaaaugaaagcuaaaucuacacgcu

SEQ ID NO: 62698 - RNA, 64 nt, hsa
caaaccacuggaaaacaugcauuuuggaaacuuuaaaauaaaugguuaacauggcauuucuaag

SEQ ID NO: 62699 - RNA, 64 nt, hsa
uauaguaaggucaagaagaguaucaaaguauaauaaaauaaaaauuguauacucuccauauauu

SEQ ID NO: 62700 - RNA, 64 nt, hsa
ggaaaucuugauugcuuccaguuuucagugauuaaaaauaaagccgcuauaaacauuugugugc

SEQ ID NO: 62701 - RNA, 64 nt, hsa
uucuagugccuugguuuucuuucuugaugcuggaaaaauaaacaaaccgguauugaguguuuag

SEQ ID NO: 62702 - RNA, 64 nt, hsa
acguagggaggcccugagaacuaaauuuugccccaaaauaaaaacagaaauuaugagauugccu

SEQ ID NO: 62703 - RNA, 64 nt, hsa
uucuauugaaaaaggaaaaucagcaauucagcaaaaaauaaauaaaaaauaaaaauguaaauau

SEQ ID NO: 62704 - RNA, 64 nt, hsa
aaggaaaaucagcaauucagcaaaaaauaaauaaaaaauaaaaauguaaauaugauaguaauaa

SEQ ID NO: 62705 - RNA, 64 nt, hsa
gggagagagagagagaugcuguugagcacaugacaaaauaaaauaaaauggaugauucauucuu

SEQ ID NO: 62706 - RNA, 64 nt, hsa
agagagagagaugcuguugagcacaugacaaaauaaaauaaaauggaugauucauucuuaagug

SEQ ID NO: 62707 - RNA, 64 nt, hsa
auaaugagacaacuuguuaaucucuuuaauacuaaaaauaaauuacucuucuauuucagggacu

SEQ ID NO: 62708 - RNA, 64 nt, hsa
aauuacucuucuauuucagggacuuagguaauuuaaaauaaaccuucaauuuauggucuucugu

SEQ ID NO: 62709 - RNA, 64 nt, hsa
uguuaacucauuucucaugccauuagcucucuacaaaauaaagcaaaguaguucuagugugguc

SEQ ID NO: 62710 - RNA, 64 nt, hsa
uuugccugcuaaacaaguuagaauaggaaauaguaaaauaaauccaaacaagaguguaauauug

SEQ ID NO: 62711 - RNA, 64 nt, hsa
caaugucauuacauagaacacuucagacacaggaaaaauaaacguggauuuuaaaaaaucaauc

SEQ ID NO: 62712 - RNA, 64 nt, hsa
aaucuacauaaaugauuuacagguuaaaagaauaaaaauaaagguaacuuuaccuuucuuaaau

SEQ ID NO: 62713 - RNA, 64 nt, hsa
auagugagagacccuguaucugaaaguaauaauaaaaauaaaaaauauaaaugaggucucguug

SEQ ID NO: 62714 - RNA, 64 nt, hsa
cagccugggcaacaaagcaagacucugucucaaaaaaauaaaaauaaaaaaaaaaucuuaguuc

SEQ ID NO: 62715 - RNA, 64 nt, hsa
gggcaacaaagcaagacucugucucaaaaaaauaaaaauaaaaaaaaaaucuuaguuccaugga

SEQ ID NO: 62716 - RNA, 64 nt, hsa
uguauuaaaauucaacuauggauguauaugaaacaaaauaaauggagauaauuuuucucccaca

SEQ ID NO: 62717 - RNA, 64 nt, hsa
uucuuuuguacguaauaggacauuucauccuagaaaaauaaaguaauguuuuugacauuggauu

SEQ ID NO: 62718 - RNA, 64 nt, hsa
uuaagaauuaaaaaaauacaaaaaagaaaaaaugaaaauaaaggaauaagaaguuaccuacucc

SEQ ID NO: 62719 - RNA, 64 nt, hsa
gccaacagaguaaaguggaaggaaguuuauucagaaaauaaaggaguaucacagcucuuuuaga

SEQ ID NO: 62720 - RNA, 64 nt, hsa
cuuucaaauacaccuuuuugaucauuaaaauaaaaaaauaaaucuugcucuguuguauaagauc

SEQ ID NO: 62721 - RNA, 64 nt, hsa
ucauagugcuuucaaauacaccuuuuugaucauuaaaauaaaaaaauaaaucuugcucuguugu

SEQ ID NO: 62722 - RNA, 64 nt, hsa
uuuuguagaaauguaaagauuacuugagguguuuaaaauaaauuuuucauucagacuaccuuug

SEQ ID NO: 62723 - RNA, 64 nt, hsa
agcucuuacgaaaaacccagguuagaccgcauaaaaaauaaagugaacagugaggugguagcaa

SEQ ID NO: 62724 - RNA, 64 nt, hsa
aacuuccagaauagugauuuuaaaaguaaaaauaaaaauaaaccuuacuuacaagcauaacaga

SEQ ID NO: 62725 - RNA, 64 nt, hsa
uucuuuaacuuccagaauagugauuuuaaaaguaaaaauaaaaauaaaccuuacuuacaagcau

SEQ ID NO: 62726 - RNA, 64 nt, hsa
uuaagaaacucuaaagguuauaaaaugaaaacaaaaaauaaaauauuuguuuucugcuagaugc

SEQ ID NO: 62727 - RNA, 62 nt, hsa
uguaucuaaaggauggaaaaauaaaacgcaauuaaaaauaaacagaugcccuauuuucugug

SEQ ID NO: 62728 - RNA, 64 nt, hsa
cccuuuuacauucuguguguaucuaaaggauggaaaaauaaaacgcaauuaaaaauaaacagau

SEQ ID NO: 62729 - RNA, 64 nt, hsa
aguucuaggggguugaacuacauaguaaaaaaauaaaauaaauaguacuuaguguaaaauaauu

SEQ ID NO: 62730 - RNA, 64 nt, hsa
aaaacaguucuaggggguugaacuacauaguaaaaaaauaaaauaaauaguacuuaguguaaaa

SEQ ID NO: 62731 - RNA, 64 nt, hsa
agaauuaaaaccaaucauaaguagaacccacuucaaaauaaaaaaacagcauuacuauuucuaa

SEQ ID NO: 62732 - RNA, 64 nt, hsa
guaaucuucauuuuaguauuuaugcuuagaugugaaaauaaauguuauuuguugaucauuucua

SEQ ID NO: 62733 - RNA, 64 nt, hsa
uuuguccagccuauugcaggcuuuuccugacuuuaaaauaaauugugaucaauaauaguaccuu

SEQ ID NO: 62734 - RNA, 64 nt, hsa
uucaucucacaguaaagccuauuuccccaggaaaaaaauaaaugccuuugaaugaaaauucuga

SEQ ID NO: 62735 - RNA, 64 nt, hsa
uuaauguuuuaagcuuaauagccuuugcacuuuuaaaauaaaaaccaaguaugcaaaucaaaga

SEQ ID NO: 62736 - RNA, 64 nt, hsa
ucaucuaggagcaaggugagaaaucacaaugagaaaaauaaauggaaacaccacugcuagggga

SEQ ID NO: 62737 - RNA, 64 nt, hsa
aucaagcacuccuaccuuaauuauugcacuagagaaaauaaauuccaaauuaggaaguguuucc

SEQ ID NO: 62738 - RNA, 64 nt, hsa
auucugguauuuugacauguuauaauacgcaaguaaaauaaaacaauaguuuacucagcucaug

SEQ ID NO: 62739 - RNA, 64 nt, hsa
agcaaaacauaaauuaaaacucaaaugccaggacaaaauaaaacaauauaccagauggagagga

SEQ ID NO: 62740 - RNA, 64 nt, hsa
ccugugaccuaguuggugcaguggcuugaaugccaaaauaaagcgugugcacuggauagugugu

SEQ ID NO: 62741 - RNA, 64 nt, hsa
agaaccuccauauacauuaauuuuuuucugccuaaaaauaaaauugcguuguggcagcaauuug

SEQ ID NO: 62742 - RNA, 64 nt, hsa
aacauuuacguuguuaccaagauuuuugcuauugaaaauaaaguuuuuaugaauauuuauauau

SEQ ID NO: 62743 - RNA, 64 nt, hsa
aaaaaguggaaugggauauggcuuuugguaccugaaaauaaaugcuuuaauaauuguaagccag

SEQ ID NO: 62744 - RNA, 64 nt, hsa
acagaaauucucaaucacugaaaugaguaacugcaaaauaaauaguugauuguacuguucucau

SEQ ID NO: 62745 - RNA, 64 nt, hsa
uuuaagagcucaauuugaaaaaucuguuacuaaaaaaauaaauuguaugucgauugaauuguac

SEQ ID NO: 62746 - RNA, 64 nt, hsa
guuccucugaaccccaaacuguaaauggcugucuaaaauaaagacauucauguuuguuaaaaac

SEQ ID NO: 62747 - RNA, 64 nt, hsa
gccuauggcacaaauuguaaaccuuuguuuuucuaaaauaaaguaauugaaaaccugcaauugu

SEQ ID NO: 62748 - RNA, 64 nt, hsa
aauggggaaaaaaagucuugugauugacuuucgcaaaauaaacaggauuuacugaguagagguu

SEQ ID NO: 62749 - RNA, 64 nt, hsa
gcuauguaaaaauaaaauucaaacgcccaggauuaaaauaaaauauaaucugaaaaccucaugu

SEQ ID NO: 62750 - RNA, 64 nt, hsa
uguuuugagggaauauacuaaaugcagcuauguaaaaauaaaauucaaacgcccaggauuaaaa

SEQ ID NO: 62751 - RNA, 64 nt, hsa
agccugggcgacagagcaagacucugucucaaaaaaaauaaaaaauaaucagggcacaguggcu

SEQ ID NO: 62752 - RNA, 64 nt, hsa
uccagccugggcaacaagagcaaaacuccgucucaaaauaaaaagaaaagaaaagaauggacag

SEQ ID NO: 62753 - RNA, 64 nt, hsa
ucugggcaauauagugaggcucccaucuguacuaaaaauaaaaaaguuaggcguggcgaugugc

SEQ ID NO: 62754 - RNA, 64 nt, hsa
cgggcuucugcauccauucccucuuuuuguuuuuaaaauaaauuguauuuuugaaucaaggagg

SEQ ID NO: 62755 - RNA, 64 nt, hsa
ccagccugggggacagagcacgacccugucuccaaaaauaaaauaaaaauaaaaauaaauauug

SEQ ID NO: 62756 - RNA, 64 nt, hsa
cugggggacagagcacgacccugucuccaaaaauaaaauaaaaauaaaaauaaauauuggcggg

SEQ ID NO: 62757 - RNA, 64 nt, hsa
gacagagcacgacccugucuccaaaaauaaaauaaaaauaaaaauaaauauuggcgggggaacc

SEQ ID NO: 62758 - RNA, 64 nt, hsa
gcacgacccugucuccaaaaauaaaauaaaaauaaaaauaaauauuggcgggggaacccucugg

SEQ ID NO: 62759 - RNA, 64 nt, hsa
cagccugggcaauauagcaagaccccucacuacaaaaauaaaacaucaaaaacaaaaacaauua

SEQ ID NO: 62760 - RNA, 64 nt, hsa
uccaggcuggguaacagaaugagaccuuaucucaaaaauaaacaaacuaauaaaaagcaaaaaa

SEQ ID NO: 62761 - RNA, 64 nt, hsa
ucccugaaugacugcauggauagaaccacuaagaaaaauaaacuuuuauauuuuuauagcuacu

SEQ ID NO: 62762 - RNA, 64 nt, hsa
gccuggucgacagagugagacuccaucucaagaaaaaauaaaaauaaaguuguucucugaagag

SEQ ID NO: 62763 - RNA, 64 nt, hsa
ucgacagagugagacuccaucucaagaaaaaauaaaaauaaaguuguucucugaagagcaaaug

SEQ ID NO: 62764 - RNA, 64 nt, hsa
gcuuaguccaucagcaucuuauucuggguaauaaaaaauaaaaauaaacggauaccuguuuucc

SEQ ID NO: 62765 - RNA, 64 nt, hsa
uccaucagcaucuuauucuggguaauaaaaaauaaaaauaaacggauaccuguuuuccacugcu

SEQ ID NO: 62766 - RNA, 64 nt, hsa
guuuauacgaaaauauauuuucaaagguguaguaaaaauaaaaaaaauuuuaauccaaauuugu

SEQ ID NO: 62767 - RNA, 64 nt, hsa
cgaauauucuacuaaaugagaguucugaguauagaaaauaaaacuaaaguugguagaaaaauua

SEQ ID NO: 62768 - RNA, 64 nt, hsa
aaauaacauuuaggaagcaaauagauuaaacacaaaaauaaaacuaaagcauaggaauuauguu

SEQ ID NO: 62769 - RNA, 64 nt, hsa
uuuuaaauauaauuuuauuucuuucaacaaauauaaaauaaaaaacaacuuuggaacaaugacu

SEQ ID NO: 62770 - RNA, 64 nt, hsa
aauugcugggaauauuugacucuccguauuggagaaaauaaaauuacaacauuacgacauacua

SEQ ID NO: 62771 - RNA, 64 nt, hsa
uaguuuuuauaccuuaaaaagacugguagcauauaaaauaaaucuuaaaagcuaauuauacaca

SEQ ID NO: 62772 - RNA, 64 nt, hsa
gccugggcgacagagugagacucccucucaaaagaaaauaaaaauaaaaauaaacuggccaggu

SEQ ID NO: 62773 - RNA, 64 nt, hsa
gcgacagagugagacucccucucaaaagaaaauaaaaauaaaaauaaacuggccaggugcggug

SEQ ID NO: 62774 - RNA, 64 nt, hsa
gagugagacucccucucaaaagaaaauaaaaauaaaaauaaacuggccaggugcgguggcucac

SEQ ID NO: 62775 - RNA, 64 nt, hsa
accugggcaagagagagagacuuugucucuauuaaaaauaaaaaugauuggccgagcauggugg

SEQ ID NO: 62776 - RNA, 64 nt, hsa
cacaggcugcaccauaagacccacucacaauaaaaaaauaaaaggccgagccgggcaugguugc

SEQ ID NO: 62777 - RNA, 64 nt, hsa
cgagccgggcaugguugcucacucccguaauaaaaaaauaaaagaacaggcugagccgggcaug

SEQ ID NO: 62778 - RNA, 64 nt, hsa
auucugcaaagauaaauaauaucccugcauuaucaaaauaaaguagcagaccucucaauucaca

SEQ ID NO: 62779 - RNA, 64 nt, hsa
cauuaaugauacaugaaucuuggccacaaugagaaaaauaaaaaugaaaaaagagcaggcaucc

SEQ ID NO: 62780 - RNA, 64 nt, hsa
caacaagagcgaaacucugucucaaaauaaauaaaaaauaaaagacagaaagcaaggggugccu

SEQ ID NO: 62781 - RNA, 64 nt, hsa
uccagccugggcaacaagagcgaaacucugucucaaaauaaauaaaaaauaaaagacagaaagc

SEQ ID NO: 62782 - RNA, 64 nt, hsa
ggugacagaaugagacucugugucaaaaaaauaaaaaauaaaaaaucuaagggcucaggaacca

SEQ ID NO: 62783 - RNA, 64 nt, hsa
cagccugggugacagaaugagacucugugucaaaaaaauaaaaaauaaaaaaucuaagggcuca

SEQ ID NO: 62784 - RNA, 64 nt, hsa
uuuaaagguauuuauuagaaaucaaagaacacucaaaauaaacucagugcucaaaggguuaagu

SEQ ID NO: 62785 - RNA, 64 nt, hsa
uugaagcacuuuugcauuaauuugguuaaaaaauaaaauaaaauaauaauaauguaugaagcuc

SEQ ID NO: 62786 - RNA, 64 nt, hsa
guacuuugaagcacuuuugcauuaauuugguuaaaaaauaaaauaaaauaauaauaauguauga

SEQ ID NO: 62787 - RNA, 64 nt, hsa
gaauaaguauuuccgucaagaaaaaggaaacaacaaaauaaaaccaacccaaguaaagaacagc

SEQ ID NO: 62788 - RNA, 64 nt, hsa
aauuugguuagggauuaugucagugugauuauaaaaaauaaaagaucguaugauaugagauaca

SEQ ID NO: 62789 - RNA, 64 nt, hsa
caaagcauuauggcugucacaagcuugugaaaggaaaauaaaaauuacuaagccaaagagaaaa

SEQ ID NO: 62790 - RNA, 64 nt, hsa
gaugcuuuaugaaaagguuauggggacgauucccaaaauaaaucaccaguuuguaaauggaaaa

SEQ ID NO: 62791 - RNA, 64 nt, hsa
agagcaaaauuucaucucaaaaauaagauaaaauaaaauaaacaaauaagacagcacuuuauac

SEQ ID NO: 62792 - RNA, 64 nt, hsa
caacaagagcaaaauuucaucucaaaaauaagauaaaauaaaauaaacaaauaagacagcacuu

SEQ ID NO: 62793 - RNA, 64 nt, hsa
cuagauccagaguucagaagaccuugagacaaugaaaauaaacuugguaauaaucuuuuuucaa

SEQ ID NO: 62794 - RNA, 64 nt, hsa
auauagcaagacucugccucuauuauaaaaaaacaaaauaaaugaaaaggacuguaggaggcag

SEQ ID NO: 62795 - RNA, 64 nt, hsa
acucgcuucccccauagccaccccagaaauggugaaaauaaaauaaagcagguuuuucuccucu

SEQ ID NO: 62796 - RNA, 64 nt, hsa
cuucccccauagccaccccagaaauggugaaaauaaaauaaagcagguuuuucuccucuaccuu

SEQ ID NO: 62797 - RNA, 64 nt, hsa
aaaggucuuuuuaaaccaguuuagauuucaagaaaaaauaaauggaaaucaucgaaaauucauu

SEQ ID NO: 62798 - RNA, 64 nt, hsa
aaucaucgaaaauucauuucacauuaauggucuaaaaauaaaccaaaggacauuaugugugcau

SEQ ID NO: 62799 - RNA, 64 nt, hsa
uaauuaugcaugugauuuuaacauuuaauauucaaaaauaaaucucuugcuggauuugagagua

SEQ ID NO: 62800 - RNA, 64 nt, hsa
ugcuuguagaaacaauuuugaaagccccuugaggaaaauaaaaaucaagaagaacacuuuucuc

SEQ ID NO: 62801 - RNA, 64 nt, hsa
acuccagccugggagggugagacuccaucuaaaaaaaauaaaauaaauggcaaccccuggucua

SEQ ID NO: 62802 - RNA, 64 nt, hsa
agccugggagggugagacuccaucuaaaaaaaauaaaauaaauggcaaccccuggucuaagaua

SEQ ID NO: 62803 - RNA, 64 nt, hsa
cuuugccuauaugguagagcaauaaugcuuuuuaaaaauaaacuucugaaaacccaaggccagg

SEQ ID NO: 62804 - RNA, 64 nt, hsa
ucuugacuuuaaaaaaauuauuaaaaacaaaaaaaaaauaaauuuuuuugcaauccuuuccuca

SEQ ID NO: 62805 - RNA, 64 nt, hsa
augauauaaaggagauacauguuucuuccuuuaaaaaauaaacggaaguuacauuguuaauguu

SEQ ID NO: 62806 - RNA, 64 nt, hsa
ucagggagccuaaugagguuuuuaauaucaucuaaaaauaaagcauugaagugaaguuggugaa

SEQ ID NO: 62807 - RNA, 64 nt, hsa
auucccacugcugggccucuaucuccaugacaacaaaauaaaaacagagguugcuugacucauu

SEQ ID NO: 62808 - RNA, 64 nt, hsa
aaaaggccacaaaaguucccucucacuuucaguaaaaauaaauaaaacagcagcagcaaacaaa

SEQ ID NO: 62809 - RNA, 64 nt, hsa
auaaauauuguguugugcagcauuaaaaaaaaucaaaauaaaaauuaaaugugagcaaagaaug

SEQ ID NO: 62810 - RNA, 64 nt, hsa
agccuaggcaacaagagugaaauuccgucucaaaaaaauaaauaaauaaauaaauaaauaaguu

SEQ ID NO: 62811 - RNA, 64 nt, hsa
gguuucuaaaacccuuaacacugguaagggcucaaaaauaaacguauguguucauauucgauca

SEQ ID NO: 62812 - RNA, 64 nt, hsa
cagagcuccaugcacacagugucuucagaaggugaaaauaaauauuucccugugcuccuuuuac

SEQ ID NO: 62813 - RNA, 64 nt, hsa
uuuuugugaugaucaauggacuuuaaugaaaaaaaaaauaaaaacaaccaaaaaaauugaagga

SEQ ID NO: 62814 - RNA, 64 nt, hsa
aguccuaaacgucccauguauuuuucuaggcauaaaaauaaaaguuggcuaaaaauuuuaaaaa

SEQ ID NO: 62815 - RNA, 64 nt, hsa
aaaguaguucuuuaaauaagagauaauuuaaagaaaaauaaauacuagacaucaaauuuagauc

SEQ ID NO: 62816 - RNA, 64 nt, hsa
gaagucuguuaaagccauugucagcaaagcuuugaaaauaaaggacuucacaaaaacgguaaug

SEQ ID NO: 62817 - RNA, 64 nt, hsa
caggcaaaauccuugcuuaugacaucacuuguacaaaauaaacaaauaacaaugugcucucggg

SEQ ID NO: 62818 - RNA, 64 nt, hsa
auugacugucacuguuccuugucacugguagaccaaaauaaaaccagcucuacuggucuugugg

SEQ ID NO: 62819 - RNA, 64 nt, hsa
agaaccccuacaugaaacagaaacaaaaacacuaaaaauaaaaauggccauuugcuuuuucacc

SEQ ID NO: 62820 - RNA, 64 nt, hsa
caauccccucaaaaaaauaaaaauaaaaaaaauaaaaauaaaaaaacauuuuuuucaagcaggg

SEQ ID NO: 62821 - RNA, 64 nt, hsa
acugugcaauccccucaaaaaaauaaaaauaaaaaaaauaaaaauaaaaaaacauuuuuuucaa

SEQ ID NO: 62822 - RNA, 64 nt, hsa
uggaaauaaacugugcaauccccucaaaaaaauaaaaauaaaaaaaauaaaaauaaaaaaacau

SEQ ID NO: 62823 - RNA, 64 nt, hsa
aguguuuggaaauaaacugugcaauccccucaaaaaaauaaaaauaaaaaaaauaaaaauaaaa

SEQ ID NO: 62824 - RNA, 64 nt, hsa
cugucauuuguaugcaauuuccuguuaccuugaaaaaauaaaaauguuaacaggaaugcagugu

SEQ ID NO: 62825 - RNA, 64 nt, hsa
gagaauucaucuugaguuaucuuuuauuuagauaaaaauaaagaggcaaggaucuacugucauu

SEQ ID NO: 62826 - RNA, 64 nt, hsa
aucacucacugccaaaaauagaaagugaccaugaaaaauaaauucgcuggggaagggggcucca

SEQ ID NO: 62827 - RNA, 64 nt, hsa
gcaagacucugucucaauaaauaaauaauuaauuaaaauaaaaaacagcuuaaagagaaaaaug

SEQ ID NO: 62828 - RNA, 64 nt, hsa
agacuccgucucaaaaaaauaaauacauaaauaaaaaauaaaccaaccauaauccccagugcag

SEQ ID NO: 62829 - RNA, 64 nt, hsa
caggcugggcgacagagcgagacuccgucucaaaaaaauaaauacauaaauaaaaaauaaacca

SEQ ID NO: 62830 - RNA, 64 nt, hsa
aguuuccuauuuuugguuuauuuauuuuagaagaaaaauaaaauuauuugggcauuuuuguuua

SEQ ID NO: 62831 - RNA, 64 nt, hsa
uugccuagcauuuuauagauauuuauuauuuaaaaaaauaaagauauguuuuuaaugaagagag

SEQ ID NO: 62832 - RNA, 64 nt, hsa
uucccuguauuugauaaaacacauaauuuugagaaaaauaaaguuuuaaauguaucuaugucuc

SEQ ID NO: 62833 - RNA, 64 nt, hsa
guuuguuauaccaauaaaugcuuuagcugcaacuaaaauaaaaaaguuaaagguaagaaaauga

SEQ ID NO: 62834 - RNA, 64 nt, hsa
ccuaccaaaaauagccaguaguaucugaaaaugaaaaauaaaugaaguaucucuaggaaacagu

SEQ ID NO: 62835 - RNA, 64 nt, hsa
gauuuaaaaaacugaaaagguauaccucaacccaaaaauaaagguuuguuuugguuuguuaugg

SEQ ID NO: 62836 - RNA, 64 nt, hsa
uuuuuucuucuauuaaaauauaacauugugaaagaaaauaaaauuuaugcuauucuuugcuuug

SEQ ID NO: 62837 - RNA, 64 nt, hsa
auagaaauccaauuaagacucacuuggguaaaaaaaaauaaaaaaauaaacaaaauaaacugcu

SEQ ID NO: 62838 - RNA, 64 nt, hsa
ccaauuaagacucacuuggguaaaaaaaaauaaaaaaauaaacaaaauaaacugcucacuuauu

SEQ ID NO: 62839 - RNA, 64 nt, hsa
acucacuuggguaaaaaaaaauaaaaaaauaaacaaaauaaacugcucacuuauuugaaaaauu

SEQ ID NO: 62840 - RNA, 64 nt, hsa
uuuacuuucuaucagcugagcaaccucucaagaaaaaauaaauaaauaaauaaaccucucuuua

SEQ ID NO: 62841 - RNA, 64 nt, hsa
ccagccaacauugugagacauaaucucuacaaauaaaauaaauuaguuggacaugauggugugc

SEQ ID NO: 62842 - RNA, 64 nt, hsa
cagccugagugacagagugagacuuugcaaccaaaaaauaaaauaauaauaauaaugaaauaaa

SEQ ID NO: 62843 - RNA, 64 nt, hsa
gucugaaagugaacucucauaauucaaauuguauaaaauaaagcuacauuucuaagagcuuggu

SEQ ID NO: 62844 - RNA, 64 nt, hsa
acugcauaggauuauccccugacauuccaagagcaaaauaaagcucuugagaguaauuguuguc

SEQ ID NO: 62845 - RNA, 64 nt, hsa
caggggucuagugcccugcauuccuuugaggcaaaaaauaaaugggcuaugacugguuaaaugu

SEQ ID NO: 62846 - RNA, 64 nt, hsa
aauaucuguggaacauguaaauacugucaaauggaaaauaaaauaaguuauaauuuuugugaau

SEQ ID NO: 62847 - RNA, 64 nt, hsa
ugauguaaauguuuuacuuucaacuguguucuuuaaaauaaauccuaccugguuuuuaaauuuu

SEQ ID NO: 62848 - RNA, 64 nt, hsa
uucuuggaaaaaauuuuaagaaucaaaaauaaagaaaauaaaaaaugcauacaguuaaacauuc

SEQ ID NO: 62849 - RNA, 64 nt, hsa
uauuucuauuucuuggaaaaaauuuuaagaaucaaaaauaaagaaaauaaaaaaugcauacagu

SEQ ID NO: 62850 - RNA, 64 nt, hsa
guauuuaugcccuuauaucccaaaaaugucuuagaaaauaaaaauucugggccuuacuuguuuu

SEQ ID NO: 62851 - RNA, 64 nt, hsa
uuaaucaauggauauccuucaguagugaaugcagaaaauaaaaauacacagguaauuuaguauc

SEQ ID NO: 62852 - RNA, 64 nt, hsa
uacaguauuuuuauucauauuuaaacauuuuuacaaaauaaauaaaguguuuuacauaguaagg

SEQ ID NO: 62853 - RNA, 64 nt, hsa
cuuuaaaccaaugccuauaaaaagcaagucuaccaaaauaaacuaagacuuucuaugugguuug

SEQ ID NO: 62854 - RNA, 64 nt, hsa
cuuccuauucuuucuuaaauuugauggagaagggaaaauaaauugcaguuauugauucuugcca

SEQ ID NO: 62855 - RNA, 64 nt, hsa
ucucaacuuuaauaaguuauccugacacuugauaaaaauaaauauuugguauuuuguggucaug

SEQ ID NO: 62856 - RNA, 64 nt, hsa
ccuggaccacagagcaggccccugucucaaaaauaaaauaaaaaagugaaagaagcaagcugug

SEQ ID NO: 62857 - RNA, 64 nt, hsa
uauagccuggaccacagagcaggccccugucucaaaaauaaaauaaaaaagugaaagaagcaag

SEQ ID NO: 62858 - RNA, 64 nt, hsa
gccugggucacauagcaagaccccgucucuacaaaaaauaaauuuaaaaaacuagccaggugug

SEQ ID NO: 62859 - RNA, 64 nt, hsa
aauggugggguuuucugcuuuguuuuuauuuaagaaaauaaacacgacauauuuaaagaagguu

SEQ ID NO: 62860 - RNA, 64 nt, hsa
gauuggaugaaagucaaagguugucuacuuuaagaaaauaaaauacccugaauggagcccagca

SEQ ID NO: 62861 - RNA, 64 nt, hsa
auuccccuuuaauuguggauaguuuaaaguuuaaaaaauaaaguucuugcugggcacaguggcu

SEQ ID NO: 62862 - RNA, 64 nt, hsa
ccagcuugggcaacagagugagacuuaaucuugaaaaauaaauaaaugaaaaauaaaauucuug

SEQ ID NO: 62863 - RNA, 64 nt, hsa
cagccugggugacagagugagacccuauuucaaaaaaauaaaaauuggaagaagagcuuaaaaa

SEQ ID NO: 62864 - RNA, 64 nt, hsa
ggaauacaauguccuuccauagcaugggaagaagaaaauaaacaucuccuuuccaacagcugug

SEQ ID NO: 62865 - RNA, 64 nt, hsa
aagguggccuuucucccaagcugguggauaaugaaaaauaaagcaucccaucucucggcguucc

SEQ ID NO: 62866 - RNA, 64 nt, hsa
uggcaucaucuuuuugcucuagcccuuccucuccaaaauaaaaucaaauaaaggaaaaucucca

SEQ ID NO: 62867 - RNA, 64 nt, hsa
uguagauguuuuaauaacaauuuuuguccuucuuaaaauaaaaugaaagaaacuugcuucccuu

SEQ ID NO: 62868 - RNA, 64 nt, hsa
gaaagaaacuugcuucccuuagccuuuguucuagaaaauaaacuugugcacuuugaccucuguc

SEQ ID NO: 62869 - RNA, 64 nt, hsa
aauaguuagauauucuagauuuacauuaaauuguaaaauaaauggacuuauugaagcauaucuu

SEQ ID NO: 62870 - RNA, 64 nt, hsa
gaggcugugucacuggcauguccuuaaccuuggcaaaauaaacuuucuaaauugaaaccugucu

SEQ ID NO: 62871 - RNA, 64 nt, hsa
ucucuuuuuaaaaauaaaaccagacucuguucugaaaauaaaaaacuugagacuugugacaagc

SEQ ID NO: 62872 - RNA, 64 nt, hsa
acuagcauuuaucacuuuuuuccuucucuuuuuaaaaauaaaaccagacucuguucugaaaaua

SEQ ID NO: 62873 - RNA, 64 nt, hsa
caccuugauuuugagcuggaauguuucaaugagcaaaauaaauuagacaaaaguuuacuuucuu

SEQ ID NO: 62874 - RNA, 64 nt, hsa
auuuuuaaaaagacuguuuuuaaaaaggugcuacaaaauaaagugcuaucuuuuucuguuucuc

SEQ ID NO: 62875 - RNA, 64 nt, hsa
ugcagcacguggaggggaacacauacaugucuugaaaauaaacugcuagaauaaagaaaugcug

SEQ ID NO: 62876 - RNA, 64 nt, hsa
aauacuagaguaucuagaagggugaaaacaaaaaaaaauaaaaagaaacacagacgcccaggug

SEQ ID NO: 62877 - RNA, 64 nt, hsa
aucuacugcacaccaacuguuuauagaauacacaaaaauaaaauguaauaacuguauucuguga

SEQ ID NO: 62878 - RNA, 64 nt, hsa
guuuagaaauuagcuccagguucuuaaacuaacaaaaauaaaaccuaagcaugccacagagcua

SEQ ID NO: 62879 - RNA, 64 nt, hsa
gugggagaggaaaugucagggcaugugcucugauaaaauaaaggcagggaaacaagcugaauua

SEQ ID NO: 62880 - RNA, 64 nt, hsa
ucaugauuugaaaaguacaccuugcaaaguuuuaaaaauaaaguuuuuaggcaaaugcgauaag

SEQ ID NO: 62881 - RNA, 64 nt, hsa
uugcugcaugacccuccaaguagaccuguggcuuaaaauaaagaaaaugcagcaaaaagaaugc

SEQ ID NO: 62882 - RNA, 64 nt, hsa
uuguacacauugauauuuaaugacaaauuuacuuaaaauaaauugaccccuuguucuuacuugc

SEQ ID NO: 62883 - RNA, 64 nt, hsa
ggcaacaugaugccagauuugagaaaggaucugcaaaauaaagauaccacaauucaucuuaaaa

SEQ ID NO: 62884 - RNA, 64 nt, hsa
uaugaggaauggauugucagguugcugaaguauaaaaauaaacucuugguuguccugugcuuau

SEQ ID NO: 62885 - RNA, 64 nt, hsa
acucuggcucaucuaguccugcuccuugugcuauaaaauaaaugcagacuaauuuccugcccaa

SEQ ID NO: 62886 - RNA, 64 nt, hsa
gaaauaaggagaaaagagaaugggagagugagagaaaauaaaaaaggcaaaagggagagagagg

SEQ ID NO: 62887 - RNA, 64 nt, hsa
guguaauuuagguuuuucaacaaagcccuugucuaaaauaaaaggcauuauuggaaauauuuga

SEQ ID NO: 62888 - RNA, 64 nt, hsa
ugaaagccuacaaugaaucauuguucaaccuugaaaaauaaaauuuuguaaaacaucgguugau

SEQ ID NO: 62889 - RNA, 64 nt, hsa
acuaacauacucacugugaacccagccuauugcaaaaauaaaaucuuuuuauaauauuaucuau

SEQ ID NO: 62890 - RNA, 64 nt, hsa
uauuuuugacaugcuccuauuuuuguaacuugaaaaaauaaaauuuugccuugugacagauuuu

SEQ ID NO: 62891 - RNA, 64 nt, hsa
cacuuuuaaaaaugacacauauuuaaacacuuagaaaauaaaguuaacacuuacugaagugcua

SEQ ID NO: 62892 - RNA, 64 nt, hsa
ggccugauauuaguucuuagagcuucuuguggcaaaaauaaaaugauuuaauucugauguuuga

SEQ ID NO: 62893 - RNA, 64 nt, hsa
aucccauacuaucugcuuggauuuggagagccaaaaaauaaagcugauugucaugugauuaaau

SEQ ID NO: 62894 - RNA, 64 nt, hsa
aggugaagcauacuccaguguuuuagggguuuugaaaauaaauauuuaaauuucacaguccuca

SEQ ID NO: 62895 - RNA, 64 nt, hsa
ugggccacagagcaagacuccgucucaaaacauaaaaauaaaaaaaauacaaauagcugacccg

SEQ ID NO: 62896 - RNA, 64 nt, hsa
gaaaagcuuuuaagucucauguuugcugacuauaaaaauaaaucauaguaauaauauugaacau

SEQ ID NO: 62897 - RNA, 64 nt, hsa
ggcccagauagguugaucuuaauguaacaacccaaaaauaaaugucauagucaagauuugguag

SEQ ID NO: 62898 - RNA, 64 nt, hsa
agaaacaccuuuuaagcugaaugcagaaaauuccaaaauaaaugaugucaccacaaugguguau

SEQ ID NO: 62899 - RNA, 64 nt, hsa
uacuguaguagaaacuuuaguuuugaugaugcacaaaauaaacagcagugguucucaacuaggg

SEQ ID NO: 62900 - RNA, 64 nt, hsa
auuuugguucuacuugcuauaugccuccuuuguaaaaauaaacaccgaggcuuacuguaguaga

SEQ ID NO: 62901 - RNA, 64 nt, hsa
uguaaagaaaucagauacaaacuacugcaauuagaaaauaaaauaugaacaacuuucaacaaug

SEQ ID NO: 62902 - RNA, 64 nt, hsa
auuccuauaauacagugcuauaagcuaugcacagaaaauaaaauguuugaaauccaagaauaau

SEQ ID NO: 62903 - RNA, 64 nt, hsa
caguuucugaaugaaaaagcuacagcugagaaauaaaauaaaaugucaugcugcagaauauguu

SEQ ID NO: 62904 - RNA, 64 nt, hsa
uauauauaaauuuuaauuucauagcaacuuguaaaaaauaaaauacuuguugaaaagccuuuuu

SEQ ID NO: 62905 - RNA, 64 nt, hsa
aguugacaugaagucaucuauguggaaaaaaauaaaaauaaaagugauuucacggaugugguuu

SEQ ID NO: 62906 - RNA, 64 nt, hsa
uuuuguaguugacaugaagucaucuauguggaaaaaaauaaaaauaaaagugauuucacggaug

SEQ ID NO: 62907 - RNA, 64 nt, hsa
uaauaauuguucaauguuuaagaauaauauuaacaaaauaaaggaguuuaaugcagugaucuuu

SEQ ID NO: 62908 - RNA, 64 nt, hsa
caucguuuaaauaggaaaaauuuaaugcuagcaaaaaauaaauuuagaaauauggcaugacaug

SEQ ID NO: 62909 - RNA, 64 nt, hsa
aacagugaaacuccaucucaaaaaauaaauaaauaaaauaaauucuuaguucauacccuuccag

SEQ ID NO: 62910 - RNA, 64 nt, hsa
cuccagccugggcaacagugaaacuccaucucaaaaaauaaauaaauaaaauaaauucuuaguu

SEQ ID NO: 62911 - RNA, 64 nt, hsa
caguggacgcaaaauaauguugugaguuuuuauaaaaauaaauuuuaaaaugauauauaagaca

SEQ ID NO: 62912 - RNA, 64 nt, hsa
ucaaaaacuaucacuugcuauaaagguaauuguaaaaauaaauacaguggacgcaaaauaaugu

SEQ ID NO: 62913 - RNA, 64 nt, hsa
gcacccccacauccaaaggauguggagcucuuuaaaaauaaauugcucuggucccaccucugga

SEQ ID NO: 62914 - RNA, 64 nt, hsa
uuuuaaaaaguaaagcaauauauacacagguaaaaaaauaaaauaguacagaagggcuuauaau

SEQ ID NO: 62915 - RNA, 64 nt, hsa
ucuaauacauauuaaaagacauaacuaucaaaacaaaauaaauuugucuguuuucaaccaaaga

SEQ ID NO: 62916 - RNA, 64 nt, hsa
auauaaaguaaaauucaccauuuuaauuauaauaaaaauaaaguauauaauucaaugguuguca

SEQ ID NO: 62917 - RNA, 64 nt, hsa
agcuugggaaaaaugaaauuguauucccauuuuuaaaauaaauacaaauguuuauuucagaagg

SEQ ID NO: 62918 - RNA, 64 nt, hsa
auaguauuuuugcagccuaagaguucauuauuuaaaaauaaacuaaagaaauaugucaccuuug

SEQ ID NO: 62919 - RNA, 64 nt, hsa
guuuuuugauuaaaaaugugaacaagaaaauacuaaaauaaaaauccuuucgauuuagccaacu

SEQ ID NO: 62920 - RNA, 64 nt, hsa
ucuauauuuuuauauucauguguaaacaaaaaauaaaauaaaauucugaucgcauaaaaauaug

SEQ ID NO: 62921 - RNA, 64 nt, hsa
cuuuuucuauauuuuuauauucauguguaaacaaaaaauaaaauaaaauucugaucgcauaaaa

SEQ ID NO: 62922 - RNA, 64 nt, hsa
ucugcaguaaggugguuuaaaccauaguuauauaaaaauaaaggucauucugaauaucagccuu

SEQ ID NO: 62923 - RNA, 64 nt, hsa
uuccaaucacuuaguagccccucaaaguaguuagaaaauaaacagauuuuuccaguguugauuu

SEQ ID NO: 62924 - RNA, 64 nt, hsa
aaccccacuuauggguguaagccuacuagacuugaaaauaaaguauaaaacauuuccaaucacu

SEQ ID NO: 62925 - RNA, 64 nt, hsa
aauaaaagguauucccagguauguuuggcaaaauaaaauaaagguaauuaaaaaccuaagaaau

SEQ ID NO: 62926 - RNA, 64 nt, hsa
aaaaaaauaaaagguauucccagguauguuuggcaaaauaaaauaaagguaauuaaaaaccuaa

SEQ ID NO: 62927 - RNA, 64 nt, hsa
uuaugguuuggaaccaucaccccaagguaaaaaaaaaauaaaagguauucccagguauguuugg

SEQ ID NO: 62928 - RNA, 64 nt, hsa
gcucaguaaugcucacgauaccaauuguuuugacaaaauaaauuuacuaaacuuggccuaaaau

SEQ ID NO: 62929 - RNA, 64 nt, hsa
gcacugcaugugcucuguuuauucugauuuuacuaaaauaaaaaguucaaaagucuuccugcug

SEQ ID NO: 62930 - RNA, 64 nt, hsa
uuuuuguuuuuuagccuguuauauuuccuucuguaaaauaaaauauguccagaagaggcauguu

SEQ ID NO: 62931 - RNA, 64 nt, hsa
ccuauugcugauacugucuuugcauaaaugaauaaaaauaaacuuuuuuucuucaaauguguuu

SEQ ID NO: 62932 - RNA, 64 nt, hsa; identical to SEQ ID NO: 62930

SEQ ID NO: 62933 - RNA, 64 nt, hsa; identical to SEQ ID NO: 62931

SEQ ID NO: 62934 - RNA, 64 nt, hsa
gcaacacagugagaacucaucucuguaaaaaauaaaaauaaaacauuaaaaaaaaacaugagcu

SEQ ID NO: 62935 - RNA, 64 nt, hsa
accuaggcaacacagugagaacucaucucuguaaaaaauaaaaauaaaacauuaaaaaaaaaca

SEQ ID NO: 62936 - RNA, 64 nt, hsa
agcaucuuuucuaguugaaauggugaacugauaggaaaacaaaugaguagaaagaguucaugaa

SEQ ID NO: 62937 - RNA, 64 nt, hsa
gccuggacugaguauaacagcuuuaugauuaugagaaaacaaauucuuuauuuuuuuuuucugu

SEQ ID NO: 62938 - RNA, 64 nt, hsa
ugugcaugaaccaaaggaaauaacauugaagaaggaaaacaauauguagaaaguauuuuagaaa

SEQ ID NO: 62939 - RNA, 64 nt, hsa
gauaauugauggucagagccagcacuggaauuuugaaaacaaauaaggugauuaucuauuuuag

SEQ ID NO: 62940 - RNA, 64 nt, hsa
aucugaauaauuauggaaguugggacauguuaaggaaaacaaauauguucaucaccaacaauca

SEQ ID NO: 62941 - RNA, 64 nt, hsa
cuccuuuuccuauuugaauuucuuuggugcuguagaaaacaaaaaaagaaaaauauauauucau

SEQ ID NO: 62942 - RNA, 64 nt, hsa
gugccacaugcaaguuuugaauaaggaugguauagaaaacaacgcugcauauacagguaccauu

SEQ ID NO: 62943 - RNA, 64 nt, hsa
acugcccccuggcugaagagucugcuuuaaaugggaaaacaacguaggagcagggguuuuuagg

SEQ ID NO: 62944 - RNA, 64 nt, hsa
uucugaucauugaggauggugagauaaauagguugaaaacaaucaucugugaguuuaggagucu

SEQ ID NO: 62945 - RNA, 64 nt, hsa
uguaaaguaagggauagucuuacuuauucugccugaaaacaauguauuaccccagggcccaaca

SEQ ID NO: 62946 - RNA, 64 nt, hsa
aaggaguaaacagcuuauuuauacauuuugaggagaaaacaaaguguuucacuaggaacaccuc

SEQ ID NO: 62947 - RNA, 64 nt, hsa
guacacaauuuauaaaguaaaaagauuuuauaaggaaaacaaauauaauaaccagugcugugaa

SEQ ID NO: 62948 - RNA, 64 nt, hsa
uauaggcuuccaacaccaaauaaccuaacugcuggaaaacaagggaaauuuaaaucuccaaaua

SEQ ID NO: 62949 - RNA, 64 nt, hsa
caugugcaaagcaagcaaggaacauuugggguaagaaaacaaacaugaggcaaaagaaaaaaua

SEQ ID NO: 62950 - RNA, 64 nt, hsa
ucagcagacauucacucuggcugcugggacaucagaaaacaaagucuucaucucucucuccagu

SEQ ID NO: 62951 - RNA, 64 nt, hsa
ugacgaggaagguucuguuuugaguauagccagagaaaacaaggauggagaaaaaucuaggaca

SEQ ID NO: 62952 - RNA, 64 nt, hsa
ugacgaggaagauucuguuuuggguauagccagagaaaacaaggauggagaaaaaucuaggaca

SEQ ID NO: 62953 - RNA, 64 nt, hsa
auguacuuagugacuugacugagaaguuaggguagaaaacaaaaagggaguggauucugggagc

SEQ ID NO: 62954 - RNA, 64 nt, hsa
augcuuucauaguuucagauaugguaguuaugaagaaaacaaugucauuugcugcuauuauugu

SEQ ID NO: 62955 - RNA, 64 nt, hsa
cugcacccgggugggggacagagggaccuuuaaagaaaacaaaacuggacagaaacaggaaugu

SEQ ID NO: 62956 - RNA, 64 nt, hsa
gccgagcugccgaauucaguugacacgaggcacagaaaacaaauaucaaagaucuaauaauaca

SEQ ID NO: 62957 - RNA, 64 nt, hsa
aacuucugacucugagggguccuguuccaauucggaaaacaauaggggaaagccacaaaagcac

SEQ ID NO: 62958 - RNA, 64 nt, hsa
aguuacucaggaaucaaaagagaaaaaaguuucugaaaacaaugaaaccauaaaagauaauauu

SEQ ID NO: 62959 - RNA, 64 nt, hsa
caagcagcaucuuauguccugauuucauauaguagaaaacaaacauuggguccgacuucaaaau

SEQ ID NO: 62960 - RNA, 64 nt, hsa
ggggcuuacuggaaucgucauaucucugaauauugaaaacaacaacuaaaaaaguggaccuucu

SEQ ID NO: 62961 - RNA, 64 nt, hsa
acuguacacagcuccuucuguaaggcuggucuuagaaaacaaguacuuuaguaucaggacagga

SEQ ID NO: 62962 - RNA, 64 nt, hsa
gaguaugguggcaauaucacaagggaggagagaggaaaacaauuaucuucucuacuuggauuau

SEQ ID NO: 62963 - RNA, 64 nt, hsa
aauuuuaguuauguaacaaccugacaugauggaggaaaacaaccuuuaaagggauugugucuau

SEQ ID NO: 62964 - RNA, 64 nt, hsa
uugcuggucagucuuaguguuuuacaguauuugggaaaacaacuguuacaguuuuauugcucug

SEQ ID NO: 62965 - RNA, 64 nt, hsa
auuuuagaagagucaacucuuaagauuaucauuagaaaacaaauacgucaacaccuaugaaaag

SEQ ID NO: 62966 - RNA, 64 nt, hsa
aacaaauacgucaacaccuaugaaaagaagcggggaaaacaacaacaaggacaacaacaaaaaa

SEQ ID NO: 62967 - RNA, 64 nt, hsa
gguaauaaaggcaauuggaugauaucuguaggaggaaaacaaugacuaauuucuuccuuuugaa

SEQ ID NO: 62968 - RNA, 64 nt, hsa
aaauaguuuuuagaacuuuuuguuuaauucugaagaaaacaauauauaugguuuacuucucgaa

SEQ ID NO: 62969 - RNA, 64 nt, hsa
gugacagaagagaccuugucucgaaaaggaaucugaaaacaauggaaccaugccuucauaauuc

SEQ ID NO: 62970 - RNA, 64 nt, hsa
aauguugccaccuuguuuguaacagugaaaaauugaaaacaaccuggaaguccagugaugggaa

SEQ ID NO: 62971 - RNA, 64 nt, hsa
gcauguuuuucuaauaaauuuauauauuuguaaagaaaacaacagaaaucuuuaugcaauuugu

SEQ ID NO: 62972 - RNA, 64 nt, hsa
aguauuuggcucuaggaaacauuuacuuguuugugaaaacaauaccccaagguaauaggaaaag

SEQ ID NO: 62973 - RNA, 64 nt, hsa
uuuauugugaggaccuucucauggaagccauuaggaaaacaaacuagagguaaauaucacauua

SEQ ID NO: 62974 - RNA, 64 nt, hsa
cugacugagaaccugcagccauuucuuguuacaugaaaacaaaaugcuacuuguuaccucuauu

SEQ ID NO: 62975 - RNA, 64 nt, hsa
uuuucuacuauuccuuucugagcuauguuuuagagaaaacaauuugauaugcuucaauuuugua

SEQ ID NO: 62976 - RNA, 64 nt, hsa
agacaguuauuuguuucuucugcaucuugcuacugaaaacaaaaacaaugaaaauauucauauu

SEQ ID NO: 62977 - RNA, 64 nt, hsa
uuauuguuaaaggccuuuuauggaaaccaacuuggaaaacaaccuuaaauguggauguaucaga

SEQ ID NO: 62978 - RNA, 64 nt, hsa
auguaucagauuugguuuauccagccaugggagagaaaacaaaccuaaguuuacuuuacuugua

SEQ ID NO: 62979 - RNA, 64 nt, hsa
cuccagagacuggcucaaaaaagaaagaagcaacgaaaacaaaaugcacagccugaauggacgu

SEQ ID NO: 62980 - RNA, 64 nt, hsa
ggaagcaggcuguagauuuaagggcacucaaggggaaaacaaauguaguuuccacagugugagg

SEQ ID NO: 62981 - RNA, 64 nt, hsa
aacugucauaauggugaauguucaaucuguguaagaaaacaaacuaaauguaguugucacacua

SEQ ID NO: 62982 - RNA, 64 nt, hsa
ugauggcaaggugcuuguuaugucuagaaaguaagaaaacaauaugaggagacauucugucuuu

SEQ ID NO: 62983 - RNA, 64 nt, hsa
cuuuagaauucuaauugucagugauuuuguauaugaaaacaaguuccaaauccacagcuuuuac

SEQ ID NO: 62984 - RNA, 64 nt, hsa
gauauguuuuucuuucccuuaagaaucaaaagcagaaaacaaaaacaacaguccuacuccgaug

SEQ ID NO: 62985 - RNA, 64 nt, hsa
aaaauauuugccaucuuuauuaugagccuuuaaggaaaacaaacccuaaacacaaagcaucagu

SEQ ID NO: 62986 - RNA, 64 nt, hsa
acuccaguuaaaaaaaauuuuaaugaagaaaguggaaaacaaggaagucaaagcaaggaaacua

SEQ ID NO: 62987 - RNA, 64 nt, hsa
cuucaaacuagggccaagcccagcacugcuugaggaaaacaagcauucacaacuuguuuuuggu

SEQ ID NO: 62988 - RNA, 64 nt, hsa
cacauugacaugcgaucaguuugggaaaugugaugaaaacaaagacuagauggguauguguguu

SEQ ID NO: 62989 - RNA, 64 nt, hsa
aauguguuguaaacaagauucuaaauuuaaaaaggaaaacaaaacaaacuuguucuuugcagcu

SEQ ID NO: 62990 - RNA, 64 nt, hsa
cuuuaaagaguuaguguuaauggcuuucugguuugaaaacaaaaaugcaucuaugugguugaaa

SEQ ID NO: 62991 - RNA, 64 nt, hsa
uguauucuccuaacugaaauauuuacuuaaucuggaaaacaauguaacuauuuuuaaagugguu

SEQ ID NO: 62992 - RNA, 64 nt, hsa
agagaguucucccuccacgauugugaaaacaaaugaaaacaaaauuagagcaaagcugaccugg

SEQ ID NO: 62993 - RNA, 64 nt, hsa
ccaagccuccagagaguucucccuccacgauugugaaaacaaaugaaaacaaaauuagagcaaa

SEQ ID NO: 62994 - RNA, 64 nt, hsa
uuuaacuuucugaagaauaucugucaaaauuuaagaaaacaaauguauaaaauuccauuuuuuc

SEQ ID NO: 62995 - RNA, 64 nt, hsa
uugguuuggucuuuauuaaaaaucacaauauuccgaaaacaaaaaaaccuaggagauaaaugua

SEQ ID NO: 62996 - RNA, 64 nt, hsa
guguuuaauauugaaguggaucaugagauguaaagaaaacaauaauggcaaugacuuauauuca

SEQ ID NO: 62997 - RNA, 64 nt, hsa
gcuacuuuuaaaaucccagauacucugaauuuuagaaaacaaacuaauucugauugugucgugc

SEQ ID NO: 62998 - RNA, 64 nt, hsa
cugcagaagguguauguuggggagaacugaaagggaaaacaaaauacuugacauagucuuaagu

SEQ ID NO: 62999 - RNA, 64 nt, hsa
uugacauagucuuaaguagaagaaggcaguuagagaaaacaaaguaucuacuggccuugucaac

SEQ ID NO: 63000 - RNA, 64 nt, hsa
uacaaauuugaaacuuucauaauuguauuaaucagaaaacaagcacauugccauucuuugaaac

SEQ ID NO: 63001 - RNA, 64 nt, hsa
auguuucuagacaugacagcaguaauaaaaggaugaaaacaagugucuucacuaagcguauggc

SEQ ID NO: 63002 - RNA, 64 nt, hsa
gugauuggaaauuuuuagcuguaacaaaaagaaagaaaacaacuuuuuuuaaagccucauucuc

SEQ ID NO: 63003 - RNA, 64 nt, hsa
uuauuuuuauuuucucccugcucuguauugaccagaaaacaaugauuuuauaauauuuaaccca

SEQ ID NO: 63004 - RNA, 64 nt, hsa
uauguacaugagucuucaucacagcaucguuuaugaaaacaacuaaauauucacuaauggugcc

SEQ ID NO: 63005 - RNA, 64 nt, hsa
ucuguuuucauuucuuuuucuguaaaugcaggaugaaaacaauauguaucuccuaggauggcug

SEQ ID NO: 63006 - RNA, 64 nt, hsa
uuuguuuaguauaaauugucauagcugguuuacugaaaacaaacacauuuaaaauugguuuacc

SEQ ID NO: 63007 - RNA, 64 nt, hsa
cccagcaccaaccucugagcccaagaccuugccugaaaacaagcagauaccgauugcuucaucc

SEQ ID NO: 63008 - RNA, 64 nt, hsa
aaacaacuguuuaguggaaacuuucugagagauggaaaacaagcuucuggugggugcauuuucu

SEQ ID NO: 63009 - RNA, 64 nt, hsa
caaauuuuuuucauguaggagcugaaagaucuccgaaaacaaagugaaaucauaccucagcuca

SEQ ID NO: 63010 - RNA, 64 nt, hsa
aggugcagugucaguuucaaaucaaauuaucuaagaaaacaagaaaacaaaggcagcagacuau

SEQ ID NO: 63011 - RNA, 64 nt, hsa
ugucaguuucaaaucaaauuaucuaagaaaacaagaaaacaaaggcagcagacuauugguacac

SEQ ID NO: 63012 - RNA, 64 nt, hsa
ccuccaaguagcuccaaaugcaauuuuuaaaauggaaaacaaaaaucugaaagaaacgucuuua

SEQ ID NO: 63013 - RNA, 64 nt, hsa
gaaaaaguuccaugacucgaauaucugaaaugaagaaaacaaaccgacucacaaaccuccaagu

SEQ ID NO: 63014 - RNA, 64 nt, hsa
ucaaggggacgcugugugugcugcaagugaccccgaaaacaaccacagccgucacaugguccuc

SEQ ID NO: 63015 - RNA, 64 nt, hsa
acaugcucuguuuacaucgauaaaugcacuuaaggaaaacaaacaaauuaaagcucaucuuaaa

SEQ ID NO: 63016 - RNA, 64 nt, hsa
ggcuggucaugagagcaaaccguaguccccuggagacagcgacuccagagaaccucuugggaga

SEQ ID NO: 63017 - RNA, 64 nt, hsa
cuuguguauugcauuccagcagaccacugaaccagacagcgaagccaagaucauuguucuacuu

SEQ ID NO: 63018 - RNA, 64 nt, hsa
cccuuuccauuuccucucauuccauucauggguggacagcgaccacaaagacucauggggcuuc

SEQ ID NO: 63019 - RNA, 64 nt, hsa
agcugagauugugccacugcacuccagccugggugacagcgagacccugucucaaaauauguau

SEQ ID NO: 63020 - RNA, 64 nt, hsa
ccuccuggcuccaagcuaagucacucaacagaaugacagcgaaccuccuggacccucaccauau

SEQ ID NO: 63021 - RNA, 64 nt, hsa
ggaggaagaggaggcgagggaaucagaaauugaggacagcgaugcgggcagcuggggggcugag

SEQ ID NO: 63022 - RNA, 64 nt, hsa
ugaaauagcaaauagaaaugugcaggagcggagggacagcgacaccugguucuuaagcaaauuc

SEQ ID NO: 63023 - RNA, 64 nt, hsa
agccacccccaggggccuccacaggccgcugcaugacagcgauacaguacuuaagugucugugu

SEQ ID NO: 63024 - RNA, 64 nt, hsa
ucugaauguuugaacugccaagaaaaggcauggagacagcgaacuagaagaaagggcaagaagg

SEQ ID NO: 63025 - RNA, 64 nt, hsa
gagcacccuccacauggacucccaccugcaaguggacagcgacauucaguccugcacugcucac

SEQ ID NO: 63026 - RNA, 56 nt, hsa
ugccccucucacacaugugagggccggacagcgaacuggaggggggagaaauuuuc

SEQ ID NO: 63027 - RNA, 64 nt, hsa
cucggcucgggguuuuacugcagcagccggaggugacagcgacgccucagccgccucuguugcu

SEQ ID NO: 63028 - RNA, 64 nt, hsa
uuuccgaaaauggaggcauuccuuuccaaaucuggacagcgaucguuuuuaguguuucugucuc

SEQ ID NO: 63029 - RNA, 64 nt, hsa
cauucacaaaaauuaauauaauuuuuaauguagugacagcgauuuaguguuuuguuugauaaag

SEQ ID NO: 63030 - RNA, 64 nt, hsa
uguuuccuuauaccagauccucagucucacuaaagacagcgauaugggagacacccaggggccu

SEQ ID NO: 63031 - RNA, 64 nt, hsa
ccgaggagcuccaugcggcacugagugaguggcugacagcgauccgggcuugguuuugugaggu

SEQ ID NO: 63032 - RNA, 64 nt, hsa
cuggauuccauaaacaguuuucgugcuuccuccugacagcgacagaaaaccucaagggcuuucc

SEQ ID NO: 63033 - RNA, 64 nt, hsa
uuccucaugugguguaauuacagcccuaucuggagacagcgaauacagcaaacagauuuuauua

SEQ ID NO: 63034 - RNA, 64 nt, hsa
guuucugaucuuguuuucccuguggauauuggaggacagcgagguucuuucugauacuaaaaac

SEQ ID NO: 63035 - RNA, 64 nt, hsa
uuaaagauuuuauuuuuacaaaucacagcugauagacagcgaagccuuccccauagagaccgug

SEQ ID NO: 63036 - RNA, 64 nt, hsa
ggacaggugaggggcucggacggagccguggggggacagcgacugggggccuccaugccuucac

SEQ ID NO: 63037 - RNA, 64 nt, hsa
uuaaaauuaauauaucauuaucuuugcuguuauugacagcgauauaauuuuauuacauaugauu

SEQ ID NO: 63038 - RNA, 64 nt, hsa
uguagaguugugugaaaccccuagcauagagacagacagcgaagagauggugugaaaagcuugc

SEQ ID NO: 63039 - RNA, 64 nt, hsa
ucuuugcaaccucccagcugcgcucauuccagcugacagcgagaugcaagcaaaugcucagcuc

SEQ ID NO: 63040 - RNA, 64 nt, hsa
ucggagggagcagcggaaugcggcgaagacucuggacagcgagggcacagggucccaaaccgag

SEQ ID NO: 63041 - RNA, 64 nt, hsa
aacaaacuuucuucacuuuguauuauagguacaagacagcgacuuacguaucuuuucuccuccu

SEQ ID NO: 63042 - RNA, 64 nt, hsa
uugaggaagguauucugucccacagguuucuguggacagcgauacagcaggagucagugaaauc

SEQ ID NO: 63043 - RNA, 64 nt, hsa
uuguggucugguaagaggggugcuggaggacauggacagcgacaaaccugaggccgugucuagg

SEQ ID NO: 63044 - RNA, 64 nt, hsa
cuucuacauuugagggcccagccaggagcagauggacagcgaugaggggacauuuucuggauuc

SEQ ID NO: 63045 - RNA, 64 nt, hsa
gcuucauugaccucuacuugcugaaggagaaaaagacagcgauaagcuuucaauaguggcauac

SEQ ID NO: 63046 - RNA, 64 nt, hsa
cauguguggcccugucugcuuauccuuggaaggugacagcgauucccuguguagcucucacaug

SEQ ID NO: 63047 - RNA, 64 nt, hsa
gggucggcggcccucaggagagaccaggaggacugacagcgaagaucgagcucagguucgccac

SEQ ID NO: 63048 - RNA, 64 nt, hsa
acaguaauaggcacuggguccagccuugaucagugacagcgaaggaaguuaucugcugggaaca

SEQ ID NO: 63049 - RNA, 64 nt, hsa
ucagcagccccggaagccugccucacccgacgaggacagcgagcggcccggcuccuuucugucu

SEQ ID NO: 63050 - RNA, 64 nt, hsa
cugggcuaggaguuggacggaauggaggauggaggacagcgagaagaaaggaagagaaaugcaa

SEQ ID NO: 63051 - RNA, 64 nt, hsa
accacacguagcccccaggcugcuggacacgucggacagcgaaguauccccgacaggacgggcu

SEQ ID NO: 63052 - RNA, 64 nt, hsa
caguuugugguuaugaaaccgucuguggccucaugacagcgagagaugggaauacacuagaagg

SEQ ID NO: 63053 - RNA, 64 nt, hsa
agccaagaucacagcacugcacugcugccugggcgacagcgagacucuaucucaaaaaaaaaaa

SEQ ID NO: 63054 - RNA, 64 nt, hsa
gcucugggagagccagcuuugcuauucccauugugacagcgauggcaggccugacccacggggc

SEQ ID NO: 63055 - RNA, 64 nt, hsa
ggagggugagaucaacacguacuggggccugcuggacagcgaggacagcaggcaaguuccacag

SEQ ID NO: 63056 - RNA, 64 nt, hsa
uaacaagccaaaugaacagacaaguaaaagacaugacagcgauacuuucccagagcugaaguua

SEQ ID NO: 63057 - RNA, 64 nt, hsa
ggaccuaguacccacugagauuuccacgccgaaggacagcgaugggaaaaaugcccuuaaauca

SEQ ID NO: 63058 - RNA, 64 nt, hsa
gcaccagcacggcuaugacagugaugaggagguggacagcgagcugggcaccugggagcaccag

SEQ ID NO: 63059 - RNA, 64 nt, hsa
ccuguccuggcucucccggcccugcucugauuaggacagcgaccucggauagcacagccagcua

SEQ ID NO: 63060 - RNA, 64 nt, hsa
cacaaagcaaacuacuaaccacuagcucuuacuggacagcgauuucuggcuuauaagaguucuc

SEQ ID NO: 63061 - RNA, 64 nt, hsa
ggcgucacuguauguaguucauggcuacuguacugacagcgagagcauguccaucuguuggaca

SEQ ID NO: 63062 - RNA, 64 nt, hsa
cuccuguguaccaagguauugcuuuuauuuacacgacagcgacucaaaaggcacucgauuaaug

SEQ ID NO: 63063 - RNA, 64 nt, hsa
cuugcuuuuccugugcacacauguagcccaucaggacagcgagccgacgggucacgccaggggc

SEQ ID NO: 63064 - RNA, 64 nt, hsa
gggccacccccaaguguugggccaucugccaagagacagcgacccaaagccgaaggacaggugg

SEQ ID NO: 63065 - RNA, 64 nt, hsa
augggguaaggagaggccccagaaccccaaagcagacagcgagacccccagcggcagaggccuc

SEQ ID NO: 63066 - RNA, 64 nt, hsa
guccuguaaacugugccaacuucaccuguccagggacagcgaagcuggggguggcggggggcau

SEQ ID NO: 63067 - RNA, 64 nt, hsa
ggacgcuuagagucggcagagucugggguagggagacagcgacuuguccaaggucaagcacaga

SEQ ID NO: 63068 - RNA, 64 nt, hsa
ugguccccaugaaggcauucagaguccaccugcagacagcgagagccccaggaagguuugcaca

SEQ ID NO: 63069 - RNA, 64 nt, hsa
uucucuauuggcauuuuuccgauucuguucagaugacagcgaccgccuuuucauuccccccgcc

SEQ ID NO: 63070 - RNA, 64 nt, hsa
ggccgggaucguacuacugcacuccagcauggaagacagcgagacuccgucuccaaaaaaaaaa

SEQ ID NO: 63071 - RNA, 64 nt, hsa
uuggccucgguggcaggggagccccgcagagcuggacagcgacacgcagggggcucggaggacu

SEQ ID NO: 63072 - RNA, 64 nt, hsa
aaucuugcaagauuuguagaccagcacuacaaagaucgcauagaucaaauaggaaaaaaaaugu

SEQ ID NO: 63073 - RNA, 64 nt, hsa
aggaguuuuccagaaugcaauuccgagugagcaaaucgcauagcuguagaaugugcgugcuuuu

SEQ ID NO: 63074 - RNA, 64 nt, hsa
cucuauuuuuaguuugcugaagacuugaaagugaaucgcauauaucaugacacuucuuggagug

SEQ ID NO: 63075 - RNA, 64 nt, hsa
ccuagacuuagacuugauuucuuaacauuaggguaucgcauacucaaaugguagacaaugaccc

SEQ ID NO: 63076 - RNA, 64 nt, hsa
ugaauuaaacaugaaagaacccaagacaucauguaucgcauauuaguuaaucuccucagacagu

SEQ ID NO: 63077 - RNA, 64 nt, hsa
uauucuccauagauugaagaaauuuauaccacauaucgcauaugaccaucuuuccaucaaauca

SEQ ID NO: 63078 - RNA, 64 nt, hsa
auccuuuaggucauuuucucuuuggauaauuuucaucgcauauccagcaacuauagaccaaagu

SEQ ID NO: 63079 - RNA, 64 nt, hsa
gcagauuuuuuuguucucaguggaacccugucaaaucgcauaaaagaggaaaaaaacaaaacuc

SEQ ID NO: 63080 - RNA, 64 nt, hsa
aauaaguuaucaugaaaaguuuuuagauuacacgaucgcauaugcugcauuucacguuuuauug

SEQ ID NO: 63081 - RNA, 64 nt, hsa
cacacugccuuauuacauaacugaucuauuuauuaucgcauacagauauucuaagucguugagg

SEQ ID NO: 63082 - RNA, 64 nt, hsa
ccuacacaggacagggguuccuucugggcauuacaucgcauagaaaucaauaauuuguggugau

SEQ ID NO: 63083 - RNA, 64 nt, hsa
ccccucuguuuacaucuccccucuaccccgcuguaucgcauauugcugaguuuucuauuuuugc

SEQ ID NO: 63084 - RNA, 64 nt, hsa
acaagaaagcauguagcccuaaugauaggagauuaucgcauagaguucagagacuggaaacuga

SEQ ID NO: 63085 - RNA, 64 nt, hsa
aagcaguagauacacccugauguaauuauuauaaaucgcauaccuguaucaaaauaucucaugu

SEQ ID NO: 63086 - RNA, 64 nt, hsa
aaaucgugugaaaauggguuggaacccaucagugaucgcauauucauugaugaggguuugcuug

SEQ ID NO: 63087 - RNA, 64 nt, hsa
ucaguccuguuacaaaauagauaacugagcaccuaucgcauaacauuuugcgguggcuuuuagc

SEQ ID NO: 63088 - RNA, 64 nt, hsa; identical to SEQ ID NO: 61352

SEQ ID NO: 63089 - RNA, 64 nt, hsa; identical to SEQ ID NO: 61353

SEQ ID NO: 63090 - RNA, 64 nt, hsa; identical to SEQ ID NO: 61354

SEQ ID NO: 63091 - RNA, 64 nt, hsa; identical to SEQ ID NO: 61355

SEQ ID NO: 63092 - RNA, 64 nt, hsa; identical to SEQ ID NO: 61356

SEQ ID NO: 63093 - RNA, 64 nt, hsa; identical to SEQ ID NO: 61357

SEQ ID NO: 63094 - RNA, 64 nt, hsa; identical to SEQ ID NO: 61358

SEQ ID NO: 63095 - RNA, 64 nt, hsa; identical to SEQ ID NO: 61359

SEQ ID NO: 63096 - RNA, 64 nt, hsa; identical to SEQ ID NO: 61360

SEQ ID NO: 63097 - RNA, 64 nt, hsa; identical to SEQ ID NO: 61361

SEQ ID NO: 63098 - RNA, 64 nt, hsa; identical to SEQ ID NO: 61362

SEQ ID NO: 63099 - RNA, 64 nt, hsa; identical to SEQ ID NO: 61363

SEQ ID NO: 63100 - RNA, 64 nt, hsa; identical to SEQ ID NO: 61364

SEQ ID NO: 63101 - RNA, 64 nt, hsa; identical to SEQ ID NO: 61365

SEQ ID NO: 63102 - RNA, 64 nt, hsa; identical to SEQ ID NO: 61366

SEQ ID NO: 63103 - RNA, 64 nt, hsa; identical to SEQ ID NO: 61367

SEQ ID NO: 63104 - RNA, 64 nt, hsa; identical to SEQ ID NO: 61368

SEQ ID NO: 63105 - RNA, 56 nt, hsa; identical to SEQ ID NO: 61369

SEQ ID NO: 63106 - RNA, 64 nt, hsa; identical to SEQ ID NO: 61370

SEQ ID NO: 63107 - RNA, 64 nt, hsa; identical to SEQ ID NO: 61371

SEQ ID NO: 63108 - RNA, 64 nt, hsa; identical to SEQ ID NO: 61372

SEQ ID NO: 63109 - RNA, 64 nt, hsa; identical to SEQ ID NO: 61373

SEQ ID NO: 63110 - RNA, 64 nt, hsa; identical to SEQ ID NO: 61374

SEQ ID NO: 63111 - RNA, 64 nt, hsa; identical to SEQ ID NO: 61375

SEQ ID NO: 63112 - RNA, 63 nt, hsa; identical to SEQ ID NO: 57669

SEQ ID NO: 63113 - RNA, 63 nt, hsa; identical to SEQ ID NO: 57670

SEQ ID NO: 63114 - RNA, 63 nt, hsa; identical to SEQ ID NO: 57671

SEQ ID NO: 63115 - RNA, 63 nt, hsa; identical to SEQ ID NO: 57672

SEQ ID NO: 63116 - RNA, 63 nt, hsa; identical to SEQ ID NO: 57673

SEQ ID NO: 63117 - RNA, 63 nt, hsa; identical to SEQ ID NO: 57674

SEQ ID NO: 63118 - RNA, 63 nt, hsa; identical to SEQ ID NO: 57675

SEQ ID NO: 63119 - RNA, 63 nt, hsa; identical to SEQ ID NO: 57676

SEQ ID NO: 63120 - RNA, 63 nt, hsa; identical to SEQ ID NO: 57677

SEQ ID NO: 63121 - RNA, 63 nt, hsa; identical to SEQ ID NO: 57678

SEQ ID NO: 63122 - RNA, 63 nt, hsa; identical to SEQ ID NO: 57679

SEQ ID NO: 63123 - RNA, 63 nt, hsa; identical to SEQ ID NO: 57680

SEQ ID NO: 63124 - RNA, 63 nt, hsa; identical to SEQ ID NO: 57681

SEQ ID NO: 63125 - RNA, 63 nt, hsa; identical to SEQ ID NO: 57682

SEQ ID NO: 63126 - RNA, 63 nt, hsa; identical to SEQ ID NO: 57683

SEQ ID NO: 63127 - RNA, 63 nt, hsa; identical to SEQ ID NO: 57684

SEQ ID NO: 63128 - RNA, 63 nt, hsa; identical to SEQ ID NO: 57685

SEQ ID NO: 63129 - RNA, 63 nt, hsa; identical to SEQ ID NO: 57686

SEQ ID NO: 63130 - RNA, 63 nt, hsa; identical to SEQ ID NO: 57687

SEQ ID NO: 63131 - RNA, 63 nt, hsa; identical to SEQ ID NO: 57688

SEQ ID NO: 63132 - RNA, 63 nt, hsa; identical to SEQ ID NO: 57689

SEQ ID NO: 63133 - RNA, 63 nt, hsa; identical to SEQ ID NO: 57690

SEQ ID NO: 63134 - RNA, 63 nt, hsa; identical to SEQ ID NO: 57691

SEQ ID NO: 63135 - RNA, 63 nt, hsa; identical to SEQ ID NO: 57692

SEQ ID NO: 63136 - RNA, 63 nt, hsa; identical to SEQ ID NO: 57693

SEQ ID NO: 63137 - RNA, 63 nt, hsa; identical to SEQ ID NO: 57694

SEQ ID NO: 63138 - RNA, 63 nt, hsa; identical to SEQ ID NO: 57695

SEQ ID NO: 63139 - RNA, 63 nt, hsa; identical to SEQ ID NO: 57696

SEQ ID NO: 63140 - RNA, 63 nt, hsa; identical to SEQ ID NO: 57697

SEQ ID NO: 63141 - RNA, 63 nt, hsa; identical to SEQ ID NO: 57698

SEQ ID NO: 63142 - RNA, 63 nt, hsa; identical to SEQ ID NO: 57699

SEQ ID NO: 63143 - RNA, 63 nt, hsa; identical to SEQ ID NO: 57700

SEQ ID NO: 63144 - RNA, 63 nt, hsa; identical to SEQ ID NO: 57701

SEQ ID NO: 63145 - RNA, 63 nt, hsa; identical to SEQ ID NO: 57702

SEQ ID NO: 63146 - RNA, 63 nt, hsa; identical to SEQ ID NO: 57703

SEQ ID NO: 63147 - RNA, 63 nt, hsa; identical to SEQ ID NO: 57704

SEQ ID NO: 63148 - RNA, 63 nt, hsa; identical to SEQ ID NO: 57705

SEQ ID NO: 63149 - RNA, 63 nt, hsa; identical to SEQ ID NO: 57706

SEQ ID NO: 63150 - RNA, 63 nt, hsa; identical to SEQ ID NO: 57707

SEQ ID NO: 63151 - RNA, 63 nt, hsa; identical to SEQ ID NO: 57708

SEQ ID NO: 63152 - RNA, 63 nt, hsa; identical to SEQ ID NO: 57709

SEQ ID NO: 63153 - RNA, 63 nt, hsa; identical to SEQ ID NO: 57710

SEQ ID NO: 63154 - RNA, 63 nt, hsa; identical to SEQ ID NO: 57711

SEQ ID NO: 63155 - RNA, 63 nt, hsa; identical to SEQ ID NO: 57712

SEQ ID NO: 63156 - RNA, 63 nt, hsa; identical to SEQ ID NO: 57713

SEQ ID NO: 63157 - RNA, 63 nt, hsa; identical to SEQ ID NO: 57714

SEQ ID NO: 63158 - RNA, 63 nt, hsa; identical to SEQ ID NO: 57715

SEQ ID NO: 63159 - RNA, 63 nt, hsa; identical to SEQ ID NO: 57716

SEQ ID NO: 63160 - RNA, 63 nt, hsa; identical to SEQ ID NO: 57717

SEQ ID NO: 63161 - RNA, 63 nt, hsa; identical to SEQ ID NO: 57718

SEQ ID NO: 63162 - RNA, 63 nt, hsa; identical to SEQ ID NO: 57719

SEQ ID NO: 63163 - RNA, 63 nt, hsa; identical to SEQ ID NO: 57720

SEQ ID NO: 63164 - RNA, 63 nt, hsa; identical to SEQ ID NO: 57721

SEQ ID NO: 63165 - RNA, 63 nt, hsa; identical to SEQ ID NO: 57722

SEQ ID NO: 63166 - RNA, 63 nt, hsa; identical to SEQ ID NO: 57723

SEQ ID NO: 63167 - RNA, 63 nt, hsa; identical to SEQ ID NO: 57724

SEQ ID NO: 63168 - RNA, 63 nt, hsa; identical to SEQ ID NO: 57725

SEQ ID NO: 63169 - RNA, 63 nt, hsa; identical to SEQ ID NO: 57726

SEQ ID NO: 63170 - RNA, 63 nt, hsa; identical to SEQ ID NO: 57727

SEQ ID NO: 63171 - RNA, 63 nt, hsa; identical to SEQ ID NO: 57728

SEQ ID NO: 63172 - RNA, 63 nt, hsa; identical to SEQ ID NO: 57729

SEQ ID NO: 63173 - RNA, 63 nt, hsa; identical to SEQ ID NO: 57730

SEQ ID NO: 63174 - RNA, 63 nt, hsa; identical to SEQ ID NO: 57731

SEQ ID NO: 63175 - RNA, 63 nt, hsa; identical to SEQ ID NO: 57732

SEQ ID NO: 63176 - RNA, 63 nt, hsa; identical to SEQ ID NO: 57733

SEQ ID NO: 63177 - RNA, 63 nt, hsa; identical to SEQ ID NO: 57734

SEQ ID NO: 63178 - RNA, 63 nt, hsa; identical to SEQ ID NO: 57735

SEQ ID NO: 63179 - RNA, 63 nt, hsa; identical to SEQ ID NO: 57736

SEQ ID NO: 63180 - RNA, 63 nt, hsa; identical to SEQ ID NO: 57737

SEQ ID NO: 63181 - RNA, 63 nt, hsa; identical to SEQ ID NO: 57738

SEQ ID NO: 63182 - RNA, 63 nt, hsa; identical to SEQ ID NO: 57739

SEQ ID NO: 63183 - RNA, 63 nt, hsa; identical to SEQ ID NO: 57740

SEQ ID NO: 63184 - RNA, 63 nt, hsa; identical to SEQ ID NO: 57741

SEQ ID NO: 63185 - RNA, 63 nt, hsa; identical to SEQ ID NO: 57742

SEQ ID NO: 63186 - RNA, 63 nt, hsa; identical to SEQ ID NO: 57743

SEQ ID NO: 63187 - RNA, 63 nt, hsa; identical to SEQ ID NO: 57744

SEQ ID NO: 63188 - RNA, 63 nt, hsa; identical to SEQ ID NO: 57745

SEQ ID NO: 63189 - RNA, 63 nt, hsa; identical to SEQ ID NO: 57746

SEQ ID NO: 63190 - RNA, 63 nt, hsa; identical to SEQ ID NO: 57747

SEQ ID NO: 63191 - RNA, 63 nt, hsa; identical to SEQ ID NO: 57748

SEQ ID NO: 63192 - RNA, 63 nt, hsa; identical to SEQ ID NO: 57749

SEQ ID NO: 63193 - RNA, 63 nt, hsa; identical to SEQ ID NO: 57750

SEQ ID NO: 63194 - RNA, 63 nt, hsa; identical to SEQ ID NO: 57751

SEQ ID NO: 63195 - RNA, 63 nt, hsa; identical to SEQ ID NO: 57752

SEQ ID NO: 63196 - RNA, 63 nt, hsa; identical to SEQ ID NO: 57753

SEQ ID NO: 63197 - RNA, 63 nt, hsa; identical to SEQ ID NO: 57754

SEQ ID NO: 63198 - RNA, 63 nt, hsa; identical to SEQ ID NO: 57755

SEQ ID NO: 63199 - RNA, 63 nt, hsa; identical to SEQ ID NO: 57756

SEQ ID NO: 63200 - RNA, 63 nt, hsa; identical to SEQ ID NO: 57757

SEQ ID NO: 63201 - RNA, 63 nt, hsa; identical to SEQ ID NO: 57758

SEQ ID NO: 63202 - RNA, 63 nt, hsa; identical to SEQ ID NO: 57759

SEQ ID NO: 63203 - RNA, 63 nt, hsa; identical to SEQ ID NO: 57760

SEQ ID NO: 63204 - RNA, 63 nt, hsa; identical to SEQ ID NO: 57761

SEQ ID NO: 63205 - RNA, 63 nt, hsa; identical to SEQ ID NO: 57762

SEQ ID NO: 63206 - RNA, 63 nt, hsa; identical to SEQ ID NO: 57763

SEQ ID NO: 63207 - RNA, 63 nt, hsa; identical to SEQ ID NO: 57764

SEQ ID NO: 63208 - RNA, 63 nt, hsa; identical to SEQ ID NO: 57765

SEQ ID NO: 63209 - RNA, 63 nt, hsa; identical to SEQ ID NO: 57766

SEQ ID NO: 63210 - RNA, 63 nt, hsa; identical to SEQ ID NO: 57767

SEQ ID NO: 63211 - RNA, 63 nt, hsa; identical to SEQ ID NO: 57768

SEQ ID NO: 63212 - RNA, 63 nt, hsa; identical to SEQ ID NO: 57769

SEQ ID NO: 63213 - RNA, 63 nt, hsa; identical to SEQ ID NO: 57770

SEQ ID NO: 63214 - RNA, 63 nt, hsa; identical to SEQ ID NO: 57771

SEQ ID NO: 63215 - RNA, 63 nt, hsa; identical to SEQ ID NO: 57772

SEQ ID NO: 63216 - RNA, 63 nt, hsa; identical to SEQ ID NO: 57773

SEQ ID NO: 63217 - RNA, 63 nt, hsa; identical to SEQ ID NO: 57774

SEQ ID NO: 63218 - RNA, 63 nt, hsa; identical to SEQ ID NO: 57775

SEQ ID NO: 63219 - RNA, 63 nt, hsa; identical to SEQ ID NO: 57776

SEQ ID NO: 63220 - RNA, 63 nt, hsa; identical to SEQ ID NO: 57777

SEQ ID NO: 63221 - RNA, 63 nt, hsa; identical to SEQ ID NO: 57778

SEQ ID NO: 63222 - RNA, 63 nt, hsa; identical to SEQ ID NO: 57779

SEQ ID NO: 63223 - RNA, 63 nt, hsa; identical to SEQ ID NO: 57780

SEQ ID NO: 63224 - RNA, 63 nt, hsa; identical to SEQ ID NO: 57781

SEQ ID NO: 63225 - RNA, 63 nt, hsa; identical to SEQ ID NO: 57782

SEQ ID NO: 63226 - RNA, 63 nt, hsa; identical to SEQ ID NO: 57783

SEQ ID NO: 63227 - RNA, 63 nt, hsa; identical to SEQ ID NO: 57784

SEQ ID NO: 63228 - RNA, 63 nt, hsa; identical to SEQ ID NO: 57785

SEQ ID NO: 63229 - RNA, 63 nt, hsa; identical to SEQ ID NO: 57786

SEQ ID NO: 63230 - RNA, 63 nt, hsa; identical to SEQ ID NO: 57787

SEQ ID NO: 63231 - RNA, 63 nt, hsa; identical to SEQ ID NO: 57788

SEQ ID NO: 63232 - RNA, 63 nt, hsa; identical to SEQ ID NO: 57789

SEQ ID NO: 63233 - RNA, 63 nt, hsa; identical to SEQ ID NO: 57790

SEQ ID NO: 63234 - RNA, 63 nt, hsa; identical to SEQ ID NO: 57791

SEQ ID NO: 63235 - RNA, 63 nt, hsa; identical to SEQ ID NO: 57792

SEQ ID NO: 63236 - RNA, 63 nt, hsa; identical to SEQ ID NO: 57793

SEQ ID NO: 63237 - RNA, 63 nt, hsa; identical to SEQ ID NO: 57794

SEQ ID NO: 63238 - RNA, 51 nt, hsa; identical to SEQ ID NO: 57795

SEQ ID NO: 63239 - RNA, 63 nt, hsa; identical to SEQ ID NO: 57796

SEQ ID NO: 63240 - RNA, 63 nt, hsa; identical to SEQ ID NO: 57797

SEQ ID NO: 63241 - RNA, 63 nt, hsa; identical to SEQ ID NO: 57798

SEQ ID NO: 63242 - RNA, 63 nt, hsa; identical to SEQ ID NO: 57799

SEQ ID NO: 63243 - RNA, 63 nt, hsa; identical to SEQ ID NO: 57800

SEQ ID NO: 63244 - RNA, 63 nt, hsa; identical to SEQ ID NO: 57801

SEQ ID NO: 63245 - RNA, 63 nt, hsa; identical to SEQ ID NO: 57802

SEQ ID NO: 63246 - RNA, 63 nt, hsa; identical to SEQ ID NO: 57803

SEQ ID NO: 63247 - RNA, 63 nt, hsa; identical to SEQ ID NO: 57804

SEQ ID NO: 63248 - RNA, 63 nt, hsa; identical to SEQ ID NO: 57805

SEQ ID NO: 63249 - RNA, 63 nt, hsa; identical to SEQ ID NO: 57806

SEQ ID NO: 63250 - RNA, 63 nt, hsa; identical to SEQ ID NO: 57807

SEQ ID NO: 63251 - RNA, 63 nt, hsa; identical to SEQ ID NO: 57808

SEQ ID NO: 63252 - RNA, 63 nt, hsa; identical to SEQ ID NO: 57809

SEQ ID NO: 63253 - RNA, 63 nt, hsa; identical to SEQ ID NO: 57810

SEQ ID NO: 63254 - RNA, 63 nt, hsa; identical to SEQ ID NO: 57811

SEQ ID NO: 63255 - RNA, 63 nt, hsa; identical to SEQ ID NO: 57812

SEQ ID NO: 63256 - RNA, 63 nt, hsa; identical to SEQ ID NO: 57813

SEQ ID NO: 63257 - RNA, 63 nt, hsa; identical to SEQ ID NO: 57814

SEQ ID NO: 63258 - RNA, 63 nt, hsa; identical to SEQ ID NO: 57815

SEQ ID NO: 63259 - RNA, 63 nt, hsa; identical to SEQ ID NO: 57816

SEQ ID NO: 63260 - RNA, 63 nt, hsa; identical to SEQ ID NO: 57817

SEQ ID NO: 63261 - RNA, 63 nt, hsa; identical to SEQ ID NO: 57818

SEQ ID NO: 63262 - RNA, 63 nt, hsa; identical to SEQ ID NO: 57819

SEQ ID NO: 63263 - RNA, 63 nt, hsa; identical to SEQ ID NO: 57820

SEQ ID NO: 63264 - RNA, 63 nt, hsa; identical to SEQ ID NO: 57821

SEQ ID NO: 63265 - RNA, 63 nt, hsa; identical to SEQ ID NO: 57822

SEQ ID NO: 63266 - RNA, 63 nt, hsa; identical to SEQ ID NO: 57823

SEQ ID NO: 63267 - RNA, 63 nt, hsa; identical to SEQ ID NO: 57824

SEQ ID NO: 63268 - RNA, 63 nt, hsa; identical to SEQ ID NO: 57825

SEQ ID NO: 63269 - RNA, 63 nt, hsa; identical to SEQ ID NO: 57826

SEQ ID NO: 63270 - RNA, 63 nt, hsa; identical to SEQ ID NO: 57827

SEQ ID NO: 63271 - RNA, 63 nt, hsa; identical to SEQ ID NO: 57828

SEQ ID NO: 63272 - RNA, 63 nt, hsa; identical to SEQ ID NO: 57829

SEQ ID NO: 63273 - RNA, 63 nt, hsa; identical to SEQ ID NO: 57830

SEQ ID NO: 63274 - RNA, 63 nt, hsa; identical to SEQ ID NO: 57831

SEQ ID NO: 63275 - RNA, 63 nt, hsa; identical to SEQ ID NO: 57832

SEQ ID NO: 63276 - RNA, 63 nt, hsa; identical to SEQ ID NO: 57833

SEQ ID NO: 63277 - RNA, 63 nt, hsa; identical to SEQ ID NO: 57834

SEQ ID NO: 63278 - RNA, 63 nt, hsa; identical to SEQ ID NO: 57835

SEQ ID NO: 63279 - RNA, 63 nt, hsa; identical to SEQ ID NO: 57836

SEQ ID NO: 63280 - RNA, 63 nt, hsa; identical to SEQ ID NO: 57837

SEQ ID NO: 63281 - RNA, 63 nt, hsa; identical to SEQ ID NO: 57838

SEQ ID NO: 63282 - RNA, 63 nt, hsa; identical to SEQ ID NO: 57839

SEQ ID NO: 63283 - RNA, 63 nt, hsa; identical to SEQ ID NO: 57840

SEQ ID NO: 63284 - RNA, 63 nt, hsa; identical to SEQ ID NO: 57841

SEQ ID NO: 63285 - RNA, 63 nt, hsa; identical to SEQ ID NO: 57842

SEQ ID NO: 63286 - RNA, 63 nt, hsa; identical to SEQ ID NO: 57843

SEQ ID NO: 63287 - RNA, 63 nt, hsa; identical to SEQ ID NO: 57844

SEQ ID NO: 63288 - RNA, 63 nt, hsa; identical to SEQ ID NO: 57845

SEQ ID NO: 63289 - RNA, 63 nt, hsa; identical to SEQ ID NO: 57846

SEQ ID NO: 63290 - RNA, 63 nt, hsa; identical to SEQ ID NO: 57847

SEQ ID NO: 63291 - RNA, 63 nt, hsa; identical to SEQ ID NO: 57848

SEQ ID NO: 63292 - RNA, 63 nt, hsa; identical to SEQ ID NO: 57849

SEQ ID NO: 63293 - RNA, 63 nt, hsa; identical to SEQ ID NO: 57850

SEQ ID NO: 63294 - RNA, 63 nt, hsa; identical to SEQ ID NO: 57851

SEQ ID NO: 63295 - RNA, 63 nt, hsa; identical to SEQ ID NO: 57852

SEQ ID NO: 63296 - RNA, 63 nt, hsa; identical to SEQ ID NO: 57853

SEQ ID NO: 63297 - RNA, 63 nt, hsa; identical to SEQ ID NO: 57854

SEQ ID NO: 63298 - RNA, 63 nt, hsa; identical to SEQ ID NO: 57855

SEQ ID NO: 63299 - RNA, 63 nt, hsa; identical to SEQ ID NO: 57856

SEQ ID NO: 63300 - RNA, 63 nt, hsa; identical to SEQ ID NO: 57857

SEQ ID NO: 63301 - RNA, 63 nt, hsa; identical to SEQ ID NO: 57858

SEQ ID NO: 63302 - RNA, 63 nt, hsa; identical to SEQ ID NO: 57859

SEQ ID NO: 63303 - RNA, 63 nt, hsa; identical to SEQ ID NO: 57860

SEQ ID NO: 63304 - RNA, 63 nt, hsa; identical to SEQ ID NO: 57861

SEQ ID NO: 63305 - RNA, 63 nt, hsa; identical to SEQ ID NO: 57862

SEQ ID NO: 63306 - RNA, 63 nt, hsa; identical to SEQ ID NO: 57863

SEQ ID NO: 63307 - RNA, 63 nt, hsa; identical to SEQ ID NO: 57864

SEQ ID NO: 63308 - RNA, 63 nt, hsa; identical to SEQ ID NO: 57865

SEQ ID NO: 63309 - RNA, 63 nt, hsa; identical to SEQ ID NO: 57866

SEQ ID NO: 63310 - RNA, 63 nt, hsa; identical to SEQ ID NO: 57867

SEQ ID NO: 63311 - RNA, 63 nt, hsa; identical to SEQ ID NO: 57868

SEQ ID NO: 63312 - RNA, 63 nt, hsa; identical to SEQ ID NO: 57869

SEQ ID NO: 63313 - RNA, 63 nt, hsa; identical to SEQ ID NO: 57870

SEQ ID NO: 63314 - RNA, 63 nt, hsa; identical to SEQ ID NO: 57871

SEQ ID NO: 63315 - RNA, 63 nt, hsa; identical to SEQ ID NO: 57872

SEQ ID NO: 63316 - RNA, 63 nt, hsa; identical to SEQ ID NO: 57873

SEQ ID NO: 63317 - RNA, 63 nt, hsa; identical to SEQ ID NO: 57874

SEQ ID NO: 63318 - RNA, 63 nt, hsa; identical to SEQ ID NO: 57875

SEQ ID NO: 63319 - RNA, 63 nt, hsa; identical to SEQ ID NO: 57876

SEQ ID NO: 63320 - RNA, 63 nt, hsa; identical to SEQ ID NO: 57877

SEQ ID NO: 63321 - RNA, 63 nt, hsa; identical to SEQ ID NO: 57878

SEQ ID NO: 63322 - RNA, 63 nt, hsa; identical to SEQ ID NO: 57879

SEQ ID NO: 63323 - RNA, 63 nt, hsa; identical to SEQ ID NO: 57880

SEQ ID NO: 63324 - RNA, 63 nt, hsa; identical to SEQ ID NO: 57881

SEQ ID NO: 63325 - RNA, 63 nt, hsa; identical to SEQ ID NO: 57882

SEQ ID NO: 63326 - RNA, 63 nt, hsa; identical to SEQ ID NO: 57883

SEQ ID NO: 63327 - RNA, 63 nt, hsa; identical to SEQ ID NO: 57884

SEQ ID NO: 63328 - RNA, 63 nt, hsa; identical to SEQ ID NO: 57885

SEQ ID NO: 63329 - RNA, 63 nt, hsa; identical to SEQ ID NO: 57886

SEQ ID NO: 63330 - RNA, 63 nt, hsa; identical to SEQ ID NO: 57887

SEQ ID NO: 63331 - RNA, 63 nt, hsa; identical to SEQ ID NO: 57888

SEQ ID NO: 63332 - RNA, 63 nt, hsa; identical to SEQ ID NO: 57889

SEQ ID NO: 63333 - RNA, 63 nt, hsa; identical to SEQ ID NO: 57890

SEQ ID NO: 63334 - RNA, 63 nt, hsa; identical to SEQ ID NO: 57891

SEQ ID NO: 63335 - RNA, 63 nt, hsa; identical to SEQ ID NO: 57892

SEQ ID NO: 63336 - RNA, 63 nt, hsa; identical to SEQ ID NO: 57893

SEQ ID NO: 63337 - RNA, 63 nt, hsa; identical to SEQ ID NO: 57894

SEQ ID NO: 63338 - RNA, 63 nt, hsa; identical to SEQ ID NO: 57895

SEQ ID NO: 63339 - RNA, 63 nt, hsa; identical to SEQ ID NO: 57896

SEQ ID NO: 63340 - RNA, 63 nt, hsa; identical to SEQ ID NO: 57897

SEQ ID NO: 63341 - RNA, 63 nt, hsa; identical to SEQ ID NO: 57898

SEQ ID NO: 63342 - RNA, 63 nt, hsa; identical to SEQ ID NO: 57899

SEQ ID NO: 63343 - RNA, 63 nt, hsa; identical to SEQ ID NO: 57900

SEQ ID NO: 63344 - RNA, 63 nt, hsa; identical to SEQ ID NO: 57901

SEQ ID NO: 63345 - RNA, 63 nt, hsa; identical to SEQ ID NO: 57902

SEQ ID NO: 63346 - RNA, 63 nt, hsa; identical to SEQ ID NO: 57903

SEQ ID NO: 63347 - RNA, 63 nt, hsa; identical to SEQ ID NO: 57904

SEQ ID NO: 63348 - RNA, 63 nt, hsa; identical to SEQ ID NO: 57905

SEQ ID NO: 63349 - RNA, 63 nt, hsa; identical to SEQ ID NO: 57906

SEQ ID NO: 63350 - RNA, 63 nt, hsa; identical to SEQ ID NO: 57907

SEQ ID NO: 63351 - RNA, 63 nt, hsa; identical to SEQ ID NO: 57908

SEQ ID NO: 63352 - RNA, 63 nt, hsa; identical to SEQ ID NO: 57909

SEQ ID NO: 63353 - RNA, 63 nt, hsa; identical to SEQ ID NO: 57910

SEQ ID NO: 63354 - RNA, 63 nt, hsa; identical to SEQ ID NO: 57911

SEQ ID NO: 63355 - RNA, 63 nt, hsa; identical to SEQ ID NO: 57912

SEQ ID NO: 63356 - RNA, 63 nt, hsa; identical to SEQ ID NO: 57913

SEQ ID NO: 63357 - RNA, 63 nt, hsa; identical to SEQ ID NO: 57914

SEQ ID NO: 63358 - RNA, 63 nt, hsa; identical to SEQ ID NO: 57915

SEQ ID NO: 63359 - RNA, 63 nt, hsa; identical to SEQ ID NO: 57916

SEQ ID NO: 63360 - RNA, 63 nt, hsa; identical to SEQ ID NO: 57917

SEQ ID NO: 63361 - RNA, 63 nt, hsa; identical to SEQ ID NO: 57918

SEQ ID NO: 63362 - RNA, 63 nt, hsa; identical to SEQ ID NO: 57919

SEQ ID NO: 63363 - RNA, 63 nt, hsa; identical to SEQ ID NO: 57920

SEQ ID NO: 63364 - RNA, 63 nt, hsa; identical to SEQ ID NO: 57921

SEQ ID NO: 63365 - RNA, 63 nt, hsa; identical to SEQ ID NO: 57922

SEQ ID NO: 63366 - RNA, 63 nt, hsa; identical to SEQ ID NO: 57923

SEQ ID NO: 63367 - RNA, 63 nt, hsa; identical to SEQ ID NO: 57924

SEQ ID NO: 63368 - RNA, 63 nt, hsa; identical to SEQ ID NO: 57925

SEQ ID NO: 63369 - RNA, 63 nt, hsa; identical to SEQ ID NO: 57926

SEQ ID NO: 63370 - RNA, 63 nt, hsa; identical to SEQ ID NO: 57927

SEQ ID NO: 63371 - RNA, 63 nt, hsa; identical to SEQ ID NO: 57928

SEQ ID NO: 63372 - RNA, 63 nt, hsa; identical to SEQ ID NO: 57929

SEQ ID NO: 63373 - RNA, 63 nt, hsa; identical to SEQ ID NO: 57930

SEQ ID NO: 63374 - RNA, 63 nt, hsa; identical to SEQ ID NO: 57931

SEQ ID NO: 63375 - RNA, 63 nt, hsa; identical to SEQ ID NO: 57932

SEQ ID NO: 63376 - RNA, 63 nt, hsa; identical to SEQ ID NO: 57933

SEQ ID NO: 63377 - RNA, 63 nt, hsa; identical to SEQ ID NO: 57934

SEQ ID NO: 63378 - RNA, 63 nt, hsa; identical to SEQ ID NO: 57935

SEQ ID NO: 63379 - RNA, 63 nt, hsa; identical to SEQ ID NO: 57936

SEQ ID NO: 63380 - RNA, 63 nt, hsa; identical to SEQ ID NO: 57937

SEQ ID NO: 63381 - RNA, 63 nt, hsa; identical to SEQ ID NO: 57938

SEQ ID NO: 63382 - RNA, 63 nt, hsa; identical to SEQ ID NO: 57939

SEQ ID NO: 63383 - RNA, 63 nt, hsa; identical to SEQ ID NO: 57940

SEQ ID NO: 63384 - RNA, 63 nt, hsa; identical to SEQ ID NO: 57941

SEQ ID NO: 63385 - RNA, 63 nt, hsa; identical to SEQ ID NO: 57942

SEQ ID NO: 63386 - RNA, 63 nt, hsa; identical to SEQ ID NO: 57943

SEQ ID NO: 63387 - RNA, 63 nt, hsa; identical to SEQ ID NO: 57944

SEQ ID NO: 63388 - RNA, 63 nt, hsa; identical to SEQ ID NO: 57945

SEQ ID NO: 63389 - RNA, 63 nt, hsa; identical to SEQ ID NO: 57946

SEQ ID NO: 63390 - RNA, 63 nt, hsa; identical to SEQ ID NO: 57947

SEQ ID NO: 63391 - RNA, 63 nt, hsa; identical to SEQ ID NO: 57948

SEQ ID NO: 63392 - RNA, 63 nt, hsa; identical to SEQ ID NO: 57949

SEQ ID NO: 63393 - RNA, 63 nt, hsa; identical to SEQ ID NO: 57950

SEQ ID NO: 63394 - RNA, 63 nt, hsa; identical to SEQ ID NO: 57951

SEQ ID NO: 63395 - RNA, 63 nt, hsa; identical to SEQ ID NO: 57952

SEQ ID NO: 63396 - RNA, 63 nt, hsa; identical to SEQ ID NO: 57953

SEQ ID NO: 63397 - RNA, 63 nt, hsa; identical to SEQ ID NO: 57954

SEQ ID NO: 63398 - RNA, 63 nt, hsa; identical to SEQ ID NO: 57955

SEQ ID NO: 63399 - RNA, 63 nt, hsa; identical to SEQ ID NO: 57956

SEQ ID NO: 63400 - RNA, 63 nt, hsa; identical to SEQ ID NO: 57957

SEQ ID NO: 63401 - RNA, 63 nt, hsa; identical to SEQ ID NO: 57958

SEQ ID NO: 63402 - RNA, 63 nt, hsa; identical to SEQ ID NO: 57959

SEQ ID NO: 63403 - RNA, 63 nt, hsa; identical to SEQ ID NO: 57960

SEQ ID NO: 63404 - RNA, 63 nt, hsa; identical to SEQ ID NO: 57961

SEQ ID NO: 63405 - RNA, 63 nt, hsa; identical to SEQ ID NO: 57962

SEQ ID NO: 63406 - RNA, 63 nt, hsa; identical to SEQ ID NO: 57963

SEQ ID NO: 63407 - RNA, 63 nt, hsa; identical to SEQ ID NO: 57964

SEQ ID NO: 63408 - RNA, 63 nt, hsa; identical to SEQ ID NO: 57965

SEQ ID NO: 63409 - RNA, 63 nt, hsa; identical to SEQ ID NO: 57966

SEQ ID NO: 63410 - RNA, 63 nt, hsa; identical to SEQ ID NO: 57967

SEQ ID NO: 63411 - RNA, 63 nt, hsa; identical to SEQ ID NO: 57968

SEQ ID NO: 63412 - RNA, 63 nt, hsa; identical to SEQ ID NO: 57969

SEQ ID NO: 63413 - RNA, 63 nt, hsa; identical to SEQ ID NO: 57970

SEQ ID NO: 63414 - RNA, 63 nt, hsa; identical to SEQ ID NO: 57971

SEQ ID NO: 63415 - RNA, 63 nt, hsa; identical to SEQ ID NO: 57972

SEQ ID NO: 63416 - RNA, 63 nt, hsa; identical to SEQ ID NO: 57973

SEQ ID NO: 63417 - RNA, 63 nt, hsa; identical to SEQ ID NO: 57974

SEQ ID NO: 63418 - RNA, 63 nt, hsa; identical to SEQ ID NO: 57975

SEQ ID NO: 63419 - RNA, 63 nt, hsa; identical to SEQ ID NO: 57976

SEQ ID NO: 63420 - RNA, 63 nt, hsa; identical to SEQ ID NO: 57977

SEQ ID NO: 63421 - RNA, 63 nt, hsa; identical to SEQ ID NO: 57978

SEQ ID NO: 63422 - RNA, 63 nt, hsa; identical to SEQ ID NO: 57979

SEQ ID NO: 63423 - RNA, 63 nt, hsa; identical to SEQ ID NO: 57980

SEQ ID NO: 63424 - RNA, 63 nt, hsa; identical to SEQ ID NO: 57981

SEQ ID NO: 63425 - RNA, 63 nt, hsa; identical to SEQ ID NO: 57982

SEQ ID NO: 63426 - RNA, 63 nt, hsa; identical to SEQ ID NO: 57983

SEQ ID NO: 63427 - RNA, 63 nt, hsa; identical to SEQ ID NO: 57984

SEQ ID NO: 63428 - RNA, 63 nt, hsa; identical to SEQ ID NO: 57985

SEQ ID NO: 63429 - RNA, 63 nt, hsa; identical to SEQ ID NO: 57984

SEQ ID NO: 63430 - RNA, 63 nt, hsa; identical to SEQ ID NO: 57987

SEQ ID NO: 63431 - RNA, 63 nt, hsa; identical to SEQ ID NO: 57988

SEQ ID NO: 63432 - RNA, 63 nt, hsa; identical to SEQ ID NO: 57989

SEQ ID NO: 63433 - RNA, 63 nt, hsa; identical to SEQ ID NO: 57990

SEQ ID NO: 63434 - RNA, 63 nt, hsa; identical to SEQ ID NO: 57991

SEQ ID NO: 63435 - RNA, 63 nt, hsa; identical to SEQ ID NO: 57992

SEQ ID NO: 63436 - RNA, 63 nt, hsa; identical to SEQ ID NO: 57993

SEQ ID NO: 63437 - RNA, 63 nt, hsa; identical to SEQ ID NO: 57994

SEQ ID NO: 63438 - RNA, 63 nt, hsa; identical to SEQ ID NO: 57995

SEQ ID NO: 63439 - RNA, 63 nt, hsa; identical to SEQ ID NO: 57996

SEQ ID NO: 63440 - RNA, 63 nt, hsa; identical to SEQ ID NO: 57997

SEQ ID NO: 63441 - RNA, 63 nt, hsa; identical to SEQ ID NO: 57998

SEQ ID NO: 63442 - RNA, 63 nt, hsa; identical to SEQ ID NO: 57999

SEQ ID NO: 63443 - RNA, 63 nt, hsa; identical to SEQ ID NO: 58000

SEQ ID NO: 63444 - RNA, 63 nt, hsa; identical to SEQ ID NO: 58001

SEQ ID NO: 63445 - RNA, 63 nt, hsa; identical to SEQ ID NO: 58002

SEQ ID NO: 63446 - RNA, 63 nt, hsa; identical to SEQ ID NO: 58003

SEQ ID NO: 63447 - RNA, 63 nt, hsa; identical to SEQ ID NO: 58004

SEQ ID NO: 63448 - RNA, 63 nt, hsa; identical to SEQ ID NO: 58005

SEQ ID NO: 63449 - RNA, 63 nt, hsa; identical to SEQ ID NO: 58006

SEQ ID NO: 63450 - RNA, 63 nt, hsa; identical to SEQ ID NO: 58007

SEQ ID NO: 63451 - RNA, 63 nt, hsa; identical to SEQ ID NO: 58008

SEQ ID NO: 63452 - RNA, 63 nt, hsa; identical to SEQ ID NO: 58009

SEQ ID NO: 63453 - RNA, 63 nt, hsa; identical to SEQ ID NO: 58010

SEQ ID NO: 63454 - RNA, 63 nt, hsa; identical to SEQ ID NO: 58011

SEQ ID NO: 63455 - RNA, 63 nt, hsa; identical to SEQ ID NO: 58012

SEQ ID NO: 63456 - RNA, 63 nt, hsa; identical to SEQ ID NO: 58013

SEQ ID NO: 63457 - RNA, 63 nt, hsa; identical to SEQ ID NO: 58014

SEQ ID NO: 63458 - RNA, 63 nt, hsa; identical to SEQ ID NO: 58015

SEQ ID NO: 63459 - RNA, 63 nt, hsa; identical to SEQ ID NO: 58016

SEQ ID NO: 63460 - RNA, 63 nt, hsa; identical to SEQ ID NO: 58017

SEQ ID NO: 63461 - RNA, 63 nt, hsa; identical to SEQ ID NO: 58018

SEQ ID NO: 63462 - RNA, 63 nt, hsa; identical to SEQ ID NO: 58019

SEQ ID NO: 63463 - RNA, 63 nt, hsa; identical to SEQ ID NO: 58020

SEQ ID NO: 63464 - RNA, 63 nt, hsa; identical to SEQ ID NO: 58021

SEQ ID NO: 63465 - RNA, 63 nt, hsa; identical to SEQ ID NO: 58022

SEQ ID NO: 63466 - RNA, 63 nt, hsa; identical to SEQ ID NO: 58023

SEQ ID NO: 63467 - RNA, 63 nt, hsa; identical to SEQ ID NO: 58024

SEQ ID NO: 63468 - RNA, 63 nt, hsa; identical to SEQ ID NO: 58025

SEQ ID NO: 63469 - RNA, 63 nt, hsa; identical to SEQ ID NO: 58026

SEQ ID NO: 63470 - RNA, 63 nt, hsa; identical to SEQ ID NO: 58027

SEQ ID NO: 63471 - RNA, 63 nt, hsa; identical to SEQ ID NO: 58028

SEQ ID NO: 63472 - RNA, 63 nt, hsa; identical to SEQ ID NO: 58029

SEQ ID NO: 63473 - RNA, 63 nt, hsa; identical to SEQ ID NO: 58030

SEQ ID NO: 63474 - RNA, 63 nt, hsa; identical to SEQ ID NO: 58031

SEQ ID NO: 63475 - RNA, 63 nt, hsa; identical to SEQ ID NO: 58032

SEQ ID NO: 63476 - RNA, 63 nt, hsa; identical to SEQ ID NO: 58033

SEQ ID NO: 63477 - RNA, 57 nt, hsa; identical to SEQ ID NO: 58034

SEQ ID NO: 63478 - RNA, 63 nt, hsa; identical to SEQ ID NO: 58035

SEQ ID NO: 63479 - RNA, 63 nt, hsa; identical to SEQ ID NO: 58036

SEQ ID NO: 63480 - RNA, 63 nt, hsa; identical to SEQ ID NO: 58037

SEQ ID NO: 63481 - RNA, 63 nt, hsa; identical to SEQ ID NO: 58038

SEQ ID NO: 63482 - RNA, 63 nt, hsa; identical to SEQ ID NO: 58039

SEQ ID NO: 63483 - RNA, 63 nt, hsa; identical to SEQ ID NO: 58040

SEQ ID NO: 63484 - RNA, 63 nt, hsa; identical to SEQ ID NO: 58041

SEQ ID NO: 63485 - RNA, 63 nt, hsa; identical to SEQ ID NO: 58042

SEQ ID NO: 63486 - RNA, 63 nt, hsa; identical to SEQ ID NO: 58043

SEQ ID NO: 63487 - RNA, 63 nt, hsa; identical to SEQ ID NO: 58044

SEQ ID NO: 63488 - RNA, 63 nt, hsa; identical to SEQ ID NO: 58045

SEQ ID NO: 63489 - RNA, 63 nt, hsa; identical to SEQ ID NO: 58046

SEQ ID NO: 63490 - RNA, 63 nt, hsa; identical to SEQ ID NO: 58047

SEQ ID NO: 63491 - RNA, 63 nt, hsa; identical to SEQ ID NO: 58048

SEQ ID NO: 63492 - RNA, 63 nt, hsa; identical to SEQ ID NO: 58049

SEQ ID NO: 63493 - RNA, 63 nt, hsa; identical to SEQ ID NO: 58050

SEQ ID NO: 63494 - RNA, 63 nt, hsa; identical to SEQ ID NO: 58051

SEQ ID NO: 63495 - RNA, 63 nt, hsa; identical to SEQ ID NO: 58052

SEQ ID NO: 63496 - RNA, 61 nt, hsa; identical to SEQ ID NO: 58053

SEQ ID NO: 63497 - RNA, 63 nt, hsa; identical to SEQ ID NO: 58054

SEQ ID NO: 63498 - RNA, 63 nt, hsa; identical to SEQ ID NO: 58055

SEQ ID NO: 63499 - RNA, 63 nt, hsa; identical to SEQ ID NO: 58056

SEQ ID NO: 63500 - RNA, 63 nt, hsa; identical to SEQ ID NO: 58057

SEQ ID NO: 63501 - RNA, 63 nt, hsa; identical to SEQ ID NO: 58058

SEQ ID NO: 63502 - RNA, 63 nt, hsa; identical to SEQ ID NO: 58059

SEQ ID NO: 63503 - RNA, 63 nt, hsa; identical to SEQ ID NO: 58060

SEQ ID NO: 63504 - RNA, 63 nt, hsa; identical to SEQ ID NO: 58061

SEQ ID NO: 63505 - RNA, 63 nt, hsa; identical to SEQ ID NO: 58062

SEQ ID NO: 63506 - RNA, 63 nt, hsa; identical to SEQ ID NO: 58063

SEQ ID NO: 63507 - RNA, 63 nt, hsa; identical to SEQ ID NO: 58064

SEQ ID NO: 63508 - RNA, 55 nt, hsa; identical to SEQ ID NO: 58065

SEQ ID NO: 63509 - RNA, 63 nt, hsa; identical to SEQ ID NO: 58066

SEQ ID NO: 63510 - RNA, 63 nt, hsa; identical to SEQ ID NO: 58067

SEQ ID NO: 63511 - RNA, 63 nt, hsa; identical to SEQ ID NO: 58068

SEQ ID NO: 63512 - RNA, 63 nt, hsa; identical to SEQ ID NO: 58069

SEQ ID NO: 63513 - RNA, 63 nt, hsa; identical to SEQ ID NO: 58070

SEQ ID NO: 63514 - RNA, 63 nt, hsa; identical to SEQ ID NO: 58071

SEQ ID NO: 63515 - RNA, 63 nt, hsa; identical to SEQ ID NO: 58072

SEQ ID NO: 63516 - RNA, 63 nt, hsa; identical to SEQ ID NO: 58073

SEQ ID NO: 63517 - RNA, 63 nt, hsa; identical to SEQ ID NO: 58074

SEQ ID NO: 63518 - RNA, 63 nt, hsa; identical to SEQ ID NO: 58075

SEQ ID NO: 63519 - RNA, 63 nt, hsa; identical to SEQ ID NO: 58076

SEQ ID NO: 63520 - RNA, 63 nt, hsa; identical to SEQ ID NO: 58077

SEQ ID NO: 63521 - RNA, 63 nt, hsa; identical to SEQ ID NO: 58078

SEQ ID NO: 63522 - RNA, 63 nt, hsa; identical to SEQ ID NO: 58079

SEQ ID NO: 63523 - RNA, 63 nt, hsa; identical to SEQ ID NO: 58080

SEQ ID NO: 63524 - RNA, 63 nt, hsa; identical to SEQ ID NO: 58081

SEQ ID NO: 63525 - RNA, 63 nt, hsa; identical to SEQ ID NO: 58082

SEQ ID NO: 63526 - RNA, 63 nt, hsa; identical to SEQ ID NO: 58083

SEQ ID NO: 63527 - RNA, 63 nt, hsa; identical to SEQ ID NO: 58084

SEQ ID NO: 63528 - RNA, 63 nt, hsa; identical to SEQ ID NO: 58085

SEQ ID NO: 63529 - RNA, 63 nt, hsa; identical to SEQ ID NO: 58086

SEQ ID NO: 63530 - RNA, 63 nt, hsa; identical to SEQ ID NO: 58087

SEQ ID NO: 63531 - RNA, 63 nt, hsa; identical to SEQ ID NO: 58088

SEQ ID NO: 63532 - RNA, 63 nt, hsa; identical to SEQ ID NO: 58089

SEQ ID NO: 63533 - RNA, 63 nt, hsa; identical to SEQ ID NO: 58087

SEQ ID NO: 63534 - RNA, 63 nt, hsa; identical to SEQ ID NO: 58091

SEQ ID NO: 63535 - RNA, 63 nt, hsa; identical to SEQ ID NO: 58092

SEQ ID NO: 63536 - RNA, 63 nt, hsa; identical to SEQ ID NO: 58093

SEQ ID NO: 63537 - RNA, 63 nt, hsa; identical to SEQ ID NO: 58094

SEQ ID NO: 63538 - RNA, 63 nt, hsa; identical to SEQ ID NO: 58095

SEQ ID NO: 63539 - RNA, 63 nt, hsa; identical to SEQ ID NO: 58096

SEQ ID NO: 63540 - RNA, 63 nt, hsa; identical to SEQ ID NO: 58097

SEQ ID NO: 63541 - RNA, 63 nt, hsa; identical to SEQ ID NO: 58098

SEQ ID NO: 63542 - RNA, 63 nt, hsa; identical to SEQ ID NO: 58099

SEQ ID NO: 63543 - RNA, 63 nt, hsa; identical to SEQ ID NO: 58100

SEQ ID NO: 63544 - RNA, 63 nt, hsa; identical to SEQ ID NO: 58101

SEQ ID NO: 63545 - RNA, 64 nt, hsa; identical to SEQ ID NO: 21195

SEQ ID NO: 63546 - RNA, 64 nt, hsa; identical to SEQ ID NO: 21196

SEQ ID NO: 63547 - RNA, 64 nt, hsa; identical to SEQ ID NO: 21197

SEQ ID NO: 63548 - RNA, 64 nt, hsa; identical to SEQ ID NO: 21198

SEQ ID NO: 63549 - RNA, 64 nt, hsa
cauacugaaagaguccauuguuuaaaaaucuuaauguaucaaacuguauaacuuggccgcugua

SEQ ID NO: 63550 - RNA, 64 nt, hsa
uugaacuugauggcuaacuuacaaagauucucuauguaucaaauguaacuuacugcgacuaaac

SEQ ID NO: 63551 - RNA, 64 nt, hsa
guggucaccagggggacagggagccccccaccaauguaucaaugggugauuuaugaugccuucu

SEQ ID NO: 63552 - RNA, 64 nt, hsa
guuaguaauugugcaguaaaguaaagcccugugguguaucaacuacuaguuaagagucucaguu

SEQ ID NO: 63553 - RNA, 64 nt, hsa
aauauuggaugacuaacuaucaaauagauggauuuguaucaauaccaaauagcuucuguuuugu

SEQ ID NO: 63554 - RNA, 64 nt, hsa
cuugaaucuagggagggggaauguagugaagggauguaucaagugggguggugggagggggagg

SEQ ID NO: 63555 - RNA, 64 nt, hsa
gggaaucucagucgcacucaagcucugagaccuuuguaucaaaaauaggcauuugauuuccugu

SEQ ID NO: 63556 - RNA, 64 nt, hsa
aauauuccauagggccauguugccagaaucuguauguaucaauacaggguuuuuccaagccagg

SEQ ID NO: 63557 - RNA, 64 nt, hsa
uucggugauauauauugcauuauauauugauguguguaucaauauauauugauauguauuacac

SEQ ID NO: 63558 - RNA, 64 nt, hsa
cagacacauuugugcccggcguuugggagcccuuuguaucaauguucugacaagggucccuaua

SEQ ID NO: 63559 - RNA, 64 nt, hsa
gucuuaaagauuggucccuugaaaauaugcuuccuguaucaaagguacguauguggugcaaaca

SEQ ID NO: 63560 - RNA, 64 nt, hsa
uuuuuaggucuaaaagucuuuauauuauauacucuguaucaagucaaaauaucuuuggccauuu

SEQ ID NO: 63561 - RNA, 64 nt, hsa
gugagaccacagaccaggcccgucucuccuguaggcuuuuaauucaauggcaacucuauuucaa

SEQ ID NO: 63562 - RNA, 64 nt, hsa
uauucuucucuaaccauauacgauagggcucuucgcuuuuaaugauaucugggauuucugugga

SEQ ID NO: 63563 - RNA, 64 nt, hsa
uauaaaugaagaagacauacuaauagaacuccuugcuuuuaauuggggaaauagggcuuuaaua

SEQ ID NO: 63564 - RNA, 64 nt, hsa
ccccugaagggcauaccuaaccucaauaguguuggcuuuuaaaacguauguuuguaugguagag

SEQ ID NO: 63565 - RNA, 64 nt, hsa
caagaauagagucaucauguauucuuuguuauuugcuuuuaacaaccuuuaaaaaauauuaaaa

SEQ ID NO: 63566 - RNA, 64 nt, hsa
auuguuuucuuuccuucucaaagguugaaaaaaugcuuuuaauuuuucacagccgagaaacagu

SEQ ID NO: 63567 - RNA, 64 nt, hsa
uuuggauccugcucucaccauugcugccaguuuggcuuuuaagucuccguuuguaaguaaacaa

SEQ ID NO: 63568 - RNA, 64 nt, hsa
uccauuuauucacuagccaucacuacaaucaccagcuuuuaaaacaacagcuaccagaaauaca

SEQ ID NO: 63569 - RNA, 64 nt, hsa
uuuacuuaaauuuuauuuuaucuuauuuuuaggugcuuuuaaucucaaaauucugaaaagcgaa

SEQ ID NO: 63570 - RNA, 64 nt, hsa
auaaaauaugaccaaaauauuuaaaaugcacaaugcuuuuaacuuaaaugugcuaacccuguuu

SEQ ID NO: 63571 - RNA, 64 nt, hsa
aguacuucugugguuaauguauauuuuuauucuggcuuuuaaaaugggaauaauuuguauguau

SEQ ID NO: 63572 - RNA, 64 nt, hsa
ucaaaccauuucugucaguacgaugucaacucaugcuuuuaauucagcaucagcagaaaaugac

SEQ ID NO: 63573 - RNA, 64 nt, hsa
agagcugaucugcaucuguuuauccauuuuaguagcuuuuaaauaugauuuuaugugaagugcc

SEQ ID NO: 63574 - RNA, 64 nt, hsa
gggaaugagugugguaagaaauuuauaaaguuuugcuuuuaaaacguggacauaacucauuuuu

SEQ ID NO: 63575 - RNA, 64 nt, hsa
uucuccccagaggaacuuagggauuucaccccuggcuuuuaaaaaaaacgaaauaccgacaagc

SEQ ID NO: 63576 - RNA, 64 nt, hsa
uuugaugccauauuuucaguguuacacuuuuauggcuuuuaauuuucgauuugacagauguaag

SEQ ID NO: 63577 - RNA, 64 nt, hsa
gugagaaaccuuacaauguaaagaauguggcacagcuuuuaacuaaucuucaaaccuuacugaa

SEQ ID NO: 63578 - RNA, 64 nt, hsa
agaggaacucuauaguugugaagaauguggcaaagcuuuuaaccaauccucauaccuuacuaua

SEQ ID NO: 63579 - RNA, 64 nt, hsa
agagaaagccuacaauugugaagaauguggcaaagcuuuuaaccuuccuuaacccuuaacugua

SEQ ID NO: 63580 - RNA, 64 nt, hsa
aaagaaacccuacaaaugugaagucuguggcaaagcuuuuaacugauucucaacucuuacuaca

SEQ ID NO: 63581 - RNA, 64 nt, hsa
agagaaaccccacaaaugugaagaauguggcagagcuuuuaaccaguccgcaaagcucacugaa

SEQ ID NO: 63582 - RNA, 64 nt, hsa
agaaaaacccuacaaaugugaagaauguggcaaagcuuuuaaccaguccucacaccuuaugaga

SEQ ID NO: 63583 - RNA, 64 nt, hsa
agagaaacucuacaaaugugaagaauguggcaaagcuuuuaaccaagucucaacacuuacuaua

SEQ ID NO: 63584 - RNA, 64 nt, hsa
agagaaaccccacaaauaugaagaaugugguaaugcuuuuaaccaauucucaaaucuuacuaaa

SEQ ID NO: 63585 - RNA, 64 nt, hsa
uccuugaagaauaucuaagcuuuuucugagaugggcuuuuaaaauuauaauaagggaaguuuau

SEQ ID NO: 63586 - RNA, 64 nt, hsa
gagaccugaagauuguaauauucaugucugugaagcuuuuaaacauuacacuugagaucaguca

SEQ ID NO: 63587 - RNA, 64 nt, hsa
uuuccaaccuguaacucugaugugcucuggaucagcuuuuaacuuuuaaucauauauuacuguc

SEQ ID NO: 63588 - RNA, 64 nt, hsa
cacagccagccucugaaaucauagcucuccaguggcuuuuaaagaaagcugguccucagcacua

SEQ ID NO: 63589 - RNA, 64 nt, hsa
aaaaguuuucgauguauuggaauuauuugggaaugcuuuuaaaacaauuuguaauuauuucuuu

SEQ ID NO: 63590 - RNA, 64 nt, hsa
aaacagcugagccugccuacuuugcccuuuuacagcuuuuaauuuuauggauuuuuaaaaauga

SEQ ID NO: 63591 - RNA, 64 nt, hsa
agguuguccaggacuuccuuuuaauggaggaugggcuuuuaaaccacaucaucuuguacaacaa

SEQ ID NO: 63592 - RNA, 64 nt, hsa
agaguucuucaauucaaugcacguucacccuagagcuuuuaacaucuuugcuaguuuuauaaag

SEQ ID NO: 63593 - RNA, 64 nt, hsa
aucuaucuuuguauaauucauauuugggaauauggcuuuuaauaauguucuucccacaaauaau

SEQ ID NO: 63594 - RNA, 64 nt, hsa
aaaaaaaccuuaauaagcuguaucuguuucauaugcuuuuaauuuuaaaggaauaacaaaacug

SEQ ID NO: 63595 - RNA, 64 nt, hsa
cugcagugccagaggggccucuggagcaggccuggcuuuuaaauggggggcugaauuccagcuc

SEQ ID NO: 63596 - RNA, 64 nt, hsa
aauacauuucuuguaaaaccuggcuuguugcuuggcuuuuaaagaugguguauguuuguaaaaa

SEQ ID NO: 63597 - RNA, 64 nt, hsa
agagaaauccuacaaauaugaagaaugugacaaagcuuuuaaccacuucucaacccugccuaca

SEQ ID NO: 63598 - RNA, 64 nt, hsa
agauaaauuauacaaaugugaagaauguggcaaagcuuuuaacaaauccucauccauuaguaaa

SEQ ID NO: 63599 - RNA, 64 nt, hsa
agagaaacccuacaaaugugaaaaauguggcaaagcuuuuaaccaauuuucaaaccuuacuaaa

SEQ ID NO: 63600 - RNA, 64 nt, hsa
agagaaaccauacaacugugaagaauguggcaaagcuuuuaaccaguccucaaacuuuauugaa

SEQ ID NO: 63601 - RNA, 64 nt, hsa
agaaaaacccuacaaaugugaagaaugugucaaagcuuuuaacuguuccucaauccuuacuaaa

SEQ ID NO: 63602 - RNA, 64 nt, hsa
agagaaacccuacaaaugugaagaacguggccuggcuuuuaacaaauccucaacauuuacuaag

SEQ ID NO: 63603 - RNA, 64 nt, hsa
ggagcgaaacuacaauccugaaugaugucacagugcuuuuaacaauaccucaaacuuuucuaaa

SEQ ID NO: 63604 - RNA, 64 nt, hsa
uuuuaauuauguacaggcaaaaaugcagcauuccgcuuuuaacuaucugcuuaaaagagcuaac

SEQ ID NO: 63605 - RNA, 64 nt, hsa
ugcuuuauuuacuuuuguaaucuuggauuuuguagcuuuuaaaacuagaaaccauuguucuaac

SEQ ID NO: 63606 - RNA, 64 nt, hsa
aagggugcugggcaucacugguccuugugaggaugcuuuuaaaguuuuauauuuauguccccaa

SEQ ID NO: 63607 - RNA, 64 nt, hsa
gaguucauagucauauucauagacacagaaucaagcuuuuaacauauacauccaccucuauaug

SEQ ID NO: 63608 - RNA, 64 nt, hsa
uagagagcucagagcaauuaaaccacuauuccaugcuuuuaaguaguuuucuccaccuuuuucu

SEQ ID NO: 63609 - RNA, 64 nt, hsa
ugucuugcuguuuucaguauuuucuuaagaaauugcuuuuaaaacaaauaauuguuuuacaaaa

SEQ ID NO: 63610 - RNA, 64 nt, hsa
ccuuauuuauaaauugaggugguuugaauagauugcuuuuaaggucuuucugcucugugauucc

SEQ ID NO: 63611 - RNA, 64 nt, hsa
uugaauaaauuaguuauuaagcuucaguuuucuagcuuuuaacugauuauaacaaugcacacac

SEQ ID NO: 63612 - RNA, 64 nt, hsa
uugcacaaaaagauaccuuaaaauuugaaacauugcuuuuaaaacuacuuagcacuucagggca

SEQ ID NO: 63613 - RNA, 64 nt, hsa
uaaauugauguugaugcaauccuuacaaaugauugcuuuuaaaauuuuaagcuaggaaaagaaa

SEQ ID NO: 63614 - RNA, 64 nt, hsa
cuuauuuucuaccuggauaaacuucuggaacuuggcuuuuaaauuuaacuuuucuaguuuuuaa

SEQ ID NO: 63615 - RNA, 64 nt, hsa
aguaguuccuuccucuuucuccucuccaauuuaugcuuuuaacuuauuuucuaccuggauaaac

SEQ ID NO: 63616 - RNA, 64 nt, hsa
uaugucuuuauaagguucacuuaacuuaaaaacagcuuuuaaaacaacuuuuuaucuucugucu

SEQ ID NO: 63617 - RNA, 64 nt, hsa
ugacaaacaacaauuaauguuucccuuggauguuuugacaaaaauaaaccucaucguuguuauc

SEQ ID NO: 63618 - RNA, 64 nt, hsa
ucuauccuuagacaauguagugugaaguucacaguugacaaacaacaauuaauguuucccuugg

SEQ ID NO: 63619 - RNA, 64 nt, hsa
acaguacuccagaugucuacacucaauaaaacauuugacaaaaccagccuugguguguuugggg

SEQ ID NO: 63620 - RNA, 64 nt, hsa
aaugcgacaaauaaaguuggggagaugggaaucuuugacaaacaaauuauuuuuauuuguuuua

SEQ ID NO: 63621 - RNA, 64 nt, hsa
cagaacuguuguagaaagcugccuuauaguuggcuugacaaagcauaauucucucauaacaaac

SEQ ID NO: 63622 - RNA, 64 nt, hsa
ggggccuuucucuuugauaaauuuuuuuugucuguugacaaaaacaaaaaucuuuuuucaaaug

SEQ ID NO: 63623 - RNA, 64 nt, hsa
aggucuaugaaguguagcugaaaucugaagagucuugacaaagggauuuacacccuugacaaaa

SEQ ID NO: 63624 - RNA, 64 nt, hsa
aaucugaagagucuugacaaagggauuuacacccuugacaaaaccaaaagaaauuaacaggcca

SEQ ID NO: 63625 - RNA, 64 nt, hsa
aucuuugaaucagaaggaaaaaaagcagcgcugguugacaaaggguguugaagauuuuugcugc

SEQ ID NO: 63626 - RNA, 64 nt, hsa
guugucauuaaguaagauccaggucaaauuccauuugacaaaucccagggacuauccaggaauu

SEQ ID NO: 63627 - RNA, 64 nt, hsa
ucuuucucaauaccugcccugucucaaaucucacuugacaaauggucuacgaucuugcaguuau

SEQ ID NO: 63628 - RNA, 64 nt, hsa
accuuggcugcccaacuguguggaggcugagugauugacaaacacagguuggcucauucuugcu

SEQ ID NO: 63629 - RNA, 64 nt, hsa
cuuuagccuuuucauguuucugucucaaaacacuuugacaaagcucaccaacuuuaaaauauua

SEQ ID NO: 63630 - RNA, 64 nt, hsa
aacacuaauuuuugaaaaagauagguuaaaguauuugacaaaagugaauacaauaauaacacuu

SEQ ID NO: 63631 - RNA, 64 nt, hsa
uuaucuaaaaugcuuugaguuuguauaauauaucuugacaaauuuuacuaccauauguuaugua

SEQ ID NO: 63632 - RNA, 64 nt, hsa
aggacaacgaaauaauucucuuuauugagacuacuugacaaauacuuuaugcuaaaaauuuugu

SEQ ID NO: 63633 - RNA, 64 nt, hsa
ucugacuacuauaaaaauauuugcauauauaaguuugacaaagaaaagaaaaucaauguuaaac

SEQ ID NO: 63634 - RNA, 64 nt, hsa
guuuaacaugauuaauuuaaaaaguauuuagugcuugacaaaguagugucacucuuaagauguc

SEQ ID NO: 63635 - RNA, 64 nt, hsa
aaaguaccuguacagaaaauugaauauugaaaaauugacaaauuguguacaaacacuaaaaaaa

SEQ ID NO: 63636 - RNA, 64 nt, hsa
ucuuuuuaauuuacagcaaaauauugaauaaccauugacaaaaacacuauuauuuuuuguacca

SEQ ID NO: 63637 - RNA, 64 nt, hsa
gaaauaaagcuacacaccuacaaccaucuaaucuuugacaaaguugacaaaaauacgcaauggg

SEQ ID NO: 63638 - RNA, 64 nt, hsa
cuacacaccuacaaccaucuaaucuuugacaaaguugacaaaaauacgcaauggggaaagaauu

SEQ ID NO: 63639 - RNA, 64 nt, hsa
aagaucccaaaaauaauuguaacgaaagcaaaaauugacaaaugggacaugauuaaacagaauu

SEQ ID NO: 63640 - RNA, 64 nt, hsa
guacugauaaaaacaaacaugguuuuccuuuacuuugacaaaguaauguaauuuuuaccuuauu

SEQ ID NO: 63641 - RNA, 64 nt, hsa
uuuuaauccuuuuacauaaaauaaucugaacucuuugacaaauugcacagagcucuuuggcauu

SEQ ID NO: 63642 - RNA, 64 nt, hsa
ucuaugagcacagguccuccuagugaagcuuaguuugacaaagggugucauaugcuuuccuaac

SEQ ID NO: 63643 - RNA, 64 nt, hsa
gucagacauuuaccaacuauuuucuaaaacuaauuugacaaaucaugacacuagaaaacgccaa

SEQ ID NO: 63644 - RNA, 64 nt, hsa
gaaauaaugccacauaucuacaacuaucugaccuuugacaaaccugacaaaaacaagcaauggg

SEQ ID NO: 63645 - RNA, 64 nt, hsa
aaaacaccaaaagcaauggcaacaaaagccaaaauugacaaaugggaucuaauuaaacuaaaga

SEQ ID NO: 63646 - RNA, 64 nt, hsa
aauaaaccagucucuuggagggcacaacccuuauuugacaaaacuuggauguuggcuugacugu

SEQ ID NO: 63647 - RNA, 64 nt, hsa
uuccaaaacaaaaauaaagaccuguccaaaaguuuugacaaaaauacugauugcucccaaauaa

SEQ ID NO: 63648 - RNA, 64 nt, hsa
uguuggcucaguaaugcucaagauaucaauuguuuugacaaaauaaauuuacugaacuugggcu

SEQ ID NO: 63649 - RNA, 64 nt, hsa
ugcugcuaguuuuauguaauauuuauugaacauuuugacaaauauuuauuuuuguaagccuaaa

SEQ ID NO: 63650 - RNA, 64 nt, hsa
uuuacuguguugaagcuaaaaaaauaauggcucuuugacaaaacuuguuauguugaucgcggua

SEQ ID NO: 63651 - RNA, 64 nt, hsa
agaagaacguaaguuguacaaagauauuuguacuuugacaaacugaauuuaaauaaacuuuauu

SEQ ID NO: 63652 - RNA, 64 nt, hsa
uguuggcucaguaaugcucacgauaccaauuguuuugacaaaauaaauuuacuaaacuuggccu

SEQ ID NO: 63653 - RNA, 64 nt, hsa
cuuuaaaaacaaaucuuuucaauggcauaagaaguugacaaaaauuucuuaaagugcaauagau

SEQ ID NO: 63654 - RNA, 64 nt, hsa
uuugcugcuaguuguguaauauuuauugaacauuuugacaaauauuuauuuuuguaagccuaaa

SEQ ID NO: 63655 - RNA, 63 nt, hsa; identical to SEQ ID NO: 57615

SEQ ID NO: 63656 - RNA, 63 nt, hsa; identical to SEQ ID NO: 57616

SEQ ID NO: 63657 - RNA, 63 nt, hsa; identical to SEQ ID NO: 57617

SEQ ID NO: 63658 - RNA, 63 nt, hsa; identical to SEQ ID NO: 57618

SEQ ID NO: 63659 - RNA, 63 nt, hsa; identical to SEQ ID NO: 57619

SEQ ID NO: 63660 - RNA, 63 nt, hsa; identical to SEQ ID NO: 57620

SEQ ID NO: 63661 - RNA, 50 nt, hsa; identical to SEQ ID NO: 57621

SEQ ID NO: 63662 - RNA, 63 nt, hsa; identical to SEQ ID NO: 57622

SEQ ID NO: 63663 - RNA, 63 nt, hsa; identical to SEQ ID NO: 57623

SEQ ID NO: 63664 - RNA, 63 nt, hsa; identical to SEQ ID NO: 57624

SEQ ID NO: 63665 - RNA, 63 nt, hsa; identical to SEQ ID NO: 57625

SEQ ID NO: 63666 - RNA, 63 nt, hsa; identical to SEQ ID NO: 57626

SEQ ID NO: 63667 - RNA, 63 nt, hsa; identical to SEQ ID NO: 57627

SEQ ID NO: 63668 - RNA, 63 nt, hsa; identical to SEQ ID NO: 57628

SEQ ID NO: 63669 - RNA, 63 nt, hsa; identical to SEQ ID NO: 57629

SEQ ID NO: 63670 - RNA, 63 nt, hsa; identical to SEQ ID NO: 57630

SEQ ID NO: 63671 - RNA, 63 nt, hsa; identical to SEQ ID NO: 57631

SEQ ID NO: 63672 - RNA, 63 nt, hsa; identical to SEQ ID NO: 57632

SEQ ID NO: 63673 - RNA, 63 nt, hsa; identical to SEQ ID NO: 57633

SEQ ID NO: 63674 - RNA, 66 nt, hsa; identical to SEQ ID NO: 57634

SEQ ID NO: 63675 - RNA, 66 nt, hsa; identical to SEQ ID NO: 57635

SEQ ID NO: 63676 - RNA, 66 nt, hsa; identical to SEQ ID NO: 57636

SEQ ID NO: 63677 - RNA, 66 nt, hsa; identical to SEQ ID NO: 57637

SEQ ID NO: 63678 - RNA, 66 nt, hsa; identical to SEQ ID NO: 57638

SEQ ID NO: 63679 - RNA, 66 nt, hsa; identical to SEQ ID NO: 57639

SEQ ID NO: 63680 - RNA, 66 nt, hsa; identical to SEQ ID NO: 57640

SEQ ID NO: 63681 - RNA, 66 nt, hsa; identical to SEQ ID NO: 57641

SEQ ID NO: 63682 - RNA, 66 nt, hsa; identical to SEQ ID NO: 57642

SEQ ID NO: 63683 - RNA, 66 nt, hsa; identical to SEQ ID NO: 57643

SEQ ID NO: 63684 - RNA, 66 nt, hsa; identical to SEQ ID NO: 57644

SEQ ID NO: 63685 - RNA, 66 nt, hsa; identical to SEQ ID NO: 57645

SEQ ID NO: 63686 - RNA, 66 nt, hsa; identical to SEQ ID NO: 57646

SEQ ID NO: 63687 - RNA, 66 nt, hsa; identical to SEQ ID NO: 57647

SEQ ID NO: 63688 - RNA, 66 nt, hsa; identical to SEQ ID NO: 57648

SEQ ID NO: 63689 - RNA, 66 nt, hsa; identical to SEQ ID NO: 57649

SEQ ID NO: 63690 - RNA, 66 nt, hsa; identical to SEQ ID NO: 57650

SEQ ID NO: 63691 - RNA, 66 nt, hsa; identical to SEQ ID NO: 57651

SEQ ID NO: 63692 - RNA, 66 nt, hsa; identical to SEQ ID NO: 57652

SEQ ID NO: 63693 - RNA, 66 nt, hsa; identical to SEQ ID NO: 57653

SEQ ID NO: 63694 - RNA, 66 nt, hsa; identical to SEQ ID NO: 57654

SEQ ID NO: 63695 - RNA, 66 nt, hsa; identical to SEQ ID NO: 57655

SEQ ID NO: 63696 - RNA, 66 nt, hsa; identical to SEQ ID NO: 57656

SEQ ID NO: 63697 - RNA, 66 nt, hsa; identical to SEQ ID NO: 57657

SEQ ID NO: 63698 - RNA, 66 nt, hsa; identical to SEQ ID NO: 57658

SEQ ID NO: 63699 - RNA, 66 nt, hsa; identical to SEQ ID NO: 57659

SEQ ID NO: 63700 - RNA, 66 nt, hsa; identical to SEQ ID NO: 57660

SEQ ID NO: 63701 - RNA, 66 nt, hsa; identical to SEQ ID NO: 57661

SEQ ID NO: 63702 - RNA, 66 nt, hsa; identical to SEQ ID NO: 57662

SEQ ID NO: 63703 - RNA, 66 nt, hsa; identical to SEQ ID NO: 57663

SEQ ID NO: 63704 - RNA, 66 nt, hsa; identical to SEQ ID NO: 57664

SEQ ID NO: 63705 - RNA, 66 nt, hsa; identical to SEQ ID NO: 57665

SEQ ID NO: 63706 - RNA, 66 nt, hsa; identical to SEQ ID NO: 57666

SEQ ID NO: 63707 - RNA, 66 nt, hsa; identical to SEQ ID NO: 57667

SEQ ID NO: 63708 - RNA, 66 nt, hsa; identical to SEQ ID NO: 57668

SEQ ID NO: 63709 - RNA, 63 nt, hsa; identical to SEQ ID NO: 57669

SEQ ID NO: 63710 - RNA, 63 nt, hsa; identical to SEQ ID NO: 57670

SEQ ID NO: 63711 - RNA, 63 nt, hsa; identical to SEQ ID NO: 57671

SEQ ID NO: 63712 - RNA, 63 nt, hsa; identical to SEQ ID NO: 57672

SEQ ID NO: 63713 - RNA, 63 nt, hsa; identical to SEQ ID NO: 57673

SEQ ID NO: 63714 - RNA, 63 nt, hsa; identical to SEQ ID NO: 57674

SEQ ID NO: 63715 - RNA, 63 nt, hsa; identical to SEQ ID NO: 57675

SEQ ID NO: 63716 - RNA, 63 nt, hsa; identical to SEQ ID NO: 57676

SEQ ID NO: 63717 - RNA, 63 nt, hsa; identical to SEQ ID NO: 57677

SEQ ID NO: 63718 - RNA, 63 nt, hsa; identical to SEQ ID NO: 57678

SEQ ID NO: 63719 - RNA, 63 nt, hsa; identical to SEQ ID NO: 57679

SEQ ID NO: 63720 - RNA, 63 nt, hsa; identical to SEQ ID NO: 57680

SEQ ID NO: 63721 - RNA, 63 nt, hsa; identical to SEQ ID NO: 57681

SEQ ID NO: 63722 - RNA, 63 nt, hsa; identical to SEQ ID NO: 57682

SEQ ID NO: 63723 - RNA, 63 nt, hsa; identical to SEQ ID NO: 57683

SEQ ID NO: 63724 - RNA, 63 nt, hsa; identical to SEQ ID NO: 57684

SEQ ID NO: 63725 - RNA, 63 nt, hsa; identical to SEQ ID NO: 57685

SEQ ID NO: 63726 - RNA, 63 nt, hsa; identical to SEQ ID NO: 57686

SEQ ID NO: 63727 - RNA, 63 nt, hsa; identical to SEQ ID NO: 57687

SEQ ID NO: 63728 - RNA, 63 nt, hsa; identical to SEQ ID NO: 57688

SEQ ID NO: 63729 - RNA, 63 nt, hsa; identical to SEQ ID NO: 57689

SEQ ID NO: 63730 - RNA, 63 nt, hsa; identical to SEQ ID NO: 57690

SEQ ID NO: 63731 - RNA, 63 nt, hsa; identical to SEQ ID NO: 57691

SEQ ID NO: 63732 - RNA, 63 nt, hsa; identical to SEQ ID NO: 57692

SEQ ID NO: 63733 - RNA, 63 nt, hsa; identical to SEQ ID NO: 57693

SEQ ID NO: 63734 - RNA, 63 nt, hsa; identical to SEQ ID NO: 57694

SEQ ID NO: 63735 - RNA, 63 nt, hsa; identical to SEQ ID NO: 57695

SEQ ID NO: 63736 - RNA, 63 nt, hsa; identical to SEQ ID NO: 57696

SEQ ID NO: 63737 - RNA, 63 nt, hsa; identical to SEQ ID NO: 57697

SEQ ID NO: 63738 - RNA, 63 nt, hsa; identical to SEQ ID NO: 57698

SEQ ID NO: 63739 - RNA, 63 nt, hsa; identical to SEQ ID NO: 57699

SEQ ID NO: 63740 - RNA, 63 nt, hsa; identical to SEQ ID NO: 57700

SEQ ID NO: 63741 - RNA, 63 nt, hsa; identical to SEQ ID NO: 57701

SEQ ID NO: 63742 - RNA, 63 nt, hsa; identical to SEQ ID NO: 57702

SEQ ID NO: 63743 - RNA, 63 nt, hsa; identical to SEQ ID NO: 57703

SEQ ID NO: 63744 - RNA, 63 nt, hsa; identical to SEQ ID NO: 57704

SEQ ID NO: 63745 - RNA, 63 nt, hsa; identical to SEQ ID NO: 57705

SEQ ID NO: 63746 - RNA, 63 nt, hsa; identical to SEQ ID NO: 57706

SEQ ID NO: 63747 - RNA, 63 nt, hsa; identical to SEQ ID NO: 57707

SEQ ID NO: 63748 - RNA, 63 nt, hsa; identical to SEQ ID NO: 57708

SEQ ID NO: 63749 - RNA, 63 nt, hsa; identical to SEQ ID NO: 57709

SEQ ID NO: 63750 - RNA, 63 nt, hsa; identical to SEQ ID NO: 57710

SEQ ID NO: 63751 - RNA, 63 nt, hsa; identical to SEQ ID NO: 57711

SEQ ID NO: 63752 - RNA, 63 nt, hsa; identical to SEQ ID NO: 57712

SEQ ID NO: 63753 - RNA, 63 nt, hsa; identical to SEQ ID NO: 57713

SEQ ID NO: 63754 - RNA, 63 nt, hsa; identical to SEQ ID NO: 57714

SEQ ID NO: 63755 - RNA, 63 nt, hsa; identical to SEQ ID NO: 57715

SEQ ID NO: 63756 - RNA, 63 nt, hsa; identical to SEQ ID NO: 57716

SEQ ID NO: 63757 - RNA, 63 nt, hsa; identical to SEQ ID NO: 57717

SEQ ID NO: 63758 - RNA, 63 nt, hsa; identical to SEQ ID NO: 57718

SEQ ID NO: 63759 - RNA, 63 nt, hsa; identical to SEQ ID NO: 57719

SEQ ID NO: 63760 - RNA, 63 nt, hsa; identical to SEQ ID NO: 57720

SEQ ID NO: 63761 - RNA, 63 nt, hsa; identical to SEQ ID NO: 57721

SEQ ID NO: 63762 - RNA, 63 nt, hsa; identical to SEQ ID NO: 57722

SEQ ID NO: 63763 - RNA, 63 nt, hsa; identical to SEQ ID NO: 57723

SEQ ID NO: 63764 - RNA, 63 nt, hsa; identical to SEQ ID NO: 57724

SEQ ID NO: 63765 - RNA, 63 nt, hsa; identical to SEQ ID NO: 57725

SEQ ID NO: 63766 - RNA, 63 nt, hsa; identical to SEQ ID NO: 57726

SEQ ID NO: 63767 - RNA, 63 nt, hsa; identical to SEQ ID NO: 57727

SEQ ID NO: 63768 - RNA, 63 nt, hsa; identical to SEQ ID NO: 57728

SEQ ID NO: 63769 - RNA, 63 nt, hsa; identical to SEQ ID NO: 57729

SEQ ID NO: 63770 - RNA, 63 nt, hsa; identical to SEQ ID NO: 57730

SEQ ID NO: 63771 - RNA, 63 nt, hsa; identical to SEQ ID NO: 57731

SEQ ID NO: 63772 - RNA, 63 nt, hsa; identical to SEQ ID NO: 57732

SEQ ID NO: 63773 - RNA, 63 nt, hsa; identical to SEQ ID NO: 57733

SEQ ID NO: 63774 - RNA, 63 nt, hsa; identical to SEQ ID NO: 57734

SEQ ID NO: 63775 - RNA, 63 nt, hsa; identical to SEQ ID NO: 57735

SEQ ID NO: 63776 - RNA, 63 nt, hsa; identical to SEQ ID NO: 57736

SEQ ID NO: 63777 - RNA, 63 nt, hsa; identical to SEQ ID NO: 57737

SEQ ID NO: 63778 - RNA, 63 nt, hsa; identical to SEQ ID NO: 57738

SEQ ID NO: 63779 - RNA, 63 nt, hsa; identical to SEQ ID NO: 57739

SEQ ID NO: 63780 - RNA, 63 nt, hsa; identical to SEQ ID NO: 57740

SEQ ID NO: 63781 - RNA, 63 nt, hsa; identical to SEQ ID NO: 57741

SEQ ID NO: 63782 - RNA, 63 nt, hsa; identical to SEQ ID NO: 57742

SEQ ID NO: 63783 - RNA, 63 nt, hsa; identical to SEQ ID NO: 57743

SEQ ID NO: 63784 - RNA, 63 nt, hsa; identical to SEQ ID NO: 57744

SEQ ID NO: 63785 - RNA, 63 nt, hsa; identical to SEQ ID NO: 57745

SEQ ID NO: 63786 - RNA, 63 nt, hsa; identical to SEQ ID NO: 57746

SEQ ID NO: 63787 - RNA, 63 nt, hsa; identical to SEQ ID NO: 57747

SEQ ID NO: 63788 - RNA, 63 nt, hsa; identical to SEQ ID NO: 57748

SEQ ID NO: 63789 - RNA, 63 nt, hsa; identical to SEQ ID NO: 57749

SEQ ID NO: 63790 - RNA, 63 nt, hsa; identical to SEQ ID NO: 57750

SEQ ID NO: 63791 - RNA, 63 nt, hsa; identical to SEQ ID NO: 57751

SEQ ID NO: 63792 - RNA, 63 nt, hsa; identical to SEQ ID NO: 57752

SEQ ID NO: 63793 - RNA, 63 nt, hsa; identical to SEQ ID NO: 57753

SEQ ID NO: 63794 - RNA, 63 nt, hsa; identical to SEQ ID NO: 57754

SEQ ID NO: 63795 - RNA, 63 nt, hsa; identical to SEQ ID NO: 57755

SEQ ID NO: 63796 - RNA, 63 nt, hsa; identical to SEQ ID NO: 57756

SEQ ID NO: 63797 - RNA, 63 nt, hsa; identical to SEQ ID NO: 57757

SEQ ID NO: 63798 - RNA, 63 nt, hsa; identical to SEQ ID NO: 57758

SEQ ID NO: 63799 - RNA, 63 nt, hsa; identical to SEQ ID NO: 57759

SEQ ID NO: 63800 - RNA, 63 nt, hsa; identical to SEQ ID NO: 57760

SEQ ID NO: 63801 - RNA, 63 nt, hsa; identical to SEQ ID NO: 57761

SEQ ID NO: 63802 - RNA, 63 nt, hsa; identical to SEQ ID NO: 57762

SEQ ID NO: 63803 - RNA, 63 nt, hsa; identical to SEQ ID NO: 57763

SEQ ID NO: 63804 - RNA, 63 nt, hsa; identical to SEQ ID NO: 57764

SEQ ID NO: 63805 - RNA, 63 nt, hsa; identical to SEQ ID NO: 57765

SEQ ID NO: 63806 - RNA, 63 nt, hsa; identical to SEQ ID NO: 57766

SEQ ID NO: 63807 - RNA, 63 nt, hsa; identical to SEQ ID NO: 57767

SEQ ID NO: 63808 - RNA, 63 nt, hsa; identical to SEQ ID NO: 57768

SEQ ID NO: 63809 - RNA, 63 nt, hsa; identical to SEQ ID NO: 57769

SEQ ID NO: 63810 - RNA, 63 nt, hsa; identical to SEQ ID NO: 57770

SEQ ID NO: 63811 - RNA, 63 nt, hsa; identical to SEQ ID NO: 57771

SEQ ID NO: 63812 - RNA, 63 nt, hsa; identical to SEQ ID NO: 57772

SEQ ID NO: 63813 - RNA, 63 nt, hsa; identical to SEQ ID NO: 57773

SEQ ID NO: 63814 - RNA, 63 nt, hsa; identical to SEQ ID NO: 57774

SEQ ID NO: 63815 - RNA, 63 nt, hsa; identical to SEQ ID NO: 57775

SEQ ID NO: 63816 - RNA, 63 nt, hsa; identical to SEQ ID NO: 57776

SEQ ID NO: 63817 - RNA, 63 nt, hsa; identical to SEQ ID NO: 57777

SEQ ID NO: 63818 - RNA, 63 nt, hsa; identical to SEQ ID NO: 57778

SEQ ID NO: 63819 - RNA, 63 nt, hsa; identical to SEQ ID NO: 57779

SEQ ID NO: 63820 - RNA, 63 nt, hsa; identical to SEQ ID NO: 57780

SEQ ID NO: 63821 - RNA, 63 nt, hsa; identical to SEQ ID NO: 57781

SEQ ID NO: 63822 - RNA, 63 nt, hsa; identical to SEQ ID NO: 57782

SEQ ID NO: 63823 - RNA, 63 nt, hsa; identical to SEQ ID NO: 57783

SEQ ID NO: 63824 - RNA, 63 nt, hsa; identical to SEQ ID NO: 57784

SEQ ID NO: 63825 - RNA, 63 nt, hsa; identical to SEQ ID NO: 57785

SEQ ID NO: 63826 - RNA, 63 nt, hsa; identical to SEQ ID NO: 57786

SEQ ID NO: 63827 - RNA, 63 nt, hsa; identical to SEQ ID NO: 57787

SEQ ID NO: 63828 - RNA, 63 nt, hsa; identical to SEQ ID NO: 57788

SEQ ID NO: 63829 - RNA, 63 nt, hsa; identical to SEQ ID NO: 57789

SEQ ID NO: 63830 - RNA, 63 nt, hsa; identical to SEQ ID NO: 57790

SEQ ID NO: 63831 - RNA, 63 nt, hsa; identical to SEQ ID NO: 57791

SEQ ID NO: 63832 - RNA, 63 nt, hsa; identical to SEQ ID NO: 57792

SEQ ID NO: 63833 - RNA, 63 nt, hsa; identical to SEQ ID NO: 57793

SEQ ID NO: 63834 - RNA, 63 nt, hsa; identical to SEQ ID NO: 57794

SEQ ID NO: 63835 - RNA, 51 nt, hsa; identical to SEQ ID NO: 57795

SEQ ID NO: 63836 - RNA, 63 nt, hsa; identical to SEQ ID NO: 57796

SEQ ID NO: 63837 - RNA, 63 nt, hsa; identical to SEQ ID NO: 57797

SEQ ID NO: 63838 - RNA, 63 nt, hsa; identical to SEQ ID NO: 57798

SEQ ID NO: 63839 - RNA, 63 nt, hsa; identical to SEQ ID NO: 57799

SEQ ID NO: 63840 - RNA, 63 nt, hsa; identical to SEQ ID NO: 57800

SEQ ID NO: 63841 - RNA, 63 nt, hsa; identical to SEQ ID NO: 57801

SEQ ID NO: 63842 - RNA, 63 nt, hsa; identical to SEQ ID NO: 57802

SEQ ID NO: 63843 - RNA, 63 nt, hsa; identical to SEQ ID NO: 57803

SEQ ID NO: 63844 - RNA, 63 nt, hsa; identical to SEQ ID NO: 57804

SEQ ID NO: 63845 - RNA, 63 nt, hsa; identical to SEQ ID NO: 57805

SEQ ID NO: 63846 - RNA, 63 nt, hsa; identical to SEQ ID NO: 57806

SEQ ID NO: 63847 - RNA, 63 nt, hsa; identical to SEQ ID NO: 57807

SEQ ID NO: 63848 - RNA, 63 nt, hsa; identical to SEQ ID NO: 57808

SEQ ID NO: 63849 - RNA, 63 nt, hsa; identical to SEQ ID NO: 57809

SEQ ID NO: 63850 - RNA, 63 nt, hsa; identical to SEQ ID NO: 57810

SEQ ID NO: 63851 - RNA, 63 nt, hsa; identical to SEQ ID NO: 57811

SEQ ID NO: 63852 - RNA, 63 nt, hsa; identical to SEQ ID NO: 57812

SEQ ID NO: 63853 - RNA, 63 nt, hsa; identical to SEQ ID NO: 57813

SEQ ID NO: 63854 - RNA, 63 nt, hsa; identical to SEQ ID NO: 57814

SEQ ID NO: 63855 - RNA, 63 nt, hsa; identical to SEQ ID NO: 57815

SEQ ID NO: 63856 - RNA, 63 nt, hsa; identical to SEQ ID NO: 57816

SEQ ID NO: 63857 - RNA, 63 nt, hsa; identical to SEQ ID NO: 57817

SEQ ID NO: 63858 - RNA, 63 nt, hsa; identical to SEQ ID NO: 57818

SEQ ID NO: 63859 - RNA, 63 nt, hsa; identical to SEQ ID NO: 57819

SEQ ID NO: 63860 - RNA, 63 nt, hsa; identical to SEQ ID NO: 57820

SEQ ID NO: 63861 - RNA, 63 nt, hsa; identical to SEQ ID NO: 57821

SEQ ID NO: 63862 - RNA, 63 nt, hsa; identical to SEQ ID NO: 57822

SEQ ID NO: 63863 - RNA, 63 nt, hsa; identical to SEQ ID NO: 57823

SEQ ID NO: 63864 - RNA, 63 nt, hsa; identical to SEQ ID NO: 57824

SEQ ID NO: 63865 - RNA, 63 nt, hsa; identical to SEQ ID NO: 57825

SEQ ID NO: 63866 - RNA, 63 nt, hsa; identical to SEQ ID NO: 57826

SEQ ID NO: 63867 - RNA, 63 nt, hsa; identical to SEQ ID NO: 57827

SEQ ID NO: 63868 - RNA, 63 nt, hsa; identical to SEQ ID NO: 57828

SEQ ID NO: 63869 - RNA, 63 nt, hsa; identical to SEQ ID NO: 57829

SEQ ID NO: 63870 - RNA, 63 nt, hsa; identical to SEQ ID NO: 57830

SEQ ID NO: 63871 - RNA, 63 nt, hsa; identical to SEQ ID NO: 57831

SEQ ID NO: 63872 - RNA, 63 nt, hsa; identical to SEQ ID NO: 57832

SEQ ID NO: 63873 - RNA, 63 nt, hsa; identical to SEQ ID NO: 57833

SEQ ID NO: 63874 - RNA, 63 nt, hsa; identical to SEQ ID NO: 57834

SEQ ID NO: 63875 - RNA, 63 nt, hsa; identical to SEQ ID NO: 57835

SEQ ID NO: 63876 - RNA, 63 nt, hsa; identical to SEQ ID NO: 57836

SEQ ID NO: 63877 - RNA, 63 nt, hsa; identical to SEQ ID NO: 57837

SEQ ID NO: 63878 - RNA, 63 nt, hsa; identical to SEQ ID NO: 57838

SEQ ID NO: 63879 - RNA, 63 nt, hsa; identical to SEQ ID NO: 57839

SEQ ID NO: 63880 - RNA, 63 nt, hsa; identical to SEQ ID NO: 57840

SEQ ID NO: 63881 - RNA, 63 nt, hsa; identical to SEQ ID NO: 57841

SEQ ID NO: 63882 - RNA, 63 nt, hsa; identical to SEQ ID NO: 57842

SEQ ID NO: 63883 - RNA, 63 nt, hsa; identical to SEQ ID NO: 57843

SEQ ID NO: 63884 - RNA, 63 nt, hsa; identical to SEQ ID NO: 57844

SEQ ID NO: 63885 - RNA, 63 nt, hsa; identical to SEQ ID NO: 57845

SEQ ID NO: 63886 - RNA, 63 nt, hsa; identical to SEQ ID NO: 57846

SEQ ID NO: 63887 - RNA, 63 nt, hsa; identical to SEQ ID NO: 57847

SEQ ID NO: 63888 - RNA, 63 nt, hsa; identical to SEQ ID NO: 57848

SEQ ID NO: 63889 - RNA, 63 nt, hsa; identical to SEQ ID NO: 57849

SEQ ID NO: 63890 - RNA, 63 nt, hsa; identical to SEQ ID NO: 57850

SEQ ID NO: 63891 - RNA, 63 nt, hsa; identical to SEQ ID NO: 57851

SEQ ID NO: 63892 - RNA, 63 nt, hsa; identical to SEQ ID NO: 57852

SEQ ID NO: 63893 - RNA, 63 nt, hsa; identical to SEQ ID NO: 57853

SEQ ID NO: 63894 - RNA, 63 nt, hsa; identical to SEQ ID NO: 57854

SEQ ID NO: 63895 - RNA, 63 nt, hsa; identical to SEQ ID NO: 57855

SEQ ID NO: 63896 - RNA, 63 nt, hsa; identical to SEQ ID NO: 57856

SEQ ID NO: 63897 - RNA, 63 nt, hsa; identical to SEQ ID NO: 57857

SEQ ID NO: 63898 - RNA, 63 nt, hsa; identical to SEQ ID NO: 57858

SEQ ID NO: 63899 - RNA, 63 nt, hsa; identical to SEQ ID NO: 57859

SEQ ID NO: 63900 - RNA, 63 nt, hsa; identical to SEQ ID NO: 57860

SEQ ID NO: 63901 - RNA, 63 nt, hsa; identical to SEQ ID NO: 57861

SEQ ID NO: 63902 - RNA, 63 nt, hsa; identical to SEQ ID NO: 57862

SEQ ID NO: 63903 - RNA, 63 nt, hsa; identical to SEQ ID NO: 57863

SEQ ID NO: 63904 - RNA, 63 nt, hsa; identical to SEQ ID NO: 57864

SEQ ID NO: 63905 - RNA, 63 nt, hsa; identical to SEQ ID NO: 57865

SEQ ID NO: 63906 - RNA, 63 nt, hsa; identical to SEQ ID NO: 57866

SEQ ID NO: 63907 - RNA, 63 nt, hsa; identical to SEQ ID NO: 57867

SEQ ID NO: 63908 - RNA, 63 nt, hsa; identical to SEQ ID NO: 57868

SEQ ID NO: 63909 - RNA, 63 nt, hsa; identical to SEQ ID NO: 57869

SEQ ID NO: 63910 - RNA, 63 nt, hsa; identical to SEQ ID NO: 57870

SEQ ID NO: 63911 - RNA, 63 nt, hsa; identical to SEQ ID NO: 57871

SEQ ID NO: 63912 - RNA, 63 nt, hsa; identical to SEQ ID NO: 57872

SEQ ID NO: 63913 - RNA, 63 nt, hsa; identical to SEQ ID NO: 57873

SEQ ID NO: 63914 - RNA, 63 nt, hsa; identical to SEQ ID NO: 57874

SEQ ID NO: 63915 - RNA, 63 nt, hsa; identical to SEQ ID NO: 57875

SEQ ID NO: 63916 - RNA, 63 nt, hsa; identical to SEQ ID NO: 57876

SEQ ID NO: 63917 - RNA, 63 nt, hsa; identical to SEQ ID NO: 57877

SEQ ID NO: 63918 - RNA, 63 nt, hsa; identical to SEQ ID NO: 57878

SEQ ID NO: 63919 - RNA, 63 nt, hsa; identical to SEQ ID NO: 57879

SEQ ID NO: 63920 - RNA, 63 nt, hsa; identical to SEQ ID NO: 57880

SEQ ID NO: 63921 - RNA, 63 nt, hsa; identical to SEQ ID NO: 57881

SEQ ID NO: 63922 - RNA, 63 nt, hsa; identical to SEQ ID NO: 57882

SEQ ID NO: 63923 - RNA, 63 nt, hsa; identical to SEQ ID NO: 57883

SEQ ID NO: 63924 - RNA, 63 nt, hsa; identical to SEQ ID NO: 57884

SEQ ID NO: 63925 - RNA, 63 nt, hsa; identical to SEQ ID NO: 57885

SEQ ID NO: 63926 - RNA, 63 nt, hsa; identical to SEQ ID NO: 57886

SEQ ID NO: 63927 - RNA, 63 nt, hsa; identical to SEQ ID NO: 57887

SEQ ID NO: 63928 - RNA, 63 nt, hsa; identical to SEQ ID NO: 57888

SEQ ID NO: 63929 - RNA, 63 nt, hsa; identical to SEQ ID NO: 57889

SEQ ID NO: 63930 - RNA, 63 nt, hsa; identical to SEQ ID NO: 57890

SEQ ID NO: 63931 - RNA, 63 nt, hsa; identical to SEQ ID NO: 57891

SEQ ID NO: 63932 - RNA, 63 nt, hsa; identical to SEQ ID NO: 57892

SEQ ID NO: 63933 - RNA, 63 nt, hsa; identical to SEQ ID NO: 57893

SEQ ID NO: 63934 - RNA, 63 nt, hsa; identical to SEQ ID NO: 57894

SEQ ID NO: 63935 - RNA, 63 nt, hsa; identical to SEQ ID NO: 57895

SEQ ID NO: 63936 - RNA, 63 nt, hsa; identical to SEQ ID NO: 57896

SEQ ID NO: 63937 - RNA, 63 nt, hsa; identical to SEQ ID NO: 57897

SEQ ID NO: 63938 - RNA, 63 nt, hsa; identical to SEQ ID NO: 57898

SEQ ID NO: 63939 - RNA, 63 nt, hsa; identical to SEQ ID NO: 57899

SEQ ID NO: 63940 - RNA, 63 nt, hsa; identical to SEQ ID NO: 57900

SEQ ID NO: 63941 - RNA, 63 nt, hsa; identical to SEQ ID NO: 57901

SEQ ID NO: 63942 - RNA, 63 nt, hsa; identical to SEQ ID NO: 57902

SEQ ID NO: 63943 - RNA, 63 nt, hsa; identical to SEQ ID NO: 57903

SEQ ID NO: 63944 - RNA, 63 nt, hsa; identical to SEQ ID NO: 57904

SEQ ID NO: 63945 - RNA, 63 nt, hsa; identical to SEQ ID NO: 57905

SEQ ID NO: 63946 - RNA, 63 nt, hsa; identical to SEQ ID NO: 57906

SEQ ID NO: 63947 - RNA, 63 nt, hsa; identical to SEQ ID NO: 57907

SEQ ID NO: 63948 - RNA, 63 nt, hsa; identical to SEQ ID NO: 57908

SEQ ID NO: 63949 - RNA, 63 nt, hsa; identical to SEQ ID NO: 57909

SEQ ID NO: 63950 - RNA, 63 nt, hsa; identical to SEQ ID NO: 57910

SEQ ID NO: 63951 - RNA, 63 nt, hsa; identical to SEQ ID NO: 57911

SEQ ID NO: 63952 - RNA, 63 nt, hsa; identical to SEQ ID NO: 57912

SEQ ID NO: 63953 - RNA, 63 nt, hsa; identical to SEQ ID NO: 57913

SEQ ID NO: 63954 - RNA, 63 nt, hsa; identical to SEQ ID NO: 57914

SEQ ID NO: 63955 - RNA, 63 nt, hsa; identical to SEQ ID NO: 57915

SEQ ID NO: 63956 - RNA, 63 nt, hsa; identical to SEQ ID NO: 57916

SEQ ID NO: 63957 - RNA, 63 nt, hsa; identical to SEQ ID NO: 57917

SEQ ID NO: 63958 - RNA, 63 nt, hsa; identical to SEQ ID NO: 57918

SEQ ID NO: 63959 - RNA, 63 nt, hsa; identical to SEQ ID NO: 57919

SEQ ID NO: 63960 - RNA, 63 nt, hsa; identical to SEQ ID NO: 57920

SEQ ID NO: 63961 - RNA, 63 nt, hsa; identical to SEQ ID NO: 57921

SEQ ID NO: 63962 - RNA, 63 nt, hsa; identical to SEQ ID NO: 57922

SEQ ID NO: 63963 - RNA, 63 nt, hsa; identical to SEQ ID NO: 57923

SEQ ID NO: 63964 - RNA, 63 nt, hsa; identical to SEQ ID NO: 57924

SEQ ID NO: 63965 - RNA, 63 nt, hsa; identical to SEQ ID NO: 57925

SEQ ID NO: 63966 - RNA, 63 nt, hsa; identical to SEQ ID NO: 57926

SEQ ID NO: 63967 - RNA, 63 nt, hsa; identical to SEQ ID NO: 57927

SEQ ID NO: 63968 - RNA, 63 nt, hsa; identical to SEQ ID NO: 57928

SEQ ID NO: 63969 - RNA, 63 nt, hsa; identical to SEQ ID NO: 57929

SEQ ID NO: 63970 - RNA, 63 nt, hsa; identical to SEQ ID NO: 57930

SEQ ID NO: 63971 - RNA, 63 nt, hsa; identical to SEQ ID NO: 57931

SEQ ID NO: 63972 - RNA, 63 nt, hsa; identical to SEQ ID NO: 57932

SEQ ID NO: 63973 - RNA, 63 nt, hsa; identical to SEQ ID NO: 57933

SEQ ID NO: 63974 - RNA, 63 nt, hsa; identical to SEQ ID NO: 57934

SEQ ID NO: 63975 - RNA, 63 nt, hsa; identical to SEQ ID NO: 57935

SEQ ID NO: 63976 - RNA, 63 nt, hsa; identical to SEQ ID NO: 57936

SEQ ID NO: 63977 - RNA, 63 nt, hsa; identical to SEQ ID NO: 57937

SEQ ID NO: 63978 - RNA, 63 nt, hsa; identical to SEQ ID NO: 57938

SEQ ID NO: 63979 - RNA, 63 nt, hsa; identical to SEQ ID NO: 57939

SEQ ID NO: 63980 - RNA, 63 nt, hsa; identical to SEQ ID NO: 57940

SEQ ID NO: 63981 - RNA, 63 nt, hsa; identical to SEQ ID NO: 57941

SEQ ID NO: 63982 - RNA, 63 nt, hsa; identical to SEQ ID NO: 57942

SEQ ID NO: 63983 - RNA, 63 nt, hsa; identical to SEQ ID NO: 57943

SEQ ID NO: 63984 - RNA, 63 nt, hsa; identical to SEQ ID NO: 57944

SEQ ID NO: 63985 - RNA, 63 nt, hsa; identical to SEQ ID NO: 57945

SEQ ID NO: 63986 - RNA, 63 nt, hsa; identical to SEQ ID NO: 57946

SEQ ID NO: 63987 - RNA, 63 nt, hsa; identical to SEQ ID NO: 57947

SEQ ID NO: 63988 - RNA, 63 nt, hsa; identical to SEQ ID NO: 57948

SEQ ID NO: 63989 - RNA, 63 nt, hsa; identical to SEQ ID NO: 57949

SEQ ID NO: 63990 - RNA, 63 nt, hsa; identical to SEQ ID NO: 57950

SEQ ID NO: 63991 - RNA, 63 nt, hsa; identical to SEQ ID NO: 57951

SEQ ID NO: 63992 - RNA, 63 nt, hsa; identical to SEQ ID NO: 57952

SEQ ID NO: 63993 - RNA, 63 nt, hsa; identical to SEQ ID NO: 57953

SEQ ID NO: 63994 - RNA, 63 nt, hsa; identical to SEQ ID NO: 57954

SEQ ID NO: 63995 - RNA, 63 nt, hsa; identical to SEQ ID NO: 57955

SEQ ID NO: 63996 - RNA, 63 nt, hsa; identical to SEQ ID NO: 57956

SEQ ID NO: 63997 - RNA, 63 nt, hsa; identical to SEQ ID NO: 57957

SEQ ID NO: 63998 - RNA, 63 nt, hsa; identical to SEQ ID NO: 57958

SEQ ID NO: 63999 - RNA, 63 nt, hsa; identical to SEQ ID NO: 57959

SEQ ID NO: 64000 - RNA, 63 nt, hsa; identical to SEQ ID NO: 57960

SEQ ID NO: 64001 - RNA, 63 nt, hsa; identical to SEQ ID NO: 57961

SEQ ID NO: 64002 - RNA, 63 nt, hsa; identical to SEQ ID NO: 57962

SEQ ID NO: 64003 - RNA, 63 nt, hsa; identical to SEQ ID NO: 57963

SEQ ID NO: 64004 - RNA, 63 nt, hsa; identical to SEQ ID NO: 57964

SEQ ID NO: 64005 - RNA, 63 nt, hsa; identical to SEQ ID NO: 57965

SEQ ID NO: 64006 - RNA, 63 nt, hsa; identical to SEQ ID NO: 57966

SEQ ID NO: 64007 - RNA, 63 nt, hsa; identical to SEQ ID NO: 57967

SEQ ID NO: 64008 - RNA, 63 nt, hsa; identical to SEQ ID NO: 57968

SEQ ID NO: 64009 - RNA, 63 nt, hsa; identical to SEQ ID NO: 57969

SEQ ID NO: 64010 - RNA, 63 nt, hsa; identical to SEQ ID NO: 57970

SEQ ID NO: 64011 - RNA, 63 nt, hsa; identical to SEQ ID NO: 57971

SEQ ID NO: 64012 - RNA, 63 nt, hsa; identical to SEQ ID NO: 57972

SEQ ID NO: 64013 - RNA, 63 nt, hsa; identical to SEQ ID NO: 57973

SEQ ID NO: 64014 - RNA, 63 nt, hsa; identical to SEQ ID NO: 57974

SEQ ID NO: 64015 - RNA, 63 nt, hsa; identical to SEQ ID NO: 57975

SEQ ID NO: 64016 - RNA, 63 nt, hsa; identical to SEQ ID NO: 57976

SEQ ID NO: 64017 - RNA, 63 nt, hsa; identical to SEQ ID NO: 57977

SEQ ID NO: 64018 - RNA, 63 nt, hsa; identical to SEQ ID NO: 57978

SEQ ID NO: 64019 - RNA, 63 nt, hsa; identical to SEQ ID NO: 57979

SEQ ID NO: 64020 - RNA, 63 nt, hsa; identical to SEQ ID NO: 57980

SEQ ID NO: 64021 - RNA, 63 nt, hsa; identical to SEQ ID NO: 57981

SEQ ID NO: 64022 - RNA, 63 nt, hsa; identical to SEQ ID NO: 57982

SEQ ID NO: 64023 - RNA, 63 nt, hsa; identical to SEQ ID NO: 57983

SEQ ID NO: 64024 - RNA, 63 nt, hsa; identical to SEQ ID NO: 57984

SEQ ID NO: 64025 - RNA, 63 nt, hsa; identical to SEQ ID NO: 57985

SEQ ID NO: 64026 - RNA, 63 nt, hsa; identical to SEQ ID NO: 57984

SEQ ID NO: 64027 - RNA, 63 nt, hsa; identical to SEQ ID NO: 57987

SEQ ID NO: 64028 - RNA, 63 nt, hsa; identical to SEQ ID NO: 57988

SEQ ID NO: 64029 - RNA, 63 nt, hsa; identical to SEQ ID NO: 57989

SEQ ID NO: 64030 - RNA, 63 nt, hsa; identical to SEQ ID NO: 57990

SEQ ID NO: 64031 - RNA, 63 nt, hsa; identical to SEQ ID NO: 57991

SEQ ID NO: 64032 - RNA, 63 nt, hsa; identical to SEQ ID NO: 57992

SEQ ID NO: 64033 - RNA, 63 nt, hsa; identical to SEQ ID NO: 57993

SEQ ID NO: 64034 - RNA, 63 nt, hsa; identical to SEQ ID NO: 57994

SEQ ID NO: 64035 - RNA, 63 nt, hsa; identical to SEQ ID NO: 57995

SEQ ID NO: 64036 - RNA, 63 nt, hsa; identical to SEQ ID NO: 57996

SEQ ID NO: 64037 - RNA, 63 nt, hsa; identical to SEQ ID NO: 57997

SEQ ID NO: 64038 - RNA, 63 nt, hsa; identical to SEQ ID NO: 57998

SEQ ID NO: 64039 - RNA, 63 nt, hsa; identical to SEQ ID NO: 57999

SEQ ID NO: 64040 - RNA, 63 nt, hsa; identical to SEQ ID NO: 58000

SEQ ID NO: 64041 - RNA, 63 nt, hsa; identical to SEQ ID NO: 58001

SEQ ID NO: 64042 - RNA, 63 nt, hsa; identical to SEQ ID NO: 58002

SEQ ID NO: 64043 - RNA, 63 nt, hsa; identical to SEQ ID NO: 58003

SEQ ID NO: 64044 - RNA, 63 nt, hsa; identical to SEQ ID NO: 58004

SEQ ID NO: 64045 - RNA, 63 nt, hsa; identical to SEQ ID NO: 58005

SEQ ID NO: 64046 - RNA, 63 nt, hsa; identical to SEQ ID NO: 58006

SEQ ID NO: 64047 - RNA, 63 nt, hsa; identical to SEQ ID NO: 58007

SEQ ID NO: 64048 - RNA, 63 nt, hsa; identical to SEQ ID NO: 58008

SEQ ID NO: 64049 - RNA, 63 nt, hsa; identical to SEQ ID NO: 58009

SEQ ID NO: 64050 - RNA, 63 nt, hsa; identical to SEQ ID NO: 58010

SEQ ID NO: 64051 - RNA, 63 nt, hsa; identical to SEQ ID NO: 58011

SEQ ID NO: 64052 - RNA, 63 nt, hsa; identical to SEQ ID NO: 58012

SEQ ID NO: 64053 - RNA, 63 nt, hsa; identical to SEQ ID NO: 58013

SEQ ID NO: 64054 - RNA, 63 nt, hsa; identical to SEQ ID NO: 58014

SEQ ID NO: 64055 - RNA, 63 nt, hsa; identical to SEQ ID NO: 58015

SEQ ID NO: 64056 - RNA, 63 nt, hsa; identical to SEQ ID NO: 58016

SEQ ID NO: 64057 - RNA, 63 nt, hsa; identical to SEQ ID NO: 58017

SEQ ID NO: 64058 - RNA, 63 nt, hsa; identical to SEQ ID NO: 58018

SEQ ID NO: 64059 - RNA, 63 nt, hsa; identical to SEQ ID NO: 58019

SEQ ID NO: 64060 - RNA, 63 nt, hsa; identical to SEQ ID NO: 58020

SEQ ID NO: 64061 - RNA, 63 nt, hsa; identical to SEQ ID NO: 58021

SEQ ID NO: 64062 - RNA, 63 nt, hsa; identical to SEQ ID NO: 58022

SEQ ID NO: 64063 - RNA, 63 nt, hsa; identical to SEQ ID NO: 58023

SEQ ID NO: 64064 - RNA, 63 nt, hsa; identical to SEQ ID NO: 58024

SEQ ID NO: 64065 - RNA, 63 nt, hsa; identical to SEQ ID NO: 58025

SEQ ID NO: 64066 - RNA, 63 nt, hsa; identical to SEQ ID NO: 58026

SEQ ID NO: 64067 - RNA, 63 nt, hsa; identical to SEQ ID NO: 58027

SEQ ID NO: 64068 - RNA, 63 nt, hsa; identical to SEQ ID NO: 58028

SEQ ID NO: 64069 - RNA, 63 nt, hsa; identical to SEQ ID NO: 58029

SEQ ID NO: 64070 - RNA, 63 nt, hsa; identical to SEQ ID NO: 58030

SEQ ID NO: 64071 - RNA, 63 nt, hsa; identical to SEQ ID NO: 58031

SEQ ID NO: 64072 - RNA, 63 nt, hsa; identical to SEQ ID NO: 58032

SEQ ID NO: 64073 - RNA, 63 nt, hsa; identical to SEQ ID NO: 58033

SEQ ID NO: 64074 - RNA, 57 nt, hsa; identical to SEQ ID NO: 58034

SEQ ID NO: 64075 - RNA, 63 nt, hsa; identical to SEQ ID NO: 58035

SEQ ID NO: 64076 - RNA, 63 nt, hsa; identical to SEQ ID NO: 58036

SEQ ID NO: 64077 - RNA, 63 nt, hsa; identical to SEQ ID NO: 58037

SEQ ID NO: 64078 - RNA, 63 nt, hsa; identical to SEQ ID NO: 58038

SEQ ID NO: 64079 - RNA, 63 nt, hsa; identical to SEQ ID NO: 58039

SEQ ID NO: 64080 - RNA, 63 nt, hsa; identical to SEQ ID NO: 58040

SEQ ID NO: 64081 - RNA, 63 nt, hsa; identical to SEQ ID NO: 58041

SEQ ID NO: 64082 - RNA, 63 nt, hsa; identical to SEQ ID NO: 58042

SEQ ID NO: 64083 - RNA, 63 nt, hsa; identical to SEQ ID NO: 58043

SEQ ID NO: 64084 - RNA, 63 nt, hsa; identical to SEQ ID NO: 58044

SEQ ID NO: 64085 - RNA, 63 nt, hsa; identical to SEQ ID NO: 58045

SEQ ID NO: 64086 - RNA, 63 nt, hsa; identical to SEQ ID NO: 58046

SEQ ID NO: 64087 - RNA, 63 nt, hsa; identical to SEQ ID NO: 58047

SEQ ID NO: 64088 - RNA, 63 nt, hsa; identical to SEQ ID NO: 58048

SEQ ID NO: 64089 - RNA, 63 nt, hsa; identical to SEQ ID NO: 58049

SEQ ID NO: 64090 - RNA, 63 nt, hsa; identical to SEQ ID NO: 58050

SEQ ID NO: 64091 - RNA, 63 nt, hsa; identical to SEQ ID NO: 58051

SEQ ID NO: 64092 - RNA, 63 nt, hsa; identical to SEQ ID NO: 58052

SEQ ID NO: 64093 - RNA, 61 nt, hsa; identical to SEQ ID NO: 58053

SEQ ID NO: 64094 - RNA, 63 nt, hsa; identical to SEQ ID NO: 58054

SEQ ID NO: 64095 - RNA, 63 nt, hsa; identical to SEQ ID NO: 58055

SEQ ID NO: 64096 - RNA, 63 nt, hsa; identical to SEQ ID NO: 58056

SEQ ID NO: 64097 - RNA, 63 nt, hsa; identical to SEQ ID NO: 58057

SEQ ID NO: 64098 - RNA, 63 nt, hsa; identical to SEQ ID NO: 58058

SEQ ID NO: 64099 - RNA, 63 nt, hsa; identical to SEQ ID NO: 58059

SEQ ID NO: 64100 - RNA, 63 nt, hsa; identical to SEQ ID NO: 58060

SEQ ID NO: 64101 - RNA, 63 nt, hsa; identical to SEQ ID NO: 58061

SEQ ID NO: 64102 - RNA, 63 nt, hsa; identical to SEQ ID NO: 58062

SEQ ID NO: 64103 - RNA, 63 nt, hsa; identical to SEQ ID NO: 58063

SEQ ID NO: 64104 - RNA, 63 nt, hsa; identical to SEQ ID NO: 58064

SEQ ID NO: 64105 - RNA, 55 nt, hsa; identical to SEQ ID NO: 58065

SEQ ID NO: 64106 - RNA, 63 nt, hsa; identical to SEQ ID NO: 58066

SEQ ID NO: 64107 - RNA, 63 nt, hsa; identical to SEQ ID NO: 58067

SEQ ID NO: 64108 - RNA, 63 nt, hsa; identical to SEQ ID NO: 58068

SEQ ID NO: 64109 - RNA, 63 nt, hsa; identical to SEQ ID NO: 58069

SEQ ID NO: 64110 - RNA, 63 nt, hsa; identical to SEQ ID NO: 58070

SEQ ID NO: 64111 - RNA, 63 nt, hsa; identical to SEQ ID NO: 58071

SEQ ID NO: 64112 - RNA, 63 nt, hsa; identical to SEQ ID NO: 58072

SEQ ID NO: 64113 - RNA, 63 nt, hsa; identical to SEQ ID NO: 58073

SEQ ID NO: 64114 - RNA, 63 nt, hsa; identical to SEQ ID NO: 58074

SEQ ID NO: 64115 - RNA, 63 nt, hsa; identical to SEQ ID NO: 58075

SEQ ID NO: 64116 - RNA, 63 nt, hsa; identical to SEQ ID NO: 58076

SEQ ID NO: 64117 - RNA, 63 nt, hsa; identical to SEQ ID NO: 58077

SEQ ID NO: 64118 - RNA, 63 nt, hsa; identical to SEQ ID NO: 58078

SEQ ID NO: 64119 - RNA, 63 nt, hsa; identical to SEQ ID NO: 58079

SEQ ID NO: 64120 - RNA, 63 nt, hsa; identical to SEQ ID NO: 58080

SEQ ID NO: 64121 - RNA, 63 nt, hsa; identical to SEQ ID NO: 58081

SEQ ID NO: 64122 - RNA, 63 nt, hsa; identical to SEQ ID NO: 58082

SEQ ID NO: 64123 - RNA, 63 nt, hsa; identical to SEQ ID NO: 58083

SEQ ID NO: 64124 - RNA, 63 nt, hsa; identical to SEQ ID NO: 58084

SEQ ID NO: 64125 - RNA, 63 nt, hsa; identical to SEQ ID NO: 58085

SEQ ID NO: 64126 - RNA, 63 nt, hsa; identical to SEQ ID NO: 58086

SEQ ID NO: 64127 - RNA, 63 nt, hsa; identical to SEQ ID NO: 58087

SEQ ID NO: 64128 - RNA, 63 nt, hsa; identical to SEQ ID NO: 58088

SEQ ID NO: 64129 - RNA, 63 nt, hsa; identical to SEQ ID NO: 58089

SEQ ID NO: 64130 - RNA, 63 nt, hsa; identical to SEQ ID NO: 58087

SEQ ID NO: 64131 - RNA, 63 nt, hsa; identical to SEQ ID NO: 58091

SEQ ID NO: 64132 - RNA, 63 nt, hsa; identical to SEQ ID NO: 58092

SEQ ID NO: 64133 - RNA, 63 nt, hsa; identical to SEQ ID NO: 58093

SEQ ID NO: 64134 - RNA, 63 nt, hsa; identical to SEQ ID NO: 58094

SEQ ID NO: 64135 - RNA, 63 nt, hsa; identical to SEQ ID NO: 58095

SEQ ID NO: 64136 - RNA, 63 nt, hsa; identical to SEQ ID NO: 58096

SEQ ID NO: 64137 - RNA, 63 nt, hsa; identical to SEQ ID NO: 58097

SEQ ID NO: 64138 - RNA, 63 nt, hsa; identical to SEQ ID NO: 58098

SEQ ID NO: 64139 - RNA, 63 nt, hsa; identical to SEQ ID NO: 58099

SEQ ID NO: 64140 - RNA, 63 nt, hsa; identical to SEQ ID NO: 58100

SEQ ID NO: 64141 - RNA, 63 nt, hsa; identical to SEQ ID NO: 58101

SEQ ID NO: 64142 - RNA, 63 nt, hsa; identical to SEQ ID NO: 58102

SEQ ID NO: 64143 - RNA, 63 nt, hsa; identical to SEQ ID NO: 58103

SEQ ID NO: 64144 - RNA, 63 nt, hsa; identical to SEQ ID NO: 58104

SEQ ID NO: 64145 - RNA, 63 nt, hsa; identical to SEQ ID NO: 58105

SEQ ID NO: 64146 - RNA, 63 nt, hsa; identical to SEQ ID NO: 58106

SEQ ID NO: 64147 - RNA, 63 nt, hsa; identical to SEQ ID NO: 58107

SEQ ID NO: 64148 - RNA, 63 nt, hsa; identical to SEQ ID NO: 58108

SEQ ID NO: 64149 - RNA, 63 nt, hsa; identical to SEQ ID NO: 58109

SEQ ID NO: 64150 - RNA, 63 nt, hsa; identical to SEQ ID NO: 58110

SEQ ID NO: 64151 - RNA, 63 nt, hsa; identical to SEQ ID NO: 58111

SEQ ID NO: 64152 - RNA, 63 nt, hsa; identical to SEQ ID NO: 58112

SEQ ID NO: 64153 - RNA, 63 nt, hsa; identical to SEQ ID NO: 58113

SEQ ID NO: 64154 - RNA, 63 nt, hsa; identical to SEQ ID NO: 58114

SEQ ID NO: 64155 - RNA, 63 nt, hsa; identical to SEQ ID NO: 58115

SEQ ID NO: 64156 - RNA, 63 nt, hsa; identical to SEQ ID NO: 58116

SEQ ID NO: 64157 - RNA, 63 nt, hsa; identical to SEQ ID NO: 58117

SEQ ID NO: 64158 - RNA, 63 nt, hsa; identical to SEQ ID NO: 58118

SEQ ID NO: 64159 - RNA, 63 nt, hsa; identical to SEQ ID NO: 58119

SEQ ID NO: 64160 - RNA, 63 nt, hsa; identical to SEQ ID NO: 58120

SEQ ID NO: 64161 - RNA, 63 nt, hsa; identical to SEQ ID NO: 58121

SEQ ID NO: 64162 - RNA, 63 nt, hsa; identical to SEQ ID NO: 58122

SEQ ID NO: 64163 - RNA, 63 nt, hsa; identical to SEQ ID NO: 58123

SEQ ID NO: 64164 - RNA, 63 nt, hsa; identical to SEQ ID NO: 58124

SEQ ID NO: 64165 - RNA, 63 nt, hsa; identical to SEQ ID NO: 58125

SEQ ID NO: 64166 - RNA, 63 nt, hsa; identical to SEQ ID NO: 58126

SEQ ID NO: 64167 - RNA, 63 nt, hsa; identical to SEQ ID NO: 58127

SEQ ID NO: 64168 - RNA, 63 nt, hsa; identical to SEQ ID NO: 58128

SEQ ID NO: 64169 - RNA, 63 nt, hsa; identical to SEQ ID NO: 58129

SEQ ID NO: 64170 - RNA, 63 nt, hsa; identical to SEQ ID NO: 58130

SEQ ID NO: 64171 - RNA, 63 nt, hsa; identical to SEQ ID NO: 58131

SEQ ID NO: 64172 - RNA, 62 nt, hsa
gcccaggccugugucccaagcaguacccaggcuuugcagaccacgcggggcagggcuccacu

SEQ ID NO: 64173 - RNA, 62 nt, hsa
gaaaucugcagguuuuuaaugucuuguggaaauuugcagaggggcaggugugugguaaacgg

SEQ ID NO: 64174 - RNA, 62 nt, hsa
uacaaauugugucuauacauuucuaagccuuguuugcagaauaaacagggcauuuagcaaac

SEQ ID NO: 64175 - RNA, 62 nt, hsa
aaaucuuuuuucuuuuuuaauuaaaaaaaauauuugcagagaugagcucuugcuauguugcc

SEQ ID NO: 64176 - RNA, 62 nt, hsa
gcagggacgguugccuuuccugggaagggcaguuugcagaaccagggguuuauauugcaggg

SEQ ID NO: 64177 - RNA, 62 nt, hsa
caucucgccuguuggcucagugcuucaucccauuugcagagccucagacacgucuugguggu

SEQ ID NO: 64178 - RNA, 62 nt, hsa
ugaaauucucaucaguccauugcucuugagucuuugcagagaaccucagaucaggugcaccu

SEQ ID NO: 64179 - RNA, 62 nt, hsa
ugccugggcugggaaaggggccuuucuuuuguuuugcagauagauccacccacugaggaacu

SEQ ID NO: 64180 - RNA, 62 nt, hsa
aaaggaaggagagaaggggcuucucagacuuauuugcagaagggcccagaacucaguaugaa

SEQ ID NO: 64181 - RNA, 62 nt, hsa
ucuggccuaaccauggagauauugguuaucaguuugcagaugaauacacaguucuauccaac

SEQ ID NO: 64182 - RNA, 62 nt, hsa
cggcugccugggcugagggcucgcuccagggcuuugcagacuggacccuuaccgguggcucu

SEQ ID NO: 64183 - RNA, 62 nt, hsa
caggggggccuccuccuaggauaauaaacaauuuugcagaauuggacucccccucacucgca

SEQ ID NO: 64184 - RNA, 62 nt, hsa
guucuuucacuuggaauuacuaagaucggaguuuugcagagguugauuaaagcaaccauacc

SEQ ID NO: 64185 - RNA, 62 nt, hsa
acuuuaggaaaugagguuucauaauucugccuuuugcagauuuuuuuacuuuaaagcuguca

SEQ ID NO: 64186 - RNA, 62 nt, hsa
aagggcccccaagguggucaugacuggucucauuugcagaagucuaagaauguaccuuuuuc

SEQ ID NO: 64187 - RNA, 62 nt, hsa
cuacauguucugggggcccggagauagaugacuuugcagauggaaagaggugaaaaugaaga

SEQ ID NO: 64188 - RNA, 62 nt, hsa
uacucuuguuuuugcauaacugguuuuguuuuuuugcagaauuaacuauaacaaucacuggc

SEQ ID NO: 64189 - RNA, 62 nt, hsa
uuucuuaagaccugucgucaaacuuaaaagguuuugcagagggcaguaucaaaagaaagugg

SEQ ID NO: 64190 - RNA, 62 nt, hsa
acagcagaggccaugcaguauuauauauucauuuugcagaaucugcaccuacagcucaauac

SEQ ID NO: 64191 - RNA, 62 nt, hsa
ucuggaaauacugucuucuguuuccuuuugccuuugcagaaugugcuuuagccuuugucuga

SEQ ID NO: 64192 - RNA, 62 nt, hsa
cugcauaugagugauaugugaucaugauucauuuugcagauuuacauuuugcuuguguggaa

SEQ ID NO: 64193 - RNA, 62 nt, hsa
cguuuguuuccccgguggcccuugcuucuugcuuugcagacugccugcagccaugauuuugu

SEQ ID NO: 64194 - RNA, 62 nt, hsa
cucuccugccgcucccugcagaggaugcucguuuugcagagaaggcaguguuccucuauucc

SEQ ID NO: 64195 - RNA, 62 nt, hsa
uccuacagcagcugugucuccaacguugagacuuugcagauggcacagacuccauggauaau

SEQ ID NO: 64196 - RNA, 62 nt, hsa
uuaggggaugacaucccaaacagcccggaguauuugcagaaggcucaggcaacgagugggcc

SEQ ID NO: 64197 - RNA, 62 nt, hsa
aucuaugccuaacagagccccaguacaacuauuuugcagaauggcuguuacccuagaauuac

SEQ ID NO: 64198 - RNA, 62 nt, hsa
ugucuaauaaauauugacuucucuugaauuauuuugcagacuagugagucuguaccauaagu

SEQ ID NO: 64199 - RNA, 62 nt, hsa
ggccaauaccugccuuccaaagagauccuaccuuugcagauuugcuccuuucccauugccuu

SEQ ID NO: 64200 - RNA, 62 nt, hsa
accuuaaagaccaucugguaucaucuucucauuuugcagaagagaaacugaggcccagaggc

SEQ ID NO: 64201 - RNA, 62 nt, hsa
ggugaucuacauuugggugcuuguuucugagauuugcagagaaguauaacaugguaguuccu

SEQ ID NO: 64202 - RNA, 62 nt, hsa
auuuacaucacuuuagaaaccacacucacacuuuugcagaguguugagcuuaauaacuaccu

SEQ ID NO: 64203 - RNA, 62 nt, hsa
uaaaaaacaauuaucccuuacagacuugaacauuugcagacguuaugaucuugcuuccaacu

SEQ ID NO: 64204 - RNA, 62 nt, hsa
aaaacaagcugggcacacuguuaaaucaugauuuugcagaaccuuugguuuuggacaguuuc

SEQ ID NO: 64205 - RNA, 62 nt, hsa
cccacucuauaagcagggcuaauuguguacccuuugcagaaaugcuuuuggucuccuaccca

SEQ ID NO: 64206 - RNA, 62 nt, hsa
cagggucuuagguuggggagugugaauaggaguuugcagauggagaauaggaagggcauucc

SEQ ID NO: 64207 - RNA, 62 nt, hsa
cuguguugcuugugaagcgguguaguagcauuuuugcagauucuuggcuggguuuaguguac

SEQ ID NO: 64208 - RNA, 62 nt, hsa
gugucuguccacugacgacugucaaggccucauuugcagaggccaccggagcuagggcacua

SEQ ID NO: 64209 - RNA, 62 nt, hsa
cauugaggagacuccacagacugaaaagugaguuugcagaaaccuuggggaaaagggcccuu

SEQ ID NO: 64210 - RNA, 62 nt, hsa
guguggcuggcaaccucgacucccuggugcucuuugcagaguugggcagugaaauuaccuuu

SEQ ID NO: 64211 - RNA, 62 nt, hsa
uguuuaguucuuaguggguuaauuuuuguacuuuugcagaagaaacuucagcaagcuagaac

SEQ ID NO: 64212 - RNA, 62 nt, hsa
ccugugucuuucuucucuuaccagagcaucuguuugcagagguaacauuaccuuccccagcc

SEQ ID NO: 64213 - RNA, 62 nt, hsa
uccaguuguacuuaaguguguaacaggaauauuuugcagaauauagguuuaacugaaugaag

SEQ ID NO: 64214 - RNA, 62 nt, hsa
ugaaaacaaaaguaaugggaauuuuaaauacguuugcagaaacugccccuccccucauugag

SEQ ID NO: 64215 - RNA, 62 nt, hsa
uucaaauuugugucauaccagaaagcucuacauuugcagauguucaaauauuguaaaacuuu

SEQ ID NO: 64216 - RNA, 62 nt, hsa
cauuuuuucccaaguagcuggggcucuuccauuuugcagauaagucaaauaaucaacacuaa

SEQ ID NO: 64217 - RNA, 62 nt, hsa
aaugcaaguucuaaaaauagacuaaggaugccuuugcagaacaccaaagcaucccaaggaac

SEQ ID NO: 64218 - RNA, 62 nt, hsa
aaaacagaagcacaaauuuuggugaauugggauuugcagagaugaaaaagacugggugaccu

SEQ ID NO: 64219 - RNA, 62 nt, hsa
uccaauaggcguagcuauccggacagagcacguuugcagaagggggucucuucuuccaggua

SEQ ID NO: 64220 - RNA, 62 nt, hsa
guuuggaaaaaacugcaaaucagaaagaaugauuugcagaaagaaagaaaaacuauggugua

SEQ ID NO: 64221 - RNA, 62 nt, hsa
ggugcugcuguguguggacugaacaccugcacuuugcagaggacacgcugcaugggccccgc

SEQ ID NO: 64222 - RNA, 62 nt, hsa
ggauaggcauuagaugaauagagaauauuaauuuugcagaaaugaaggaaaaucucuucgug

SEQ ID NO: 64223 - RNA, 62 nt, hsa
uggaguuauugaagcagaguggcagucuucaguuugcagaguaggggucugucuuuuaaacu

SEQ ID NO: 64224 - RNA, 62 nt, hsa
ucaacucugugagguggauaccaauauucuauuuugcagauagaauuuggcccagagagguu

SEQ ID NO: 64225 - RNA, 62 nt, hsa
ccuccacggcccacuucauuuucuguucucauuuugcagaguugcacaaggagagaacucag

SEQ ID NO: 64226 - RNA, 62 nt, hsa
gagaaugcaacacuauaaaagcuggucaaauuuuugcagagcccuuauucuguguguuuuuu

SEQ ID NO: 64227 - RNA, 62 nt, hsa
auuaguagauggcucacuagacauguuuuuguuuugcagacauuauauccauuccaguccuc

SEQ ID NO: 64228 - RNA, 62 nt, hsa
uuccuuuccaagccgucgaacagacugugggauuugcagaguguuucuuccaugucuuugac

SEQ ID NO: 64229 - RNA, 62 nt, hsa
guuccacugagcuccaugugcccccucuaccauuugcagaguccugcacaguuuucuggcug

SEQ ID NO: 64230 - RNA, 62 nt, hsa
auugguauguaaaagauuucuucaagcuccauuuugcagagaccaccacuuagagaaucaaa

SEQ ID NO: 64231 - RNA, 62 nt, hsa
aaaauaaagaggagaaaggcuuaggaaguuuuuuugcagagagugcugguaaagaauugagc

SEQ ID NO: 64232 - RNA, 62 nt, hsa
gagcacugauuuuugauagacuaaguggaaaauuugcagagaaaugaugguuguaaguggac

SEQ ID NO: 64233 - RNA, 62 nt, hsa
gaaaagccuauuagauguuuuacaaauuuaauuuugcagauuauuuuagucugucauccaga

SEQ ID NO: 64234 - RNA, 62 nt, hsa
aauuuuggcacgaugaauuauuuuuguuucucuuugcagagagccaaauauggggcugaugg

SEQ ID NO: 64235 - RNA, 62 nt, hsa
uuaagagaagagcagaucaugcuauugugacauuugcagagauauacacacacuuuuuguac

SEQ ID NO: 64236 - RNA, 62 nt, hsa
agugauuggaacccacguuugcacaaaacauuuuugcagaaggaaagucaacacuucuugcu

SEQ ID NO: 64237 - RNA, 62 nt, hsa
gucuuggagagauggggaaggcuuucagcugauuugcagaaguugcccaugugggccccagc

SEQ ID NO: 64238 - RNA, 62 nt, hsa
ggucugugacuauaguuaaacuucacuaagaauuugcagaauuguuuugagaugugugaaua

SEQ ID NO: 64239 - RNA, 62 nt, hsa
uuuucuaaaauugaggagaaggaaguuauauauuugcagaauguuuuaaagugaauuguugu

SEQ ID NO: 64240 - RNA, 62 nt, hsa
auuuagaauaaauuaguuuucugcuuucuaauuuugcagaucuuuacauuuuuauugcuuuu

SEQ ID NO: 64241 - RNA, 62 nt, hsa
cuacugagaagugaccuggaagugagaaguucuuugcagauuuggggcgaggggugauuugg

SEQ ID NO: 64242 - RNA, 62 nt, hsa
cgauauuaguccuacaccaauugaagugaaauuuugcagaugugccuaugagcacaaacuuc

SEQ ID NO: 64243 - RNA, 62 nt, hsa
uccaagcugcuuuucauuuacggccucuuucuuuugcagaaaugugaguuccuccucuugaa

SEQ ID NO: 64244 - RNA, 62 nt, hsa
ucaucccugacucagcuuuuaccuuaauuuuauuugcagaggauucuuuucucaaaaugcuc

SEQ ID NO: 64245 - RNA, 62 nt, hsa
ggccugcaggugucuagggucucagcuuuucauuugcagaggacauguucaacuuccucucu

SEQ ID NO: 64246 - RNA, 62 nt, hsa
cacuuggguggagaccaguugaccauagagcauuugcagagccucauuguuugauuucuugu

SEQ ID NO: 64247 - RNA, 62 nt, hsa
cuaugggugacacaagagcuguccacuggguguuugcagaauaauuacacuaucuuaugucu

SEQ ID NO: 64248 - RNA, 62 nt, hsa
uaaagcauuuaccauauccuaaauuugcacucuuugcagacuugugcacauauauuccgcuu

SEQ ID NO: 64249 - RNA, 62 nt, hsa
acuuuuaggucaguuccuauuaaaugagcucuuuugcagauagcacauucaguagccuuauu

SEQ ID NO: 64250 - RNA, 62 nt, hsa
ccaaagaguaugguuaacuucacgcagcugcuuuugcagaagcacuaauaaaaacaaauauu

SEQ ID NO: 64251 - RNA, 62 nt, hsa
uccuuuuuucuccuuccccuagccuauugggcuuugcagauaucuggaguguuuuaaaguca

SEQ ID NO: 64252 - RNA, 62 nt, hsa
ggaggcauuggugauguucggcucacauauuguuugcagacacacaagaaaucuggcuuggc

SEQ ID NO: 64253 - RNA, 62 nt, hsa
cucuaucaaucaguaguuagcauccaagagacuuugcagaggcguaggaaugaggcuggaca

SEQ ID NO: 64254 - RNA, 62 nt, hsa
gccccuugcugcuggcucccaucucccucccauuugcagaccaggaaggaagagcaagcugu

SEQ ID NO: 64255 - RNA, 62 nt, hsa
cacugccuacuugcugcagggagaugaaaggcuuugcagaaagcuuugagcucuguggggga

SEQ ID NO: 64256 - RNA, 62 nt, hsa
acucuaugcuagauuugagauuaaaguggucauuugcagaucuccaacucacacagauacuu

SEQ ID NO: 64257 - RNA, 62 nt, hsa
guauuaaaaccucucuuacuuuuaaacuugauuuugcagacucuggcaauaagccuuccaaa

SEQ ID NO: 64258 - RNA, 62 nt, hsa
auauuugugguuuagaaggcauauugaguuauuuugcagaaucauaauggacccgcacaaaa

SEQ ID NO: 64259 - RNA, 62 nt, hsa
uuguuuuaaauauguauuauguguauauauuguuugcagacauuauuguucaugccuuagag

SEQ ID NO: 64260 - RNA, 62 nt, hsa
gaaaauaucagaaucugaguuuuacuugaaauuuugcagaauacccagguggagugaaaauu

SEQ ID NO: 64261 - RNA, 62 nt, hsa
uagguuuaagaugaccaaugacaaugaccaccuuugcagaaaguaaacugauugaauaaaua

SEQ ID NO: 64262 - RNA, 62 nt, hsa
ugaugugugaacugcuaagggccaaaugaacguuugcagagcagugggcacaauguuuacaa

SEQ ID NO: 64263 - RNA, 62 nt, hsa
cccucaagaauagcuucagauccucuuguguauuugcagaauacacaaggucauuucccagu

SEQ ID NO: 64264 - RNA, 62 nt, hsa
aaaaauccuuuauaaucaggacugagucuugguuugcagaagcugucacuuacccugaaaca

SEQ ID NO: 64265 - RNA, 62 nt, hsa
gaaaaaugccuuucuguuccccucucaugacauuugcagauacaaaagauggaaauuuuucu

SEQ ID NO: 64266 - RNA, 62 nt, hsa
agugucagcuuugcucagugugguggaaacauuuugcagaacuguuguagaaagcugccuua

SEQ ID NO: 64267 - RNA, 62 nt, hsa
caccccacaggaggguaauuuucuaacucuaguuugcagaggagcaaauugagguucagcaa

SEQ ID NO: 64268 - RNA, 62 nt, hsa
ccggggauucuuccacuccugaaaugaguugauuugcagauaacucacaacuucuuaagcua

SEQ ID NO: 64269 - RNA, 62 nt, hsa
aauauaccgaaauauuuccauuguuucccuuuuuugcagagcauguggaaguuaaaccugcu

SEQ ID NO: 64270 - RNA, 62 nt, hsa
augaggccacaaccccuaggccccucaggagcuuugcagagaggaggacguguacuccaggc

SEQ ID NO: 64271 - RNA, 62 nt, hsa
ucugcaaggacauuucucaagggccaugugguuuugcagacaacccuguccucaggccugaa

SEQ ID NO: 64272 - RNA, 62 nt, hsa
gaagauggauugguguaaaaggaugggucugguuugcagagcuugaacacagucucacccag

SEQ ID NO: 64273 - RNA, 62 nt, hsa
cagagcagcuacuucuaagccauaucgacuguuuugcagaggauuugugugugcugccucag

SEQ ID NO: 64274 - RNA, 62 nt, hsa
ugcugagccaguacagccacaaacaguacuauuuugcagaugcucauguaagcagcuuuucg

SEQ ID NO: 64275 - RNA, 62 nt, hsa
uucaccaaagaacagaccaauuaacauacuuauuugcagaagugguguaguucuauaaaacg

SEQ ID NO: 64276 - RNA, 62 nt, hsa
gacgguccgggcgggcacccucagccgggcucuuugcagaagcagcaccgcugacugugggc

SEQ ID NO: 64277 - RNA, 62 nt, hsa
aauuaguuuuuuaaaccuucuguuaguggcuuuuugcagaagcaaaacagauuaaguagaua

SEQ ID NO: 64278 - RNA, 62 nt, hsa
ucuugaauucuuauuuugguuugccuggauguuuugcagaucccaaucuuucuuuuaagcuu

SEQ ID NO: 64279 - RNA, 62 nt, hsa
uugaugaagugccuggguauuuucccgucccauuugcagagcucuacuacuucauuuccaca

SEQ ID NO: 64280 - RNA, 62 nt, hsa
acguccuugauuaaaucaccccaauaugccccuuugcagaaaguauuggcuuuucccugaau

SEQ ID NO: 64281 - RNA, 62 nt, hsa
aggcucucugggcagaggcuggcccacuguaguuugcagacaugcucuccagaugguuuuac

SEQ ID NO: 64282 - RNA, 62 nt, hsa
guauccagauaggaaaagaagaaguaaaacuauuugcagaugacacaguuuuguauauagaa

SEQ ID NO: 64283 - RNA, 62 nt, hsa
uaaaaauacugacauuucacacagguaccagcuuugcagaggagguagacucuuuggcacuu

SEQ ID NO: 64284 - RNA, 62 nt, hsa
aaugaagaaguaauucugucucugcaccuacuuuugcagaauguucaaggaaguauucugug

SEQ ID NO: 64285 - RNA, 62 nt, hsa
gaguuauuuuaaccucaaaaauuagcuaacuuuuugcagauggacuuggugguguuuuuugu

SEQ ID NO: 64286 - RNA, 62 nt, hsa
uuaacaaacugaaaggagauuuugauuaaaauuuugcagaggucuucaguaucuauauuuga

SEQ ID NO: 64287 - RNA, 62 nt, hsa
uuaucaacuccuuaaaugugcuuuugaaccaauuugcagaagcucacauagcaaguucauaa

SEQ ID NO: 64288 - RNA, 62 nt, hsa
cucuuacugcaaaugucaucagaacuuuuugguuugcagaugacaaaaauucaacucagacu

SEQ ID NO: 64289 - RNA, 62 nt, hsa
aagcaucguuauacuucuaaaaccuucagcauuuugcagagcuuugcuuuucauuccuggac

SEQ ID NO: 64290 - RNA, 62 nt, hsa
uaucacaugucucauucuccucaaauauuccauuugcagacagaccgucauauucuaauagc

SEQ ID NO: 64291 - RNA, 62 nt, hsa
guucucugccaauuacuauaggcagucuucauuuugcagaggugagguaagacuucaucuua

SEQ ID NO: 64292 - RNA, 62 nt, hsa
cugucacuguaagccugcccaguaggcaguguuuugcagacuuuggggaguggucuaugugg

SEQ ID NO: 64293 - RNA, 62 nt, hsa
aaaggggucuaaaaagauuuuggcaaaacauauuugcagauguagauuagcuggugaagaaa

SEQ ID NO: 64294 - RNA, 62 nt, hsa
agcucuuuugcuuggauucccaucauggccccuuugcagaaaauugucuaggauuucagcaa

SEQ ID NO: 64295 - RNA, 62 nt, hsa
acaaaaaguauuugcccauuccuauucuaagauuugcagaauaugucacccuaucuagcuuu

SEQ ID NO: 64296 - RNA, 54 nt, hsa
guuuaauucaaguagucuagugccuuugcagaaucaaaugccuacuauuuuaua

SEQ ID NO: 64297 - RNA, 62 nt, hsa
uaaauauacuuuggcacuuuuuggaaaaaaaguuugcagacaccugcccuaaaugauuauag

SEQ ID NO: 64298 - RNA, 62 nt, hsa
augccuaucaaaauuugaauucaguucuucauuuugcagauggcugaaagguacaaaggccu

SEQ ID NO: 64299 - RNA, 62 nt, hsa
accaaagauuaaauccuugacauaagaucucauuugcagaaagcagauuaaagaccaucaga

SEQ ID NO: 64300 - RNA, 62 nt, hsa
aaaaucaguaggaaaucuaaacuuauccccucuuugcagaugucuagcagcuucagacauuu

SEQ ID NO: 64301 - RNA, 62 nt, hsa
guucagaaggcaagcaucuucauuuugcuagcuuugcagaaucuuaaaauguguacucguua

SEQ ID NO: 64302 - RNA, 62 nt, hsa
uuugugggcuccuuguuagccugagaccaggcuuugcagaggggcggggggugaggcuuagc

SEQ ID NO: 64303 - RNA, 62 nt, hsa
cuaaguuauauguguuagugucggggaaauaguuugcagauaauggaggaguaacccuacaa

SEQ ID NO: 64304 - RNA, 62 nt, hsa
uuauuuuuguggcaugguuagauuugacugguuuugcagaagauuacaguuauguacugcau

SEQ ID NO: 64305 - RNA, 62 nt, hsa
gcuccaguuaaaugcuuugauauaguggcuccuuugcagagccaaaacaagauuuauuaaau

SEQ ID NO: 64306 - RNA, 62 nt, hsa
ucaugagacauuaggguagaugaaaggagagcuuugcagauaacaaaauagccuauccuuaa

SEQ ID NO: 64307 - RNA, 62 nt, hsa
guuccaaauaugacucccuaaaauauauacacuuugcagaagcucuaggcccucaccucaaa

SEQ ID NO: 64308 - RNA, 62 nt, hsa
gcuauugggaaagaacuuccaaacucaggaaguuugcagagagcagacagcuagagauaacu

SEQ ID NO: 64309 - RNA, 62 nt, hsa
uuuaaugcaaauuuauuuuuuucauugcauauuuugcagauuuuauccacagugucauuuuu

SEQ ID NO: 64310 - RNA, 62 nt, hsa
uggaaaauauaaugaucagcaaaaagacuggauuugcagaaguuuuuuuuuuuuuuuucuuc

SEQ ID NO: 64311 - RNA, 62 nt, hsa
aaaccaugccaaacuacugcuuuaaugucaaguuugcagaauugucucugaaaauaaaaacc

SEQ ID NO: 64312 - RNA, 62 nt, hsa
uauuguacuguuuuucauuucacuugcaaaauuuugcagaauuccuccuuucuacccauaaa

SEQ ID NO: 64313 - RNA, 62 nt, hsa
ugccacuggcugaugaagaguugagaggucucuuugcagaaugaucuuuuuguuucguuuug

SEQ ID NO: 64314 - RNA, 62 nt, hsa
uucagaguuccagucauuauuguuacaucauguuugcagaaaccuugucuuauuuagugucu

SEQ ID NO: 64315 - RNA, 62 nt, hsa
guagcagaaaucagugguuugaaaagucauacuuugcagauaugaaccugaaaaucaaagug

SEQ ID NO: 64316 - RNA, 62 nt, hsa
uuaaagggaacuguacuacucgcagugauagguuugcagagugugugcuuggcuguggcagc

SEQ ID NO: 64317 - RNA, 62 nt, hsa
aacaaaaaugaaauguucuaguuuugguuccuuuugcagagugaaaugccucccaggaaaaa

SEQ ID NO: 64318 - RNA, 62 nt, hsa
uuucacaaauuuuguauugcuuuuuuuccaguuuugcagaaaauuuacauucuaguucucuu

SEQ ID NO: 64319 - RNA, 62 nt, hsa
uuguuuuuuggauggugaauucaugcugagaauuugcagaugcaagcuccucuccuaggucu

SEQ ID NO: 64320 - RNA, 62 nt, hsa
gguucucuuuacacauuaacacuguaccaagcuuugcagaucuuuuccgacacacaugucug

SEQ ID NO: 64321 - RNA, 62 nt, hsa
gaaguuuggaaaagaaaccuuccuuucuggaguuugcagaguucagcaauaugauagggaac

SEQ ID NO: 64322 - RNA, 62 nt, hsa
gaguguaagugcuucauuugggaaauucagcuuuugcagaagcaguguuucuacuugcacua

SEQ ID NO: 64323 - RNA, 62 nt, hsa
uacugaugugcuugacugaaguguguaggcuuuuugcagaagaucuuacuaacugaccuauu

SEQ ID NO: 64324 - RNA, 62 nt, hsa
uccugauucauauuuaauuugaagauagaagguuugcagauauucucuagucauuuguuaau

SEQ ID NO: 64325 - RNA, 62 nt, hsa
cauauaagcauggugguaucuuaaaauggugguuugcagaaaccaugguagccaacagaacc

SEQ ID NO: 64326 - RNA, 62 nt, hsa
ggugauaaguuacuucaauuauaaaauugaauuuugcagacuaaauuauuuuauaaggcugu

SEQ ID NO: 64327 - RNA, 62 nt, hsa
gacacaggguguauaucuagaacgauaaugcuuuugcagaaacuaaagccuuuuuaagaaau

SEQ ID NO: 64328 - RNA, 62 nt, hsa
ugggaagagaugaugguggcauaucuaaagaguuugcagagcggacugacgcuccuccccuu

SEQ ID NO: 64329 - RNA, 62 nt, hsa
ugauuuuuaaccuuucaacauuuuccuaaugauuugcagagauaacugcacaauuuugcaua

SEQ ID NO: 64330 - RNA, 62 nt, hsa
cacagaugagucuuucagaggcaggauccauuuuugcagauagcuaugacuuguggcaauca

SEQ ID NO: 64331 - RNA, 50 nt, hsa
gauuacaacucauuuuguaauuugcagauuauucaguuauaggggugauu

SEQ ID NO: 64332 - RNA, 62 nt, hsa
gguaauauaauguauggguuuucuauugguuuuuugcagacaguagagggagauuuuguaac

SEQ ID NO: 64333 - RNA, 62 nt, hsa
auuuuaguaauuuccuuggggaacuaaauaauuuugcagaauuuuuccuaauuuuguuuauc

SEQ ID NO: 64334 - RNA, 62 nt, hsa
gcgguauacucagaauggugagagcccugaauuuugcagaccgcuaagacuauagacaaauu

SEQ ID NO: 64335 - RNA, 62 nt, hsa
ggucaggccggagcccguccuaagacacacgcuuugcagagcugugcaugcgcagucugcua

SEQ ID NO: 64336 - RNA, 62 nt, hsa
uuaaauaagguaaaucuuuuuuaguuuauauauuugcagacuauacauguuggauuaaaugg

SEQ ID NO: 64337 - RNA, 62 nt, hsa
cacuguuuaggacaauuuuucuuuaaaauaguuuugcagauuaaaauugcuuaaauaagugg

SEQ ID NO: 64338 - RNA, 62 nt, hsa
gagagacucucuuugauacauuaaaaaaacuguuugcagaagcaguucuguggaagagacug

SEQ ID NO: 64339 - RNA, 62 nt, hsa
uaaucaaugaauuuguucuuucugauuuuaaguuugcagauuuauuuagugaaggcaagugc

SEQ ID NO: 64340 - RNA, 62 nt, hsa
aaauauaugugauauuugcauuauuaaaccccuuugcagaucuaaagucucaggguuccacu

SEQ ID NO: 64341 - RNA, 62 nt, hsa
ccgugacuguuacuuuauacagcaaaggaaacuuugcagaugugauuaaagcuaaggaccuu

SEQ ID NO: 64342 - RNA, 62 nt, hsa
acaguucaacugaaacuucgaaagcaucauuauuugcagagacaggaccugacuauugaagu

SEQ ID NO: 64343 - RNA, 60 nt, hsa
ccacugggccugauacuuagcugacauggauuugcagaccccagggugggcagaugucuc

SEQ ID NO: 64344 - RNA, 62 nt, hsa
caguugaucucagguuuuucacuguacauuacuuugcagauauggacagccuuuacaaaaau

SEQ ID NO: 64345 - RNA, 62 nt, hsa
aauaauuuuagguucuuuuguuauucaguaguuuugcagacuuaaaaguguaaauuuagaau

SEQ ID NO: 64346 - RNA, 62 nt, hsa
ugggagcugagggcccuggaggauggggaagguuugcagagagaggaagaagagggcagggu

SEQ ID NO: 64347 - RNA, 62 nt, hsa
auuaaaagaaaaauauaaugugaauuagccacuuugcagaauauguucuagacuggugaucu

SEQ ID NO: 64348 - RNA, 62 nt, hsa
ggccagaaaugaagaagaaguuugcagauguauuugcagagaagacgaaggcagaguggugu

SEQ ID NO: 64349 - RNA, 62 nt, hsa
gcauggaugauuggccagaaaugaagaagaaguuugcagauguauuugcagagaagacgaag

SEQ ID NO: 64350 - RNA, 62 nt, hsa
aaacuguagaagagucuaaaacaaguucucuuuuugcagauucacauacuaaugguuuaauu

SEQ ID NO: 64351 - RNA, 62 nt, hsa
agauaccuguuuuaaaagguuuuucagacaauuuugcagaaaggugcauugauucuuaaauu

SEQ ID NO: 64352 - RNA, 62 nt, hsa
ccaccauacccaacuaauuuuauuuuuuauuuuuugcagagauggagucucacuguugccca

SEQ ID NO: 64353 - RNA, 62 nt, hsa
ugaaguuucguuggauguucaaaaugcuaauuuuugcagagauauaaggauaaauuaguuuu

SEQ ID NO: 64354 - RNA, 62 nt, hsa
cucuucuaccauuugaauuuguguagaggguguuugcagagcaaugcccguaaugcuuagag

SEQ ID NO: 64355 - RNA, 62 nt, hsa
uuguaggaaaccaagauuagaaacauuagaaauuugcagaauuuaagaaauuauguuuugug

SEQ ID NO: 64356 - RNA, 62 nt, hsa
aagaauauuaaccuuucuaaacuaaauuuagguuugcagaaaguauuaaacauuuuuaagcu

SEQ ID NO: 64357 - RNA, 62 nt, hsa
cauauuagucaucauuuguaacuauggcuuuauuugcagagcuucuaaaaggcguauaacug

SEQ ID NO: 64358 - RNA, 62 nt, hsa
aauauuuaucaauggauuaagaaguuuaagauuuugcagauuuaucaauuuggguuuuugua

SEQ ID NO: 64359 - RNA, 62 nt, hsa
uccaaaccaguugggagacuugugcaaaggacuuugcagauuaaaaaaaaaaaaaaaaaaaa

SEQ ID NO: 64360 - RNA, 62 nt, hsa
caucagauuuggaaguuuugccaucaaaauucuuugcagaauuggaaguuaacacauuugcu

SEQ ID NO: 64361 - RNA, 62 nt, hsa
acaggcuuuuuugcuuugggcucugcuauuuguuugcagaacacccaagagcgagcaaacau

SEQ ID NO: 64362 - RNA, 62 nt, hsa
auuugggccagugcacuguuuacuuccaucuguuugcagacacauuugugcccggcguuugg

SEQ ID NO: 64363 - RNA, 62 nt, hsa
agcaacuugcuucuaaaugcccaguucacuucuuugcagagccuuuuaccccugcacaguuu

SEQ ID NO: 64364 - RNA, 62 nt, hsa
ggaguuggagcagggggauggguaauuacagauuugcagacuauagaaagaguuucauuuuu

SEQ ID NO: 64365 - RNA, 62 nt, hsa
aauacuacuuuauagacaguuuugguuuucuguuugcagauaugauugauguauuucaccaa

SEQ ID NO: 64366 - RNA, 62 nt, hsa
gucuugugaggcccuuauauaauuacucccauuuugcagaugaaguaacugaggcuuagaaa

SEQ ID NO: 64367 - RNA, 62 nt, hsa
uuaaaagcacugauucaauugcuaggaauauuuuugcagauuuuucuuuacaguauuccaua

SEQ ID NO: 64368 - RNA, 62 nt, hsa
ccguuagcccagauucaaaaggugaacaucuguuugcagaaucugauucaugagaaggugag

SEQ ID NO: 64369 - RNA, 62 nt, hsa
ugugccaucuuuaaaauuuuuacuauuggucauuugcagaacaguaaauucuguguguuggu

SEQ ID NO: 64370 - RNA, 62 nt, hsa
ggaggaagugaucagagggaacgagcuguagguuugcagaaaugugugaaaccaaaaugauc

SEQ ID NO: 64371 - RNA, 62 nt, hsa
ggacggccugcuaucuacagcacagugugucauuugcagauuugugguuaccuauaccacgc

SEQ ID NO: 64372 - RNA, 62 nt, hsa
aggcuuucaagaguugguaccuuuuagcuauauuugcagauucucugggauuuuaaggaacu

SEQ ID NO: 64373 - RNA, 62 nt, hsa
aauaugguauagaguuuauuaauauacuauuguuugcagauaaaggccuuaacuuuaaacau

SEQ ID NO: 64374 - RNA, 62 nt, hsa
gugcuggguguguucguguaaaucagauucuguuugcagauggaucuguuuggucuuuucua

SEQ ID NO: 64375 - RNA, 62 nt, hsa
uauauuucacccaucucucaggaaucaucuccuuugcagaaugaugcagguucagguccccu

SEQ ID NO: 64376 - RNA, 62 nt, hsa
aggaagaacgcacagagggcaggagccuccuguuugcagacguuggcgggccccgaggcucc

SEQ ID NO: 64377 - RNA, 62 nt, hsa
ugaaauuugauacuaaaaaggccaccuagcuuuuugcagauaacaaacaagaaagcuauucc

SEQ ID NO: 64378 - RNA, 62 nt, hsa
uuugccuuggaaucaugauuacaauuuuuuccuuugcagaugccuuccugggggauacuccu

SEQ ID NO: 64379 - RNA, 62 nt, hsa
ggcacgugcccacacccccacuucucuagccguuugcagaggccgccacccagcaggggccu

SEQ ID NO: 64380 - RNA, 62 nt, hsa
cugaacccacccuccccaggguucaggguugcuuugcagaaggcauggaggugggaccagau

SEQ ID NO: 64381 - RNA, 62 nt, hsa
gguuucaaauucugggaaaccaguuccaaacauuugcagaaaccauuaagcaguuacauauu

SEQ ID NO: 64382 - RNA, 62 nt, hsa
uauaaauguaugucuucauugcuagguacuaauuugcagaugucuuuacauauuucaauaca

SEQ ID NO: 64383 - RNA, 62 nt, hsa
uucccuccgagccuguggaaaggcagagcccuuuugcagauacgaaagcaagcuuuugccaa

SEQ ID NO: 64384 - RNA, 62 nt, hsa
ugcagcuguugagaaaacgaagucuuuuucauuuugcagaaggaaaugauggaauuuuucug

SEQ ID NO: 64385 - RNA, 62 nt, hsa
uccccacuacacagagaggugagcuuucaaauuuugcagagcucugcuaucacugaauuaca

SEQ ID NO: 64386 - RNA, 62 nt, hsa
uuauaucgacaaugaagaugaucauauuucauuuugcagauguggccauaaaauauuauuua

SEQ ID NO: 64387 - RNA, 62 nt, hsa
uagaaguuuuugcuuugcuaguuaaagcuuacuuugcagagcuucccaaagugaaagggaaa

SEQ ID NO: 64388 - RNA, 62 nt, hsa
cuuguguguucguaucuuuauuuauucccuaguuugcagaacugucugaauaaaggauacaa

SEQ ID NO: 64389 - RNA, 62 nt, hsa
aguaagagagagagagagccaaagcuguccguuuugcagauggacaggaaggagccaggaca

SEQ ID NO: 64390 - RNA, 62 nt, hsa
ugagaauguuuggacucuaacucaccgauugcuuugcagacaaaggucuuuuauuucuccug

SEQ ID NO: 64391 - RNA, 62 nt, hsa
uaggguuugaaauugauaaugcuuucacaacauuugcagauguuuuagaaggaaaaaaguuc

SEQ ID NO: 64392 - RNA, 62 nt, hsa
aaaacaucagagaguucauacuaaaauauauuuuugcagaugcaguaaauaugaaaaauauu

SEQ ID NO: 64393 - RNA, 62 nt, hsa
gauuuaaccagcauuuuucaacccugggaaaauuugcagaaucuaaguugauuguaaugauu

SEQ ID NO: 64394 - RNA, 62 nt, hsa
augggggugcuauuuggcuuuuauucccugccuuugcagaacugaugucaccccagaugucc

SEQ ID NO: 64395 - RNA, 62 nt, hsa
uugaaaaucaaucaaguagugaaugugaucucuuugcagagcuauagauagaaacagcugga

SEQ ID NO: 64396 - RNA, 62 nt, hsa
guuuucuagucuacuucaaaauuuuuuacacguuugcagaggugcaaucaaauggaauuaag

SEQ ID NO: 64397 - RNA, 62 nt, hsa
uuaauaaauacuucugacacuacauuuaaauguuugcagauucugcaaacuaauugcucauu

SEQ ID NO: 64398 - RNA, 62 nt, hsa
uacuucucagagcacugaaaagaaaggaaggguuugcagaggagaguguagaaaucccagug

SEQ ID NO: 64399 - RNA, 62 nt, hsa
cuaucuggggagcuccuggccaggauaauauauuugcagauaauucuggaccagagacuugg

SEQ ID NO: 64400 - RNA, 62 nt, hsa
gcauucaauugguaacuauuccucuucaaguauuugcagauggggcaacaugauauuugggu

SEQ ID NO: 64401 - RNA, 62 nt, hsa
uuauccuggaaaaagaagaaaagagcuucuucuuugcagaugaaaauaaagguguuuuuggu

SEQ ID NO: 64402 - RNA, 62 nt, hsa
aucuacuuaaacauguuuaaaguauguuuuguuuugcagacuuuuugcauacuuauuucuac

SEQ ID NO: 64403 - RNA, 62 nt, hsa
uuuaguaaaggagcugagaagcuagcauuagguuugcagaaacuauuuaaguuucaacucug

SEQ ID NO: 64404 - RNA, 62 nt, hsa
cccagugguuucagaaaugucuggguguuuuauuugcagagaacaagaugugucuuaugagu

SEQ ID NO: 64405 - RNA, 62 nt, hsa
uuaucaguagguacauggauacaucaaguucauuugcagaaacaaauaacugaaauaaaaaa

SEQ ID NO: 64406 - RNA, 62 nt, hsa
ugugaauauguuaugccacauugcaaaagaauuuugcagaagugauuaauuuaaaauguuau

SEQ ID NO: 64407 - RNA, 62 nt, hsa
gagauauagucauauuuaaaguuguccuacaguuugcagauaauuuuuauauuacuauucuu

SEQ ID NO: 64408 - RNA, 62 nt, hsa
guagauaggauaaucuauugacugaauuaucuuuugcagauaucagcugguuggauuucuca

SEQ ID NO: 64409 - RNA, 61 nt, hsa
acgaagaagaagaaggcugauaucacacagcuuugcagaaggaaggaagaccuugaucgac

SEQ ID NO: 64410 - RNA, 62 nt, hsa
uaauacugccuguuauugguauagcagugguauuugcagacugggaucauaaggagcccuua

SEQ ID NO: 64411 - RNA, 62 nt, hsa
cuacagacaucuuucuuaagccgagagcugucuuugcagaauuaucuuauuaaaaaaaaaua

SEQ ID NO: 64412 - RNA, 62 nt, hsa
gagcaaaggauuaaacagaggcccacagcuaguuugcagaaccacucaauuuuaagugcugu

SEQ ID NO: 64413 - RNA, 62 nt, hsa
uaggaagaggcgauucaacacaccauuggaauuuugcagacagaaagagauuuuuguuuucu

SEQ ID NO: 64414 - RNA, 62 nt, hsa
cccuagcggcugcuccuucaggcgaagggugguuugcagauguggggagggugucuggggac

SEQ ID NO: 64415 - RNA, 62 nt, hsa
cagcgucagaccuauuguaucauauuagagaauuugcagacuaagaauuuaugagaaaauau

SEQ ID NO: 64416 - RNA, 62 nt, hsa
ccuaugggaaauggcugugcucccaacauagcuuugcagaugauguggguuuuuuuuuuuuu

SEQ ID NO: 64417 - RNA, 62 nt, hsa
cagugaaaaauuauuuuuccacauugaaacacuuugcagacacaaauaucuaugaaaagaug

SEQ ID NO: 64418 - RNA, 62 nt, hsa
ccgugaaugggaccuuguuuggaaauagggucuuugcagauauagucaagaugaggucacau

SEQ ID NO: 64419 - RNA, 62 nt, hsa
gaaacgccccgggcaaagggucuuuugcagcuuuugcagacgggcaagaagcugcuucugcc

SEQ ID NO: 64420 - RNA, 62 nt, hsa
gggcacaaacuucacuuagggcaucgcagauguuugcagaaugguuggccuaaugauuaugc

SEQ ID NO: 64421 - RNA, 62 nt, hsa
acccaaccuuggucauaagugugccuggcugguuugcagauauuuguucugcuuuguaaaaa

SEQ ID NO: 64422 - RNA, 62 nt, hsa
acccgacucucagauggggucagucccgucgcuuugcagacugacccuggaaaucuacaaaa

SEQ ID NO: 64423 - RNA, 62 nt, hsa
aauaaaaacacuaugacagacagguuugccaguuugcagaaacuaacucuuuucucacauca

SEQ ID NO: 64424 - RNA, 62 nt, hsa
cuugcauggauggcagcauuguucugaagggguuugcagaaaaaaaagauuuucuuuacaua

SEQ ID NO: 64425 - RNA, 62 nt, hsa
caccuugguugaauguuucucacucauuaaacuuugcagaagugauucauauucaguacugu

SEQ ID NO: 64426 - RNA, 62 nt, hsa
auuaucuugccuuauccaggaauaauugccccuuugcagagaaaaaaaaaaacuuaaaaaaa

SEQ ID NO: 64427 - RNA, 62 nt, hsa
guccucuacugcuaaauaaguuaauuuugcauuuugcagaaagaaacauugauugcuaaauc

SEQ ID NO: 64428 - RNA, 62 nt, hsa
acccuauuuuguguacuucuugugaauuauaauuugcagacuauuucagaaaagaaauuauc

SEQ ID NO: 64429 - RNA, 62 nt, hsa
ccauuacaguuauuguugcuagauccaccucauuugcagauguccaaacuuaaauucaucug

SEQ ID NO: 64430 - RNA, 62 nt, hsa
caagugggcggagcugagggcagcagcuugacuuugcagacaucugagcaauaguucuguua

SEQ ID NO: 64431 - RNA, 62 nt, hsa
uuguagcucucauucauuguuuuuuaucuuaguuugcagaaagguguugaaaugcuucucua

SEQ ID NO: 64432 - RNA, 62 nt, hsa
uucucccccuccucuccugaccuucuccccacuuugcagagccuucuaggagcucaagggcu

SEQ ID NO: 64433 - RNA, 62 nt, hsa
cauauuuuuucagcugaaggguaaaaucuuucuuugcagagacaguauuuugcugaauacuu

SEQ ID NO: 64434 - RNA, 62 nt, hsa
uuuaccuguuugacuuuauaauguguuuuaguuuugcagaagaacacuguuguaguuuagaa

SEQ ID NO: 64435 - RNA, 62 nt, hsa
cguguuuauagaaaggacauuacuaaugacauuuugcagauuaaaaacauucauuugaacac

SEQ ID NO: 64436 - RNA, 62 nt, hsa
cucauuuaauuuuaggauguaaaaaguauauuuuugcagaacaggcagcagcaauaacuugu

SEQ ID NO: 64437 - RNA, 62 nt, hsa
uuuucuaccaaucacuauguauuggggauaucuuugcagauauguucaaauuggacuggacu

SEQ ID NO: 64438 - RNA, 62 nt, hsa
uauacugaguacccuaggccaacuuuuuuuucuuugcagagaaccuuuuuuguuuuauucuu

SEQ ID NO: 64439 - RNA, 62 nt, hsa
ugcauuuauaugguugauuggguggggaauuuuuugcagaaagaugcaaagugauuggguuu

SEQ ID NO: 64440 - RNA, 62 nt, hsa
aaagcucacuuuacaaaauauuuccucaguacuuugcagaaaacaccaaacaaaaaugccau

SEQ ID NO: 64441 - RNA, 62 nt, hsa
aacaaaagcuguguccuggcagaaggucuggguuugcagaugggugcccugaauggaacuac

SEQ ID NO: 64442 - RNA, 62 nt, hsa
aggaagucacgaaaugaggaguucuugccacauuugcagagucccuccuugauaagguuugg

SEQ ID NO: 64443 - RNA, 62 nt, hsa
aaaguuauucaaaguauuuuuaaagcauuugauuugcagaugggugauucguaauaaauaaa

SEQ ID NO: 64444 - RNA, 62 nt, hsa
gucuuuuacaaaacaaggacagcagaggaggguuugcagagaccucccucugaaaaacacaa

SEQ ID NO: 64445 - RNA, 62 nt, hsa
augauuuauaaacagacaauaugugagugccuuuugcagaagaggguguguuugaaaucauc

SEQ ID NO: 64446 - RNA, 62 nt, hsa
ccauugcagaauagcugagccaagugagugaguuugcagaaagcagguggugagcuccugcc

SEQ ID NO: 64447 - RNA, 62 nt, hsa
gcgaguuuagccuuuaaguuucuguguauugauuugcagauuaaguaaugcugggaggaaua

SEQ ID NO: 64448 - RNA, 62 nt, hsa
cuuguuugacaucucaugcugacccccuggccuuugcagaagcugaugguuacagagcuagu

SEQ ID NO: 64449 - RNA, 62 nt, hsa
uccuagccaacacuauccuugggagaaagaaauuugcagaaacugcuaagaccaagugugga

SEQ ID NO: 64450 - RNA, 62 nt, hsa
gcugcucugaggacucaggaacaccuucgagcuuugcagaccugcggucagcccuccaugcg

SEQ ID NO: 64451 - RNA, 62 nt, hsa
gccaggccugggucuagaauucuugcugcugcuuugcagagucaacagcccaucagcccaug

SEQ ID NO: 64452 - RNA, 62 nt, hsa
ccguguacaaugaggagcuggggccuccucaauuugcagaucccccaaguacaggcgcuaau

SEQ ID NO: 64453 - RNA, 62 nt, hsa
guuuuaggaacuuuaacuuuuaauguggcaaguuugcagaugucauagaggcuauccuggag

SEQ ID NO: 64454 - RNA, 62 nt, hsa
uggcugggcauucagugaagucuuaggacuucuuugcagacaacugacuggguauauauagg

SEQ ID NO: 64455 - RNA, 62 nt, hsa
guuacaauuacagaaacugauuaguuugucaguuugcagauagauuuagcacaguacucauc

SEQ ID NO: 64456 - RNA, 62 nt, hsa
auaccccacaaggacaguguguauacaaaguauuugcagagcaugacuuuuauauguguggg

SEQ ID NO: 64457 - RNA, 62 nt, hsa
caaucacaagagcccgccggccagugggcuuguuugcagacugggugagguggagcccugcu

SEQ ID NO: 64458 - RNA, 62 nt, hsa
gcacauagcuucucuccauacuccuaagggacuuugcagacacccaagccacugggaccccu

SEQ ID NO: 64459 - RNA, 62 nt, hsa
gaugacccuggacagagcggggcuauucccauuuugcagacaggacagcagaggcuccagac

SEQ ID NO: 64460 - RNA, 62 nt, hsa
ggaacaauuucaagguccucaccacuccuucauuugcagaggggacaacagacuuucugacc

SEQ ID NO: 64461 - RNA, 62 nt, hsa
uuuauggcauuuaguaccuucaaauaauuggcuuugcagauauuggauaccccauuaaaucu

SEQ ID NO: 64462 - RNA, 62 nt, hsa
cugccaccugacaccgcugacuggcuaaaugcuuugcagaaagugaugaccuuacaccacaa

SEQ ID NO: 64463 - RNA, 62 nt, hsa
ucuugauucuagugacaaaggauccagcaguauuugcagauuccgauuuggagucucuaggu

SEQ ID NO: 64464 - RNA, 62 nt, hsa
uacccucugaauuggagggcagugccagggcauuugcagaagcugggaaggaccaagccuca

SEQ ID NO: 64465 - RNA, 62 nt, hsa
uugguaaaggcacagauguuuugagaacuuuauuugcagagacaccugagaaucgauggcuc

SEQ ID NO: 64466 - RNA, 62 nt, hsa
uauauauuaauauacaucuuuccccugucacuuuugcagauauucuucgguuugaauaauua

SEQ ID NO: 64467 - RNA, 62 nt, hsa
ugauuguuaaaauucucccaacugguucgaccuuugcagauacccauaaccuauguugagcc

SEQ ID NO: 64468 - RNA, 62 nt, hsa
uucagaaucauugaagcagucuuaaagggucuuuugcagaugguacaaauuagaacaauuag

SEQ ID NO: 64469 - RNA, 62 nt, hsa
caccugaucaagagcagugcuucuccauuuguuuugcagagaaauguuuuucauuucccgug

SEQ ID NO: 64470 - RNA, 62 nt, hsa
gagaagaauagccuagauaugaauauauggcauuugcagauuuuuauauuaguugcuuuguu

SEQ ID NO: 64471 - RNA, 62 nt, hsa
cugggccugcguugagggggcugucaugguccuuugcagagcugcugcuuuuggcauucaua

SEQ ID NO: 64472 - RNA, 62 nt, hsa
ggcagacuggcuaaggaccagcccagggcaauuuugcagaaaugaucauuugcacagaaugg

SEQ ID NO: 64473 - RNA, 62 nt, hsa
gaaaaggcccacuuuuuaaaaagugaaacaaguuugcagauacgguucucuuccuggacucc

SEQ ID NO: 64474 - RNA, 62 nt, hsa
uuucauuuaauucucauggcaaccaccaugcauuugcagauaggcaagucaggcucacaaaa

SEQ ID NO: 64475 - RNA, 62 nt, hsa
gaguguacuauauacuauuaccuuugaauguguuugcagagcuaguggauguguuugucuac

SEQ ID NO: 64476 - RNA, 62 nt, hsa
uggaaaauauuugacccccuuggcugaauucuuuugcagaacuacugugugucuguucacua

SEQ ID NO: 64477 - RNA, 62 nt, hsa
uauuuuugcaugaauuaagacguuuuaauuucuuugcagacaaggucuagaugcggagucag

SEQ ID NO: 64478 - RNA, 62 nt, hsa
aaaaauauagcauucugaccuaaaaaaguuauuuugcagaugaauguguuuucaacucagga

SEQ ID NO: 64479 - RNA, 62 nt, hsa
gaaggacacuuccugccuaagggagagugguauuugcagacuagaauucuagugcugcugaa

SEQ ID NO: 64480 - RNA, 62 nt, hsa
cacguaauuucauuuacugugacacuugcuucuuugcagauuuugcauugacuuguguguac

SEQ ID NO: 64481 - RNA, 62 nt, hsa
cucugggcagcucccaucccagucuggggccauuugcagacucaggaaaggauuucuacagu

SEQ ID NO: 64482 - RNA, 62 nt, hsa
caaccuuccuucugcuucucccacacccaguauuugcagaagggcaaagcugcuuaagagag

SEQ ID NO: 64483 - RNA, 62 nt, hsa
uuuuuucaagagaucauguuuuuaaagugucuuuugcagaguuuuaaguuguucugucugaa

SEQ ID NO: 64484 - RNA, 62 nt, hsa
ggagguugucuucaagcuguggacuucugggauuugcagauuuugcaacgugguacuacuuu

SEQ ID NO: 64485 - RNA, 62 nt, hsa
agcccgcugcuuuuucuauccucccagucaccuuugcagacaaagaccaggggcagcucccg

SEQ ID NO: 64486 - RNA, 62 nt, hsa
augagagcgagcaaauaaaacuuaauuuaaucuuugcagauacauacuuaugggaaauuuga

SEQ ID NO: 64487 - RNA, 62 nt, hsa
aauauacauacaauucagugguuuuuaguauuuuugcagaauugugcagccaucaccacugu

SEQ ID NO: 64488 - RNA, 62 nt, hsa
cuuaaucugucccaacagcaaugugacggauuuuugcagauucaaaaucugcaaugguuauu

SEQ ID NO: 64489 - RNA, 62 nt, hsa
aggcuuugugacauucauuuaaauuguaauaauuugcagauuauuuuuguauaaucaugucc

SEQ ID NO: 64490 - RNA, 62 nt, hsa
aaugaagaaguggauuucucuuuuacuccugauuugcagaauguaagugauuucuccagcag

SEQ ID NO: 64491 - RNA, 62 nt, hsa
aaaaauguauucagugggcuuuaaaauuuccauuugcagaauuuggucucucaggcuguuug

SEQ ID NO: 64492 - RNA, 62 nt, hsa
ugaaaggcaggugaggaaacagaaaaggucucuuugcagauauauauuuuuuaaauggcacu

SEQ ID NO: 64493 - RNA, 62 nt, hsa
accacaggccaucaaaauauaaguuuccaggcuuugcagaagaccuugucuccuuagaaaug

SEQ ID NO: 64494 - RNA, 62 nt, hsa
uccagucaggcauuauuuuccuauuacuaguguuugcagaauagguguaggacuauuuaagu

SEQ ID NO: 64495 - RNA, 62 nt, hsa
ugaaggagucugggccaagguuugcccucagcuuugcagaaugaagccuugaggucugucac

SEQ ID NO: 64496 - RNA, 62 nt, hsa
uuuuuuuuuucuuucuccuuugcacuaagugcuuugcagacacggcacagcaaacauuuugc

SEQ ID NO: 64497 - RNA, 62 nt, hsa
acagcagagagacccaccggagcccccucaacuuugcagaugcccaccuggaaaaugggcug

SEQ ID NO: 64498 - RNA, 62 nt, hsa
uuggagucccugaauaauaaagagggaauauauuugcagaaagucgcauaggguuuuuuaau

SEQ ID NO: 64499 - RNA, 62 nt, hsa
acuaaagauaaauaaggagaaaacauuuaggauuugcagauaagucaacagaaagugccugc

SEQ ID NO: 64500 - RNA, 62 nt, hsa
gaaucaccagcacauucacugacaugauauuauuugcagauugacaaguaggaaguggggaa

SEQ ID NO: 64501 - RNA, 62 nt, hsa
ccuggcuuauuccauaccauuucccuugcagauuugcagaaacauggcaucuuucacugcau

SEQ ID NO: 64502 - RNA, 62 nt, hsa
uaauacggcaauaagguagcaaaggcaggugcuuugcagaaagaaugcuuggaaacuugagu

SEQ ID NO: 64503 - RNA, 62 nt, hsa
augcugcaccuucagccagcucugcucugaucuuugcagaucuuuaaguugucacuguuucu

SEQ ID NO: 64504 - RNA, 62 nt, hsa
ugaaaaaauuuuaaagauaaaauaggacauauuuugcagauauauauauauauauacacaaa

SEQ ID NO: 64505 - RNA, 62 nt, hsa
aaagaaguuuccagaaacuuugacuugaaauguuugcagaucaacuauaagcacaaagaaga

SEQ ID NO: 64506 - RNA, 62 nt, hsa
cauaaagcaaguuuuaccucucuguacauguuuuugcagacauacuugaaaagcucacuuaa

SEQ ID NO: 64507 - RNA, 62 nt, hsa
auaucugcccguguacccucaacugccuccuuuuugcagagaacgauccccacaggaacugg

SEQ ID NO: 64508 - RNA, 62 nt, hsa
aagggaaauacucuuaauucaugaauaaaaacuuugcagaaaauuagacaguguuuaauuuu

SEQ ID NO: 64509 - RNA, 62 nt, hsa
auucauuauugcgcccuccagguccccuccuuuuugcagaagguguaaaagagcugcccuug

SEQ ID NO: 64510 - RNA, 62 nt, hsa
ucaaaggaggaacucguggggggagggugugauuugcagaccugggucucugcucugcucug

SEQ ID NO: 64511 - RNA, 62 nt, hsa
uaaaaaaauuuuuuaauuaaauucaagucaaauuugcagaacccuguaucuccuccauagau

SEQ ID NO: 64512 - RNA, 62 nt, hsa
cacaauguagacaggagguuuauuaugagcauuuugcagaaagguguggaguaaguaaagug

SEQ ID NO: 64513 - RNA, 62 nt, hsa
aucuuggcuguauuuaauggcauaggcugacuuuugcagauggaggaauuucuugauuaaug

SEQ ID NO: 64514 - RNA, 62 nt, hsa
gaggugccucccuaucugguaggcugcccugcuuugcagaagccccacugcaugaaggccug

SEQ ID NO: 64515 - RNA, 62 nt, hsa
ugggacuacaggugugagucaccacuguauuuuuugcagacaggaucucccuguuuccuagg

SEQ ID NO: 64516 - RNA, 62 nt, hsa
aaccaaagaccaaauguuaggccgccguuauauuugcagaagcuuugagaaccaugcguaua

SEQ ID NO: 64517 - RNA, 62 nt, hsa
uuuuuuuuuuuuuccuugguuaagaaaucaaauuugcagaauuuaaucuacaaguuguauua

SEQ ID NO: 64518 - RNA, 62 nt, hsa
guuccugcauuuaccauaauuuaaucagucaauuugcagauagcuaaggaaaaucuuccaaa

SEQ ID NO: 64519 - RNA, 62 nt, hsa
auuuggauuucuccauagaauaaucauuuauuuuugcagaucaaauaaaucagaguuuacaa

SEQ ID NO: 64520 - RNA, 62 nt, hsa
cagguacccaugaaugugagcuuaccagggucuuugcagauguaauuaguuaaguuaaggug

SEQ ID NO: 64521 - RNA, 62 nt, hsa
cuccgugaaaauauguuuggaauauuccacuauuugcagaggcuuauucaguucuuacacau

SEQ ID NO: 64522 - RNA, 62 nt, hsa
uuacuugguauauuuuuauuuugggaaaaacguuugcagaaauguaaguaaagccaaucugc

SEQ ID NO: 64523 - RNA, 62 nt, hsa
uaagcugaaccaccaacagagaaaagcaggccuuugcagauaugauggaaugcaucccaccu

SEQ ID NO: 64524 - RNA, 62 nt, hsa
uacuguuccaagaaaaccaggaguugcuucaauuugcagaugcuuauguguuaauaccuuuu

SEQ ID NO: 64525 - RNA, 62 nt, hsa
gaucuauaacaacagagcaaagucuaugcucauuugcagacuggaaucauuaaguaauuuaa

SEQ ID NO: 64526 - RNA, 62 nt, hsa
uguguguguguguguguguguguguguguguguuugcagacaugcaaaacugcagcugaaau

SEQ ID NO: 64527 - RNA, 62 nt, hsa
gugcucccaccagcccccaccucauccgucuguuugcagagccucaucuacagguccccacg

SEQ ID NO: 64528 - RNA, 62 nt, hsa
cugaugguauauuucuauccuaacagugucccuuugcagaucaagcuuuauucugaagaaua

SEQ ID NO: 64529 - RNA, 62 nt, hsa
aaauagaugugauugguugccauuuguguucuuuugcagaacucugauaagaaaaguguuca

SEQ ID NO: 64530 - RNA, 62 nt, hsa
uauaauuuuucuauuuuuguuuuugguuuuaauuugcagagauuugcugccaggaaucaauu

SEQ ID NO: 64531 - RNA, 62 nt, hsa
aaagguuuguuguaguugucuuaugugcugaauuugcagaugaucagaugcugugcagaauu

SEQ ID NO: 64532 - RNA, 62 nt, hsa
acaggaaaucccagugucuagcaaugguuugguuugcagagaacacagccugauacuuaauu

SEQ ID NO: 64533 - RNA, 62 nt, hsa
gcagcucaggcuacugcuaaggccugagaguuuuugcagaaauggggcagagggacacccuu

SEQ ID NO: 64534 - RNA, 62 nt, hsa
aggggcauagucaggguggggaguguuugaaguuugcagaugagaagguuugacaaaaagac

SEQ ID NO: 64535 - RNA, 62 nt, hsa
ugagacuuggguuuucuuaaugccagugugaauuugcagauguuuucagaaaaucaagucac

SEQ ID NO: 64536 - RNA, 62 nt, hsa
ggacucaagcaacuauuauuauauuucuccuuuuugcagauacaggguaagugacuuaacca

SEQ ID NO: 64537 - RNA, 62 nt, hsa
caguugccaguucccauuaucgauacucuuucuuugcagaauaccuuagaaccguuauuucc

SEQ ID NO: 64538 - RNA, 62 nt, hsa
caaauagugucuacuaucucaacccuccaaaauuugcagaguguugggacugucauuuguga

SEQ ID NO: 64539 - RNA, 62 nt, hsa
cagucggucaagaggaggauuuuguuuuguaguuugcagaugagcauuucuaaagcauuuuc

SEQ ID NO: 64540 - RNA, 62 nt, hsa
cuguugaaugaacaacugugccuuguggaauuuuugcagaaguguuuaugcuuuguuagcau

SEQ ID NO: 64541 - RNA, 62 nt, hsa
cuuuuccuaguuacggaugauuuggggaugcuuuugcagaaauguguucauagaugaugcug

SEQ ID NO: 64542 - RNA, 62 nt, hsa
aauugaggaagcaguuaaauugugcgcuguauuuugcagauuauggggauucaaauucuagu

SEQ ID NO: 64543 - RNA, 62 nt, hsa
ucuuauugucuaaauugagacagccucagauauuugcagauauuuacuuuuugucugauauc

SEQ ID NO: 64544 - RNA, 62 nt, hsa
aaagacaugucaucuugugcuagccacuggauuuugcagauuuuccuguccaugcaagcaag

SEQ ID NO: 64545 - RNA, 62 nt, hsa
gaaaacugucauuuagcuggcugcagaacuccuuugcagaaacugggguuccaggagccugg

SEQ ID NO: 64546 - RNA, 62 nt, hsa
caucuucauuaaaguauauuuaacucauaauuuuugcagaaaauaugcuauauauuaggcaa

SEQ ID NO: 64547 - RNA, 62 nt, hsa
cacaugcaucagaaccaugauuuagauguaguuuugcagagacaaaaauccaugagugaaua

SEQ ID NO: 64548 - RNA, 62 nt, hsa
gugauucacccaccuuggccucauaaaccuguuuugcagaacucauuuauucagcaaauauu

SEQ ID NO: 64549 - RNA, 62 nt, hsa
ggauccauguagcaggacugaauuguccccaguuugcagaaaagcaccugccgaccucgucc

SEQ ID NO: 64550 - RNA, 62 nt, hsa
acacgcaucacagccauuugagaaauggcuucuuugcagagcuggggaagccgggcagaaga

SEQ ID NO: 64551 - RNA, 62 nt, hsa
aacccucaagaguucuaauucuuuuucaucuauuugcagagcuauuuggguaccucauuuug

SEQ ID NO: 64552 - RNA, 62 nt, hsa
agaaagaaaagagagcucaggcccaaguggaguuugcagacauaggcuguggcuaugguggc

SEQ ID NO: 64553 - RNA, 62 nt, hsa
caccuaaaaaugugcuacuguaccuugcucauuuugcagauuuagaagcugaaacauggguu

SEQ ID NO: 64554 - RNA, 62 nt, hsa
auaccuagucuuguuacauaaaggggaugugguuugcagaagaauuuucuuuauaaaauuga

SEQ ID NO: 64555 - RNA, 62 nt, hsa
guugugcuagccaaaguaaugcuaugaaaucauuugcagaauuaacccgugaguuaauguua

SEQ ID NO: 64556 - RNA, 62 nt, hsa
ugggaccugcuucauucaagcuucauauaugcuuugcagagaacucauaaaggagcauauaa

SEQ ID NO: 64557 - RNA, 62 nt, hsa
cauuccaguaagaacucaauuugucucccaaauuugcagaaacaaaacgugauuuaaaagcu

SEQ ID NO: 64558 - RNA, 62 nt, hsa
gagggggcucgcugcugcgcccugggcucgucuuugcagaguggucccugcccucaucucuc

SEQ ID NO: 64559 - RNA, 62 nt, hsa
auggaagacuugucuucaacuuggccacugucuuugcagagcugggcacaugugcccagggg

SEQ ID NO: 64560 - RNA, 62 nt, hsa
gcgccugggagaaccccuacacugcccuggccuuugcagaguaugcccgacugugcuuucaa

SEQ ID NO: 64561 - RNA, 62 nt, hsa
cccuggauggcaauuugcuugauagcaucugauuugcagacucauaauuugauuuuuaauua

SEQ ID NO: 64562 - RNA, 62 nt, hsa
aaguaagaaagaaacuaaagacccugaaugaauuugcagauuacccaugugcacagugggga

SEQ ID NO: 64563 - RNA, 62 nt, hsa
ccuucauggcuuccgaucagauggcaagggucuuugcagaugugcauuccagagccagccgg

SEQ ID NO: 64564 - RNA, 62 nt, hsa
auuccucuuuccuucacuauuuagccuaugauuuugcagaggugucacacuguauuaggauc

SEQ ID NO: 64565 - RNA, 62 nt, hsa
agaugaagccauguugcauccacauguucccguuugcagaaaccucacaggacaguacgaau

SEQ ID NO: 64566 - RNA, 60 nt, hsa
gaagagucccccuccuggcagaaugucugggcuuugcagagcaggccccgggggugaagu

SEQ ID NO: 64567 - RNA, 62 nt, hsa
cucgccaugcuucuuuacuuuaacauauuucuuuugcagaauguaaaagguaaugauaauua

SEQ ID NO: 64568 - RNA, 62 nt, hsa
uacugaacacuuggaagucaccuuuacuugccuuugcagaaaacagaacuuagccaaaccua

SEQ ID NO: 64569 - RNA, 62 nt, hsa
uugggaugaaauuuaaaccagauacgauuuacuuugcagaucauaaggcuuuuuauacucuu

SEQ ID NO: 64570 - RNA, 62 nt, hsa
gcacaaugacuguaggacuaagcuaagucugcuuugcagauaucugaucagauagucccuuc

SEQ ID NO: 64571 - RNA, 62 nt, hsa
uccacaagccuaacuuauucacucucuggcccuuugcagaaaaagugugcugccuuagucua

SEQ ID NO: 64572 - RNA, 62 nt, hsa
ugaugcugaacuauuugguaauaaagugcuuauuugcagauaacagaacaaauguguugggg

SEQ ID NO: 64573 - RNA, 62 nt, hsa
accguccucacuuuuccuuccucucacgguuuuuugcagaagcaagugcucagggaaaugaa

SEQ ID NO: 64574 - RNA, 62 nt, hsa
cagccucgccucccuguuuguacuauuugaacuuugcagaucucuguucucucaagcagaac

SEQ ID NO: 64575 - RNA, 62 nt, hsa
cuuucugcuaugugugguacuuugcagcugcuuuugcagaaaucacaauuuuccuguggaau

SEQ ID NO: 64576 - RNA, 62 nt, hsa
aagaagagaacguuugucuuuuucaaugaagcuuugcagaucaccaugugguugaagguuuu

SEQ ID NO: 64577 - RNA, 62 nt, hsa
acucauuuuugcauaaaaagguuccuaauccuuuugcagaauaaguuuuguuuacucuuuau

SEQ ID NO: 64578 - RNA, 62 nt, hsa
gguauuuuguagcauuccuugucaaguucuccuuugcagaauaccugucuccacauuccuag

SEQ ID NO: 64579 - RNA, 62 nt, hsa
ucuuguaaauauuaaaacgacuccccaauuauuuugcagaauugcacuuaauauugaaaugu

SEQ ID NO: 64580 - RNA, 62 nt, hsa
accagcaacugggccuugagaacuuccauuuuuuugcagauugucugcagaaacucagacag

SEQ ID NO: 64581 - RNA, 62 nt, hsa
caaaugugaauucuuuugagaaaguaugaaguuuugcagaaauugacugugaaaugucagag

SEQ ID NO: 64582 - RNA, 62 nt, hsa
uucauaugcagauuuuauucucaccugggccauuugcagaugagacuguaguuugcagauga

SEQ ID NO: 64583 - RNA, 62 nt, hsa
cucaccugggccauuugcagaugagacuguaguuugcagaugagacuguaguuugcagaugg

SEQ ID NO: 64584 - RNA, 62 nt, hsa
gaugagacuguaguuugcagaugagacuguaguuugcagauggcguggaagcauucaucagg

SEQ ID NO: 64585 - RNA, 62 nt, hsa
uggaguuuuaaaauuauguguuaauauuuuuauuugcagauuucguuuccgucaacuuaaac

SEQ ID NO: 64586 - RNA, 62 nt, hsa
uuaaaaauaguugaaugcugguggaaaguuacuuugcagauggguguaaggacucauggccc

SEQ ID NO: 64587 - RNA, 62 nt, hsa
uuuaccccauuuucaagaaggauguacuguacuuugcagaagugaaguuuuucuguuauuaa

SEQ ID NO: 64588 - RNA, 62 nt, hsa
caggaauugcccucaagaacucugcuucuugcuuugcagagugccauggucaugucauucug

SEQ ID NO: 64589 - RNA, 62 nt, hsa
uagguaacaggacauauguaaaaacuaucaucuuugcagauuacucugccuccaaaugcagg

SEQ ID NO: 64590 - RNA, 62 nt, hsa
guaaaaccugcccaggaacuuacagaauuuacuuugcagaagcguuaucauacuccauuuac

SEQ ID NO: 64591 - RNA, 62 nt, hsa
aauuuaccuagaugucuauuuaugggauuacuuuugcagaaucauaauuuagcaaccauuua

SEQ ID NO: 64592 - RNA, 62 nt, hsa
aguugauagaggcugugguguucucacuagacuuugcagagcaguaggcaucucaagguaac

SEQ ID NO: 64593 - RNA, 62 nt, hsa
uccuuugaggaagguagaagugaguuuccauguuugcagaguauuuaaauaccucagauuuu

SEQ ID NO: 64594 - RNA, 62 nt, hsa
ugucuaaaguuagggcauuuuucuuggaucuuuuugcagacuagcuaauuagcucucgccuc

SEQ ID NO: 64595 - RNA, 62 nt, hsa
uguagaaaaaaagugcuuaauauuguuauugcuuugcagaaaaaaaaaaaaucacauuucug

SEQ ID NO: 64596 - RNA, 62 nt, hsa
caagaaagggagaagaggugccugugggagauuuugcagaccuauuguggguauagguauuu

SEQ ID NO: 64597 - RNA, 62 nt, hsa
gcauggcauguuuuguuacagguuguagaguauuugcagaaggaaaccauuucugguuauuu

SEQ ID NO: 64598 - RNA, 62 nt, hsa
augaaguaucuuguacauauaaauuuauuucuuuugcagagcauuauauuacuggauguuua

SEQ ID NO: 64599 - RNA, 62 nt, hsa
ugucugcacaaggagugaccuucucaugcugauuugcagacggggcaccccuguggaggggc

SEQ ID NO: 64600 - RNA, 62 nt, hsa
aagaaaaaagaguccucuucuuuucccagccuuuugcagaacacaguagacagaacugccac

SEQ ID NO: 64601 - RNA, 62 nt, hsa
auguuaguuuuauauacagcaaaacuugauuuuuugcagauggaaagguauuuuguuucuau

SEQ ID NO: 64602 - RNA, 62 nt, hsa
ggacaguguuauaaaucagaauuuuacgacaguuugcagaacacugauuugaaagcuuccua

SEQ ID NO: 64603 - RNA, 62 nt, hsa
ucuguaccugaggaaaccaggcccugggugacuuugcagaucugcucacccucggugagcaa

SEQ ID NO: 64604 - RNA, 62 nt, hsa
uuggacuacuuguuucguaaagauaaccaguuuuugcagagaaacguguacccauauauaau

SEQ ID NO: 64605 - RNA, 62 nt, hsa
ucauguaaagcaaucgcaaagcaagggggaaguuugcagagcaugccaggggacuacguuuc

SEQ ID NO: 64606 - RNA, 62 nt, hsa
augauuugucugcuaagaagacggguuccugcuuugcagagaaggagccggggaccagcuug

SEQ ID NO: 64607 - RNA, 62 nt, hsa
gaguggcccugccuccuguccuccccgggguuuuugcagacucgaagucucacugcaccagu

SEQ ID NO: 64608 - RNA, 62 nt, hsa
ucauugcauuucugaguauuauguaaccuauuuuugcagaagguacuguuacauuaagugca

SEQ ID NO: 64609 - RNA, 62 nt, hsa
cucuguaguuuucccagauuuuaguuccucauuuugcagaugaaaagcggggaaaaaaaaaa

SEQ ID NO: 64610 - RNA, 62 nt, hsa
uaucccacaucagaaucacugggaaauuuaaguuugcagaucccacacucacccugaauccu

SEQ ID NO: 64611 - RNA, 62 nt, hsa
guuucaaagaaaaggugucauuggagcaguguuuugcagaaugagccagaguucaccaagca

SEQ ID NO: 64612 - RNA, 62 nt, hsa
ggaauccagacccggcugcgugguugaugaucuuugcagacaggcaagcaccuccugccucg

SEQ ID NO: 64613 - RNA, 62 nt, hsa
uauaaaagaugauaguaauuuaccaagugacauuugcagagaaacagguguacaguuaucgu

SEQ ID NO: 64614 - RNA, 62 nt, hsa
ccccuuucuuccgggcccugcugucaggcagcuuugcagaagcccagauggaccuggugccc

SEQ ID NO: 64615 - RNA, 62 nt, hsa
ugagucaccuagggguucauagaaaaaggaaguuugcagaugcaauaaaugugaggaaguau

SEQ ID NO: 64616 - RNA, 62 nt, hsa
caagacugcaucuagaaucgcucaaacaccuguuugcagaccccaugcaccagcuggagggg

SEQ ID NO: 64617 - RNA, 62 nt, hsa
ucggcuuuuucauuuacccucauuuagagccauuugcagagauuuagaaagauuuacaguaa

SEQ ID NO: 64618 - RNA, 62 nt, hsa
gaaaugaaguacccuuuuguaaauagcauuuuuuugcagaaggugaaaauuccacucucuac

SEQ ID NO: 64619 - RNA, 62 nt, hsa
gucugcaagauaaauuagaucgcccugugggguuugcagaauuagugaaggguccaggacga

SEQ ID NO: 64620 - RNA, 62 nt, hsa
aagccacgccuguugaauaaagcuuugguguguuugcagaugggaucuggcugaugucuguc

SEQ ID NO: 64621 - RNA, 62 nt, hsa
ggagcccggggcucugcagcauuccaguccccuuugcagauccauagcugcucugcagggcg

SEQ ID NO: 64622 - RNA, 62 nt, hsa
cucugcauggguuggauuuuccaaaaucauaauuugcagaaggaaggccagcauuuacgaug

SEQ ID NO: 64623 - RNA, 62 nt, hsa
cagugaggauaagcacagauugaauuguacaguuugcagaugcagauguaaaugcaugggac

SEQ ID NO: 64624 - RNA, 62 nt, hsa
gcgaguggagcaggggcaggcgaaccucuuucuuugcagaccgaacagugaaaagcuuucag

SEQ ID NO: 64625 - RNA, 62 nt, hsa
auauuuuaaaauuuguucuuguauuuauugguuuugcagaagaaggcaucgucaugcacagu

SEQ ID NO: 64626 - RNA, 62 nt, hsa
guagcaguaucuugagaaguuuuauaaauauuuuugcagaacacuauucuaauugaacaaug

SEQ ID NO: 64627 - RNA, 62 nt, hsa
accuccucuggauuuguucacucugagaucuguuugcagagugggugcuuagcagacagagu

SEQ ID NO: 64628 - RNA, 62 nt, hsa
agccuuuaguuuuuaaaguaaaauucauuuuauuugcagaguacacuuguaugguagacugu

SEQ ID NO: 64629 - RNA, 62 nt, hsa
acaccuggcccuugcaaucuucuacuuuaagguuugcagagauaaaccaauaaauccacacc

SEQ ID NO: 64630 - RNA, 62 nt, hsa
cugugcaaugaaaaauagccuuuaaggguuucuuugcagacugauuucauuggauggauacu

SEQ ID NO: 64631 - RNA, 62 nt, hsa
uuccuuuugucuuuugcuguaagcuuugaccuuuugcagaucugaugaaaauacaaccucuu

SEQ ID NO: 64632 - RNA, 62 nt, hsa
caacccugugggcuuaugucucugccuuaggguuugcagaguggaaacucagccguagggug

SEQ ID NO: 64633 - RNA, 62 nt, hsa
gagcguguacguuaaugugaauguauauagucuuugcagagguccaaaugauauucaugaug

SEQ ID NO: 64634 - RNA, 62 nt, hsa
cccaccgcagcuacuccccuuucuuccaaacuuuugcagaaaaaacaaaaaaacuacaaaca

SEQ ID NO: 64635 - RNA, 62 nt, hsa
agcgucaggccuaccucaaguucuuggaccaguuugcagagugaaagaucaagaaaugucuc

SEQ ID NO: 64636 - RNA, 62 nt, hsa
gaacuccugugcuuggugcccacaguauagauuuugcagaggcuguaaaauugauugugggg

SEQ ID NO: 64637 - RNA, 62 nt, hsa
uccaacaaagaagccaugaccaguuaaagauauuugcagaguuacaccuuggucauaagucc

SEQ ID NO: 64638 - RNA, 62 nt, hsa
acaggugcgugucaccaugcuuggcuaauuuuuuugcagaaacgaggccucacuauauuguc

SEQ ID NO: 64639 - RNA, 62 nt, hsa
aaccaaaaagaaaggaagucgaaguaucucuguuugcagacgauaugauucuauaucuagaa

SEQ ID NO: 64640 - RNA, 62 nt, hsa
uuucucugcaaagacuagauccuuuuuuacgcuuugcagaccgcauagucacugucucaacu

SEQ ID NO: 64641 - RNA, 62 nt, hsa
aggaguuugaggguuugggaugggagaaguauuuugcagagcuaucaauguccaaauaauuu

SEQ ID NO: 64642 - RNA, 62 nt, hsa
cauauuuuguuuaguacaguuucauauuugaguuugcagaauuaucuaauagucuuuuuuug

SEQ ID NO: 64643 - RNA, 62 nt, hsa
gcuaggccagugcuuuuuccucuuaggguuucuuugcagaaagaaaccuccagcaagggaag

SEQ ID NO: 64644 - RNA, 62 nt, hsa
aaagaugaaugcaauaguaggacugcugacauuuugcagaaaauacauuuuauuuaaaaucu

SEQ ID NO: 64645 - RNA, 62 nt, hsa
aagguuggaacugcugccaugauuuuggccacuuugcagaccugggacuuuagggcuaacca

SEQ ID NO: 64646 - RNA, 62 nt, hsa
gaugggauagacuggggagacgaugcuguugcuuugcagaucacagugcuggaagcaggaac

SEQ ID NO: 64647 - RNA, 62 nt, hsa
aagagagagaagagaaaaugaaagcagcugguuuugcagaagugugugucgcaugcgccagu

SEQ ID NO: 64648 - RNA, 62 nt, hsa
ucuggugcacagguuuguuuuuucaagaaaauuuugcagaagcuauguuuuuaaaguguaca

SEQ ID NO: 64649 - RNA, 62 nt, hsa
agcucauuccuuacccugguuaggucacuacuuuugcagauuuugcuggcacugaucuggag

SEQ ID NO: 64650 - RNA, 62 nt, hsa
gcaggugcugacucccgcacucccuggcauuuuuugcagacaagggcuugggauggacccuc

SEQ ID NO: 64651 - RNA, 62 nt, hsa
cauguucuccauucaagggucuuguguaaacguuugcagacacaggugcagcuuuggagaac

SEQ ID NO: 64652 - RNA, 62 nt, hsa
uauccaaucugccugugacaugcauuuuacucuuugcagagaaugagcugcaguccaguuua

SEQ ID NO: 64653 - RNA, 62 nt, hsa
aaguccggaugggaauauucacauuaaucauuuuugcagagacuuugcuagauccucucaua

SEQ ID NO: 64654 - RNA, 51 nt, hsa
ccuguuggggagcaggaugacuuugcagauuuuauggcuuucaguaauagc

SEQ ID NO: 64655 - RNA, 62 nt, hsa
gaaauggaagaaagugaacuugaugcucaguauuugcagaauacauucaagguuucaaagcg

SEQ ID NO: 64656 - RNA, 62 nt, hsa
uaacagaagggaaaaggaaagaagaaaagauuuuugcagaauuucucaaaaaucaguuugug

SEQ ID NO: 64657 - RNA, 62 nt, hsa
gaguuuucuuaucuuguguuuagagguuguuuuuugcagaucuugguguuaauagaccaaau

SEQ ID NO: 64658 - RNA, 62 nt, hsa
aaucuuuuuuuuguuguuuuuaaaaaauucauuuugcagaaagccugaaagaaaaaaaauac

SEQ ID NO: 64659 - RNA, 62 nt, hsa
caagcgcuuggccucuccuucucuuccuucacuuugcagaggcuggaagacggcagccgccg

SEQ ID NO: 64660 - RNA, 62 nt, hsa
uuuaggguuggcgagcaucucuggaaauagcuuuugcagaggaguggugggaggaauagagg

SEQ ID NO: 64661 - RNA, 62 nt, hsa
gcuggguuagggcagggccuggaaaugugcauuuugcagaaacuuuugagggucguugcaag

SEQ ID NO: 64662 - RNA, 62 nt, hsa
uaaucacgugcucgaugaagaacaguuggcacuuugcagauggccagugucacggugaaggc

SEQ ID NO: 64663 - RNA, 62 nt, hsa
acuuaucaaaauuugguagcuauucuaaggcuuuugcagaaaaauaaguguucaauguuugu

SEQ ID NO: 64664 - RNA, 62 nt, hsa
gguauuugauguauuuaauugugaaaggagacuuugcagauaaaugaggccagaauggcaug

SEQ ID NO: 64665 - RNA, 62 nt, hsa
ugcacuccagacggcuuucucaguuccaagauuuugcagagagaaggagcaaaccuuuucau

SEQ ID NO: 64666 - RNA, 62 nt, hsa
cugcuugcacuuuugcauuugccuaacagacuuuugcagaggcgauggcagagagcagcugc

SEQ ID NO: 64667 - RNA, 62 nt, hsa
ucgauuuacuuccuaauuauaaaagcugcuuuuuugcagaacauuccuugaaaauauaaggu

SEQ ID NO: 64668 - RNA, 62 nt, hsa
ccacgcugcuuucuucccaaaggacauguauauuugcagagcuccacauacagaaacacauu

SEQ ID NO: 64669 - RNA, 62 nt, hsa
uuugcagagcuccacauacagaaacacauuauuuugcagaaauagguguuuuuaagaaguuu

SEQ ID NO: 64670 - RNA, 62 nt, hsa
acuucuaaaauucggaauucuagauccuugcuuuugcagaauuuggugcucagacaauauuu

SEQ ID NO: 64671 - RNA, 62 nt, hsa
aaaauaaaaagaaaagaaaagaauggacaguguuugcagagaguugcucacgaguuucccuc

SEQ ID NO: 64672 - RNA, 62 nt, hsa
gggucuggggccucccuccgucugcgcccaccuuugcagaauaaacucucuccugggguuug

SEQ ID NO: 64673 - RNA, 62 nt, hsa
uuggccaugauugaugacgugacugcuuccauuuugcagaugaggaaacuaaggcucagaga

SEQ ID NO: 64674 - RNA, 62 nt, hsa
agggccggguccacuuccauuguuagcaguuguuugcagaauuuucucuuuuaccauuccuc

SEQ ID NO: 64675 - RNA, 62 nt, hsa
uugcccaaagauccuuugcugaguguucuguuuuugcagaauaaaagcaaaggaugcagacu

SEQ ID NO: 64676 - RNA, 62 nt, hsa
ugcagugacuuucugacccauccaccuguuuuuuugcagauugucaugaauaaaacggugcu

SEQ ID NO: 64677 - RNA, 62 nt, hsa
uuguauagaacuuuaagaggaucagaagguuuuuugcagaguuauaauuacauucaaaguau

SEQ ID NO: 64678 - RNA, 62 nt, hsa
aaaacaccaaaguguucauacuaaaauauauuuuugcagauacauuaaauaugaaagauauu

SEQ ID NO: 64679 - RNA, 62 nt, hsa
uuucuaaauacuugcucuugguaucuauaacuuuugcagagaccagaagcaaacaauuugug

SEQ ID NO: 64680 - RNA, 62 nt, hsa
cuuuguaaaguuuguauuuauuccccuuuagguuugcagaggggguaggggcagagucaggg

SEQ ID NO: 64681 - RNA, 62 nt, hsa
acuaaauaacuucugcacagcaaaagaagcuauuugcagacuacagaaugggagaaaauguu

SEQ ID NO: 64682 - RNA, 62 nt, hsa
uucucccauuucugaguugucucuucauucuguuugcagaagcuguuuagaagccacaccuu

SEQ ID NO: 64683 - RNA, 62 nt, hsa
uagacuucagugaccacacuguggaaaauaccuuugcagacguggcacccgagugcacacac

SEQ ID NO: 64684 - RNA, 62 nt, hsa
uucacuccggcaggcagaccugcuggagcugcuuugcagaaugacuugggucuugcuggccc

SEQ ID NO: 64685 - RNA, 62 nt, hsa
ccccuucugacucuggaaaccgcaccuuuaacuuugcagaccuuccuucaccccugacuucu

SEQ ID NO: 64686 - RNA, 62 nt, hsa
aggaaggucuuacccccucuucuauuuauuaauuugcagacccagccccuccccuacuuuuu

SEQ ID NO: 64687 - RNA, 62 nt, hsa
acaacaccagaggguucauacugagauauauuuuugcagaugcaguauauauuuaaaacauu

SEQ ID NO: 64688 - RNA, 62 nt, hsa
aaaacaccagagaguucauacuaaaacauauuuuugcagauacaggaaaaauuuuuuaaaaa

SEQ ID NO: 64689 - RNA, 62 nt, hsa
ugauucuguucuucuccauuuuuggcaguuaauuugcagaaguaacugacagcugacaccau

SEQ ID NO: 64690 - RNA, 62 nt, hsa
cucccuugaauguggcugugcaggauucaggguuugcagaaauucucaggaccucagaccuc

SEQ ID NO: 64691 - RNA, 62 nt, hsa
guuguauugcccaguaggagcuaucacuauauuuugcagaauggaaacugcccugacucaug

SEQ ID NO: 64692 - RNA, 62 nt, hsa
auagaaaugaacacagagauauugccuguguguuugcagagaagaugguuucuauaaagagu

SEQ ID NO: 64693 - RNA, 62 nt, hsa; identical to SEQ ID NO: 64692

SEQ ID NO: 64694 - RNA, 62 nt, hsa
auaaguuagucauauggccugauuuucccauuuuugcagaucucguggacaaguguuuauca

SEQ ID NO: 64695 - RNA, 62 nt, hsa
gggggugcagaacccugcaggcagccccaggcuuugcagaaaccacacacacuguugcugga

SEQ ID NO: 64696 - RNA, 62 nt, hsa
cugcccuccgccgcuccgccugagcuccccgguuugcagaauggaggagggaaguugaagga

SEQ ID NO: 64697 - RNA, 62 nt, hsa
gcaggcugggggcaagggauucugcucauguguuugcagaccggcugggauagccuccccac

SEQ ID NO: 64698 - RNA, 62 nt, hsa
uuucuguucucauaaggauacugcugagugucuuugcagauucagccuaaaagcaaagaaaa

SEQ ID NO: 64699 - RNA, 62 nt, hsa
ccaaagagucuagcaaaacaauauaguauuuuuuugcagaggcaugaaaaauuaagacgcuu

SEQ ID NO: 64700 - RNA, 62 nt, hsa
gaacuguuccccugaggagaagcgguggccucuuugcagaucaaccaacuuaaucugguuga

SEQ ID NO: 64701 - RNA, 62 nt, hsa
auaagcaaaaaguaccucuucuuaaagugcacuuugcagacguuucacuccuuuuccaauaa

SEQ ID NO: 64702 - RNA, 62 nt, hsa
accaacuuccuuagauuuuuuuuuuuaagcuguuugcagaaaacugggugguagcgugucug

SEQ ID NO: 64703 - RNA, 62 nt, hsa
acagugacccugcgaggcaaggguuugcccaguuugcagaugagaaacccaaagcugagaga

SEQ ID NO: 64704 - RNA, 62 nt, hsa
gcaacaaccgacaucugaacaccuacauuuccuuugcagacaaauugaagaacuggugggau

SEQ ID NO: 64705 - RNA, 62 nt, hsa
ccuccaggaacugucauggauguccaaauggcuuugcagaaaggaaaugagaugacaguauu

SEQ ID NO: 64706 - RNA, 62 nt, hsa
guuacauguaugccugcccaguucccuuuuuauuugcagaagcugugaguuuuguucacaau

SEQ ID NO: 64707 - RNA, 62 nt, hsa
ugagccccgugcuguauuuuguaauaaagucuuuugcagauugcuucccgagcuuccuuugu

SEQ ID NO: 64708 - RNA, 62 nt, hsa
ucucauuagggaacuuuuacaguucaaauuaauuugcagaaguugccauaaauguuugcaua

SEQ ID NO: 64709 - RNA, 62 nt, hsa
ccaucucuucuccaccuucucuccacagaauguuugcagagcugggcaguugaggaaaggac

SEQ ID NO: 64710 - RNA, 62 nt, hsa
uccgggaaguuguggaauuguuggaagaagaguuugcagaagguuaggaauggguagauagc

SEQ ID NO: 64711 - RNA, 62 nt, hsa
ggccuuccugcugccccccuccaccagugccuuuugcagagagauauuuuguguacacagaa

SEQ ID NO: 64712 - RNA, 62 nt, hsa
uaccugggagauuucaccaguuugacucaccauuugcagaugugcuuuuguauuaaauuuaa

SEQ ID NO: 64713 - RNA, 62 nt, hsa
ugagugauugacaucuuuuuggcacauuacacuuugcagaguaagggaucauugaggcuucu

SEQ ID NO: 64714 - RNA, 62 nt, hsa
acacaggaggacgccuggggacuuuuuauauauuugcagauuacgccuuuuuguaacgagca

SEQ ID NO: 64715 - RNA, 62 nt, hsa
agaagccgaggagcagaaggagcugugagagcuuugcagaaacgcccuuguccccgcccucc

SEQ ID NO: 64716 - RNA, 62 nt, hsa
ugguuuucugagaagauaggauuggauuggauuuugcagagggugagaacuucucugugccu

SEQ ID NO: 64717 - RNA, 62 nt, hsa
agccucuggcccaggccccuccccaccagggcuuugcagauguccuugaaagacccacccua

SEQ ID NO: 64718 - RNA, 62 nt, hsa
ccauuucagaugcaaucacuuuuggacaugcuuuugcagacaguccuuaaugcugaaaacac

SEQ ID NO: 64719 - RNA, 62 nt, hsa
aguugcauauucccagacugaggcagggcagguuugcagagagagacccagagugcacguga

SEQ ID NO: 64720 - RNA, 62 nt, hsa
ccuucaaugugaccuaauugggaaauagagucuuugcagaugaucuaguugagaugagguca

SEQ ID NO: 64721 - RNA, 62 nt, hsa
gauggcugcaagcgcacuugauggucaggaaguuugcagauacucgccaaggcagagcgcaa

SEQ ID NO: 64722 - RNA, 62 nt, hsa
uuugggguauggggggaguguuucugaccugcuuugcagacgugccuccgcaccucagcagu

SEQ ID NO: 64723 - RNA, 62 nt, hsa
cugugaggugacucgugaaaguaggugauuccuuugcagaacuucagggacugggagcagag

SEQ ID NO: 64724 - RNA, 62 nt, hsa
gacggacuuccucucccuucggacucacagccuuugcagagucaagcuccacuugaagcuca

SEQ ID NO: 64725 - RNA, 62 nt, hsa
uaggaugugauuuggcucuuuaggaaacugaauuugcagaacuuaagaauauugauuuauaa

SEQ ID NO: 64726 - RNA, 62 nt, hsa
cagugaucuggagaggcugcaggggccacgaguuugcagaugcuguacuucagcaauaaccu

SEQ ID NO: 64727 - RNA, 62 nt, hsa
agccuucagagaugauccagcccaaaccccauuuugcagagaggaaaacugaggccuagaag

SEQ ID NO: 64728 - RNA, 62 nt, hsa
uccccugggcuguacugagccgagcccagggguuugcagaggguggggguccaucucuccag

SEQ ID NO: 64729 - RNA, 62 nt, hsa
aggagugggcaccccauaaggguuuaggccacuuugcagaggauggaggucaaaaaccacuc

SEQ ID NO: 64730 - RNA, 62 nt, hsa
agcccacccuccaccccgcuguuuuucuuaaauuugcagaacuucaaauuggcuauuccucu

SEQ ID NO: 64731 - RNA, 62 nt, hsa
aaccaaaugauauuugaguuuuuguuauuccuuuugcagauugggauguguuuugggggcag

SEQ ID NO: 64732 - RNA, 62 nt, hsa
ugagcucccccacccccuccagguccucagaguuugcagaucugggcuuucuaaagcaagug

SEQ ID NO: 64733 - RNA, 62 nt, hsa
uggggagggagggagggggagggcugaauuguuuugcagaggaagauggcaucugugcuuua

SEQ ID NO: 64734 - RNA, 62 nt, hsa
cucccagaggaaaacacugcagaaggaacugguuugcagacuguggaaggaucugcaguuuu

SEQ ID NO: 64735 - RNA, 62 nt, hsa
cacaucucaggcggcagugaaguccagauaguuuugcagauuguuuugcuacuuuuucauau

SEQ ID NO: 64736 - RNA, 62 nt, hsa
gugggcgggcgggccuggggcacuccgucgccuuugcagaaccaccugggccccuuucuguc

SEQ ID NO: 64737 - RNA, 62 nt, hsa
guagacaccguuccucaugcugccggguggguuuugcagaagcucccuuagugauuucaugu

SEQ ID NO: 64738 - RNA, 62 nt, hsa
augggacaccuguaauguaacccacacagcgguuugcagagaauguuagccaugacuugggc

SEQ ID NO: 64739 - RNA, 62 nt, hsa
gaaguugugaaacugcuucaaguaaauagugguuugcagaacacuguaggagcaucugucac

SEQ ID NO: 64740 - RNA, 62 nt, hsa
agcucucugauggguucgagaaaacuuauguuuuugcagauuacccagcuuuguucuuguua

SEQ ID NO: 64741 - RNA, 62 nt, hsa
cagaaaauuuacaguguaacauugugucaacauuugcagauugacuguauaugaccuuaauc

SEQ ID NO: 64742 - RNA, 62 nt, hsa
guuauacgcgugccauccaaauuaauccugcauuugcagaugcacauagcaaucuggcuucc

SEQ ID NO: 64743 - RNA, 62 nt, hsa
uuguaaaaaaauaaaauuaaaauuaaaaaaaguuugcagaaccgcauauacaguaucagccc

SEQ ID NO: 64744 - RNA, 62 nt, hsa
aaucuauugggauuuucuacaaguauucugccuuugcagaaacagauuuggugaauuugaau

SEQ ID NO: 64745 - RNA, 62 nt, hsa
ucaaaccaagcaagcuuuaucaaaauggcuuauuugcagaauaguuccaaugauauaaaugc

SEQ ID NO: 64746 - RNA, 62 nt, hsa
cuuaguauuuuauaucagcaaaauaacucaauuuugcagauugcaaacaaauauaaaagcug

SEQ ID NO: 64747 - RNA, 62 nt, hsa
gucuccaaauaaaagaagcuuauuguaguauguuugcagaaaaauucuaaacaaaaauuaua

SEQ ID NO: 64748 - RNA, 62 nt, hsa
aaaucagccagcuccaugcccaaaccuuccuguuugcagaacuuuuuaaugucuuuucuuuu

SEQ ID NO: 64749 - RNA, 62 nt, hsa
cagccucucucaugucuaaaaaggcacagaauuuugcagaucugaggaagagggaugcauua

SEQ ID NO: 64750 - RNA, 62 nt, hsa
aaaaaaucccaacuauugagcauguuuaaaucuuugcagagauuugccuuuucuuaaucaaa

SEQ ID NO: 64751 - RNA, 62 nt, hsa
acacuuuuuccuuccaacacuucuugauuggcuuugcagaaauaaaguuuuaaaauaaaacu

SEQ ID NO: 64752 - RNA, 62 nt, hsa
uguuuugaucauaugcauguauguagaauauuuuugcagagcagaaagauuauguuagaagu

SEQ ID NO: 64753 - RNA, 62 nt, hsa
cuguuuguucuccuggggcgcucccuccaacuuuugcagauucuugcaaccuccuccugagc

SEQ ID NO: 64754 - RNA, 62 nt, hsa
gauacagcucaucauucuguagaaaugugcaguuugcagauagaacacugcacacagaaaug

SEQ ID NO: 64755 - RNA, 62 nt, hsa
gcuugcccuaggcuuaauggaugggcagucauuuugcagaggcuaugggaagagggugauaa

SEQ ID NO: 64756 - RNA, 62 nt, hsa
gccauuuaccuucuaauaacccugccaugugguuugcagaaagagauggauauaguagccuc

SEQ ID NO: 64757 - RNA, 62 nt, hsa
cugugguggucucccuguccaagcgggaccgcuuugcagagaccagaggcauaucgcggcuu

SEQ ID NO: 64758 - RNA, 62 nt, hsa
aaugggacggaauccacccacaacgcgcuugguuugcagaugucaaagaaucugcagagggu

SEQ ID NO: 64759 - RNA, 62 nt, hsa
guuuuuauuugauuuuaguugugugcuuuucauuugcagaaguuaguaacugcagcucaccu

SEQ ID NO: 64760 - RNA, 62 nt, hsa
auguaaacacaaauguaugccugagguugguuuuugcagaaaacagucucugcuucuaaaaa

SEQ ID NO: 64761 - RNA, 62 nt, hsa
auuggccucuuugggugggacucuaagcaguauuugcagaaauaugcuucugguccaacuug

SEQ ID NO: 64762 - RNA, 62 nt, hsa
uggacaugccuggaagaccccucagccuucuguuugcagaacguucauuucaggagcuucuc

SEQ ID NO: 64763 - RNA, 62 nt, hsa
ugacaucuuuagggcaggauucuuauccccauuuugcagaugaaaacccugagucacagauu

SEQ ID NO: 64764 - RNA, 62 nt, hsa
agccagggagagauccagagaguuuucaaguuuuugcagauguaggugguuccagcuuuucu

SEQ ID NO: 64765 - RNA, 62 nt, hsa
aaggcaguagucugcauuaggacuguuugaguuuugcagacuugggguugggagaacaucuu

SEQ ID NO: 64766 - RNA, 62 nt, hsa
gaccacgcauugucacagcuaccaaagugugguuugcagaugaucugggcuuguuucuggca

SEQ ID NO: 64767 - RNA, 64 nt, hsa
uuguucugaaguuacccucugaaaaauauuuugucucucugacuugauuucuauaaaugcuuuu

SEQ ID NO: 64768 - RNA, 64 nt, hsa
auucuuuuuuaaauuauuuuuuaaaagucuuucucucucugauucagcuuaaauuuuuuuaucg

SEQ ID NO: 64769 - RNA, 64 nt, hsa
caucuuugaguagcacuguuuuggggcccucggucucucugaagacccuagcagaacugauacc

SEQ ID NO: 64770 - RNA, 64 nt, hsa
cagugucugaucaugugaaacacaacacguuuuccucucugagucccagcuauggggaacaucu

SEQ ID NO: 64771 - RNA, 64 nt, hsa
aagacuccgucucaaaaaaagggcaauaaaugcccucucugaauguuugaacugccaagaaaag

SEQ ID NO: 64772 - RNA, 64 nt, hsa
ugggaggcuggucucccuccagcuggaauugcugcucucugagggagaggcugugguggcuguc

SEQ ID NO: 64773 - RNA, 64 nt, hsa
uagccaccacuacagggcuguuucauguacuucucucucugacucugucuuguccgacucucuu

SEQ ID NO: 64774 - RNA, 64 nt, hsa
uacuauuuuugguugugugauagaguuauuuaaccucucugagccucaguucccucguauguaa

SEQ ID NO: 64775 - RNA, 64 nt, hsa
ggauacccaccaucuuucaagggucacaagcucacucucugacaagucagaauagggacacugc

SEQ ID NO: 64776 - RNA, 64 nt, hsa
uccgggguuuuucuuccaucugacaucugccagccucucugaauggaaguugugaauguuugca

SEQ ID NO: 64777 - RNA, 64 nt, hsa
cucuuuauuuuucaaucucugaauauuuuagucucucucugagucucauuuuuuaaaaugcucu

SEQ ID NO: 64778 - RNA, 64 nt, hsa
accuacuauaauaugacugucugaaacuuauuuucucucugagaaauaaauguucuaaugggca

SEQ ID NO: 64779 - RNA, 64 nt, hsa
guguuggguguggguggucuccaaggccacgcugcucucugaauugauuuuuugaguuuuguuu

SEQ ID NO: 64780 - RNA, 64 nt, hsa
gaacuccugucucugugagaauguauacuuuaugcucucugaaauguaugacacccagcuuuaa

SEQ ID NO: 64781 - RNA, 64 nt, hsa
ccugggggucaggacagggccugauuugagccuccucucugaagaugauuuggccgagcggaag

SEQ ID NO: 64782 - RNA, 64 nt, hsa
uuuggacaggaggugcugaggcuggcugcaccugcucucugaagacgccuuccucucuagguuc

SEQ ID NO: 64783 - RNA, 64 nt, hsa
gaccguggccucccgaaucgccuucuuccucugacucucugagugguguccucggccccccuga

SEQ ID NO: 64784 - RNA, 64 nt, hsa
ccucgcuguguuuccucaggcagcauggcuccgccucucugagccucugucucugcuucugaac

SEQ ID NO: 64785 - RNA, 64 nt, hsa
ucuuguugccugaaauuguuauuguuuguuauuucucucugauguuuuuuguaagacauuguau

SEQ ID NO: 64786 - RNA, 64 nt, hsa
aucagcuuaauaacaacacuuauugcaccugucucucucugagaacacggugugucucgacacg

SEQ ID NO: 64787 - RNA, 64 nt, hsa
gcccugggcaggccgcuccugagcugcugucucccucucugaccuaugccuaccuucucuuucu

SEQ ID NO: 64788 - RNA, 64 nt, hsa
ugccagggucccuaagaacagguuugcagcuacccucucugaccuuuuccccauaucuugugcu

SEQ ID NO: 64789 - RNA, 64 nt, hsa
acacugcacagaagacagcagcaagugugcuggccucucugacauaugcuaacccccaaauacu

SEQ ID NO: 64790 - RNA, 64 nt, hsa
cagcgcgcacacgcacgcacacacacauacagagcucucugagggugauggggcugagcaggag

SEQ ID NO: 64791 - RNA, 64 nt, hsa
uuuaccaaaguaggauuuugagggugggggugcucucucugagggggugggggugccgcugucu

SEQ ID NO: 64792 - RNA, 64 nt, hsa
ggugccgcugucucugaggggugggggugccgcucucucugagggggugggggugccgcuuucu

SEQ ID NO: 64793 - RNA, 64 nt, hsa
gugccgcuuucucugagggggugggggugccgcucucucugagggggugggggugcugcucucu

SEQ ID NO: 64794 - RNA, 64 nt, hsa
gccucuugucuuucuucccugcuuugcugcuuugcucucugaaaccuacauuccgucaguuucc

SEQ ID NO: 64795 - RNA, 64 nt, hsa
uuggccuacacagagaaccguucguguugggcuucucucugaacgccccgaaccuugcaucaag

SEQ ID NO: 64796 - RNA, 64 nt, hsa
gagaaggugcacgaaggagacaccacuuggggaccucucugagcaggcucucgugaaucagcuc

SEQ ID NO: 64797 - RNA, 64 nt, hsa
ucuguggagucaaggucccccucucccaggcaggcucucugagggcauucuguagucccaggcc

SEQ ID NO: 64798 - RNA, 64 nt, hsa
aaauucacccuacauuccucuccucuucacuagccucucugaagguguccuggccagcccugga

SEQ ID NO: 64799 - RNA, 64 nt, hsa
ccaaccuggaauggagacuuuuaucuacuucucucucucugaagaugucaaaucgugguuuaga

SEQ ID NO: 64800 - RNA, 64 nt, hsa
uuccccacggcccuugccacugucuccuggcccucucucugaucaugccagguuugcaccagcc

SEQ ID NO: 64801 - RNA, 64 nt, hsa
uuguaguacauucuccaagaugcagcccaggagccucucugaaggaccagucugguuacgaugg

SEQ ID NO: 64802 - RNA, 64 nt, hsa
cugggucuccucccgggcucagugggccuggggccucucugacguggugccugcuggagggagg

SEQ ID NO: 64803 - RNA, 64 nt, hsa
gguggguuacacugaucuuguuccacugauuacucucucugacgaguccaucaccugcaacuua

SEQ ID NO: 64804 - RNA, 64 nt, hsa
caccauggcuccccuuccuugucuggggccuggacacacugaggacaaugcggcuauagcagau

SEQ ID NO: 64805 - RNA, 64 nt, hsa
ucuugccauugagccuugaagcugccuuuggugacacacugagugaaagggacugggccagcuc

SEQ ID NO: 64806 - RNA, 64 nt, hsa
aaucauggcauuacugaggaguaaaccucucuggcacacugagcauggucagggcauuggucag

SEQ ID NO: 64807 - RNA, 64 nt, hsa
ucauacacaauucauacacaugcaaucauacaugcacacugacucugaacugggugaacucugu

SEQ ID NO: 64808 - RNA, 64 nt, hsa
ucacucaacaaugccagaugaauggaagagggaacacacugagaugacuuagacucugguccac

SEQ ID NO: 64809 - RNA, 64 nt, hsa
acugucuuccaaacaugagacaaagcugacuguucacacugauugcccagcacauaccgucuug

SEQ ID NO: 64810 - RNA, 64 nt, hsa
ggcggguggcacgcugcagcccggaguccccguucacacugaggaacggagaccugugaccaca

SEQ ID NO: 64811 - RNA, 64 nt, hsa
uuucgugucaauucucuagcauacuggguaugcucacacugacggggggaccuagugaaugguc

SEQ ID NO: 64812 - RNA, 64 nt, hsa
ccacacacauccucaccccacagaaacugcuggacacacugaagaaacugaauaaaacagauga

SEQ ID NO: 64813 - RNA, 64 nt, hsa
gaaucauagagaugucuguguucuuggaguauuucacacugaggacuaaucugcuaucuucauu

SEQ ID NO: 64814 - RNA, 64 nt, hsa
ucucguccaucucuguugccucugcacaucagcacacacugacuccaccugggcuggcuccugc

SEQ ID NO: 64815 - RNA, 64 nt, hsa
cagcaacagucucaucucccagauuaccucugugcacacugacacguggucccguccauccuga

SEQ ID NO: 64816 - RNA, 64 nt, hsa
cagucccuguucauaccaucucugcacccacaaucacacugauuuuucaaauucauuuuguuuu

SEQ ID NO: 64817 - RNA, 64 nt, hsa
uuuuucuuuuuuuuuuuuuuuuguccacuaaaaacacacugauggucaacacaggucaaaacca

SEQ ID NO: 64818 - RNA, 64 nt, hsa
ccuggagguaggaagggacuugcccccaaggccgcacacugaguuaacagcagaauugagacug

SEQ ID NO: 64819 - RNA, 64 nt, hsa
ugguccguauaacacauuuuaccaacagcuccuucacacugaauccuuuaacuuggccaaagga

SEQ ID NO: 64820 - RNA, 51 nt, hsa
uacugaccacugagcucugagggccuguagcuggaauacgcaucucuccag

SEQ ID NO: 64821 - RNA, 64 nt, hsa
uaaaagagaucucuaaaacuuccccaucccuuugggccuguacaaagaaauucuggauguuaaa

SEQ ID NO: 64822 - RNA, 64 nt, hsa
cacucagcaaacacauuggguaucuugugcccaaggccuguauuuguggagcugauguucuagu

SEQ ID NO: 64823 - RNA, 64 nt, hsa
aaguggagauguuggggccaggcacaguggcccaggccuguaaucccaucacuuugggaggugc

SEQ ID NO: 64824 - RNA, 64 nt, hsa
cagaaauugaggacagcgaugcgggcagcuggggggcugagagcacccagaggaccgaggacag

SEQ ID NO: 64825 - RNA, 64 nt, hsa
ccuccugggacagggcuggguccucuggcuauuuggcugagaaggggccaggccaagggccggg

SEQ ID NO: 64826 - RNA, 64 nt, hsa
accccucagucccuacgucaagcggaguggauaaggcugagaugagugcugggagugguggaca

SEQ ID NO: 64827 - RNA, 64 nt, hsa
ccgaggagacuaacuugcuuucucccugcaugcaggcugagauuguuucuggaaggggcuggcc

SEQ ID NO: 64828 - RNA, 64 nt, hsa
gcaggccugccagccccucuccacugagaaguugggcugagaguauggggaaaagaaucaagag

SEQ ID NO: 64829 - RNA, 64 nt, hsa
ugaguuuuucacguguaagaugagaauggcugauggcugagagcccaccaaccuuccccacccc

SEQ ID NO: 64830 - RNA, 64 nt, hsa
uuccuuuuguauuccauuguggaagcuucuaggaggcugagaagcaggagauccaagcuccagu

SEQ ID NO: 64831 - RNA, 64 nt, hsa
gguggcgggcgccuguagucccagcuacuuggaaggcugagacaggagaauggcgugaaucggg

SEQ ID NO: 64832 - RNA, 64 nt, hsa
gggcagggugucaugcaugggugcagaggauggaggcugagaaagguagacagcuacccaugau

SEQ ID NO: 64833 - RNA, 64 nt, hsa
accccuguagcagagccucccguccacccucaggggcugagacagcucucgaggaguggugcuc

SEQ ID NO: 64834 - RNA, 64 nt, hsa
cccgcggacuuccuagugcccaaaugcccugugaggcugagagacccaggccccuguggcuuuc

SEQ ID NO: 64835 - RNA, 64 nt, hsa
cauguggaccgugagucgcaaacacucuggagaaggcugagaugccaccauucccacggggacu

SEQ ID NO: 64836 - RNA, 64 nt, hsa
ucaucccgaaguggaagggggucuaaacagaacaggcugagagaggcgggacugggucaagugg

SEQ ID NO: 64837 - RNA, 64 nt, hsa
ucaugucacaaacacaaucuauucuacaugaggaggcugagaaaggggaagagaaaaacaaacc

SEQ ID NO: 64838 - RNA, 64 nt, hsa
cugaggauuucuagccagaggucccagaugccugggcugagaacccagcgauaagggggcguuc

SEQ ID NO: 64839 - RNA, 64 nt, hsa
uauccacaugcagaaacaucuggcaaccccacauggcugagaugaccugguccuaggacacccu

SEQ ID NO: 64840 - RNA, 64 nt, hsa
auagaccagccccuggaaaggcugcuuuggucaaggcugagagcagcuuugcucaaggaaauua

SEQ ID NO: 64841 - RNA, 64 nt, hsa
gagcagcccgcugaguggacuggaguggagcauuggcugagagaccaggagggcacuggagcug

SEQ ID NO: 64842 - RNA, 64 nt, hsa
acaggucccucacccacccacaauccuauucucgggcugagaacccugcguggggacagggcuc

SEQ ID NO: 64843 - RNA, 64 nt, hsa
ccuuggcacuacuacaaugcccuccauucuucagggcugagaauugacgagaagccagcucacc

SEQ ID NO: 64844 - RNA, 64 nt, hsa
gaagagacaauucagggcaguugaugaauaucagggcugagauguggugagacuuccguuuuua

SEQ ID NO: 64845 - RNA, 64 nt, hsa
ugcuggaccucgacguccugcggggccaccccccggcugagacuuugcccugaacuuguccggg

SEQ ID NO: 64846 - RNA, 64 nt, hsa
cuagcucacggguagugggauucugcauuaguggggcugagagaugugggggccccuccagccc

SEQ ID NO: 64847 - RNA, 64 nt, hsa
auuguuagaaaccaaagucuucucugcuggcuggggcugagagagggucuggguuaucuccuuc

SEQ ID NO: 64848 - RNA, 64 nt, hsa
ccuagccaagaucauaugaagaguuuggcacggaggcugagaaugaccuggcauagaugguuug

SEQ ID NO: 64849 - RNA, 64 nt, hsa
cccgggcccucagccucucuuguacaggcugagaggcugagaaaucauccccugaauaacuuuu

SEQ ID NO: 64850 - RNA, 64 nt, hsa
gugagggccccgggcccucagccucucuuguacaggcugagaggcugagaaaucauccccugaa

SEQ ID NO: 64851 - RNA, 64 nt, hsa
uguggcacacaacuguggucccagcuacaggggaggcugagacgcaaggaucacuugagcccag

SEQ ID NO: 64852 - RNA, 64 nt, hsa
ggaggcucgugcauguaauccuagcacuuugggaggcugagaugggaggaucacuugaggccaa

SEQ ID NO: 64853 - RNA, 64 nt, hsa
aguggugugcaccuguagucccagcucuucaggaggcugagaaaagagaauuguuugaaccugg

SEQ ID NO: 64854 - RNA, 64 nt, hsa
cuacuuaggaggcugaggggcaaggauugcuugaggcugagagauugagccugcagugagcuau

SEQ ID NO: 64855 - RNA, 64 nt, hsa
uguuggagggguggagggauguuccccugagccaggcugagacuagaaccccaucuucccugag

SEQ ID NO: 64856 - RNA, 64 nt, hsa
aggcugagacuagaaccccaucuucccugagccaggcugagacuagaaccccaucuuccccacc

SEQ ID NO: 64857 - RNA, 62 nt, hsa
gaggcccuguucuuagagccccugacaaaggcagcacuuauuuccugggcuggugcgcccca

SEQ ID NO: 64858 - RNA, 62 nt, hsa
agcaugacaaaauggucaaaaaauaagucaucagcacuuaagaaaugaaagcaacuuuugaa

SEQ ID NO: 64859 - RNA, 62 nt, hsa
agauuuaaaaucuuaaaauguuucuuauuuucagcacuuacaucauuugguacacaggguca

SEQ ID NO: 64860 - RNA, 62 nt, hsa
agccaguuucaucaaacaguucaacagagagcagcacuuaauacccuuuauacagcccauuu

SEQ ID NO: 64861 - RNA, 62 nt, hsa
agucaaaaaacuugauuucagguccuagcucuagcacuuacagcugugugaucuugggcaag

SEQ ID NO: 64862 - RNA, 62 nt, hsa
auuuugauuuuacccagcuuaaucuguaaaguagcacuuaaauauaucugauagcaacacuu

SEQ ID NO: 64863 - RNA, 62 nt, hsa
ugaggaugaggaauaauaaacucuuuuuggcaagcacuuaaauguucugaaauuuguauaag

SEQ ID NO: 64864 - RNA, 62 nt, hsa
gguaaguuuuauaagggaguacauuuugacugagcacuuagggcaucaggaacagugcuacu

SEQ ID NO: 64865 - RNA, 62 nt, hsa
uggcauaccaaucugugcggggcaguguccuaagcacuuagacuacaucagggaagaacaca

SEQ ID NO: 64866 - RNA, 62 nt, hsa
aaauaucuuaaaauaucuaaaacauuuuuuaaagcacuuagauugucuuacguaugugcaua

SEQ ID NO: 64867 - RNA, 62 nt, hsa
aaacugucugucuaauggucacagagcacuguagcacuuaacagauugccauggacaccagu

SEQ ID NO: 64868 - RNA, 62 nt, hsa
ggcccucuuucccugcgagacgcacacagcugagcacuuagcaggcaccgccacgucccagc

SEQ ID NO: 64869 - RNA, 62 nt, hsa
auaaucaguauaauaauuugccuuguguggucagcacuuaacuguuuacaaagcccuuucac

SEQ ID NO: 64870 - RNA, 62 nt, hsa
caccuguggccccuaaacccagagugacugagagcacuuaacauucagcuugucucaucccc

SEQ ID NO: 64871 - RNA, 62 nt, hsa
gguuauguagaaaagcaauuuauuccauuuuaagcacuuacacaguuagucauggagaguaa

SEQ ID NO: 64872 - RNA, 62 nt, hsa
cucagugggccugugggagccuacuggagcccagcacuuacucccccugagcagcgagccug

SEQ ID NO: 64873 - RNA, 62 nt, hsa
uuucuucuaccacccaauucuacuaggaaaggagcacuuaggaggcucuugggaugcagcaa

SEQ ID NO: 64874 - RNA, 62 nt, hsa
uugugaggauuaaaaugaggaaaugaauguaaagcacuuaguacaguauaugaaauaauggg

SEQ ID NO: 64875 - RNA, 62 nt, hsa
cugggggugaaagaaaaauauuaguuuaccugagcacuuauuuccaugacagggucuaaaau

SEQ ID NO: 64876 - RNA, 62 nt, hsa
aaauagaaucuuauaucuguauguuaaaauagagcacuuaccugaagucaguggccuggauc

SEQ ID NO: 64877 - RNA, 62 nt, hsa
acauaauggugucuuaaaauugacaaaaaaugagcacuuacaauuguaugucuccucaaaug

SEQ ID NO: 64878 - RNA, 62 nt, hsa
gggcaggauugucuuuuuuuuucuguguccccagcacuuacaacaaagccuagcacaaagua

SEQ ID NO: 64879 - RNA, 62 nt, hsa
ucagcgcucuugcuuugcucuuuucaaugaauagcacuuauguuacugguguccagcugagu

SEQ ID NO: 64880 - RNA, 62 nt, hsa
auauauaguauguuuuaaguuuguaucuaaauagcacuuacuguaauguauuauaccuaaau

SEQ ID NO: 64881 - RNA, 62 nt, hsa
uuuuucuuuccucccuuaccccaaauucauugagcacuuaaaggagcagagaugcagccagu

SEQ ID NO: 64882 - RNA, 62 nt, hsa
cauuguaaacaaacuguguaacugcccaaagcagcacuuauaaaucagccuaacauaagauc

SEQ ID NO: 64883 - RNA, 62 nt, hsa
guuuuaaauuaauuuuuuagcagauagcaguuagcacuuaaucuguaaauugaauaauuuau

SEQ ID NO: 64884 - RNA, 62 nt, hsa
aaucaauuaguaauggcggaaacugucgcugaagcacuuaagaaauaaagguacuuuacagc

SEQ ID NO: 64885 - RNA, 62 nt, hsa
aagguggcuuuugcuuuauaguuuggcuggggagcacuuaauucuucccauuucaaaaggua

SEQ ID NO: 64886 - RNA, 62 nt, hsa
ucuauucuuauuauucacugcacuauauucuaagcacuuacauguggagauacuguaaccug

SEQ ID NO: 64887 - RNA, 62 nt, hsa
uuuccugucuuucccguccaucacccauccuaagcacuuacgugaguaaauaaugcagcuca

SEQ ID NO: 64888 - RNA, 62 nt, hsa
cucccucgagaaacagugccgccggugugaugagcacuuacacccacguucucaagggcaga

SEQ ID NO: 64889 - RNA, 62 nt, hsa
aucuuggcugucaagaguaucaaaugccaugcagcacuuaaacuugugauaaggaagaugaa

SEQ ID NO: 64890 - RNA, 62 nt, hsa
cauuuaauuagcugcauaucaccuuaggguacagcacuuaacgcaaucugccucaauuucuu

SEQ ID NO: 64891 - RNA, 62 nt, hsa
ggcugagugcaguggcucaugccuguaaucccagcacuuagggugccaauguggauuaccug

SEQ ID NO: 64892 - RNA, 62 nt, hsa
uuuuagaccucuuacuuccacugcuaguagcuagcacuuacugagcaccugcgaugagguaa

SEQ ID NO: 64893 - RNA, 62 nt, hsa
ggauuucagauaugaacgguguaaauuugagaagcacuuaugcauacaugugggugaaaaac

SEQ ID NO: 64894 - RNA, 62 nt, hsa
guucuuguuuuuauuuuugaaaguacucacacagcacuuacuaugcuccaaacacuccucua

SEQ ID NO: 64895 - RNA, 62 nt, hsa
uuugccucaacaacguaaacuuccuaaugauuagcacuuaauaauugcauauaaaaugcuuu

SEQ ID NO: 64896 - RNA, 62 nt, hsa
ugggacaauuguuuuaaucugaaauucuaaagagcacuuacuguaaccuguugcuguguuua

SEQ ID NO: 64897 - RNA, 62 nt, hsa
cugcggguggggcuuggggcucacacaccuguagcacuuacugguaggaccaagcaucuugg

SEQ ID NO: 64898 - RNA, 62 nt, hsa
agauaaaggcagcuaaaacgagggcaguagagagcacuuacccgaccccaaggugccagaga

SEQ ID NO: 64899 - RNA, 62 nt, hsa
aauuccuuggggauuuuuuacugcccuuucaaagcacuuaaguguuagaucuaacguguucc

SEQ ID NO: 64900 - RNA, 62 nt, hsa
acagaggcauauauuuaaaaugaaauuuaaugagcacuuagugacuucauuuguucaagaau

SEQ ID NO: 64901 - RNA, 62 nt, hsa
acauuuuuuagucuguaauacacuccacuugaagcacuuaagucuuccuuaaaugacuuuuc

SEQ ID NO: 64902 - RNA, 62 nt, hsa
uccuaaacaagagaauaaaaaugggccaucccagcacuuauaaggggagcacaucuuguaau

SEQ ID NO: 64903 - RNA, 62 nt, hsa
cuuucuugugaaaguuuucaaucagcgauaucagcacuuacaguaagaaguaaaaguagugc

SEQ ID NO: 64904 - RNA, 62 nt, hsa
cacugugugugauuuuguuucuuuuguuaagcagcacuuauguagacugcauuuccaaaugu

SEQ ID NO: 64905 - RNA, 62 nt, hsa
uaguacagaagauucuuuguuuuucuccacugagcacuuaacaauugcuuucucucuggccu

SEQ ID NO: 64906 - RNA, 62 nt, hsa
gauauacaaaguguaccaacauaaguguugguagcacuuaagacuuauacuugccuucugau

SEQ ID NO: 64907 - RNA, 62 nt, hsa
aagcuaaaacaacccauuugcuacccauccaaagcacuuacaguuuagcaaauauuaaagag

SEQ ID NO: 64908 - RNA, 62 nt, hsa
auaaaagagaaaaaaauucggaaagugaucagagcacuuauucaaaauacagugauagaagu

SEQ ID NO: 64909 - RNA, 62 nt, hsa
caagauauauaucuggaaccucuuauaaauggagcacuuagaaauuuguuguucugcacuua

SEQ ID NO: 64910 - RNA, 62 nt, hsa
cauuagcucagugacuuguccacacucgucuuagcacuuacguuucaaaagcuugucacaaa

SEQ ID NO: 64911 - RNA, 62 nt, hsa
acugaugucucagugaaucagucuguuuauuaagcacuuaucagggcuuccacacacuuauu

SEQ ID NO: 64912 - RNA, 62 nt, hsa
guggagggcugcaaucugucuugauuucuccaagcacuuaacuuucuuugacugcacugaga

SEQ ID NO: 64913 - RNA, 62 nt, hsa
ucaggucuuugcucauucacucaguaauacugagcacuuaccauguaccagaauuuuacuag

SEQ ID NO: 64914 - RNA, 62 nt, hsa
uuuaaauaauguaaacgcaaacaggguuugauagcacuuaaacuaguucauuucaaaauuaa

SEQ ID NO: 64915 - RNA, 62 nt, hsa
aaugaguaaaauaauuaaugaaacauauuuagagcacuuaauggucucuguuuucaauauaa

SEQ ID NO: 64916 - RNA, 62 nt, hsa
acuuagaaacauugcgcauauucuucugaaauagcacuuaaaaaugauuagugucaguauuu

SEQ ID NO: 64917 - RNA, 62 nt, hsa
ucaaaaggcccagagucugagucccagcccugagcacuuaggagccuucugacuuaggguuu

SEQ ID NO: 64918 - RNA, 62 nt, hsa
uuuuaagucagggaugcuuuauucuauuuuaaagcacuuaugaguuacauguuguaaucaag

SEQ ID NO: 64919 - RNA, 62 nt, hsa
cuuuguuauaauucauauaggcuugugaauauagcacuuauuuuaauccaguagagacuugc

SEQ ID NO: 64920 - RNA, 62 nt, hsa
uaaccucacacauuaacuuuauucaaacaaacagcacuuacaggaaauguaaaguagaaaaa

SEQ ID NO: 64921 - RNA, 62 nt, hsa
aaugggaaaaaacaccaggauuuaaguuucacagcacuuacaauuuucccucuucacuuggu

SEQ ID NO: 64922 - RNA, 62 nt, hsa
augguuucauguaacauacauauuccugguguagcacuuaacuccuuuuccacuuuaaauuu

SEQ ID NO: 64923 - RNA, 62 nt, hsa
cugaugaggaaaagauuaacuaauagaugcauagcacuuaacagagugcauagcauacacug

SEQ ID NO: 64924 - RNA, 62 nt, hsa
agacacggaucugagaaucuuuauugagaaagagcacuuaagagaauauuuuaaguauugca

SEQ ID NO: 64925 - RNA, 62 nt, hsa
uauugauguuuucauagagaauauaaaaauaaagcacuuauagaaaaaacucguuugauuuu

SEQ ID NO: 64926 - RNA, 62 nt, hsa
gcauuugucauacguuucuacuuaaauuauuaagcacuuacgauuuagauguaauaauuaua

SEQ ID NO: 64927 - RNA, 62 nt, hsa
uacuuuugugggaguauuucuauuauauaaccagcacuuacuaccuguacucaaaauucagc

SEQ ID NO: 64928 - RNA, 62 nt, hsa
augaggaagaagacaauuggauaagaugggacagcacuuauaaugaaauaaaaaaaaacuuu

SEQ ID NO: 64929 - RNA, 62 nt, hsa
auuucagucaguccagaggcaguuaacccuguagcacuuacuagacuggugacaacuggcug

SEQ ID NO: 64930 - RNA, 62 nt, hsa
augaaucaccugaguacaauucuuuguuguuuagcacuuaaauuucccaauuuauuaaauug

SEQ ID NO: 64931 - RNA, 62 nt, hsa
acauugcagucugcuucugcaccuuaucuuaaagcacuuacagauaggccuucuugugaucu

SEQ ID NO: 64932 - RNA, 62 nt, hsa
aggguuauggaaucuaguaauaaaauuucaacagcacuuaaacugaaguuuggguugcucau

SEQ ID NO: 64933 - RNA, 62 nt, hsa
cacacaugccuauauuaucauaagaauuuuucagcacuuaacuacuuuguuggcauugaucc

SEQ ID NO: 64934 - RNA, 62 nt, hsa
caagggaaaauacucaaagaaagaaaaguggcagcacuuauauuaguuuuauaacaggauaa

SEQ ID NO: 64935 - RNA, 62 nt, hsa
gcuuacauuacauguccaguccacauuuaaagagcacuuacuguggaacaagccuucagcca

SEQ ID NO: 64936 - RNA, 62 nt, hsa
uuugaauucuuuagauuuuuaaauuggagaaaagcacuuaaaguuuuuuauauaugaauauu

SEQ ID NO: 64937 - RNA, 62 nt, hsa
auugugcacuaugggaggccgcugcugcguggagcacuuaaaguccagccuccaggaccgga

SEQ ID NO: 64938 - RNA, 62 nt, hsa
uccagagagcuuuauggaagcgggagaggaggagcacuuacucauguuguauuuguuaaugg

SEQ ID NO: 64939 - RNA, 62 nt, hsa
cacuggggauguuauuuacuuguuuauuaguuagcacuuagaaugaguucauuuuuagguga

SEQ ID NO: 64940 - RNA, 62 nt, hsa
auauuuuaggauuauuuuuggcaaauacagugagcacuuauguaaccagaugauaaugaacu

SEQ ID NO: 64941 - RNA, 62 nt, hsa
gcugugaguagaauauguaaaaguggcauggcagcacuuaugcucugugacaguauugugug

SEQ ID NO: 64942 - RNA, 62 nt, hsa
caguuuggucaccuguaaaaggaaauaacaagagcacuuacuuuauaagauugaugugagua

SEQ ID NO: 64943 - RNA, 62 nt, hsa
cucuaaaagcacugaccucaaaaaaccuuauaagcacuuagauuuaauugcauuuuccauag

SEQ ID NO: 64944 - RNA, 62 nt, hsa
cugauaaugaaaauuaugauaaggaugauaaaagcacuuacuucguguccgacucuucugag

SEQ ID NO: 64945 - RNA, 62 nt, hsa
agucuccaaauaauaauagccgacguuuauugagcacuuacuaugugcccaacccuguuaug

SEQ ID NO: 64946 - RNA, 62 nt, hsa
aguuuccugaccuaugaaacagagaaaauaaaagcacuuauuuauuguuguuggaggcugca

SEQ ID NO: 64947 - RNA, 62 nt, hsa
auaaccucaccccaaauacaauaaagggacgaagcacuuauagauaccacagacacaugugu

SEQ ID NO: 64948 - RNA, 62 nt, hsa
accugaccuugugcgcugggaggcgcaucugcagcacuuacaggugagggauggggagaugg

SEQ ID NO: 64949 - RNA, 62 nt, hsa
aaggagacacaugccaccccagcaguacacaaagcacuuaccuugacuggugaagucagcca

SEQ ID NO: 64950 - RNA, 62 nt, hsa
agcuuucauuuacauagugcuuacauuuauauagcacuuacuaugugcgauguacuaauuua

SEQ ID NO: 64951 - RNA, 62 nt, hsa
uuuuacaauagauaaaugcuugugcuaccuaaagcacuuagcacacaguuaaauuauauuua

SEQ ID NO: 64952 - RNA, 62 nt, hsa
uaaaucacuauacugauauuuugauacaagcaagcacuuacaugguaaucacuauauagauc

SEQ ID NO: 64953 - RNA, 62 nt, hsa
ugucaucucauauugaucagguauuuuaaucuagcacuuacauauuguugauaaaugaaagc

SEQ ID NO: 64954 - RNA, 62 nt, hsa
agagacuguuaauggccccuuacccugggugaagcacuuacccuuggaacagaacucuaaaa

SEQ ID NO: 64955 - RNA, 62 nt, hsa
auauuauuuucuucuccuuuauauguaaugaaagcacuuauaaagaaacaggaaucauuaga

SEQ ID NO: 64956 - RNA, 62 nt, hsa
guuagucucauuuagaaaaaucgaaagugcacagcacuuaaagggaauauaugagguuuuuu

SEQ ID NO: 64957 - RNA, 62 nt, hsa
aaccugauccucaugcugauagaaugacagcuagcacuuauuuccuaagugcaacuguuuua

SEQ ID NO: 64958 - RNA, 62 nt, hsa
ccccuccaaagauggaguguagaaaugaugacagcacuuaguaaguucaaagaugacauuca

SEQ ID NO: 64959 - RNA, 62 nt, hsa
agcugggcacgguggcucacgccuguaaucccagcacuuacuuugggaggccaaggugggca

SEQ ID NO: 64960 - RNA, 62 nt, hsa
ugcgguucucuuugacccccaaagacaagacaagcacuuauuuuuauuuucagaagacaaaa

SEQ ID NO: 64961 - RNA, 62 nt, hsa
gggaagacacauguuaaguuuuguggccuuccagcacuuacuauuuucagcuuuuuaaagca

SEQ ID NO: 64962 - RNA, 62 nt, hsa
auugguaaaggaaagagcagguguggggguuaagcacuuauuugagguggggguguucaccu

SEQ ID NO: 64963 - RNA, 62 nt, hsa
uuagggccggucaggcccuaaaguauucacugagcacuuaggaagaccgggcauugggcugg

SEQ ID NO: 64964 - RNA, 62 nt, hsa
aaaaacugaagagaacaaaauuuguaaccacuagcacuuaaguacuccugauucuuaacauu

SEQ ID NO: 64965 - RNA, 62 nt, hsa
gcuuauuuuauuauaguagccaacauuuauccagcacuuaccuuauauaaagggcuguuugu

SEQ ID NO: 64966 - RNA, 62 nt, hsa
cuccuggggagacgugacucugguggacgcagagcacuuaguuacccuggacgcuccccaca

SEQ ID NO: 64967 - RNA, 62 nt, hsa
uuucuuaauuauuauaaaaauauuaagacaauagcacuuaaauuccucaacaguguuuucag

SEQ ID NO: 64968 - RNA, 62 nt, hsa
aacaaaaauuuuucuuucuuuacugcaugcauagcacuuaauaaaauggauuuuuaaaaaau

SEQ ID NO: 64969 - RNA, 62 nt, hsa
aaaaagugucucugccuugagucaucuauucaagcacuuacagcucuggccacaacagggca

SEQ ID NO: 64970 - RNA, 62 nt, hsa
ccucagugccuguccauaacugugaaguauuaagcacuuagggccagaugcacuguaaacau

SEQ ID NO: 64971 - RNA, 62 nt, hsa
ucuacucaucuuuagagaugaaucaucuauuaagcacuuaccaaaacauaucauuaaacuga

SEQ ID NO: 64972 - RNA, 62 nt, hsa
uauuauaauuaguuuugugaauagaaaaauaaagcacuuauguuuaaauuuguuacagugac

SEQ ID NO: 64973 - RNA, 62 nt, hsa
aagugagguguggaacuccaggcaacgacccaagcacuuauuuuuuaagagggaaaggacuu

SEQ ID NO: 64974 - RNA, 62 nt, hsa
auuaucgaucuaugagacaucuugauauguaaagcacuuaauauuaaaggcauaaaagugaa

SEQ ID NO: 64975 - RNA, 62 nt, hsa
ucaucucccuguccucugagauaauaugagugagcacuuagguaucauaucagaugcucaag

SEQ ID NO: 64976 - RNA, 62 nt, hsa
uuucuagcauauggacaccuggccucugcuugagcacuuaggugacaggaacuuccgcaccu

SEQ ID NO: 64977 - RNA, 62 nt, hsa
aacugaaaauaggagcuauuuauagauggagcagcacuuagugcuucauagaaagcaaugcc

SEQ ID NO: 64978 - RNA, 62 nt, hsa
aaugguaguggaauuauuugaauucuacaccaagcacuuaccaugugccaggcccuuugcag

SEQ ID NO: 64979 - RNA, 62 nt, hsa
aucgacuuagccugagucauaacgguuaagaaagcacuuaaacagaagcagaggcuaauuca

SEQ ID NO: 64980 - RNA, 62 nt, hsa
uuauauucuuauguuaucaccuuccaaacaaaagcacuuacuuuuuuuggaaguuauuuauu

SEQ ID NO: 64981 - RNA, 62 nt, hsa
aguuagagcggucgucggccaaccuccccaacagcacuuagguuuuccuguugagauggggg

SEQ ID NO: 64982 - RNA, 62 nt, hsa
gcuaguaaccggcugugagggagagggucagaagcacuuagcguuggccucugauugcuguc

SEQ ID NO: 64983 - RNA, 62 nt, hsa
gguauuuccuaucgacguuuauuuaccucuuuagcacuuauacuuuagcauaaaaaauguug

SEQ ID NO: 64984 - RNA, 62 nt, hsa
uagugaucaaacugccauucacaguguaaggcagcacuuaaauuucgaaccuaaaguuuaga

SEQ ID NO: 64985 - RNA, 62 nt, hsa
uguguauuuugcuuaauggaaugcuuuauuuaagcacuuaggcagaguagacacaauuaaag

SEQ ID NO: 64986 - RNA, 62 nt, hsa
uuuucaacuccaaaucaauucuaaaaacuucaagcacuuaauggaaagguaaauggucagau

SEQ ID NO: 64987 - RNA, 62 nt, hsa
accagaugcugaaggcaaggggagggagcagaagcacuuauguuuacggauauuuuaaacuc

SEQ ID NO: 64988 - RNA, 62 nt, hsa
ccccucuugaaagagauuuacucaucuauccaagcacuuaauuuggaaauuuuauuguccua

SEQ ID NO: 64989 - RNA, 62 nt, hsa
cugaccuugacacuucccccuuuagcuauaaaagcacuuaccagccgaacguggaacaguau

SEQ ID NO: 64990 - RNA, 62 nt, hsa
auuucggcaucgacacggacguuguugcacaaagcacuuaaagaacgagagcaucuuguuca

SEQ ID NO: 64991 - RNA, 62 nt, hsa
cccccucaauagccagcacccacagugagcugagcacuuacagcaacaauuguaagucgacu

SEQ ID NO: 64992 - RNA, 62 nt, hsa
uucuccauuuuauuagaaaauacaaguugcuaagcacuuaggaccauuugagcuuguggguc

SEQ ID NO: 64993 - RNA, 62 nt, hsa
gguguaguaauuguggguacuuuaagguuuggagcacuuacaaggcugugguagaaucauac

SEQ ID NO: 64994 - RNA, 62 nt, hsa
auauuuuuaugccuacuuaggaaaaaaaggguagcacuuauucauuccaaguacuuuuuuuu

SEQ ID NO: 64995 - RNA, 56 nt, hsa; identical to SEQ ID NO: 61369

SEQ ID NO: 64996 - RNA, 62 nt, hsa
acaggaauuauaaauaacuucaauaugaugagagcacuuaagaucucaauaacuguggaagu

SEQ ID NO: 64997 - RNA, 62 nt, hsa
uuacugguuugccaaagccauccuuggcaucuagcacuuacaucucucuaugcuguucuaca

SEQ ID NO: 64998 - RNA, 62 nt, hsa
agcgaggaauuaacccuguguccucagucgccagcacuuacagcuccaacuuuuuugaauga

SEQ ID NO: 64999 - RNA, 62 nt, hsa
cgauucagugucacaaaauaacuccagaaagaagcacuuagcgugcuguuccuguggaaaaa

SEQ ID NO: 65000 - RNA, 62 nt, hsa
auguuuuuaauuuucucaacaagcauuuagccagcacuuauccagugaaacaauuugauaag

SEQ ID NO: 65001 - RNA, 62 nt, hsa
caggagacuugagaaguagagugacaaaaacaagcacuuaauuaaauuauaaaauuuaacuu

SEQ ID NO: 65002 - RNA, 62 nt, hsa
aaguggucuuugaccacaguugauugaaccagagcacuuauugcuuaaagaauaacagaguu

SEQ ID NO: 65003 - RNA, 62 nt, hsa
ugcauccaaggcagguguuguuaaucuaucauagcacuuaaaaaaaaaaaaaaaaagagacc

SEQ ID NO: 65004 - RNA, 62 nt, hsa
ugaucugcacaauuuaauuaugugguuauucgagcacuuaauuucacucaagguucauuggg

SEQ ID NO: 65005 - RNA, 62 nt, hsa
ggccaggcacgguggcucacgccuauaaucccagcacuuagggaggccaaggcgggcagauc

SEQ ID NO: 65006 - RNA, 62 nt, hsa
aggcacaguucuauguuuuuuacauguaauaaagcacuuaaugcaagucuuugagauacguu

SEQ ID NO: 65007 - RNA, 62 nt, hsa
cugaagaaagaagauaauagaccagcaauugcagcacuuacaaucacuaauucccuuaaggu

SEQ ID NO: 65008 - RNA, 62 nt, hsa
agcuugugggccaguguccuuguacaugcuguagcacuuaaaaaauaauuccaggguucccu

SEQ ID NO: 65009 - RNA, 62 nt, hsa
uucaggaguaaaucuaaauguggcuuuugucaagcacuuagauggauauaaaugcagcaacu

SEQ ID NO: 65010 - RNA, 62 nt, hsa
gguucuuaaggcacauccgggacgaucgauauagcacuuaggcuaugcaggggggucuuucu

SEQ ID NO: 65011 - RNA, 62 nt, hsa
aauaaaaacugacuagaaauaccgucaaaaccagcacuuaccaaacucagagcaucugagua

SEQ ID NO: 65012 - RNA, 62 nt, hsa
ccaucugcaccugaauccucuaacuucacgguagcacuuacagcugaagccaucagcaucug

SEQ ID NO: 65013 - RNA, 62 nt, hsa
cauccucccagggucuggcuggcugguagccaagcacuuauggaccagaguggcccaggcca

SEQ ID NO: 65014 - RNA, 62 nt, hsa
auguaucguaaguuaauacuaaaagaagagaaagcacuuaaguuucacagaagccguuaugu

SEQ ID NO: 65015 - RNA, 62 nt, hsa
agcuuuugugaaauagaaucagugaccaguauagcacuuagaucccuucuaacucauauaau

SEQ ID NO: 65016 - RNA, 62 nt, hsa
gcugcuccuauauuuuuuaagaaauauaauaaagcacuuagggcaggggaaaucaucucggu

SEQ ID NO: 65017 - RNA, 62 nt, hsa
ucuaggauuaacugagagauuaaaggaacagcagcacuuaggcucaaaaucgccccuacaaa

SEQ ID NO: 65018 - RNA, 62 nt, hsa
uagcaaugacaaccugugaugucucacaguagagcacuuagcgcagaaucagguccccacgg

SEQ ID NO: 65019 - RNA, 62 nt, hsa
gcuuugaggucuaaaugaguuaacauuuucaaagcacuuagaauagugucugagacacaaga

SEQ ID NO: 65020 - RNA, 62 nt, hsa
gcugcuacugcaacaaccgcuaacacuuguuaagcacuuacuacagacuagaaaguguucua

SEQ ID NO: 65021 - RNA, 62 nt, hsa
auaaagcaacuuuuguagaugcuguuucauacagcacuuagaugaauuauugaucuuccuaa

SEQ ID NO: 65022 - RNA, 62 nt, hsa
gaaaacacaaagagaaaauaugaacaauauaaagcacuuaaaggaagaggaugauuucuucc

SEQ ID NO: 65023 - RNA, 62 nt, hsa
ggaaagcaugauauguauauugcugaguugaaagcacuuauuggaaaauauuaaaaggcuaa

SEQ ID NO: 65024 - RNA, 62 nt, hsa
gugagccucccagagccccaggacugggccagagcacuuagguuucuuuuuccaugguuucc

SEQ ID NO: 65025 - RNA, 62 nt, hsa
cgggaaagcugccccacagccucagcaucuucagcacuuaccgauccagagccucccggccu

SEQ ID NO: 65026 - RNA, 62 nt, hsa
uuuauguuucuuuuuagauguguaccuucccaagcacuuauuuaugcagugaccuggucacc

SEQ ID NO: 65027 - RNA, 62 nt, hsa
uauuuuucuaugagaagcacuucauagggagaagcacuuaugacaaggcuauuuuuuaaacc

SEQ ID NO: 65028 - RNA, 62 nt, hsa
uaaugggagcuuugccugggaccugaaccuggagcacuuaccgcauuaggaagaaaggagcu

SEQ ID NO: 65029 - RNA, 62 nt, hsa
gugggcagcaugcccagguuccuugcugacucagcacuuauuucuguaguuuuaaaaaagaa

SEQ ID NO: 65030 - RNA, 62 nt, hsa
augcaauugcauauuauguuuauacucacuucagcacuuaucagagauaauugcaguuucac

SEQ ID NO: 65031 - RNA, 62 nt, hsa
accucuugcaccaaaucaauaucuauuuguugagcacuuauugauuaagaccuugcauaugu

SEQ ID NO: 65032 - RNA, 62 nt, hsa
auauaacucacugggacauugccaaaugaguaagcacuuaauucgcugcuucugagacuucu

SEQ ID NO: 65033 - RNA, 62 nt, hsa
aaugauaguagguauguauuauggauuggagaagcacuuauuacacuaucuaaccuaauaug

SEQ ID NO: 65034 - RNA, 62 nt, hsa
cagauaugauggaaugcaucccaccuugccaaagcacuuacaccaguuugacugugcuagcu

SEQ ID NO: 65035 - RNA, 62 nt, hsa
agagggcuagagaaagcaucuucugcagaggaagcacuuaugggaacagucugugagauuga

SEQ ID NO: 65036 - RNA, 62 nt, hsa
ugcuccuuuccaccagugauuuguauuaagacagcacuuauauuguacaauacuucagacug

SEQ ID NO: 65037 - RNA, 62 nt, hsa
uuuaaccugaucuguagagcagagagguugaaagcacuuaacucuuguuuaguauccucauu

SEQ ID NO: 65038 - RNA, 62 nt, hsa
gugugguucagggccagugcauauuaguggacagcacuuaguagcugugaaggaaggugcag

SEQ ID NO: 65039 - RNA, 62 nt, hsa
acaguaguaauuaagguacaucucuaaaguggagcacuuacaccaggcucuaagauucacuu

SEQ ID NO: 65040 - RNA, 62 nt, hsa
aaugagggaaguccuaggauggauagaaaaaaagcacuuacauuggggcacacaggaaaucc

SEQ ID NO: 65041 - RNA, 62 nt, hsa
uuaggaguagauauugauuacuaucauaauucagcacuuaacuaugagccaggcaucauacu

SEQ ID NO: 65042 - RNA, 62 nt, hsa
ugcucaauaacucuacucauuuguaucuuuucagcacuuaauuuuaauguaagaaaguuguu

SEQ ID NO: 65043 - RNA, 62 nt, hsa
ggauggugguuagcaacaguggcccgugccaaagcacuuaccaaagugaugaugacuaaggu

SEQ ID NO: 65044 - RNA, 62 nt, hsa
aaauuuggcuuuagugugacgggauuugauuaagcacuuaguauagucuuuugaacacggaa

SEQ ID NO: 65045 - RNA, 62 nt, hsa
cacccaaacugauaacauuuaucucauuuucuagcacuuaaaauacaaagucuauauuauug

SEQ ID NO: 65046 - RNA, 62 nt, hsa
agaaaacaauuguggggaucaaggacagacauagcacuuagacaggacuuucaugacccaau

SEQ ID NO: 65047 - RNA, 62 nt, hsa
uuuaucugugucaaguauuucugguaauaagaagcacuuaauuuacacauauuuuaauccug

SEQ ID NO: 65048 - RNA, 62 nt, hsa
cuuaugguaauaaaaauggcucauacuuauauagcacuuacuuuguugcaaguacugcugua

SEQ ID NO: 65049 - RNA, 62 nt, hsa
gagccuuguuuuucuaaaggggggcgcugucuagcacuuaacuaggguaagcauucuuaaca

SEQ ID NO: 65050 - RNA, 62 nt, hsa
guaguacuggaaauuuuacaagacuuuuaccuagcacuuaaauauguauaaauguacauaaa

SEQ ID NO: 65051 - RNA, 62 nt, hsa
gccaguaaucaaaacagacugggaaugaauaaagcacuuacagaagaguauccuaaugaaaa

SEQ ID NO: 65052 - RNA, 62 nt, hsa
acauaaaagguuaaagaacaggcaacacaaugagcacuuaaguuuuuaacauguggggaaua

SEQ ID NO: 65053 - RNA, 62 nt, hsa
cucaguucagcaacuguuuauucuguuuauugagcacuuacuuggaccaagcacuguggucu

SEQ ID NO: 65054 - RNA, 62 nt, hsa
gcagguaguguuuaguuaucuacugcauuaugagcacuuaaaguacugcuagcuguagaacu

SEQ ID NO: 65055 - RNA, 62 nt, hsa
acuuucuauuuuuagccuauauuuggaaagaaagcacuuaacauuuuaggaauucuuuuuaa

SEQ ID NO: 65056 - RNA, 62 nt, hsa
cggguuguaaggacaaaggauuuuaaaaucugagcacuuaggugaagggacaagcagguuua

SEQ ID NO: 65057 - RNA, 62 nt, hsa
aaagucuaccaaaggaauuugcauccagcagcagcacuuagaccugccagccacugucaccg

SEQ ID NO: 65058 - RNA, 62 nt, hsa
gcauuuguuauaaauguaguaaggcagguccaagcacuuacaaguuuuuuguaguuguuacc

SEQ ID NO: 65059 - RNA, 62 nt, hsa
gcuguuauuuucuacauuuguauuuuauccauagcacuuauucacauuuaggaaaagacaua

SEQ ID NO: 65060 - RNA, 62 nt, hsa
auauuuuugaaaauuuaguacaguuuagaaagagcacuuauuuuguuuauauccauuuuuuc

SEQ ID NO: 65061 - RNA, 62 nt, hsa
caucugaaggggauucugaucuguucuuauguagcacuuaacacuguguagaaacuauuuuu

SEQ ID NO: 65062 - RNA, 62 nt, hsa
aaaacauuuuacuuggcuuauucaauuucuaaagcacuuacguugugccagguuccacucaa

SEQ ID NO: 65063 - RNA, 62 nt, hsa
aucagugggaauuaagaaagccucgucgugaaagcacuuaauuuuuuacaguuagcacuuca

SEQ ID NO: 65064 - RNA, 62 nt, hsa
uuucaucuauguuuaucacauuuuaauaccacagcacuuauaaugaugucacuacauauaga

SEQ ID NO: 65065 - RNA, 62 nt, hsa
uuaaguacuuacuacaugcuaagagcuuuuuaagcacuuauuuaauccucauuaacaaauuc

SEQ ID NO: 65066 - RNA, 62 nt, hsa
auuuuuagcauuaaaaacuaaggaauauacuuagcacuuacuuaaucuuuucaguuuuccag

SEQ ID NO: 65067 - RNA, 62 nt, hsa
aauucccugggcacagguugcaccugggugugagcacuuaaucacucaacgcuuuguuuucu

SEQ ID NO: 65068 - RNA, 62 nt, hsa
gcuuauucauugaauauuuuucuguaauuuucagcacuuauguauacacuuuuucuguacuu

SEQ ID NO: 65069 - RNA, 62 nt, hsa
aaaaaagaauuuuuaaugcuaaugagagguuuagcacuuaagaucagauucaagagaauaua

SEQ ID NO: 65070 - RNA, 62 nt, hsa
cauuugccaacaccuuuuuaaggggaggagagagcacuuaguuucugaacuagucuggggac

SEQ ID NO: 65071 - RNA, 62 nt, hsa
ucuaaccguaacacgucccacccccuuuuuaaagcacuuacuguuuucagagcacccauauc

SEQ ID NO: 65072 - RNA, 62 nt, hsa
ugcuuuucucuccuuauguguggaaggaggggagcacuuagacauuugcuaacucccagaau

SEQ ID NO: 65073 - RNA, 62 nt, hsa
guauuuuuacaaacacauaaacacacagccguagcacuuagaagaaaagaggcuuucuaagc

SEQ ID NO: 65074 - RNA, 62 nt, hsa
gagggaagcggguguuggcuguuuccaaagagagcacuuaauuuaauuuuuccuuuaaauga

SEQ ID NO: 65075 - RNA, 62 nt, hsa
uauuuaguuuugcuuucucguggauaauauuaagcacuuacucugcaguuuccuggaaguug

SEQ ID NO: 65076 - RNA, 62 nt, hsa
aaugguaaguaguugcuacuggccaacugucuagcacuuaccugaaaacuuaguauggagcu

SEQ ID NO: 65077 - RNA, 62 nt, hsa
aacagugcuugccacagagcggggacucgguaagcacuuaaugaaugaaugaauucuaaguc

SEQ ID NO: 65078 - RNA, 62 nt, hsa
gucuauugcaaacaauucucucaguuacguucagcacuuaagaacggcuaauggcaauagga

SEQ ID NO: 65079 - RNA, 62 nt, hsa
ucaaugccaacaagagcaucugccgguuacugagcacuuacuaagugccaagcauuauuuua

SEQ ID NO: 65080 - RNA, 62 nt, hsa
uauuugacuguaauaguauaguaguuaaauacagcacuuaaaaauaccacagacacaguuaa

SEQ ID NO: 65081 - RNA, 62 nt, hsa
caguggguuaucucuaggaugaucaguaguucagcacuuaaaaacugcagagaaaacugaaa

SEQ ID NO: 65082 - RNA, 62 nt, hsa
cagggguuucccuggcgcagcgaaagucucugagcacuuaccgggcgugaccguuucuuagg

SEQ ID NO: 65083 - RNA, 62 nt, hsa
guuuacacagacaaagugacaucagaaggcugagcacuuaucuggaucauuuggucaguuug

SEQ ID NO: 65084 - RNA, 62 nt, hsa
ugggaaucuaucccuaaggaauaaaaagcgccagcacuuaagauuauauguuuacuaaugua

SEQ ID NO: 65085 - RNA, 62 nt, hsa
uccucuuuuuggguuuucuucuuucuccuuuaagcacuuacaugguuggggguaagacuagg

SEQ ID NO: 65086 - RNA, 62 nt, hsa
aaaaaaaaaaaaaaaaaaacacaaaacccacaagcacuuaucuuggcuacuaaugaagcucu

SEQ ID NO: 65087 - RNA, 60 nt, hsa
auccaggcaaagugcugugaagggggucugagcacuuagcccacaaguucccugacuacg

SEQ ID NO: 65088 - RNA, 62 nt, hsa
cuaguguucccagcacugugccugcucucaagagcacuuacugccucgcaaauaauaaaaau

SEQ ID NO: 65089 - RNA, 62 nt, hsa
ccagaaccuaggaggaugccuaacagagaguaagcacuuaaaaaauauuugucauaugaaug

SEQ ID NO: 65090 - RNA, 62 nt, hsa
gagauuuaucuugaagcugaauuugcaaagcaagcacuuauaaaaauuagauuguguguuac

SEQ ID NO: 65091 - RNA, 62 nt, hsa
acauuuguuaauaguuacgucucuccugauguagcacuuaagcuucauuuaguuauuauuuc

SEQ ID NO: 65092 - RNA, 62 nt, hsa
cgaccucaucaucugggagaucgaggugccaaagcacuuagucggucggcuaauuggcaagc

SEQ ID NO: 65093 - RNA, 62 nt, hsa
guucaugucucguccauguccauguucguguuagcacuuacgugggaacaaauaccaauuug

SEQ ID NO: 65094 - RNA, 51 nt, hsa
ugacgguugauguggccugaaagcacuuagcgggcgcgcugggaugucaca

SEQ ID NO: 65095 - RNA, 62 nt, hsa
uuuaugcucuuucuggcaaauaagauucuaaaagcacuuauaucccugugaauacuucagag

SEQ ID NO: 65096 - RNA, 62 nt, hsa
uucuccuuagguccucacacaauuccuuacagagcacuuauuaaaaaaaaaucuuaagaguu

SEQ ID NO: 65097 - RNA, 62 nt, hsa
ucaguuccauucaugaacgaauuauuucuucaagcacuuauggacaacgaacaaauucuuca

SEQ ID NO: 65098 - RNA, 62 nt, hsa
cgacguccuuuagcccucccaggccccacggcagcacuuaugguagcggcacugucuuggcu

SEQ ID NO: 65099 - RNA, 62 nt, hsa
uaccccaagaccccagagggcaguccuuaggaagcacuuacaccaccugggaaccccuccgu

SEQ ID NO: 65100 - RNA, 62 nt, hsa
cauacaagcaucagaagagcucucuuguuguuagcacuuauuguuugcaagaacagaauaca

SEQ ID NO: 65101 - RNA, 62 nt, hsa
ugccuuggcaccgucacagaugccaagcaggcagcacuuagggaucucccagcuggguuagg

SEQ ID NO: 65102 - RNA, 62 nt, hsa
uuucuuggccaaaguggcuuccucaagaaagcagcacuuaccuuugaaaaaugcugggaaca

SEQ ID NO: 65103 - RNA, 62 nt, hsa
ccaagggccauuucuucucagcuugguggagcagcacuuacuuacuacuggaaaugaaaaaa

SEQ ID NO: 65104 - RNA, 62 nt, hsa
ugcaggaauauaaauaauaaaagacuguuauuagcacuuaguaagucuucaucuaugcaugu

SEQ ID NO: 65105 - RNA, 62 nt, hsa
uuuugaugccaggugcaaucuacuggaaauguagcacuuacguaaaacauuuguuuccccca

SEQ ID NO: 65106 - RNA, 62 nt, hsa
uccaauucaggagcccuugcgaguauaucugaagcacuuauuugcuaaggaaaccugaauug

SEQ ID NO: 65107 - RNA, 62 nt, hsa
gcagcaauuccuccauuuuuaugaaucuugugagcacuuacgcuaggagaaauuucuuuuac

SEQ ID NO: 65108 - RNA, 62 nt, hsa
uccuuugcaggagggcugggaauccucuuuagagcacuuaauccuauuuauccccuggaaug

SEQ ID NO: 65109 - RNA, 62 nt, hsa
auaugauauauucaaaugauagaauaguauacagcacuuaaaagcagugaaccagauccaua

SEQ ID NO: 65110 - RNA, 62 nt, hsa
ggcuuuucugaggauuaaauaaauaaaugugaagcacuuagaacugauggccagcacaugag

SEQ ID NO: 65111 - RNA, 62 nt, hsa
uuccaaacauacaagaggcucccucuuaacgcagcacuuagacacguguuguuccaccuucc

SEQ ID NO: 65112 - RNA, 62 nt, hsa
uuccaaacauacaagaggcugccucuuaacacagcacuuagacacgugcuguuccaccuccc

SEQ ID NO: 65113 - RNA, 62 nt, hsa
ggccgggcacggugccucacaccuguaaucccagcacuuagguaggccaagguggguggauc

SEQ ID NO: 65114 - RNA, 62 nt, hsa
auuuauguagagcauguaggaaaaccugguauagcacuuauuuuguaccuaaaaauucagag

SEQ ID NO: 65115 - RNA, 62 nt, hsa
ggcugggcacaguggcucacgccuguaaucccagcacuuagggugggcaaauugcuugaccu

SEQ ID NO: 65116 - RNA, 62 nt, hsa
caggacugguuuccuagccucccgcuaagacuagcacuuagcucuucuuggaaaaggaccca

SEQ ID NO: 65117 - RNA, 62 nt, hsa
uuuuaaacucaauauaauguuaauauuacuguagcacuuacuagcauuucugaagguugguc

SEQ ID NO: 65118 - RNA, 62 nt, hsa
auuguggauccccugagaucuggcuucccaagagcacuuauugacccuuccucaggccuccc

SEQ ID NO: 65119 - RNA, 62 nt, hsa
cucaagcacauugguauuguauaaagguauagagcacuuagcuuacaaucuuuaaagguuuc

SEQ ID NO: 65120 - RNA, 62 nt, hsa
agacauggcuggaugcgcugcugaccaacaucagcacuuaaauaaaugcaaaugcaacauuu

SEQ ID NO: 65121 - RNA, 62 nt, hsa
cguuuauagccuugccuguaaaaaugugccccagcacuuaaugagugaccguuugaauccau

SEQ ID NO: 65122 - RNA, 62 nt, hsa
cuccugccguccugacgccaccccgccccaucagcacuuaagccacaugacacaaagucugu

SEQ ID NO: 65123 - RNA, 62 nt, hsa
ccuagguguuucacugguccucuaugaaucccagcacuuauaaucccagucuuuuaucacuc

SEQ ID NO: 65124 - RNA, 62 nt, hsa
uaggaagcaaccuuucgccugugcagcgguccagcacuuaacucuaauacaucagcaugcgu

SEQ ID NO: 65125 - RNA, 62 nt, hsa
ggauuaagugaaccaauacauauacagugcuuagcacuuaauaaguauuccccccugcgaca

SEQ ID NO: 65126 - RNA, 62 nt, hsa
ggaaaacagacucccuucgggaaacauccuuaagcacuuaaggccggggggggugucugccu

SEQ ID NO: 65127 - RNA, 62 nt, hsa
cagccuagcuuuuuuuuuuuuuuuuuuuuuuuagcacuuaguauuuagcauuuauuaacagg

SEQ ID NO: 65128 - RNA, 62 nt, hsa
agcuggaaccaagaucuagauaguccguagauagcacuuaggacaagaaugugcauugaugg

SEQ ID NO: 65129 - RNA, 62 nt, hsa
aagucguuccaucauaaucuaugaucuuguacagcacuuauagaaauaagcuguucuuuuga

SEQ ID NO: 65130 - RNA, 62 nt, hsa
uuguuaguuauagggauggacaguuuauguuaagcacuuagcuuaaacaauccguuuauauu

SEQ ID NO: 65131 - RNA, 62 nt, hsa
ugguuacacauauggaaguaagcaaaaugaaaagcacuuauugcuuucugacagaauuauag

SEQ ID NO: 65132 - RNA, 62 nt, hsa
cagcccauaauugggacccagagcccuuucccagcacuuaaaacaggagccuagagcccccu

SEQ ID NO: 65133 - RNA, 62 nt, hsa
ucuuccuucuguagagggcuguuuacauauacagcacuuaaaauguuugugugggaaaaaaa

SEQ ID NO: 65134 - RNA, 62 nt, hsa
cuuggagaaauggcuaggacagggaacagggaagcacuuacaauuauuccuugauuuauuca

SEQ ID NO: 65135 - RNA, 62 nt, hsa
guuacuguaauuccucaacguauuguuucggcagcacuuauuuaaugccgauauacucuaga

SEQ ID NO: 65136 - RNA, 63 nt, hsa
ggaggcccuguucuuagagccccugacaaaggcagcacuuauuuccugggcuggugcgcccca

SEQ ID NO: 65137 - RNA, 63 nt, hsa
cagcaugacaaaauggucaaaaaauaagucaucagcacuuaagaaaugaaagcaacuuuugaa

SEQ ID NO: 65138 - RNA, 63 nt, hsa
gagauuuaaaaucuuaaaauguuucuuauuuucagcacuuacaucauuugguacacaggguca

SEQ ID NO: 65139 - RNA, 63 nt, hsa
aagccaguuucaucaaacaguucaacagagagcagcacuuaauacccuuuauacagcccauuu

SEQ ID NO: 65140 - RNA, 63 nt, hsa
gagucaaaaaacuugauuucagguccuagcucuagcacuuacagcugugugaucuugggcaag

SEQ ID NO: 65141 - RNA, 63 nt, hsa
uauuuugauuuuacccagcuuaaucuguaaaguagcacuuaaauauaucugauagcaacacuu

SEQ ID NO: 65142 - RNA, 63 nt, hsa
augaggaugaggaauaauaaacucuuuuuggcaagcacuuaaauguucugaaauuuguauaag

SEQ ID NO: 65143 - RNA, 63 nt, hsa
agguaaguuuuauaagggaguacauuuugacugagcacuuagggcaucaggaacagugcuacu

SEQ ID NO: 65144 - RNA, 63 nt, hsa
auggcauaccaaucugugcggggcaguguccuaagcacuuagacuacaucagggaagaacaca

SEQ ID NO: 65145 - RNA, 63 nt, hsa
uaaauaucuuaaaauaucuaaaacauuuuuuaaagcacuuagauugucuuacguaugugcaua

SEQ ID NO: 65146 - RNA, 63 nt, hsa
gaaacugucugucuaauggucacagagcacuguagcacuuaacagauugccauggacaccagu

SEQ ID NO: 65147 - RNA, 63 nt, hsa
gggcccucuuucccugcgagacgcacacagcugagcacuuagcaggcaccgccacgucccagc

SEQ ID NO: 65148 - RNA, 63 nt, hsa
gauaaucaguauaauaauuugccuuguguggucagcacuuaacuguuuacaaagcccuuucac

SEQ ID NO: 65149 - RNA, 63 nt, hsa
ccaccuguggccccuaaacccagagugacugagagcacuuaacauucagcuugucucaucccc

SEQ ID NO: 65150 - RNA, 63 nt, hsa
ggguuauguagaaaagcaauuuauuccauuuuaagcacuuacacaguuagucauggagaguaa

SEQ ID NO: 65151 - RNA, 63 nt, hsa
ccucagugggccugugggagccuacuggagcccagcacuuacucccccugagcagcgagccug

SEQ ID NO: 65152 - RNA, 63 nt, hsa
guuucuucuaccacccaauucuacuaggaaaggagcacuuaggaggcucuugggaugcagcaa

SEQ ID NO: 65153 - RNA, 63 nt, hsa
guugugaggauuaaaaugaggaaaugaauguaaagcacuuaguacaguauaugaaauaauggg

SEQ ID NO: 65154 - RNA, 63 nt, hsa
ucugggggugaaagaaaaauauuaguuuaccugagcacuuauuuccaugacagggucuaaaau

SEQ ID NO: 65155 - RNA, 63 nt, hsa
caaauagaaucuuauaucuguauguuaaaauagagcacuuaccugaagucaguggccuggauc

SEQ ID NO: 65156 - RNA, 63 nt, hsa
cacauaauggugucuuaaaauugacaaaaaaugagcacuuacaauuguaugucuccucaaaug

SEQ ID NO: 65157 - RNA, 63 nt, hsa
agggcaggauugucuuuuuuuuucuguguccccagcacuuacaacaaagccuagcacaaagua

SEQ ID NO: 65158 - RNA, 63 nt, hsa
gucagcgcucuugcuuugcucuuuucaaugaauagcacuuauguuacugguguccagcugagu

SEQ ID NO: 65159 - RNA, 63 nt, hsa
aauauauaguauguuuuaaguuuguaucuaaauagcacuuacuguaauguauuauaccuaaau

SEQ ID NO: 65160 - RNA, 63 nt, hsa
uuuuuucuuuccucccuuaccccaaauucauugagcacuuaaaggagcagagaugcagccagu

SEQ ID NO: 65161 - RNA, 63 nt, hsa
ucauuguaaacaaacuguguaacugcccaaagcagcacuuauaaaucagccuaacauaagauc

SEQ ID NO: 65162 - RNA, 63 nt, hsa
uguuuuaaauuaauuuuuuagcagauagcaguuagcacuuaaucuguaaauugaauaauuuau

SEQ ID NO: 65163 - RNA, 63 nt, hsa
uaaucaauuaguaauggcggaaacugucgcugaagcacuuaagaaauaaagguacuuuacagc

SEQ ID NO: 65164 - RNA, 63 nt, hsa
gaagguggcuuuugcuuuauaguuuggcuggggagcacuuaauucuucccauuucaaaaggua

SEQ ID NO: 65165 - RNA, 63 nt, hsa
cucuauucuuauuauucacugcacuauauucuaagcacuuacauguggagauacuguaaccug

SEQ ID NO: 65166 - RNA, 63 nt, hsa
auuuccugucuuucccguccaucacccauccuaagcacuuacgugaguaaauaaugcagcuca

SEQ ID NO: 65167 - RNA, 63 nt, hsa
ccucccucgagaaacagugccgccggugugaugagcacuuacacccacguucucaagggcaga

SEQ ID NO: 65168 - RNA, 63 nt, hsa
uaucuuggcugucaagaguaucaaaugccaugcagcacuuaaacuugugauaaggaagaugaa

SEQ ID NO: 65169 - RNA, 63 nt, hsa
ccauuuaauuagcugcauaucaccuuaggguacagcacuuaacgcaaucugccucaauuucuu

SEQ ID NO: 65170 - RNA, 63 nt, hsa
gggcugagugcaguggcucaugccuguaaucccagcacuuagggugccaauguggauuaccug

SEQ ID NO: 65171 - RNA, 63 nt, hsa
cuuuuagaccucuuacuuccacugcuaguagcuagcacuuacugagcaccugcgaugagguaa

SEQ ID NO: 65172 - RNA, 63 nt, hsa
gggauuucagauaugaacgguguaaauuugagaagcacuuaugcauacaugugggugaaaaac

SEQ ID NO: 65173 - RNA, 63 nt, hsa
aguucuuguuuuuauuuuugaaaguacucacacagcacuuacuaugcuccaaacacuccucua

SEQ ID NO: 65174 - RNA, 63 nt, hsa
auuugccucaacaacguaaacuuccuaaugauuagcacuuaauaauugcauauaaaaugcuuu

SEQ ID NO: 65175 - RNA, 63 nt, hsa
uugggacaauuguuuuaaucugaaauucuaaagagcacuuacuguaaccuguugcuguguuua

SEQ ID NO: 65176 - RNA, 63 nt, hsa
ccugcggguggggcuuggggcucacacaccuguagcacuuacugguaggaccaagcaucuugg

SEQ ID NO: 65177 - RNA, 63 nt, hsa
gagauaaaggcagcuaaaacgagggcaguagagagcacuuacccgaccccaaggugccagaga

SEQ ID NO: 65178 - RNA, 63 nt, hsa
gaauuccuuggggauuuuuuacugcccuuucaaagcacuuaaguguuagaucuaacguguucc

SEQ ID NO: 65179 - RNA, 63 nt, hsa
aacagaggcauauauuuaaaaugaaauuuaaugagcacuuagugacuucauuuguucaagaau

SEQ ID NO: 65180 - RNA, 63 nt, hsa
aacauuuuuuagucuguaauacacuccacuugaagcacuuaagucuuccuuaaaugacuuuuc

SEQ ID NO: 65181 - RNA, 63 nt, hsa
cuccuaaacaagagaauaaaaaugggccaucccagcacuuauaaggggagcacaucuuguaau

SEQ ID NO: 65182 - RNA, 63 nt, hsa
ccuuucuugugaaaguuuucaaucagcgauaucagcacuuacaguaagaaguaaaaguagugc

SEQ ID NO: 65183 - RNA, 63 nt, hsa
acacugugugugauuuuguuucuuuuguuaagcagcacuuauguagacugcauuuccaaaugu

SEQ ID NO: 65184 - RNA, 63 nt, hsa
auaguacagaagauucuuuguuuuucuccacugagcacuuaacaauugcuuucucucuggccu

SEQ ID NO: 65185 - RNA, 63 nt, hsa
ugauauacaaaguguaccaacauaaguguugguagcacuuaagacuuauacuugccuucugau

SEQ ID NO: 65186 - RNA, 63 nt, hsa
aaagcuaaaacaacccauuugcuacccauccaaagcacuuacaguuuagcaaauauuaaagag

SEQ ID NO: 65187 - RNA, 63 nt, hsa
cauaaaagagaaaaaaauucggaaagugaucagagcacuuauucaaaauacagugauagaagu

SEQ ID NO: 65188 - RNA, 63 nt, hsa
ucaagauauauaucuggaaccucuuauaaauggagcacuuagaaauuuguuguucugcacuua

SEQ ID NO: 65189 - RNA, 63 nt, hsa
ucauuagcucagugacuuguccacacucgucuuagcacuuacguuucaaaagcuugucacaaa

SEQ ID NO: 65190 - RNA, 63 nt, hsa
uacugaugucucagugaaucagucuguuuauuaagcacuuaucagggcuuccacacacuuauu

SEQ ID NO: 65191 - RNA, 63 nt, hsa
uguggagggcugcaaucugucuugauuucuccaagcacuuaacuuucuuugacugcacugaga

SEQ ID NO: 65192 - RNA, 63 nt, hsa
uucaggucuuugcucauucacucaguaauacugagcacuuaccauguaccagaauuuuacuag

SEQ ID NO: 65193 - RNA, 63 nt, hsa
auuuaaauaauguaaacgcaaacaggguuugauagcacuuaaacuaguucauuucaaaauuaa

SEQ ID NO: 65194 - RNA, 63 nt, hsa
aaaugaguaaaauaauuaaugaaacauauuuagagcacuuaauggucucuguuuucaauauaa

SEQ ID NO: 65195 - RNA, 63 nt, hsa
aacuuagaaacauugcgcauauucuucugaaauagcacuuaaaaaugauuagugucaguauuu

SEQ ID NO: 65196 - RNA, 63 nt, hsa
gucaaaaggcccagagucugagucccagcccugagcacuuaggagccuucugacuuaggguuu

SEQ ID NO: 65197 - RNA, 63 nt, hsa
cuuuuaagucagggaugcuuuauucuauuuuaaagcacuuaugaguuacauguuguaaucaag

SEQ ID NO: 65198 - RNA, 63 nt, hsa
ucuuuguuauaauucauauaggcuugugaauauagcacuuauuuuaauccaguagagacuugc

SEQ ID NO: 65199 - RNA, 63 nt, hsa
guaaccucacacauuaacuuuauucaaacaaacagcacuuacaggaaauguaaaguagaaaaa

SEQ ID NO: 65200 - RNA, 63 nt, hsa
caaugggaaaaaacaccaggauuuaaguuucacagcacuuacaauuuucccucuucacuuggu

SEQ ID NO: 65201 - RNA, 63 nt, hsa
uaugguuucauguaacauacauauuccugguguagcacuuaacuccuuuuccacuuuaaauuu

SEQ ID NO: 65202 - RNA, 63 nt, hsa
ucugaugaggaaaagauuaacuaauagaugcauagcacuuaacagagugcauagcauacacug

SEQ ID NO: 65203 - RNA, 63 nt, hsa
cagacacggaucugagaaucuuuauugagaaagagcacuuaagagaauauuuuaaguauugca

SEQ ID NO: 65204 - RNA, 63 nt, hsa
uuauugauguuuucauagagaauauaaaaauaaagcacuuauagaaaaaacucguuugauuuu

SEQ ID NO: 65205 - RNA, 63 nt, hsa
ugcauuugucauacguuucuacuuaaauuauuaagcacuuacgauuuagauguaauaauuaua

SEQ ID NO: 65206 - RNA, 63 nt, hsa
cuacuuuugugggaguauuucuauuauauaaccagcacuuacuaccuguacucaaaauucagc

SEQ ID NO: 65207 - RNA, 63 nt, hsa
gaugaggaagaagacaauuggauaagaugggacagcacuuauaaugaaauaaaaaaaaacuuu

SEQ ID NO: 65208 - RNA, 63 nt, hsa
uauuucagucaguccagaggcaguuaacccuguagcacuuacuagacuggugacaacuggcug

SEQ ID NO: 65209 - RNA, 63 nt, hsa
uaugaaucaccugaguacaauucuuuguuguuuagcacuuaaauuucccaauuuauuaaauug

SEQ ID NO: 65210 - RNA, 63 nt, hsa
gacauugcagucugcuucugcaccuuaucuuaaagcacuuacagauaggccuucuugugaucu

SEQ ID NO: 65211 - RNA, 63 nt, hsa
uaggguuauggaaucuaguaauaaaauuucaacagcacuuaaacugaaguuuggguugcucau

SEQ ID NO: 65212 - RNA, 63 nt, hsa
ucacacaugccuauauuaucauaagaauuuuucagcacuuaacuacuuuguuggcauugaucc

SEQ ID NO: 65213 - RNA, 63 nt, hsa
ucaagggaaaauacucaaagaaagaaaaguggcagcacuuauauuaguuuuauaacaggauaa

SEQ ID NO: 65214 - RNA, 63 nt, hsa
agcuuacauuacauguccaguccacauuuaaagagcacuuacuguggaacaagccuucagcca

SEQ ID NO: 65215 - RNA, 63 nt, hsa
uuuugaauucuuuagauuuuuaaauuggagaaaagcacuuaaaguuuuuuauauaugaauauu

SEQ ID NO: 65216 - RNA, 63 nt, hsa
cauugugcacuaugggaggccgcugcugcguggagcacuuaaaguccagccuccaggaccgga

SEQ ID NO: 65217 - RNA, 63 nt, hsa
guccagagagcuuuauggaagcgggagaggaggagcacuuacucauguuguauuuguuaaugg

SEQ ID NO: 65218 - RNA, 63 nt, hsa
acacuggggauguuauuuacuuguuuauuaguuagcacuuagaaugaguucauuuuuagguga

SEQ ID NO: 65219 - RNA, 63 nt, hsa
cauauuuuaggauuauuuuuggcaaauacagugagcacuuauguaaccagaugauaaugaacu

SEQ ID NO: 65220 - RNA, 63 nt, hsa
ggcugugaguagaauauguaaaaguggcauggcagcacuuaugcucugugacaguauugugug

SEQ ID NO: 65221 - RNA, 63 nt, hsa
ucaguuuggucaccuguaaaaggaaauaacaagagcacuuacuuuauaagauugaugugagua

SEQ ID NO: 65222 - RNA, 63 nt, hsa
acucuaaaagcacugaccucaaaaaaccuuauaagcacuuagauuuaauugcauuuuccauag

SEQ ID NO: 65223 - RNA, 63 nt, hsa
ucugauaaugaaaauuaugauaaggaugauaaaagcacuuacuucguguccgacucuucugag

SEQ ID NO: 65224 - RNA, 63 nt, hsa
gagucuccaaauaauaauagccgacguuuauugagcacuuacuaugugcccaacccuguuaug

SEQ ID NO: 65225 - RNA, 63 nt, hsa
caguuuccugaccuaugaaacagagaaaauaaaagcacuuauuuauuguuguuggaggcugca

SEQ ID NO: 65226 - RNA, 63 nt, hsa
aauaaccucaccccaaauacaauaaagggacgaagcacuuauagauaccacagacacaugugu

SEQ ID NO: 65227 - RNA, 63 nt, hsa
uaccugaccuugugcgcugggaggcgcaucugcagcacuuacaggugagggauggggagaugg

SEQ ID NO: 65228 - RNA, 63 nt, hsa
caaggagacacaugccaccccagcaguacacaaagcacuuaccuugacuggugaagucagcca

SEQ ID NO: 65229 - RNA, 63 nt, hsa
uagcuuucauuuacauagugcuuacauuuauauagcacuuacuaugugcgauguacuaauuua

SEQ ID NO: 65230 - RNA, 63 nt, hsa
auuuuacaauagauaaaugcuugugcuaccuaaagcacuuagcacacaguuaaauuauauuua

SEQ ID NO: 65231 - RNA, 63 nt, hsa
auaaaucacuauacugauauuuugauacaagcaagcacuuacaugguaaucacuauauagauc

SEQ ID NO: 65232 - RNA, 63 nt, hsa
uugucaucucauauugaucagguauuuuaaucuagcacuuacauauuguugauaaaugaaagc

SEQ ID NO: 65233 - RNA, 63 nt, hsa
cagagacuguuaauggccccuuacccugggugaagcacuuacccuuggaacagaacucuaaaa

SEQ ID NO: 65234 - RNA, 63 nt, hsa
uauauuauuuucuucuccuuuauauguaaugaaagcacuuauaaagaaacaggaaucauuaga

SEQ ID NO: 65235 - RNA, 63 nt, hsa
gguuagucucauuuagaaaaaucgaaagugcacagcacuuaaagggaauauaugagguuuuuu

SEQ ID NO: 65236 - RNA, 63 nt, hsa
caaccugauccucaugcugauagaaugacagcuagcacuuauuuccuaagugcaacuguuuua

SEQ ID NO: 65237 - RNA, 63 nt, hsa
cccccuccaaagauggaguguagaaaugaugacagcacuuaguaaguucaaagaugacauuca

SEQ ID NO: 65238 - RNA, 63 nt, hsa
cagcugggcacgguggcucacgccuguaaucccagcacuuacuuugggaggccaaggugggca

SEQ ID NO: 65239 - RNA, 63 nt, hsa
gugcgguucucuuugacccccaaagacaagacaagcacuuauuuuuauuuucagaagacaaaa

SEQ ID NO: 65240 - RNA, 63 nt, hsa
ugggaagacacauguuaaguuuuguggccuuccagcacuuacuauuuucagcuuuuuaaagca

SEQ ID NO: 65241 - RNA, 63 nt, hsa
aauugguaaaggaaagagcagguguggggguuaagcacuuauuugagguggggguguucaccu

SEQ ID NO: 65242 - RNA, 63 nt, hsa
uuuagggccggucaggcccuaaaguauucacugagcacuuaggaagaccgggcauugggcugg

SEQ ID NO: 65243 - RNA, 63 nt, hsa
gaaaaacugaagagaacaaaauuuguaaccacuagcacuuaaguacuccugauucuuaacauu

SEQ ID NO: 65244 - RNA, 63 nt, hsa
ggcuuauuuuauuauaguagccaacauuuauccagcacuuaccuuauauaaagggcuguuugu

SEQ ID NO: 65245 - RNA, 63 nt, hsa
ccuccuggggagacgugacucugguggacgcagagcacuuaguuacccuggacgcuccccaca

SEQ ID NO: 65246 - RNA, 63 nt, hsa
auuucuuaauuauuauaaaaauauuaagacaauagcacuuaaauuccucaacaguguuuucag

SEQ ID NO: 65247 - RNA, 63 nt, hsa
aaacaaaaauuuuucuuucuuuacugcaugcauagcacuuaauaaaauggauuuuuaaaaaau

SEQ ID NO: 65248 - RNA, 63 nt, hsa
caaaaagugucucugccuugagucaucuauucaagcacuuacagcucuggccacaacagggca

SEQ ID NO: 65249 - RNA, 63 nt, hsa
uccucagugccuguccauaacugugaaguauuaagcacuuagggccagaugcacuguaaacau

SEQ ID NO: 65250 - RNA, 63 nt, hsa
cucuacucaucuuuagagaugaaucaucuauuaagcacuuaccaaaacauaucauuaaacuga

SEQ ID NO: 65251 - RNA, 63 nt, hsa
guauuauaauuaguuuugugaauagaaaaauaaagcacuuauguuuaaauuuguuacagugac

SEQ ID NO: 65252 - RNA, 63 nt, hsa
aaagugagguguggaacuccaggcaacgacccaagcacuuauuuuuuaagagggaaaggacuu

SEQ ID NO: 65253 - RNA, 63 nt, hsa
gauuaucgaucuaugagacaucuugauauguaaagcacuuaauauuaaaggcauaaaagugaa

SEQ ID NO: 65254 - RNA, 63 nt, hsa
cucaucucccuguccucugagauaauaugagugagcacuuagguaucauaucagaugcucaag

SEQ ID NO: 65255 - RNA, 63 nt, hsa
auuucuagcauauggacaccuggccucugcuugagcacuuaggugacaggaacuuccgcaccu

SEQ ID NO: 65256 - RNA, 63 nt, hsa
aaacugaaaauaggagcuauuuauagauggagcagcacuuagugcuucauagaaagcaaugcc

SEQ ID NO: 65257 - RNA, 63 nt, hsa
aaaugguaguggaauuauuugaauucuacaccaagcacuuaccaugugccaggcccuuugcag

SEQ ID NO: 65258 - RNA, 63 nt, hsa
caucgacuuagccugagucauaacgguuaagaaagcacuuaaacagaagcagaggcuaauuca

SEQ ID NO: 65259 - RNA, 63 nt, hsa
uuuauauucuuauguuaucaccuuccaaacaaaagcacuuacuuuuuuuggaaguuauuuauu

SEQ ID NO: 65260 - RNA, 63 nt, hsa
caguuagagcggucgucggccaaccuccccaacagcacuuagguuuuccuguugagauggggg

SEQ ID NO: 65261 - RNA, 63 nt, hsa
agcuaguaaccggcugugagggagagggucagaagcacuuagcguuggccucugauugcuguc

SEQ ID NO: 65262 - RNA, 63 nt, hsa
cgguauuuccuaucgacguuuauuuaccucuuuagcacuuauacuuuagcauaaaaaauguug

SEQ ID NO: 65263 - RNA, 63 nt, hsa
uuagugaucaaacugccauucacaguguaaggcagcacuuaaauuucgaaccuaaaguuuaga

SEQ ID NO: 65264 - RNA, 63 nt, hsa
auguguauuuugcuuaauggaaugcuuuauuuaagcacuuaggcagaguagacacaauuaaag

SEQ ID NO: 65265 - RNA, 63 nt, hsa
guuuucaacuccaaaucaauucuaaaaacuucaagcacuuaauggaaagguaaauggucagau

SEQ ID NO: 65266 - RNA, 63 nt, hsa
uaccagaugcugaaggcaaggggagggagcagaagcacuuauguuuacggauauuuuaaacuc

SEQ ID NO: 65267 - RNA, 63 nt, hsa
accccucuugaaagagauuuacucaucuauccaagcacuuaauuuggaaauuuuauuguccua

SEQ ID NO: 65268 - RNA, 63 nt, hsa
ccugaccuugacacuucccccuuuagcuauaaaagcacuuaccagccgaacguggaacaguau

SEQ ID NO: 65269 - RNA, 63 nt, hsa
gauuucggcaucgacacggacguuguugcacaaagcacuuaaagaacgagagcaucuuguuca

SEQ ID NO: 65270 - RNA, 63 nt, hsa
acccccucaauagccagcacccacagugagcugagcacuuacagcaacaauuguaagucgacu

SEQ ID NO: 65271 - RNA, 63 nt, hsa
guucuccauuuuauuagaaaauacaaguugcuaagcacuuaggaccauuugagcuuguggguc

SEQ ID NO: 65272 - RNA, 63 nt, hsa
agguguaguaauuguggguacuuuaagguuuggagcacuuacaaggcugugguagaaucauac

SEQ ID NO: 65273 - RNA, 63 nt, hsa
aauauuuuuaugccuacuuaggaaaaaaaggguagcacuuauucauuccaaguacuuuuuuuu

SEQ ID NO: 65274 - RNA, 56 nt, hsa; identical to SEQ ID NO: 61369

SEQ ID NO: 65275 - RNA, 63 nt, hsa
aacaggaauuauaaauaacuucaauaugaugagagcacuuaagaucucaauaacuguggaagu

SEQ ID NO: 65276 - RNA, 63 nt, hsa
cuuacugguuugccaaagccauccuuggcaucuagcacuuacaucucucuaugcuguucuaca

SEQ ID NO: 65277 - RNA, 63 nt, hsa
cagcgaggaauuaacccuguguccucagucgccagcacuuacagcuccaacuuuuuugaauga

SEQ ID NO: 65278 - RNA, 63 nt, hsa
gcgauucagugucacaaaauaacuccagaaagaagcacuuagcgugcuguuccuguggaaaaa

SEQ ID NO: 65279 - RNA, 63 nt, hsa
cauguuuuuaauuuucucaacaagcauuuagccagcacuuauccagugaaacaauuugauaag

SEQ ID NO: 65280 - RNA, 63 nt, hsa
gcaggagacuugagaaguagagugacaaaaacaagcacuuaauuaaauuauaaaauuuaacuu

SEQ ID NO: 65281 - RNA, 63 nt, hsa
gaaguggucuuugaccacaguugauugaaccagagcacuuauugcuuaaagaauaacagaguu

SEQ ID NO: 65282 - RNA, 63 nt, hsa
cugcauccaaggcagguguuguuaaucuaucauagcacuuaaaaaaaaaaaaaaaaagagacc

SEQ ID NO: 65283 - RNA, 63 nt, hsa
cugaucugcacaauuuaauuaugugguuauucgagcacuuaauuucacucaagguucauuggg

SEQ ID NO: 65284 - RNA, 63 nt, hsa
aggccaggcacgguggcucacgccuauaaucccagcacuuagggaggccaaggcgggcagauc

SEQ ID NO: 65285 - RNA, 63 nt, hsa
gaggcacaguucuauguuuuuuacauguaauaaagcacuuaaugcaagucuuugagauacguu

SEQ ID NO: 65286 - RNA, 63 nt, hsa
acugaagaaagaagauaauagaccagcaauugcagcacuuacaaucacuaauucccuuaaggu

SEQ ID NO: 65287 - RNA, 63 nt, hsa
aagcuugugggccaguguccuuguacaugcuguagcacuuaaaaaauaauuccaggguucccu

SEQ ID NO: 65288 - RNA, 63 nt, hsa
uuucaggaguaaaucuaaauguggcuuuugucaagcacuuagauggauauaaaugcagcaacu

SEQ ID NO: 65289 - RNA, 63 nt, hsa
cgguucuuaaggcacauccgggacgaucgauauagcacuuaggcuaugcaggggggucuuucu

SEQ ID NO: 65290 - RNA, 63 nt, hsa
gaauaaaaacugacuagaaauaccgucaaaaccagcacuuaccaaacucagagcaucugagua

SEQ ID NO: 65291 - RNA, 63 nt, hsa
cccaucugcaccugaauccucuaacuucacgguagcacuuacagcugaagccaucagcaucug

SEQ ID NO: 65292 - RNA, 63 nt, hsa
gcauccucccagggucuggcuggcugguagccaagcacuuauggaccagaguggcccaggcca

SEQ ID NO: 65293 - RNA, 63 nt, hsa
cauguaucguaaguuaauacuaaaagaagagaaagcacuuaaguuucacagaagccguuaugu

SEQ ID NO: 65294 - RNA, 63 nt, hsa
uagcuuuugugaaauagaaucagugaccaguauagcacuuagaucccuucuaacucauauaau

SEQ ID NO: 65295 - RNA, 63 nt, hsa
ugcugcuccuauauuuuuuaagaaauauaauaaagcacuuagggcaggggaaaucaucucggu

SEQ ID NO: 65296 - RNA, 63 nt, hsa
uucuaggauuaacugagagauuaaaggaacagcagcacuuaggcucaaaaucgccccuacaaa

SEQ ID NO: 65297 - RNA, 63 nt, hsa
cuagcaaugacaaccugugaugucucacaguagagcacuuagcgcagaaucagguccccacgg

SEQ ID NO: 65298 - RNA, 63 nt, hsa
ugcuuugaggucuaaaugaguuaacauuuucaaagcacuuagaauagugucugagacacaaga

SEQ ID NO: 65299 - RNA, 63 nt, hsa
agcugcuacugcaacaaccgcuaacacuuguuaagcacuuacuacagacuagaaaguguucua

SEQ ID NO: 65300 - RNA, 63 nt, hsa
aauaaagcaacuuuuguagaugcuguuucauacagcacuuagaugaauuauugaucuuccuaa

SEQ ID NO: 65301 - RNA, 63 nt, hsa
agaaaacacaaagagaaaauaugaacaauauaaagcacuuaaaggaagaggaugauuucuucc

SEQ ID NO: 65302 - RNA, 63 nt, hsa
aggaaagcaugauauguauauugcugaguugaaagcacuuauuggaaaauauuaaaaggcuaa

SEQ ID NO: 65303 - RNA, 63 nt, hsa
cgugagccucccagagccccaggacugggccagagcacuuagguuucuuuuuccaugguuucc

SEQ ID NO: 65304 - RNA, 63 nt, hsa
ccgggaaagcugccccacagccucagcaucuucagcacuuaccgauccagagccucccggccu

SEQ ID NO: 65305 - RNA, 63 nt, hsa
auuuauguuucuuuuuagauguguaccuucccaagcacuuauuuaugcagugaccuggucacc

SEQ ID NO: 65306 - RNA, 63 nt, hsa
auauuuuucuaugagaagcacuucauagggagaagcacuuaugacaaggcuauuuuuuaaacc

SEQ ID NO: 65307 - RNA, 63 nt, hsa
uuaaugggagcuuugccugggaccugaaccuggagcacuuaccgcauuaggaagaaaggagcu

SEQ ID NO: 65308 - RNA, 63 nt, hsa
ugugggcagcaugcccagguuccuugcugacucagcacuuauuucuguaguuuuaaaaaagaa

SEQ ID NO: 65309 - RNA, 63 nt, hsa
caugcaauugcauauuauguuuauacucacuucagcacuuaucagagauaauugcaguuucac

SEQ ID NO: 65310 - RNA, 63 nt, hsa
caccucuugcaccaaaucaauaucuauuuguugagcacuuauugauuaagaccuugcauaugu

SEQ ID NO: 65311 - RNA, 63 nt, hsa
uauauaacucacugggacauugccaaaugaguaagcacuuaauucgcugcuucugagacuucu

SEQ ID NO: 65312 - RNA, 63 nt, hsa
uaaugauaguagguauguauuauggauuggagaagcacuuauuacacuaucuaaccuaauaug

SEQ ID NO: 65313 - RNA, 63 nt, hsa
gcagauaugauggaaugcaucccaccuugccaaagcacuuacaccaguuugacugugcuagcu

SEQ ID NO: 65314 - RNA, 63 nt, hsa
cagagggcuagagaaagcaucuucugcagaggaagcacuuaugggaacagucugugagauuga

SEQ ID NO: 65315 - RNA, 63 nt, hsa
cugcuccuuuccaccagugauuuguauuaagacagcacuuauauuguacaauacuucagacug

SEQ ID NO: 65316 - RNA, 63 nt, hsa
uuuuaaccugaucuguagagcagagagguugaaagcacuuaacucuuguuuaguauccucauu

SEQ ID NO: 65317 - RNA, 63 nt, hsa
agugugguucagggccagugcauauuaguggacagcacuuaguagcugugaaggaaggugcag

SEQ ID NO: 65318 - RNA, 63 nt, hsa
uacaguaguaauuaagguacaucucuaaaguggagcacuuacaccaggcucuaagauucacuu

SEQ ID NO: 65319 - RNA, 63 nt, hsa
uaaugagggaaguccuaggauggauagaaaaaaagcacuuacauuggggcacacaggaaaucc

SEQ ID NO: 65320 - RNA, 63 nt, hsa
guuaggaguagauauugauuacuaucauaauucagcacuuaacuaugagccaggcaucauacu

SEQ ID NO: 65321 - RNA, 63 nt, hsa
uugcucaauaacucuacucauuuguaucuuuucagcacuuaauuuuaauguaagaaaguuguu

SEQ ID NO: 65322 - RNA, 63 nt, hsa
aggauggugguuagcaacaguggcccgugccaaagcacuuaccaaagugaugaugacuaaggu

SEQ ID NO: 65323 - RNA, 63 nt, hsa
uaaauuuggcuuuagugugacgggauuugauuaagcacuuaguauagucuuuugaacacggaa

SEQ ID NO: 65324 - RNA, 63 nt, hsa
ucacccaaacugauaacauuuaucucauuuucuagcacuuaaaauacaaagucuauauuauug

SEQ ID NO: 65325 - RNA, 63 nt, hsa
cagaaaacaauuguggggaucaaggacagacauagcacuuagacaggacuuucaugacccaau

SEQ ID NO: 65326 - RNA, 63 nt, hsa
guuuaucugugucaaguauuucugguaauaagaagcacuuaauuuacacauauuuuaauccug

SEQ ID NO: 65327 - RNA, 63 nt, hsa
gcuuaugguaauaaaaauggcucauacuuauauagcacuuacuuuguugcaaguacugcugua

SEQ ID NO: 65328 - RNA, 63 nt, hsa
ggagccuuguuuuucuaaaggggggcgcugucuagcacuuaacuaggguaagcauucuuaaca

SEQ ID NO: 65329 - RNA, 63 nt, hsa
gguaguacuggaaauuuuacaagacuuuuaccuagcacuuaaauauguauaaauguacauaaa

SEQ ID NO: 65330 - RNA, 63 nt, hsa
agccaguaaucaaaacagacugggaaugaauaaagcacuuacagaagaguauccuaaugaaaa

SEQ ID NO: 65331 - RNA, 63 nt, hsa
gacauaaaagguuaaagaacaggcaacacaaugagcacuuaaguuuuuaacauguggggaaua

SEQ ID NO: 65332 - RNA, 63 nt, hsa
acucaguucagcaacuguuuauucuguuuauugagcacuuacuuggaccaagcacuguggucu

SEQ ID NO: 65333 - RNA, 63 nt, hsa
ugcagguaguguuuaguuaucuacugcauuaugagcacuuaaaguacugcuagcuguagaacu

SEQ ID NO: 65334 - RNA, 63 nt, hsa
aacuuucuauuuuuagccuauauuuggaaagaaagcacuuaacauuuuaggaauucuuuuuaa

SEQ ID NO: 65335 - RNA, 63 nt, hsa
acggguuguaaggacaaaggauuuuaaaaucugagcacuuaggugaagggacaagcagguuua

SEQ ID NO: 65336 - RNA, 63 nt, hsa
aaaagucuaccaaaggaauuugcauccagcagcagcacuuagaccugccagccacugucaccg

SEQ ID NO: 65337 - RNA, 63 nt, hsa
cgcauuuguuauaaauguaguaaggcagguccaagcacuuacaaguuuuuuguaguuguuacc

SEQ ID NO: 65338 - RNA, 63 nt, hsa
ugcuguuauuuucuacauuuguauuuuauccauagcacuuauucacauuuaggaaaagacaua

SEQ ID NO: 65339 - RNA, 63 nt, hsa
aauauuuuugaaaauuuaguacaguuuagaaagagcacuuauuuuguuuauauccauuuuuuc

SEQ ID NO: 65340 - RNA, 63 nt, hsa
ccaucugaaggggauucugaucuguucuuauguagcacuuaacacuguguagaaacuauuuuu

SEQ ID NO: 65341 - RNA, 63 nt, hsa
uaaaacauuuuacuuggcuuauucaauuucuaaagcacuuacguugugccagguuccacucaa

SEQ ID NO: 65342 - RNA, 63 nt, hsa
aaucagugggaauuaagaaagccucgucgugaaagcacuuaauuuuuuacaguuagcacuuca

SEQ ID NO: 65343 - RNA, 63 nt, hsa
cuuucaucuauguuuaucacauuuuaauaccacagcacuuauaaugaugucacuacauauaga

SEQ ID NO: 65344 - RNA, 63 nt, hsa
auuaaguacuuacuacaugcuaagagcuuuuuaagcacuuauuuaauccucauuaacaaauuc

SEQ ID NO: 65345 - RNA, 63 nt, hsa
gauuuuuagcauuaaaaacuaaggaauauacuuagcacuuacuuaaucuuuucaguuuuccag

SEQ ID NO: 65346 - RNA, 63 nt, hsa
aaauucccugggcacagguugcaccugggugugagcacuuaaucacucaacgcuuuguuuucu

SEQ ID NO: 65347 - RNA, 63 nt, hsa
ugcuuauucauugaauauuuuucuguaauuuucagcacuuauguauacacuuuuucuguacuu

SEQ ID NO: 65348 - RNA, 63 nt, hsa
uaaaaaagaauuuuuaaugcuaaugagagguuuagcacuuaagaucagauucaagagaauaua

SEQ ID NO: 65349 - RNA, 63 nt, hsa
gcauuugccaacaccuuuuuaaggggaggagagagcacuuaguuucugaacuagucuggggac

SEQ ID NO: 65350 - RNA, 63 nt, hsa
cucuaaccguaacacgucccacccccuuuuuaaagcacuuacuguuuucagagcacccauauc

SEQ ID NO: 65351 - RNA, 63 nt, hsa
augcuuuucucuccuuauguguggaaggaggggagcacuuagacauuugcuaacucccagaau

SEQ ID NO: 65352 - RNA, 63 nt, hsa
uguauuuuuacaaacacauaaacacacagccguagcacuuagaagaaaagaggcuuucuaagc

SEQ ID NO: 65353 - RNA, 63 nt, hsa
ggagggaagcggguguuggcuguuuccaaagagagcacuuaauuuaauuuuuccuuuaaauga

SEQ ID NO: 65354 - RNA, 63 nt, hsa
auauuuaguuuugcuuucucguggauaauauuaagcacuuacucugcaguuuccuggaaguug

SEQ ID NO: 65355 - RNA, 63 nt, hsa
uaaugguaaguaguugcuacuggccaacugucuagcacuuaccugaaaacuuaguauggagcu

SEQ ID NO: 65356 - RNA, 63 nt, hsa
gaacagugcuugccacagagcggggacucgguaagcacuuaaugaaugaaugaauucuaaguc

SEQ ID NO: 65357 - RNA, 63 nt, hsa
ugucuauugcaaacaauucucucaguuacguucagcacuuaagaacggcuaauggcaauagga

SEQ ID NO: 65358 - RNA, 63 nt, hsa
aucaaugccaacaagagcaucugccgguuacugagcacuuacuaagugccaagcauuauuuua

SEQ ID NO: 65359 - RNA, 63 nt, hsa
guauuugacuguaauaguauaguaguuaaauacagcacuuaaaaauaccacagacacaguuaa

SEQ ID NO: 65360 - RNA, 63 nt, hsa
ucaguggguuaucucuaggaugaucaguaguucagcacuuaaaaacugcagagaaaacugaaa

SEQ ID NO: 65361 - RNA, 63 nt, hsa
gcagggguuucccuggcgcagcgaaagucucugagcacuuaccgggcgugaccguuucuuagg

SEQ ID NO: 65362 - RNA, 63 nt, hsa
cguuuacacagacaaagugacaucagaaggcugagcacuuaucuggaucauuuggucaguuug

SEQ ID NO: 65363 - RNA, 63 nt, hsa
cugggaaucuaucccuaaggaauaaaaagcgccagcacuuaagauuauauguuuacuaaugua

SEQ ID NO: 65364 - RNA, 63 nt, hsa
uuccucuuuuuggguuuucuucuuucuccuuuaagcacuuacaugguuggggguaagacuagg

SEQ ID NO: 65365 - RNA, 63 nt, hsa
aaaaaaaaaaaaaaaaaaaacacaaaacccacaagcacuuaucuuggcuacuaaugaagcucu

SEQ ID NO: 65366 - RNA, 60 nt, hsa; identical to SEQ ID NO: 65087

SEQ ID NO: 65367 - RNA, 63 nt, hsa
ccuaguguucccagcacugugccugcucucaagagcacuuacugccucgcaaauaauaaaaau

SEQ ID NO: 65368 - RNA, 63 nt, hsa
uccagaaccuaggaggaugccuaacagagaguaagcacuuaaaaaauauuugucauaugaaug

SEQ ID NO: 65369 - RNA, 63 nt, hsa
ggagauuuaucuugaagcugaauuugcaaagcaagcacuuauaaaaauuagauuguguguuac

SEQ ID NO: 65370 - RNA, 63 nt, hsa
aacauuuguuaauaguuacgucucuccugauguagcacuuaagcuucauuuaguuauuauuuc

SEQ ID NO: 65371 - RNA, 63 nt, hsa
ucgaccucaucaucugggagaucgaggugccaaagcacuuagucggucggcuaauuggcaagc

SEQ ID NO: 65372 - RNA, 63 nt, hsa
aguucaugucucguccauguccauguucguguuagcacuuacgugggaacaaauaccaauuug

SEQ ID NO: 65373 - RNA, 51 nt, hsa; identical to SEQ ID NO: 65094

SEQ ID NO: 65374 - RNA, 63 nt, hsa
uuuuaugcucuuucuggcaaauaagauucuaaaagcacuuauaucccugugaauacuucagag

SEQ ID NO: 65375 - RNA, 63 nt, hsa
uuucuccuuagguccucacacaauuccuuacagagcacuuauuaaaaaaaaaucuuaagaguu

SEQ ID NO: 65376 - RNA, 63 nt, hsa
uucaguuccauucaugaacgaauuauuucuucaagcacuuauggacaacgaacaaauucuuca

SEQ ID NO: 65377 - RNA, 63 nt, hsa
ccgacguccuuuagcccucccaggccccacggcagcacuuaugguagcggcacugucuuggcu

SEQ ID NO: 65378 - RNA, 63 nt, hsa
auaccccaagaccccagagggcaguccuuaggaagcacuuacaccaccugggaaccccuccgu

SEQ ID NO: 65379 - RNA, 63 nt, hsa
ccauacaagcaucagaagagcucucuuguuguuagcacuuauuguuugcaagaacagaauaca

SEQ ID NO: 65380 - RNA, 63 nt, hsa
cugccuuggcaccgucacagaugccaagcaggcagcacuuagggaucucccagcuggguuagg

SEQ ID NO: 65381 - RNA, 63 nt, hsa
auuucuuggccaaaguggcuuccucaagaaagcagcacuuaccuuugaaaaaugcugggaaca

SEQ ID NO: 65382 - RNA, 63 nt, hsa
gccaagggccauuucuucucagcuugguggagcagcacuuacuuacuacuggaaaugaaaaaa

SEQ ID NO: 65383 - RNA, 63 nt, hsa
uugcaggaauauaaauaauaaaagacuguuauuagcacuuaguaagucuucaucuaugcaugu

SEQ ID NO: 65384 - RNA, 63 nt, hsa
cuuuugaugccaggugcaaucuacuggaaauguagcacuuacguaaaacauuuguuuccccca

SEQ ID NO: 65385 - RNA, 63 nt, hsa
cuccaauucaggagcccuugcgaguauaucugaagcacuuauuugcuaaggaaaccugaauug

SEQ ID NO: 65386 - RNA, 63 nt, hsa
ugcagcaauuccuccauuuuuaugaaucuugugagcacuuacgcuaggagaaauuucuuuuac

SEQ ID NO: 65387 - RNA, 63 nt, hsa
cuccuuugcaggagggcugggaauccucuuuagagcacuuaauccuauuuauccccuggaaug

SEQ ID NO: 65388 - RNA, 63 nt, hsa
aauaugauauauucaaaugauagaauaguauacagcacuuaaaagcagugaaccagauccaua

SEQ ID NO: 65389 - RNA, 63 nt, hsa
gggcuuuucugaggauuaaauaaauaaaugugaagcacuuagaacugauggccagcacaugag

SEQ ID NO: 65390 - RNA, 63 nt, hsa
auuccaaacauacaagaggcucccucuuaacgcagcacuuagacacguguuguuccaccuucc

SEQ ID NO: 65391 - RNA, 63 nt, hsa
auuccaaacauacaagaggcugccucuuaacacagcacuuagacacgugcuguuccaccuccc

SEQ ID NO: 65392 - RNA, 63 nt, hsa
gggccgggcacggugccucacaccuguaaucccagcacuuagguaggccaagguggguggauc

SEQ ID NO: 65393 - RNA, 63 nt, hsa
uauuuauguagagcauguaggaaaaccugguauagcacuuauuuuguaccuaaaaauucagag

SEQ ID NO: 65394 - RNA, 63 nt, hsa
aggcugggcacaguggcucacgccuguaaucccagcacuuagggugggcaaauugcuugaccu

SEQ ID NO: 65395 - RNA, 63 nt, hsa
ccaggacugguuuccuagccucccgcuaagacuagcacuuagcucuucuuggaaaaggaccca

SEQ ID NO: 65396 - RNA, 63 nt, hsa
cuuuuaaacucaauauaauguuaauauuacuguagcacuuacuagcauuucugaagguugguc

SEQ ID NO: 65397 - RNA, 63 nt, hsa
gauuguggauccccugagaucuggcuucccaagagcacuuauugacccuuccucaggccuccc

SEQ ID NO: 65398 - RNA, 63 nt, hsa
acucaagcacauugguauuguauaaagguauagagcacuuagcuuacaaucuuuaaagguuuc

SEQ ID NO: 65399 - RNA, 63 nt, hsa
aagacauggcuggaugcgcugcugaccaacaucagcacuuaaauaaaugcaaaugcaacauuu

SEQ ID NO: 65400 - RNA, 63 nt, hsa
acguuuauagccuugccuguaaaaaugugccccagcacuuaaugagugaccguuugaauccau

SEQ ID NO: 65401 - RNA, 63 nt, hsa
gcuccugccguccugacgccaccccgccccaucagcacuuaagccacaugacacaaagucugu

SEQ ID NO: 65402 - RNA, 63 nt, hsa
gccuagguguuucacugguccucuaugaaucccagcacuuauaaucccagucuuuuaucacuc

SEQ ID NO: 65403 - RNA, 63 nt, hsa
cuaggaagcaaccuuucgccugugcagcgguccagcacuuaacucuaauacaucagcaugcgu

SEQ ID NO: 65404 - RNA, 63 nt, hsa
aggauuaagugaaccaauacauauacagugcuuagcacuuaauaaguauuccccccugcgaca

SEQ ID NO: 65405 - RNA, 63 nt, hsa
gggaaaacagacucccuucgggaaacauccuuaagcacuuaaggccggggggggugucugccu

SEQ ID NO: 65406 - RNA, 63 nt, hsa
ccagccuagcuuuuuuuuuuuuuuuuuuuuuuuagcacuuaguauuuagcauuuauuaacagg

SEQ ID NO: 65407 - RNA, 63 nt, hsa
gagcuggaaccaagaucuagauaguccguagauagcacuuaggacaagaaugugcauugaugg

SEQ ID NO: 65408 - RNA, 63 nt, hsa
gaagucguuccaucauaaucuaugaucuuguacagcacuuauagaaauaagcuguucuuuuga

SEQ ID NO: 65409 - RNA, 63 nt, hsa
uuuguuaguuauagggauggacaguuuauguuaagcacuuagcuuaaacaauccguuuauauu

SEQ ID NO: 65410 - RNA, 63 nt, hsa
cugguuacacauauggaaguaagcaaaaugaaaagcacuuauugcuuucugacagaauuauag

SEQ ID NO: 65411 - RNA, 63 nt, hsa
ccagcccauaauugggacccagagcccuuucccagcacuuaaaacaggagccuagagcccccu

SEQ ID NO: 65412 - RNA, 63 nt, hsa
gucuuccuucuguagagggcuguuuacauauacagcacuuaaaauguuugugugggaaaaaaa

SEQ ID NO: 65413 - RNA, 63 nt, hsa
gcuuggagaaauggcuaggacagggaacagggaagcacuuacaauuauuccuugauuuauuca

SEQ ID NO: 65414 - RNA, 63 nt, hsa
uguuacuguaauuccucaacguauuguuucggcagcacuuauuuaaugccgauauacucuaga

SEQ ID NO: 65415 - RNA, 64 nt, hsa
aggaggcccuguucuuagagccccugacaaaggcagcacuuauuuccugggcuggugcgcccca

SEQ ID NO: 65416 - RNA, 64 nt, hsa
ccagcaugacaaaauggucaaaaaauaagucaucagcacuuaagaaaugaaagcaacuuuugaa

SEQ ID NO: 65417 - RNA, 64 nt, hsa
ugagauuuaaaaucuuaaaauguuucuuauuuucagcacuuacaucauuugguacacaggguca

SEQ ID NO: 65418 - RNA, 64 nt, hsa
aaagccaguuucaucaaacaguucaacagagagcagcacuuaauacccuuuauacagcccauuu

SEQ ID NO: 65419 - RNA, 64 nt, hsa; identical to SEQ ID NO: 61352

SEQ ID NO: 65420 - RNA, 64 nt, hsa; identical to SEQ ID NO: 61353

SEQ ID NO: 65421 - RNA, 64 nt, hsa
aaugaggaugaggaauaauaaacucuuuuuggcaagcacuuaaauguucugaaauuuguauaag

SEQ ID NO: 65422 - RNA, 64 nt, hsa
uagguaaguuuuauaagggaguacauuuugacugagcacuuagggcaucaggaacagugcuacu

SEQ ID NO: 65423 - RNA, 64 nt, hsa
uauggcauaccaaucugugcggggcaguguccuaagcacuuagacuacaucagggaagaacaca

SEQ ID NO: 65424 - RNA, 64 nt, hsa
uuaaauaucuuaaaauaucuaaaacauuuuuuaaagcacuuagauugucuuacguaugugcaua

SEQ ID NO: 65425 - RNA, 64 nt, hsa
ggaaacugucugucuaauggucacagagcacuguagcacuuaacagauugccauggacaccagu

SEQ ID NO: 65426 - RNA, 64 nt, hsa
ugggcccucuuucccugcgagacgcacacagcugagcacuuagcaggcaccgccacgucccagc

SEQ ID NO: 65427 - RNA, 64 nt, hsa; identical to SEQ ID NO: 61354

SEQ ID NO: 65428 - RNA, 64 nt, hsa; identical to SEQ ID NO: 61355

SEQ ID NO: 65429 - RNA, 64 nt, hsa
gggguuauguagaaaagcaauuuauuccauuuuaagcacuuacacaguuagucauggagaguaa

SEQ ID NO: 65430 - RNA, 64 nt, hsa
gccucagugggccugugggagccuacuggagcccagcacuuacucccccugagcagcgagccug

SEQ ID NO: 65431 - RNA, 64 nt, hsa
gguuucuucuaccacccaauucuacuaggaaaggagcacuuaggaggcucuugggaugcagcaa

SEQ ID NO: 65432 - RNA, 64 nt, hsa
uguugugaggauuaaaaugaggaaaugaauguaaagcacuuaguacaguauaugaaauaauggg

SEQ ID NO: 65433 - RNA, 64 nt, hsa
uucugggggugaaagaaaaauauuaguuuaccugagcacuuauuuccaugacagggucuaaaau

SEQ ID NO: 65434 - RNA, 64 nt, hsa
ucaaauagaaucuuauaucuguauguuaaaauagagcacuuaccugaagucaguggccuggauc

SEQ ID NO: 65435 - RNA, 64 nt, hsa
acacauaauggugucuuaaaauugacaaaaaaugagcacuuacaauuguaugucuccucaaaug

SEQ ID NO: 65436 - RNA, 64 nt, hsa
gagggcaggauugucuuuuuuuuucuguguccccagcacuuacaacaaagccuagcacaaagua

SEQ ID NO: 65437 - RNA, 64 nt, hsa
ggucagcgcucuugcuuugcucuuuucaaugaauagcacuuauguuacugguguccagcugagu

SEQ ID NO: 65438 - RNA, 64 nt, hsa
aaauauauaguauguuuuaaguuuguaucuaaauagcacuuacuguaauguauuauaccuaaau

SEQ ID NO: 65439 - RNA, 64 nt, hsa
cuuuuuucuuuccucccuuaccccaaauucauugagcacuuaaaggagcagagaugcagccagu

SEQ ID NO: 65440 - RNA, 64 nt, hsa
cucauuguaaacaaacuguguaacugcccaaagcagcacuuauaaaucagccuaacauaagauc

SEQ ID NO: 65441 - RNA, 64 nt, hsa; identical to SEQ ID NO: 61356

SEQ ID NO: 65442 - RNA, 64 nt, hsa; identical to SEQ ID NO: 61357

SEQ ID NO: 65443 - RNA, 64 nt, hsa
ugaagguggcuuuugcuuuauaguuuggcuggggagcacuuaauucuucccauuucaaaaggua

SEQ ID NO: 65444 - RNA, 64 nt, hsa
ucucuauucuuauuauucacugcacuauauucuaagcacuuacauguggagauacuguaaccug

SEQ ID NO: 65445 - RNA, 64 nt, hsa
cauuuccugucuuucccguccaucacccauccuaagcacuuacgugaguaaauaaugcagcuca

SEQ ID NO: 65446 - RNA, 64 nt, hsa
uccucccucgagaaacagugccgccggugugaugagcacuuacacccacguucucaagggcaga

SEQ ID NO: 65447 - RNA, 64 nt, hsa
guaucuuggcugucaagaguaucaaaugccaugcagcacuuaaacuugugauaaggaagaugaa

SEQ ID NO: 65448 - RNA, 64 nt, hsa
gccauuuaauuagcugcauaucaccuuaggguacagcacuuaacgcaaucugccucaauuucuu

SEQ ID NO: 65449 - RNA, 64 nt, hsa
ggggcugagugcaguggcucaugccuguaaucccagcacuuagggugccaauguggauuaccug

SEQ ID NO: 65450 - RNA, 64 nt, hsa
gcuuuuagaccucuuacuuccacugcuaguagcuagcacuuacugagcaccugcgaugagguaa

SEQ ID NO: 65451 - RNA, 64 nt, hsa
ugggauuucagauaugaacgguguaaauuugagaagcacuuaugcauacaugugggugaaaaac

SEQ ID NO: 65452 - RNA, 64 nt, hsa
aaguucuuguuuuuauuuuugaaaguacucacacagcacuuacuaugcuccaaacacuccucua

SEQ ID NO: 65453 - RNA, 64 nt, hsa
gauuugccucaacaacguaaacuuccuaaugauuagcacuuaauaauugcauauaaaaugcuuu

SEQ ID NO: 65454 - RNA, 64 nt, hsa
uuugggacaauuguuuuaaucugaaauucuaaagagcacuuacuguaaccuguugcuguguuua

SEQ ID NO: 65455 - RNA, 64 nt, hsa
uccugcggguggggcuuggggcucacacaccuguagcacuuacugguaggaccaagcaucuugg

SEQ ID NO: 65456 - RNA, 64 nt, hsa
cgagauaaaggcagcuaaaacgagggcaguagagagcacuuacccgaccccaaggugccagaga

SEQ ID NO: 65457 - RNA, 64 nt, hsa
ugaauuccuuggggauuuuuuacugcccuuucaaagcacuuaaguguuagaucuaacguguucc

SEQ ID NO: 65458 - RNA, 64 nt, hsa
uaacagaggcauauauuuaaaaugaaauuuaaugagcacuuagugacuucauuuguucaagaau

SEQ ID NO: 65459 - RNA, 64 nt, hsa
aaacauuuuuuagucuguaauacacuccacuugaagcacuuaagucuuccuuaaaugacuuuuc

SEQ ID NO: 65460 - RNA, 64 nt, hsa
gcuccuaaacaagagaauaaaaaugggccaucccagcacuuauaaggggagcacaucuuguaau

SEQ ID NO: 65461 - RNA, 64 nt, hsa
gccuuucuugugaaaguuuucaaucagcgauaucagcacuuacaguaagaaguaaaaguagugc

SEQ ID NO: 65462 - RNA, 64 nt, hsa
cacacugugugugauuuuguuucuuuuguuaagcagcacuuauguagacugcauuuccaaaugu

SEQ ID NO: 65463 - RNA, 64 nt, hsa
cauaguacagaagauucuuuguuuuucuccacugagcacuuaacaauugcuuucucucuggccu

SEQ ID NO: 65464 - RNA, 64 nt, hsa
gugauauacaaaguguaccaacauaaguguugguagcacuuaagacuuauacuugccuucugau

SEQ ID NO: 65465 - RNA, 64 nt, hsa; identical to SEQ ID NO: 61358

SEQ ID NO: 65466 - RNA, 64 nt, hsa; identical to SEQ ID NO: 61359

SEQ ID NO: 65467 - RNA, 64 nt, hsa
aucaagauauauaucuggaaccucuuauaaauggagcacuuagaaauuuguuguucugcacuua

SEQ ID NO: 65468 - RNA, 64 nt, hsa
uucauuagcucagugacuuguccacacucgucuuagcacuuacguuucaaaagcuugucacaaa

SEQ ID NO: 65469 - RNA, 64 nt, hsa
guacugaugucucagugaaucagucuguuuauuaagcacuuaucagggcuuccacacacuuauu

SEQ ID NO: 65470 - RNA, 64 nt, hsa
auguggagggcugcaaucugucuugauuucuccaagcacuuaacuuucuuugacugcacugaga

SEQ ID NO: 65471 - RNA, 64 nt, hsa
uuucaggucuuugcucauucacucaguaauacugagcacuuaccauguaccagaauuuuacuag

SEQ ID NO: 65472 - RNA, 64 nt, hsa
aauuuaaauaauguaaacgcaaacaggguuugauagcacuuaaacuaguucauuucaaaauuaa

SEQ ID NO: 65473 - RNA, 64 nt, hsa
aaaaugaguaaaauaauuaaugaaacauauuuagagcacuuaauggucucuguuuucaauauaa

SEQ ID NO: 65474 - RNA, 64 nt, hsa
uaacuuagaaacauugcgcauauucuucugaaauagcacuuaaaaaugauuagugucaguauuu

SEQ ID NO: 65475 - RNA, 64 nt, hsa
agucaaaaggcccagagucugagucccagcccugagcacuuaggagccuucugacuuaggguuu

SEQ ID NO: 65476 - RNA, 64 nt, hsa
ccuuuuaagucagggaugcuuuauucuauuuuaaagcacuuaugaguuacauguuguaaucaag

SEQ ID NO: 65477 - RNA, 64 nt, hsa
gucuuuguuauaauucauauaggcuugugaauauagcacuuauuuuaauccaguagagacuugc

SEQ ID NO: 65478 - RNA, 64 nt, hsa
cguaaccucacacauuaacuuuauucaaacaaacagcacuuacaggaaauguaaaguagaaaaa

SEQ ID NO: 65479 - RNA, 64 nt, hsa
ucaaugggaaaaaacaccaggauuuaaguuucacagcacuuacaauuuucccucuucacuuggu

SEQ ID NO: 65480 - RNA, 64 nt, hsa
uuaugguuucauguaacauacauauuccugguguagcacuuaacuccuuuuccacuuuaaauuu

SEQ ID NO: 65481 - RNA, 64 nt, hsa
gucugaugaggaaaagauuaacuaauagaugcauagcacuuaacagagugcauagcauacacug

SEQ ID NO: 65482 - RNA, 64 nt, hsa
gcagacacggaucugagaaucuuuauugagaaagagcacuuaagagaauauuuuaaguauugca

SEQ ID NO: 65483 - RNA, 64 nt, hsa
auuauugauguuuucauagagaauauaaaaauaaagcacuuauagaaaaaacucguuugauuuu

SEQ ID NO: 65484 - RNA, 64 nt, hsa
augcauuugucauacguuucuacuuaaauuauuaagcacuuacgauuuagauguaauaauuaua

SEQ ID NO: 65485 - RNA, 64 nt, hsa
gcuacuuuugugggaguauuucuauuauauaaccagcacuuacuaccuguacucaaaauucagc

SEQ ID NO: 65486 - RNA, 64 nt, hsa
ugaugaggaagaagacaauuggauaagaugggacagcacuuauaaugaaauaaaaaaaaacuuu

SEQ ID NO: 65487 - RNA, 64 nt, hsa
auauuucagucaguccagaggcaguuaacccuguagcacuuacuagacuggugacaacuggcug

SEQ ID NO: 65488 - RNA, 64 nt, hsa
uuaugaaucaccugaguacaauucuuuguuguuuagcacuuaaauuucccaauuuauuaaauug

SEQ ID NO: 65489 - RNA, 64 nt, hsa
cgacauugcagucugcuucugcaccuuaucuuaaagcacuuacagauaggccuucuugugaucu

SEQ ID NO: 65490 - RNA, 64 nt, hsa
guaggguuauggaaucuaguaauaaaauuucaacagcacuuaaacugaaguuuggguugcucau

SEQ ID NO: 65491 - RNA, 64 nt, hsa
uucacacaugccuauauuaucauaagaauuuuucagcacuuaacuacuuuguuggcauugaucc

SEQ ID NO: 65492 - RNA, 64 nt, hsa
cucaagggaaaauacucaaagaaagaaaaguggcagcacuuauauuaguuuuauaacaggauaa

SEQ ID NO: 65493 - RNA, 64 nt, hsa
aagcuuacauuacauguccaguccacauuuaaagagcacuuacuguggaacaagccuucagcca

SEQ ID NO: 65494 - RNA, 64 nt, hsa
uuuuugaauucuuuagauuuuuaaauuggagaaaagcacuuaaaguuuuuuauauaugaauauu

SEQ ID NO: 65495 - RNA, 64 nt, hsa
ccauugugcacuaugggaggccgcugcugcguggagcacuuaaaguccagccuccaggaccgga

SEQ ID NO: 65496 - RNA, 64 nt, hsa
gguccagagagcuuuauggaagcgggagaggaggagcacuuacucauguuguauuuguuaaugg

SEQ ID NO: 65497 - RNA, 64 nt, hsa
uacacuggggauguuauuuacuuguuuauuaguuagcacuuagaaugaguucauuuuuagguga

SEQ ID NO: 65498 - RNA, 64 nt, hsa
ucauauuuuaggauuauuuuuggcaaauacagugagcacuuauguaaccagaugauaaugaacu

SEQ ID NO: 65499 - RNA, 64 nt, hsa
uggcugugaguagaauauguaaaaguggcauggcagcacuuaugcucugugacaguauugugug

SEQ ID NO: 65500 - RNA, 64 nt, hsa
cucaguuuggucaccuguaaaaggaaauaacaagagcacuuacuuuauaagauugaugugagua

SEQ ID NO: 65501 - RNA, 64 nt, hsa
cacucuaaaagcacugaccucaaaaaaccuuauaagcacuuagauuuaauugcauuuuccauag

SEQ ID NO: 65502 - RNA, 64 nt, hsa
uucugauaaugaaaauuaugauaaggaugauaaaagcacuuacuucguguccgacucuucugag

SEQ ID NO: 65503 - RNA, 64 nt, hsa
ugagucuccaaauaauaauagccgacguuuauugagcacuuacuaugugcccaacccuguuaug

SEQ ID NO: 65504 - RNA, 64 nt, hsa
ucaguuuccugaccuaugaaacagagaaaauaaaagcacuuauuuauuguuguuggaggcugca

SEQ ID NO: 65505 - RNA, 64 nt, hsa
aaauaaccucaccccaaauacaauaaagggacgaagcacuuauagauaccacagacacaugugu

SEQ ID NO: 65506 - RNA, 64 nt, hsa
cuaccugaccuugugcgcugggaggcgcaucugcagcacuuacaggugagggauggggagaugg

SEQ ID NO: 65507 - RNA, 64 nt, hsa
gcaaggagacacaugccaccccagcaguacacaaagcacuuaccuugacuggugaagucagcca

SEQ ID NO: 65508 - RNA, 64 nt, hsa
auagcuuucauuuacauagugcuuacauuuauauagcacuuacuaugugcgauguacuaauuua

SEQ ID NO: 65509 - RNA, 64 nt, hsa; identical to SEQ ID NO: 61360

SEQ ID NO: 65510 - RNA, 64 nt, hsa; identical to SEQ ID NO: 61361

SEQ ID NO: 65511 - RNA, 64 nt, hsa
auugucaucucauauugaucagguauuuuaaucuagcacuuacauauuguugauaaaugaaagc

SEQ ID NO: 65512 - RNA, 64 nt, hsa
gcagagacuguuaauggccccuuacccugggugaagcacuuacccuuggaacagaacucuaaaa

SEQ ID NO: 65513 - RNA, 64 nt, hsa
auauauuauuuucuucuccuuuauauguaaugaaagcacuuauaaagaaacaggaaucauuaga

SEQ ID NO: 65514 - RNA, 64 nt, hsa
agguuagucucauuuagaaaaaucgaaagugcacagcacuuaaagggaauauaugagguuuuuu

SEQ ID NO: 65515 - RNA, 64 nt, hsa
ucaaccugauccucaugcugauagaaugacagcuagcacuuauuuccuaagugcaacuguuuua

SEQ ID NO: 65516 - RNA, 64 nt, hsa
acccccuccaaagauggaguguagaaaugaugacagcacuuaguaaguucaaagaugacauuca

SEQ ID NO: 65517 - RNA, 64 nt, hsa
ccagcugggcacgguggcucacgccuguaaucccagcacuuacuuugggaggccaaggugggca

SEQ ID NO: 65518 - RNA, 64 nt, hsa
agugcgguucucuuugacccccaaagacaagacaagcacuuauuuuuauuuucagaagacaaaa

SEQ ID NO: 65519 - RNA, 64 nt, hsa
augggaagacacauguuaaguuuuguggccuuccagcacuuacuauuuucagcuuuuuaaagca

SEQ ID NO: 65520 - RNA, 64 nt, hsa
caauugguaaaggaaagagcagguguggggguuaagcacuuauuugagguggggguguucaccu

SEQ ID NO: 65521 - RNA, 64 nt, hsa
cuuuagggccggucaggcccuaaaguauucacugagcacuuaggaagaccgggcauugggcugg

SEQ ID NO: 65522 - RNA, 64 nt, hsa
ugaaaaacugaagagaacaaaauuuguaaccacuagcacuuaaguacuccugauucuuaacauu

SEQ ID NO: 65523 - RNA, 64 nt, hsa
aggcuuauuuuauuauaguagccaacauuuauccagcacuuaccuuauauaaagggcuguuugu

SEQ ID NO: 65524 - RNA, 64 nt, hsa
cccuccuggggagacgugacucugguggacgcagagcacuuaguuacccuggacgcuccccaca

SEQ ID NO: 65525 - RNA, 64 nt, hsa
uauuucuuaauuauuauaaaaauauuaagacaauagcacuuaaauuccucaacaguguuuucag

SEQ ID NO: 65526 - RNA, 64 nt, hsa
uaaacaaaaauuuuucuuucuuuacugcaugcauagcacuuaauaaaauggauuuuuaaaaaau

SEQ ID NO: 65527 - RNA, 64 nt, hsa
acaaaaagugucucugccuugagucaucuauucaagcacuuacagcucuggccacaacagggca

SEQ ID NO: 65528 - RNA, 64 nt, hsa
uuccucagugccuguccauaacugugaaguauuaagcacuuagggccagaugcacuguaaacau

SEQ ID NO: 65529 - RNA, 64 nt, hsa; identical to SEQ ID NO: 61362

SEQ ID NO: 65530 - RNA, 64 nt, hsa; identical to SEQ ID NO: 61363

SEQ ID NO: 65531 - RNA, 64 nt, hsa; identical to SEQ ID NO: 61364

SEQ ID NO: 65532 - RNA, 64 nt, hsa; identical to SEQ ID NO: 61365

SEQ ID NO: 65533 - RNA, 64 nt, hsa
ccucaucucccuguccucugagauaauaugagugagcacuuagguaucauaucagaugcucaag

SEQ ID NO: 65534 - RNA, 64 nt, hsa
cauuucuagcauauggacaccuggccucugcuugagcacuuaggugacaggaacuuccgcaccu

SEQ ID NO: 65535 - RNA, 64 nt, hsa
caaacugaaaauaggagcuauuuauagauggagcagcacuuagugcuucauagaaagcaaugcc

SEQ ID NO: 65536 - RNA, 64 nt, hsa
gaaaugguaguggaauuauuugaauucuacaccaagcacuuaccaugugccaggcccuuugcag

SEQ ID NO: 65537 - RNA, 64 nt, hsa
ucaucgacuuagccugagucauaacgguuaagaaagcacuuaaacagaagcagaggcuaauuca

SEQ ID NO: 65538 - RNA, 64 nt, hsa
guuuauauucuuauguuaucaccuuccaaacaaaagcacuuacuuuuuuuggaaguuauuuauu

SEQ ID NO: 65539 - RNA, 64 nt, hsa
gcaguuagagcggucgucggccaaccuccccaacagcacuuagguuuuccuguugagauggggg

SEQ ID NO: 65540 - RNA, 64 nt, hsa
cagcuaguaaccggcugugagggagagggucagaagcacuuagcguuggccucugauugcuguc

SEQ ID NO: 65541 - RNA, 64 nt, hsa
ucgguauuuccuaucgacguuuauuuaccucuuuagcacuuauacuuuagcauaaaaaauguug

SEQ ID NO: 65542 - RNA, 64 nt, hsa
uuuagugaucaaacugccauucacaguguaaggcagcacuuaaauuucgaaccuaaaguuuaga

SEQ ID NO: 65543 - RNA, 64 nt, hsa
cauguguauuuugcuuaauggaaugcuuuauuuaagcacuuaggcagaguagacacaauuaaag

SEQ ID NO: 65544 - RNA, 64 nt, hsa
uguuuucaacuccaaaucaauucuaaaaacuucaagcacuuaauggaaagguaaauggucagau

SEQ ID NO: 65545 - RNA, 64 nt, hsa
uuaccagaugcugaaggcaaggggagggagcagaagcacuuauguuuacggauauuuuaaacuc

SEQ ID NO: 65546 - RNA, 64 nt, hsa
uaccccucuugaaagagauuuacucaucuauccaagcacuuaauuuggaaauuuuauuguccua

SEQ ID NO: 65547 - RNA, 64 nt, hsa
cccugaccuugacacuucccccuuuagcuauaaaagcacuuaccagccgaacguggaacaguau

SEQ ID NO: 65548 - RNA, 64 nt, hsa; identical to SEQ ID NO: 61366

SEQ ID NO: 65549 - RNA, 64 nt, hsa; identical to SEQ ID NO: 61367

SEQ ID NO: 65550 - RNA, 64 nt, hsa
aguucuccauuuuauuagaaaauacaaguugcuaagcacuuaggaccauuugagcuuguggguc

SEQ ID NO: 65551 - RNA, 64 nt, hsa
cagguguaguaauuguggguacuuuaagguuuggagcacuuacaaggcugugguagaaucauac

SEQ ID NO: 65552 - RNA, 64 nt, hsa; identical to SEQ ID NO: 61368

SEQ ID NO: 65553 - RNA, 56 nt, hsa; identical to SEQ ID NO: 61369

SEQ ID NO: 65554 - RNA, 64 nt, hsa
uaacaggaauuauaaauaacuucaauaugaugagagcacuuaagaucucaauaacuguggaagu

SEQ ID NO: 65555 - RNA, 64 nt, hsa
ccuuacugguuugccaaagccauccuuggcaucuagcacuuacaucucucuaugcuguucuaca

SEQ ID NO: 65556 - RNA, 64 nt, hsa
gcagcgaggaauuaacccuguguccucagucgccagcacuuacagcuccaacuuuuuugaauga

SEQ ID NO: 65557 - RNA, 64 nt, hsa
ggcgauucagugucacaaaauaacuccagaaagaagcacuuagcgugcuguuccuguggaaaaa

SEQ ID NO: 65558 - RNA, 64 nt, hsa
acauguuuuuaauuuucucaacaagcauuuagccagcacuuauccagugaaacaauuugauaag

SEQ ID NO: 65559 - RNA, 64 nt, hsa
agcaggagacuugagaaguagagugacaaaaacaagcacuuaauuaaauuauaaaauuuaacuu

SEQ ID NO: 65560 - RNA, 64 nt, hsa
ugaaguggucuuugaccacaguugauugaaccagagcacuuauugcuuaaagaauaacagaguu

SEQ ID NO: 65561 - RNA, 64 nt, hsa
ccugcauccaaggcagguguuguuaaucuaucauagcacuuaaaaaaaaaaaaaaaaagagacc

SEQ ID NO: 65562 - RNA, 64 nt, hsa
gcugaucugcacaauuuaauuaugugguuauucgagcacuuaauuucacucaagguucauuggg

SEQ ID NO: 65563 - RNA, 64 nt, hsa
caggccaggcacgguggcucacgccuauaaucccagcacuuagggaggccaaggcgggcagauc

SEQ ID NO: 65564 - RNA, 64 nt, hsa
cgaggcacaguucuauguuuuuuacauguaauaaagcacuuaaugcaagucuuugagauacguu

SEQ ID NO: 65565 - RNA, 64 nt, hsa
aacugaagaaagaagauaauagaccagcaauugcagcacuuacaaucacuaauucccuuaaggu

SEQ ID NO: 65566 - RNA, 64 nt, hsa
caagcuugugggccaguguccuuguacaugcuguagcacuuaaaaaauaauuccaggguucccu

SEQ ID NO: 65567 - RNA, 64 nt, hsa
guuucaggaguaaaucuaaauguggcuuuugucaagcacuuagauggauauaaaugcagcaacu

SEQ ID NO: 65568 - RNA, 64 nt, hsa
acgguucuuaaggcacauccgggacgaucgauauagcacuuaggcuaugcaggggggucuuucu

SEQ ID NO: 65569 - RNA, 64 nt, hsa
agaauaaaaacugacuagaaauaccgucaaaaccagcacuuaccaaacucagagcaucugagua

SEQ ID NO: 65570 - RNA, 64 nt, hsa
ccccaucugcaccugaauccucuaacuucacgguagcacuuacagcugaagccaucagcaucug

SEQ ID NO: 65571 - RNA, 64 nt, hsa
ggcauccucccagggucuggcuggcugguagccaagcacuuauggaccagaguggcccaggcca

SEQ ID NO: 65572 - RNA, 64 nt, hsa
ucauguaucguaaguuaauacuaaaagaagagaaagcacuuaaguuucacagaagccguuaugu

SEQ ID NO: 65573 - RNA, 64 nt, hsa
guagcuuuugugaaauagaaucagugaccaguauagcacuuagaucccuucuaacucauauaau

SEQ ID NO: 65574 - RNA, 64 nt, hsa; identical to SEQ ID NO: 61370

SEQ ID NO: 65575 - RNA, 64 nt, hsa; identical to SEQ ID NO: 61371

SEQ ID NO: 65576 - RNA, 64 nt, hsa
ucuagcaaugacaaccugugaugucucacaguagagcacuuagcgcagaaucagguccccacgg

SEQ ID NO: 65577 - RNA, 64 nt, hsa
uugcuuugaggucuaaaugaguuaacauuuucaaagcacuuagaauagugucugagacacaaga

SEQ ID NO: 65578 - RNA, 64 nt, hsa
cagcugcuacugcaacaaccgcuaacacuuguuaagcacuuacuacagacuagaaaguguucua

SEQ ID NO: 65579 - RNA, 64 nt, hsa
gaauaaagcaacuuuuguagaugcuguuucauacagcacuuagaugaauuauugaucuuccuaa

SEQ ID NO: 65580 - RNA, 64 nt, hsa
aagaaaacacaaagagaaaauaugaacaauauaaagcacuuaaaggaagaggaugauuucuucc

SEQ ID NO: 65581 - RNA, 64 nt, hsa
gaggaaagcaugauauguauauugcugaguugaaagcacuuauuggaaaauauuaaaaggcuaa

SEQ ID NO: 65582 - RNA, 64 nt, hsa
gcgugagccucccagagccccaggacugggccagagcacuuagguuucuuuuuccaugguuucc

SEQ ID NO: 65583 - RNA, 64 nt, hsa
cccgggaaagcugccccacagccucagcaucuucagcacuuaccgauccagagccucccggccu

SEQ ID NO: 65584 - RNA, 64 nt, hsa
uauuuauguuucuuuuuagauguguaccuucccaagcacuuauuuaugcagugaccuggucacc

SEQ ID NO: 65585 - RNA, 64 nt, hsa
uauauuuuucuaugagaagcacuucauagggagaagcacuuaugacaaggcuauuuuuuaaacc

SEQ ID NO: 65586 - RNA, 64 nt, hsa
cuuaaugggagcuuugccugggaccugaaccuggagcacuuaccgcauuaggaagaaaggagcu

SEQ ID NO: 65587 - RNA, 64 nt, hsa
augugggcagcaugcccagguuccuugcugacucagcacuuauuucuguaguuuuaaaaaagaa

SEQ ID NO: 65588 - RNA, 64 nt, hsa
ucaugcaauugcauauuauguuuauacucacuucagcacuuaucagagauaauugcaguuucac

SEQ ID NO: 65589 - RNA, 64 nt, hsa
ccaccucuugcaccaaaucaauaucuauuuguugagcacuuauugauuaagaccuugcauaugu

SEQ ID NO: 65590 - RNA, 64 nt, hsa
uuauauaacucacugggacauugccaaaugaguaagcacuuaauucgcugcuucugagacuucu

SEQ ID NO: 65591 - RNA, 64 nt, hsa
auaaugauaguagguauguauuauggauuggagaagcacuuauuacacuaucuaaccuaauaug

SEQ ID NO: 65592 - RNA, 64 nt, hsa
ugcagauaugauggaaugcaucccaccuugccaaagcacuuacaccaguuugacugugcuagcu

SEQ ID NO: 65593 - RNA, 64 nt, hsa
acagagggcuagagaaagcaucuucugcagaggaagcacuuaugggaacagucugugagauuga

SEQ ID NO: 65594 - RNA, 64 nt, hsa
ccugcuccuuuccaccagugauuuguauuaagacagcacuuauauuguacaauacuucagacug

SEQ ID NO: 65595 - RNA, 64 nt, hsa
uuuuuaaccugaucuguagagcagagagguugaaagcacuuaacucuuguuuaguauccucauu

SEQ ID NO: 65596 - RNA, 64 nt, hsa
aagugugguucagggccagugcauauuaguggacagcacuuaguagcugugaaggaaggugcag

SEQ ID NO: 65597 - RNA, 64 nt, hsa
auacaguaguaauuaagguacaucucuaaaguggagcacuuacaccaggcucuaagauucacuu

SEQ ID NO: 65598 - RNA, 64 nt, hsa
guaaugagggaaguccuaggauggauagaaaaaaagcacuuacauuggggcacacaggaaaucc

SEQ ID NO: 65599 - RNA, 64 nt, hsa
gguuaggaguagauauugauuacuaucauaauucagcacuuaacuaugagccaggcaucauacu

SEQ ID NO: 65600 - RNA, 64 nt, hsa
uuugcucaauaacucuacucauuuguaucuuuucagcacuuaauuuuaauguaagaaaguuguu

SEQ ID NO: 65601 - RNA, 64 nt, hsa
caggauggugguuagcaacaguggcccgugccaaagcacuuaccaaagugaugaugacuaaggu

SEQ ID NO: 65602 - RNA, 64 nt, hsa
cuaaauuuggcuuuagugugacgggauuugauuaagcacuuaguauagucuuuugaacacggaa

SEQ ID NO: 65603 - RNA, 64 nt, hsa
uucacccaaacugauaacauuuaucucauuuucuagcacuuaaaauacaaagucuauauuauug

SEQ ID NO: 65604 - RNA, 64 nt, hsa
ccagaaaacaauuguggggaucaaggacagacauagcacuuagacaggacuuucaugacccaau

SEQ ID NO: 65605 - RNA, 64 nt, hsa
uguuuaucugugucaaguauuucugguaauaagaagcacuuaauuuacacauauuuuaauccug

SEQ ID NO: 65606 - RNA, 64 nt, hsa
ugcuuaugguaauaaaaauggcucauacuuauauagcacuuacuuuguugcaaguacugcugua

SEQ ID NO: 65607 - RNA, 64 nt, hsa
cggagccuuguuuuucuaaaggggggcgcugucuagcacuuaacuaggguaagcauucuuaaca

SEQ ID NO: 65608 - RNA, 64 nt, hsa
ugguaguacuggaaauuuuacaagacuuuuaccuagcacuuaaauauguauaaauguacauaaa

SEQ ID NO: 65609 - RNA, 64 nt, hsa
cagccaguaaucaaaacagacugggaaugaauaaagcacuuacagaagaguauccuaaugaaaa

SEQ ID NO: 65610 - RNA, 64 nt, hsa
ugacauaaaagguuaaagaacaggcaacacaaugagcacuuaaguuuuuaacauguggggaaua

SEQ ID NO: 65611 - RNA, 64 nt, hsa
gacucaguucagcaacuguuuauucuguuuauugagcacuuacuuggaccaagcacuguggucu

SEQ ID NO: 65612 - RNA, 64 nt, hsa; identical to SEQ ID NO: 61372

SEQ ID NO: 65613 - RNA, 64 nt, hsa; identical to SEQ ID NO: 61373

SEQ ID NO: 65614 - RNA, 64 nt, hsa
cacggguuguaaggacaaaggauuuuaaaaucugagcacuuaggugaagggacaagcagguuua

SEQ ID NO: 65615 - RNA, 64 nt, hsa
aaaaagucuaccaaaggaauuugcauccagcagcagcacuuagaccugccagccacugucaccg

SEQ ID NO: 65616 - RNA, 64 nt, hsa
ucgcauuuguuauaaauguaguaaggcagguccaagcacuuacaaguuuuuuguaguuguuacc

SEQ ID NO: 65617 - RNA, 64 nt, hsa; identical to SEQ ID NO: 61374

SEQ ID NO: 65618 - RNA, 64 nt, hsa; identical to SEQ ID NO: 61375

SEQ ID NO: 65619 - RNA, 64 nt, hsa
gccaucugaaggggauucugaucuguucuuauguagcacuuaacacuguguagaaacuauuuuu

SEQ ID NO: 65620 - RNA, 64 nt, hsa
uuaaaacauuuuacuuggcuuauucaauuucuaaagcacuuacguugugccagguuccacucaa

SEQ ID NO: 65621 - RNA, 64 nt, hsa
aaaucagugggaauuaagaaagccucgucgugaaagcacuuaauuuuuuacaguuagcacuuca

SEQ ID NO: 65622 - RNA, 64 nt, hsa
gcuuucaucuauguuuaucacauuuuaauaccacagcacuuauaaugaugucacuacauauaga

SEQ ID NO: 65623 - RNA, 64 nt, hsa
uauuaaguacuuacuacaugcuaagagcuuuuuaagcacuuauuuaauccucauuaacaaauuc

SEQ ID NO: 65624 - RNA, 64 nt, hsa
cgauuuuuagcauuaaaaacuaaggaauauacuuagcacuuacuuaaucuuuucaguuuuccag

SEQ ID NO: 65625 - RNA, 64 nt, hsa
aaaauucccugggcacagguugcaccugggugugagcacuuaaucacucaacgcuuuguuuucu

SEQ ID NO: 65626 - RNA, 64 nt, hsa
uugcuuauucauugaauauuuuucuguaauuuucagcacuuauguauacacuuuuucuguacuu

SEQ ID NO: 65627 - RNA, 64 nt, hsa
auaaaaaagaauuuuuaaugcuaaugagagguuuagcacuuaagaucagauucaagagaauaua

SEQ ID NO: 65628 - RNA, 64 nt, hsa
ugcauuugccaacaccuuuuuaaggggaggagagagcacuuaguuucugaacuagucuggggac

SEQ ID NO: 65629 - RNA, 64 nt, hsa
gcucuaaccguaacacgucccacccccuuuuuaaagcacuuacuguuuucagagcacccauauc

SEQ ID NO: 65630 - RNA, 64 nt, hsa
aaugcuuuucucuccuuauguguggaaggaggggagcacuuagacauuugcuaacucccagaau

SEQ ID NO: 65631 - RNA, 64 nt, hsa
uuguauuuuuacaaacacauaaacacacagccguagcacuuagaagaaaagaggcuuucuaagc

SEQ ID NO: 65632 - RNA, 64 nt, hsa
gggagggaagcggguguuggcuguuuccaaagagagcacuuaauuuaauuuuuccuuuaaauga

SEQ ID NO: 65633 - RNA, 64 nt, hsa
aauauuuaguuuugcuuucucguggauaauauuaagcacuuacucugcaguuuccuggaaguug

SEQ ID NO: 65634 - RNA, 64 nt, hsa
auaaugguaaguaguugcuacuggccaacugucuagcacuuaccugaaaacuuaguauggagcu

SEQ ID NO: 65635 - RNA, 64 nt, hsa
agaacagugcuugccacagagcggggacucgguaagcacuuaaugaaugaaugaauucuaaguc

SEQ ID NO: 65636 - RNA, 64 nt, hsa
augucuauugcaaacaauucucucaguuacguucagcacuuaagaacggcuaauggcaauagga

SEQ ID NO: 65637 - RNA, 64 nt, hsa
caucaaugccaacaagagcaucugccgguuacugagcacuuacuaagugccaagcauuauuuua

SEQ ID NO: 65638 - RNA, 64 nt, hsa
aguauuugacuguaauaguauaguaguuaaauacagcacuuaaaaauaccacagacacaguuaa

SEQ ID NO: 65639 - RNA, 64 nt, hsa
uucaguggguuaucucuaggaugaucaguaguucagcacuuaaaaacugcagagaaaacugaaa

SEQ ID NO: 65640 - RNA, 64 nt, hsa
ugcagggguuucccuggcgcagcgaaagucucugagcacuuaccgggcgugaccguuucuuagg

SEQ ID NO: 65641 - RNA, 64 nt, hsa
ccguuuacacagacaaagugacaucagaaggcugagcacuuaucuggaucauuuggucaguuug

SEQ ID NO: 65642 - RNA, 64 nt, hsa
ccugggaaucuaucccuaaggaauaaaaagcgccagcacuuaagauuauauguuuacuaaugua

SEQ ID NO: 65643 - RNA, 64 nt, hsa
cuuccucuuuuuggguuuucuucuuucuccuuuaagcacuuacaugguuggggguaagacuagg

SEQ ID NO: 65644 - RNA, 64 nt, hsa
aaaaaaaaaaaaaaaaaaaaacacaaaacccacaagcacuuaucuuggcuacuaaugaagcucu

SEQ ID NO: 65645 - RNA, 60 nt, hsa; identical to SEQ ID NO: 65087

SEQ ID NO: 65646 - RNA, 64 nt, hsa
gccuaguguucccagcacugugccugcucucaagagcacuuacugccucgcaaauaauaaaaau

SEQ ID NO: 65647 - RNA, 64 nt, hsa
uuccagaaccuaggaggaugccuaacagagaguaagcacuuaaaaaauauuugucauaugaaug

SEQ ID NO: 65648 - RNA, 64 nt, hsa
gggagauuuaucuugaagcugaauuugcaaagcaagcacuuauaaaaauuagauuguguguuac

SEQ ID NO: 65649 - RNA, 64 nt, hsa
caacauuuguuaauaguuacgucucuccugauguagcacuuaagcuucauuuaguuauuauuuc

SEQ ID NO: 65650 - RNA, 64 nt, hsa
gucgaccucaucaucugggagaucgaggugccaaagcacuuagucggucggcuaauuggcaagc

SEQ ID NO: 65651 - RNA, 64 nt, hsa
caguucaugucucguccauguccauguucguguuagcacuuacgugggaacaaauaccaauuug

SEQ ID NO: 65652 - RNA, 51 nt, hsa; identical to SEQ ID NO: 65094

SEQ ID NO: 65653 - RNA, 64 nt, hsa
auuuuaugcucuuucuggcaaauaagauucuaaaagcacuuauaucccugugaauacuucagag

SEQ ID NO: 65654 - RNA, 64 nt, hsa
cuuucuccuuagguccucacacaauuccuuacagagcacuuauuaaaaaaaaaucuuaagaguu

SEQ ID NO: 65655 - RNA, 64 nt, hsa
uuucaguuccauucaugaacgaauuauuucuucaagcacuuauggacaacgaacaaauucuuca

SEQ ID NO: 65656 - RNA, 64 nt, hsa
accgacguccuuuagcccucccaggccccacggcagcacuuaugguagcggcacugucuuggcu

SEQ ID NO: 65657 - RNA, 64 nt, hsa
aauaccccaagaccccagagggcaguccuuaggaagcacuuacaccaccugggaaccccuccgu

SEQ ID NO: 65658 - RNA, 64 nt, hsa
accauacaagcaucagaagagcucucuuguuguuagcacuuauuguuugcaagaacagaauaca

SEQ ID NO: 65659 - RNA, 64 nt, hsa
ccugccuuggcaccgucacagaugccaagcaggcagcacuuagggaucucccagcuggguuagg

SEQ ID NO: 65660 - RNA, 64 nt, hsa
cauuucuuggccaaaguggcuuccucaagaaagcagcacuuaccuuugaaaaaugcugggaaca

SEQ ID NO: 65661 - RNA, 64 nt, hsa
agccaagggccauuucuucucagcuugguggagcagcacuuacuuacuacuggaaaugaaaaaa

SEQ ID NO: 65662 - RNA, 64 nt, hsa
auugcaggaauauaaauaauaaaagacuguuauuagcacuuaguaagucuucaucuaugcaugu

SEQ ID NO: 65663 - RNA, 64 nt, hsa
gcuuuugaugccaggugcaaucuacuggaaauguagcacuuacguaaaacauuuguuuccccca

SEQ ID NO: 65664 - RNA, 64 nt, hsa
acuccaauucaggagcccuugcgaguauaucugaagcacuuauuugcuaaggaaaccugaauug

SEQ ID NO: 65665 - RNA, 64 nt, hsa
cugcagcaauuccuccauuuuuaugaaucuugugagcacuuacgcuaggagaaauuucuuuuac

SEQ ID NO: 65666 - RNA, 64 nt, hsa
ccuccuuugcaggagggcugggaauccucuuuagagcacuuaauccuauuuauccccuggaaug

SEQ ID NO: 65667 - RNA, 64 nt, hsa
aaauaugauauauucaaaugauagaauaguauacagcacuuaaaagcagugaaccagauccaua

SEQ ID NO: 65668 - RNA, 64 nt, hsa
agggcuuuucugaggauuaaauaaauaaaugugaagcacuuagaacugauggccagcacaugag

SEQ ID NO: 65669 - RNA, 64 nt, hsa
aauuccaaacauacaagaggcucccucuuaacgcagcacuuagacacguguuguuccaccuucc

SEQ ID NO: 65670 - RNA, 64 nt, hsa
aauuccaaacauacaagaggcugccucuuaacacagcacuuagacacgugcuguuccaccuccc

SEQ ID NO: 65671 - RNA, 64 nt, hsa
ggggccgggcacggugccucacaccuguaaucccagcacuuagguaggccaagguggguggauc

SEQ ID NO: 65672 - RNA, 64 nt, hsa
uuauuuauguagagcauguaggaaaaccugguauagcacuuauuuuguaccuaaaaauucagag

SEQ ID NO: 65673 - RNA, 64 nt, hsa
gaggcugggcacaguggcucacgccuguaaucccagcacuuagggugggcaaauugcuugaccu

SEQ ID NO: 65674 - RNA, 64 nt, hsa
uccaggacugguuuccuagccucccgcuaagacuagcacuuagcucuucuuggaaaaggaccca

SEQ ID NO: 65675 - RNA, 64 nt, hsa
ucuuuuaaacucaauauaauguuaauauuacuguagcacuuacuagcauuucugaagguugguc

SEQ ID NO: 65676 - RNA, 64 nt, hsa
ugauuguggauccccugagaucuggcuucccaagagcacuuauugacccuuccucaggccuccc

SEQ ID NO: 65677 - RNA, 64 nt, hsa
gacucaagcacauugguauuguauaaagguauagagcacuuagcuuacaaucuuuaaagguuuc

SEQ ID NO: 65678 - RNA, 64 nt, hsa
aaagacauggcuggaugcgcugcugaccaacaucagcacuuaaauaaaugcaaaugcaacauuu

SEQ ID NO: 65679 - RNA, 64 nt, hsa
aacguuuauagccuugccuguaaaaaugugccccagcacuuaaugagugaccguuugaauccau

SEQ ID NO: 65680 - RNA, 64 nt, hsa
ggcuccugccguccugacgccaccccgccccaucagcacuuaagccacaugacacaaagucugu

SEQ ID NO: 65681 - RNA, 64 nt, hsa
agccuagguguuucacugguccucuaugaaucccagcacuuauaaucccagucuuuuaucacuc

SEQ ID NO: 65682 - RNA, 64 nt, hsa
gcuaggaagcaaccuuucgccugugcagcgguccagcacuuaacucuaauacaucagcaugcgu

SEQ ID NO: 65683 - RNA, 64 nt, hsa
gaggauuaagugaaccaauacauauacagugcuuagcacuuaauaaguauuccccccugcgaca

SEQ ID NO: 65684 - RNA, 64 nt, hsa
agggaaaacagacucccuucgggaaacauccuuaagcacuuaaggccggggggggugucugccu

SEQ ID NO: 65685 - RNA, 64 nt, hsa
gccagccuagcuuuuuuuuuuuuuuuuuuuuuuuagcacuuaguauuuagcauuuauuaacagg

SEQ ID NO: 65686 - RNA, 64 nt, hsa
agagcuggaaccaagaucuagauaguccguagauagcacuuaggacaagaaugugcauugaugg

SEQ ID NO: 65687 - RNA, 64 nt, hsa
ugaagucguuccaucauaaucuaugaucuuguacagcacuuauagaaauaagcuguucuuuuga

SEQ ID NO: 65688 - RNA, 64 nt, hsa
cuuuguuaguuauagggauggacaguuuauguuaagcacuuagcuuaaacaauccguuuauauu

SEQ ID NO: 65689 - RNA, 64 nt, hsa
ucugguuacacauauggaaguaagcaaaaugaaaagcacuuauugcuuucugacagaauuauag

SEQ ID NO: 65690 - RNA, 64 nt, hsa
cccagcccauaauugggacccagagcccuuucccagcacuuaaaacaggagccuagagcccccu

SEQ ID NO: 65691 - RNA, 64 nt, hsa
agucuuccuucuguagagggcuguuuacauauacagcacuuaaaauguuugugugggaaaaaaa

SEQ ID NO: 65692 - RNA, 64 nt, hsa
ggcuuggagaaauggcuaggacagggaacagggaagcacuuacaauuauuccuugauuuauuca

SEQ ID NO: 65693 - RNA, 64 nt, hsa
guguuacuguaauuccucaacguauuguuucggcagcacuuauuuaaugccgauauacucuaga

SEQ ID NO: 65694 - RNA, 65 nt, hsa
caggaggcccuguucuuagagccccugacaaaggcagcacuuauuuccugggcuggugcgcccca

SEQ ID NO: 65695 - RNA, 65 nt, hsa
accagcaugacaaaauggucaaaaaauaagucaucagcacuuaagaaaugaaagcaacuuuugaa

SEQ ID NO: 65696 - RNA, 65 nt, hsa
augagauuuaaaaucuuaaaauguuucuuauuuucagcacuuacaucauuugguacacaggguca

SEQ ID NO: 65697 - RNA, 65 nt, hsa
uaaagccaguuucaucaaacaguucaacagagagcagcacuuaauacccuuuauacagcccauuu

SEQ ID NO: 65698 - RNA, 65 nt, hsa
aggagucaaaaaacuugauuucagguccuagcucuagcacuuacagcugugugaucuugggcaag

SEQ ID NO: 65699 - RNA, 65 nt, hsa
uauauuuugauuuuacccagcuuaaucuguaaaguagcacuuaaauauaucugauagcaacacuu

SEQ ID NO: 65700 - RNA, 65 nt, hsa
aaaugaggaugaggaauaauaaacucuuuuuggcaagcacuuaaauguucugaaauuuguauaag

SEQ ID NO: 65701 - RNA, 65 nt, hsa
auagguaaguuuuauaagggaguacauuuugacugagcacuuagggcaucaggaacagugcuacu

SEQ ID NO: 65702 - RNA, 65 nt, hsa
guauggcauaccaaucugugcggggcaguguccuaagcacuuagacuacaucagggaagaacaca

SEQ ID NO: 65703 - RNA, 65 nt, hsa
guuaaauaucuuaaaauaucuaaaacauuuuuuaaagcacuuagauugucuuacguaugugcaua

SEQ ID NO: 65704 - RNA, 65 nt, hsa
aggaaacugucugucuaauggucacagagcacuguagcacuuaacagauugccauggacaccagu

SEQ ID NO: 65705 - RNA, 65 nt, hsa
cugggcccucuuucccugcgagacgcacacagcugagcacuuagcaggcaccgccacgucccagc

SEQ ID NO: 65706 - RNA, 65 nt, hsa
augauaaucaguauaauaauuugccuuguguggucagcacuuaacuguuuacaaagcccuuucac

SEQ ID NO: 65707 - RNA, 65 nt, hsa
ucccaccuguggccccuaaacccagagugacugagagcacuuaacauucagcuugucucaucccc

SEQ ID NO: 65708 - RNA, 65 nt, hsa
ugggguuauguagaaaagcaauuuauuccauuuuaagcacuuacacaguuagucauggagaguaa

SEQ ID NO: 65709 - RNA, 65 nt, hsa
ugccucagugggccugugggagccuacuggagcccagcacuuacucccccugagcagcgagccug

SEQ ID NO: 65710 - RNA, 65 nt, hsa
ugguuucuucuaccacccaauucuacuaggaaaggagcacuuaggaggcucuugggaugcagcaa

SEQ ID NO: 65711 - RNA, 65 nt, hsa
uuguugugaggauuaaaaugaggaaaugaauguaaagcacuuaguacaguauaugaaauaauggg

SEQ ID NO: 65712 - RNA, 65 nt, hsa
guucugggggugaaagaaaaauauuaguuuaccugagcacuuauuuccaugacagggucuaaaau

SEQ ID NO: 65713 - RNA, 65 nt, hsa
aucaaauagaaucuuauaucuguauguuaaaauagagcacuuaccugaagucaguggccuggauc

SEQ ID NO: 65714 - RNA, 65 nt, hsa
uacacauaauggugucuuaaaauugacaaaaaaugagcacuuacaauuguaugucuccucaaaug

SEQ ID NO: 65715 - RNA, 65 nt, hsa
cgagggcaggauugucuuuuuuuuucuguguccccagcacuuacaacaaagccuagcacaaagua

SEQ ID NO: 65716 - RNA, 65 nt, hsa
gggucagcgcucuugcuuugcucuuuucaaugaauagcacuuauguuacugguguccagcugagu

SEQ ID NO: 65717 - RNA, 65 nt, hsa
aaaauauauaguauguuuuaaguuuguaucuaaauagcacuuacuguaauguauuauaccuaaau

SEQ ID NO: 65718 - RNA, 65 nt, hsa
gcuuuuuucuuuccucccuuaccccaaauucauugagcacuuaaaggagcagagaugcagccagu

SEQ ID NO: 65719 - RNA, 65 nt, hsa
ccucauuguaaacaaacuguguaacugcccaaagcagcacuuauaaaucagccuaacauaagauc

SEQ ID NO: 65720 - RNA, 65 nt, hsa
auuguuuuaaauuaauuuuuuagcagauagcaguuagcacuuaaucuguaaauugaauaauuuau

SEQ ID NO: 65721 - RNA, 65 nt, hsa
uuuaaucaauuaguaauggcggaaacugucgcugaagcacuuaagaaauaaagguacuuuacagc

SEQ ID NO: 65722 - RNA, 65 nt, hsa
gugaagguggcuuuugcuuuauaguuuggcuggggagcacuuaauucuucccauuucaaaaggua

SEQ ID NO: 65723 - RNA, 65 nt, hsa
uucucuauucuuauuauucacugcacuauauucuaagcacuuacauguggagauacuguaaccug

SEQ ID NO: 65724 - RNA, 65 nt, hsa
ccauuuccugucuuucccguccaucacccauccuaagcacuuacgugaguaaauaaugcagcuca

SEQ ID NO: 65725 - RNA, 65 nt, hsa
guccucccucgagaaacagugccgccggugugaugagcacuuacacccacguucucaagggcaga

SEQ ID NO: 65726 - RNA, 65 nt, hsa
uguaucuuggcugucaagaguaucaaaugccaugcagcacuuaaacuugugauaaggaagaugaa

SEQ ID NO: 65727 - RNA, 65 nt, hsa
ugccauuuaauuagcugcauaucaccuuaggguacagcacuuaacgcaaucugccucaauuucuu

SEQ ID NO: 65728 - RNA, 65 nt, hsa
uggggcugagugcaguggcucaugccuguaaucccagcacuuagggugccaauguggauuaccug

SEQ ID NO: 65729 - RNA, 65 nt, hsa
agcuuuuagaccucuuacuuccacugcuaguagcuagcacuuacugagcaccugcgaugagguaa

SEQ ID NO: 65730 - RNA, 65 nt, hsa
gugggauuucagauaugaacgguguaaauuugagaagcacuuaugcauacaugugggugaaaaac

SEQ ID NO: 65731 - RNA, 65 nt, hsa
caaguucuuguuuuuauuuuugaaaguacucacacagcacuuacuaugcuccaaacacuccucua

SEQ ID NO: 65732 - RNA, 65 nt, hsa
ugauuugccucaacaacguaaacuuccuaaugauuagcacuuaauaauugcauauaaaaugcuuu

SEQ ID NO: 65733 - RNA, 65 nt, hsa
uuuugggacaauuguuuuaaucugaaauucuaaagagcacuuacuguaaccuguugcuguguuua

SEQ ID NO: 65734 - RNA, 65 nt, hsa
auccugcggguggggcuuggggcucacacaccuguagcacuuacugguaggaccaagcaucuugg

SEQ ID NO: 65735 - RNA, 65 nt, hsa
acgagauaaaggcagcuaaaacgagggcaguagagagcacuuacccgaccccaaggugccagaga

SEQ ID NO: 65736 - RNA, 65 nt, hsa
uugaauuccuuggggauuuuuuacugcccuuucaaagcacuuaaguguuagaucuaacguguucc

SEQ ID NO: 65737 - RNA, 65 nt, hsa
uuaacagaggcauauauuuaaaaugaaauuuaaugagcacuuagugacuucauuuguucaagaau

SEQ ID NO: 65738 - RNA, 65 nt, hsa
aaaacauuuuuuagucuguaauacacuccacuugaagcacuuaagucuuccuuaaaugacuuuuc

SEQ ID NO: 65739 - RNA, 65 nt, hsa
agcuccuaaacaagagaauaaaaaugggccaucccagcacuuauaaggggagcacaucuuguaau

SEQ ID NO: 65740 - RNA, 65 nt, hsa
ugccuuucuugugaaaguuuucaaucagcgauaucagcacuuacaguaagaaguaaaaguagugc

SEQ ID NO: 65741 - RNA, 65 nt, hsa
ucacacugugugugauuuuguuucuuuuguuaagcagcacuuauguagacugcauuuccaaaugu

SEQ ID NO: 65742 - RNA, 65 nt, hsa
acauaguacagaagauucuuuguuuuucuccacugagcacuuaacaauugcuuucucucuggccu

SEQ ID NO: 65743 - RNA, 65 nt, hsa
ugugauauacaaaguguaccaacauaaguguugguagcacuuaagacuuauacuugccuucugau

SEQ ID NO: 65744 - RNA, 65 nt, hsa
ugaaagcuaaaacaacccauuugcuacccauccaaagcacuuacaguuuagcaaauauuaaagag

SEQ ID NO: 65745 - RNA, 65 nt, hsa
accauaaaagagaaaaaaauucggaaagugaucagagcacuuauucaaaauacagugauagaagu

SEQ ID NO: 65746 - RNA, 65 nt, hsa
aaucaagauauauaucuggaaccucuuauaaauggagcacuuagaaauuuguuguucugcacuua

SEQ ID NO: 65747 - RNA, 65 nt, hsa
cuucauuagcucagugacuuguccacacucgucuuagcacuuacguuucaaaagcuugucacaaa

SEQ ID NO: 65748 - RNA, 65 nt, hsa
uguacugaugucucagugaaucagucuguuuauuaagcacuuaucagggcuuccacacacuuauu

SEQ ID NO: 65749 - RNA, 65 nt, hsa
gauguggagggcugcaaucugucuugauuucuccaagcacuuaacuuucuuugacugcacugaga

SEQ ID NO: 65750 - RNA, 65 nt, hsa
auuucaggucuuugcucauucacucaguaauacugagcacuuaccauguaccagaauuuuacuag

SEQ ID NO: 65751 - RNA, 65 nt, hsa
uaauuuaaauaauguaaacgcaaacaggguuugauagcacuuaaacuaguucauuucaaaauuaa

SEQ ID NO: 65752 - RNA, 65 nt, hsa
aaaaaugaguaaaauaauuaaugaaacauauuuagagcacuuaauggucucuguuuucaauauaa

SEQ ID NO: 65753 - RNA, 65 nt, hsa
auaacuuagaaacauugcgcauauucuucugaaauagcacuuaaaaaugauuagugucaguauuu

SEQ ID NO: 65754 - RNA, 65 nt, hsa
gagucaaaaggcccagagucugagucccagcccugagcacuuaggagccuucugacuuaggguuu

SEQ ID NO: 65755 - RNA, 65 nt, hsa
cccuuuuaagucagggaugcuuuauucuauuuuaaagcacuuaugaguuacauguuguaaucaag

SEQ ID NO: 65756 - RNA, 65 nt, hsa
ggucuuuguuauaauucauauaggcuugugaauauagcacuuauuuuaauccaguagagacuugc

SEQ ID NO: 65757 - RNA, 65 nt, hsa
ccguaaccucacacauuaacuuuauucaaacaaacagcacuuacaggaaauguaaaguagaaaaa

SEQ ID NO: 65758 - RNA, 65 nt, hsa
gucaaugggaaaaaacaccaggauuuaaguuucacagcacuuacaauuuucccucuucacuuggu

SEQ ID NO: 65759 - RNA, 65 nt, hsa
uuuaugguuucauguaacauacauauuccugguguagcacuuaacuccuuuuccacuuuaaauuu

SEQ ID NO: 65760 - RNA, 65 nt, hsa
agucugaugaggaaaagauuaacuaauagaugcauagcacuuaacagagugcauagcauacacug

SEQ ID NO: 65761 - RNA, 65 nt, hsa
ggcagacacggaucugagaaucuuuauugagaaagagcacuuaagagaauauuuuaaguauugca

SEQ ID NO: 65762 - RNA, 65 nt, hsa
aauuauugauguuuucauagagaauauaaaaauaaagcacuuauagaaaaaacucguuugauuuu

SEQ ID NO: 65763 - RNA, 65 nt, hsa
gaugcauuugucauacguuucuacuuaaauuauuaagcacuuacgauuuagauguaauaauuaua

SEQ ID NO: 65764 - RNA, 65 nt, hsa
agcuacuuuugugggaguauuucuauuauauaaccagcacuuacuaccuguacucaaaauucagc

SEQ ID NO: 65765 - RNA, 65 nt, hsa
uugaugaggaagaagacaauuggauaagaugggacagcacuuauaaugaaauaaaaaaaaacuuu

SEQ ID NO: 65766 - RNA, 65 nt, hsa
cauauuucagucaguccagaggcaguuaacccuguagcacuuacuagacuggugacaacuggcug

SEQ ID NO: 65767 - RNA, 65 nt, hsa
cuuaugaaucaccugaguacaauucuuuguuguuuagcacuuaaauuucccaauuuauuaaauug

SEQ ID NO: 65768 - RNA, 65 nt, hsa
gcgacauugcagucugcuucugcaccuuaucuuaaagcacuuacagauaggccuucuugugaucu

SEQ ID NO: 65769 - RNA, 65 nt, hsa
uguaggguuauggaaucuaguaauaaaauuucaacagcacuuaaacugaaguuuggguugcucau

SEQ ID NO: 65770 - RNA, 65 nt, hsa
auucacacaugccuauauuaucauaagaauuuuucagcacuuaacuacuuuguuggcauugaucc

SEQ ID NO: 65771 - RNA, 65 nt, hsa
ucucaagggaaaauacucaaagaaagaaaaguggcagcacuuauauuaguuuuauaacaggauaa

SEQ ID NO: 65772 - RNA, 65 nt, hsa
gaagcuuacauuacauguccaguccacauuuaaagagcacuuacuguggaacaagccuucagcca

SEQ ID NO: 65773 - RNA, 65 nt, hsa
auuuuugaauucuuuagauuuuuaaauuggagaaaagcacuuaaaguuuuuuauauaugaauauu

SEQ ID NO: 65774 - RNA, 65 nt, hsa
accauugugcacuaugggaggccgcugcugcguggagcacuuaaaguccagccuccaggaccgga

SEQ ID NO: 65775 - RNA, 65 nt, hsa
agguccagagagcuuuauggaagcgggagaggaggagcacuuacucauguuguauuuguuaaugg

SEQ ID NO: 65776 - RNA, 65 nt, hsa
uuacacuggggauguuauuuacuuguuuauuaguuagcacuuagaaugaguucauuuuuagguga

SEQ ID NO: 65777 - RNA, 65 nt, hsa
aucauauuuuaggauuauuuuuggcaaauacagugagcacuuauguaaccagaugauaaugaacu

SEQ ID NO: 65778 - RNA, 65 nt, hsa
uuggcugugaguagaauauguaaaaguggcauggcagcacuuaugcucugugacaguauugugug

SEQ ID NO: 65779 - RNA, 65 nt, hsa
ccucaguuuggucaccuguaaaaggaaauaacaagagcacuuacuuuauaagauugaugugagua

SEQ ID NO: 65780 - RNA, 65 nt, hsa
ucacucuaaaagcacugaccucaaaaaaccuuauaagcacuuagauuuaauugcauuuuccauag

SEQ ID NO: 65781 - RNA, 65 nt, hsa
guucugauaaugaaaauuaugauaaggaugauaaaagcacuuacuucguguccgacucuucugag

SEQ ID NO: 65782 - RNA, 65 nt, hsa
cugagucuccaaauaauaauagccgacguuuauugagcacuuacuaugugcccaacccuguuaug

SEQ ID NO: 65783 - RNA, 65 nt, hsa
cucaguuuccugaccuaugaaacagagaaaauaaaagcacuuauuuauuguuguuggaggcugca

SEQ ID NO: 65784 - RNA, 65 nt, hsa
aaaauaaccucaccccaaauacaauaaagggacgaagcacuuauagauaccacagacacaugugu

SEQ ID NO: 65785 - RNA, 65 nt, hsa
ccuaccugaccuugugcgcugggaggcgcaucugcagcacuuacaggugagggauggggagaugg

SEQ ID NO: 65786 - RNA, 65 nt, hsa
ugcaaggagacacaugccaccccagcaguacacaaagcacuuaccuugacuggugaagucagcca

SEQ ID NO: 65787 - RNA, 65 nt, hsa
aauagcuuucauuuacauagugcuuacauuuauauagcacuuacuaugugcgauguacuaauuua

SEQ ID NO: 65788 - RNA, 65 nt, hsa
ucauuuuacaauagauaaaugcuugugcuaccuaaagcacuuagcacacaguuaaauuauauuua

SEQ ID NO: 65789 - RNA, 65 nt, hsa
gaauaaaucacuauacugauauuuugauacaagcaagcacuuacaugguaaucacuauauagauc

SEQ ID NO: 65790 - RNA, 65 nt, hsa
cauugucaucucauauugaucagguauuuuaaucuagcacuuacauauuguugauaaaugaaagc

SEQ ID NO: 65791 - RNA, 65 nt, hsa
agcagagacuguuaauggccccuuacccugggugaagcacuuacccuuggaacagaacucuaaaa

SEQ ID NO: 65792 - RNA, 65 nt, hsa
uauauauuauuuucuucuccuuuauauguaaugaaagcacuuauaaagaaacaggaaucauuaga

SEQ ID NO: 65793 - RNA, 65 nt, hsa
aagguuagucucauuuagaaaaaucgaaagugcacagcacuuaaagggaauauaugagguuuuuu

SEQ ID NO: 65794 - RNA, 65 nt, hsa
aucaaccugauccucaugcugauagaaugacagcuagcacuuauuuccuaagugcaacuguuuua

SEQ ID NO: 65795 - RNA, 65 nt, hsa
cacccccuccaaagauggaguguagaaaugaugacagcacuuaguaaguucaaagaugacauuca

SEQ ID NO: 65796 - RNA, 65 nt, hsa
accagcugggcacgguggcucacgccuguaaucccagcacuuacuuugggaggccaaggugggca

SEQ ID NO: 65797 - RNA, 65 nt, hsa
uagugcgguucucuuugacccccaaagacaagacaagcacuuauuuuuauuuucagaagacaaaa

SEQ ID NO: 65798 - RNA, 65 nt, hsa
gaugggaagacacauguuaaguuuuguggccuuccagcacuuacuauuuucagcuuuuuaaagca

SEQ ID NO: 65799 - RNA, 65 nt, hsa
gcaauugguaaaggaaagagcagguguggggguuaagcacuuauuugagguggggguguucaccu

SEQ ID NO: 65800 - RNA, 65 nt, hsa
acuuuagggccggucaggcccuaaaguauucacugagcacuuaggaagaccgggcauugggcugg

SEQ ID NO: 65801 - RNA, 65 nt, hsa
augaaaaacugaagagaacaaaauuuguaaccacuagcacuuaaguacuccugauucuuaacauu

SEQ ID NO: 65802 - RNA, 65 nt, hsa
gaggcuuauuuuauuauaguagccaacauuuauccagcacuuaccuuauauaaagggcuguuugu

SEQ ID NO: 65803 - RNA, 65 nt, hsa
gcccuccuggggagacgugacucugguggacgcagagcacuuaguuacccuggacgcuccccaca

SEQ ID NO: 65804 - RNA, 65 nt, hsa
uuauuucuuaauuauuauaaaaauauuaagacaauagcacuuaaauuccucaacaguguuuucag

SEQ ID NO: 65805 - RNA, 65 nt, hsa
guaaacaaaaauuuuucuuucuuuacugcaugcauagcacuuaauaaaauggauuuuuaaaaaau

SEQ ID NO: 65806 - RNA, 65 nt, hsa
cacaaaaagugucucugccuugagucaucuauucaagcacuuacagcucuggccacaacagggca

SEQ ID NO: 65807 - RNA, 65 nt, hsa
auuccucagugccuguccauaacugugaaguauuaagcacuuagggccagaugcacuguaaacau

SEQ ID NO: 65808 - RNA, 65 nt, hsa
aacucuacucaucuuuagagaugaaucaucuauuaagcacuuaccaaaacauaucauuaaacuga

SEQ ID NO: 65809 - RNA, 65 nt, hsa
guguauuauaauuaguuuugugaauagaaaaauaaagcacuuauguuuaaauuuguuacagugac

SEQ ID NO: 65810 - RNA, 65 nt, hsa
gaaaagugagguguggaacuccaggcaacgacccaagcacuuauuuuuuaagagggaaaggacuu

SEQ ID NO: 65811 - RNA, 65 nt, hsa
gagauuaucgaucuaugagacaucuugauauguaaagcacuuaauauuaaaggcauaaaagugaa

SEQ ID NO: 65812 - RNA, 65 nt, hsa
uccucaucucccuguccucugagauaauaugagugagcacuuagguaucauaucagaugcucaag

SEQ ID NO: 65813 - RNA, 65 nt, hsa
ccauuucuagcauauggacaccuggccucugcuugagcacuuaggugacaggaacuuccgcaccu

SEQ ID NO: 65814 - RNA, 65 nt, hsa
ccaaacugaaaauaggagcuauuuauagauggagcagcacuuagugcuucauagaaagcaaugcc

SEQ ID NO: 65815 - RNA, 65 nt, hsa
ugaaaugguaguggaauuauuugaauucuacaccaagcacuuaccaugugccaggcccuuugcag

SEQ ID NO: 65816 - RNA, 65 nt, hsa
uucaucgacuuagccugagucauaacgguuaagaaagcacuuaaacagaagcagaggcuaauuca

SEQ ID NO: 65817 - RNA, 65 nt, hsa
gguuuauauucuuauguuaucaccuuccaaacaaaagcacuuacuuuuuuuggaaguuauuuauu

SEQ ID NO: 65818 - RNA, 65 nt, hsa
agcaguuagagcggucgucggccaaccuccccaacagcacuuagguuuuccuguugagauggggg

SEQ ID NO: 65819 - RNA, 65 nt, hsa
acagcuaguaaccggcugugagggagagggucagaagcacuuagcguuggccucugauugcuguc

SEQ ID NO: 65820 - RNA, 65 nt, hsa
uucgguauuuccuaucgacguuuauuuaccucuuuagcacuuauacuuuagcauaaaaaauguug

SEQ ID NO: 65821 - RNA, 65 nt, hsa
auuuagugaucaaacugccauucacaguguaaggcagcacuuaaauuucgaaccuaaaguuuaga

SEQ ID NO: 65822 - RNA, 65 nt, hsa
ccauguguauuuugcuuaauggaaugcuuuauuuaagcacuuaggcagaguagacacaauuaaag

SEQ ID NO: 65823 - RNA, 65 nt, hsa
auguuuucaacuccaaaucaauucuaaaaacuucaagcacuuaauggaaagguaaauggucagau

SEQ ID NO: 65824 - RNA, 65 nt, hsa
uuuaccagaugcugaaggcaaggggagggagcagaagcacuuauguuuacggauauuuuaaacuc

SEQ ID NO: 65825 - RNA, 65 nt, hsa
auaccccucuugaaagagauuuacucaucuauccaagcacuuaauuuggaaauuuuauuguccua

SEQ ID NO: 65826 - RNA, 65 nt, hsa
ucccugaccuugacacuucccccuuuagcuauaaaagcacuuaccagccgaacguggaacaguau

SEQ ID NO: 65827 - RNA, 65 nt, hsa
aagauuucggcaucgacacggacguuguugcacaaagcacuuaaagaacgagagcaucuuguuca

SEQ ID NO: 65828 - RNA, 65 nt, hsa
gcacccccucaauagccagcacccacagugagcugagcacuuacagcaacaauuguaagucgacu

SEQ ID NO: 65829 - RNA, 65 nt, hsa
caguucuccauuuuauuagaaaauacaaguugcuaagcacuuaggaccauuugagcuuguggguc

SEQ ID NO: 65830 - RNA, 65 nt, hsa
acagguguaguaauuguggguacuuuaagguuuggagcacuuacaaggcugugguagaaucauac

SEQ ID NO: 65831 - RNA, 65 nt, hsa
aaaauauuuuuaugccuacuuaggaaaaaaaggguagcacuuauucauuccaaguacuuuuuuuu

SEQ ID NO: 65832 - RNA, 56 nt, hsa; identical to SEQ ID NO: 61369

SEQ ID NO: 65833 - RNA, 65 nt, hsa
uuaacaggaauuauaaauaacuucaauaugaugagagcacuuaagaucucaauaacuguggaagu

SEQ ID NO: 65834 - RNA, 65 nt, hsa
gccuuacugguuugccaaagccauccuuggcaucuagcacuuacaucucucuaugcuguucuaca

SEQ ID NO: 65835 - RNA, 65 nt, hsa
agcagcgaggaauuaacccuguguccucagucgccagcacuuacagcuccaacuuuuuugaauga

SEQ ID NO: 65836 - RNA, 65 nt, hsa
uggcgauucagugucacaaaauaacuccagaaagaagcacuuagcgugcuguuccuguggaaaaa

SEQ ID NO: 65837 - RNA, 65 nt, hsa
aacauguuuuuaauuuucucaacaagcauuuagccagcacuuauccagugaaacaauuugauaag

SEQ ID NO: 65838 - RNA, 65 nt, hsa
uagcaggagacuugagaaguagagugacaaaaacaagcacuuaauuaaauuauaaaauuuaacuu

SEQ ID NO: 65839 - RNA, 65 nt, hsa
augaaguggucuuugaccacaguugauugaaccagagcacuuauugcuuaaagaauaacagaguu

SEQ ID NO: 65840 - RNA, 65 nt, hsa
uccugcauccaaggcagguguuguuaaucuaucauagcacuuaaaaaaaaaaaaaaaaagagacc

SEQ ID NO: 65841 - RNA, 65 nt, hsa
ugcugaucugcacaauuuaauuaugugguuauucgagcacuuaauuucacucaagguucauuggg

SEQ ID NO: 65842 - RNA, 65 nt, hsa
gcaggccaggcacgguggcucacgccuauaaucccagcacuuagggaggccaaggcgggcagauc

SEQ ID NO: 65843 - RNA, 65 nt, hsa
gcgaggcacaguucuauguuuuuuacauguaauaaagcacuuaaugcaagucuuugagauacguu

SEQ ID NO: 65844 - RNA, 65 nt, hsa
aaacugaagaaagaagauaauagaccagcaauugcagcacuuacaaucacuaauucccuuaaggu

SEQ ID NO: 65845 - RNA, 65 nt, hsa
gcaagcuugugggccaguguccuuguacaugcuguagcacuuaaaaaauaauuccaggguucccu

SEQ ID NO: 65846 - RNA, 65 nt, hsa
aguuucaggaguaaaucuaaauguggcuuuugucaagcacuuagauggauauaaaugcagcaacu

SEQ ID NO: 65847 - RNA, 65 nt, hsa
cacgguucuuaaggcacauccgggacgaucgauauagcacuuaggcuaugcaggggggucuuucu

SEQ ID NO: 65848 - RNA, 65 nt, hsa
cagaauaaaaacugacuagaaauaccgucaaaaccagcacuuaccaaacucagagcaucugagua

SEQ ID NO: 65849 - RNA, 65 nt, hsa
accccaucugcaccugaauccucuaacuucacgguagcacuuacagcugaagccaucagcaucug

SEQ ID NO: 65850 - RNA, 65 nt, hsa
gggcauccucccagggucuggcuggcugguagccaagcacuuauggaccagaguggcccaggcca

SEQ ID NO: 65851 - RNA, 65 nt, hsa
cucauguaucguaaguuaauacuaaaagaagagaaagcacuuaaguuucacagaagccguuaugu

SEQ ID NO: 65852 - RNA, 65 nt, hsa
gguagcuuuugugaaauagaaucagugaccaguauagcacuuagaucccuucuaacucauauaau

SEQ ID NO: 65853 - RNA, 65 nt, hsa
gcugcugcuccuauauuuuuuaagaaauauaauaaagcacuuagggcaggggaaaucaucucggu

SEQ ID NO: 65854 - RNA, 65 nt, hsa
auuucuaggauuaacugagagauuaaaggaacagcagcacuuaggcucaaaaucgccccuacaaa

SEQ ID NO: 65855 - RNA, 65 nt, hsa
cucuagcaaugacaaccugugaugucucacaguagagcacuuagcgcagaaucagguccccacgg

SEQ ID NO: 65856 - RNA, 65 nt, hsa
auugcuuugaggucuaaaugaguuaacauuuucaaagcacuuagaauagugucugagacacaaga

SEQ ID NO: 65857 - RNA, 65 nt, hsa
gcagcugcuacugcaacaaccgcuaacacuuguuaagcacuuacuacagacuagaaaguguucua

SEQ ID NO: 65858 - RNA, 65 nt, hsa
ugaauaaagcaacuuuuguagaugcuguuucauacagcacuuagaugaauuauugaucuuccuaa

SEQ ID NO: 65859 - RNA, 65 nt, hsa
aaagaaaacacaaagagaaaauaugaacaauauaaagcacuuaaaggaagaggaugauuucuucc

SEQ ID NO: 65860 - RNA, 65 nt, hsa
ugaggaaagcaugauauguauauugcugaguugaaagcacuuauuggaaaauauuaaaaggcuaa

SEQ ID NO: 65861 - RNA, 65 nt, hsa
agcgugagccucccagagccccaggacugggccagagcacuuagguuucuuuuuccaugguuucc

SEQ ID NO: 65862 - RNA, 65 nt, hsa
ucccgggaaagcugccccacagccucagcaucuucagcacuuaccgauccagagccucccggccu

SEQ ID NO: 65863 - RNA, 65 nt, hsa
guauuuauguuucuuuuuagauguguaccuucccaagcacuuauuuaugcagugaccuggucacc

SEQ ID NO: 65864 - RNA, 65 nt, hsa
guauauuuuucuaugagaagcacuucauagggagaagcacuuaugacaaggcuauuuuuuaaacc

SEQ ID NO: 65865 - RNA, 65 nt, hsa
gcuuaaugggagcuuugccugggaccugaaccuggagcacuuaccgcauuaggaagaaaggagcu

SEQ ID NO: 65866 - RNA, 65 nt, hsa
caugugggcagcaugcccagguuccuugcugacucagcacuuauuucuguaguuuuaaaaaagaa

SEQ ID NO: 65867 - RNA, 65 nt, hsa
aucaugcaauugcauauuauguuuauacucacuucagcacuuaucagagauaauugcaguuucac

SEQ ID NO: 65868 - RNA, 65 nt, hsa
uccaccucuugcaccaaaucaauaucuauuuguugagcacuuauugauuaagaccuugcauaugu

SEQ ID NO: 65869 - RNA, 65 nt, hsa
uuuauauaacucacugggacauugccaaaugaguaagcacuuaauucgcugcuucugagacuucu

SEQ ID NO: 65870 - RNA, 65 nt, hsa
aauaaugauaguagguauguauuauggauuggagaagcacuuauuacacuaucuaaccuaauaug

SEQ ID NO: 65871 - RNA, 65 nt, hsa
uugcagauaugauggaaugcaucccaccuugccaaagcacuuacaccaguuugacugugcuagcu

SEQ ID NO: 65872 - RNA, 65 nt, hsa
aacagagggcuagagaaagcaucuucugcagaggaagcacuuaugggaacagucugugagauuga

SEQ ID NO: 65873 - RNA, 65 nt, hsa
uccugcuccuuuccaccagugauuuguauuaagacagcacuuauauuguacaauacuucagacug

SEQ ID NO: 65874 - RNA, 65 nt, hsa
guuuuuaaccugaucuguagagcagagagguugaaagcacuuaacucuuguuuaguauccucauu

SEQ ID NO: 65875 - RNA, 65 nt, hsa
gaagugugguucagggccagugcauauuaguggacagcacuuaguagcugugaaggaaggugcag

SEQ ID NO: 65876 - RNA, 65 nt, hsa
aauacaguaguaauuaagguacaucucuaaaguggagcacuuacaccaggcucuaagauucacuu

SEQ ID NO: 65877 - RNA, 65 nt, hsa
cguaaugagggaaguccuaggauggauagaaaaaaagcacuuacauuggggcacacaggaaaucc

SEQ ID NO: 65878 - RNA, 65 nt, hsa
agguuaggaguagauauugauuacuaucauaauucagcacuuaacuaugagccaggcaucauacu

SEQ ID NO: 65879 - RNA, 65 nt, hsa
auuugcucaauaacucuacucauuuguaucuuuucagcacuuaauuuuaauguaagaaaguuguu

SEQ ID NO: 65880 - RNA, 65 nt, hsa
ccaggauggugguuagcaacaguggcccgugccaaagcacuuaccaaagugaugaugacuaaggu

SEQ ID NO: 65881 - RNA, 65 nt, hsa
acuaaauuuggcuuuagugugacgggauuugauuaagcacuuaguauagucuuuugaacacggaa

SEQ ID NO: 65882 - RNA, 65 nt, hsa
uuucacccaaacugauaacauuuaucucauuuucuagcacuuaaaauacaaagucuauauuauug

SEQ ID NO: 65883 - RNA, 65 nt, hsa
accagaaaacaauuguggggaucaaggacagacauagcacuuagacaggacuuucaugacccaau

SEQ ID NO: 65884 - RNA, 65 nt, hsa
guguuuaucugugucaaguauuucugguaauaagaagcacuuaauuuacacauauuuuaauccug

SEQ ID NO: 65885 - RNA, 65 nt, hsa
uugcuuaugguaauaaaaauggcucauacuuauauagcacuuacuuuguugcaaguacugcugua

SEQ ID NO: 65886 - RNA, 65 nt, hsa
ccggagccuuguuuuucuaaaggggggcgcugucuagcacuuaacuaggguaagcauucuuaaca

SEQ ID NO: 65887 - RNA, 65 nt, hsa
augguaguacuggaaauuuuacaagacuuuuaccuagcacuuaaauauguauaaauguacauaaa

SEQ ID NO: 65888 - RNA, 65 nt, hsa
ucagccaguaaucaaaacagacugggaaugaauaaagcacuuacagaagaguauccuaaugaaaa

SEQ ID NO: 65889 - RNA, 65 nt, hsa
augacauaaaagguuaaagaacaggcaacacaaugagcacuuaaguuuuuaacauguggggaaua

SEQ ID NO: 65890 - RNA, 65 nt, hsa
agacucaguucagcaacuguuuauucuguuuauugagcacuuacuuggaccaagcacuguggucu

SEQ ID NO: 65891 - RNA, 65 nt, hsa
agugcagguaguguuuaguuaucuacugcauuaugagcacuuaaaguacugcuagcuguagaacu

SEQ ID NO: 65892 - RNA, 65 nt, hsa
acaacuuucuauuuuuagccuauauuuggaaagaaagcacuuaacauuuuaggaauucuuuuuaa

SEQ ID NO: 65893 - RNA, 65 nt, hsa
acacggguuguaaggacaaaggauuuuaaaaucugagcacuuaggugaagggacaagcagguuua

SEQ ID NO: 65894 - RNA, 65 nt, hsa
aaaaaagucuaccaaaggaauuugcauccagcagcagcacuuagaccugccagccacugucaccg

SEQ ID NO: 65895 - RNA, 65 nt, hsa
gucgcauuuguuauaaauguaguaaggcagguccaagcacuuacaaguuuuuuguaguuguuacc

SEQ ID NO: 65896 - RNA, 65 nt, hsa
gcugcuguuauuuucuacauuuguauuuuauccauagcacuuauucacauuuaggaaaagacaua

SEQ ID NO: 65897 - RNA, 65 nt, hsa
acaauauuuuugaaaauuuaguacaguuuagaaagagcacuuauuuuguuuauauccauuuuuuc

SEQ ID NO: 65898 - RNA, 65 nt, hsa
ugccaucugaaggggauucugaucuguucuuauguagcacuuaacacuguguagaaacuauuuuu

SEQ ID NO: 65899 - RNA, 65 nt, hsa
cuuaaaacauuuuacuuggcuuauucaauuucuaaagcacuuacguugugccagguuccacucaa

SEQ ID NO: 65900 - RNA, 65 nt, hsa
aaaaucagugggaauuaagaaagccucgucgugaaagcacuuaauuuuuuacaguuagcacuuca

SEQ ID NO: 65901 - RNA, 65 nt, hsa
ugcuuucaucuauguuuaucacauuuuaauaccacagcacuuauaaugaugucacuacauauaga

SEQ ID NO: 65902 - RNA, 65 nt, hsa
uuauuaaguacuuacuacaugcuaagagcuuuuuaagcacuuauuuaauccucauuaacaaauuc

SEQ ID NO: 65903 - RNA, 65 nt, hsa
ccgauuuuuagcauuaaaaacuaaggaauauacuuagcacuuacuuaaucuuuucaguuuuccag

SEQ ID NO: 65904 - RNA, 65 nt, hsa
uaaaauucccugggcacagguugcaccugggugugagcacuuaaucacucaacgcuuuguuuucu

SEQ ID NO: 65905 - RNA, 65 nt, hsa
uuugcuuauucauugaauauuuuucuguaauuuucagcacuuauguauacacuuuuucuguacuu

SEQ ID NO: 65906 - RNA, 65 nt, hsa
uauaaaaaagaauuuuuaaugcuaaugagagguuuagcacuuaagaucagauucaagagaauaua

SEQ ID NO: 65907 - RNA, 65 nt, hsa
cugcauuugccaacaccuuuuuaaggggaggagagagcacuuaguuucugaacuagucuggggac

SEQ ID NO: 65908 - RNA, 65 nt, hsa
agcucuaaccguaacacgucccacccccuuuuuaaagcacuuacuguuuucagagcacccauauc

SEQ ID NO: 65909 - RNA, 65 nt, hsa
gaaugcuuuucucuccuuauguguggaaggaggggagcacuuagacauuugcuaacucccagaau

SEQ ID NO: 65910 - RNA, 65 nt, hsa
uuuguauuuuuacaaacacauaaacacacagccguagcacuuagaagaaaagaggcuuucuaagc

SEQ ID NO: 65911 - RNA, 65 nt, hsa
ggggagggaagcggguguuggcuguuuccaaagagagcacuuaauuuaauuuuuccuuuaaauga

SEQ ID NO: 65912 - RNA, 65 nt, hsa
uaauauuuaguuuugcuuucucguggauaauauuaagcacuuacucugcaguuuccuggaaguug

SEQ ID NO: 65913 - RNA, 65 nt, hsa
gauaaugguaaguaguugcuacuggccaacugucuagcacuuaccugaaaacuuaguauggagcu

SEQ ID NO: 65914 - RNA, 65 nt, hsa
uagaacagugcuugccacagagcggggacucgguaagcacuuaaugaaugaaugaauucuaaguc

SEQ ID NO: 65915 - RNA, 65 nt, hsa
caugucuauugcaaacaauucucucaguuacguucagcacuuaagaacggcuaauggcaauagga

SEQ ID NO: 65916 - RNA, 65 nt, hsa
acaucaaugccaacaagagcaucugccgguuacugagcacuuacuaagugccaagcauuauuuua

SEQ ID NO: 65917 - RNA, 65 nt, hsa
caguauuugacuguaauaguauaguaguuaaauacagcacuuaaaaauaccacagacacaguuaa

SEQ ID NO: 65918 - RNA, 65 nt, hsa
uuucaguggguuaucucuaggaugaucaguaguucagcacuuaaaaacugcagagaaaacugaaa

SEQ ID NO: 65919 - RNA, 65 nt, hsa
cugcagggguuucccuggcgcagcgaaagucucugagcacuuaccgggcgugaccguuucuuagg

SEQ ID NO: 65920 - RNA, 65 nt, hsa
uccguuuacacagacaaagugacaucagaaggcugagcacuuaucuggaucauuuggucaguuug

SEQ ID NO: 65921 - RNA, 65 nt, hsa
uccugggaaucuaucccuaaggaauaaaaagcgccagcacuuaagauuauauguuuacuaaugua

SEQ ID NO: 65922 - RNA, 65 nt, hsa
ccuuccucuuuuuggguuuucuucuuucuccuuuaagcacuuacaugguuggggguaagacuagg

SEQ ID NO: 65923 - RNA, 65 nt, hsa
uaaaaaaaaaaaaaaaaaaaaacacaaaacccacaagcacuuaucuuggcuacuaaugaagcucu

SEQ ID NO: 65924 - RNA, 60 nt, hsa; identical to SEQ ID NO: 65087

SEQ ID NO: 65925 - RNA, 65 nt, hsa
ggccuaguguucccagcacugugccugcucucaagagcacuuacugccucgcaaauaauaaaaau

SEQ ID NO: 65926 - RNA, 65 nt, hsa
cuuccagaaccuaggaggaugccuaacagagaguaagcacuuaaaaaauauuugucauaugaaug

SEQ ID NO: 65927 - RNA, 65 nt, hsa
agggagauuuaucuugaagcugaauuugcaaagcaagcacuuauaaaaauuagauuguguguuac

SEQ ID NO: 65928 - RNA, 65 nt, hsa
ccaacauuuguuaauaguuacgucucuccugauguagcacuuaagcuucauuuaguuauuauuuc

SEQ ID NO: 65929 - RNA, 65 nt, hsa
ggucgaccucaucaucugggagaucgaggugccaaagcacuuagucggucggcuaauuggcaagc

SEQ ID NO: 65930 - RNA, 65 nt, hsa
gcaguucaugucucguccauguccauguucguguuagcacuuacgugggaacaaauaccaauuug

SEQ ID NO: 65931 - RNA, 51 nt, hsa; identical to SEQ ID NO: 65094

SEQ ID NO: 65932 - RNA, 65 nt, hsa
aauuuuaugcucuuucuggcaaauaagauucuaaaagcacuuauaucccugugaauacuucagag

SEQ ID NO: 65933 - RNA, 65 nt, hsa
ucuuucuccuuagguccucacacaauuccuuacagagcacuuauuaaaaaaaaaucuuaagaguu

SEQ ID NO: 65934 - RNA, 65 nt, hsa
cuuucaguuccauucaugaacgaauuauuucuucaagcacuuauggacaacgaacaaauucuuca

SEQ ID NO: 65935 - RNA, 65 nt, hsa
gaccgacguccuuuagcccucccaggccccacggcagcacuuaugguagcggcacugucuuggcu

SEQ ID NO: 65936 - RNA, 65 nt, hsa
caauaccccaagaccccagagggcaguccuuaggaagcacuuacaccaccugggaaccccuccgu

SEQ ID NO: 65937 - RNA, 65 nt, hsa
caccauacaagcaucagaagagcucucuuguuguuagcacuuauuguuugcaagaacagaauaca

SEQ ID NO: 65938 - RNA, 65 nt, hsa
cccugccuuggcaccgucacagaugccaagcaggcagcacuuagggaucucccagcuggguuagg

SEQ ID NO: 65939 - RNA, 65 nt, hsa
gcauuucuuggccaaaguggcuuccucaagaaagcagcacuuaccuuugaaaaaugcugggaaca

SEQ ID NO: 65940 - RNA, 65 nt, hsa
cagccaagggccauuucuucucagcuugguggagcagcacuuacuuacuacuggaaaugaaaaaa

SEQ ID NO: 65941 - RNA, 65 nt, hsa
uauugcaggaauauaaauaauaaaagacuguuauuagcacuuaguaagucuucaucuaugcaugu

SEQ ID NO: 65942 - RNA, 65 nt, hsa
agcuuuugaugccaggugcaaucuacuggaaauguagcacuuacguaaaacauuuguuuccccca

SEQ ID NO: 65943 - RNA, 65 nt, hsa
aacuccaauucaggagcccuugcgaguauaucugaagcacuuauuugcuaaggaaaccugaauug

SEQ ID NO: 65944 - RNA, 65 nt, hsa
ccugcagcaauuccuccauuuuuaugaaucuugugagcacuuacgcuaggagaaauuucuuuuac

SEQ ID NO: 65945 - RNA, 65 nt, hsa
accuccuuugcaggagggcugggaauccucuuuagagcacuuaauccuauuuauccccuggaaug

SEQ ID NO: 65946 - RNA, 65 nt, hsa
aaaauaugauauauucaaaugauagaauaguauacagcacuuaaaagcagugaaccagauccaua

SEQ ID NO: 65947 - RNA, 65 nt, hsa
gagggcuuuucugaggauuaaauaaauaaaugugaagcacuuagaacugauggccagcacaugag

SEQ ID NO: 65948 - RNA, 65 nt, hsa
caauuccaaacauacaagaggcucccucuuaacgcagcacuuagacacguguuguuccaccuucc

SEQ ID NO: 65949 - RNA, 65 nt, hsa
caauuccaaacauacaagaggcugccucuuaacacagcacuuagacacgugcuguuccaccuccc

SEQ ID NO: 65950 - RNA, 65 nt, hsa
aggggccgggcacggugccucacaccuguaaucccagcacuuagguaggccaagguggguggauc

SEQ ID NO: 65951 - RNA, 65 nt, hsa
guuauuuauguagagcauguaggaaaaccugguauagcacuuauuuuguaccuaaaaauucagag

SEQ ID NO: 65952 - RNA, 65 nt, hsa
ugaggcugggcacaguggcucacgccuguaaucccagcacuuagggugggcaaauugcuugaccu

SEQ ID NO: 65953 - RNA, 65 nt, hsa
cuccaggacugguuuccuagccucccgcuaagacuagcacuuagcucuucuuggaaaaggaccca

SEQ ID NO: 65954 - RNA, 65 nt, hsa
uucuuuuaaacucaauauaauguuaauauuacuguagcacuuacuagcauuucugaagguugguc

SEQ ID NO: 65955 - RNA, 65 nt, hsa
augauuguggauccccugagaucuggcuucccaagagcacuuauugacccuuccucaggccuccc

SEQ ID NO: 65956 - RNA, 65 nt, hsa
agacucaagcacauugguauuguauaaagguauagagcacuuagcuuacaaucuuuaaagguuuc

SEQ ID NO: 65957 - RNA, 65 nt, hsa
uaaagacauggcuggaugcgcugcugaccaacaucagcacuuaaauaaaugcaaaugcaacauuu

SEQ ID NO: 65958 - RNA, 65 nt, hsa
gaacguuuauagccuugccuguaaaaaugugccccagcacuuaaugagugaccguuugaauccau

SEQ ID NO: 65959 - RNA, 65 nt, hsa
gggcuccugccguccugacgccaccccgccccaucagcacuuaagccacaugacacaaagucugu

SEQ ID NO: 65960 - RNA, 65 nt, hsa
cagccuagguguuucacugguccucuaugaaucccagcacuuauaaucccagucuuuuaucacuc

SEQ ID NO: 65961 - RNA, 65 nt, hsa
agcuaggaagcaaccuuucgccugugcagcgguccagcacuuaacucuaauacaucagcaugcgu

SEQ ID NO: 65962 - RNA, 65 nt, hsa
ugaggauuaagugaaccaauacauauacagugcuuagcacuuaauaaguauuccccccugcgaca

SEQ ID NO: 65963 - RNA, 65 nt, hsa
aagggaaaacagacucccuucgggaaacauccuuaagcacuuaaggccggggggggugucugccu

SEQ ID NO: 65964 - RNA, 65 nt, hsa
ugccagccuagcuuuuuuuuuuuuuuuuuuuuuuuagcacuuaguauuuagcauuuauuaacagg

SEQ ID NO: 65965 - RNA, 65 nt, hsa
cagagcuggaaccaagaucuagauaguccguagauagcacuuaggacaagaaugugcauugaugg

SEQ ID NO: 65966 - RNA, 65 nt, hsa
augaagucguuccaucauaaucuaugaucuuguacagcacuuauagaaauaagcuguucuuuuga

SEQ ID NO: 65967 - RNA, 65 nt, hsa
ucuuuguuaguuauagggauggacaguuuauguuaagcacuuagcuuaaacaauccguuuauauu

SEQ ID NO: 65968 - RNA, 65 nt, hsa
aucugguuacacauauggaaguaagcaaaaugaaaagcacuuauugcuuucugacagaauuauag

SEQ ID NO: 65969 - RNA, 65 nt, hsa
ccccagcccauaauugggacccagagcccuuucccagcacuuaaaacaggagccuagagcccccu

SEQ ID NO: 65970 - RNA, 65 nt, hsa
cagucuuccuucuguagagggcuguuuacauauacagcacuuaaaauguuugugugggaaaaaaa

SEQ ID NO: 65971 - RNA, 65 nt, hsa
aggcuuggagaaauggcuaggacagggaacagggaagcacuuacaauuauuccuugauuuauuca

SEQ ID NO: 65972 - RNA, 65 nt, hsa
gguguuacuguaauuccucaacguauuguuucggcagcacuuauuuaaugccgauauacucuaga

SEQ ID NO: 65973 - RNA, 62 nt, hsa
auaguuaauacagguauaucuauuuuuauuuacuuuguaagaaacaagcucaaggagcuucc

SEQ ID NO: 65974 - RNA, 62 nt, hsa
guuaauaauaaaugcuguaaauaagcaucucacuuuguaaaaauaaaauauugugguuuugu

SEQ ID NO: 65975 - RNA, 62 nt, hsa
gcccugccccuggcuccuuaaaugccccgucucuuuguaaacugauauucagccagcaaugc

SEQ ID NO: 65976 - RNA, 62 nt, hsa
ccggccgccuucuccccucucccagggaugcucuuuguaaauaucggaugggugugggagug

SEQ ID NO: 65977 - RNA, 62 nt, hsa
gggucccuuuucaucccuucucugacagauugcuuuguaaacuuucuuaggccuucccccca

SEQ ID NO: 65978 - RNA, 62 nt, hsa
aggucaauuauacuuuuguuguucauuagcaucuuuguaaacuauaagacguaguuuuaauu

SEQ ID NO: 65979 - RNA, 62 nt, hsa
agguuugcaugcugguaaugcaaccuuugaaacuuuguaaaggaaacauauauguauauauu

SEQ ID NO: 65980 - RNA, 62 nt, hsa
aauguauuauuuuggugacaaaaaugaaggagcuuuguaaauuuuuuuuaaaauuaugaauc

SEQ ID NO: 65981 - RNA, 62 nt, hsa
guggggaggcauaagcugauguuuguaaagcgcuuuguaaauaaacgugcucucugaaugcc

SEQ ID NO: 65982 - RNA, 62 nt, hsa
uuuugagauacuauuuucauuuuugugagccucuuuguaauaaaaugguacauuucuauauc

SEQ ID NO: 65983 - RNA, 62 nt, hsa
ccacccacaaugcaugagagugccuauuaaaucuuuguaaguguuaucaaauguuuugaucu

SEQ ID NO: 65984 - RNA, 62 nt, hsa
uccucuggcagccaauaaaaucaucauaagcccuuuguaauaaaaagcuaguuuccugagug

SEQ ID NO: 65985 - RNA, 62 nt, hsa
guauauucuauacaaagguacuuguccuuucccuuuguaaacuacauuugacauggauuaaa

SEQ ID NO: 65986 - RNA, 62 nt, hsa
gcauuauagaggaauguaguaugucauaaguacuuuguaaagauuugacauucaacuguagu

SEQ ID NO: 65987 - RNA, 62 nt, hsa
uaauuucucauauggugcuggaaaugguugggcuuuguaacauuugaaguguuuccauggua

SEQ ID NO: 65988 - RNA, 62 nt, hsa
guaaagugcaauuucauuggauagcuaaauaucuuuguaagauagagauuguugaaaauucu

SEQ ID NO: 65989 - RNA, 62 nt, hsa
uggcauguugauuucuauggccaacuuucucucuuuguaaaacaaagauugauugauuuucu

SEQ ID NO: 65990 - RNA, 62 nt, hsa
uuaauacagcagagcauggcaugaccaagcaucuuuguaaaguguuagauggaaaaugcugu

SEQ ID NO: 65991 - RNA, 62 nt, hsa
auaaugacauaauuuaguuucauguaaugaaacuuuguaaacagaauacauacauguguaua

SEQ ID NO: 65992 - RNA, 62 nt, hsa
uuuacuguuaugagguagaauaaaaaagaauacuuuguaauagccacaaguucuuguuuaga

SEQ ID NO: 65993 - RNA, 62 nt, hsa
uguguccaguuauauuauuuaaaaaaguguuacuuuguaaaaauuguauauaaagaacugua

SEQ ID NO: 65994 - RNA, 62 nt, hsa
gaugaacacauuaauccguuaaguaaaauggacuuuguaauuguacagcauaccuaagaaac

SEQ ID NO: 65995 - RNA, 62 nt, hsa
caucuaaaguguauuaacagugcaugcuuuuacuuuguaaauguggugccaaaucccuguuu

SEQ ID NO: 65996 - RNA, 62 nt, hsa
ugacuucugguuuccacuguaucaguauguaccuuuguaauuguuauuuuuaugucuuuuau

SEQ ID NO: 65997 - RNA, 62 nt, hsa
ggcucugugucagggaaaaccuucuggguggacuuuguaagaauccaguuuccaagguuaga

SEQ ID NO: 65998 - RNA, 62 nt, hsa
gauucucauagacaacuggguaacuuauauuucuuuguaaucaagacuugagauaucgaagu

SEQ ID NO: 65999 - RNA, 62 nt, hsa
acaagccuuggaaauaaaucucuauuaaaccgcuuuguaaccaagcucugguacccucuguc

SEQ ID NO: 66000 - RNA, 62 nt, hsa
acacaucgugaugaugacguccucucaacucucuuuguaaaaauuuuguuauuuuugcuugu

SEQ ID NO: 66001 - RNA, 62 nt, hsa
caauuuugugcuaaugagcauugagacugaugcuuuguaagucacaccacaacaaauauuga

SEQ ID NO: 66002 - RNA, 62 nt, hsa
uauuuuauuuuucuauaaugaucauauauuaccuuuguaauaaaacauuauaaccaaaacau

SEQ ID NO: 66003 - RNA, 62 nt, hsa
agccucucgagggugaggccuagccuucuugucuuuguaacccacagcagcugguacugugc

SEQ ID NO: 66004 - RNA, 62 nt, hsa
aggguuuucaauaggguguagaccuccaguaccuuuguaacuaaagucugucuagucauugu

SEQ ID NO: 66005 - RNA, 62 nt, hsa
aauuuuaucucuuauucaguaaaaaacaacuucuuuguaaucguuauguguguauauguaug

SEQ ID NO: 66006 - RNA, 62 nt, hsa
auguguagccucuccuggucauagaccagucucuuuguaaguuauuguggcaguucacacag

SEQ ID NO: 66007 - RNA, 62 nt, hsa
gagaaauauaguucacaaugaaauuauauuuucuuuguaaagaaaguggcuugaaaucuuuu

SEQ ID NO: 66008 - RNA, 62 nt, hsa
gugaucuugaaccauuguuuuauauuuuucaccuuuguaaccucauggaaagaggcuuuaca

SEQ ID NO: 66009 - RNA, 62 nt, hsa
aaaguugaaggccuuauucuacauuucaccuacuuuguaagugagagagacaagaagcaaau

SEQ ID NO: 66010 - RNA, 62 nt, hsa
acucagcuacacucucugauuuugugcuacuccuuuguaaagucacugccuuaagggggcug

SEQ ID NO: 66011 - RNA, 62 nt, hsa
ugaauuuuugcugguuaaccuuuaucauuuaucuuuguaaugugaacaugcuucagagugua

SEQ ID NO: 66012 - RNA, 62 nt, hsa
aaaaaaaaaaucacuuggcgcaggagggagaacuuuguaagaagcugcccucuguuuuuuuu

SEQ ID NO: 66013 - RNA, 62 nt, hsa
ccuaaaccaggaagcugcguuagccgaucaggcuuuguaagaucucgccaacagcuagcugc

SEQ ID NO: 66014 - RNA, 62 nt, hsa
uuguuuccuucucccuuccccuuuucccuguacuuuguaaugucaguguuuauaugaauaug

SEQ ID NO: 66015 - RNA, 62 nt, hsa
aaaaaaggaaucaaauccacgaguggaaaagccuuuguaaauuuaauuuuauuacacauaac

SEQ ID NO: 66016 - RNA, 62 nt, hsa
cgggcucaucuguaccaaggacauagaacauucuuuguaacccgaauguucccuggauguug

SEQ ID NO: 66017 - RNA, 62 nt, hsa
cuuagccuaaagaaugaucuguuguuugaaaccuuuguaacuuguuuguaugaguaaagaaa

SEQ ID NO: 66018 - RNA, 62 nt, hsa
caagccugguaggaaagggcaagucuuuaggucuuuguaagaacuaaagaagaucuguaauu

SEQ ID NO: 66019 - RNA, 62 nt, hsa
accacuaucuugcacugcuaacuuuuuucuaccuuuguaaauagaaacauuucugcauaaaa

SEQ ID NO: 66020 - RNA, 62 nt, hsa
uauuuauguucacacaggaauuugguuuacugcuuuguaaauaaaaggaaaaacuccgggua

SEQ ID NO: 66021 - RNA, 62 nt, hsa
aagcugauuacugucaauaaacagcuucaugccuuuguaaguuauuucuuguuuguuuguuu

SEQ ID NO: 66022 - RNA, 62 nt, hsa
aauuuuuggaauuugggaagcagacagcuuuacuuuguaagguuggaacagcagcacuauac

SEQ ID NO: 66023 - RNA, 62 nt, hsa
augcaugucuuuuaaaaugcaauguaagcauacuuuguaaauaggauuuuuagaauuaaaaa

SEQ ID NO: 66024 - RNA, 62 nt, hsa
gaauaauguaagguaaagaguugcaugucagucuuuguaauuauuuacacuuuaacuuucuc

SEQ ID NO: 66025 - RNA, 62 nt, hsa
auguuuaaucaauugcaagcaaauagauuuuucuuuguaacaauuuguucugcagaaggcug

SEQ ID NO: 66026 - RNA, 62 nt, hsa
cuccugcauuuguugauaccacuaacaaaaugcuuuguaacagacuugcgguuaauuaugca

SEQ ID NO: 66027 - RNA, 62 nt, hsa
uaugaauuggaagugauguuggcuuuaguuaucuuuguaaauaagguaauuagaaugguaug

SEQ ID NO: 66028 - RNA, 62 nt, hsa
gguuuugaucucuggguaaagaggccguuuaucuuuguaaacacgaaacauuuuugcuuucu

SEQ ID NO: 66029 - RNA, 62 nt, hsa
auucucagauagauguuacagggcuucuuauucuuuguaauguacucuuuuuaaaucccuuu

SEQ ID NO: 66030 - RNA, 62 nt, hsa
cuuuuaaaacguauguuuguaugguagagaaacuuuguaaaagaagaauccaagagaaguuu

SEQ ID NO: 66031 - RNA, 62 nt, hsa
gagaugccuuugacauuuugggcugaaguguucuuuguaaggaaaaccuguuuccuauuuug

SEQ ID NO: 66032 - RNA, 62 nt, hsa
uuccccuuuaaaaggaauuagcuauagaacugcuuuguaaagaugcuucuugauauuuuacu

SEQ ID NO: 66033 - RNA, 62 nt, hsa
ccaaccagcccaaaauuauuucaucuuguauucuuuguaaaauucucccucaccccacccug

SEQ ID NO: 66034 - RNA, 62 nt, hsa
cccucccugccucccccagcucccacacuggccuuuguaaauaaauggcguggucuuuguug

SEQ ID NO: 66035 - RNA, 62 nt, hsa
uauaggaagaagcaaagucuacagcacauagucuuuguaagggauugaugugaacacuuuuu

SEQ ID NO: 66036 - RNA, 62 nt, hsa
uuccaugaaucauuguggugguugagauggagcuuuguaaugggaauaaaacaguaccuuag

SEQ ID NO: 66037 - RNA, 62 nt, hsa
ggucacuauauaaagcaaauaaacuuaaaacacuuuguaaccauguauuuacucugccaggu

SEQ ID NO: 66038 - RNA, 62 nt, hsa
uuagcaaccugucuuggcccuaaugagaaacccuuuguaagugggcucuggauuuuugguuu

SEQ ID NO: 66039 - RNA, 62 nt, hsa
auagcuagagaaacaauauuacugccuuugcucuuuguaacuaugucuguuuucuuuuuugu

SEQ ID NO: 66040 - RNA, 62 nt, hsa
ggguugugcauccccaauccagauaauaaagacuuuguaaaacaugaauaaaacacauuuua

SEQ ID NO: 66041 - RNA, 62 nt, hsa
cggcugagcuccagccaccccgcagucacuuucuuuguaacaacuuccguugcugccaucgu

SEQ ID NO: 66042 - RNA, 62 nt, hsa
uggcuaauuuucaguugcuaauuaauuagcagcuuuguaauacuugauuugggagcauuuac

SEQ ID NO: 66043 - RNA, 62 nt, hsa
guucuguuuggcacuuguauuuaauucuucaccuuuguaagacauuuguauauuguggaugu

SEQ ID NO: 66044 - RNA, 62 nt, hsa
gucgggagauugaaagauguuuuuguuucuuucuuuguaaaggccuuggauauugaaaaaau

SEQ ID NO: 66045 - RNA, 62 nt, hsa
gggaaagaggucaacugagauuuggaaaucaucuuuguaauauuugcaaauuauacuuguuc

SEQ ID NO: 66046 - RNA, 62 nt, hsa
cagaaaaccacaguguguuuucauauuuggaacuuuguaauagcgggaguagcaguagucca

SEQ ID NO: 66047 - RNA, 62 nt, hsa
aguguauuucuuucuugaauuucagucugcugcuuuguaaaaaauaacuguaauugauauuu

SEQ ID NO: 66048 - RNA, 62 nt, hsa
cagaccagaauuuucuuugucccaugaggugucuuuguaagucagcaugcucuugcuugaac

SEQ ID NO: 66049 - RNA, 62 nt, hsa
uuuuccugaaauacauuugcaaaauaaggcugcuuuguaaucaaggaauauuuuuauugauu

SEQ ID NO: 66050 - RNA, 58 nt, hsa
uuggagauaccacuguuuaaggaaauaccuuuguaaaccugcagaacauuuuacuuaa

SEQ ID NO: 66051 - RNA, 62 nt, hsa
uccauuuguacaugguuuacauguuguggaugcuuuguaaacauuuuccuguauguuuaaau

SEQ ID NO: 66052 - RNA, 62 nt, hsa
ucuggguuaaguguuuaucauauauauggguacuuuguaauaucuaaaaacuuagaaacgga

SEQ ID NO: 66053 - RNA, 62 nt, hsa
acauuguuaccaaccauuaauuggcucaggaccuuuguaauuuuuauuuaacuauaugaguu

SEQ ID NO: 66054 - RNA, 62 nt, hsa
aaacuucagugucccaccuugaccaaaaucagcuuuguaacuguuuucaaggaggugcuuag

SEQ ID NO: 66055 - RNA, 62 nt, hsa
aaacaagaagaccucaugagagagguaaacaccuuuguaaagaaucuguaaccaauaccaug

SEQ ID NO: 66056 - RNA, 62 nt, hsa
acacagcuuuugcauacuuacaguuucuguuccuuuguaauaacuuuaacuugcaccuuuga

SEQ ID NO: 66057 - RNA, 62 nt, hsa
caaaccauaccacacacauuaucauuguuaaacuuuguaaaguauuuaagguacauggaaca

SEQ ID NO: 66058 - RNA, 62 nt, hsa
ucuaaauuucuguaguagagagagccguagcccuuuguaaaggcuuucguucguccaaacaa

SEQ ID NO: 66059 - RNA, 62 nt, hsa
gagcugugagauggauuuauuuuuaaaugcuacuuuguaaaggugaccuuuaaaaaauaaaa

SEQ ID NO: 66060 - RNA, 62 nt, hsa
aucuuuacaccuccugugugguuacaaguuaacuuuguaaguagcguaccuuccuuccuuaa

SEQ ID NO: 66061 - RNA, 62 nt, hsa
uagaacaaauaagguauauuuuuuagaaucaacuuuguaagcacuauaaaaucuuuaauaag

SEQ ID NO: 66062 - RNA, 62 nt, hsa
caagcucgaauuauuccucauuguauagccugcuuuguaaacuaguuuacaauuugcaggcu

SEQ ID NO: 66063 - RNA, 62 nt, hsa
ccucuuccuccuccacuucccacuuauugucacuuuguaauauucagagagcacuuggauua

SEQ ID NO: 66064 - RNA, 62 nt, hsa
cuauaauagaaaauagcagacaacauaaacaucuuuguaaauaucaaaccuaauacauuucu

SEQ ID NO: 66065 - RNA, 62 nt, hsa
auaucaaaaggaagauucuuccauuaaauugccuuuguaauaugagaauguauuaguacaaa

SEQ ID NO: 66066 - RNA, 62 nt, hsa
augccuaauacucacacgcaacauuucuuguacuuuguaagucguuugcgagaaugcagacc

SEQ ID NO: 66067 - RNA, 62 nt, hsa
uuaacuuauugcuuuguaucuugggaaaaaaacuuuguaaauaaguuauaaaguuucuuuga

SEQ ID NO: 66068 - RNA, 62 nt, hsa
cacacuagcauagagaauguguugaaauuuaacuuuguaagcuuguaugugguuguugaucu

SEQ ID NO: 66069 - RNA, 62 nt, hsa
ggcgccuccucucuacuuucauggacuuguuccuuuguaauagugcaauuugguuuuguuuu

SEQ ID NO: 66070 - RNA, 62 nt, hsa
ucacuagauuucuacguagugaucugcuuuuacuuuguaauuuguaguucucaaaagacuuu

SEQ ID NO: 66071 - RNA, 62 nt, hsa
ucuauguugaauccuuuuauaaaccaguaucacuuuguaauauaaacaccuauuuguacuua

SEQ ID NO: 66072 - RNA, 62 nt, hsa
accagccagaccucaggucuucacucuuucuucuuuguaaacuaugucauguggaaagauuu

SEQ ID NO: 66073 - RNA, 62 nt, hsa
gauuuauuccuuuguuacuucucuaauucuuccuuuguaaaaaaaaaaaaaagcaacacuuu

SEQ ID NO: 66074 - RNA, 62 nt, hsa
uuaaauucaggcuacugcuucaaucucaauugcuuuguaagugaaaaacaugacccagagga

SEQ ID NO: 66075 - RNA, 62 nt, hsa
ccauuaaaaguuggggcuccuacucuccuuugcuuuguaaauucaaaaguugggggugggua

SEQ ID NO: 66076 - RNA, 62 nt, hsa
uuguaccggcacgggauauggaacgaaaacugcuuuguaaugcaguuugugacauuaauagu

SEQ ID NO: 66077 - RNA, 62 nt, hsa
uuuggaucucauuguugauauaccugaauuuacuuuguaagagauuuuaacuucacuucaug

SEQ ID NO: 66078 - RNA, 62 nt, hsa
uagaggauagccuugaggcuagauuaucuuuccuuuguaagauuauuugaucagaauauuuu

SEQ ID NO: 66079 - RNA, 62 nt, hsa
agaagcauggcucaccagccagccucuguggucuuuguaauuagaagcuucagaacucacua

SEQ ID NO: 66080 - RNA, 62 nt, hsa
uaaaaguacauuuuauaaaccauuuacuauggcuuuguaacaauugcauacccauauuuuaa

SEQ ID NO: 66081 - RNA, 62 nt, hsa
auguaacuuaauuacugcuaguuuugaaaugucuuuguaagaguagggucgccaugaugcag

SEQ ID NO: 66082 - RNA, 62 nt, hsa
ggagcuuuguauucugugacugcuauggcuagcuuuguaaccaaagcaaaaugagaauuuca

SEQ ID NO: 66083 - RNA, 62 nt, hsa
guacaaaagcugcaguaaccugucuucaguuacuuuguaauuuauuguggcaugagauaaga

SEQ ID NO: 66084 - RNA, 62 nt, hsa
agcaugcaaggguaagaaugaguuuuuaacugcuuuguaagaaaauggaaaaggucaauaaa

SEQ ID NO: 66085 - RNA, 62 nt, hsa
aaucuaaauauggaauuugguaaauuagaauacuuuguaauuuguaagaccaaauucauacu

SEQ ID NO: 66086 - RNA, 62 nt, hsa
uauaagcagcugugaaauuuaagugaaauguucuuuguaaacauuuguacuauuuuaaauga

SEQ ID NO: 66087 - RNA, 62 nt, hsa
ugcacagggcuuauagcugcuucauucugcuacuuuguaacuaggagccauugcauuuauua

SEQ ID NO: 66088 - RNA, 62 nt, hsa
ugauggcaucccuacagucuucuucacuugaacuuuguaaaacugcauauggaccuguaauc

SEQ ID NO: 66089 - RNA, 62 nt, hsa
uuuguaauauucucuccgccauugagaaugugcuuuguaagauccacccccugcccacaaaa

SEQ ID NO: 66090 - RNA, 62 nt, hsa
gacaauacaccuuccccacccuugagaaggugcuuuguaauauucuccccacccaccccacg

SEQ ID NO: 66091 - RNA, 62 nt, hsa
cauguuccugggaucacugaugacuuuuuauacuuuguaaagacaauuguuggagagccccu

SEQ ID NO: 66092 - RNA, 62 nt, hsa
cagacucugaugaugauuagagcucaauaauucuuuguaaauugucuuuuuuuuucugcuuc

SEQ ID NO: 66093 - RNA, 62 nt, hsa
gagccuuguaauucuaaaugaauguuuacacucuuuguaagaguggaaccaacacuaacaua

SEQ ID NO: 66094 - RNA, 62 nt, hsa
ugauaccaugacaaaaaucuuuccugaauugucuuuguaaaaguauuauugaauuuucaauu

SEQ ID NO: 66095 - RNA, 62 nt, hsa
aaggaaaaaguaagaugagaaauaaagaaagccuuuguaaggugguuuuaaaagccuuauau

SEQ ID NO: 66096 - RNA, 62 nt, hsa
uacaugauuuauaauuucacugauugagauuacuuuguaaguagcuguucagaagaauaaaa

SEQ ID NO: 66097 - RNA, 62 nt, hsa
guaacauaauggugaugguuggccauuugagucuuuguaaccuaggaaagacaaaggucuga

SEQ ID NO: 66098 - RNA, 62 nt, hsa
auggcaagucuagaacucuccgaauccuacagcuuuguaauuuuuuuucuacaaaugucuaa

SEQ ID NO: 66099 - RNA, 62 nt, hsa
cugauucaauuauaauuguaauggauuuuugacuuuguaauggauucuuuucaucaaaaagc

SEQ ID NO: 66100 - RNA, 62 nt, hsa
cuaguugucuguguauaauauuuccaaagcuccuuuguaaaccccgucuccuuucauucaga

SEQ ID NO: 66101 - RNA, 62 nt, hsa
gguaggguagagacuacccuagacaucugcaucuuuguaaguuagccagacaauaaagaaaa

SEQ ID NO: 66102 - RNA, 62 nt, hsa
cuuuauauuugucuuauuuugaaucuuauccacuuuguaagaacaaguuuauguuugagcaa

SEQ ID NO: 66103 - RNA, 62 nt, hsa
uguuaguagacagugguguccucaaaauuuuacuuuguaauucuucagaauugauuauuuuu

SEQ ID NO: 66104 - RNA, 62 nt, hsa
uuuugguuucugcuucucucuucucucaaccccuuuguaaugguuugggggcagacucuuaa

SEQ ID NO: 66105 - RNA, 62 nt, hsa
cacuguuccucugucauacuguaucuggaaugcuuuguaauacuugcaugcuucuuagacca

SEQ ID NO: 66106 - RNA, 62 nt, hsa
guaugacauaaugauuugcuauguuguaaaaucuuuguaaaaaauuucuauauaaaaauauu

SEQ ID NO: 66107 - RNA, 62 nt, hsa
cuuugcccaauaaccacauuuuauuucuucagcuuuguaaauaccagguucuaggaaauguu

SEQ ID NO: 66108 - RNA, 62 nt, hsa
cuaauuuuuaaauuuuaaguuauuuuguacagcuuuguaaauucuuaacauuuuuauauugc

SEQ ID NO: 66109 - RNA, 62 nt, hsa
cuguagugcagugauccuuuacagguuuauuucuuuguaaaaaaaaauaauaauaauuugaa

SEQ ID NO: 66110 - RNA, 62 nt, hsa
ugaggcccaucucuccagccagccacugccuucuuuguaauauuaagugccuugagcuggaa

SEQ ID NO: 66111 - RNA, 62 nt, hsa
gccgucucaaggcauuuacgguuuaaaaagaccuuuguaauuacuaacgaaaaugcaaagca

SEQ ID NO: 66112 - RNA, 62 nt, hsa
gguguguuucugagaauuuguuugaauuaguucuuuguaaauaaaacaggauuuugaaugca

SEQ ID NO: 66113 - RNA, 62 nt, hsa
cagggaauaaaagcuuuucaacucaaccacuucuuuguaagacaaaacugaaguaucugugu

SEQ ID NO: 66114 - RNA, 62 nt, hsa
ggguuuucuguuuuuugauggaggugaaaucucuuuguaauccacuagguuuucaucguaaa

SEQ ID NO: 66115 - RNA, 62 nt, hsa
uagacucuuuuauaccuguugucacaagaaagcuuuguaaaaccagacagugaagcaaaaug

SEQ ID NO: 66116 - RNA, 62 nt, hsa
agucaaucauuuaauuuuugggaccucaguuucuuuguaaguaaaauaacaccugcuuguuc

SEQ ID NO: 66117 - RNA, 62 nt, hsa
ggacugggucacuauugugguuuuuacuauaacuuuguaaauuaacuuaauuuugcugacuu

SEQ ID NO: 66118 - RNA, 62 nt, hsa
gcuuugaaucaacuuaagggaaaaccuuuugucuuuguaaaaauaaaagccuguagcuaagg

SEQ ID NO: 66119 - RNA, 62 nt, hsa
gaauaugcccgacuccccaugacaagacagaacuuuguaacaaacaguaccaauuuauuuug

SEQ ID NO: 66120 - RNA, 62 nt, hsa
uuguuccugccccacccuaacugaucaauguacuuuguaaucucccccacccuuaagaaggu

SEQ ID NO: 66121 - RNA, 62 nt, hsa
acuuuguaaucucccccacccuuaagaagguacuuuguaaucuuccccacccuuaagaaggu

SEQ ID NO: 66122 - RNA, 62 nt, hsa
acuuuguaaucuuccccacccuuaagaagguucuuuguaauucuccccacccuugagaaugu

SEQ ID NO: 66123 - RNA, 62 nt, hsa
aacguguucuuuuagaccaguuuucuaauaagcuuuguaaaauguacuauccaaauuagaag

SEQ ID NO: 66124 - RNA, 62 nt, hsa
ggagaacauuaggacaaaaagucaccaacuuacuuuguaacauuuuaauaaugacuuaaggg

SEQ ID NO: 66125 - RNA, 62 nt, hsa
cccauacaaguauucauuuuuucuacccuuuccuuuguaaguuccugggcaaccuuuuugau

SEQ ID NO: 66126 - RNA, 62 nt, hsa
ggugugugugugucuauguguguguuucagcacuuuguaaauagcaagaagcuguacagauu

SEQ ID NO: 66127 - RNA, 62 nt, hsa
ggugaaggguacccaggaccacucuguaccaucuuuguaacuuccugugaauuuauaauaau

SEQ ID NO: 66128 - RNA, 62 nt, hsa
aaaauaauugcuuugacauugucuauaugguacuuuguaaagucaugcuuaaguacaaauuc

SEQ ID NO: 66129 - RNA, 62 nt, hsa
uuguuugaaagccuccauauaguuagauugugcuuuguaauuuuguuguuguugcucuaucu

SEQ ID NO: 66130 - RNA, 62 nt, hsa
aaaaguguguuugaaaaauauuaucuuggguucuuuguaaaauuuauuuuuuacaugcugaa

SEQ ID NO: 66131 - RNA, 62 nt, hsa
gggaauaaaaagcugugaaauuguucaaccuacuuuguaaccaaagaagcaaagcuguguaa

SEQ ID NO: 66132 - RNA, 62 nt, hsa
aaugacuagcuuuuaaaaauacaguacaaagacuuuguaaaugugauucagggcccccagca

SEQ ID NO: 66133 - RNA, 62 nt, hsa
ggguccuccaggcaucagcuguuguguccucucuuuguaacaguggacaggacagaccaccc

SEQ ID NO: 66134 - RNA, 50 nt, hsa
uuuuacaacaauuauacugacuuuguaaggaauauggaauugcuaagaua

SEQ ID NO: 66135 - RNA, 62 nt, hsa
cuacauuuuaaaagcaauuguauuaguaagaacuuuguaaauaaauaccuaaaacccaagug

SEQ ID NO: 66136 - RNA, 62 nt, hsa
auccgugcuuugucggccagcguuucugcagucuuuguaaaggccccacgagagcgggccag

SEQ ID NO: 66137 - RNA, 62 nt, hsa
caguaagauaucucaaugaaccauaaauucaacuuuguaaaaaucuuuugaagcauagauaa

SEQ ID NO: 66138 - RNA, 62 nt, hsa
gcauauacuucuugggauauaguaucuaagaccuuuguaaacugccauuuuguuagguaugg

SEQ ID NO: 66139 - RNA, 62 nt, hsa
gcagugccaccugaguuccaaauuuuaccauucuuuguaaacaguuggauggauuaugauaa

SEQ ID NO: 66140 - RNA, 62 nt, hsa
auaaaaucuuagaaagaaacauaggcauagaucuuuguaaccuugaauuaggcagugguuuc

SEQ ID NO: 66141 - RNA, 62 nt, hsa
auugaucaucugccuuaacgugaucggagaugcuuuguaaucuacuguccagcugaaagcac

SEQ ID NO: 66142 - RNA, 62 nt, hsa
gcugcugccaagcacauaucccuaugacaacacuuuguaaaagccgcggggcccccauacag

SEQ ID NO: 66143 - RNA, 62 nt, hsa
uuacugcuuauugaucacugcuagacuguaagcuuuguaagggcagggaccauauaagccuu

SEQ ID NO: 66144 - RNA, 62 nt, hsa
uuuagccucuacaugcuaggaucacaggaagacuuuguaaggacaguuuaaguucuccugca

SEQ ID NO: 66145 - RNA, 62 nt, hsa
ggacuggagggagacuuuuauacguuuuguaccuuuguaaccagagagaugcuuauguuauu

SEQ ID NO: 66146 - RNA, 62 nt, hsa
ggaaaaacaacagcgacaaaaaagucaagaaacuuuguaaaauaucgugugugugauuccuu

SEQ ID NO: 66147 - RNA, 62 nt, hsa
agggaucugggguggucagggcucaggcuucacuuuguaaaccaggugggggcaucucacag

SEQ ID NO: 66148 - RNA, 62 nt, hsa
gguauauacaaauuaaaacugagacacauuggcuuuguaaaucaguauguuuuuacauaaug

SEQ ID NO: 66149 - RNA, 62 nt, hsa
cuuuuuuuauauaaugaaccacucuuuuuuaacuuuguaaccuucccuugaagacagaauuu

SEQ ID NO: 66150 - RNA, 62 nt, hsa
uucauuuaccgaaugagaauucuucauuuucacuuuguaauuuuucuuaguauauagucagc

SEQ ID NO: 66151 - RNA, 62 nt, hsa
auccacauccaccuucggaauacauuaacuuccuuuguaauuuauuugaaaguaguguuaaa

SEQ ID NO: 66152 - RNA, 62 nt, hsa
agccacaaacaguucaucauuuggugcuuagucuuuguaagggcucucugugguuugacuua

SEQ ID NO: 66153 - RNA, 62 nt, hsa
agaccucuaugaaugaauguaucagagaaugucuuuguaacuguuuaauucaaucuguaaua

SEQ ID NO: 66154 - RNA, 62 nt, hsa
caagguacuuuuuuauuuaaaaaaaaacauaacuuuguaaauauuacccuguaauauuauau

SEQ ID NO: 66155 - RNA, 62 nt, hsa
gcacacacggaguggcuuugacagauugauaacuuuguaagaugggagacaucugaaauauu

SEQ ID NO: 66156 - RNA, 62 nt, hsa
gggaaaaaaaaaauccuugcuaaugugguuuccuuuguaaaccaggauucuuauuugugcug

SEQ ID NO: 66157 - RNA, 62 nt, hsa
guugauuaaaucuauaaguuuuuaugugaggacuuuguaagucagcauaaaaaugaaaaguu

SEQ ID NO: 66158 - RNA, 62 nt, hsa
auauucaaauuccguauaccaaaauccauuuccuuuguaacaagaauuuaccaguaacugug

SEQ ID NO: 66159 - RNA, 62 nt, hsa
aauccuccacucucuggaaggagacugaggggcuuuguaaaacauuagucaguugcucauuu

SEQ ID NO: 66160 - RNA, 62 nt, hsa
agaaccucacuugguaccauauagaucaaaagcuuuguaaccacaggaaaaaauaaacucuu

SEQ ID NO: 66161 - RNA, 62 nt, hsa
ggaauauuccccuaucucuagaauuuuaagugcuuuguaaugggaacugccucuuuccuguu

SEQ ID NO: 66162 - RNA, 60 nt, hsa
gccaaaacaaccaaacuauuuucuaaauaaaccuuuguaaucuaauguugggugccgcag

SEQ ID NO: 66163 - RNA, 62 nt, hsa
auuuuauguugaauuauuuuuggagcugaaaucuuuguaauauuaaagcaacuaguuucuaa

SEQ ID NO: 66164 - RNA, 62 nt, hsa
uuauguuuugccacaguuaacccauugugcuucuuuguaaucaaacaguuugugggagaaug

SEQ ID NO: 66165 - RNA, 62 nt, hsa
uuaggaugugggcugguuugcuuuucuaccaccuuuguaauuuuauguaucccaucuccuuu

SEQ ID NO: 66166 - RNA, 62 nt, hsa
gcaauuuuuuucaggaugcaaaggcaauuauucuuuguaagcgggacauuuagaauauauuu

SEQ ID NO: 66167 - RNA, 62 nt, hsa
cuuaaaaaagcuaaucccuaaaauaguuagaucuuuguaaaugcauauuaaauaauaaagua

SEQ ID NO: 66168 - RNA, 62 nt, hsa
aaugcaguuuuuaaaaaccuguaucugacccacuuuguaauuuuugcuccaauauccauucu

SEQ ID NO: 66169 - RNA, 62 nt, hsa
uacugcaucaucuguuuguaaucauuaucucacuuuguaaauaaaaacacaccuuaaaacau

SEQ ID NO: 66170 - RNA, 62 nt, hsa
uaugaauugaguccacaaaggaacacaaaacucuuuguaauucuguuaaaucuuuuauguag

SEQ ID NO: 66171 - RNA, 62 nt, hsa
acuuauuagaaacccaaauugggacaacagugcuuuguaaauuguguugucuucagcaguca

SEQ ID NO: 66172 - RNA, 62 nt, hsa
uucuugcucaguuguuucaggcaagcccaagacuuuguaauuuuuaaagggcccaagauuuu

SEQ ID NO: 66173 - RNA, 62 nt, hsa
auuuaaaaagguuguauuacauauuguuuaaacuuuguaaguagaaauauaucuguuauaau

SEQ ID NO: 66174 - RNA, 62 nt, hsa
uauuacuguuucacauguacagcuuucuacuucuuuguaagaacaccaaccaaccaagguuu

SEQ ID NO: 66175 - RNA, 62 nt, hsa
aggcugcuuuggaaauaauucccauauccuugcuuuguaaguugguaauaucacuaugcauu

SEQ ID NO: 66176 - RNA, 62 nt, hsa
uggcgcucaugggcccugguguuugcaccgcacuuuguaaucagucccgugguugucuguac

SEQ ID NO: 66177 - RNA, 62 nt, hsa
gucagauuuuuaaaguuuuguacaaaguuuuccuuuguaaucacucccauuuuuacuuaaca

SEQ ID NO: 66178 - RNA, 62 nt, hsa
guaaccuuaaagacagaccccucuaaagaacgcuuuguaaauacaugugagguauagccacc

SEQ ID NO: 66179 - RNA, 62 nt, hsa
ucuuuuggauuuuuuuaagguauuugcuaagucuuuguaaacggaaauugaaaaugaccugg

SEQ ID NO: 66180 - RNA, 62 nt, hsa
auagcagaaaaaccuagacccaccuagugaaacuuuguaagaacuccagggcaaaaacgaac

SEQ ID NO: 66181 - RNA, 62 nt, hsa
aaaugucgcuucuucaagugaaugauucugcacuuuguaaacagcacugagauuuauuuuaa

SEQ ID NO: 66182 - RNA, 62 nt, hsa
ugaaaaacaguuuguauaguuggaauauuugucuuuguaauuacuugugauguuuuaaaaua

SEQ ID NO: 66183 - RNA, 62 nt, hsa
uauaguaaaagugcaaucauauggauggcuaacuuuguaaucucuacaaauaauuuaccuua

SEQ ID NO: 66184 - RNA, 62 nt, hsa
gcucguuagcauggaagacuucuccauucuaucuuuguaaaacagacaagauaugcacuuga

SEQ ID NO: 66185 - RNA, 62 nt, hsa
aaggaagacauaaguguugugauuaguagaagcuuuguaaucauaacacaaugaguaauucu

SEQ ID NO: 66186 - RNA, 62 nt, hsa
uguguguguguaguuacuuaaagguuauuccucuuuguaauaggaaacuauaugggaugaac

SEQ ID NO: 66187 - RNA, 62 nt, hsa
auuuuaaguucuagccccaugauaaccuuuuucuuuguaauuuaugcuuucauauauccuug

SEQ ID NO: 66188 - RNA, 62 nt, hsa
gccuucuuauuuuacuucuuuuagcuguuuaacuuuguaagaugcaaagagguuggaucaag

SEQ ID NO: 66189 - RNA, 62 nt, hsa
cuaaauaauaauaaaaaaaaaagcccuuuaaacuuuguaaggaaauauuuuuugauuuugcg

SEQ ID NO: 66190 - RNA, 62 nt, hsa
cccaaguaauucacuacagccuaaagccuugccuuuguaauuugacuucugacauguuggca

SEQ ID NO: 66191 - RNA, 62 nt, hsa
gcaagagucugauucuuuaaguauauuaaucucuuuguaaucucuucugaaaucauuguaaa

SEQ ID NO: 66192 - RNA, 62 nt, hsa
gcuuuguagcagaauauauuugcagcuauugacuuuguaauuuaggaaaaauguauaauaag

SEQ ID NO: 66193 - RNA, 62 nt, hsa
aguuaaugugcugagcauuuuuuuaaaagaagcuuuguaauaaaacauuuuuaaaaauuguc

SEQ ID NO: 66194 - RNA, 62 nt, hsa
ggcagguuagaagucauuguauaauuuguaggcuuuguaaugauugaaugcaagcguggaaa

SEQ ID NO: 66195 - RNA, 51 nt, hsa
aucacaauaaacaggauugaacuuuguaaacaaccaaagucaggggccuuc

SEQ ID NO: 66196 - RNA, 62 nt, hsa
guuucucucaccuucuugaaggcauuuacagucuuuguaagcuuuucuccuagauuuucccu

SEQ ID NO: 66197 - RNA, 62 nt, hsa
ggaaaacagugccaaaccuccacagcucauuucuuuguaauauaaucagaaugaaaaauaau

SEQ ID NO: 66198 - RNA, 62 nt, hsa
ugcuacuauaauaaguuuuucacgagaacaaacuuuguaaaucuuccauaagcaaaaugaca

SEQ ID NO: 66199 - RNA, 62 nt, hsa
ucuuggauuuauuaugaagaacuuuguaguugcuuuguaauuucccauaaauugucuuugaa

SEQ ID NO: 66200 - RNA, 62 nt, hsa
gauuuuagaaauaagauaaucaacguacaacucuuuguaaaacaaaagcaacuuugggugag

SEQ ID NO: 66201 - RNA, 62 nt, hsa
cuugaagcuuuccaauggcgcuucucuauggacuuuguaaauaaguuauaucuuuguaauuu

SEQ ID NO: 66202 - RNA, 62 nt, hsa
gcuucucuauggacuuuguaaauaaguuauaucuuuguaauuuuccugcuacuuuaucauuu

SEQ ID NO: 66203 - RNA, 62 nt, hsa
aaaguuauaugcuguaguuuuuaguauuuugucuuuguaauuuacagaaguuauuggagaaa

SEQ ID NO: 66204 - RNA, 62 nt, hsa
aaguccucaucuguuauauaaaauccuuucugcuuuguaaguuuucucuuuuugggauuuuc

SEQ ID NO: 66205 - RNA, 62 nt, hsa
uccccucccauguugucgcacugaucacacugcuuuguaauuauuuucuuuauuguugguaa

SEQ ID NO: 66206 - RNA, 62 nt, hsa
aauguuuuguugggcuguguugaacauuauuucuuuguaaaugaauguuguaggaaugagga

SEQ ID NO: 66207 - RNA, 62 nt, hsa
uaacaugugauuauaauuuuucuuagcauuuucuuuguaaagaacuacaauauaaacuaguu

SEQ ID NO: 66208 - RNA, 62 nt, hsa
uacaguauguaacugcgggaaacccacugccccuuuguaagcuguggaacccaaacuguaug

SEQ ID NO: 66209 - RNA, 62 nt, hsa
uuaauaauuuugauugaaacccuuuaacaacucuuuguaaauuuuaacucauuuuaguugau

SEQ ID NO: 66210 - RNA, 62 nt, hsa
ccaauuuguacauuuuaauuauucaauuucuacuuuguaaaaauagggaaauuauuugaagu

SEQ ID NO: 66211 - RNA, 62 nt, hsa
gaauagcaaaugagaaaauguauauaaaagcacuuuguaaauuguaaaaguaguacagaugu

SEQ ID NO: 66212 - RNA, 62 nt, hsa
ucuacguauaaacacucuugaauagacuuccacuuuguaauuagaaaauuuuauggacagua

SEQ ID NO: 66213 - RNA, 62 nt, hsa
uuuugugaacacuuuugaaaauguacauguuccuuuguaauugacacuauauauuucuuaau

SEQ ID NO: 66214 - RNA, 62 nt, hsa
acuccaaugccuguacugugucuacugcaccacuuuguaaacacuucaauuuacuaucuuug

SEQ ID NO: 66215 - RNA, 62 nt, hsa
aucccugagcuuucccaguagccuccaguuuccuuuguaagacccagggaucacuuagccau

SEQ ID NO: 66216 - RNA, 62 nt, hsa
cugagagccagccugacauuagacagaauacccuuuguaauacauuggaaauuuuuacucau

SEQ ID NO: 66217 - RNA, 62 nt, hsa
gauucauucauuauucuaguccugcuuuaguccuuuguaauuugugguaauuaugcuuuucu

SEQ ID NO: 66218 - RNA, 62 nt, hsa
aauauuuuaauuacuauuuaaauaucucuuuacuuuguaauccuaugcauuuuacgcauuaa

SEQ ID NO: 66219 - RNA, 62 nt, hsa
cugguuuauguucuaggaacucuucaugagcacuuuguaaacacccucuugcuuaauccucc

SEQ ID NO: 66220 - RNA, 62 nt, hsa
ccuuuacaauuaaacuaaauauugugcaaccgcuuuguaaauuaauaugaagaagauauauc

SEQ ID NO: 66221 - RNA, 62 nt, hsa
aacgugaauauuuauacaguagccucuucaggcuuuguaauuuucauuccaaaaaugcccgg

SEQ ID NO: 66222 - RNA, 62 nt, hsa
gauauauauuuuuuuuaaugcaggaaaguauacuuuguaaggagcagauuuuuuuguucuca

SEQ ID NO: 66223 - RNA, 62 nt, hsa
gcacauuccaaacuuuagcaacaguuaucacacuuuguaauuugcaaagaaaaguuucaccu

SEQ ID NO: 66224 - RNA, 62 nt, hsa
aaagaccaguaacuuuguuuuucaaaauuagucuuuguaacauagaauucaugaguguuuac

SEQ ID NO: 66225 - RNA, 62 nt, hsa
aacuugcuucccuuuucacuaauuuugcuaaacuuuguaaugcacauucuuagcauauaacu

SEQ ID NO: 66226 - RNA, 62 nt, hsa
aaaauauccaaggaucagagucucuuucuaagcuuuguaagcuaagcaauaguuuauguccu

SEQ ID NO: 66227 - RNA, 62 nt, hsa
uuuggaaggucugaaaacuugcacagggucaucuuuguaauuauauaaccccaaacuaagau

SEQ ID NO: 66228 - RNA, 62 nt, hsa
uaaaagaguuuauacaggccuuaaauaucagacuuuguaacagguagaaauauuacagaaua

SEQ ID NO: 66229 - RNA, 62 nt, hsa
ggcugcaaguggaagcggauaauauguaggcacuuuguaaauucauauugaguaaaugaaug

SEQ ID NO: 66230 - RNA, 62 nt, hsa
ugcauucugaggcugaacuaauaaaaacucuucuuuguaaucauauuuugggcauucucagc

SEQ ID NO: 66231 - RNA, 62 nt, hsa
uuuguaaacacugccagaauacuuucuagcugcuuuguaauuuuuuaagaguguuauuuugu

SEQ ID NO: 66232 - RNA, 62 nt, hsa
cagaauucugaguuaaagaaacaaaguauuugcuuuguaaaaggccaaaauucuauuuccua

SEQ ID NO: 66233 - RNA, 62 nt, hsa
cauuucugcuucagcucuuugcugcuucacuucuuuguaaaguuguaaccugaugguaauua

SEQ ID NO: 66234 - RNA, 62 nt, hsa
agguuuugguaauuguagaccuguuucauaagcuuuguaauucagaaauccuuguauuuagu

SEQ ID NO: 66235 - RNA, 62 nt, hsa
cagaaucaguuacaaacaucacaguucccaugcuuuguaauaacaccuggugaaaaaguuag

SEQ ID NO: 66236 - RNA, 62 nt, hsa
uaguggguggauagcaaguauauucuaaaaaacuuuguaaauaaaguuuuguggcuaaaaug

SEQ ID NO: 66237 - RNA, 62 nt, hsa
auugauagucacuagaguaauguauucuuaaccuuuguaagaacugaucucagcauguauuc

SEQ ID NO: 66238 - RNA, 62 nt, hsa
aacaacaacaaagggcaguaaauuaaaguacucuuuguaagguacaguuaccgauuaaucua

SEQ ID NO: 66239 - RNA, 62 nt, hsa
ugaaauuacuguaccuagucuuuuuugcauuacuuuguaaccuuuuucuaugcaagagucuu

SEQ ID NO: 66240 - RNA, 62 nt, hsa
ucuuuugguucuguucacugagcuaaauuuaucuuuguaaaucuuuuugagucuggggggug

SEQ ID NO: 66241 - RNA, 62 nt, hsa
aagagcuucugggacagagacugcuuggccagcuuuguaaguaaguggcugccuccaaugug

SEQ ID NO: 66242 - RNA, 62 nt, hsa
ugaugguuuugugauuuagcuggguaaacuaucuuuguaacagauaaguuauuuauaaaaau

SEQ ID NO: 66243 - RNA, 62 nt, hsa
ugggaacagccaaagggauuccaaggcuaaaucuuuguaacagcucucuuucccccuugcua

SEQ ID NO: 66244 - RNA, 62 nt, hsa
cuugauucagauauuuaugugaacuuaaaccucuuuguaaaauagcgcuaaauaauuugaac

SEQ ID NO: 66245 - RNA, 62 nt, hsa
accaacugcugagauuuuuauguauuuugugacuuuguaacaacugcuauuguaauaagugu

SEQ ID NO: 66246 - RNA, 62 nt, hsa
aucuccuuguuguucuuuaacccucacugggacuuuguaaacuuccaagucauucucaccua

SEQ ID NO: 66247 - RNA, 62 nt, hsa
uuauucuuucuacugagggcauugucuguuuucuuuguaaaugccguacaauaaacaaauua

SEQ ID NO: 66248 - RNA, 62 nt, hsa
agcaguaagggggaaggagggugauuauauugcuuuguaaugguuugugauacuugaaacau

SEQ ID NO: 66249 - RNA, 62 nt, hsa
auggauuauguuuuagcauuuuauacagucaacuuuguaaugaacuuuuuaaaaauuaauug

SEQ ID NO: 66250 - RNA, 62 nt, hsa
cccauggaaaaaugccaucaaaugaauaaugccuuuguaaccacaacuuucacuauaaugug

SEQ ID NO: 66251 - RNA, 62 nt, hsa
uuugucacuggaugcuacuugaagagggaguacuuuguaaccacuuugauaugcuguuauca

SEQ ID NO: 66252 - RNA, 62 nt, hsa
aauacagucaccuagacacuuccauuuguaaucuuuguaauagacuguaaauauauuuuugg

SEQ ID NO: 66253 - RNA, 62 nt, hsa
acaaauaacagaaacaaaaucuguaaauguuccuuuguaaaacuuguaaauuuuauuuauac

SEQ ID NO: 66254 - RNA, 62 nt, hsa
uuuuuaaaaguaguaagccacauuacauuuaucuuuguaaaaagauuuaugguaacugguuu

SEQ ID NO: 66255 - RNA, 62 nt, hsa
ugauacauaauuuaaaagcacacucccuuccacuuuguaauaccagaacucuaauuggacac

SEQ ID NO: 66256 - RNA, 62 nt, hsa
aauuuguacauauuuuagaauuuguguaucugcuuuguaauaaauguaauuucuuuccuuuu

SEQ ID NO: 66257 - RNA, 62 nt, hsa
uuuaagacauuuaaaaacgugaaauuuguuaucuuuguaaaaugacaaucauguagaaaccu

SEQ ID NO: 66258 - RNA, 62 nt, hsa
uagcacauauaugcaagcaccuaguauaauuucuuuguaauaugugaaacuuuauuaaugua

SEQ ID NO: 66259 - RNA, 62 nt, hsa
cacugcuauuagacaauugaaguguucauuuacuuuguaauuccaauaaucauaguuaugga

SEQ ID NO: 66260 - RNA, 62 nt, hsa
uuuucauuguguguauuucccaagaaaguauccuuuguaaaaacuugcuuguuuuccuuauu

SEQ ID NO: 66261 - RNA, 62 nt, hsa
aagaguaauguauuaccucaauuuuugacugacuuuguaaaagccaauaacugguuuaaugu

SEQ ID NO: 66262 - RNA, 62 nt, hsa
aguuauguuuacacaucauuuuuauguuccugcuuuguaauucauguuugagauggguggcc

SEQ ID NO: 66263 - RNA, 62 nt, hsa
gggaagccuuugcaagaaaauugcauacaaggcuuuguaacgaucaagugcuaaucgaugga

SEQ ID NO: 66264 - RNA, 62 nt, hsa
aauaccagcuggggagacacuagggaagggagcuuuguaagccuugauugcgaaaguccaaa

SEQ ID NO: 66265 - RNA, 62 nt, hsa
uaggauucucucuaaauuauuuauugaagaggcuuuguaaauagugcaccagugacaggugc

SEQ ID NO: 66266 - RNA, 62 nt, hsa
ccguaguuuauuuuaaaauauauuuuuaaaagcuuuguaaaaauuaugucauucucagaauu

SEQ ID NO: 66267 - RNA, 62 nt, hsa
gugcccuguaaccugacugguuaacagcaguccuuuguaaacaguguuuuaaacucuccuag

SEQ ID NO: 66268 - RNA, 62 nt, hsa
uauacuuguagcaaauuguuuuaauucuguagcuuuguaauauguuuuaaaaucagaaacua

SEQ ID NO: 66269 - RNA, 62 nt, hsa
ccuaugucuguuacaaaacauaguuuauguagcuuuguaacauuccucagugccuguccaua

SEQ ID NO: 66270 - RNA, 62 nt, hsa
auucauaucuguuucauuuggaggauuuucuucuuuguaauguaaagaaauucaaaguuauc

SEQ ID NO: 66271 - RNA, 62 nt, hsa
uaaacauuaacuuuccuauaagaauauuuuggcuuuguaaucuauagccucaaauugguauu

SEQ ID NO: 66272 - RNA, 62 nt, hsa
acacucuuacaccuguuauggaaaaugucaaccuuuguaagaaaaccaaaauaaaaauugaa

SEQ ID NO: 66273 - RNA, 62 nt, hsa
accucacagcagcuucgugcuuuuguacagaccuuuguaacaaguguacagaaaacucauuu

SEQ ID NO: 66274 - RNA, 62 nt, hsa
gcuacguuuauugccucgucuuauucacugaccuuuguaaugauacacagugaauucuuuuu

SEQ ID NO: 66275 - RNA, 62 nt, hsa
auuuuuuuaauguacccuaccuucaguauucucuuuguaaguuggugacuugcaucuguggc

SEQ ID NO: 66276 - RNA, 62 nt, hsa
uucuaauuaauagccaaagauuucauaucuaacuuuguaaccagaauuauacaguaaguuga

SEQ ID NO: 66277 - RNA, 62 nt, hsa
ugcccaggggcccacagggaacccugcuugcacuuuguaacauguuuacuuuucagggcauc

SEQ ID NO: 66278 - RNA, 62 nt, hsa
ucugcugcccuccaccauuuauuuuuacagugcuuuguaauuuuuuucaucaguuccuuaaa

SEQ ID NO: 66279 - RNA, 62 nt, hsa
ccccagacauccugcaaccuggggggacauuccuuuguaaaaccugggcuggaagucaaagc

SEQ ID NO: 66280 - RNA, 62 nt, hsa
uuuuguuuuuaaaauguguuuaauaaaugauccuuuguaaauaacuuuggucucccuacauu

SEQ ID NO: 66281 - RNA, 62 nt, hsa
aauaguauggaucuuuuuaaaucaauaagaugcuuuguaaaguugaaauaaguaauacuuuc

SEQ ID NO: 66282 - RNA, 62 nt, hsa
uaaauaccaaaagagggaaaauaaaaaagaaccuuuguaaaauauaucugaaccuaaugguu

SEQ ID NO: 66283 - RNA, 62 nt, hsa
ugccccucuuccuucuuccuucugugacuuaacuuuguaaaggggauauggacaaguaagua

SEQ ID NO: 66284 - RNA, 62 nt, hsa
gaguauaaaaagaaccccaauguuauguuaugcuuuguaaauuuuuuuuuuugcuuuuaccu

SEQ ID NO: 66285 - RNA, 62 nt, hsa
aaacauacaguuuauuccacacagcaguuugacuuuguaaaaguuuagcaaaauaacugauu

SEQ ID NO: 66286 - RNA, 62 nt, hsa
uagcuuuuuaauuguuguuucuuucuaguggucuuuguaagaguguagaagcauuccuucuu

SEQ ID NO: 66287 - RNA, 62 nt, hsa
gggggagggggagagagcaaggagaucgguaucuuuguaauaaaacugcaauuuuauaaauu

SEQ ID NO: 66288 - RNA, 62 nt, hsa
auaaauaggacaaaucauuuaugugugaguuucuuuguaauaaaauguaucaauauguuaua

SEQ ID NO: 66289 - RNA, 62 nt, hsa
agcauuuuucuuaaggcuaugcuucaguuuuucuuuguaagccaucacaagccauaguggua

SEQ ID NO: 66290 - RNA, 62 nt, hsa
uggagacccaccacgucucuaugccggaugaccuuuguaaguuaagguccuugugcaucuua

SEQ ID NO: 66291 - RNA, 62 nt, hsa
ucuugccuuucuucccugcuguuuuagcauuucuuuguaaaauguuagcuucaauuaauuag

SEQ ID NO: 66292 - RNA, 62 nt, hsa
uagguuaaguauuauuuagguauuauaauaugcuuuguaaauuuuauauuccaaauauugcu

SEQ ID NO: 66293 - RNA, 62 nt, hsa
acagaaugaaagggcaucucagccucucugaacuuuguaaaaaucuguccccaguucuucca

SEQ ID NO: 66294 - RNA, 62 nt, hsa
uauauuaugaagcuuuuaugugaaacauguuucuuuguaaugaaaaccacauuggagauguu

SEQ ID NO: 66295 - RNA, 62 nt, hsa
ucuuaguucagacucauauauggauuucaaaucuuuguaauaaaaauuauuuguauuuuuaa

SEQ ID NO: 66296 - RNA, 62 nt, hsa
augcuguuuaagugcaggcugagacccagccucuuuguaaguacaguaaaauaauccaccgu

SEQ ID NO: 66297 - RNA, 62 nt, hsa
cguguguccuuugguacuaugguguguuguaucuuuguaagagcaaaagccucagaaaggga

SEQ ID NO: 66298 - RNA, 62 nt, hsa
uuucugaaacuccauuauaacauauguaacuccuuuguaaccaaaauuuagguaagcaggcu

SEQ ID NO: 66299 - RNA, 62 nt, hsa
aacuauguguaaauauauuaaggaaaguauagcuuuguaauuuaaauuggagcuuuuagcuu

SEQ ID NO: 66300 - RNA, 62 nt, hsa
aaucacuaaacucuaguacauuauagcaggugcuuuguaaucuggaauggagaagagguagg

SEQ ID NO: 66301 - RNA, 62 nt, hsa
ugugccuggcugguuugcagauauuuguucugcuuuguaaaaauuggccauuagugcauuua

SEQ ID NO: 66302 - RNA, 62 nt, hsa
gaggaaacuaauggaguuucauuguaacuguccuuuguaauuuauauaaauguauuauuuuc

SEQ ID NO: 66303 - RNA, 62 nt, hsa
uaugaaaauguccucuucuucaaagguauaggcuuuguaaugaauuagauuuucugccaaua

SEQ ID NO: 66304 - RNA, 62 nt, hsa
gaggaauuauacaaaauuaauauauaugaguccuuuguaauuuauuuuuuuuugagacagga

SEQ ID NO: 66305 - RNA, 62 nt, hsa
cucuaaacuagccuugaaguuuacagacaugacuuuguaaauguauuguuuuucuuuguugu

SEQ ID NO: 66306 - RNA, 62 nt, hsa
ucaauuucaguucagcuaacauauauuaauaccuuuguaacucuuugcuauggcuuuuguua

SEQ ID NO: 66307 - RNA, 62 nt, hsa
gaacaaacauauuuaugaucaugaauaaugugcuuuguaaaaagauuucaaguuauuaggaa

SEQ ID NO: 66308 - RNA, 62 nt, hsa
gggguucuaauuacugucugugagaguuacuacuuuguaacuuaugguuucugcuucaguau

SEQ ID NO: 66309 - RNA, 62 nt, hsa
guguaauucuauuguaauaaacuggcagguaucuuuguaacuauaaauagugcaugcucagc

SEQ ID NO: 66310 - RNA, 62 nt, hsa
accaggagauuacaauuuuuugcucuucuugucuuuguaaucuauuuaguugauuuuaauua

SEQ ID NO: 66311 - RNA, 62 nt, hsa
aaaacucucagggcccuauuaagauuuauaaccuuuguaauguucuucaccacagacaccuu

SEQ ID NO: 66312 - RNA, 62 nt, hsa
ggcuuaccccucucuaggguugcaguugcuuucuuuguaauaaguauuuugccacaccugua

SEQ ID NO: 66313 - RNA, 62 nt, hsa
uaaaugugguaggaaauauaaaucauaugguccuuuguaaaauauacaaauaaucuaacaca

SEQ ID NO: 66314 - RNA, 62 nt, hsa
ugucuacgguuaagcaacagauaccuccuucccuuuguaaauaguauuuuuauacuucaucc

SEQ ID NO: 66315 - RNA, 62 nt, hsa
agccuauacugcauuagcccaagagauuguugcuuuguaacuuuuugcacuauuguuuuggc

SEQ ID NO: 66316 - RNA, 62 nt, hsa
ccaaaucauuucaacugaaaagaacaguauugcuuuguaauagagucuguaauaggauuucc

SEQ ID NO: 66317 - RNA, 62 nt, hsa
ccuuuuccuucugaccaacacuuagucuuuaacuuuguaagguucgguuuaagguuucaggg

SEQ ID NO: 66318 - RNA, 62 nt, hsa
agugguauccuauauuacuuuagugucguacgcuuuguaagacuuaaauauuuuauucuauu

SEQ ID NO: 66319 - RNA, 62 nt, hsa
cuuucuuccauauaugugguucauuggaaguucuuuguaauuuuaauuccaugaaagucuua

SEQ ID NO: 66320 - RNA, 62 nt, hsa
cuuugugauagguuuguacugugccuaauuuacuuuguaaaccagaaugauuccguuuuugc

SEQ ID NO: 66321 - RNA, 62 nt, hsa
gugcuuuucagagacgccauagcuguuuuucccuuuguaauaucaaagcaguaauaucuucu

SEQ ID NO: 66322 - RNA, 62 nt, hsa
aggggaaacuguguaagcuguacuuguuauuucuuuguaaaaugucuuagauaauaaaacua

SEQ ID NO: 66323 - RNA, 62 nt, hsa
uuucccaccauuucccuuuaagugcucugcuccuuuguaaaaaguuaaagauuugaaagaga

SEQ ID NO: 66324 - RNA, 62 nt, hsa
uuuguaaagaaguauauuuuuaugaaaagaaacuuuguaaaaguaugauguaaauuuucagu

SEQ ID NO: 66325 - RNA, 62 nt, hsa
guauguccucauagaacuuuuaauacuuaaggcuuuguaaaaacuauccaugaagggaaagc

SEQ ID NO: 66326 - RNA, 62 nt, hsa
caggagacugaaaguucauacuaauuuacaaacuuuguaaagacuggugcuguucauucaua

SEQ ID NO: 66327 - RNA, 62 nt, hsa
auaaccacacacagauaaccacacaaaaaauccuuuguaaaauuucugauugauaggauuag

SEQ ID NO: 66328 - RNA, 62 nt, hsa
ggugccaaauuccauuuaacuuuuuuacaagucuuuguaaaauuuuaaaugcauaaaggggg

SEQ ID NO: 66329 - RNA, 62 nt, hsa
gugagggaaucuaauuaagauuucaugcuguucuuuguaaugauaaauguuuccggacuaaa

SEQ ID NO: 66330 - RNA, 62 nt, hsa
uagauguuggaacuaccuuuuuacuccccauacuuuguaaguaaugcuuccagauuaaccug

SEQ ID NO: 66331 - RNA, 62 nt, hsa
ccauaugugaauguaagcucuuaacuaugucucuuuguaauguguaauuucuuucugaaaua

SEQ ID NO: 66332 - RNA, 62 nt, hsa
gugaaauucuagaaaaaaauauuaccaccucucuuuguaauuuacuuuacuuguaugaauuu

SEQ ID NO: 66333 - RNA, 62 nt, hsa
ccugcacugugucaucuuuucaaggcauuugucuuuguaauauuuuccauaaauuuggacug

SEQ ID NO: 66334 - RNA, 62 nt, hsa
aaauuacccuauccuuuguucucuacuguuuucuuuguaauguaugacuacgagagugauac

SEQ ID NO: 66335 - RNA, 62 nt, hsa
uuuuuuucuuuuuuugacucguugacaagugucuuuguaauauguuuuuaguucccuuuuuu

SEQ ID NO: 66336 - RNA, 62 nt, hsa
acagcauuuuuacuuucuguacaacaaaaaagcuuuguaaauaaaaucuuaacauuuugggu

SEQ ID NO: 66337 - RNA, 62 nt, hsa
auguuucuugcauuaugaaggcuacaucugugcuuuguaaguaccacuucaaaaaauaguuc

SEQ ID NO: 66338 - RNA, 62 nt, hsa
uuagagcuuugugcuuuucucucauuccaucacuuuguaaugaugauacuuaacaugagcag

SEQ ID NO: 66339 - RNA, 62 nt, hsa
gggcuuuaucuaugaaaaaguaguaaauaguucuuuguaaccugugugaagcagcagccagc

SEQ ID NO: 66340 - RNA, 62 nt, hsa
cauugaggguuuguuuguguuuucaucaaugucuuuguaaagcacaaauuaucugccuuaaa

SEQ ID NO: 66341 - RNA, 62 nt, hsa
uggagucguuuugagaugagcauuagccccagcuuuguaaccaaugaggaacacuuacuuau

SEQ ID NO: 66342 - RNA, 62 nt, hsa
aguuaagagaaacuuuauacauuaguaaaugucuuuguaagucaguguugagauggggauaa

SEQ ID NO: 66343 - RNA, 62 nt, hsa
ggaugucaauacaagauugucugccuguuuuucuuuguaauuuguaauuacaguuuuuguaa

SEQ ID NO: 66344 - RNA, 62 nt, hsa
ugucaauuugcucuagugucuuauuaguuaaacuuuguaaaauauauauauacuuguuuuuc

SEQ ID NO: 66345 - RNA, 62 nt, hsa
aacacugguuaauuucacacuccaucuccccgcuuuguaaauacccaucgggaagagacuuu

SEQ ID NO: 66346 - RNA, 62 nt, hsa
aguuccugaccuuccucugagcccuugagacacuuuguaaugcucuuuuguaacuaucgaca

SEQ ID NO: 66347 - RNA, 62 nt, hsa
auuaagugcccaauauugaaaggcugcaaguacuuuguaaucacucuuuggcauggguaaau

SEQ ID NO: 66348 - RNA, 62 nt, hsa
uuaccaguauaucagaggaaaauuuucguagucuuuguaaaauaauauacucaucauagaaa

SEQ ID NO: 66349 - RNA, 62 nt, hsa
aacgguuucuccuguggauaguggacagagaccuuuguaaccaauggaauuauucauuuuuc

SEQ ID NO: 66350 - RNA, 62 nt, hsa
uaggccguggugaaguugauaaaccaccccugcuuuguaacaaaauuauuuuaaagugacug

SEQ ID NO: 66351 - RNA, 62 nt, hsa
ugucuguuuuguuacauaccuuucaugucgugcuuuguaaaugucuuauuuguguaauaaag

SEQ ID NO: 66352 - RNA, 62 nt, hsa
uuaaacauuagagcuggaguggggcuggaaaucuuuguaaaggaaguucuuucaguaagaug

SEQ ID NO: 66353 - RNA, 62 nt, hsa
uaauacaauagagacuuuucauuuaacuuuaacuuuguaaauauugaaguguguaauaaagc

SEQ ID NO: 66354 - RNA, 62 nt, hsa
aaacuguuuggaaccacaccaaugauauuuuucuuuguaauacuugaaauuuauuuuuuuau

SEQ ID NO: 66355 - RNA, 62 nt, hsa
gagaucauugguagccagggguugcuaccaaacuuuguaaccucaaggacaaaaugaggaag

SEQ ID NO: 66356 - RNA, 62 nt, hsa
auaaagaagacaugaauuguuuuaagucuacacuuuguaauuagcuaaguugugcaguauuu

SEQ ID NO: 66357 - RNA, 62 nt, hsa
aaucuagaccaaagaaugguauuuucacuuuucuuuguaacauugaaugguuugaaguacuc

SEQ ID NO: 66358 - RNA, 62 nt, hsa
uucaauagaaauuuuuauuucauuuucaauuacuuuguaaauucguguguauuuaguacacu

SEQ ID NO: 66359 - RNA, 62 nt, hsa
uaccugagacuuucaguucguuuguauucuaccuuuguaaaacagccuauagaugaugaugu

SEQ ID NO: 66360 - RNA, 62 nt, hsa
guaucuuuugguuguuugauuuuucuuucuuucuuuguaaauaguucugaguucugucaaau

SEQ ID NO: 66361 - RNA, 62 nt, hsa
cuuuuguacuagcccaguauuuauuuacauugcuuuguaauauaaaucuguuuuagaacugc

SEQ ID NO: 66362 - RNA, 62 nt, hsa
ccucugccccucccccagccaugccagcuggccuuuguaagugcaggaaaccgaguagaaaa

SEQ ID NO: 66363 - RNA, 62 nt, hsa
gaguuauauaaggcuacuucaugacaagacugcuuuguaauauuucacuuuguuuuacuaca

SEQ ID NO: 66364 - RNA, 62 nt, hsa
auuaaaaaaagcacuggguucugcccuuucaucuuuguaagagauucuugccucuagcaaug

SEQ ID NO: 66365 - RNA, 62 nt, hsa
uacagcucagauacugaucucuuucuaaugggcuuuguaaaccacuugacuuugcuaauggc

SEQ ID NO: 66366 - RNA, 62 nt, hsa
cuauguaauuuuguccuuguuauuuuuguuuccuuuguaauuuacuugaugaguuuauaucu

SEQ ID NO: 66367 - RNA, 62 nt, hsa
agguggcuggagagagcugaggauuuccaggacuuuguaaguucuuauucugggagaacaua

SEQ ID NO: 66368 - RNA, 62 nt, hsa
aaaaggcuuuuaaaauuuuguuuguuuuaaaucuuuguaaaguuauuauuccagagaguaua

SEQ ID NO: 66369 - RNA, 62 nt, hsa
uauacauuuuucuuaauguuccaacaucuauacuuuguaaagucaaaacauuucccaugagc

SEQ ID NO: 66370 - RNA, 62 nt, hsa
gaaaguggcuuugacaccaagugcuacugucccuuuguaauuggcuucuaacagaauucaac

SEQ ID NO: 66371 - RNA, 62 nt, hsa
ccaggugagcccuggauuggcucccagaaggccuuuguaaaaucaguagccguccugcaggc

SEQ ID NO: 66372 - RNA, 62 nt, hsa
uuccucaggcuucucaccuguggccaacuucacuuuguaagacccauauuuuuaacucuucc

SEQ ID NO: 66373 - RNA, 62 nt, hsa
ucuuuccagagcuuauaguugcuaacacuuuucuuuguaaagaaguuuaccuuuugacugga

SEQ ID NO: 66374 - RNA, 62 nt, hsa
uuauuccuuuccuuuccuggagcuacaccuuucuuuguaaaacuguacugugggccgggcgc

SEQ ID NO: 66375 - RNA, 62 nt, hsa
uccucccaaggguucuggcaccuuaugauguacuuuguaaaaaaauugauugaagauuuuaa

SEQ ID NO: 66376 - RNA, 62 nt, hsa
uacuagcgagaaaucuuugauuucauuuuauucuuuguaauucuagacacuagauuguaguu

SEQ ID NO: 66377 - RNA, 62 nt, hsa
ucaguaaaaaaacacaaaaacuguaugaaugacuuuguaaauuuuguucuauaugaauaaaa

SEQ ID NO: 66378 - RNA, 62 nt, hsa
uaacucuaacacccuucagaaauuucuaacuacuuuguaacugcauggcuuaaccuggugau

SEQ ID NO: 66379 - RNA, 62 nt, hsa
guuaaugguuaauauaggcagggcgaauacuacuuuguaacuuuuaaagucuuaaacuuuuc

SEQ ID NO: 66380 - RNA, 62 nt, hsa
cuauuuguuuuguacauguauauaucuaggaacuuuguaacaacacaucuuuaauaauguua

SEQ ID NO: 66381 - RNA, 62 nt, hsa
uuuucauuuucaguuauuuuugaagcuaaaaccuuuguaauauuguuacuaaagugucuagu

SEQ ID NO: 66382 - RNA, 62 nt, hsa
auaaauugguuccugagaggguuuccuaacagcuuuguaauaagaaaaauauggccuugaug

SEQ ID NO: 66383 - RNA, 62 nt, hsa
acuacuacaaaauuggaaaaagauuggcaauucuuuguaaagaauuugugaauuguguauaa

SEQ ID NO: 66384 - RNA, 62 nt, hsa
uaauagaacaacguuuaugaaccugccguuugcuuuguaacguaacuaaauaauguaauggc

SEQ ID NO: 66385 - RNA, 62 nt, hsa
uagaugaacuaagagaaaaagaaucggauggucuuuguaacugauucuggacauaugcauca

SEQ ID NO: 66386 - RNA, 62 nt, hsa
ucacugcuuaacuucaucuucaugaaaugaaacuuuguaacuuauuguaguuagaaauugua

SEQ ID NO: 66387 - RNA, 62 nt, hsa
uugacuuaaguagaaguaauaugcucucauuucuuuguaaucuagauuuuccuauguugaau

SEQ ID NO: 66388 - RNA, 62 nt, hsa
uaguacacaaaacuaagaaucuuuagacuuaucuuuguaacuaauuaggguggaaguuauga

SEQ ID NO: 66389 - RNA, 62 nt, hsa
caauaaacauguuuucauguaauacuggcuuacuuuguaauuuacaucuguaacuuucauau

SEQ ID NO: 66390 - RNA, 62 nt, hsa
acauguaacuucucucacaagaguacucuuuacuuuguaaucauauacaaugucaacuuuuu

SEQ ID NO: 66391 - RNA, 62 nt, hsa
uguugagaugaguuugcuguacugacgcugcacuuuguaaacagauuaccaguuuuuuacuu

SEQ ID NO: 66392 - RNA, 62 nt, hsa
uacacuguguuuuaaauuacuuuaaaaauaaacuuuguaagcagauuuuaauuuagucuuug

SEQ ID NO: 66393 - RNA, 62 nt, hsa
aagagcugcugcuauaacuuccaguuuuacaucuuuguaaaauuguaucucaaaggcagaaa

SEQ ID NO: 66394 - RNA, 62 nt, hsa
aauaugcuguuuccauuaugacacagcagcuccuuuguaaguaccaggucauguccaucccu

SEQ ID NO: 66395 - RNA, 62 nt, hsa
agagagaacagggugguauucuaaguauguuucuuuguaacaucuuuagcaguaggacagag

SEQ ID NO: 66396 - RNA, 62 nt, hsa
uuauuauuauuauuuuuugagauggagucucacuuuguaacccaggcuggaaugcaauggca

SEQ ID NO: 66397 - RNA, 62 nt, hsa
aagacuuuauuguucuaauuauccagauguaccuuuguaaaauagcucuuuuaugaauuagc

SEQ ID NO: 66398 - RNA, 62 nt, hsa
gcuuugaacaauuguguuuucgucacaggagucuuuguaaugcuuguacaguugaugucgau

SEQ ID NO: 66399 - RNA, 62 nt, hsa
auuuuucuuuguauaugaaauaauuuuuuguacuuuguaaaauauggagcccauuguaccuu

SEQ ID NO: 66400 - RNA, 62 nt, hsa
ugaaaggugucaucaucacuaggaauaacacccuuuguaacuacauauagaacuguuacaau

SEQ ID NO: 66401 - RNA, 62 nt, hsa
ugaagaguugaucccuuuguccuaucguggggcuuuguaauguuacacaucucgugaaaacu

SEQ ID NO: 66402 - RNA, 62 nt, hsa
uagauuuguuuuguguuguuugaaaauauuaucuuuguaauuauuuuuaauauguaaggaau

SEQ ID NO: 66403 - RNA, 62 nt, hsa
cagcccuuuuaucucugcuuuccugaagcagccuuuguaaguggaaggauuguacugaaggc

SEQ ID NO: 66404 - RNA, 62 nt, hsa
cuagcugacucagcauagauuguauaaaauaccuuuguaacggcucuuagcacacucacaga

SEQ ID NO: 66405 - RNA, 62 nt, hsa
uaagauaaccacuugauuuugugauuccaauucuuuguaauugucuucagagcagcccuacu

SEQ ID NO: 66406 - RNA, 62 nt, hsa
uugucaugugauuuuugagucucaauuuaaggcuuuguaaaaugaagaguagaauuccaaga

SEQ ID NO: 66407 - RNA, 62 nt, hsa
gucggaccuugugauuuggauugucaccuagccuuuguaaccgcuuggugccucuuaggacu

SEQ ID NO: 66408 - RNA, 62 nt, hsa
ggaggauauuauuauguggguauuuauaugaccuuuguaaccauuuaaaaauguaaaaacga

SEQ ID NO: 66409 - RNA, 62 nt, hsa
gaggacagaagggacuagggcucuggcggggucuuuguaagaccagaguuucggacagccca

SEQ ID NO: 66410 - RNA, 62 nt, hsa
uaaauaaggggaggguuguuccagcuuugauccuuuguaagauuuugugacugucaccugag

SEQ ID NO: 66411 - RNA, 62 nt, hsa
ccgguucccugagggaugagccuucagccucccuuuguaaugcugcuccucuccacugccca

SEQ ID NO: 66412 - RNA, 62 nt, hsa
uaauggaagcaagacuuccaaccucacggagacuuuguaauuuguuuucugagagcacaggg

SEQ ID NO: 66413 - RNA, 62 nt, hsa
ccauagaaaauuggguguguauacuuguauaacuuuguaaauaaguuuuuuuucuggguuca

SEQ ID NO: 66414 - RNA, 62 nt, hsa
uccacccaacacguuuuugcaaagcaagaagucuuuguaagacaccuuaaacaaaguccuuc

SEQ ID NO: 66415 - RNA, 62 nt, hsa
ccugauggucauuuuucuaaacagaggcccugcuuuguaauauguggccaaggagauaauuu

SEQ ID NO: 66416 - RNA, 62 nt, hsa
cauguuuuucuguagcacugggcccaaauauucuuuguaaagaaaaucgcugcagcaaaaac

SEQ ID NO: 66417 - RNA, 62 nt, hsa
uuuaagucggcagcuuucuaauuuaaucuuagcuuuguaauucauguuuugcuuuuguggac

SEQ ID NO: 66418 - RNA, 62 nt, hsa
accaaauaaucuuaccucuagucuacuuacaacuuuguaaggguuucuaagcuaugcccauu

SEQ ID NO: 66419 - RNA, 62 nt, hsa
gaaaaucaaaugaugcaaaauauauacaagcacuuuguaaauuguaaaaugauacaaaauuu

SEQ ID NO: 66420 - RNA, 62 nt, hsa
ugugugaagcucuuggcuuuuuuccaacguuacuuuguaacuaaugaggguggauguucauu

SEQ ID NO: 66421 - RNA, 62 nt, hsa
guuauuguugacucucucccaagugccuugaucuuuguaauaucuccuguuguuucuaugau

SEQ ID NO: 66422 - RNA, 62 nt, hsa
auacaagaaacaaccuuggaaaaguuauuucccuuuguaauaccuuuaaaaauccagaguau

SEQ ID NO: 66423 - RNA, 62 nt, hsa
auaaccuuaaaaaggacuauauuaaucaccuucuuuguaaucccuucacagucccagguuua

SEQ ID NO: 66424 - RNA, 62 nt, hsa
auuuaaggaaacuagacaaguaaaauuauccucuuuguaauuuaaugaaaagguacaacaga

SEQ ID NO: 66425 - RNA, 56 nt, hsa
gguaugaaauucaguuauaguuuaaucuuuguaaucucacuaauuuucaugauaaa

SEQ ID NO: 66426 - RNA, 62 nt, hsa
ccaaagaucauuuuuuuauauagacuucagcccuuuguaaauauuguaacuggggaguauag

SEQ ID NO: 66427 - RNA, 62 nt, hsa
caacaauuaaaucuugccuuuacacacccaaacuuuguaauuuuagucuuggugaaauauaa

SEQ ID NO: 66428 - RNA, 62 nt, hsa
agggugcuuuuauauauaagagcagcagccgccuuuguaaagugugaucuaugagaauugga

SEQ ID NO: 66429 - RNA, 62 nt, hsa
ucaguagaacuuacacauccuaggaaaucuuucuuuguaaguaauucuuuuggucucaagug

SEQ ID NO: 66430 - RNA, 62 nt, hsa
acugucaccuugauggacaaguuucaauaaaacuuuguaaaaauaauuggacaugugccugg

SEQ ID NO: 66431 - RNA, 62 nt, hsa
ggccauggagcuggcccagaggccccucagcccuuuguaaagucugaugaaggcaggggugg

SEQ ID NO: 66432 - RNA, 62 nt, hsa
gauagaaaggaacaagacuaaaauuguaaauacuuuguaaacaucagcauuuguacuugaau

SEQ ID NO: 66433 - RNA, 62 nt, hsa
aaccucucacaagcuggggcaggucaccuuaucuuuguaagaugaggauaucaucuagauca

SEQ ID NO: 66434 - RNA, 62 nt, hsa
aggguaggccucagaccagggggucuccaaaacuuuguaaaucaugcaucuuuucuccauaa

SEQ ID NO: 66435 - RNA, 62 nt, hsa
uccucagccucgaaaagugggcucuggaaucccuuuguaaauagguguguugaauuuguuuu

SEQ ID NO: 66436 - RNA, 62 nt, hsa
uaagguugggaggcuaacgagucuaccucccucuuuguaaaucaaagaauuguuuaaaaugg

SEQ ID NO: 66437 - RNA, 62 nt, hsa
uccuuuucuuuuucuuuccuuucauuuuuuuucuuuguaaugcaccugacagaaaaaaaaga

SEQ ID NO: 66438 - RNA, 62 nt, hsa
aaacauugugaucuauaaaugcacagaaaauacuuuguaaaaaguagcauccuuauauaaua

SEQ ID NO: 66439 - RNA, 62 nt, hsa
uuuucugcuuuguauauuucuauauuguuuaacuuuguaagaaugcccauuacuuuuuuaac

SEQ ID NO: 66440 - RNA, 62 nt, hsa
guugauuuuagaagauggagaacuccagccaccuuuguaaagcacuaguguuugucauuuau

SEQ ID NO: 66441 - RNA, 62 nt, hsa
augcuguugccucaucuauaacaugcauuugucuuuguaaugucaccaccuucccagcucuc

SEQ ID NO: 66442 - RNA, 62 nt, hsa
ccugucuuucucauccaggucaggcauugacacuuuguaagaaaggggguaggggacacagc

SEQ ID NO: 66443 - RNA, 62 nt, hsa
gguuucugcaucaauuagaauaucauuaauuucuuuguaaccaagugaaaaacuauacuuuu

SEQ ID NO: 66444 - RNA, 62 nt, hsa
uuuauuuaaagucuucuguccagcuuuaagcacuuuguaagacauggcugaaaguagcuuuu

SEQ ID NO: 66445 - RNA, 62 nt, hsa
gucagucaaaccccuuuaaaauguugcuuuggcuuuguaaauuuaaauauguaagugcuaua

SEQ ID NO: 66446 - RNA, 62 nt, hsa
uuuucucuuuauguaguuugacuaugccuuaccuuuguaaauauuuuugcuuguguugucgc

SEQ ID NO: 66447 - RNA, 62 nt, hsa
uaaaugaaauggggagauauuuacauuccguacuuuguaaacuugagcuauuggacuucacu

SEQ ID NO: 66448 - RNA, 62 nt, hsa
cuuacauuguaacaaucuuacugguggaaagucuuuguaaggaaaaaacacauagcaaggag

SEQ ID NO: 66449 - RNA, 62 nt, hsa
gguuuuugauagaacagaggccagcaaacuuucuuuguaaaaggcugguuaguaaauuauug

SEQ ID NO: 66450 - RNA, 62 nt, hsa
acugaagagcucaaugauugacaucugaaaugcuuuguaauuauugacuucagccccuaaga

SEQ ID NO: 66451 - RNA, 62 nt, hsa
aacuguaacuaaguucaacagacuauuauuaucuuuguaauaaauuaaccuagcaauaaaaa

SEQ ID NO: 66452 - RNA, 62 nt, hsa
ucucugcucucauuuaacccgucaaacacaaucuuuguaaagcuagauuggugguguuuuau

SEQ ID NO: 66453 - RNA, 62 nt, hsa
cuagagagggucgucuggccugcuugcugggucuuuguaacccagcacuuccucuugcccuc

SEQ ID NO: 66454 - RNA, 62 nt, hsa
gcagaugaagaggguaggaacuaaauaaaggacuuuguaagccaaagugguugggcugcuuu

SEQ ID NO: 66455 - RNA, 62 nt, hsa
cccaccccagaucccagggacucauccugugacuuuguaaccacacucauuccuuucaaaca

SEQ ID NO: 66456 - RNA, 62 nt, hsa
uuuuaaauguacagacauauuuaacuggugcacuuuguaaauucccuggggaaaacuugcag

SEQ ID NO: 66457 - RNA, 62 nt, hsa
cacuggauucuaaguaguugccaucuugaauccuuuguaauaaagccauacuuuugugugug

SEQ ID NO: 66458 - RNA, 62 nt, hsa
aaccugcucauuaaaucaucucucuauuaguucuuuguaaaucacuuaguacauuagagcua

SEQ ID NO: 66459 - RNA, 62 nt, hsa
aaaugauauggcauguacuuucaauuauguagcuuuguaacuaugaauauuuacauauuuug

SEQ ID NO: 66460 - RNA, 62 nt, hsa
uggcuuuuuguuuccccaaggggaaagacuggcuuuguaauuauaauuuuuuccuuauuuau

SEQ ID NO: 66461 - RNA, 62 nt, hsa
uauauuacuuuuauuuuuaggaccauaaucaacuuuguaauauucuuauauaauuaauuagu

SEQ ID NO: 66462 - RNA, 62 nt, hsa
agaauauucuucuaaguauuuugaugaaguaacuuuguaauuauuugaacauuguuuuaauc

SEQ ID NO: 66463 - RNA, 62 nt, hsa
agguugaacuuugccaaaaaaaaaagaaguuacuuuguaauuuuuggggaaaaaagcacaua

SEQ ID NO: 66464 - RNA, 62 nt, hsa
aguuaauuuguucuuaccaaaaaauaaaauuacuuuguaaauagcaguucacauuuuuccac

SEQ ID NO: 66465 - RNA, 62 nt, hsa
cuucuacuggacaucacagaauucuuuggguucuuuguaauuuaaugaauaggucugaaaac

SEQ ID NO: 66466 - RNA, 62 nt, hsa
uauuggguuugcuuuauuucauaggcuuaauucuuuguaaaucugaaugaccauaauagaaa

SEQ ID NO: 66467 - RNA, 62 nt, hsa
uuaaaagcuuugcaaccuauauauuuauauaacuuuguaauauaacaugggcaaauaucuga

SEQ ID NO: 66468 - RNA, 62 nt, hsa
uuuugggaauaggcaucaaugggugguauuugcuuuguaacuccccccagguacgauaggga

SEQ ID NO: 66469 - RNA, 62 nt, hsa
augggggaaacacagcaguucuugguaaaguccuuuguaauaauaguuugauuuuuuuauuu

SEQ ID NO: 66470 - RNA, 62 nt, hsa
uggaauguucuuauuuagcuuaucauaaucuacuuuguaaaacaugcugaaaccucacugug

SEQ ID NO: 66471 - RNA, 62 nt, hsa
gaauucagaaagguuacccccuuccucugugucuuuguaaggauacauuuggaagaacauac

SEQ ID NO: 66472 - RNA, 62 nt, hsa
ucauugaagucugcuugauuaaaccauaauaucuuuguaauaauuggauuuaaaaugcuaug

SEQ ID NO: 66473 - RNA, 62 nt, hsa
uuauuaauuuaaaauagaacgcuugagaggcacuuuguaaagauuuguuaaacuggaaacgu

SEQ ID NO: 66474 - RNA, 62 nt, hsa
auuccauauuguauccacaauuuaugauaucacuuuguaacccauacauuuauacaauuaua

SEQ ID NO: 66475 - RNA, 62 nt, hsa
cugcuuagauuuagaaaucuacucuugcuggucuuuguaaguugcaugaauauuugacuuug

SEQ ID NO: 66476 - RNA, 62 nt, hsa
ucucucagcaaaauaaaacugugaugugucuucuuuguaaaaguuuagguauaaaaugcuau

SEQ ID NO: 66477 - RNA, 62 nt, hsa
aaaagaccauuaacuuaaagugguguuaaaugcuuuguaaagcugagaucuaaauggggaca

SEQ ID NO: 66478 - RNA, 62 nt, hsa
ccugggcagccaaccaggcaacaccaaggacucuuuguaaacgauagcugaucgugugcacg

SEQ ID NO: 66479 - RNA, 62 nt, hsa
aucagcaacauaaauuuaucaaauuugcagcacuuuguaaaugaugagauugcuuccuaccu

SEQ ID NO: 66480 - RNA, 62 nt, hsa
uuuuaaacuugugauaggcauaucuaugaaaccuuuguaaauuuaguuuauugcuuuaccau

SEQ ID NO: 66481 - RNA, 62 nt, hsa
guuuguauuuucaacuggaguacauguauuuucuuuguaaaguagcuuccuaugaaaaugug

SEQ ID NO: 66482 - RNA, 62 nt, hsa
agauucaccaggcacuggcaugaagaaagagucuuuguaaauggacauugaacaaacaaacu

SEQ ID NO: 66483 - RNA, 62 nt, hsa
ucauaauucauaaaauuuuaguuuaaugugcucuuuguaaaaugaaauuguaaagaaaauac

SEQ ID NO: 66484 - RNA, 62 nt, hsa
acaaagaggaaaucaucuucauaguaaugaaacuuuguaaaguguuuccuuauauugguaau

SEQ ID NO: 66485 - RNA, 62 nt, hsa
gagggcuuacagccucagcaaggaccuuguggcuuuguaacaacaaucagccauaacaaguu

SEQ ID NO: 66486 - RNA, 62 nt, hsa
auaguuacauuucacaaaagauauuuuaaacucuuuguaaaacuuagauaauagagccuagc

SEQ ID NO: 66487 - RNA, 62 nt, hsa
cuggagaaugggaguguuaagacuuuugacuucuuuguaaguuuuguacugcuuuggagagu

SEQ ID NO: 66488 - RNA, 62 nt, hsa
aacccuaaugaugcaagucauaugggggaacacuuuguaaauggucaggauaaaaaccaaau

SEQ ID NO: 66489 - RNA, 62 nt, hsa
aauuuuuuuacccauaagacaucacauuaucccuuuguaagcuacuuaucuccaaaaaacuu

SEQ ID NO: 66490 - RNA, 62 nt, hsa
ucauuuucguuaagaauuuggggcaggaaauacuuuguaacuuuguauaugaaucaaaacaa

SEQ ID NO: 66491 - RNA, 62 nt, hsa
cugguuuuuacuuuuuuaauguaagucucagucuuuguaauuaauuauugaauugugagaac

SEQ ID NO: 66492 - RNA, 62 nt, hsa
ugugguuugccccaagugugcacuauuuaauacuuuguaauaugccaccaagaguacugaca

SEQ ID NO: 66493 - RNA, 62 nt, hsa
uccuaugcaguuuagccaccuucucauuaauucuuuguaacagcaaauccuaggcucagagg

SEQ ID NO: 66494 - RNA, 62 nt, hsa
aggaggaucucuaaagcaguagccaaacaccacuuuguaaaaggacucuuccaucagagaug

SEQ ID NO: 66495 - RNA, 62 nt, hsa
aaaauagcuuaaaaguuuguaaaaaaaugaaucuuuguaauuacuuaauauguuaguuaaga

SEQ ID NO: 66496 - RNA, 62 nt, hsa
aucuaugaauguuuuucuuaaaauuuacaaagcuuuguaaauuagauuuucuuuaauaaaau

SEQ ID NO: 66497 - RNA, 62 nt, hsa
ucuaauucacaaauuaauuucuggaaauuaaacuuuguaaauuaaguuuuugccuauaagaa

SEQ ID NO: 66498 - RNA, 62 nt, hsa
aagaugucaauaagcuugcauuaagccaccugcuuuguaaguggauugauuaauaaauaacu

SEQ ID NO: 66499 - RNA, 62 nt, hsa
aaauuaaauguuauuugaaaauguuauaagagcuuuguaaauauuucagaaaauaugggaua

SEQ ID NO: 66500 - RNA, 62 nt, hsa
guguuuacaggaugcccuucugaaggguaguccuuuguaaagcuguacagacuuugcaguuu

SEQ ID NO: 66501 - RNA, 62 nt, hsa
gugguuugcccucaauugagcacuguuuauuacuuuguaauaugccacugugaguacugaca

SEQ ID NO: 66502 - RNA, 62 nt, hsa
uguaaggcugggcugcugcgacacaggcagcgcuuuguaaacugugaagccauauacgugaa

SEQ ID NO: 66503 - RNA, 62 nt, hsa
agggcaauucccaucucauccaucacucaggucuuuguaaagggugcagccaagcucugcag

SEQ ID NO: 66504 - RNA, 62 nt, hsa
uagugauugucagacugguauggaggugacugcuuuguaagguuuugucguuucuaauacag

SEQ ID NO: 66505 - RNA, 62 nt, hsa
ucuuauuuuccuucuuccuagaugacucagcucuuuguaaauguugugcucaacuucuaggg

SEQ ID NO: 66506 - RNA, 62 nt, hsa; identical to SEQ ID NO: 66492

SEQ ID NO: 66507 - RNA, 62 nt, hsa
gcgguuugcccucaagugugcacuguuuauuacuuuguaauaugccacugugaguacugaca

SEQ ID NO: 66508 - RNA, 62 nt, hsa
uuuuaguggccuguccuugaccugccgugguccuuuguaaacuauggcuccaugcuguguga

SEQ ID NO: 66509 - RNA, 62 nt, hsa
uugagacuggccucuuuuacucaccauaaugccuuuguaauucauccaugcuguugugugua

SEQ ID NO: 66510 - RNA, 62 nt, hsa
auacauuguacaugaaaaaaugaaaaguagaacuuuguaauacuuuaaucaauaaaauuaau

SEQ ID NO: 66511 - RNA, 62 nt, hsa
aagcauccgguucuaaaauuaauuuguugcagcuuuguaaauauuucuuuaagauucagccu

SEQ ID NO: 66512 - RNA, 62 nt, hsa
gaaguuccagacagaugagaaagcaaaaaguacuuuguaaaguguuauacaaucagaaggug

SEQ ID NO: 66513 - RNA, 62 nt, hsa
acugggguauuguuggcuucuuguguuggaaacuuuguaauguaaaaggaaaaacuggaaau

SEQ ID NO: 66514 - RNA, 62 nt, hsa
ugaggaauugaugagaugauguaugugaaacacuuuguaaccuguaaagcgcugugcacacg

SEQ ID NO: 66515 - RNA, 62 nt, hsa
caaagacucgaauucauuuucucagucauuuccuuuguaacagaguuuuacgacuuagaguc

SEQ ID NO: 66516 - RNA, 62 nt, hsa
cauagaggugauaaguaauaaaacuaugaacacuuuguaaaacauugacauuuuauuuucca

SEQ ID NO: 66517 - RNA, 62 nt, hsa
gcgccuacuucacggaaacuugugccuuuaaacuuuguaaacuuaaacacagccgagaaguu

SEQ ID NO: 66518 - RNA, 62 nt, hsa
uuaaauuauucagugcuaaucauuguuuuuuccuuuguaaauguugauucagaaaaggaaag

SEQ ID NO: 66519 - RNA, 62 nt, hsa
auguuacugccccacccuaacugaucaauguacuuuguaauccucccacccuuaagaagguu

SEQ ID NO: 66520 - RNA, 62 nt, hsa
ccuggauuauucaaaaugauguauguugaagccuuuguaaauugucagaugcugugcaaaug

SEQ ID NO: 66521 - RNA, 62 nt, hsa
uagauuuaaaaagugaaagaaacugcaggcgccuuuguaaaaugcaaaauauuuaauuaaaa

SEQ ID NO: 66522 - RNA, 62 nt, hsa
ccccugucucucaccuccaccaaccccacucacuuuguaacuucaucacugacccggccaau

SEQ ID NO: 66523 - RNA, 62 nt, hsa
acguugaucuccugguagcaugaccuuuuggccuuuguaagacacacagccuuucuguauca

SEQ ID NO: 66524 - RNA, 62 nt, hsa
aacacguagcauuugcaccccuccaaagccaucuuuguaaaggaaaacguauuuguaauuga

SEQ ID NO: 66525 - RNA, 62 nt, hsa
acuacagauugacacguuuuuaauuagcuguccuuuguaagaagucaggaaaucugaugcug

SEQ ID NO: 66526 - RNA, 62 nt, hsa
cuuagaaugcgaaucuguguuaagaaucuagucuuuguaauagaaguuucccaguggcauuc

SEQ ID NO: 66527 - RNA, 62 nt, hsa
aggaacuucagaggcuuuguuuaaacgcaaagcuuuguaaaagccacaaggucugagcugaa

SEQ ID NO: 66528 - RNA, 62 nt, hsa
auacugcuaccuucagggcagaagacacugcucuuuguaacccagccaccaccaaaaagcaa

SEQ ID NO: 66529 - RNA, 62 nt, hsa
guggggagaaaaaaaccaagaggccaccgugccuuuguaaagaaacaaaauaaaguuuguac

SEQ ID NO: 66530 - RNA, 62 nt, hsa
gagcuuuuuggaaauacucagauccuggccgccuuuguaaccuucucuaaacgucaggccug

SEQ ID NO: 66531 - RNA, 62 nt, hsa
aacucugcuuccuuggacagauuuggcaauagcuuuguaagugauguggacauaauugccua

SEQ ID NO: 66532 - RNA, 62 nt, hsa
cuguguuagaaguguugcaaaugcuguacugacuuuguaaaauauaaaacuaaggaaaacuc

SEQ ID NO: 66533 - RNA, 62 nt, hsa
uaguguuuggacagcugauaaauuuaauccuucuuuguaauacuuucuaugugacauuucuc

SEQ ID NO: 66534 - RNA, 62 nt, hsa
gaagagucaucugauucgaggccacucauguucuuuguaacuuaaacuuugaccaagaaauu

SEQ ID NO: 66535 - RNA, 62 nt, hsa
ggcuguuuucuucuggggcuuagucgaaucagcuuuguaauguuaugggacaaaaaucaauu

SEQ ID NO: 66536 - RNA, 62 nt, hsa
gucaccuauaugggauuugccuguuuuaauaacuuuguaaggaauucuugcucuucuagggg

SEQ ID NO: 66537 - RNA, 62 nt, hsa
agcaacucauuuauuucauuuuggucuuaaugcuuuguaaacaggucaaaaaauacugucau

SEQ ID NO: 66538 - RNA, 62 nt, hsa
uccaucccuauucccuccucugaaaugcaccccuuuguaauugaggacaaggugguucugug

SEQ ID NO: 66539 - RNA, 62 nt, hsa
guuuaugucagagcuuuguuguaagccucucacuuuguaaggaaauucuuauuggguagguu

SEQ ID NO: 66540 - RNA, 62 nt, hsa
uuuuuuugcauuuaugaacggcuguuuuucuacuuuguaauugugagacauuuucuugggga

SEQ ID NO: 66541 - RNA, 62 nt, hsa
cuguuaugccuuuuauuuguuugcaaggaugucuuuguaauguguuucaugaauagaauauc

SEQ ID NO: 66542 - RNA, 62 nt, hsa
ucacauaggaauuguucagcaacagaaagauacuuuguaaugagaagguacaaauuugagua

SEQ ID NO: 66543 - RNA, 62 nt, hsa
uuugagaaaaaucugggucuuucuaaaaacugcuuuguaaguuacuuuuucuuuaugacuuc

SEQ ID NO: 66544 - RNA, 62 nt, hsa
cccugcauccccccuccucugccugagugugucuuuguaaugucagcuggcaucauacaaag

SEQ ID NO: 66545 - RNA, 62 nt, hsa
cagggacugugagagacaaccagcagcauccucuuuguaaucacagggcagggaucagaguu

SEQ ID NO: 66546 - RNA, 62 nt, hsa
caggccugaaccccucccgugcuguaauaaaucuuuguaaauaacugcugagacuccucuuu

SEQ ID NO: 66547 - RNA, 62 nt, hsa
cgaacccacacugcaacaggaacugugagagucuuuguaaguaaacugcccugucuagguca

SEQ ID NO: 66548 - RNA, 62 nt, hsa
gcagaccugggacuuuagggcuaaccaguucucuuuguaaggacuugugccucuugggagac

SEQ ID NO: 66549 - RNA, 62 nt, hsa
gacucuacauugggcagccuuuaaauaugauucuuuguaaugcuaaauagccuuuuuuucuc

SEQ ID NO: 66550 - RNA, 62 nt, hsa
auauauacuuuuucauauauaauuagaucuuucuuuguaauuucauauguaguucuucauag

SEQ ID NO: 66551 - RNA, 62 nt, hsa
cuugguugauaacugucuugauacuuuucauucuuuguaagaggccaaaucgucuaaggacg

SEQ ID NO: 66552 - RNA, 62 nt, hsa
aucagugugcuaaaucucucugccuguuuggacuuuguaauuauuuuuuuagcaguaauuaa

SEQ ID NO: 66553 - RNA, 62 nt, hsa
ugaaaacuaccuguggguuaaggauguaguuccuuuguaagggugggcaggccucguaagaa

SEQ ID NO: 66554 - RNA, 62 nt, hsa
aaggacccgcuuccuguugucggugcuaauuccuuuguaauuccagcccccugucgccuguc

SEQ ID NO: 66555 - RNA, 62 nt, hsa
ggcugcaucuuuauauguuacauucauauaaacuuuguaacuuuuuggacauugaaagaugu

SEQ ID NO: 66556 - RNA, 62 nt, hsa
ugagucugggauuauccgcauuguauuuagugcuuuguaauaaaauauguuuuguaguaaca

SEQ ID NO: 66557 - RNA, 62 nt, hsa
uggcacaaauauuuuaucauaugcagucacuucuuuguaaaugauuuuuuguaaagucauug

SEQ ID NO: 66558 - RNA, 62 nt, hsa
aucaccaugacaucucucuccaaaguaacgaccuuuguaagugaagaugcucuuccagagac

SEQ ID NO: 66559 - RNA, 62 nt, hsa
cuccuuugcccugggacaucuguaucucuuggcuuuguaauaaaugcugcauacuuucugga

SEQ ID NO: 66560 - RNA, 62 nt, hsa
cgcccugcugcauuugcucuugucuggauuaacuuuguaauuuauggaguauugugcacaac

SEQ ID NO: 66561 - RNA, 62 nt, hsa
auucagucacaagucauuuuggucauguuggucuuuguaacaaaucaaaauuaccuuauauc

SEQ ID NO: 66562 - RNA, 62 nt, hsa
uuagacuuuuuuuuauaaauagacuuauuuuccuuuguaauguauuggccuuuuagugagua

SEQ ID NO: 66563 - RNA, 62 nt, hsa
uuacaucaagcuaauugugcgagcucaauucacuuuguaagaaaacucucggagaaauaaaa

SEQ ID NO: 66564 - RNA, 62 nt, hsa
uacacaauucuccuucgggaccucaauuuccacuuuguaaaaugaggguggaggugggaaua

SEQ ID NO: 66565 - RNA, 62 nt, hsa
uacugaggaccaaagauacauguaaaauagggcuuuguaaacuccacagggacuguucuaua

SEQ ID NO: 66566 - RNA, 62 nt, hsa
uugguacugcagagucuggguuguagagaacucuuuguaagcaauaaaguuuggggugauga

SEQ ID NO: 66567 - RNA, 62 nt, hsa
accuccccuuuucuauguugcuauuguaaggucuuuguaaaaucuugcaguuuuguaagccc

SEQ ID NO: 66568 - RNA, 62 nt, hsa
gcaauugucuuuuuuuuccuuugaacgugcuucuuuguaaugaccaagguaccgauuucugc

SEQ ID NO: 66569 - RNA, 62 nt, hsa
guacucuccacauuauuuuaaauauuaguugccuuuguaaacaguuuccccucccccacccc

SEQ ID NO: 66570 - RNA, 62 nt, hsa
ccguuucuuaaguauugcgcagauuuguucaacuuuguaaauauggacaucacuuuuuuuuu

SEQ ID NO: 66571 - RNA, 62 nt, hsa
uaguacaugggaaaaacaguaugggaagaguucuuuguaauguaaggaaauaacaauguagu

SEQ ID NO: 66572 - RNA, 62 nt, hsa
aaaaaaaauaaaauuauuuugaauuauucuaccuuuguaaacaauuggcuaaaagaaucauc

SEQ ID NO: 66573 - RNA, 62 nt, hsa
auacaugaucuugaacagcuccuguacuugcucuuuguaaaaaaaaauaaaauuauuuugaa

SEQ ID NO: 66574 - RNA, 62 nt, hsa
cagaaauaugaauaaauaguuuuuguuaaacccuuuguaaaauaccaagguucccguuaaca

SEQ ID NO: 66575 - RNA, 62 nt, hsa
aaauucauguuuacuuuucuagguguaugauacuuuguaaaguugauacuuuccuaagaauu

SEQ ID NO: 66576 - RNA, 62 nt, hsa
auggaaaauguuaaggaagcaaaugguuguaacuuuguaaguacuuauaacaugguguaucu

SEQ ID NO: 66577 - RNA, 62 nt, hsa
ggugguuuuucguucucuuaaauaaucaggugcuuuguaaccaagcacaucggaaccagagg

SEQ ID NO: 66578 - RNA, 62 nt, hsa
ucaaagaugagggccuggcuuccgugcucuggcuuuguaacuuaucuggaagggaaagcaca

SEQ ID NO: 66579 - RNA, 62 nt, hsa
uacuguggauuguacauuuaacuuuggaauggcuuuguaauaaucagucuuaagaaaauguu

SEQ ID NO: 66580 - RNA, 62 nt, hsa
ugcuuuacugccauugcuguaugcuuuacugucuuuguaaaaaucccccucuccccuuuucu

SEQ ID NO: 66581 - RNA, 62 nt, hsa
uauccaugauauucaguacaacucugucauuucuuuguaauauuuaaaaaauauuaguaaag

SEQ ID NO: 66582 - RNA, 62 nt, hsa
aaauguuuugaauuuauaaaauuaauguuuuucuuuguaacauuuauauauauuuuuuaaca

SEQ ID NO: 66583 - RNA, 62 nt, hsa
uuuugauuuguauucaaguacucuucaaguaucuuuguaaugaagguuuggcuacuuguaua

SEQ ID NO: 66584 - RNA, 62 nt, hsa
gaucaguauuccuccucuaucaccuuuuuagacuuuguaagguaaauauuuggacuaacuuu

SEQ ID NO: 66585 - RNA, 62 nt, hsa
auugcugggccauaugaaaaaucaauaguuagcuuuguaagaaacagucaaacuguuuucca

SEQ ID NO: 66586 - RNA, 62 nt, hsa
uaucuaucauacucccaaauuccuucuugcaucuuuguaauuucucacucuuccuucucccu

SEQ ID NO: 66587 - RNA, 62 nt, hsa
guucuguauuuuuaaauugccaagaaaaacaacuuuguaaauuuggagauauuuuccaacag

SEQ ID NO: 66588 - RNA, 62 nt, hsa
accuuauaaaaacagguuccaaauauucacugcuuuguaaaaaugaacaaacaugagacugu

SEQ ID NO: 66589 - RNA, 62 nt, hsa
acugggauagucagguaaacaguuggucaagacuuuguaaagaaauugguuucuguaaaucc

SEQ ID NO: 66590 - RNA, 62 nt, hsa
aguauuugguggucccuaugacuuauacauaacuuuguaaaaagaaaaaaaaauuuuuucug

SEQ ID NO: 66591 - RNA, 62 nt, hsa
aagcacccaucuucacuuggugcugccaucaacuuuguaagauugcauucuauuuauuguga

SEQ ID NO: 66592 - RNA, 62 nt, hsa
auguaggauacuuuuuauuuggggcucauugucuuuguaauuacggagaggaacaaaccauc

SEQ ID NO: 66593 - RNA, 62 nt, hsa
ucauugcuuuacauacuagacauuuuucuucucuuuguaaguagauucaaauuagauaguca

SEQ ID NO: 66594 - RNA, 62 nt, hsa
aucugccuaauuuuucuugaaagcuaaauuuucuuuguaaguuuuuacaaauuguuuaauac

SEQ ID NO: 66595 - RNA, 62 nt, hsa
caggagcaagagaccagaaggaugaucugcuccuuuguaacguuguugagggcccucuuguu

SEQ ID NO: 66596 - RNA, 62 nt, hsa
gugugaaaucuaagcaguaauguacuuucucccuuuguaaagacuuggggaguaaggacauu

SEQ ID NO: 66597 - RNA, 62 nt, hsa
acaucuuauuggauauuagcaauugcacgcugcuuuguaagccacuuuuuaguacucugaca

SEQ ID NO: 66598 - RNA, 62 nt, hsa
cgacuuccucugccaguuauugacacagcucucuuuguaagagaggaaagaaacuaaaccca

SEQ ID NO: 66599 - RNA, 62 nt, hsa
caggugucccggucugcauaagccucgugugccuuuguaaaguccaccuacacuuuugacca

SEQ ID NO: 66600 - RNA, 61 nt, hsa
aucagugauacugaugagaauaaacuaaacgccuuuguaacagccuugccgcaugcucguu

SEQ ID NO: 66601 - RNA, 62 nt, hsa
cgcugggcucgcuggugaccgccacagccccgcuuuguaaccagggaauacacagucauuuc

SEQ ID NO: 66602 - RNA, 62 nt, hsa
cuugaaccccgaccacuaccccagguuucuaacuuuguaacuugcuucugaugugggucccu

SEQ ID NO: 66603 - RNA, 62 nt, hsa
gagaggacagguccucaacaaauggcaugugacuuuguaaguguagaauugcugugagguau

SEQ ID NO: 66604 - RNA, 62 nt, hsa
cccgccccagggcaauguuggacccccuuuuacuuuguaaaguuuguauuuauuccccuuua

SEQ ID NO: 66605 - RNA, 62 nt, hsa
gcccguccuaggaauggauguggggauggucgcuuuguaaugugcugguucucuuuuuuuuu

SEQ ID NO: 66606 - RNA, 62 nt, hsa
ggaaaauucaccaccucuagcuccucacuguucuuuguaauuaacacgcuguugguaaucuu

SEQ ID NO: 66607 - RNA, 62 nt, hsa
cccgccccaaacguccgcuuuccuuuucucuacuuuguaauuuauugaucaguuucuguugg

SEQ ID NO: 66608 - RNA, 62 nt, hsa
ccugcccucuaauuugggggcagcaguuugugcuuuguaagcuucagucuuauuuauagugu

SEQ ID NO: 66609 - RNA, 62 nt, hsa
auaugugggaggcuuucaugagguguguugcacuuuguaacugucuagagcucuugauggaa

SEQ ID NO: 66610 - RNA, 62 nt, hsa
aaaggcaaccaaccacauuagaagucuuggcacuuuguaacggaacggguacuacacuuuau

SEQ ID NO: 66611 - RNA, 62 nt, hsa
guugucuuaaugccauuucauuucacaugguacuuuguaaauuuugacgagaaaguugguug

SEQ ID NO: 66612 - RNA, 62 nt, hsa
uuccaggucaguacguaaagauguaacccauucuuuguaagguucagaauauuucuagaaug

SEQ ID NO: 66613 - RNA, 62 nt, hsa
auauuugcacaaguacaguaacaaucugcuuucuuuguaacaugacacauuugaaaucauug

SEQ ID NO: 66614 - RNA, 62 nt, hsa
aagaaguguaacucaccagccucugcucuuaucuuuguaauaaauguuaaagccagaaguug

SEQ ID NO: 66615 - RNA, 62 nt, hsa
auaauacauauguuguacuuuuauguauuucacuuuguaacaaaguaucuuucaguuuuaua

SEQ ID NO: 66616 - RNA, 62 nt, hsa
accuaaaaaguacaguguguuuaucacgagagcuuuguaagguacuucacuuccacuuuaaa

SEQ ID NO: 66617 - RNA, 62 nt, hsa
uucuacaaaaaaauguuguuaauaaaugucugcuuuguaaaagcaguuuugcaauuuuuuaa

SEQ ID NO: 66618 - RNA, 62 nt, hsa
ugugguugcugugacaguuucguuuucugaaucuuuguaaugcucuuccacccugcucgugc

SEQ ID NO: 66619 - RNA, 62 nt, hsa
aucugaacuaacuugcuuuuagaagucuuuuucuuuguaagcauuguaaaugcuaauaaauc

SEQ ID NO: 66620 - RNA, 62 nt, hsa
guguccccuguccugccccaccgguuugcuggcuuuguaauaacauaagaccauugugguug

SEQ ID NO: 66621 - RNA, 62 nt, hsa
cucuugaagcuuuuucugccuccugauucucucuuuguaaacuauuuucaaauuguuuuuca

SEQ ID NO: 66622 - RNA, 62 nt, hsa
uacaguauuuuccaugguucugccugcacuuacuuuguaaugccacgguugagauugagaga

SEQ ID NO: 66623 - RNA, 61 nt, hsa
gaugugaaucuuacauuccuuuucaucauuuccuuuguaaaaaugacgagugcuggguuuu

SEQ ID NO: 66624 - RNA, 62 nt, hsa
uuucguuuuaaauuuuagauuuuauuuuagugcuuuguaauuaauugggguuuauauugaua

SEQ ID NO: 66625 - RNA, 62 nt, hsa
aauggcuucaaaauaagucacgaacacaaauucuuuguaaauuauguaaauuccuguuuaua

SEQ ID NO: 66626 - RNA, 62 nt, hsa
cuuccccacccagcucuccccugcgccccugucuuuguaaauugacccuucuggaguggggg

SEQ ID NO: 66627 - RNA, 60 nt, hsa
ccuaauaaacaccugcucacuggcuggguauucuuuguaaccaguguuucuggcuccugc

SEQ ID NO: 66628 - RNA, 62 nt, hsa
cauuagaaacauugagaguucaagugcuguuucuuuguaaaaauguauccagaguaguugga

SEQ ID NO: 66629 - RNA, 62 nt, hsa
aagcacguuugggaaggaacagccuaaagaugcuuuguaaagcuguauuuuacccuugagcu

SEQ ID NO: 66630 - RNA, 62 nt, hsa
ugcuucacagaauaaugggaagugacucuagucuuuguaagcaauuuucauucucauuagga

SEQ ID NO: 66631 - RNA, 62 nt, hsa
aauugugugaacuuggaagcacaccaaucuuacuuuguaaauucugauuucuuuucaccauu

SEQ ID NO: 66632 - RNA, 62 nt, hsa
agagaaaaguacaagacagaaaucuucuagcacuuuguaaacacagugaauaaccucuugga

SEQ ID NO: 66633 - RNA, 62 nt, hsa
gucauaggacuggcaaagcaacuguuuaaacccuuuguaaccggggccuugcccccaccucc

SEQ ID NO: 66634 - RNA, 62 nt, hsa
uaucaaacaaaugacuuucauauugcaacaaucuuuguaagaaccacucaaauaaaagucuc

SEQ ID NO: 66635 - RNA, 62 nt, hsa
uaucuuuucaauuaauguaucuguaaaaguuucuuuguaaauacuauguguucugguguguc

SEQ ID NO: 66636 - RNA, 62 nt, hsa
gaacugcagggaacuucucugcuccuccuugucuuuguaaaaagggaccaccucccuggggc

SEQ ID NO: 66637 - RNA, 62 nt, hsa
gagacuggcagcaguggguauaugguaaaagccuuuguaaaacagugcauuuuucagauuug

SEQ ID NO: 66638 - RNA, 62 nt, hsa
uccaacaguggccuucuccgggcuucauaguucuuuguaauauguugaaguuaauuugaauu

SEQ ID NO: 66639 - RNA, 62 nt, hsa
acugcccaaccccaggucuaaguccagucugucuuuguaagcauggaaauaugguguccacg

SEQ ID NO: 66640 - RNA, 62 nt, hsa
ugugucuggacuaaguuaaaagaauuaaaauacuuuguaauguccugggcuuugggaaaugu

SEQ ID NO: 66641 - RNA, 62 nt, hsa
uuaguuuaauuuucuucaaaaugaaaauacugcuuuguaauuacaaaaugagacacaccuau

SEQ ID NO: 66642 - RNA, 62 nt, hsa
uauaucccggaauauuucccuccggcuuucgccuuuguaacucccaucuguggacccaucgu

SEQ ID NO: 66643 - RNA, 62 nt, hsa
uccuaaaaucagguuuacuuaacuuuagauugcuuuguaaauguuuggaaacuuucuuuuac

SEQ ID NO: 66644 - RNA, 62 nt, hsa
aagaacugaagaugagaauacuggucaucuaacuuuguaauuugauuugauuauacuguaaa

SEQ ID NO: 66645 - RNA, 62 nt, hsa
cgaggcuaacgauguagguuucauuucucagacuuuguaauauaaggcaagcccucucucag

SEQ ID NO: 66646 - RNA, 62 nt, hsa
agccacaggccuaagucauuaaaaaauucucccuuuguaaccucagugcuggggacugaggc

SEQ ID NO: 66647 - RNA, 62 nt, hsa
ccucucucauuggccuauacaucucuuaggaccuuuguaaugguguccaugcaccuuuagag

SEQ ID NO: 66648 - RNA, 62 nt, hsa
gccaggcggcauccuuuucuaugaaguguugacuuuguaaaucugcccacacccagcuggcc

SEQ ID NO: 66649 - RNA, 62 nt, hsa
guggggaagguuggagaagaguuagguuugugcuuuguaaucuuggcauccauguuuugugc

SEQ ID NO: 66650 - RNA, 62 nt, hsa
aaguguuacuugugccgggaaaauuuugcugucuuuguaauuuuaaaacuuuaaaauaaauu

SEQ ID NO: 66651 - RNA, 62 nt, hsa
uguuuaucaucagcuccucugaaaugugaucccuuuguaacugugcucaucacuucgccagu

SEQ ID NO: 66652 - RNA, 62 nt, hsa
cuacugaaagcuaucccaggugauacagagcucuuuguaaaccgcagucacacauuaggguu

SEQ ID NO: 66653 - RNA, 62 nt, hsa
uuuuuuuaauuaaagagcaaagcuuuuuauuacuuuguaauuuaaaaaacugaaaaaaaaaa

SEQ ID NO: 66654 - RNA, 62 nt, hsa
gacugccaaauaauauuugaagucaucugucucuuuguaaauuauuuuauaugaccuauaaa

SEQ ID NO: 66655 - RNA, 62 nt, hsa
uagacuccugggaugcccuccucccccucgcccuuuguaauaaccuaaucugagaccgugcu

SEQ ID NO: 66656 - RNA, 62 nt, hsa
cuuagaauucugagaggcaggaacugcucugucuuuguaacuacucaaggccaacugucaca

SEQ ID NO: 66657 - RNA, 62 nt, hsa
caguguucuuggggguggggcugcauccaaggcuuuguaaaccggcuggaccacgucucccu

SEQ ID NO: 66658 - RNA, 62 nt, hsa
caaagaccaguuuguaccgaugaaacgcgcaacuuuguaaucccaacacuuucuauuuucua

SEQ ID NO: 66659 - RNA, 62 nt, hsa; identical to SEQ ID NO: 66188

SEQ ID NO: 66660 - RNA, 62 nt, hsa
gucuuucauagccaaacuuguauauuuaaauucuuuguaauaauaauauccaaaucaucauc

SEQ ID NO: 66661 - RNA, 62 nt, hsa
acauaccgugagaaguuacguaacauuuacuccuuuguaaauguuucccuaucaucagacaa

SEQ ID NO: 66662 - RNA, 62 nt, hsa
auacuuauauagaggaauuuauguaaccaugacuuuguaauuuugagaauuccucccaguga

SEQ ID NO: 66663 - RNA, 62 nt, hsa
aauuaauaaaacaaagucauacaacacauuuucuuuguaauugagaacuagauaacauggua

SEQ ID NO: 66664 - RNA, 62 nt, hsa
cacccccaaugaggucuuaggcagauucuuuacuuuguaauucaaaaggccuguuaaccuuu

SEQ ID NO: 66665 - RNA, 62 nt, hsa
uggaaaaaaaauacuagccuagcuggucauuucuuuguaagguaguuagcaauuuuaagucu

SEQ ID NO: 66666 - RNA, 62 nt, hsa
aaugagauuuuguacauggaguugacauaauacuuuguaaauugaauuuuuuaaagaaauag

SEQ ID NO: 66667 - RNA, 62 nt, hsa
gaaucguucaacugucaaucagccucuugauucuuuguaaauugccaggguggguggguaca

SEQ ID NO: 66668 - RNA, 62 nt, hsa
cacucugcuuccuuggacaauaucaguaauagcuuuguaagugauguggacguaauugccua

SEQ ID NO: 66669 - RNA, 62 nt, hsa
uugcccucccaucccguuuagaguuauuuaggcuuuguaacgauugggggauaaaaagaugu

SEQ ID NO: 66670 - RNA, 62 nt, hsa
uaaaacacuaacggaaacccauggaguuuguccuuuguaaaaauuuuaaacacagugucuug

SEQ ID NO: 66671 - RNA, 62 nt, hsa
acuccaaugguguacaaugucuuuugcacaaacuuuguaacuuuuguuacugugaauucaaa

SEQ ID NO: 66672 - RNA, 62 nt, hsa
guuuuuaauauaaagguguuaagcuuauuuugcuuuguaaguaaagaauguguauauuguga

SEQ ID NO: 66673 - RNA, 62 nt, hsa
cuguuuuguuuuguguuguugaauuugaaagccuuuguaaauaucaauauaauguaccaaug

SEQ ID NO: 66674 - RNA, 62 nt, hsa
aaagcuauauacuugugcuaucuaaagcacuacuuuguaaagaugacuacccaagauuguaa

SEQ ID NO: 66675 - RNA, 62 nt, hsa
guuuucaaugaauuaagaaagauuaaauauaucuuuguaaauuauuuuaugucauaguuuaa

SEQ ID NO: 66676 - RNA, 62 nt, hsa
guguuuugccagccugaacuauauuuaagagacuuuguaaaaaagaaaaauguauauagcug

SEQ ID NO: 66677 - RNA, 62 nt, hsa
auaagauuuugguucuacuugcuauaugccuccuuuguaaaaauaaacaccgaggcuuacug

SEQ ID NO: 66678 - RNA, 62 nt, hsa
uaguauuccugagcaaaacguggcuuucaucgcuuuguaaaaauuugcaucuguuuagaaac

SEQ ID NO: 66679 - RNA, 62 nt, hsa
ccucucagaagcacaagugcauacuaggaaggcuuuguaaacugguuuuguaggcaggcugu

SEQ ID NO: 66680 - RNA, 62 nt, hsa
ugcuuuuagcagauaugaagauuuccuuauuucuuuguaauugugcagauauuuugaaaggc

SEQ ID NO: 66681 - RNA, 62 nt, hsa
ucucaaaaagcuuauuaagccugaaaagccaacuuuguaacauauuuaaaacugcuauuuuc

SEQ ID NO: 66682 - RNA, 62 nt, hsa
gcaaagccaauggagaguauuucacaaaaauacuuuguaaaugagaugccaguaguguucaa

SEQ ID NO: 66683 - RNA, 62 nt, hsa
augaaaagcacauaaauguaaucuacuuugaacuuuguaaaaaugauguguggaggcuauuc

SEQ ID NO: 66684 - RNA, 62 nt, hsa
uacuuuuggacuugaaaauuauuucuucucuacuuuguaaccaaaugcaaucggugugccuu

SEQ ID NO: 66685 - RNA, 62 nt, hsa
auaauuugaauaauuuugagcuaucaaaaugucuuuguaauuuucacaaccgcuguccauug

SEQ ID NO: 66686 - RNA, 62 nt, hsa
guaccccaaugcaaaaccuucgucucuuugugcuuuguaaagcaaacucaagaaaacuggua

SEQ ID NO: 66687 - RNA, 62 nt, hsa
gccguuuggaaguguucuuugauauuacaguucuuuguaaaaugaccugcgaauuacccuaa

SEQ ID NO: 66688 - RNA, 62 nt, hsa
aauccaugguuaucugagauaggagauacaaacuuuguaauucuaauaaugcacucaguuua

SEQ ID NO: 66689 - RNA, 62 nt, hsa
ccugccccucacuucuuaacauauuccugugucuuuguaauggccaaauuucuccuuccacu

SEQ ID NO: 66690 - RNA, 62 nt, hsa
auaacgagagggggaaaaaaagcuacuacugccuuuguaacuuccacuuagccuacuacagg

SEQ ID NO: 66691 - RNA, 62 nt, hsa
guauucugccagccugaacuauauuuaagaaacuuuguaaaaaauaaaaauguauauagcug

SEQ ID NO: 66692 - RNA, 63 nt, hsa
cauaguuaauacagguauaucuauuuuuauuuacuuuguaagaaacaagcucaaggagcuucc

SEQ ID NO: 66693 - RNA, 63 nt, hsa
aguuaauaauaaaugcuguaaauaagcaucucacuuuguaaaaauaaaauauugugguuuugu

SEQ ID NO: 66694 - RNA, 63 nt, hsa
ggcccugccccuggcuccuuaaaugccccgucucuuuguaaacugauauucagccagcaaugc

SEQ ID NO: 66695 - RNA, 63 nt, hsa
gccggccgccuucuccccucucccagggaugcucuuuguaaauaucggaugggugugggagug

SEQ ID NO: 66696 - RNA, 63 nt, hsa
ggggucccuuuucaucccuucucugacagauugcuuuguaaacuuucuuaggccuucccccca

SEQ ID NO: 66697 - RNA, 63 nt, hsa
aaggucaauuauacuuuuguuguucauuagcaucuuuguaaacuauaagacguaguuuuaauu

SEQ ID NO: 66698 - RNA, 63 nt, hsa
gagguuugcaugcugguaaugcaaccuuugaaacuuuguaaaggaaacauauauguauauauu

SEQ ID NO: 66699 - RNA, 63 nt, hsa
aaauguauuauuuuggugacaaaaaugaaggagcuuuguaaauuuuuuuuaaaauuaugaauc

SEQ ID NO: 66700 - RNA, 63 nt, hsa
uguggggaggcauaagcugauguuuguaaagcgcuuuguaaauaaacgugcucucugaaugcc

SEQ ID NO: 66701 - RNA, 63 nt, hsa
uuuuugagauacuauuuucauuuuugugagccucuuuguaauaaaaugguacauuucuauauc

SEQ ID NO: 66702 - RNA, 63 nt, hsa
cccacccacaaugcaugagagugccuauuaaaucuuuguaaguguuaucaaauguuuugaucu

SEQ ID NO: 66703 - RNA, 63 nt, hsa
uuccucuggcagccaauaaaaucaucauaagcccuuuguaauaaaaagcuaguuuccugagug

SEQ ID NO: 66704 - RNA, 63 nt, hsa
uguauauucuauacaaagguacuuguccuuucccuuuguaaacuacauuugacauggauuaaa

SEQ ID NO: 66705 - RNA, 63 nt, hsa
ugcauuauagaggaauguaguaugucauaaguacuuuguaaagauuugacauucaacuguagu

SEQ ID NO: 66706 - RNA, 63 nt, hsa
guaauuucucauauggugcuggaaaugguugggcuuuguaacauuugaaguguuuccauggua

SEQ ID NO: 66707 - RNA, 63 nt, hsa
aguaaagugcaauuucauuggauagcuaaauaucuuuguaagauagagauuguugaaaauucu

SEQ ID NO: 66708 - RNA, 63 nt, hsa
guggcauguugauuucuauggccaacuuucucucuuuguaaaacaaagauugauugauuuucu

SEQ ID NO: 66709 - RNA, 63 nt, hsa
uuuaauacagcagagcauggcaugaccaagcaucuuuguaaaguguuagauggaaaaugcugu

SEQ ID NO: 66710 - RNA, 63 nt, hsa
cauaaugacauaauuuaguuucauguaaugaaacuuuguaaacagaauacauacauguguaua

SEQ ID NO: 66711 - RNA, 63 nt, hsa
guuuacuguuaugagguagaauaaaaaagaauacuuuguaauagccacaaguucuuguuuaga

SEQ ID NO: 66712 - RNA, 63 nt, hsa
uuguguccaguuauauuauuuaaaaaaguguuacuuuguaaaaauuguauauaaagaacugua

SEQ ID NO: 66713 - RNA, 63 nt, hsa
ugaugaacacauuaauccguuaaguaaaauggacuuuguaauuguacagcauaccuaagaaac

SEQ ID NO: 66714 - RNA, 63 nt, hsa
acaucuaaaguguauuaacagugcaugcuuuuacuuuguaaauguggugccaaaucccuguuu

SEQ ID NO: 66715 - RNA, 63 nt, hsa
cugacuucugguuuccacuguaucaguauguaccuuuguaauuguuauuuuuaugucuuuuau

SEQ ID NO: 66716 - RNA, 63 nt, hsa
gggcucugugucagggaaaaccuucuggguggacuuuguaagaauccaguuuccaagguuaga

SEQ ID NO: 66717 - RNA, 63 nt, hsa
ggauucucauagacaacuggguaacuuauauuucuuuguaaucaagacuugagauaucgaagu

SEQ ID NO: 66718 - RNA, 63 nt, hsa
aacaagccuuggaaauaaaucucuauuaaaccgcuuuguaaccaagcucugguacccucuguc

SEQ ID NO: 66719 - RNA, 63 nt, hsa
aacacaucgugaugaugacguccucucaacucucuuuguaaaaauuuuguuauuuuugcuugu

SEQ ID NO: 66720 - RNA, 63 nt, hsa
ccaauuuugugcuaaugagcauugagacugaugcuuuguaagucacaccacaacaaauauuga

SEQ ID NO: 66721 - RNA, 63 nt, hsa
cuauuuuauuuuucuauaaugaucauauauuaccuuuguaauaaaacauuauaaccaaaacau

SEQ ID NO: 66722 - RNA, 63 nt, hsa
aagccucucgagggugaggccuagccuucuugucuuuguaacccacagcagcugguacugugc

SEQ ID NO: 66723 - RNA, 63 nt, hsa
aaggguuuucaauaggguguagaccuccaguaccuuuguaacuaaagucugucuagucauugu

SEQ ID NO: 66724 - RNA, 63 nt, hsa
aaauuuuaucucuuauucaguaaaaaacaacuucuuuguaaucguuauguguguauauguaug

SEQ ID NO: 66725 - RNA, 63 nt, hsa
cauguguagccucuccuggucauagaccagucucuuuguaaguuauuguggcaguucacacag

SEQ ID NO: 66726 - RNA, 63 nt, hsa
agagaaauauaguucacaaugaaauuauauuuucuuuguaaagaaaguggcuugaaaucuuuu

SEQ ID NO: 66727 - RNA, 63 nt, hsa
agugaucuugaaccauuguuuuauauuuuucaccuuuguaaccucauggaaagaggcuuuaca

SEQ ID NO: 66728 - RNA, 63 nt, hsa
aaaaguugaaggccuuauucuacauuucaccuacuuuguaagugagagagacaagaagcaaau

SEQ ID NO: 66729 - RNA, 63 nt, hsa
aacucagcuacacucucugauuuugugcuacuccuuuguaaagucacugccuuaagggggcug

SEQ ID NO: 66730 - RNA, 63 nt, hsa
uugaauuuuugcugguuaaccuuuaucauuuaucuuuguaaugugaacaugcuucagagugua

SEQ ID NO: 66731 - RNA, 63 nt, hsa
aaaaaaaaaaaucacuuggcgcaggagggagaacuuuguaagaagcugcccucuguuuuuuuu

SEQ ID NO: 66732 - RNA, 63 nt, hsa
uccuaaaccaggaagcugcguuagccgaucaggcuuuguaagaucucgccaacagcuagcugc

SEQ ID NO: 66733 - RNA, 63 nt, hsa
uuuguuuccuucucccuuccccuuuucccuguacuuuguaaugucaguguuuauaugaauaug

SEQ ID NO: 66734 - RNA, 63 nt, hsa
caaaaaaggaaucaaauccacgaguggaaaagccuuuguaaauuuaauuuuauuacacauaac

SEQ ID NO: 66735 - RNA, 63 nt, hsa
ccgggcucaucuguaccaaggacauagaacauucuuuguaacccgaauguucccuggauguug

SEQ ID NO: 66736 - RNA, 63 nt, hsa
ccuuagccuaaagaaugaucuguuguuugaaaccuuuguaacuuguuuguaugaguaaagaaa

SEQ ID NO: 66737 - RNA, 63 nt, hsa
acaagccugguaggaaagggcaagucuuuaggucuuuguaagaacuaaagaagaucuguaauu

SEQ ID NO: 66738 - RNA, 63 nt, hsa
aaccacuaucuugcacugcuaacuuuuuucuaccuuuguaaauagaaacauuucugcauaaaa

SEQ ID NO: 66739 - RNA, 63 nt, hsa
auauuuauguucacacaggaauuugguuuacugcuuuguaaauaaaaggaaaaacuccgggua

SEQ ID NO: 66740 - RNA, 63 nt, hsa
aaagcugauuacugucaauaaacagcuucaugccuuuguaaguuauuucuuguuuguuuguuu

SEQ ID NO: 66741 - RNA, 63 nt, hsa
uaauuuuuggaauuugggaagcagacagcuuuacuuuguaagguuggaacagcagcacuauac

SEQ ID NO: 66742 - RNA, 63 nt, hsa
gaugcaugucuuuuaaaaugcaauguaagcauacuuuguaaauaggauuuuuagaauuaaaaa

SEQ ID NO: 66743 - RNA, 63 nt, hsa
ugaauaauguaagguaaagaguugcaugucagucuuuguaauuauuuacacuuuaacuuucuc

SEQ ID NO: 66744 - RNA, 63 nt, hsa
uauguuuaaucaauugcaagcaaauagauuuuucuuuguaacaauuuguucugcagaaggcug

SEQ ID NO: 66745 - RNA, 63 nt, hsa
ccuccugcauuuguugauaccacuaacaaaaugcuuuguaacagacuugcgguuaauuaugca

SEQ ID NO: 66746 - RNA, 63 nt, hsa
uuaugaauuggaagugauguuggcuuuaguuaucuuuguaaauaagguaauuagaaugguaug

SEQ ID NO: 66747 - RNA, 63 nt, hsa
agguuuugaucucuggguaaagaggccguuuaucuuuguaaacacgaaacauuuuugcuuucu

SEQ ID NO: 66748 - RNA, 63 nt, hsa
uauucucagauagauguuacagggcuucuuauucuuuguaauguacucuuuuuaaaucccuuu

SEQ ID NO: 66749 - RNA, 63 nt, hsa
gcuuuuaaaacguauguuuguaugguagagaaacuuuguaaaagaagaauccaagagaaguuu

SEQ ID NO: 66750 - RNA, 63 nt, hsa
cgagaugccuuugacauuuugggcugaaguguucuuuguaaggaaaaccuguuuccuauuuug

SEQ ID NO: 66751 - RNA, 63 nt, hsa
uuuccccuuuaaaaggaauuagcuauagaacugcuuuguaaagaugcuucuugauauuuuacu

SEQ ID NO: 66752 - RNA, 63 nt, hsa
gccaaccagcccaaaauuauuucaucuuguauucuuuguaaaauucucccucaccccacccug

SEQ ID NO: 66753 - RNA, 63 nt, hsa
ucccucccugccucccccagcucccacacuggccuuuguaaauaaauggcguggucuuuguug

SEQ ID NO: 66754 - RNA, 63 nt, hsa
guauaggaagaagcaaagucuacagcacauagucuuuguaagggauugaugugaacacuuuuu

SEQ ID NO: 66755 - RNA, 63 nt, hsa
uuuccaugaaucauuguggugguugagauggagcuuuguaaugggaauaaaacaguaccuuag

SEQ ID NO: 66756 - RNA, 63 nt, hsa
cggucacuauauaaagcaaauaaacuuaaaacacuuuguaaccauguauuuacucugccaggu

SEQ ID NO: 66757 - RNA, 63 nt, hsa
uuuagcaaccugucuuggcccuaaugagaaacccuuuguaagugggcucuggauuuuugguuu

SEQ ID NO: 66758 - RNA, 63 nt, hsa
uauagcuagagaaacaauauuacugccuuugcucuuuguaacuaugucuguuuucuuuuuugu

SEQ ID NO: 66759 - RNA, 63 nt, hsa
uggguugugcauccccaauccagauaauaaagacuuuguaaaacaugaauaaaacacauuuua

SEQ ID NO: 66760 - RNA, 63 nt, hsa
gcggcugagcuccagccaccccgcagucacuuucuuuguaacaacuuccguugcugccaucgu

SEQ ID NO: 66761 - RNA, 63 nt, hsa
auggcuaauuuucaguugcuaauuaauuagcagcuuuguaauacuugauuugggagcauuuac

SEQ ID NO: 66762 - RNA, 63 nt, hsa
uguucuguuuggcacuuguauuuaauucuucaccuuuguaagacauuuguauauuguggaugu

SEQ ID NO: 66763 - RNA, 63 nt, hsa
ugucgggagauugaaagauguuuuuguuucuuucuuuguaaaggccuuggauauugaaaaaau

SEQ ID NO: 66764 - RNA, 63 nt, hsa
ugggaaagaggucaacugagauuuggaaaucaucuuuguaauauuugcaaauuauacuuguuc

SEQ ID NO: 66765 - RNA, 63 nt, hsa
ucagaaaaccacaguguguuuucauauuuggaacuuuguaauagcgggaguagcaguagucca

SEQ ID NO: 66766 - RNA, 63 nt, hsa
uaguguauuucuuucuugaauuucagucugcugcuuuguaaaaaauaacuguaauugauauuu

SEQ ID NO: 66767 - RNA, 63 nt, hsa
ucagaccagaauuuucuuugucccaugaggugucuuuguaagucagcaugcucuugcuugaac

SEQ ID NO: 66768 - RNA, 63 nt, hsa
auuuuccugaaauacauuugcaaaauaaggcugcuuuguaaucaaggaauauuuuuauugauu

SEQ ID NO: 66769 - RNA, 58 nt, hsa; identical to SEQ ID NO: 66050

SEQ ID NO: 66770 - RNA, 63 nt, hsa
auccauuuguacaugguuuacauguuguggaugcuuuguaaacauuuuccuguauguuuaaau

SEQ ID NO: 66771 - RNA, 63 nt, hsa
aucuggguuaaguguuuaucauauauauggguacuuuguaauaucuaaaaacuuagaaacgga

SEQ ID NO: 66772 - RNA, 63 nt, hsa
gacauuguuaccaaccauuaauuggcucaggaccuuuguaauuuuuauuuaacuauaugaguu

SEQ ID NO: 66773 - RNA, 63 nt, hsa
uaaacuucagugucccaccuugaccaaaaucagcuuuguaacuguuuucaaggaggugcuuag

SEQ ID NO: 66774 - RNA, 63 nt, hsa
caaacaagaagaccucaugagagagguaaacaccuuuguaaagaaucuguaaccaauaccaug

SEQ ID NO: 66775 - RNA, 63 nt, hsa
uacacagcuuuugcauacuuacaguuucuguuccuuuguaauaacuuuaacuugcaccuuuga

SEQ ID NO: 66776 - RNA, 63 nt, hsa
ccaaaccauaccacacacauuaucauuguuaaacuuuguaaaguauuuaagguacauggaaca

SEQ ID NO: 66777 - RNA, 63 nt, hsa
aucuaaauuucuguaguagagagagccguagcccuuuguaaaggcuuucguucguccaaacaa

SEQ ID NO: 66778 - RNA, 63 nt, hsa
ugagcugugagauggauuuauuuuuaaaugcuacuuuguaaaggugaccuuuaaaaaauaaaa

SEQ ID NO: 66779 - RNA, 63 nt, hsa
aaucuuuacaccuccugugugguuacaaguuaacuuuguaaguagcguaccuuccuuccuuaa

SEQ ID NO: 66780 - RNA, 63 nt, hsa
uuagaacaaauaagguauauuuuuuagaaucaacuuuguaagcacuauaaaaucuuuaauaag

SEQ ID NO: 66781 - RNA, 63 nt, hsa
acaagcucgaauuauuccucauuguauagccugcuuuguaaacuaguuuacaauuugcaggcu

SEQ ID NO: 66782 - RNA, 63 nt, hsa
uccucuuccuccuccacuucccacuuauugucacuuuguaauauucagagagcacuuggauua

SEQ ID NO: 66783 - RNA, 63 nt, hsa
ccuauaauagaaaauagcagacaacauaaacaucuuuguaaauaucaaaccuaauacauuucu

SEQ ID NO: 66784 - RNA, 63 nt, hsa
aauaucaaaaggaagauucuuccauuaaauugccuuuguaauaugagaauguauuaguacaaa

SEQ ID NO: 66785 - RNA, 63 nt, hsa
uaugccuaauacucacacgcaacauuucuuguacuuuguaagucguuugcgagaaugcagacc

SEQ ID NO: 66786 - RNA, 63 nt, hsa
guuaacuuauugcuuuguaucuugggaaaaaaacuuuguaaauaaguuauaaaguuucuuuga

SEQ ID NO: 66787 - RNA, 63 nt, hsa
ucacacuagcauagagaauguguugaaauuuaacuuuguaagcuuguaugugguuguugaucu

SEQ ID NO: 66788 - RNA, 63 nt, hsa
uggcgccuccucucuacuuucauggacuuguuccuuuguaauagugcaauuugguuuuguuuu

SEQ ID NO: 66789 - RNA, 63 nt, hsa
uucacuagauuucuacguagugaucugcuuuuacuuuguaauuuguaguucucaaaagacuuu

SEQ ID NO: 66790 - RNA, 63 nt, hsa
aucuauguugaauccuuuuauaaaccaguaucacuuuguaauauaaacaccuauuuguacuua

SEQ ID NO: 66791 - RNA, 63 nt, hsa
gaccagccagaccucaggucuucacucuuucuucuuuguaaacuaugucauguggaaagauuu

SEQ ID NO: 66792 - RNA, 63 nt, hsa
agauuuauuccuuuguuacuucucuaauucuuccuuuguaaaaaaaaaaaaaagcaacacuuu

SEQ ID NO: 66793 - RNA, 63 nt, hsa
uuuaaauucaggcuacugcuucaaucucaauugcuuuguaagugaaaaacaugacccagagga

SEQ ID NO: 66794 - RNA, 63 nt, hsa
accauuaaaaguuggggcuccuacucuccuuugcuuuguaaauucaaaaguugggggugggua

SEQ ID NO: 66795 - RNA, 63 nt, hsa
uuuguaccggcacgggauauggaacgaaaacugcuuuguaaugcaguuugugacauuaauagu

SEQ ID NO: 66796 - RNA, 63 nt, hsa
uuuuggaucucauuguugauauaccugaauuuacuuuguaagagauuuuaacuucacuucaug

SEQ ID NO: 66797 - RNA, 63 nt, hsa
uuagaggauagccuugaggcuagauuaucuuuccuuuguaagauuauuugaucagaauauuuu

SEQ ID NO: 66798 - RNA, 63 nt, hsa
gagaagcauggcucaccagccagccucuguggucuuuguaauuagaagcuucagaacucacua

SEQ ID NO: 66799 - RNA, 63 nt, hsa
auaaaaguacauuuuauaaaccauuuacuauggcuuuguaacaauugcauacccauauuuuaa

SEQ ID NO: 66800 - RNA, 63 nt, hsa
cauguaacuuaauuacugcuaguuuugaaaugucuuuguaagaguagggucgccaugaugcag

SEQ ID NO: 66801 - RNA, 63 nt, hsa
uggagcuuuguauucugugacugcuauggcuagcuuuguaaccaaagcaaaaugagaauuuca

SEQ ID NO: 66802 - RNA, 63 nt, hsa
uguacaaaagcugcaguaaccugucuucaguuacuuuguaauuuauuguggcaugagauaaga

SEQ ID NO: 66803 - RNA, 63 nt, hsa
uagcaugcaaggguaagaaugaguuuuuaacugcuuuguaagaaaauggaaaaggucaauaaa

SEQ ID NO: 66804 - RNA, 63 nt, hsa
caaucuaaauauggaauuugguaaauuagaauacuuuguaauuuguaagaccaaauucauacu

SEQ ID NO: 66805 - RNA, 63 nt, hsa
uuauaagcagcugugaaauuuaagugaaauguucuuuguaaacauuuguacuauuuuaaauga

SEQ ID NO: 66806 - RNA, 63 nt, hsa
cugcacagggcuuauagcugcuucauucugcuacuuuguaacuaggagccauugcauuuauua

SEQ ID NO: 66807 - RNA, 63 nt, hsa
uugauggcaucccuacagucuucuucacuugaacuuuguaaaacugcauauggaccuguaauc

SEQ ID NO: 66808 - RNA, 63 nt, hsa
uuuuguaauauucucuccgccauugagaaugugcuuuguaagauccacccccugcccacaaaa

SEQ ID NO: 66809 - RNA, 63 nt, hsa
ugacaauacaccuuccccacccuugagaaggugcuuuguaauauucuccccacccaccccacg

SEQ ID NO: 66810 - RNA, 63 nt, hsa
acauguuccugggaucacugaugacuuuuuauacuuuguaaagacaauuguuggagagccccu

SEQ ID NO: 66811 - RNA, 62 nt, hsa; identical to SEQ ID NO: 66092

SEQ ID NO: 66812 - RNA, 63 nt, hsa
ugagccuuguaauucuaaaugaauguuuacacucuuuguaagaguggaaccaacacuaacaua

SEQ ID NO: 66813 - RNA, 63 nt, hsa
augauaccaugacaaaaaucuuuccugaauugucuuuguaaaaguauuauugaauuuucaauu

SEQ ID NO: 66814 - RNA, 63 nt, hsa
gaaggaaaaaguaagaugagaaauaaagaaagccuuuguaaggugguuuuaaaagccuuauau

SEQ ID NO: 66815 - RNA, 63 nt, hsa
uuacaugauuuauaauuucacugauugagauuacuuuguaaguagcuguucagaagaauaaaa

SEQ ID NO: 66816 - RNA, 63 nt, hsa
gguaacauaauggugaugguuggccauuugagucuuuguaaccuaggaaagacaaaggucuga

SEQ ID NO: 66817 - RNA, 63 nt, hsa
aauggcaagucuagaacucuccgaauccuacagcuuuguaauuuuuuuucuacaaaugucuaa

SEQ ID NO: 66818 - RNA, 63 nt, hsa
acugauucaauuauaauuguaauggauuuuugacuuuguaauggauucuuuucaucaaaaagc

SEQ ID NO: 66819 - RNA, 63 nt, hsa
ucuaguugucuguguauaauauuuccaaagcuccuuuguaaaccccgucuccuuucauucaga

SEQ ID NO: 66820 - RNA, 63 nt, hsa
ugguaggguagagacuacccuagacaucugcaucuuuguaaguuagccagacaauaaagaaaa

SEQ ID NO: 66821 - RNA, 63 nt, hsa
ucuuuauauuugucuuauuuugaaucuuauccacuuuguaagaacaaguuuauguuugagcaa

SEQ ID NO: 66822 - RNA, 63 nt, hsa
uuguuaguagacagugguguccucaaaauuuuacuuuguaauucuucagaauugauuauuuuu

SEQ ID NO: 66823 - RNA, 63 nt, hsa
cuuuugguuucugcuucucucuucucucaaccccuuuguaaugguuugggggcagacucuuaa

SEQ ID NO: 66824 - RNA, 63 nt, hsa
ucacuguuccucugucauacuguaucuggaaugcuuuguaauacuugcaugcuucuuagacca

SEQ ID NO: 66825 - RNA, 63 nt, hsa
aguaugacauaaugauuugcuauguuguaaaaucuuuguaaaaaauuucuauauaaaaauauu

SEQ ID NO: 66826 - RNA, 63 nt, hsa
ucuuugcccaauaaccacauuuuauuucuucagcuuuguaaauaccagguucuaggaaauguu

SEQ ID NO: 66827 - RNA, 63 nt, hsa
ucuaauuuuuaaauuuuaaguuauuuuguacagcuuuguaaauucuuaacauuuuuauauugc

SEQ ID NO: 66828 - RNA, 63 nt, hsa
acuguagugcagugauccuuuacagguuuauuucuuuguaaaaaaaaauaauaauaauuugaa

SEQ ID NO: 66829 - RNA, 63 nt, hsa
uugaggcccaucucuccagccagccacugccuucuuuguaauauuaagugccuugagcuggaa

SEQ ID NO: 66830 - RNA, 63 nt, hsa
ugccgucucaaggcauuuacgguuuaaaaagaccuuuguaauuacuaacgaaaaugcaaagca

SEQ ID NO: 66831 - RNA, 63 nt, hsa
agguguguuucugagaauuuguuugaauuaguucuuuguaaauaaaacaggauuuugaaugca

SEQ ID NO: 66832 - RNA, 63 nt, hsa
acagggaauaaaagcuuuucaacucaaccacuucuuuguaagacaaaacugaaguaucugugu

SEQ ID NO: 66833 - RNA, 63 nt, hsa
aggguuuucuguuuuuugauggaggugaaaucucuuuguaauccacuagguuuucaucguaaa

SEQ ID NO: 66834 - RNA, 63 nt, hsa
guagacucuuuuauaccuguugucacaagaaagcuuuguaaaaccagacagugaagcaaaaug

SEQ ID NO: 66835 - RNA, 63 nt, hsa
aagucaaucauuuaauuuuugggaccucaguuucuuuguaaguaaaauaacaccugcuuguuc

SEQ ID NO: 66836 - RNA, 63 nt, hsa
gggacugggucacuauugugguuuuuacuauaacuuuguaaauuaacuuaauuuugcugacuu

SEQ ID NO: 66837 - RNA, 63 nt, hsa
ggcuuugaaucaacuuaagggaaaaccuuuugucuuuguaaaaauaaaagccuguagcuaagg

SEQ ID NO: 66838 - RNA, 63 nt, hsa
agaauaugcccgacuccccaugacaagacagaacuuuguaacaaacaguaccaauuuauuuug

SEQ ID NO: 66839 - RNA, 63 nt, hsa
uuuguuccugccccacccuaacugaucaauguacuuuguaaucucccccacccuuaagaaggu

SEQ ID NO: 66840 - RNA, 63 nt, hsa
uacuuuguaaucucccccacccuuaagaagguacuuuguaaucuuccccacccuuaagaaggu

SEQ ID NO: 66841 - RNA, 63 nt, hsa
uacuuuguaaucuuccccacccuuaagaagguucuuuguaauucuccccacccuugagaaugu

SEQ ID NO: 66842 - RNA, 63 nt, hsa
aaacguguucuuuuagaccaguuuucuaauaagcuuuguaaaauguacuauccaaauuagaag

SEQ ID NO: 66843 - RNA, 63 nt, hsa
uggagaacauuaggacaaaaagucaccaacuuacuuuguaacauuuuaauaaugacuuaaggg

SEQ ID NO: 66844 - RNA, 63 nt, hsa
gcccauacaaguauucauuuuuucuacccuuuccuuuguaaguuccugggcaaccuuuuugau

SEQ ID NO: 66845 - RNA, 63 nt, hsa
aggugugugugugucuauguguguguuucagcacuuuguaaauagcaagaagcuguacagauu

SEQ ID NO: 66846 - RNA, 63 nt, hsa
gggugaaggguacccaggaccacucuguaccaucuuuguaacuuccugugaauuuauaauaau

SEQ ID NO: 66847 - RNA, 63 nt, hsa
aaaaauaauugcuuugacauugucuauaugguacuuuguaaagucaugcuuaaguacaaauuc

SEQ ID NO: 66848 - RNA, 63 nt, hsa
auuguuugaaagccuccauauaguuagauugugcuuuguaauuuuguuguuguugcucuaucu

SEQ ID NO: 66849 - RNA, 63 nt, hsa
uaaaaguguguuugaaaaauauuaucuuggguucuuuguaaaauuuauuuuuuacaugcugaa

SEQ ID NO: 66850 - RNA, 63 nt, hsa
ugggaauaaaaagcugugaaauuguucaaccuacuuuguaaccaaagaagcaaagcuguguaa

SEQ ID NO: 66851 - RNA, 63 nt, hsa
uaaugacuagcuuuuaaaaauacaguacaaagacuuuguaaaugugauucagggcccccagca

SEQ ID NO: 66852 - RNA, 63 nt, hsa
aggguccuccaggcaucagcuguuguguccucucuuuguaacaguggacaggacagaccaccc

SEQ ID NO: 66853 - RNA, 50 nt, hsa; identical to SEQ ID NO: 66134

SEQ ID NO: 66854 - RNA, 63 nt, hsa
gcuacauuuuaaaagcaauuguauuaguaagaacuuuguaaauaaauaccuaaaacccaagug

SEQ ID NO: 66855 - RNA, 63 nt, hsa
gauccgugcuuugucggccagcguuucugcagucuuuguaaaggccccacgagagcgggccag

SEQ ID NO: 66856 - RNA, 63 nt, hsa
acaguaagauaucucaaugaaccauaaauucaacuuuguaaaaaucuuuugaagcauagauaa

SEQ ID NO: 66857 - RNA, 63 nt, hsa
ugcauauacuucuugggauauaguaucuaagaccuuuguaaacugccauuuuguuagguaugg

SEQ ID NO: 66858 - RNA, 63 nt, hsa
ugcagugccaccugaguuccaaauuuuaccauucuuuguaaacaguuggauggauuaugauaa

SEQ ID NO: 66859 - RNA, 63 nt, hsa
uauaaaaucuuagaaagaaacauaggcauagaucuuuguaaccuugaauuaggcagugguuuc

SEQ ID NO: 66860 - RNA, 63 nt, hsa
gauugaucaucugccuuaacgugaucggagaugcuuuguaaucuacuguccagcugaaagcac

SEQ ID NO: 66861 - RNA, 63 nt, hsa
agcugcugccaagcacauaucccuaugacaacacuuuguaaaagccgcggggcccccauacag

SEQ ID NO: 66862 - RNA, 63 nt, hsa
guuacugcuuauugaucacugcuagacuguaagcuuuguaagggcagggaccauauaagccuu

SEQ ID NO: 66863 - RNA, 63 nt, hsa
uuuuagccucuacaugcuaggaucacaggaagacuuuguaaggacaguuuaaguucuccugca

SEQ ID NO: 66864 - RNA, 63 nt, hsa
gggacuggagggagacuuuuauacguuuuguaccuuuguaaccagagagaugcuuauguuauu

SEQ ID NO: 66865 - RNA, 63 nt, hsa
uggaaaaacaacagcgacaaaaaagucaagaaacuuuguaaaauaucgugugugugauuccuu

SEQ ID NO: 66866 - RNA, 63 nt, hsa
cagggaucugggguggucagggcucaggcuucacuuuguaaaccaggugggggcaucucacag

SEQ ID NO: 66867 - RNA, 63 nt, hsa
ggguauauacaaauuaaaacugagacacauuggcuuuguaaaucaguauguuuuuacauaaug

SEQ ID NO: 66868 - RNA, 63 nt, hsa
ucuuuuuuuauauaaugaaccacucuuuuuuaacuuuguaaccuucccuugaagacagaauuu

SEQ ID NO: 66869 - RNA, 63 nt, hsa
uuucauuuaccgaaugagaauucuucauuuucacuuuguaauuuuucuuaguauauagucagc

SEQ ID NO: 66870 - RNA, 63 nt, hsa
cauccacauccaccuucggaauacauuaacuuccuuuguaauuuauuugaaaguaguguuaaa

SEQ ID NO: 66871 - RNA, 63 nt, hsa
aagccacaaacaguucaucauuuggugcuuagucuuuguaagggcucucugugguuugacuua

SEQ ID NO: 66872 - RNA, 63 nt, hsa
aagaccucuaugaaugaauguaucagagaaugucuuuguaacuguuuaauucaaucuguaaua

SEQ ID NO: 66873 - RNA, 63 nt, hsa
ccaagguacuuuuuuauuuaaaaaaaaacauaacuuuguaaauauuacccuguaauauuauau

SEQ ID NO: 66874 - RNA, 63 nt, hsa
ggcacacacggaguggcuuugacagauugauaacuuuguaagaugggagacaucugaaauauu

SEQ ID NO: 66875 - RNA, 63 nt, hsa
ugggaaaaaaaaaauccuugcuaaugugguuuccuuuguaaaccaggauucuuauuugugcug

SEQ ID NO: 66876 - RNA, 63 nt, hsa
gguugauuaaaucuauaaguuuuuaugugaggacuuuguaagucagcauaaaaaugaaaaguu

SEQ ID NO: 66877 - RNA, 63 nt, hsa
cauauucaaauuccguauaccaaaauccauuuccuuuguaacaagaauuuaccaguaacugug

SEQ ID NO: 66878 - RNA, 63 nt, hsa
aaauccuccacucucuggaaggagacugaggggcuuuguaaaacauuagucaguugcucauuu

SEQ ID NO: 66879 - RNA, 63 nt, hsa
cagaaccucacuugguaccauauagaucaaaagcuuuguaaccacaggaaaaaauaaacucuu

SEQ ID NO: 66880 - RNA, 63 nt, hsa
uggaauauuccccuaucucuagaauuuuaagugcuuuguaaugggaacugccucuuuccuguu

SEQ ID NO: 66881 - RNA, 61 nt, hsa
agccaaaacaaccaaacuauuuucuaaauaaaccuuuguaaucuaauguugggugccgcag

SEQ ID NO: 66882 - RNA, 63 nt, hsa
uauuuuauguugaauuauuuuuggagcugaaaucuuuguaauauuaaagcaacuaguuucuaa

SEQ ID NO: 66883 - RNA, 63 nt, hsa
cuuauguuuugccacaguuaacccauugugcuucuuuguaaucaaacaguuugugggagaaug

SEQ ID NO: 66884 - RNA, 63 nt, hsa
auuaggaugugggcugguuugcuuuucuaccaccuuuguaauuuuauguaucccaucuccuuu

SEQ ID NO: 66885 - RNA, 63 nt, hsa
ugcaauuuuuuucaggaugcaaaggcaauuauucuuuguaagcgggacauuuagaauauauuu

SEQ ID NO: 66886 - RNA, 63 nt, hsa
gcuuaaaaaagcuaaucccuaaaauaguuagaucuuuguaaaugcauauuaaauaauaaagua

SEQ ID NO: 66887 - RNA, 63 nt, hsa
uaaugcaguuuuuaaaaaccuguaucugacccacuuuguaauuuuugcuccaauauccauucu

SEQ ID NO: 66888 - RNA, 63 nt, hsa
uuacugcaucaucuguuuguaaucauuaucucacuuuguaaauaaaaacacaccuuaaaacau

SEQ ID NO: 66889 - RNA, 63 nt, hsa
uuaugaauugaguccacaaaggaacacaaaacucuuuguaauucuguuaaaucuuuuauguag

SEQ ID NO: 66890 - RNA, 63 nt, hsa
aacuuauuagaaacccaaauugggacaacagugcuuuguaaauuguguugucuucagcaguca

SEQ ID NO: 66891 - RNA, 63 nt, hsa
uuucuugcucaguuguuucaggcaagcccaagacuuuguaauuuuuaaagggcccaagauuuu

SEQ ID NO: 66892 - RNA, 63 nt, hsa
gauuuaaaaagguuguauuacauauuguuuaaacuuuguaaguagaaauauaucuguuauaau

SEQ ID NO: 66893 - RNA, 63 nt, hsa
auauuacuguuucacauguacagcuuucuacuucuuuguaagaacaccaaccaaccaagguuu

SEQ ID NO: 66894 - RNA, 63 nt, hsa
uaggcugcuuuggaaauaauucccauauccuugcuuuguaaguugguaauaucacuaugcauu

SEQ ID NO: 66895 - RNA, 63 nt, hsa
cuggcgcucaugggcccugguguuugcaccgcacuuuguaaucagucccgugguugucuguac

SEQ ID NO: 66896 - RNA, 63 nt, hsa
agucagauuuuuaaaguuuuguacaaaguuuuccuuuguaaucacucccauuuuuacuuaaca

SEQ ID NO: 66897 - RNA, 63 nt, hsa
gguaaccuuaaagacagaccccucuaaagaacgcuuuguaaauacaugugagguauagccacc

SEQ ID NO: 66898 - RNA, 63 nt, hsa
cucuuuuggauuuuuuuaagguauuugcuaagucuuuguaaacggaaauugaaaaugaccugg

SEQ ID NO: 66899 - RNA, 63 nt, hsa
cauagcagaaaaaccuagacccaccuagugaaacuuuguaagaacuccagggcaaaaacgaac

SEQ ID NO: 66900 - RNA, 63 nt, hsa
uaaaugucgcuucuucaagugaaugauucugcacuuuguaaacagcacugagauuuauuuuaa

SEQ ID NO: 66901 - RNA, 63 nt, hsa
gugaaaaacaguuuguauaguuggaauauuugucuuuguaauuacuugugauguuuuaaaaua

SEQ ID NO: 66902 - RNA, 63 nt, hsa
uuauaguaaaagugcaaucauauggauggcuaacuuuguaaucucuacaaauaauuuaccuua

SEQ ID NO: 66903 - RNA, 63 nt, hsa
ugcucguuagcauggaagacuucuccauucuaucuuuguaaaacagacaagauaugcacuuga

SEQ ID NO: 66904 - RNA, 63 nt, hsa
aaaggaagacauaaguguugugauuaguagaagcuuuguaaucauaacacaaugaguaauucu

SEQ ID NO: 66905 - RNA, 63 nt, hsa
auguguguguguaguuacuuaaagguuauuccucuuuguaauaggaaacuauaugggaugaac

SEQ ID NO: 66906 - RNA, 63 nt, hsa
aauuuuaaguucuagccccaugauaaccuuuuucuuuguaauuuaugcuuucauauauccuug

SEQ ID NO: 66907 - RNA, 63 nt, hsa
ugccuucuuauuuuacuucuuuuagcuguuuaacuuuguaagaugcaaagagguuggaucaag

SEQ ID NO: 66908 - RNA, 63 nt, hsa
ccuaaauaauaauaaaaaaaaaagcccuuuaaacuuuguaaggaaauauuuuuugauuuugcg

SEQ ID NO: 66909 - RNA, 63 nt, hsa
gcccaaguaauucacuacagccuaaagccuugccuuuguaauuugacuucugacauguuggca

SEQ ID NO: 66910 - RNA, 63 nt, hsa
ugcaagagucugauucuuuaaguauauuaaucucuuuguaaucucuucugaaaucauuguaaa

SEQ ID NO: 66911 - RNA, 63 nt, hsa
agcuuuguagcagaauauauuugcagcuauugacuuuguaauuuaggaaaaauguauaauaag

SEQ ID NO: 66912 - RNA, 63 nt, hsa
gaguuaaugugcugagcauuuuuuuaaaagaagcuuuguaauaaaacauuuuuaaaaauuguc

SEQ ID NO: 66913 - RNA, 63 nt, hsa
gggcagguuagaagucauuguauaauuuguaggcuuuguaaugauugaaugcaagcguggaaa

SEQ ID NO: 66914 - RNA, 51 nt, hsa; identical to SEQ ID NO: 66195

SEQ ID NO: 66915 - RNA, 63 nt, hsa
aguuucucucaccuucuugaaggcauuuacagucuuuguaagcuuuucuccuagauuuucccu

SEQ ID NO: 66916 - RNA, 63 nt, hsa
uggaaaacagugccaaaccuccacagcucauuucuuuguaauauaaucagaaugaaaaauaau

SEQ ID NO: 66917 - RNA, 63 nt, hsa
gugcuacuauaauaaguuuuucacgagaacaaacuuuguaaaucuuccauaagcaaaaugaca

SEQ ID NO: 66918 - RNA, 63 nt, hsa
aucuuggauuuauuaugaagaacuuuguaguugcuuuguaauuucccauaaauugucuuugaa

SEQ ID NO: 66919 - RNA, 63 nt, hsa
ugauuuuagaaauaagauaaucaacguacaacucuuuguaaaacaaaagcaacuuugggugag

SEQ ID NO: 66920 - RNA, 63 nt, hsa
acuugaagcuuuccaauggcgcuucucuauggacuuuguaaauaaguuauaucuuuguaauuu

SEQ ID NO: 66921 - RNA, 63 nt, hsa
cgcuucucuauggacuuuguaaauaaguuauaucuuuguaauuuuccugcuacuuuaucauuu

SEQ ID NO: 66922 - RNA, 63 nt, hsa
aaaaguuauaugcuguaguuuuuaguauuuugucuuuguaauuuacagaaguuauuggagaaa

SEQ ID NO: 66923 - RNA, 63 nt, hsa
caaguccucaucuguuauauaaaauccuuucugcuuuguaaguuuucucuuuuugggauuuuc

SEQ ID NO: 66924 - RNA, 63 nt, hsa
uuccccucccauguugucgcacugaucacacugcuuuguaauuauuuucuuuauuguugguaa

SEQ ID NO: 66925 - RNA, 63 nt, hsa
gaauguuuuguugggcuguguugaacauuauuucuuuguaaaugaauguuguaggaaugagga

SEQ ID NO: 66926 - RNA, 63 nt, hsa
auaacaugugauuauaauuuuucuuagcauuuucuuuguaaagaacuacaauauaaacuaguu

SEQ ID NO: 66927 - RNA, 63 nt, hsa
guacaguauguaacugcgggaaacccacugccccuuuguaagcuguggaacccaaacuguaug

SEQ ID NO: 66928 - RNA, 63 nt, hsa
uuuaauaauuuugauugaaacccuuuaacaacucuuuguaaauuuuaacucauuuuaguugau

SEQ ID NO: 66929 - RNA, 63 nt, hsa
accaauuuguacauuuuaauuauucaauuucuacuuuguaaaaauagggaaauuauuugaagu

SEQ ID NO: 66930 - RNA, 63 nt, hsa
ugaauagcaaaugagaaaauguauauaaaagcacuuuguaaauuguaaaaguaguacagaugu

SEQ ID NO: 66931 - RNA, 63 nt, hsa
uucuacguauaaacacucuugaauagacuuccacuuuguaauuagaaaauuuuauggacagua

SEQ ID NO: 66932 - RNA, 63 nt, hsa
auuuugugaacacuuuugaaaauguacauguuccuuuguaauugacacuauauauuucuuaau

SEQ ID NO: 66933 - RNA, 63 nt, hsa
gacuccaaugccuguacugugucuacugcaccacuuuguaaacacuucaauuuacuaucuuug

SEQ ID NO: 66934 - RNA, 63 nt, hsa
gaucccugagcuuucccaguagccuccaguuuccuuuguaagacccagggaucacuuagccau

SEQ ID NO: 66935 - RNA, 63 nt, hsa
ccugagagccagccugacauuagacagaauacccuuuguaauacauuggaaauuuuuacucau

SEQ ID NO: 66936 - RNA, 63 nt, hsa
ugauucauucauuauucuaguccugcuuuaguccuuuguaauuugugguaauuaugcuuuucu

SEQ ID NO: 66937 - RNA, 63 nt, hsa
aaauauuuuaauuacuauuuaaauaucucuuuacuuuguaauccuaugcauuuuacgcauuaa

SEQ ID NO: 66938 - RNA, 63 nt, hsa
gcugguuuauguucuaggaacucuucaugagcacuuuguaaacacccucuugcuuaauccucc

SEQ ID NO: 66939 - RNA, 63 nt, hsa
accuuuacaauuaaacuaaauauugugcaaccgcuuuguaaauuaauaugaagaagauauauc

SEQ ID NO: 66940 - RNA, 63 nt, hsa
uaacgugaauauuuauacaguagccucuucaggcuuuguaauuuucauuccaaaaaugcccgg

SEQ ID NO: 66941 - RNA, 63 nt, hsa
ugauauauauuuuuuuuaaugcaggaaaguauacuuuguaaggagcagauuuuuuuguucuca

SEQ ID NO: 66942 - RNA, 63 nt, hsa
agcacauuccaaacuuuagcaacaguuaucacacuuuguaauuugcaaagaaaaguuucaccu

SEQ ID NO: 66943 - RNA, 63 nt, hsa
aaaagaccaguaacuuuguuuuucaaaauuagucuuuguaacauagaauucaugaguguuuac

SEQ ID NO: 66944 - RNA, 63 nt, hsa
gaacuugcuucccuuuucacuaauuuugcuaaacuuuguaaugcacauucuuagcauauaacu

SEQ ID NO: 66945 - RNA, 63 nt, hsa
aaaaauauccaaggaucagagucucuuucuaagcuuuguaagcuaagcaauaguuuauguccu

SEQ ID NO: 66946 - RNA, 63 nt, hsa
uuuuggaaggucugaaaacuugcacagggucaucuuuguaauuauauaaccccaaacuaagau

SEQ ID NO: 66947 - RNA, 63 nt, hsa
guaaaagaguuuauacaggccuuaaauaucagacuuuguaacagguagaaauauuacagaaua

SEQ ID NO: 66948 - RNA, 63 nt, hsa
uggcugcaaguggaagcggauaauauguaggcacuuuguaaauucauauugaguaaaugaaug

SEQ ID NO: 66949 - RNA, 63 nt, hsa
uugcauucugaggcugaacuaauaaaaacucuucuuuguaaucauauuuugggcauucucagc

SEQ ID NO: 66950 - RNA, 63 nt, hsa
auuuguaaacacugccagaauacuuucuagcugcuuuguaauuuuuuaagaguguuauuuugu

SEQ ID NO: 66951 - RNA, 63 nt, hsa
ccagaauucugaguuaaagaaacaaaguauuugcuuuguaaaaggccaaaauucuauuuccua

SEQ ID NO: 66952 - RNA, 63 nt, hsa
ucauuucugcuucagcucuuugcugcuucacuucuuuguaaaguuguaaccugaugguaauua

SEQ ID NO: 66953 - RNA, 63 nt, hsa
gagguuuugguaauuguagaccuguuucauaagcuuuguaauucagaaauccuuguauuuagu

SEQ ID NO: 66954 - RNA, 63 nt, hsa
gcagaaucaguuacaaacaucacaguucccaugcuuuguaauaacaccuggugaaaaaguuag

SEQ ID NO: 66955 - RNA, 63 nt, hsa
auaguggguggauagcaaguauauucuaaaaaacuuuguaaauaaaguuuuguggcuaaaaug

SEQ ID NO: 66956 - RNA, 63 nt, hsa
uauugauagucacuagaguaauguauucuuaaccuuuguaagaacugaucucagcauguauuc

SEQ ID NO: 66957 - RNA, 63 nt, hsa
uaacaacaacaaagggcaguaaauuaaaguacucuuuguaagguacaguuaccgauuaaucua

SEQ ID NO: 66958 - RNA, 63 nt, hsa
uugaaauuacuguaccuagucuuuuuugcauuacuuuguaaccuuuuucuaugcaagagucuu

SEQ ID NO: 66959 - RNA, 63 nt, hsa
aucuuuugguucuguucacugagcuaaauuuaucuuuguaaaucuuuuugagucuggggggug

SEQ ID NO: 66960 - RNA, 63 nt, hsa
caagagcuucugggacagagacugcuuggccagcuuuguaaguaaguggcugccuccaaugug

SEQ ID NO: 66961 - RNA, 63 nt, hsa
uugaugguuuugugauuuagcuggguaaacuaucuuuguaacagauaaguuauuuauaaaaau

SEQ ID NO: 66962 - RNA, 63 nt, hsa
uugggaacagccaaagggauuccaaggcuaaaucuuuguaacagcucucuuucccccuugcua

SEQ ID NO: 66963 - RNA, 63 nt, hsa
ccuugauucagauauuuaugugaacuuaaaccucuuuguaaaauagcgcuaaauaauuugaac

SEQ ID NO: 66964 - RNA, 63 nt, hsa
uaccaacugcugagauuuuuauguauuuugugacuuuguaacaacugcuauuguaauaagugu

SEQ ID NO: 66965 - RNA, 63 nt, hsa
aaucuccuuguuguucuuuaacccucacugggacuuuguaaacuuccaagucauucucaccua

SEQ ID NO: 66966 - RNA, 63 nt, hsa
uuuauucuuucuacugagggcauugucuguuuucuuuguaaaugccguacaauaaacaaauua

SEQ ID NO: 66967 - RNA, 63 nt, hsa
aagcaguaagggggaaggagggugauuauauugcuuuguaaugguuugugauacuugaaacau

SEQ ID NO: 66968 - RNA, 63 nt, hsa
uauggauuauguuuuagcauuuuauacagucaacuuuguaaugaacuuuuuaaaaauuaauug

SEQ ID NO: 66969 - RNA, 63 nt, hsa
acccauggaaaaaugccaucaaaugaauaaugccuuuguaaccacaacuuucacuauaaugug

SEQ ID NO: 66970 - RNA, 63 nt, hsa
cuuugucacuggaugcuacuugaagagggaguacuuuguaaccacuuugauaugcuguuauca

SEQ ID NO: 66971 - RNA, 63 nt, hsa
uaauacagucaccuagacacuuccauuuguaaucuuuguaauagacuguaaauauauuuuugg

SEQ ID NO: 66972 - RNA, 63 nt, hsa
aacaaauaacagaaacaaaaucuguaaauguuccuuuguaaaacuuguaaauuuuauuuauac

SEQ ID NO: 66973 - RNA, 63 nt, hsa
auuuuuaaaaguaguaagccacauuacauuuaucuuuguaaaaagauuuaugguaacugguuu

SEQ ID NO: 66974 - RNA, 63 nt, hsa
cugauacauaauuuaaaagcacacucccuuccacuuuguaauaccagaacucuaauuggacac

SEQ ID NO: 66975 - RNA, 63 nt, hsa
uaauuuguacauauuuuagaauuuguguaucugcuuuguaauaaauguaauuucuuuccuuuu

SEQ ID NO: 66976 - RNA, 63 nt, hsa
uuuuaagacauuuaaaaacgugaaauuuguuaucuuuguaaaaugacaaucauguagaaaccu

SEQ ID NO: 66977 - RNA, 63 nt, hsa
cuagcacauauaugcaagcaccuaguauaauuucuuuguaauaugugaaacuuuauuaaugua

SEQ ID NO: 66978 - RNA, 63 nt, hsa
ucacugcuauuagacaauugaaguguucauuuacuuuguaauuccaauaaucauaguuaugga

SEQ ID NO: 66979 - RNA, 63 nt, hsa
uuuuucauuguguguauuucccaagaaaguauccuuuguaaaaacuugcuuguuuuccuuauu

SEQ ID NO: 66980 - RNA, 63 nt, hsa
aaagaguaauguauuaccucaauuuuugacugacuuuguaaaagccaauaacugguuuaaugu

SEQ ID NO: 66981 - RNA, 63 nt, hsa
caguuauguuuacacaucauuuuuauguuccugcuuuguaauucauguuugagauggguggcc

SEQ ID NO: 66982 - RNA, 63 nt, hsa
ggggaagccuuugcaagaaaauugcauacaaggcuuuguaacgaucaagugcuaaucgaugga

SEQ ID NO: 66983 - RNA, 63 nt, hsa
gaauaccagcuggggagacacuagggaagggagcuuuguaagccuugauugcgaaaguccaaa

SEQ ID NO: 66984 - RNA, 63 nt, hsa
guaggauucucucuaaauuauuuauugaagaggcuuuguaaauagugcaccagugacaggugc

SEQ ID NO: 66985 - RNA, 63 nt, hsa
gccguaguuuauuuuaaaauauauuuuuaaaagcuuuguaaaaauuaugucauucucagaauu

SEQ ID NO: 66986 - RNA, 63 nt, hsa
ugugcccuguaaccugacugguuaacagcaguccuuuguaaacaguguuuuaaacucuccuag

SEQ ID NO: 66987 - RNA, 63 nt, hsa
uuauacuuguagcaaauuguuuuaauucuguagcuuuguaauauguuuuaaaaucagaaacua

SEQ ID NO: 66988 - RNA, 63 nt, hsa
uccuaugucuguuacaaaacauaguuuauguagcuuuguaacauuccucagugccuguccaua

SEQ ID NO: 66989 - RNA, 63 nt, hsa
uauucauaucuguuucauuuggaggauuuucuucuuuguaauguaaagaaauucaaaguuauc

SEQ ID NO: 66990 - RNA, 63 nt, hsa
auaaacauuaacuuuccuauaagaauauuuuggcuuuguaaucuauagccucaaauugguauu

SEQ ID NO: 66991 - RNA, 63 nt, hsa
aacacucuuacaccuguuauggaaaaugucaaccuuuguaagaaaaccaaaauaaaaauugaa

SEQ ID NO: 66992 - RNA, 63 nt, hsa
caccucacagcagcuucgugcuuuuguacagaccuuuguaacaaguguacagaaaacucauuu

SEQ ID NO: 66993 - RNA, 63 nt, hsa
cgcuacguuuauugccucgucuuauucacugaccuuuguaaugauacacagugaauucuuuuu

SEQ ID NO: 66994 - RNA, 63 nt, hsa
uauuuuuuuaauguacccuaccuucaguauucucuuuguaaguuggugacuugcaucuguggc

SEQ ID NO: 66995 - RNA, 63 nt, hsa
uuucuaauuaauagccaaagauuucauaucuaacuuuguaaccagaauuauacaguaaguuga

SEQ ID NO: 66996 - RNA, 63 nt, hsa
gugcccaggggcccacagggaacccugcuugcacuuuguaacauguuuacuuuucagggcauc

SEQ ID NO: 66997 - RNA, 63 nt, hsa
uucugcugcccuccaccauuuauuuuuacagugcuuuguaauuuuuuucaucaguuccuuaaa

SEQ ID NO: 66998 - RNA, 63 nt, hsa
accccagacauccugcaaccuggggggacauuccuuuguaaaaccugggcuggaagucaaagc

SEQ ID NO: 66999 - RNA, 63 nt, hsa
auuuuguuuuuaaaauguguuuaauaaaugauccuuuguaaauaacuuuggucucccuacauu

SEQ ID NO: 67000 - RNA, 63 nt, hsa
caauaguauggaucuuuuuaaaucaauaagaugcuuuguaaaguugaaauaaguaauacuuuc

SEQ ID NO: 67001 - RNA, 63 nt, hsa
uuaaauaccaaaagagggaaaauaaaaaagaaccuuuguaaaauauaucugaaccuaaugguu

SEQ ID NO: 67002 - RNA, 63 nt, hsa
cugccccucuuccuucuuccuucugugacuuaacuuuguaaaggggauauggacaaguaagua

SEQ ID NO: 67003 - RNA, 63 nt, hsa
ugaguauaaaaagaaccccaauguuauguuaugcuuuguaaauuuuuuuuuuugcuuuuaccu

SEQ ID NO: 67004 - RNA, 63 nt, hsa
aaaacauacaguuuauuccacacagcaguuugacuuuguaaaaguuuagcaaaauaacugauu

SEQ ID NO: 67005 - RNA, 63 nt, hsa
uuagcuuuuuaauuguuguuucuuucuaguggucuuuguaagaguguagaagcauuccuucuu

SEQ ID NO: 67006 - RNA, 63 nt, hsa
agggggagggggagagagcaaggagaucgguaucuuuguaauaaaacugcaauuuuauaaauu

SEQ ID NO: 67007 - RNA, 63 nt, hsa
gauaaauaggacaaaucauuuaugugugaguuucuuuguaauaaaauguaucaauauguuaua

SEQ ID NO: 67008 - RNA, 63 nt, hsa
cagcauuuuucuuaaggcuaugcuucaguuuuucuuuguaagccaucacaagccauaguggua

SEQ ID NO: 67009 - RNA, 63 nt, hsa
auggagacccaccacgucucuaugccggaugaccuuuguaaguuaagguccuugugcaucuua

SEQ ID NO: 67010 - RNA, 63 nt, hsa
gucuugccuuucuucccugcuguuuuagcauuucuuuguaaaauguuagcuucaauuaauuag

SEQ ID NO: 67011 - RNA, 63 nt, hsa
uuagguuaaguauuauuuagguauuauaauaugcuuuguaaauuuuauauuccaaauauugcu

SEQ ID NO: 67012 - RNA, 63 nt, hsa
cacagaaugaaagggcaucucagccucucugaacuuuguaaaaaucuguccccaguucuucca

SEQ ID NO: 67013 - RNA, 63 nt, hsa
uuauauuaugaagcuuuuaugugaaacauguuucuuuguaaugaaaaccacauuggagauguu

SEQ ID NO: 67014 - RNA, 63 nt, hsa
gucuuaguucagacucauauauggauuucaaaucuuuguaauaaaaauuauuuguauuuuuaa

SEQ ID NO: 67015 - RNA, 63 nt, hsa
caugcuguuuaagugcaggcugagacccagccucuuuguaaguacaguaaaauaauccaccgu

SEQ ID NO: 67016 - RNA, 63 nt, hsa
acguguguccuuugguacuaugguguguuguaucuuuguaagagcaaaagccucagaaaggga

SEQ ID NO: 67017 - RNA, 63 nt, hsa
auuucugaaacuccauuauaacauauguaacuccuuuguaaccaaaauuuagguaagcaggcu

SEQ ID NO: 67018 - RNA, 63 nt, hsa
aaacuauguguaaauauauuaaggaaaguauagcuuuguaauuuaaauuggagcuuuuagcuu

SEQ ID NO: 67019 - RNA, 63 nt, hsa
aaaucacuaaacucuaguacauuauagcaggugcuuuguaaucuggaauggagaagagguagg

SEQ ID NO: 67020 - RNA, 63 nt, hsa
gugugccuggcugguuugcagauauuuguucugcuuuguaaaaauuggccauuagugcauuua

SEQ ID NO: 67021 - RNA, 63 nt, hsa
agaggaaacuaauggaguuucauuguaacuguccuuuguaauuuauauaaauguauuauuuuc

SEQ ID NO: 67022 - RNA, 63 nt, hsa
guaugaaaauguccucuucuucaaagguauaggcuuuguaaugaauuagauuuucugccaaua

SEQ ID NO: 67023 - RNA, 63 nt, hsa
agaggaauuauacaaaauuaauauauaugaguccuuuguaauuuauuuuuuuuugagacagga

SEQ ID NO: 67024 - RNA, 63 nt, hsa
gcucuaaacuagccuugaaguuuacagacaugacuuuguaaauguauuguuuuucuuuguugu

SEQ ID NO: 67025 - RNA, 63 nt, hsa
gucaauuucaguucagcuaacauauauuaauaccuuuguaacucuuugcuauggcuuuuguua

SEQ ID NO: 67026 - RNA, 63 nt, hsa
agaacaaacauauuuaugaucaugaauaaugugcuuuguaaaaagauuucaaguuauuaggaa

SEQ ID NO: 67027 - RNA, 63 nt, hsa
agggguucuaauuacugucugugagaguuacuacuuuguaacuuaugguuucugcuucaguau

SEQ ID NO: 67028 - RNA, 63 nt, hsa
uguguaauucuauuguaauaaacuggcagguaucuuuguaacuauaaauagugcaugcucagc

SEQ ID NO: 67029 - RNA, 63 nt, hsa
caccaggagauuacaauuuuuugcucuucuugucuuuguaaucuauuuaguugauuuuaauua

SEQ ID NO: 67030 - RNA, 63 nt, hsa
aaaaacucucagggcccuauuaagauuuauaaccuuuguaauguucuucaccacagacaccuu

SEQ ID NO: 67031 - RNA, 63 nt, hsa
aggcuuaccccucucuaggguugcaguugcuuucuuuguaauaaguauuuugccacaccugua

SEQ ID NO: 67032 - RNA, 63 nt, hsa
guaaaugugguaggaaauauaaaucauaugguccuuuguaaaauauacaaauaaucuaacaca

SEQ ID NO: 67033 - RNA, 63 nt, hsa
gugucuacgguuaagcaacagauaccuccuucccuuuguaaauaguauuuuuauacuucaucc

SEQ ID NO: 67034 - RNA, 63 nt, hsa
uagccuauacugcauuagcccaagagauuguugcuuuguaacuuuuugcacuauuguuuuggc

SEQ ID NO: 67035 - RNA, 63 nt, hsa
gccaaaucauuucaacugaaaagaacaguauugcuuuguaauagagucuguaauaggauuucc

SEQ ID NO: 67036 - RNA, 63 nt, hsa
uccuuuuccuucugaccaacacuuagucuuuaacuuuguaagguucgguuuaagguuucaggg

SEQ ID NO: 67037 - RNA, 63 nt, hsa
uagugguauccuauauuacuuuagugucguacgcuuuguaagacuuaaauauuuuauucuauu

SEQ ID NO: 67038 - RNA, 63 nt, hsa
acuuucuuccauauaugugguucauuggaaguucuuuguaauuuuaauuccaugaaagucuua

SEQ ID NO: 67039 - RNA, 63 nt, hsa
acuuugugauagguuuguacugugccuaauuuacuuuguaaaccagaaugauuccguuuuugc

SEQ ID NO: 67040 - RNA, 63 nt, hsa
ugugcuuuucagagacgccauagcuguuuuucccuuuguaauaucaaagcaguaauaucuucu

SEQ ID NO: 67041 - RNA, 63 nt, hsa
caggggaaacuguguaagcuguacuuguuauuucuuuguaaaaugucuuagauaauaaaacua

SEQ ID NO: 67042 - RNA, 63 nt, hsa
guuucccaccauuucccuuuaagugcucugcuccuuuguaaaaaguuaaagauuugaaagaga

SEQ ID NO: 67043 - RNA, 63 nt, hsa
uuuuguaaagaaguauauuuuuaugaaaagaaacuuuguaaaaguaugauguaaauuuucagu

SEQ ID NO: 67044 - RNA, 63 nt, hsa
aguauguccucauagaacuuuuaauacuuaaggcuuuguaaaaacuauccaugaagggaaagc

SEQ ID NO: 67045 - RNA, 63 nt, hsa
ucaggagacugaaaguucauacuaauuuacaaacuuuguaaagacuggugcuguucauucaua

SEQ ID NO: 67046 - RNA, 63 nt, hsa
aauaaccacacacagauaaccacacaaaaaauccuuuguaaaauuucugauugauaggauuag

SEQ ID NO: 67047 - RNA, 63 nt, hsa
aggugccaaauuccauuuaacuuuuuuacaagucuuuguaaaauuuuaaaugcauaaaggggg

SEQ ID NO: 67048 - RNA, 63 nt, hsa
agugagggaaucuaauuaagauuucaugcuguucuuuguaaugauaaauguuuccggacuaaa

SEQ ID NO: 67049 - RNA, 63 nt, hsa
auagauguuggaacuaccuuuuuacuccccauacuuuguaaguaaugcuuccagauuaaccug

SEQ ID NO: 67050 - RNA, 63 nt, hsa
uccauaugugaauguaagcucuuaacuaugucucuuuguaauguguaauuucuuucugaaaua

SEQ ID NO: 67051 - RNA, 63 nt, hsa
ugugaaauucuagaaaaaaauauuaccaccucucuuuguaauuuacuuuacuuguaugaauuu

SEQ ID NO: 67052 - RNA, 63 nt, hsa
cccugcacugugucaucuuuucaaggcauuugucuuuguaauauuuuccauaaauuuggacug

SEQ ID NO: 67053 - RNA, 63 nt, hsa
uaaauuacccuauccuuuguucucuacuguuuucuuuguaauguaugacuacgagagugauac

SEQ ID NO: 67054 - RNA, 63 nt, hsa
cuuuuuuucuuuuuuugacucguugacaagugucuuuguaauauguuuuuaguucccuuuuuu

SEQ ID NO: 67055 - RNA, 63 nt, hsa
aacagcauuuuuacuuucuguacaacaaaaaagcuuuguaaauaaaaucuuaacauuuugggu

SEQ ID NO: 67056 - RNA, 63 nt, hsa
uauguuucuugcauuaugaaggcuacaucugugcuuuguaaguaccacuucaaaaaauaguuc

SEQ ID NO: 67057 - RNA, 63 nt, hsa
uuuagagcuuugugcuuuucucucauuccaucacuuuguaaugaugauacuuaacaugagcag

SEQ ID NO: 67058 - RNA, 63 nt, hsa
ggggcuuuaucuaugaaaaaguaguaaauaguucuuuguaaccugugugaagcagcagccagc

SEQ ID NO: 67059 - RNA, 63 nt, hsa
ucauugaggguuuguuuguguuuucaucaaugucuuuguaaagcacaaauuaucugccuuaaa

SEQ ID NO: 67060 - RNA, 63 nt, hsa
uuggagucguuuugagaugagcauuagccccagcuuuguaaccaaugaggaacacuuacuuau

SEQ ID NO: 67061 - RNA, 63 nt, hsa
aaguuaagagaaacuuuauacauuaguaaaugucuuuguaagucaguguugagauggggauaa

SEQ ID NO: 67062 - RNA, 63 nt, hsa
aggaugucaauacaagauugucugccuguuuuucuuuguaauuuguaauuacaguuuuuguaa

SEQ ID NO: 67063 - RNA, 63 nt, hsa
cugucaauuugcucuagugucuuauuaguuaaacuuuguaaaauauauauauacuuguuuuuc

SEQ ID NO: 67064 - RNA, 63 nt, hsa
caacacugguuaauuucacacuccaucuccccgcuuuguaaauacccaucgggaagagacuuu

SEQ ID NO: 67065 - RNA, 63 nt, hsa
caguuccugaccuuccucugagcccuugagacacuuuguaaugcucuuuuguaacuaucgaca

SEQ ID NO: 67066 - RNA, 63 nt, hsa
aauuaagugcccaauauugaaaggcugcaaguacuuuguaaucacucuuuggcauggguaaau

SEQ ID NO: 67067 - RNA, 63 nt, hsa
auuaccaguauaucagaggaaaauuuucguagucuuuguaaaauaauauacucaucauagaaa

SEQ ID NO: 67068 - RNA, 63 nt, hsa
aaacgguuucuccuguggauaguggacagagaccuuuguaaccaauggaauuauucauuuuuc

SEQ ID NO: 67069 - RNA, 63 nt, hsa
uuaggccguggugaaguugauaaaccaccccugcuuuguaacaaaauuauuuuaaagugacug

SEQ ID NO: 67070 - RNA, 63 nt, hsa
augucuguuuuguuacauaccuuucaugucgugcuuuguaaaugucuuauuuguguaauaaag

SEQ ID NO: 67071 - RNA, 63 nt, hsa
uuuaaacauuagagcuggaguggggcuggaaaucuuuguaaaggaaguucuuucaguaagaug

SEQ ID NO: 67072 - RNA, 63 nt, hsa
uuaauacaauagagacuuuucauuuaacuuuaacuuuguaaauauugaaguguguaauaaagc

SEQ ID NO: 67073 - RNA, 63 nt, hsa
aaaacuguuuggaaccacaccaaugauauuuuucuuuguaauacuugaaauuuauuuuuuuau

SEQ ID NO: 67074 - RNA, 63 nt, hsa
ugagaucauugguagccagggguugcuaccaaacuuuguaaccucaaggacaaaaugaggaag

SEQ ID NO: 67075 - RNA, 63 nt, hsa
aauaaagaagacaugaauuguuuuaagucuacacuuuguaauuagcuaaguugugcaguauuu

SEQ ID NO: 67076 - RNA, 63 nt, hsa
uaaucuagaccaaagaaugguauuuucacuuuucuuuguaacauugaaugguuugaaguacuc

SEQ ID NO: 67077 - RNA, 63 nt, hsa
uuucaauagaaauuuuuauuucauuuucaauuacuuuguaaauucguguguauuuaguacacu

SEQ ID NO: 67078 - RNA, 63 nt, hsa
uuaccugagacuuucaguucguuuguauucuaccuuuguaaaacagccuauagaugaugaugu

SEQ ID NO: 67079 - RNA, 63 nt, hsa
uguaucuuuugguuguuugauuuuucuuucuuucuuuguaaauaguucugaguucugucaaau

SEQ ID NO: 67080 - RNA, 63 nt, hsa
gcuuuuguacuagcccaguauuuauuuacauugcuuuguaauauaaaucuguuuuagaacugc

SEQ ID NO: 67081 - RNA, 63 nt, hsa
cccucugccccucccccagccaugccagcuggccuuuguaagugcaggaaaccgaguagaaaa

SEQ ID NO: 67082 - RNA, 63 nt, hsa
ugaguuauauaaggcuacuucaugacaagacugcuuuguaauauuucacuuuguuuuacuaca

SEQ ID NO: 67083 - RNA, 63 nt, hsa
cauuaaaaaaagcacuggguucugcccuuucaucuuuguaagagauucuugccucuagcaaug

SEQ ID NO: 67084 - RNA, 63 nt, hsa
cuacagcucagauacugaucucuuucuaaugggcuuuguaaaccacuugacuuugcuaauggc

SEQ ID NO: 67085 - RNA, 63 nt, hsa
acuauguaauuuuguccuuguuauuuuuguuuccuuuguaauuuacuugaugaguuuauaucu

SEQ ID NO: 67086 - RNA, 63 nt, hsa
aagguggcuggagagagcugaggauuuccaggacuuuguaaguucuuauucugggagaacaua

SEQ ID NO: 67087 - RNA, 63 nt, hsa
aaaaaggcuuuuaaaauuuuguuuguuuuaaaucuuuguaaaguuauuauuccagagaguaua

SEQ ID NO: 67088 - RNA, 63 nt, hsa
auauacauuuuucuuaauguuccaacaucuauacuuuguaaagucaaaacauuucccaugagc

SEQ ID NO: 67089 - RNA, 63 nt, hsa
agaaaguggcuuugacaccaagugcuacugucccuuuguaauuggcuucuaacagaauucaac

SEQ ID NO: 67090 - RNA, 63 nt, hsa
cccaggugagcccuggauuggcucccagaaggccuuuguaaaaucaguagccguccugcaggc

SEQ ID NO: 67091 - RNA, 63 nt, hsa
cuuccucaggcuucucaccuguggccaacuucacuuuguaagacccauauuuuuaacucuucc

SEQ ID NO: 67092 - RNA, 63 nt, hsa
gucuuuccagagcuuauaguugcuaacacuuuucuuuguaaagaaguuuaccuuuugacugga

SEQ ID NO: 67093 - RNA, 63 nt, hsa
guuauuccuuuccuuuccuggagcuacaccuuucuuuguaaaacuguacugugggccgggcgc

SEQ ID NO: 67094 - RNA, 63 nt, hsa
uuccucccaaggguucuggcaccuuaugauguacuuuguaaaaaaauugauugaagauuuuaa

SEQ ID NO: 67095 - RNA, 63 nt, hsa
uuacuagcgagaaaucuuugauuucauuuuauucuuuguaauucuagacacuagauuguaguu

SEQ ID NO: 67096 - RNA, 63 nt, hsa
gucaguaaaaaaacacaaaaacuguaugaaugacuuuguaaauuuuguucuauaugaauaaaa

SEQ ID NO: 67097 - RNA, 63 nt, hsa
uuaacucuaacacccuucagaaauuucuaacuacuuuguaacugcauggcuuaaccuggugau

SEQ ID NO: 67098 - RNA, 63 nt, hsa
uguuaaugguuaauauaggcagggcgaauacuacuuuguaacuuuuaaagucuuaaacuuuuc

SEQ ID NO: 67099 - RNA, 63 nt, hsa
ucuauuuguuuuguacauguauauaucuaggaacuuuguaacaacacaucuuuaauaauguua

SEQ ID NO: 67100 - RNA, 63 nt, hsa
uuuuucauuuucaguuauuuuugaagcuaaaaccuuuguaauauuguuacuaaagugucuagu

SEQ ID NO: 67101 - RNA, 63 nt, hsa
uauaaauugguuccugagaggguuuccuaacagcuuuguaauaagaaaaauauggccuugaug

SEQ ID NO: 67102 - RNA, 63 nt, hsa
gacuacuacaaaauuggaaaaagauuggcaauucuuuguaaagaauuugugaauuguguauaa

SEQ ID NO: 67103 - RNA, 63 nt, hsa
auaauagaacaacguuuaugaaccugccguuugcuuuguaacguaacuaaauaauguaauggc

SEQ ID NO: 67104 - RNA, 63 nt, hsa
auagaugaacuaagagaaaaagaaucggauggucuuuguaacugauucuggacauaugcauca

SEQ ID NO: 67105 - RNA, 63 nt, hsa
aucacugcuuaacuucaucuucaugaaaugaaacuuuguaacuuauuguaguuagaaauugua

SEQ ID NO: 67106 - RNA, 63 nt, hsa
uuugacuuaaguagaaguaauaugcucucauuucuuuguaaucuagauuuuccuauguugaau

SEQ ID NO: 67107 - RNA, 63 nt, hsa
uuaguacacaaaacuaagaaucuuuagacuuaucuuuguaacuaauuaggguggaaguuauga

SEQ ID NO: 67108 - RNA, 63 nt, hsa
gcaauaaacauguuuucauguaauacuggcuuacuuuguaauuuacaucuguaacuuucauau

SEQ ID NO: 67109 - RNA, 63 nt, hsa
aacauguaacuucucucacaagaguacucuuuacuuuguaaucauauacaaugucaacuuuuu

SEQ ID NO: 67110 - RNA, 63 nt, hsa
uuguugagaugaguuugcuguacugacgcugcacuuuguaaacagauuaccaguuuuuuacuu

SEQ ID NO: 67111 - RNA, 63 nt, hsa
uuacacuguguuuuaaauuacuuuaaaaauaaacuuuguaagcagauuuuaauuuagucuuug

SEQ ID NO: 67112 - RNA, 63 nt, hsa
caagagcugcugcuauaacuuccaguuuuacaucuuuguaaaauuguaucucaaaggcagaaa

SEQ ID NO: 67113 - RNA, 63 nt, hsa
uaauaugcuguuuccauuaugacacagcagcuccuuuguaaguaccaggucauguccaucccu

SEQ ID NO: 67114 - RNA, 63 nt, hsa
aagagagaacagggugguauucuaaguauguuucuuuguaacaucuuuagcaguaggacagag

SEQ ID NO: 67115 - RNA, 63 nt, hsa
auuauuauuauuauuuuuugagauggagucucacuuuguaacccaggcuggaaugcaauggca

SEQ ID NO: 67116 - RNA, 63 nt, hsa
aaagacuuuauuguucuaauuauccagauguaccuuuguaaaauagcucuuuuaugaauuagc

SEQ ID NO: 67117 - RNA, 63 nt, hsa
agcuuugaacaauuguguuuucgucacaggagucuuuguaaugcuuguacaguugaugucgau

SEQ ID NO: 67118 - RNA, 63 nt, hsa
uauuuuucuuuguauaugaaauaauuuuuuguacuuuguaaaauauggagcccauuguaccuu

SEQ ID NO: 67119 - RNA, 63 nt, hsa
augaaaggugucaucaucacuaggaauaacacccuuuguaacuacauauagaacuguuacaau

SEQ ID NO: 67120 - RNA, 63 nt, hsa
cugaagaguugaucccuuuguccuaucguggggcuuuguaauguuacacaucucgugaaaacu

SEQ ID NO: 67121 - RNA, 63 nt, hsa
guagauuuguuuuguguuguuugaaaauauuaucuuuguaauuauuuuuaauauguaaggaau

SEQ ID NO: 67122 - RNA, 63 nt, hsa
acagcccuuuuaucucugcuuuccugaagcagccuuuguaaguggaaggauuguacugaaggc

SEQ ID NO: 67123 - RNA, 63 nt, hsa
ccuagcugacucagcauagauuguauaaaauaccuuuguaacggcucuuagcacacucacaga

SEQ ID NO: 67124 - RNA, 63 nt, hsa
auaagauaaccacuugauuuugugauuccaauucuuuguaauugucuucagagcagcccuacu

SEQ ID NO: 67125 - RNA, 63 nt, hsa
uuugucaugugauuuuugagucucaauuuaaggcuuuguaaaaugaagaguagaauuccaaga

SEQ ID NO: 67126 - RNA, 63 nt, hsa
cgucggaccuugugauuuggauugucaccuagccuuuguaaccgcuuggugccucuuaggacu

SEQ ID NO: 67127 - RNA, 63 nt, hsa
uggaggauauuauuauguggguauuuauaugaccuuuguaaccauuuaaaaauguaaaaacga

SEQ ID NO: 67128 - RNA, 63 nt, hsa
ugaggacagaagggacuagggcucuggcggggucuuuguaagaccagaguuucggacagccca

SEQ ID NO: 67129 - RNA, 63 nt, hsa
uuaaauaaggggaggguuguuccagcuuugauccuuuguaagauuuugugacugucaccugag

SEQ ID NO: 67130 - RNA, 63 nt, hsa
uccgguucccugagggaugagccuucagccucccuuuguaaugcugcuccucuccacugccca

SEQ ID NO: 67131 - RNA, 63 nt, hsa
auaauggaagcaagacuuccaaccucacggagacuuuguaauuuguuuucugagagcacaggg

SEQ ID NO: 67132 - RNA, 63 nt, hsa
cccauagaaaauuggguguguauacuuguauaacuuuguaaauaaguuuuuuuucuggguuca

SEQ ID NO: 67133 - RNA, 63 nt, hsa
cuccacccaacacguuuuugcaaagcaagaagucuuuguaagacaccuuaaacaaaguccuuc

SEQ ID NO: 67134 - RNA, 63 nt, hsa
cccugauggucauuuuucuaaacagaggcccugcuuuguaauauguggccaaggagauaauuu

SEQ ID NO: 67135 - RNA, 63 nt, hsa
ucauguuuuucuguagcacugggcccaaauauucuuuguaaagaaaaucgcugcagcaaaaac

SEQ ID NO: 67136 - RNA, 63 nt, hsa
auuuaagucggcagcuuucuaauuuaaucuuagcuuuguaauucauguuuugcuuuuguggac

SEQ ID NO: 67137 - RNA, 63 nt, hsa
caccaaauaaucuuaccucuagucuacuuacaacuuuguaaggguuucuaagcuaugcccauu

SEQ ID NO: 67138 - RNA, 63 nt, hsa
ugaaaaucaaaugaugcaaaauauauacaagcacuuuguaaauuguaaaaugauacaaaauuu

SEQ ID NO: 67139 - RNA, 63 nt, hsa
uugugugaagcucuuggcuuuuuuccaacguuacuuuguaacuaaugaggguggauguucauu

SEQ ID NO: 67140 - RNA, 63 nt, hsa
uguuauuguugacucucucccaagugccuugaucuuuguaauaucuccuguuguuucuaugau

SEQ ID NO: 67141 - RNA, 63 nt, hsa
gauacaagaaacaaccuuggaaaaguuauuucccuuuguaauaccuuuaaaaauccagaguau

SEQ ID NO: 67142 - RNA, 63 nt, hsa
cauaaccuuaaaaaggacuauauuaaucaccuucuuuguaaucccuucacagucccagguuua

SEQ ID NO: 67143 - RNA, 63 nt, hsa
cauuuaaggaaacuagacaaguaaaauuauccucuuuguaauuuaaugaaaagguacaacaga

SEQ ID NO: 67144 - RNA, 56 nt, hsa; identical to SEQ ID NO: 66425

SEQ ID NO: 67145 - RNA, 63 nt, hsa
gccaaagaucauuuuuuuauauagacuucagcccuuuguaaauauuguaacuggggaguauag

SEQ ID NO: 67146 - RNA, 63 nt, hsa
ccaacaauuaaaucuugccuuuacacacccaaacuuuguaauuuuagucuuggugaaauauaa

SEQ ID NO: 67147 - RNA, 63 nt, hsa
cagggugcuuuuauauauaagagcagcagccgccuuuguaaagugugaucuaugagaauugga

SEQ ID NO: 67148 - RNA, 63 nt, hsa
aucaguagaacuuacacauccuaggaaaucuuucuuuguaaguaauucuuuuggucucaagug

SEQ ID NO: 67149 - RNA, 63 nt, hsa
uacugucaccuugauggacaaguuucaauaaaacuuuguaaaaauaauuggacaugugccugg

SEQ ID NO: 67150 - RNA, 63 nt, hsa
gggccauggagcuggcccagaggccccucagcccuuuguaaagucugaugaaggcaggggugg

SEQ ID NO: 67151 - RNA, 63 nt, hsa
agauagaaaggaacaagacuaaaauuguaaauacuuuguaaacaucagcauuuguacuugaau

SEQ ID NO: 67152 - RNA, 63 nt, hsa
gaaccucucacaagcuggggcaggucaccuuaucuuuguaagaugaggauaucaucuagauca

SEQ ID NO: 67153 - RNA, 63 nt, hsa
gaggguaggccucagaccagggggucuccaaaacuuuguaaaucaugcaucuuuucuccauaa

SEQ ID NO: 67154 - RNA, 63 nt, hsa
uuccucagccucgaaaagugggcucuggaaucccuuuguaaauagguguguugaauuuguuuu

SEQ ID NO: 67155 - RNA, 63 nt, hsa
cuaagguugggaggcuaacgagucuaccucccucuuuguaaaucaaagaauuguuuaaaaugg

SEQ ID NO: 67156 - RNA, 63 nt, hsa
uuccuuuucuuuuucuuuccuuucauuuuuuuucuuuguaaugcaccugacagaaaaaaaaga

SEQ ID NO: 67157 - RNA, 63 nt, hsa
caaacauugugaucuauaaaugcacagaaaauacuuuguaaaaaguagcauccuuauauaaua

SEQ ID NO: 67158 - RNA, 63 nt, hsa
auuuucugcuuuguauauuucuauauuguuuaacuuuguaagaaugcccauuacuuuuuuaac

SEQ ID NO: 67159 - RNA, 63 nt, hsa
uguugauuuuagaagauggagaacuccagccaccuuuguaaagcacuaguguuugucauuuau

SEQ ID NO: 67160 - RNA, 63 nt, hsa
aaugcuguugccucaucuauaacaugcauuugucuuuguaaugucaccaccuucccagcucuc

SEQ ID NO: 67161 - RNA, 63 nt, hsa
uccugucuuucucauccaggucaggcauugacacuuuguaagaaaggggguaggggacacagc

SEQ ID NO: 67162 - RNA, 63 nt, hsa
ggguuucugcaucaauuagaauaucauuaauuucuuuguaaccaagugaaaaacuauacuuuu

SEQ ID NO: 67163 - RNA, 63 nt, hsa
cuuuauuuaaagucuucuguccagcuuuaagcacuuuguaagacauggcugaaaguagcuuuu

SEQ ID NO: 67164 - RNA, 63 nt, hsa
cgucagucaaaccccuuuaaaauguugcuuuggcuuuguaaauuuaaauauguaagugcuaua

SEQ ID NO: 67165 - RNA, 63 nt, hsa
uuuuucucuuuauguaguuugacuaugccuuaccuuuguaaauauuuuugcuuguguugucgc

SEQ ID NO: 67166 - RNA, 63 nt, hsa
uuaaaugaaauggggagauauuuacauuccguacuuuguaaacuugagcuauuggacuucacu

SEQ ID NO: 67167 - RNA, 63 nt, hsa
ccuuacauuguaacaaucuuacugguggaaagucuuuguaaggaaaaaacacauagcaaggag

SEQ ID NO: 67168 - RNA, 63 nt, hsa
ugguuuuugauagaacagaggccagcaaacuuucuuuguaaaaggcugguuaguaaauuauug

SEQ ID NO: 67169 - RNA, 63 nt, hsa
uacugaagagcucaaugauugacaucugaaaugcuuuguaauuauugacuucagccccuaaga

SEQ ID NO: 67170 - RNA, 63 nt, hsa
uaacuguaacuaaguucaacagacuauuauuaucuuuguaauaaauuaaccuagcaauaaaaa

SEQ ID NO: 67171 - RNA, 63 nt, hsa
uucucugcucucauuuaacccgucaaacacaaucuuuguaaagcuagauuggugguguuuuau

SEQ ID NO: 67172 - RNA, 63 nt, hsa
ucuagagagggucgucuggccugcuugcugggucuuuguaacccagcacuuccucuugcccuc

SEQ ID NO: 67173 - RNA, 63 nt, hsa
ugcagaugaagaggguaggaacuaaauaaaggacuuuguaagccaaagugguugggcugcuuu

SEQ ID NO: 67174 - RNA, 63 nt, hsa
ucccaccccagaucccagggacucauccugugacuuuguaaccacacucauuccuuucaaaca

SEQ ID NO: 67175 - RNA, 63 nt, hsa
guuuuaaauguacagacauauuuaacuggugcacuuuguaaauucccuggggaaaacuugcag

SEQ ID NO: 67176 - RNA, 63 nt, hsa
gcacuggauucuaaguaguugccaucuugaauccuuuguaauaaagccauacuuuugugugug

SEQ ID NO: 67177 - RNA, 63 nt, hsa
caaccugcucauuaaaucaucucucuauuaguucuuuguaaaucacuuaguacauuagagcua

SEQ ID NO: 67178 - RNA, 63 nt, hsa
uaaaugauauggcauguacuuucaauuauguagcuuuguaacuaugaauauuuacauauuuug

SEQ ID NO: 67179 - RNA, 63 nt, hsa
guggcuuuuuguuuccccaaggggaaagacuggcuuuguaauuauaauuuuuuccuuauuuau

SEQ ID NO: 67180 - RNA, 63 nt, hsa
guauauuacuuuuauuuuuaggaccauaaucaacuuuguaauauucuuauauaauuaauuagu

SEQ ID NO: 67181 - RNA, 63 nt, hsa
cagaauauucuucuaaguauuuugaugaaguaacuuuguaauuauuugaacauuguuuuaauc

SEQ ID NO: 67182 - RNA, 63 nt, hsa
aagguugaacuuugccaaaaaaaaaagaaguuacuuuguaauuuuuggggaaaaaagcacaua

SEQ ID NO: 67183 - RNA, 63 nt, hsa
uaguuaauuuguucuuaccaaaaaauaaaauuacuuuguaaauagcaguucacauuuuuccac

SEQ ID NO: 67184 - RNA, 63 nt, hsa
acuucuacuggacaucacagaauucuuuggguucuuuguaauuuaaugaauaggucugaaaac

SEQ ID NO: 67185 - RNA, 63 nt, hsa
auauuggguuugcuuuauuucauaggcuuaauucuuuguaaaucugaaugaccauaauagaaa

SEQ ID NO: 67186 - RNA, 63 nt, hsa
uuuaaaagcuuugcaaccuauauauuuauauaacuuuguaauauaacaugggcaaauaucuga

SEQ ID NO: 67187 - RNA, 63 nt, hsa
guuuugggaauaggcaucaaugggugguauuugcuuuguaacuccccccagguacgauaggga

SEQ ID NO: 67188 - RNA, 63 nt, hsa
gaugggggaaacacagcaguucuugguaaaguccuuuguaauaauaguuugauuuuuuuauuu

SEQ ID NO: 67189 - RNA, 63 nt, hsa
auggaauguucuuauuuagcuuaucauaaucuacuuuguaaaacaugcugaaaccucacugug

SEQ ID NO: 67190 - RNA, 63 nt, hsa
ggaauucagaaagguuacccccuuccucugugucuuuguaaggauacauuuggaagaacauac

SEQ ID NO: 67191 - RNA, 63 nt, hsa
gucauugaagucugcuugauuaaaccauaauaucuuuguaauaauuggauuuaaaaugcuaug

SEQ ID NO: 67192 - RNA, 63 nt, hsa
uuuauuaauuuaaaauagaacgcuugagaggcacuuuguaaagauuuguuaaacuggaaacgu

SEQ ID NO: 67193 - RNA, 63 nt, hsa
uauuccauauuguauccacaauuuaugauaucacuuuguaacccauacauuuauacaauuaua

SEQ ID NO: 67194 - RNA, 63 nt, hsa
gcugcuuagauuuagaaaucuacucuugcuggucuuuguaaguugcaugaauauuugacuuug

SEQ ID NO: 67195 - RNA, 63 nt, hsa
cucucucagcaaaauaaaacugugaugugucuucuuuguaaaaguuuagguauaaaaugcuau

SEQ ID NO: 67196 - RNA, 63 nt, hsa
aaaaagaccauuaacuuaaagugguguuaaaugcuuuguaaagcugagaucuaaauggggaca

SEQ ID NO: 67197 - RNA, 63 nt, hsa
uccugggcagccaaccaggcaacaccaaggacucuuuguaaacgauagcugaucgugugcacg

SEQ ID NO: 67198 - RNA, 63 nt, hsa
uaucagcaacauaaauuuaucaaauuugcagcacuuuguaaaugaugagauugcuuccuaccu

SEQ ID NO: 67199 - RNA, 63 nt, hsa
auuuuaaacuugugauaggcauaucuaugaaaccuuuguaaauuuaguuuauugcuuuaccau

SEQ ID NO: 67200 - RNA, 63 nt, hsa
uguuuguauuuucaacuggaguacauguauuuucuuuguaaaguagcuuccuaugaaaaugug

SEQ ID NO: 67201 - RNA, 63 nt, hsa
aagauucaccaggcacuggcaugaagaaagagucuuuguaaauggacauugaacaaacaaacu

SEQ ID NO: 67202 - RNA, 63 nt, hsa
gucauaauucauaaaauuuuaguuuaaugugcucuuuguaaaaugaaauuguaaagaaaauac

SEQ ID NO: 67203 - RNA, 63 nt, hsa
aacaaagaggaaaucaucuucauaguaaugaaacuuuguaaaguguuuccuuauauugguaau

SEQ ID NO: 67204 - RNA, 63 nt, hsa
agagggcuuacagccucagcaaggaccuuguggcuuuguaacaacaaucagccauaacaaguu

SEQ ID NO: 67205 - RNA, 63 nt, hsa
aauaguuacauuucacaaaagauauuuuaaacucuuuguaaaacuuagauaauagagccuagc

SEQ ID NO: 67206 - RNA, 63 nt, hsa
ccuggagaaugggaguguuaagacuuuugacuucuuuguaaguuuuguacugcuuuggagagu

SEQ ID NO: 67207 - RNA, 63 nt, hsa
uaacccuaaugaugcaagucauaugggggaacacuuuguaaauggucaggauaaaaaccaaau

SEQ ID NO: 67208 - RNA, 63 nt, hsa
uaauuuuuuuacccauaagacaucacauuaucccuuuguaagcuacuuaucuccaaaaaacuu

SEQ ID NO: 67209 - RNA, 63 nt, hsa
uucauuuucguuaagaauuuggggcaggaaauacuuuguaacuuuguauaugaaucaaaacaa

SEQ ID NO: 67210 - RNA, 63 nt, hsa
ucugguuuuuacuuuuuuaauguaagucucagucuuuguaauuaauuauugaauugugagaac

SEQ ID NO: 67211 - RNA, 63 nt, hsa
augugguuugccccaagugugcacuauuuaauacuuuguaauaugccaccaagaguacugaca

SEQ ID NO: 67212 - RNA, 63 nt, hsa
uuccuaugcaguuuagccaccuucucauuaauucuuuguaacagcaaauccuaggcucagagg

SEQ ID NO: 67213 - RNA, 63 nt, hsa
caggaggaucucuaaagcaguagccaaacaccacuuuguaaaaggacucuuccaucagagaug

SEQ ID NO: 67214 - RNA, 63 nt, hsa
uaaaauagcuuaaaaguuuguaaaaaaaugaaucuuuguaauuacuuaauauguuaguuaaga

SEQ ID NO: 67215 - RNA, 63 nt, hsa
gaucuaugaauguuuuucuuaaaauuuacaaagcuuuguaaauuagauuuucuuuaauaaaau

SEQ ID NO: 67216 - RNA, 63 nt, hsa
aucuaauucacaaauuaauuucuggaaauuaaacuuuguaaauuaaguuuuugccuauaagaa

SEQ ID NO: 67217 - RNA, 63 nt, hsa
gaagaugucaauaagcuugcauuaagccaccugcuuuguaaguggauugauuaauaaauaacu

SEQ ID NO: 67218 - RNA, 63 nt, hsa
uaaauuaaauguuauuugaaaauguuauaagagcuuuguaaauauuucagaaaauaugggaua

SEQ ID NO: 67219 - RNA, 63 nt, hsa
aguguuuacaggaugcccuucugaaggguaguccuuuguaaagcuguacagacuuugcaguuu

SEQ ID NO: 67220 - RNA, 63 nt, hsa
ugugguuugcccucaauugagcacuguuuauuacuuuguaauaugccacugugaguacugaca

SEQ ID NO: 67221 - RNA, 63 nt, hsa
cuguaaggcugggcugcugcgacacaggcagcgcuuuguaaacugugaagccauauacgugaa

SEQ ID NO: 67222 - RNA, 63 nt, hsa
aagggcaauucccaucucauccaucacucaggucuuuguaaagggugcagccaagcucugcag

SEQ ID NO: 67223 - RNA, 63 nt, hsa
cuagugauugucagacugguauggaggugacugcuuuguaagguuuugucguuucuaauacag

SEQ ID NO: 67224 - RNA, 63 nt, hsa
gucuuauuuuccuucuuccuagaugacucagcucuuuguaaauguugugcucaacuucuaggg

SEQ ID NO: 67225 - RNA, 63 nt, hsa; identical to SEQ ID NO: 67211

SEQ ID NO: 67226 - RNA, 63 nt, hsa
ugcgguuugcccucaagugugcacuguuuauuacuuuguaauaugccacugugaguacugaca

SEQ ID NO: 67227 - RNA, 63 nt, hsa
guuuuaguggccuguccuugaccugccgugguccuuuguaaacuauggcuccaugcuguguga

SEQ ID NO: 67228 - RNA, 63 nt, hsa
uuugagacuggccucuuuuacucaccauaaugccuuuguaauucauccaugcuguugugugua

SEQ ID NO: 67229 - RNA, 63 nt, hsa
aauacauuguacaugaaaaaaugaaaaguagaacuuuguaauacuuuaaucaauaaaauuaau

SEQ ID NO: 67230 - RNA, 63 nt, hsa
aaagcauccgguucuaaaauuaauuuguugcagcuuuguaaauauuucuuuaagauucagccu

SEQ ID NO: 67231 - RNA, 63 nt, hsa
agaaguuccagacagaugagaaagcaaaaaguacuuuguaaaguguuauacaaucagaaggug

SEQ ID NO: 67232 - RNA, 63 nt, hsa
cacugggguauuguuggcuucuuguguuggaaacuuuguaauguaaaaggaaaaacuggaaau

SEQ ID NO: 67233 - RNA, 63 nt, hsa
gugaggaauugaugagaugauguaugugaaacacuuuguaaccuguaaagcgcugugcacacg

SEQ ID NO: 67234 - RNA, 63 nt, hsa
ucaaagacucgaauucauuuucucagucauuuccuuuguaacagaguuuuacgacuuagaguc

SEQ ID NO: 67235 - RNA, 63 nt, hsa
acauagaggugauaaguaauaaaacuaugaacacuuuguaaaacauugacauuuuauuuucca

SEQ ID NO: 67236 - RNA, 63 nt, hsa
agcgccuacuucacggaaacuugugccuuuaaacuuuguaaacuuaaacacagccgagaaguu

SEQ ID NO: 67237 - RNA, 63 nt, hsa
uuuaaauuauucagugcuaaucauuguuuuuuccuuuguaaauguugauucagaaaaggaaag

SEQ ID NO: 67238 - RNA, 63 nt, hsa
uauguuacugccccacccuaacugaucaauguacuuuguaauccucccacccuuaagaagguu

SEQ ID NO: 67239 - RNA, 63 nt, hsa
uccuggauuauucaaaaugauguauguugaagccuuuguaaauugucagaugcugugcaaaug

SEQ ID NO: 67240 - RNA, 63 nt, hsa
uuagauuuaaaaagugaaagaaacugcaggcgccuuuguaaaaugcaaaauauuuaauuaaaa

SEQ ID NO: 67241 - RNA, 63 nt, hsa
accccugucucucaccuccaccaaccccacucacuuuguaacuucaucacugacccggccaau

SEQ ID NO: 67242 - RNA, 63 nt, hsa
gacguugaucuccugguagcaugaccuuuuggccuuuguaagacacacagccuuucuguauca

SEQ ID NO: 67243 - RNA, 63 nt, hsa
aaacacguagcauuugcaccccuccaaagccaucuuuguaaaggaaaacguauuuguaauuga

SEQ ID NO: 67244 - RNA, 63 nt, hsa
uacuacagauugacacguuuuuaauuagcuguccuuuguaagaagucaggaaaucugaugcug

SEQ ID NO: 67245 - RNA, 63 nt, hsa
ucuuagaaugcgaaucuguguuaagaaucuagucuuuguaauagaaguuucccaguggcauuc

SEQ ID NO: 67246 - RNA, 63 nt, hsa
uaggaacuucagaggcuuuguuuaaacgcaaagcuuuguaaaagccacaaggucugagcugaa

SEQ ID NO: 67247 - RNA, 63 nt, hsa
aauacugcuaccuucagggcagaagacacugcucuuuguaacccagccaccaccaaaaagcaa

SEQ ID NO: 67248 - RNA, 63 nt, hsa
aguggggagaaaaaaaccaagaggccaccgugccuuuguaaagaaacaaaauaaaguuuguac

SEQ ID NO: 67249 - RNA, 63 nt, hsa
agagcuuuuuggaaauacucagauccuggccgccuuuguaaccuucucuaaacgucaggccug

SEQ ID NO: 67250 - RNA, 63 nt, hsa
aaacucugcuuccuuggacagauuuggcaauagcuuuguaagugauguggacauaauugccua

SEQ ID NO: 67251 - RNA, 63 nt, hsa
ucuguguuagaaguguugcaaaugcuguacugacuuuguaaaauauaaaacuaaggaaaacuc

SEQ ID NO: 67252 - RNA, 63 nt, hsa
auaguguuuggacagcugauaaauuuaauccuucuuuguaauacuuucuaugugacauuucuc

SEQ ID NO: 67253 - RNA, 63 nt, hsa
ugaagagucaucugauucgaggccacucauguucuuuguaacuuaaacuuugaccaagaaauu

SEQ ID NO: 67254 - RNA, 63 nt, hsa
uggcuguuuucuucuggggcuuagucgaaucagcuuuguaauguuaugggacaaaaaucaauu

SEQ ID NO: 67255 - RNA, 63 nt, hsa
ugucaccuauaugggauuugccuguuuuaauaacuuuguaaggaauucuugcucuucuagggg

SEQ ID NO: 67256 - RNA, 63 nt, hsa
uagcaacucauuuauuucauuuuggucuuaaugcuuuguaaacaggucaaaaaauacugucau

SEQ ID NO: 67257 - RNA, 63 nt, hsa
cuccaucccuauucccuccucugaaaugcaccccuuuguaauugaggacaaggugguucugug

SEQ ID NO: 67258 - RNA, 63 nt, hsa
uguuuaugucagagcuuuguuguaagccucucacuuuguaaggaaauucuuauuggguagguu

SEQ ID NO: 67259 - RNA, 63 nt, hsa
auuuuuuugcauuuaugaacggcuguuuuucuacuuuguaauugugagacauuuucuugggga

SEQ ID NO: 67260 - RNA, 63 nt, hsa
acuguuaugccuuuuauuuguuugcaaggaugucuuuguaauguguuucaugaauagaauauc

SEQ ID NO: 67261 - RNA, 63 nt, hsa
gucacauaggaauuguucagcaacagaaagauacuuuguaaugagaagguacaaauuugagua

SEQ ID NO: 67262 - RNA, 63 nt, hsa
auuugagaaaaaucugggucuuucuaaaaacugcuuuguaaguuacuuuuucuuuaugacuuc

SEQ ID NO: 67263 - RNA, 63 nt, hsa
gcccugcauccccccuccucugccugagugugucuuuguaaugucagcuggcaucauacaaag

SEQ ID NO: 67264 - RNA, 63 nt, hsa
gcagggacugugagagacaaccagcagcauccucuuuguaaucacagggcagggaucagaguu

SEQ ID NO: 67265 - RNA, 63 nt, hsa
ccaggccugaaccccucccgugcuguaauaaaucuuuguaaauaacugcugagacuccucuuu

SEQ ID NO: 67266 - RNA, 63 nt, hsa
ucgaacccacacugcaacaggaacugugagagucuuuguaaguaaacugcccugucuagguca

SEQ ID NO: 67267 - RNA, 63 nt, hsa
ugcagaccugggacuuuagggcuaaccaguucucuuuguaaggacuugugccucuugggagac

SEQ ID NO: 67268 - RNA, 63 nt, hsa
agacucuacauugggcagccuuuaaauaugauucuuuguaaugcuaaauagccuuuuuuucuc

SEQ ID NO: 67269 - RNA, 63 nt, hsa
uauauauacuuuuucauauauaauuagaucuuucuuuguaauuucauauguaguucuucauag

SEQ ID NO: 67270 - RNA, 63 nt, hsa
ccuugguugauaacugucuugauacuuuucauucuuuguaagaggccaaaucgucuaaggacg

SEQ ID NO: 67271 - RNA, 63 nt, hsa
gaucagugugcuaaaucucucugccuguuuggacuuuguaauuauuuuuuuagcaguaauuaa

SEQ ID NO: 67272 - RNA, 63 nt, hsa
cugaaaacuaccuguggguuaaggauguaguuccuuuguaagggugggcaggccucguaagaa

SEQ ID NO: 67273 - RNA, 63 nt, hsa
gaaggacccgcuuccuguugucggugcuaauuccuuuguaauuccagcccccugucgccuguc

SEQ ID NO: 67274 - RNA, 63 nt, hsa
aggcugcaucuuuauauguuacauucauauaaacuuuguaacuuuuuggacauugaaagaugu

SEQ ID NO: 67275 - RNA, 63 nt, hsa
uugagucugggauuauccgcauuguauuuagugcuuuguaauaaaauauguuuuguaguaaca

SEQ ID NO: 67276 - RNA, 63 nt, hsa
uuggcacaaauauuuuaucauaugcagucacuucuuuguaaaugauuuuuuguaaagucauug

SEQ ID NO: 67277 - RNA, 63 nt, hsa
caucaccaugacaucucucuccaaaguaacgaccuuuguaagugaagaugcucuuccagagac

SEQ ID NO: 67278 - RNA, 63 nt, hsa
ccuccuuugcccugggacaucuguaucucuuggcuuuguaauaaaugcugcauacuuucugga

SEQ ID NO: 67279 - RNA, 63 nt, hsa
ucgcccugcugcauuugcucuugucuggauuaacuuuguaauuuauggaguauugugcacaac

SEQ ID NO: 67280 - RNA, 63 nt, hsa
uauucagucacaagucauuuuggucauguuggucuuuguaacaaaucaaaauuaccuuauauc

SEQ ID NO: 67281 - RNA, 63 nt, hsa
uuuagacuuuuuuuuauaaauagacuuauuuuccuuuguaauguauuggccuuuuagugagua

SEQ ID NO: 67282 - RNA, 63 nt, hsa
auuacaucaagcuaauugugcgagcucaauucacuuuguaagaaaacucucggagaaauaaaa

SEQ ID NO: 67283 - RNA, 63 nt, hsa
cuacacaauucuccuucgggaccucaauuuccacuuuguaaaaugaggguggaggugggaaua

SEQ ID NO: 67284 - RNA, 63 nt, hsa
uuacugaggaccaaagauacauguaaaauagggcuuuguaaacuccacagggacuguucuaua

SEQ ID NO: 67285 - RNA, 63 nt, hsa
cuugguacugcagagucuggguuguagagaacucuuuguaagcaauaaaguuuggggugauga

SEQ ID NO: 67286 - RNA, 63 nt, hsa
uaccuccccuuuucuauguugcuauuguaaggucuuuguaaaaucuugcaguuuuguaagccc

SEQ ID NO: 67287 - RNA, 63 nt, hsa
ugcaauugucuuuuuuuuccuuugaacgugcuucuuuguaaugaccaagguaccgauuucugc

SEQ ID NO: 67288 - RNA, 63 nt, hsa
uguacucuccacauuauuuuaaauauuaguugccuuuguaaacaguuuccccucccccacccc

SEQ ID NO: 67289 - RNA, 63 nt, hsa
uccguuucuuaaguauugcgcagauuuguucaacuuuguaaauauggacaucacuuuuuuuuu

SEQ ID NO: 67290 - RNA, 63 nt, hsa
guaguacaugggaaaaacaguaugggaagaguucuuuguaauguaaggaaauaacaauguagu

SEQ ID NO: 67291 - RNA, 63 nt, hsa
aaaaaaaaauaaaauuauuuugaauuauucuaccuuuguaaacaauuggcuaaaagaaucauc

SEQ ID NO: 67292 - RNA, 63 nt, hsa
aauacaugaucuugaacagcuccuguacuugcucuuuguaaaaaaaaauaaaauuauuuugaa

SEQ ID NO: 67293 - RNA, 63 nt, hsa
ucagaaauaugaauaaauaguuuuuguuaaacccuuuguaaaauaccaagguucccguuaaca

SEQ ID NO: 67294 - RNA, 63 nt, hsa
gaaauucauguuuacuuuucuagguguaugauacuuuguaaaguugauacuuuccuaagaauu

SEQ ID NO: 67295 - RNA, 63 nt, hsa
cauggaaaauguuaaggaagcaaaugguuguaacuuuguaaguacuuauaacaugguguaucu

SEQ ID NO: 67296 - RNA, 63 nt, hsa
uggugguuuuucguucucuuaaauaaucaggugcuuuguaaccaagcacaucggaaccagagg

SEQ ID NO: 67297 - RNA, 63 nt, hsa
uucaaagaugagggccuggcuuccgugcucuggcuuuguaacuuaucuggaagggaaagcaca

SEQ ID NO: 67298 - RNA, 63 nt, hsa
guacuguggauuguacauuuaacuuuggaauggcuuuguaauaaucagucuuaagaaaauguu

SEQ ID NO: 67299 - RNA, 63 nt, hsa
augcuuuacugccauugcuguaugcuuuacugucuuuguaaaaaucccccucuccccuuuucu

SEQ ID NO: 67300 - RNA, 63 nt, hsa
uuauccaugauauucaguacaacucugucauuucuuuguaauauuuaaaaaauauuaguaaag

SEQ ID NO: 67301 - RNA, 63 nt, hsa
aaaauguuuugaauuuauaaaauuaauguuuuucuuuguaacauuuauauauauuuuuuaaca

SEQ ID NO: 67302 - RNA, 63 nt, hsa
auuuugauuuguauucaaguacucuucaaguaucuuuguaaugaagguuuggcuacuuguaua

SEQ ID NO: 67303 - RNA, 63 nt, hsa
ugaucaguauuccuccucuaucaccuuuuuagacuuuguaagguaaauauuuggacuaacuuu

SEQ ID NO: 67304 - RNA, 63 nt, hsa
aauugcugggccauaugaaaaaucaauaguuagcuuuguaagaaacagucaaacuguuuucca

SEQ ID NO: 67305 - RNA, 63 nt, hsa
cuaucuaucauacucccaaauuccuucuugcaucuuuguaauuucucacucuuccuucucccu

SEQ ID NO: 67306 - RNA, 63 nt, hsa
uguucuguauuuuuaaauugccaagaaaaacaacuuuguaaauuuggagauauuuuccaacag

SEQ ID NO: 67307 - RNA, 63 nt, hsa
aaccuuauaaaaacagguuccaaauauucacugcuuuguaaaaaugaacaaacaugagacugu

SEQ ID NO: 67308 - RNA, 63 nt, hsa
uacugggauagucagguaaacaguuggucaagacuuuguaaagaaauugguuucuguaaaucc

SEQ ID NO: 67309 - RNA, 63 nt, hsa
caguauuugguggucccuaugacuuauacauaacuuuguaaaaagaaaaaaaaauuuuuucug

SEQ ID NO: 67310 - RNA, 63 nt, hsa
gaagcacccaucuucacuuggugcugccaucaacuuuguaagauugcauucuauuuauuguga

SEQ ID NO: 67311 - RNA, 63 nt, hsa
aauguaggauacuuuuuauuuggggcucauugucuuuguaauuacggagaggaacaaaccauc

SEQ ID NO: 67312 - RNA, 63 nt, hsa
uucauugcuuuacauacuagacauuuuucuucucuuuguaaguagauucaaauuagauaguca

SEQ ID NO: 67313 - RNA, 63 nt, hsa
aaucugccuaauuuuucuugaaagcuaaauuuucuuuguaaguuuuuacaaauuguuuaauac

SEQ ID NO: 67314 - RNA, 63 nt, hsa
ccaggagcaagagaccagaaggaugaucugcuccuuuguaacguuguugagggcccucuuguu

SEQ ID NO: 67315 - RNA, 63 nt, hsa
ugugugaaaucuaagcaguaauguacuuucucccuuuguaaagacuuggggaguaaggacauu

SEQ ID NO: 67316 - RNA, 63 nt, hsa
gacaucuuauuggauauuagcaauugcacgcugcuuuguaagccacuuuuuaguacucugaca

SEQ ID NO: 67317 - RNA, 63 nt, hsa
ccgacuuccucugccaguuauugacacagcucucuuuguaagagaggaaagaaacuaaaccca

SEQ ID NO: 67318 - RNA, 63 nt, hsa
gcaggugucccggucugcauaagccucgugugccuuuguaaaguccaccuacacuuuugacca

SEQ ID NO: 67319 - RNA, 62 nt, hsa
uaucagugauacugaugagaauaaacuaaacgccuuuguaacagccuugccgcaugcucguu

SEQ ID NO: 67320 - RNA, 63 nt, hsa
ccgcugggcucgcuggugaccgccacagccccgcuuuguaaccagggaauacacagucauuuc

SEQ ID NO: 67321 - RNA, 63 nt, hsa
ucuugaaccccgaccacuaccccagguuucuaacuuuguaacuugcuucugaugugggucccu

SEQ ID NO: 67322 - RNA, 63 nt, hsa
agagaggacagguccucaacaaauggcaugugacuuuguaaguguagaauugcugugagguau

SEQ ID NO: 67323 - RNA, 63 nt, hsa
ccccgccccagggcaauguuggacccccuuuuacuuuguaaaguuuguauuuauuccccuuua

SEQ ID NO: 67324 - RNA, 63 nt, hsa
ggcccguccuaggaauggauguggggauggucgcuuuguaaugugcugguucucuuuuuuuuu

SEQ ID NO: 67325 - RNA, 63 nt, hsa
uggaaaauucaccaccucuagcuccucacuguucuuuguaauuaacacgcuguugguaaucuu

SEQ ID NO: 67326 - RNA, 63 nt, hsa
ucccgccccaaacguccgcuuuccuuuucucuacuuuguaauuuauugaucaguuucuguugg

SEQ ID NO: 67327 - RNA, 63 nt, hsa
uccugcccucuaauuugggggcagcaguuugugcuuuguaagcuucagucuuauuuauagugu

SEQ ID NO: 67328 - RNA, 63 nt, hsa
cauaugugggaggcuuucaugagguguguugcacuuuguaacugucuagagcucuugauggaa

SEQ ID NO: 67329 - RNA, 63 nt, hsa
aaaaggcaaccaaccacauuagaagucuuggcacuuuguaacggaacggguacuacacuuuau

SEQ ID NO: 67330 - RNA, 63 nt, hsa
uguugucuuaaugccauuucauuucacaugguacuuuguaaauuuugacgagaaaguugguug

SEQ ID NO: 67331 - RNA, 63 nt, hsa
uuuccaggucaguacguaaagauguaacccauucuuuguaagguucagaauauuucuagaaug

SEQ ID NO: 67332 - RNA, 63 nt, hsa
cauauuugcacaaguacaguaacaaucugcuuucuuuguaacaugacacauuugaaaucauug

SEQ ID NO: 67333 - RNA, 63 nt, hsa
gaagaaguguaacucaccagccucugcucuuaucuuuguaauaaauguuaaagccagaaguug

SEQ ID NO: 67334 - RNA, 63 nt, hsa
uauaauacauauguuguacuuuuauguauuucacuuuguaacaaaguaucuuucaguuuuaua

SEQ ID NO: 67335 - RNA, 63 nt, hsa
aaccuaaaaaguacaguguguuuaucacgagagcuuuguaagguacuucacuuccacuuuaaa

SEQ ID NO: 67336 - RNA, 63 nt, hsa
auucuacaaaaaaauguuguuaauaaaugucugcuuuguaaaagcaguuuugcaauuuuuuaa

SEQ ID NO: 67337 - RNA, 63 nt, hsa
cugugguugcugugacaguuucguuuucugaaucuuuguaaugcucuuccacccugcucgugc

SEQ ID NO: 67338 - RNA, 63 nt, hsa
aaucugaacuaacuugcuuuuagaagucuuuuucuuuguaagcauuguaaaugcuaauaaauc

SEQ ID NO: 67339 - RNA, 63 nt, hsa
uguguccccuguccugccccaccgguuugcuggcuuuguaauaacauaagaccauugugguug

SEQ ID NO: 67340 - RNA, 63 nt, hsa
ccucuugaagcuuuuucugccuccugauucucucuuuguaaacuauuuucaaauuguuuuuca

SEQ ID NO: 67341 - RNA, 63 nt, hsa
auacaguauuuuccaugguucugccugcacuuacuuuguaaugccacgguugagauugagaga

SEQ ID NO: 67342 - RNA, 62 nt, hsa
ggaugugaaucuuacauuccuuuucaucauuuccuuuguaaaaaugacgagugcuggguuuu

SEQ ID NO: 67343 - RNA, 63 nt, hsa
uuuucguuuuaaauuuuagauuuuauuuuagugcuuuguaauuaauugggguuuauauugaua

SEQ ID NO: 67344 - RNA, 63 nt, hsa
gaauggcuucaaaauaagucacgaacacaaauucuuuguaaauuauguaaauuccuguuuaua

SEQ ID NO: 67345 - RNA, 63 nt, hsa
ucuuccccacccagcucuccccugcgccccugucuuuguaaauugacccuucuggaguggggg

SEQ ID NO: 67346 - RNA, 61 nt, hsa
cccuaauaaacaccugcucacuggcuggguauucuuuguaaccaguguuucuggcuccugc

SEQ ID NO: 67347 - RNA, 63 nt, hsa
gcauuagaaacauugagaguucaagugcuguuucuuuguaaaaauguauccagaguaguugga

SEQ ID NO: 67348 - RNA, 63 nt, hsa
uaagcacguuugggaaggaacagccuaaagaugcuuuguaaagcuguauuuuacccuugagcu

SEQ ID NO: 67349 - RNA, 63 nt, hsa
cugcuucacagaauaaugggaagugacucuagucuuuguaagcaauuuucauucucauuagga

SEQ ID NO: 67350 - RNA, 63 nt, hsa
uaauugugugaacuuggaagcacaccaaucuuacuuuguaaauucugauuucuuuucaccauu

SEQ ID NO: 67351 - RNA, 63 nt, hsa
aagagaaaaguacaagacagaaaucuucuagcacuuuguaaacacagugaauaaccucuugga

SEQ ID NO: 67352 - RNA, 63 nt, hsa
agucauaggacuggcaaagcaacuguuuaaacccuuuguaaccggggccuugcccccaccucc

SEQ ID NO: 67353 - RNA, 63 nt, hsa
cuaucaaacaaaugacuuucauauugcaacaaucuuuguaagaaccacucaaauaaaagucuc

SEQ ID NO: 67354 - RNA, 63 nt, hsa
guaucuuuucaauuaauguaucuguaaaaguuucuuuguaaauacuauguguucugguguguc

SEQ ID NO: 67355 - RNA, 63 nt, hsa
ggaacugcagggaacuucucugcuccuccuugucuuuguaaaaagggaccaccucccuggggc

SEQ ID NO: 67356 - RNA, 63 nt, hsa
ugagacuggcagcaguggguauaugguaaaagccuuuguaaaacagugcauuuuucagauuug

SEQ ID NO: 67357 - RNA, 63 nt, hsa
uuccaacaguggccuucuccgggcuucauaguucuuuguaauauguugaaguuaauuugaauu

SEQ ID NO: 67358 - RNA, 63 nt, hsa
cacugcccaaccccaggucuaaguccagucugucuuuguaagcauggaaauaugguguccacg

SEQ ID NO: 67359 - RNA, 63 nt, hsa
uugugucuggacuaaguuaaaagaauuaaaauacuuuguaauguccugggcuuugggaaaugu

SEQ ID NO: 67360 - RNA, 63 nt, hsa
auuaguuuaauuuucuucaaaaugaaaauacugcuuuguaauuacaaaaugagacacaccuau

SEQ ID NO: 67361 - RNA, 63 nt, hsa
uuauaucccggaauauuucccuccggcuuucgccuuuguaacucccaucuguggacccaucgu

SEQ ID NO: 67362 - RNA, 63 nt, hsa
auccuaaaaucagguuuacuuaacuuuagauugcuuuguaaauguuuggaaacuuucuuuuac

SEQ ID NO: 67363 - RNA, 63 nt, hsa
aaagaacugaagaugagaauacuggucaucuaacuuuguaauuugauuugauuauacuguaaa

SEQ ID NO: 67364 - RNA, 63 nt, hsa
ucgaggcuaacgauguagguuucauuucucagacuuuguaauauaaggcaagcccucucucag

SEQ ID NO: 67365 - RNA, 63 nt, hsa
gagccacaggccuaagucauuaaaaaauucucccuuuguaaccucagugcuggggacugaggc

SEQ ID NO: 67366 - RNA, 63 nt, hsa
cccucucucauuggccuauacaucucuuaggaccuuuguaaugguguccaugcaccuuuagag

SEQ ID NO: 67367 - RNA, 63 nt, hsa
cgccaggcggcauccuuuucuaugaaguguugacuuuguaaaucugcccacacccagcuggcc

SEQ ID NO: 67368 - RNA, 63 nt, hsa
uguggggaagguuggagaagaguuagguuugugcuuuguaaucuuggcauccauguuuugugc

SEQ ID NO: 67369 - RNA, 63 nt, hsa
caaguguuacuugugccgggaaaauuuugcugucuuuguaauuuuaaaacuuuaaaauaaauu

SEQ ID NO: 67370 - RNA, 63 nt, hsa
cuguuuaucaucagcuccucugaaaugugaucccuuuguaacugugcucaucacuucgccagu

SEQ ID NO: 67371 - RNA, 63 nt, hsa
gcuacugaaagcuaucccaggugauacagagcucuuuguaaaccgcagucacacauuaggguu

SEQ ID NO: 67372 - RNA, 63 nt, hsa
uuuuuuuuaauuaaagagcaaagcuuuuuauuacuuuguaauuuaaaaaacugaaaaaaaaaa

SEQ ID NO: 67373 - RNA, 63 nt, hsa
ugacugccaaauaauauuugaagucaucugucucuuuguaaauuauuuuauaugaccuauaaa

SEQ ID NO: 67374 - RNA, 63 nt, hsa
uuagacuccugggaugcccuccucccccucgcccuuuguaauaaccuaaucugagaccgugcu

SEQ ID NO: 67375 - RNA, 63 nt, hsa
gcuuagaauucugagaggcaggaacugcucugucuuuguaacuacucaaggccaacugucaca

SEQ ID NO: 67376 - RNA, 63 nt, hsa
gcaguguucuuggggguggggcugcauccaaggcuuuguaaaccggcuggaccacgucucccu

SEQ ID NO: 67377 - RNA, 63 nt, hsa
ucaaagaccaguuuguaccgaugaaacgcgcaacuuuguaaucccaacacuuucuauuuucua

SEQ ID NO: 67378 - RNA, 63 nt, hsa; identical to SEQ ID NO: 66907

SEQ ID NO: 67379 - RNA, 63 nt, hsa
ggucuuucauagccaaacuuguauauuuaaauucuuuguaauaauaauauccaaaucaucauc

SEQ ID NO: 67380 - RNA, 63 nt, hsa
uacauaccgugagaaguuacguaacauuuacuccuuuguaaauguuucccuaucaucagacaa

SEQ ID NO: 67381 - RNA, 63 nt, hsa
cauacuuauauagaggaauuuauguaaccaugacuuuguaauuuugagaauuccucccaguga

SEQ ID NO: 67382 - RNA, 63 nt, hsa
gaauuaauaaaacaaagucauacaacacauuuucuuuguaauugagaacuagauaacauggua

SEQ ID NO: 67383 - RNA, 63 nt, hsa
ucacccccaaugaggucuuaggcagauucuuuacuuuguaauucaaaaggccuguuaaccuuu

SEQ ID NO: 67384 - RNA, 63 nt, hsa
uuggaaaaaaaauacuagccuagcuggucauuucuuuguaagguaguuagcaauuuuaagucu

SEQ ID NO: 67385 - RNA, 63 nt, hsa
aaaugagauuuuguacauggaguugacauaauacuuuguaaauugaauuuuuuaaagaaauag

SEQ ID NO: 67386 - RNA, 63 nt, hsa
agaaucguucaacugucaaucagccucuugauucuuuguaaauugccaggguggguggguaca

SEQ ID NO: 67387 - RNA, 63 nt, hsa
ccacucugcuuccuuggacaauaucaguaauagcuuuguaagugauguggacguaauugccua

SEQ ID NO: 67388 - RNA, 63 nt, hsa
uuugcccucccaucccguuuagaguuauuuaggcuuuguaacgauugggggauaaaaagaugu

SEQ ID NO: 67389 - RNA, 63 nt, hsa
uuaaaacacuaacggaaacccauggaguuuguccuuuguaaaaauuuuaaacacagugucuug

SEQ ID NO: 67390 - RNA, 63 nt, hsa
uacuccaaugguguacaaugucuuuugcacaaacuuuguaacuuuuguuacugugaauucaaa

SEQ ID NO: 67391 - RNA, 63 nt, hsa
gguuuuuaauauaaagguguuaagcuuauuuugcuuuguaaguaaagaauguguauauuguga

SEQ ID NO: 67392 - RNA, 63 nt, hsa
gcuguuuuguuuuguguuguugaauuugaaagccuuuguaaauaucaauauaauguaccaaug

SEQ ID NO: 67393 - RNA, 63 nt, hsa
gaaagcuauauacuugugcuaucuaaagcacuacuuuguaaagaugacuacccaagauuguaa

SEQ ID NO: 67394 - RNA, 63 nt, hsa
uguuuucaaugaauuaagaaagauuaaauauaucuuuguaaauuauuuuaugucauaguuuaa

SEQ ID NO: 67395 - RNA, 63 nt, hsa
gguguuuugccagccugaacuauauuuaagagacuuuguaaaaaagaaaaauguauauagcug

SEQ ID NO: 67396 - RNA, 63 nt, hsa
uauaagauuuugguucuacuugcuauaugccuccuuuguaaaaauaaacaccgaggcuuacug

SEQ ID NO: 67397 - RNA, 63 nt, hsa
guaguauuccugagcaaaacguggcuuucaucgcuuuguaaaaauuugcaucuguuuagaaac

SEQ ID NO: 67398 - RNA, 63 nt, hsa
uccucucagaagcacaagugcauacuaggaaggcuuuguaaacugguuuuguaggcaggcugu

SEQ ID NO: 67399 - RNA, 63 nt, hsa
uugcuuuuagcagauaugaagauuuccuuauuucuuuguaauugugcagauauuuugaaaggc

SEQ ID NO: 67400 - RNA, 63 nt, hsa
cucucaaaaagcuuauuaagccugaaaagccaacuuuguaacauauuuaaaacugcuauuuuc

SEQ ID NO: 67401 - RNA, 63 nt, hsa
agcaaagccaauggagaguauuucacaaaaauacuuuguaaaugagaugccaguaguguucaa

SEQ ID NO: 67402 - RNA, 63 nt, hsa
aaugaaaagcacauaaauguaaucuacuuugaacuuuguaaaaaugauguguggaggcuauuc

SEQ ID NO: 67403 - RNA, 63 nt, hsa
auacuuuuggacuugaaaauuauuucuucucuacuuuguaaccaaaugcaaucggugugccuu

SEQ ID NO: 67404 - RNA, 63 nt, hsa
uauaauuugaauaauuuugagcuaucaaaaugucuuuguaauuuucacaaccgcuguccauug

SEQ ID NO: 67405 - RNA, 63 nt, hsa
uguaccccaaugcaaaaccuucgucucuuugugcuuuguaaagcaaacucaagaaaacuggua

SEQ ID NO: 67406 - RNA, 63 nt, hsa
agccguuuggaaguguucuuugauauuacaguucuuuguaaaaugaccugcgaauuacccuaa

SEQ ID NO: 67407 - RNA, 63 nt, hsa
aaauccaugguuaucugagauaggagauacaaacuuuguaauucuaauaaugcacucaguuua

SEQ ID NO: 67408 - RNA, 63 nt, hsa
uccugccccucacuucuuaacauauuccugugucuuuguaauggccaaauuucuccuuccacu

SEQ ID NO: 67409 - RNA, 63 nt, hsa
gauaacgagagggggaaaaaaagcuacuacugccuuuguaacuuccacuuagccuacuacagg

SEQ ID NO: 67410 - RNA, 63 nt, hsa
gguauucugccagccugaacuauauuuaagaaacuuuguaaaaaauaaaaauguauauagcug

SEQ ID NO: 67411 - RNA, 65 nt, hsa
gaauuguugggguuuuuuuuguuguuuuguuuuguuuuguagauggaguuucacuuuuguugccc

SEQ ID NO: 67412 - RNA, 65 nt, hsa
uuguuguugucauugauuuuggugacauggacuuguuuguagaggacaggucagcugucuggcuc

SEQ ID NO: 67413 - RNA, 65 nt, hsa
uucuacaaaagucacuacagauuuugcuauauugcuuuguagauagauuuuuacuuuugccuaaa

SEQ ID NO: 67414 - RNA, 65 nt, hsa
uguuagguaacuuaggggccagaaucuccaugcacuuuguagaccacauuuccuguuaugaaauu

SEQ ID NO: 67415 - RNA, 65 nt, hsa
uguggagccuaucagaccccaagugucuugaaauguuuguagaaacccacuaaaaugccccuucu

SEQ ID NO: 67416 - RNA, 65 nt, hsa
acugcauuuuaguauuucucuuccauucuccugguuuuguagacccagaagauugaaugagugac

SEQ ID NO: 67417 - RNA, 65 nt, hsa
auguugcugugaccuguuuuucuuucucauucacauuuguagauauugugugaacuacaguauau

SEQ ID NO: 67418 - RNA, 65 nt, hsa
uuguaguauuugaauacugucaacuugacaguaacuuuguagacuuaaugguauuauuaaaguuc

SEQ ID NO: 67419 - RNA, 65 nt, hsa
cuuuuauaagcacuccagggaagauuuuauauuuuuuuguagaguuuuuggaaagauauuuacuc

SEQ ID NO: 67420 - RNA, 65 nt, hsa
gacuugcuuacuguauuugcauuguuagaaaacaguuuguagacaaugauucuuuuuuaauaaaa

SEQ ID NO: 67421 - RNA, 65 nt, hsa
gaugugaugaggauuaaaugaaucaaaagacuuaauuuguagauucuuuuagaguuaugagcuag

SEQ ID NO: 67422 - RNA, 65 nt, hsa
aucagaacagagacuuaauuuuuuaaaucuuaagauuuguagaauguuucuaggauaggauauua

SEQ ID NO: 67423 - RNA, 65 nt, hsa
accgccaucaugacgcucauacuggcuuuugccuguuuguagaggaaaaggugggcugguuuuag

SEQ ID NO: 67424 - RNA, 65 nt, hsa
uuugucauuuuugauaauuuaaauauugcugcugcuuuguagaugaugagaagaaauguuaaagu

SEQ ID NO: 67425 - RNA, 65 nt, hsa
ggaagaggccaugguuuguuggagacaagaucaccuuuguagauuuccucgccuaugauguccuu

SEQ ID NO: 67426 - RNA, 65 nt, hsa
uuccauucacaugcucauauguuuauaaacuguguuuuguagaagaaaaagaaucauaacaauac

SEQ ID NO: 67427 - RNA, 65 nt, hsa
cuuuacuuucuucugucuuuuacagcucuuugcauuuuguagaccuuaauacucagguuaaauau

SEQ ID NO: 67428 - RNA, 65 nt, hsa
cacaugccaccaugcccagcuaaauuuuuaauauuuuuguagagauggggucuugcuguguuacc

SEQ ID NO: 67429 - RNA, 65 nt, hsa
caccaccacaccuggcuaauucuucuuaaaauuuuuuuguagagacagggucucacuauguugcc

SEQ ID NO: 67430 - RNA, 65 nt, hsa
ccuguccccacacaggucaagacuacagagaaggcuuuguagaaaugugucaccuauguacaccu

SEQ ID NO: 67431 - RNA, 65 nt, hsa
auaccucaucuguucuuuuuaauauuuuaucucuguuuguagagagcuaacguuugauaguucua

SEQ ID NO: 67432 - RNA, 65 nt, hsa
ccucuuauaacuucugaaguaauuuguaaaaaagauuuguagagucaaucauguguuuaaauuau

SEQ ID NO: 67433 - RNA, 65 nt, hsa
acagacagaagcccgaaguggaaagaccuuaugguuuuguagauauggugacuccagucuuuguu

SEQ ID NO: 67434 - RNA, 65 nt, hsa
aaacuccaaaccuccuguuagcuguuauuucuauuuuuguagaaguaggaagugaaaauagguau

SEQ ID NO: 67435 - RNA, 65 nt, hsa
uauacaguggauuaauuaaaugcagcgaaccaauauuuguagaaggguuauauuuuacuacugug

SEQ ID NO: 67436 - RNA, 65 nt, hsa
uuuaauuuuuuugagauuaucggcggcacaaucacuuuguagaaacuguaaaaaauaaaaguauc

SEQ ID NO: 67437 - RNA, 65 nt, hsa
agcuucccuguagcccaccuuccccuugcuucauguuuguagaggaaccuugugccggccaggcc

SEQ ID NO: 67438 - RNA, 65 nt, hsa
caggugugcaccaacacacccggcuaauuuuuguauuuguagaagaggcgggguuucaccauguu

SEQ ID NO: 67439 - RNA, 65 nt, hsa
acagagccuuuucuguccuguagauaaucuacauguuuguagaauuauuuugaauauguuugagg

SEQ ID NO: 67440 - RNA, 65 nt, hsa
ucaccucugucgcuuggguuaaacaagagacagguuuuguagaauauugauugguaauaguaaau

SEQ ID NO: 67441 - RNA, 65 nt, hsa
ccuauaauccccauaucaaccuuauaaggaagguguuuguagaugaugcaacugagccuuaagag

SEQ ID NO: 67442 - RNA, 65 nt, hsa
uacugguuugcauguacccacccaaaaugauuauuuuuguagaaucuaaguuaaacuuacuauuu

SEQ ID NO: 67443 - RNA, 65 nt, hsa
auuaaauucuacagcuuuuuuuugauauauggaaauuuguagaacagaaauauuuuaguuaaagu

SEQ ID NO: 67444 - RNA, 65 nt, hsa
ugacucuggcuaaaauuaucuaauuuccagaugcuuuuguagaugacugaaguauuugugagcca

SEQ ID NO: 67445 - RNA, 65 nt, hsa
ccuccacacccgugagaaauccuggagaggguauuuuuguagaguguagacuguggcuagugaca

SEQ ID NO: 67446 - RNA, 65 nt, hsa
uccaguuuaaguguagacaacuccuauuuuacaaauuuguagaaauuauuuacuagaagcuuccu

SEQ ID NO: 67447 - RNA, 65 nt, hsa
caggcuggcuagcccuucccuccauccuguaggauuuuguagaugcugguaggggcuggggcuac

SEQ ID NO: 67448 - RNA, 65 nt, hsa
accacugcaaguccuuuuguaaagugaagaauccuuuuguagaaugaaccacugccccuucauug

SEQ ID NO: 67449 - RNA, 65 nt, hsa
aacuacaggcacaugccaccaugcccagcugauuuuuuguagagacagggcuucaccauguugcc

SEQ ID NO: 67450 - RNA, 65 nt, hsa
gugugccaccaugccucacuaauuuuuguauuauuuuuguagagacgguguuuugccauguuggc

SEQ ID NO: 67451 - RNA, 65 nt, hsa
ugcuguuuuaaauuauaaaaccuuuauauuucugcuuuguagaaauuauauguuuuguaguauuc

SEQ ID NO: 67452 - RNA, 65 nt, hsa
gcuuacacccaagaccaguuaauuuuuuguauuuguuuguagagauguguuuuuccauguugccc

SEQ ID NO: 67453 - RNA, 65 nt, hsa
uuugcuauggcaggauaagaaagccuaaaauugaguuuguagaacuuuauuaaguaaaauccccu

SEQ ID NO: 67454 - RNA, 65 nt, hsa
uguguaaugcagaauaaugauuuuauuucuacagcuuuguagauucuaacauuuauguaucuuua

SEQ ID NO: 67455 - RNA, 65 nt, hsa
aaaccaaagaguugccugcagguugguaaugugacuuuguagauauuccuugauuaaagccagac

SEQ ID NO: 67456 - RNA, 65 nt, hsa
acuuucacagugaagugccuuuuuccuagaagugguuuguagacuuccuuuauaauauuucagug

SEQ ID NO: 67457 - RNA, 65 nt, hsa
ccaugacaccugcaaaauaaguucugccugggcauuuuguagauauuaacaggugaauucccgac

SEQ ID NO: 67458 - RNA, 65 nt, hsa
gacaagaauauucaaaauucugcgccuuuuucuaauuuguagauuucaguuuccgucguucacuu

SEQ ID NO: 67459 - RNA, 65 nt, hsa
auuuucaugcaaauaaguaaggguggguuuuauauuuuguagaaguuuucgguccuauuuuaaug

SEQ ID NO: 67460 - RNA, 65 nt, hsa
ugcagugguauuuacaacuaauugaucacaaccaguuuguagauuucuuuguuccuucuccauuc

SEQ ID NO: 67461 - RNA, 65 nt, hsa
gcuuggguggugagggugcuuauccuuucuguuauuuuguagaugaaaaaacuuucuggggaccu

SEQ ID NO: 67462 - RNA, 65 nt, hsa
gaagaauaaguaacacucccaaacacagacauacuuuuguagaaguggaccaacuucaaagcucu

SEQ ID NO: 67463 - RNA, 65 nt, hsa
ccaugucuggcuaauuuuuuuuuuuuuuuuuuuuuuuuguagagacaggguuucgccauguugac

SEQ ID NO: 67464 - RNA, 65 nt, hsa
ucaauuuuaaaacauaaaaaguggaaauuuccuuuuuuguagacaguaggaacaaggaauuauau

SEQ ID NO: 67465 - RNA, 65 nt, hsa
gaauauucauaugaaaauacuugauuugcucuuauuuuguagaagacaaagaaguauguaauugu

SEQ ID NO: 67466 - RNA, 65 nt, hsa
uacaacuuguuucucccccuuuuccuuuuaagcuauuuguagaguuuaugacuaaauagucugug

SEQ ID NO: 67467 - RNA, 65 nt, hsa
guggccuuuucaaggccuagucccagggaaaacauuuuguagaguauaggggagugggaggaagg

SEQ ID NO: 67468 - RNA, 65 nt, hsa
ugauaggaaguuucucgaguuagccuucaugcaauuuuguagauuaaaacauaaaauuuguccag

SEQ ID NO: 67469 - RNA, 65 nt, hsa
aacuucagggcuuggaggugguguuugcacugcuuuuuguagagagggucaccuacuagaagaga

SEQ ID NO: 67470 - RNA, 65 nt, hsa
ccugacugacccuccugaacugcacuacaagacacuuuguagaagaggagaugagaguuucuagu

SEQ ID NO: 67471 - RNA, 65 nt, hsa
uguaauguaaaggguggaaaggccucaagcucacauuuguagagagagagcgagagaaaucagag

SEQ ID NO: 67472 - RNA, 65 nt, hsa
gcaggcaccaccauacccagcuaauuuuuguauuuuuuguagagaugggguuucgccauguugcc

SEQ ID NO: 67473 - RNA, 65 nt, hsa
aaagguguuauuuugacaauuaggcauaacauuguuuuguagauuaucuuuuaaugaacuauuuu

SEQ ID NO: 67474 - RNA, 65 nt, hsa
aaaaucuggauuuuuacaaccuuuucuauugauguuuuguagaaauaagacaggguacuaauuuu

SEQ ID NO: 67475 - RNA, 65 nt, hsa
auuuucgaugcuuuuauggguauuuuuguaguuucuuuguagagagauaauaaaaaucaaaauau

SEQ ID NO: 67476 - RNA, 65 nt, hsa
uauaucuaccauuguauguuaaauaaaucaccauuuuuguagaaaaaauucuaccugagaguaau

SEQ ID NO: 67477 - RNA, 65 nt, hsa
guaguuugaaggcggucagauuucuuugagaaaucuuuguagaguuaauuuuauggaaauuaaaa

SEQ ID NO: 67478 - RNA, 65 nt, hsa
aagacagguugagccuuaaucauguaacaaaauauuuuguagauuacauauugauuuuucaaaaa

SEQ ID NO: 67479 - RNA, 65 nt, hsa
uaugcaccaccaugccuggcuaauuuuuuguauuuuuuguagagaugggguuucgccauguugac

SEQ ID NO: 67480 - RNA, 65 nt, hsa
gcuaaauguugguaaauacuaauuaauuuccaucauuuguagacuuguuuugcaaugggauauau

SEQ ID NO: 67481 - RNA, 65 nt, hsa
ccuuaauuuaagcuuucuagaaagcuuuggaaguuuuuguagauaguagaaaggggggcaucacc

SEQ ID NO: 67482 - RNA, 65 nt, hsa
ucuguaaaguggcugguaacaacagcacuuuacaguuuguagauguaaccaguagcugaucuuaa

SEQ ID NO: 67483 - RNA, 65 nt, hsa
gugugugccacuaugccuggcuaauuuuuguauuuuuuguagagacgggguuuugccauguugcc

SEQ ID NO: 67484 - RNA, 65 nt, hsa
ucauuucuuguaaaacuuguaaauaaacuaucaucuuuguagauaucuuaaagguguaaaguuug

SEQ ID NO: 67485 - RNA, 65 nt, hsa
cuucucuucuucgggauguuguuugcugucugaucuuuguagacuguuccuguuugcugggagcu

SEQ ID NO: 67486 - RNA, 65 nt, hsa
ccagguuagaggcuccaagcagacaaagaagaaaguuuguagacacaauauucuaacauugcaca

SEQ ID NO: 67487 - RNA, 65 nt, hsa
uuuaugugcaaggugauaggaaaacugaauccaucuuuguagaagagcacugggcuaauuuguau

SEQ ID NO: 67488 - RNA, 65 nt, hsa
guggguauacguuuuuaccuuuuuuaaaaaacauuuuuguagaaaaaauaauuaaauccccuuuu

SEQ ID NO: 67489 - RNA, 65 nt, hsa
aaaugaauuuuuuuuccccuugauuuaacaggauuuuuguagacuuuagaauuuggacuuaccua

SEQ ID NO: 67490 - RNA, 65 nt, hsa
uccugucaugcagaguauaagaaugcuuugaacaauuuguagacuuagugaaauaaaauaagagg

SEQ ID NO: 67491 - RNA, 65 nt, hsa
ccccuuuacaaagccgcugaccccugaugugaaacuuuguagagcagcagaguggcugcgugaaa

SEQ ID NO: 67492 - RNA, 65 nt, hsa
cuuacuuuuuuccuuugucuuuggcugauuucugcuuuguagauaaauaauaauagcccugagau

SEQ ID NO: 67493 - RNA, 65 nt, hsa
uuauuuauccuugucugaauguauuuauguguauauuuguagauuuauccagccgagcuuaggaa

SEQ ID NO: 67494 - RNA, 65 nt, hsa
gugcgccaccacaucuggcuaauuuuauuuuuauuuuuguagagacaggagucuugccauguugc

SEQ ID NO: 67495 - RNA, 65 nt, hsa
cacugucacguauauaaauugcuucuucauuuuaauuuguagaaguacuuuacaguaggaaacgc

SEQ ID NO: 67496 - RNA, 65 nt, hsa
auuuuguuuuuuuuuaauugugucuuacagucaaguuuguagauuuucauaagccacaauuuuaa

SEQ ID NO: 67497 - RNA, 65 nt, hsa
uuuucauggugcuauuaauuacaaguuuaguucuuuuuguagaucauauuaaaauugcaaacaaa

SEQ ID NO: 67498 - RNA, 65 nt, hsa
gcaucacauuuaacauguuaucuacuuagaaagcauuuguagagcugcugaauuuguuuuguguu

SEQ ID NO: 67499 - RNA, 65 nt, hsa
uauuugacuucacugacagaaaagaaaccagggaguuuguagagacugugcauuuuuaguauaac

SEQ ID NO: 67500 - RNA, 65 nt, hsa
uacuuaguuuuauaaacacugcucauuuuuggauguuuguagauaacaaugaauuguuacccauc

SEQ ID NO: 67501 - RNA, 65 nt, hsa
uuuuauggacugauauuuugcuguguaacuuguucuuuguagauugucaucugcagugcugcaaa

SEQ ID NO: 67502 - RNA, 65 nt, hsa
agaggaagucaaaauuuauuuaacaccuaagccuuuuuguagacucuuuucuauauauugcuuag

SEQ ID NO: 67503 - RNA, 65 nt, hsa
caugcgccaccaugcccagcugauuuuuguaauuuuuuguagagaugggguuucgugacauugcc

SEQ ID NO: 67504 - RNA, 65 nt, hsa
guaguucuuuugagucugacauucuaauaaaauaauuuguagaaaccauuugucuuuguagugau

SEQ ID NO: 67505 - RNA, 65 nt, hsa
gcuaccuguaauaaguguggauuauauuuuuggguuuuguagaauauugcaaauuaaccacacaa

SEQ ID NO: 67506 - RNA, 65 nt, hsa
gaacuauacagcgaagagacaaucucuggcaaguuuuuguagaaaaaauguuucagugccuaguc

SEQ ID NO: 67507 - RNA, 65 nt, hsa
ucucugagugccccucacuuacauguuuaucuuuguuuguagaggcuauguuuaggauauuuugc

SEQ ID NO: 67508 - RNA, 65 nt, hsa
guaauguuacacuuuaaaggacagcaaauaagaacuuuguagaaucccaccaggacuuugcuaac

SEQ ID NO: 67509 - RNA, 65 nt, hsa
augguucuaaggaaagccuuugcaaucuugcaagauuuguagaccagcacuacaaagaucgcaua

SEQ ID NO: 67510 - RNA, 65 nt, hsa
agagacaucuuggcaccucaucccaacaaaucacauuuguagaaauguaaugcgguucugagugg

SEQ ID NO: 67511 - RNA, 65 nt, hsa
gaaaacuugcuuuaaagcuuuaccugaccugucaguuuguagacaaacaacugauaauaagcuuu

SEQ ID NO: 67512 - RNA, 65 nt, hsa
uacuaugacuaaaugaaauuauuucuuacaucuaauuuguagaaacaguauaaguuauauuaaag

SEQ ID NO: 67513 - RNA, 65 nt, hsa
auuauaaacagcucggcuuguccuugucccauguguuuguagacacacaugcauacuguccaaag

SEQ ID NO: 67514 - RNA, 65 nt, hsa
gucgguguauuugguaccccuccaaugcuggucuuuuuguagaaacucaguagagaaagucuagc

SEQ ID NO: 67515 - RNA, 65 nt, hsa
gguggagggagggagcuacgggcaggaggaagaauuuuguagagcugccagcgcucucccagguu

SEQ ID NO: 67516 - RNA, 65 nt, hsa
acuggucacagccacgugcucauuccauucuucuuuuuguagacuuugggcccacguguuuuaug

SEQ ID NO: 67517 - RNA, 65 nt, hsa
ugguauaugcucaucugagugacggauaugugaaauuuguagaacugguuagucaaauggccaga

SEQ ID NO: 67518 - RNA, 65 nt, hsa
caugcucugaaagauuuuuuuuaguuuuuaauuuuuuuguagagauggggucucgcuuuguuggc

SEQ ID NO: 67519 - RNA, 65 nt, hsa
uuacuaaggaguuuuuauuguguaaucacuaagucuuuguagauaaagcagauggggaguuacgg

SEQ ID NO: 67520 - RNA, 65 nt, hsa
acaugagccaccgagccuggccaauuuuuguguuuuuuguagagacgagguuuugccauguugcc

SEQ ID NO: 67521 - RNA, 65 nt, hsa
uuuccaauuuuucauuuuuuguuuguuauuuguuuuuuguagacagcacucugucacccaggcug

SEQ ID NO: 67522 - RNA, 65 nt, hsa
caugcaccaccacguccaucuaaauuucuuuauuauuuguagagaugaggucuugccauguuacc

SEQ ID NO: 67523 - RNA, 65 nt, hsa
uuuccccauaaaugaaauggguaaauaaugccccauuuguagaagugggcccucaugacugaggu

SEQ ID NO: 67524 - RNA, 65 nt, hsa
aagcuugacagauugaaagacaagugucauuuuuuuuuguagagggugauauauaccauguaaau

SEQ ID NO: 67525 - RNA, 65 nt, hsa
uuuuuauugcaguaggaggaaauauauuuaaaauauuuguagauuuauagcaaauagagacucgu

SEQ ID NO: 67526 - RNA, 65 nt, hsa
uuuaucugcaugacgauaacuaggcauucuauccauuuguagaucagagaaagugaagagauuau

SEQ ID NO: 67527 - RNA, 65 nt, hsa
uagcuuuaguauacucaggaaaagaaugaccaucuuuuguagaauguuuauacauuuuugcauau

SEQ ID NO: 67528 - RNA, 65 nt, hsa
acaguugagugcagaaaucucugcuucuaaaauuauuuguagagauuacaggaaacaaaugcuuu

SEQ ID NO: 67529 - RNA, 65 nt, hsa
acugaaaauucauuuugagaccaagcaggaucaaguuuguagaauaaacacugguuuccuagcca

SEQ ID NO: 67530 - RNA, 65 nt, hsa
uacuuuguguuuuuuuaauuucuaagaaguuacuuuuuguagagagagcuguauuaagugacuga

SEQ ID NO: 67531 - RNA, 65 nt, hsa
gcacaccuccaaaccuggguaguuuuugaaguuuuuuuguagagguggucuagccauguugccua

SEQ ID NO: 67532 - RNA, 65 nt, hsa
gaaaaugugaaacacaauuuaguccucauuauuuauuuguagauccugcagcaucauguuguaau

SEQ ID NO: 67533 - RNA, 65 nt, hsa
uaccuuucauuuucucuuuauguuauucuuucacuuuuguagauuacauuuaauagcuuguuacc

SEQ ID NO: 67534 - RNA, 65 nt, hsa
uacaaugccaguuugcaauaguugauuuugaugccuuuguagaauauuuuuucugaauccuuaug

SEQ ID NO: 67535 - RNA, 65 nt, hsa
cuuuugucugcuuucuuaagaccaguuguucacacuuuguagauauuagacaaauauauuucgau

SEQ ID NO: 67536 - RNA, 65 nt, hsa
gucccagcgacauuucuccaaguggaaauccuauuuuuguagaucuccaugcuuugcucucaagg

SEQ ID NO: 67537 - RNA, 65 nt, hsa
ugugugccacccugccagcuaauuuuuuauauuuuuuuguagagacaaaacuuuuauuuuuuuuu

SEQ ID NO: 67538 - RNA, 65 nt, hsa
ggcacaaaccaccaugcccagcuaauuuuguauuuuuuguagagacaggguuucaccauguugcc

SEQ ID NO: 67539 - RNA, 65 nt, hsa
cauaauaacccaaaacaaauaauuacuugaauauguuuguagagauacuauuuaauuuauucaua

SEQ ID NO: 67540 - RNA, 65 nt, hsa
acuguuguguuauuuguucaauuucaauaaaaugauuuguagauccugcacaugagaguggcauc

SEQ ID NO: 67541 - RNA, 65 nt, hsa
uuucaacuuuuucagcuuuagaauuuguaaauauuuuuguagaauaucauaugacuguaauucca

SEQ ID NO: 67542 - RNA, 65 nt, hsa
uggaauuuuaagugcucauuguaguaaacuuuugcuuuguagauuugaagguacagacuuauaca

SEQ ID NO: 67543 - RNA, 65 nt, hsa
aggaauacaaguuuguagcucuaugugcaucuauuuuuguagaaauacaaaaaguuugguuuagc

SEQ ID NO: 67544 - RNA, 65 nt, hsa
cauaaauuugacauucccucuuccauaaaccuuuguuuguagauuuaauguugaacaguacuuuu

SEQ ID NO: 67545 - RNA, 65 nt, hsa
uggauuaugcaacagcauauguaauaugggaauguuuuguagauaauaaaacuuacaugaucugu

SEQ ID NO: 67546 - RNA, 65 nt, hsa
cuuuuucugugguaucggcuauacuagggaaccauuuuguagaagaaggaacgaugacaggucgc

SEQ ID NO: 67547 - RNA, 65 nt, hsa
ucagcacucaguuauuugcaaguguauuucuuugcuuuguagaguauuuuuauuggguguuaacu

SEQ ID NO: 67548 - RNA, 65 nt, hsa
uaaaaaauuaucaauauguauaauuuuuuuugaauuuuguagauauguuuccuauaauauuccug

SEQ ID NO: 67549 - RNA, 65 nt, hsa
ggcgaugcauuuacagauuucuaggcccucaggguuuuguagagugugagcccuggugggcaggg

SEQ ID NO: 67550 - RNA, 65 nt, hsa
uggaucauggacaugagcuggaaaaaugauguauuuuuguagauuguauguccagaaugacuuua

SEQ ID NO: 67551 - RNA, 65 nt, hsa
uucuuagaaaguacccacauacucuuuuuuuuuuuuuuguagaaguagcugucauagagugaaga

SEQ ID NO: 67552 - RNA, 65 nt, hsa
uuuuuuaauuuacagaucauauuuauuuuacuauuuuuguagaaaauuauuaauuuugauuguau

SEQ ID NO: 67553 - RNA, 65 nt, hsa
ucagggaagaagugcuauaucuccuauauuguauuuuuguagaaaauuuguauuuuauguuguug

SEQ ID NO: 67554 - RNA, 65 nt, hsa
cauucccagagcuucagucucugugcauacucagcuuuguagaaccaugcugcaaagccauauac

SEQ ID NO: 67555 - RNA, 65 nt, hsa
uacuaauguggacauauagauuauucguauuauaguuuguagaacuaccuaguucagaaucuuga

SEQ ID NO: 67556 - RNA, 65 nt, hsa
uaaucuugcagcaccaugccgagcuaauuuuauuuuuuguagagaugagcucucacuaugucacc

SEQ ID NO: 67557 - RNA, 65 nt, hsa
augcaugcuuuucuucuguaaauauauaauaaauuuuuguagauagucuugaugugugaucuuua

SEQ ID NO: 67558 - RNA, 65 nt, hsa
uaguaaccuuuaaaaauguauaaugacuuuuaaaauuuguagaauugaaaagacgcuaauaaaaa

SEQ ID NO: 67559 - RNA, 65 nt, hsa
agaaucuccagaacaaccuagagagugaaugcuaauuuguagagcgaacuuccauuuggcccauu

SEQ ID NO: 67560 - RNA, 65 nt, hsa
gcaaauauaaguaugccugguuaagauaucuucccuuuguagaaauguuacauugggauggauag

SEQ ID NO: 67561 - RNA, 65 nt, hsa
ucccaauuaauuuaccaauucaucauuuuuuuuuuuuuguagaacucccauaaacaucaccuuac

SEQ ID NO: 67562 - RNA, 65 nt, hsa
gcgcucacugcaaaaauacaauggccuacauuggauuuguagaggagaaaggagcccuguauugu

SEQ ID NO: 67563 - RNA, 65 nt, hsa
cacuaucuuuuuguuuaugauuuuaguuuuuacuuuuuguagaugugggaugaaguggacucugu

SEQ ID NO: 67564 - RNA, 65 nt, hsa
auccuuaacaacucugauauucugagauucucucauuuguagaaugcccgcugaugcauuguuua

SEQ ID NO: 67565 - RNA, 65 nt, hsa
auaggaauacuucaguuuuuccuuuuggagguuuguuuguagaaaaacuaauuugaacuauaaga

SEQ ID NO: 67566 - RNA, 65 nt, hsa
auuucuaccuuuacuacaucuuuucaacaaguaacuuuguagaaaugagccagaagccaaggccc

SEQ ID NO: 67567 - RNA, 65 nt, hsa
ccacgccugguuaauuguuuuuuuuuaauuuaucuuuuguagagaugggaucucacuauguugcu

SEQ ID NO: 67568 - RNA, 65 nt, hsa
guaaucugcagauuacuucaaaugggaaaaaucuuuuuguagacucuauaguacccucucuauuc

SEQ ID NO: 67569 - RNA, 65 nt, hsa
ggcacccgccaccacgcccagcuaauuuuuguauuuuuguagagaugggguuucacgauguuggc

SEQ ID NO: 67570 - RNA, 65 nt, hsa
ugaagcauuggauauaaauaugguguccugcuuuuuuuguagaaaauguaauuugaggaugaauu

SEQ ID NO: 67571 - RNA, 65 nt, hsa
caguuacuguuuacaagacugcuuuuaccuuaaacuuuguagauguuuacaucuuuuuguugugu

SEQ ID NO: 67572 - RNA, 65 nt, hsa
ggccuguaccgucaugccuggcuaauuuuuguauuuuuguagagacaggguuucaccauguugcc

SEQ ID NO: 67573 - RNA, 65 nt, hsa
gugcaaccauguuuggcuaauuuuuuuaauguuuuuuuguagagaugaggucuuauuauauuguc

SEQ ID NO: 67574 - RNA, 65 nt, hsa
gugugugccaccaugcccagcuaauuuuuaauuguuuuguagaaacaaaguccaggcuggucuug

SEQ ID NO: 67575 - RNA, 65 nt, hsa
aauuuaaaauaagcaauaauuaaggcacaguugauuuuguagaguauugguccauacagagaaac

SEQ ID NO: 67576 - RNA, 65 nt, hsa
auuaucagaaaugaaugcauuuuuacaaaaaccuuuuuguagacuguaguuuauugauuaguuca

SEQ ID NO: 67577 - RNA, 65 nt, hsa
cgcccgccaccacacccggcuaauuuuuuguauuuuuuguagagacgggguuucaccauguuagc

SEQ ID NO: 67578 - RNA, 65 nt, hsa
aauaaaagguuaucuuauagucgugacuuuaaacuuuuguagaccacaauucacuuuuuaguuuu

SEQ ID NO: 67579 - RNA, 65 nt, hsa
auaaauauguacucaaaaggcauuuccgcuuacaauuuguagaaacacaaaaugcguuuuccaua

SEQ ID NO: 67580 - RNA, 65 nt, hsa
gauauaguagagauuguugucugugaaauuucucuuuuguagauuuugaguuuucccuuguagug

SEQ ID NO: 67581 - RNA, 65 nt, hsa
ccaaaagaaaugccucauaguucuuaaccucaacuuuuguagaaguauuuuuuucucuguaauau

SEQ ID NO: 67582 - RNA, 65 nt, hsa
ccuacaaaauuuucagauuggaaauuacucuuguauuuguagaagauugucucuaaaauuguggu

SEQ ID NO: 67583 - RNA, 65 nt, hsa
uacacaugcacucaguguggacugggaagcauuacuuuguagauguauuuucaauaaagaaaaaa

SEQ ID NO: 67584 - RNA, 65 nt, hsa
uacaacuuuccaucccccacacaguuggagaauaauuuguagaccauggcaguuaaaaugcuuuu

SEQ ID NO: 67585 - RNA, 65 nt, hsa
auucucguaggucaaaagggucuagugauggaaguuuuguagauaaguaccaggcaucucaguaa

SEQ ID NO: 67586 - RNA, 65 nt, hsa
acuuuguguauaugauuuaaucuuuuauuuuuauuuuuguagaauggggguaaaacuacaaaucu

SEQ ID NO: 67587 - RNA, 65 nt, hsa
agaaugcaaccaagucacacgcuuuugaauuaugcuuuguagaguuuugucauucagagucagcc

SEQ ID NO: 67588 - RNA, 65 nt, hsa
cucugggccuuuguuccuaucuguaaaugagaaaguuuguagauauugccaagauuucccaggcu

SEQ ID NO: 67589 - RNA, 65 nt, hsa
ugcaauauuuauuuucuuguauuagaaaagauuccuuuguagagaaaaaauguauuuuucauuaa

SEQ ID NO: 67590 - RNA, 65 nt, hsa
uuuuguuuuaucagaauggcaacagacagaaguacuuuguagagauugacuuccuaagcuacuua

SEQ ID NO: 67591 - RNA, 65 nt, hsa
agucuugauccuugccugauucccaucugcugcucuuuguagaaaagguuuccucuagaacugaa

SEQ ID NO: 67592 - RNA, 65 nt, hsa
uuguaagacauucaguauguguaaauguguuuguguuuguagacaaaaggcaaagguauuaugua

SEQ ID NO: 67593 - RNA, 65 nt, hsa
gcgugcgccaccaugcccggcuacuucuuguauuuuuuguagagacggaucgucaccauauuucu

SEQ ID NO: 67594 - RNA, 65 nt, hsa
uuucucuucucacauuuuuuaaaugguccccuguguuuguagagaacucccuuauacagaguuuu

SEQ ID NO: 67595 - RNA, 65 nt, hsa
aaaaaaaauaacacuuaacuaaaaccccuaggucauuuguagauauauauuuccaaauauucuaa

SEQ ID NO: 67596 - RNA, 65 nt, hsa
aguauaaugaaaagaaugaccuauaauauagguguuuuguagauucuugugucacugcaaacaau

SEQ ID NO: 67597 - RNA, 65 nt, hsa
gaacccccagaugagaaaauaggaaggagcaaucauuuguagaugggugaaaaaagaaugagguu

SEQ ID NO: 67598 - RNA, 65 nt, hsa
uguacccuaauaguuacuauguuuuguaaauccauuuuguagagggcauguaaauaaauguuuuc

SEQ ID NO: 67599 - RNA, 65 nt, hsa
auuccagaacaaaucauuauguuuccuaacugugauuuguagauuuacuuuuugcuguuaguuau

SEQ ID NO: 67600 - RNA, 65 nt, hsa
augcacaccaccacaccuggcuaauuuuuguguuuuuuguagagauggagauucacucgacuaau

SEQ ID NO: 67601 - RNA, 65 nt, hsa
aggaaauaaaggaaaaucaaguauaaucccugagauuuguagacuaaaggcaaugaugugggacu

SEQ ID NO: 67602 - RNA, 65 nt, hsa
auugagguucacagaugaaauauucuuuggcauacuuuguagacuuugaccacuuaaaauacuaa

SEQ ID NO: 67603 - RNA, 65 nt, hsa
accucuacauuuuguaugauauguaaaacagauuuuuuguagagcuuacuuuuauuauuaaaugu

SEQ ID NO: 67604 - RNA, 65 nt, hsa
aaauaccaaaagcuuccuacguguauauccagagguuuguagauaaauguugccaccuuguuugu

SEQ ID NO: 67605 - RNA, 65 nt, hsa
cuccaugcuuugcuaaccaagauaacuguuuucucuuuguagaaguuuuguuuuugaaaugugua

SEQ ID NO: 67606 - RNA, 65 nt, hsa
cacgccacuaugcauggcuaauuuuuguuuaauuuuuuguagagauguggucacacuguguugcc

SEQ ID NO: 67607 - RNA, 65 nt, hsa
aguggugauuaccggcauuuuauuaaacuuaaaacuuuguagaaagcaaacaaaauuguucuugg

SEQ ID NO: 67608 - RNA, 65 nt, hsa
cauuuuaaguaugagaugacugaucuuaugaauguuuuguagaaaauguuauaauuuaacagucu

SEQ ID NO: 67609 - RNA, 65 nt, hsa
gugaugucuuuuuaacuuuuuggaaagagguaucauuuguagaaaaaauuugauuuggguuaaau

SEQ ID NO: 67610 - RNA, 65 nt, hsa
uuaaaaaaguuaaaucaauugaguaaauuuuagaauuuguagacuuguagguaaaauaaaaauca

SEQ ID NO: 67611 - RNA, 65 nt, hsa
gccccugaagacgaggugaaaagucaauuuuacaauuuguagaacucuaaugaagaaaaacgagc

SEQ ID NO: 67612 - RNA, 54 nt, hsa
guuucauuccuuaccacuaggcccuuuguagacacuguuacuuucccccucccc

SEQ ID NO: 67613 - RNA, 65 nt, hsa
acugaggccuugcaagucaagcuggcugugccauguuuguagauggggcagaggaaucuagaaca

SEQ ID NO: 67614 - RNA, 65 nt, hsa
gcauucuugauuaccuacugugugccaaacaagauuuuguagaauauugcaaaaaugaccauaaa

SEQ ID NO: 67615 - RNA, 65 nt, hsa
ugugugauccgguuucuuuuugcucgccccuguuuuuuguagaaucucuucaugcuugacauacc

SEQ ID NO: 67616 - RNA, 65 nt, hsa
ggugcgcacgaccauacccagcuaauguuuuauuuuuuguagagacgaggucucacuauguugcc

SEQ ID NO: 67617 - RNA, 65 nt, hsa
gaaggaagaagaguaaaauuggcauauuuagguuuuuuguagaagaaagauacaagugaaaauua

SEQ ID NO: 67618 - RNA, 65 nt, hsa
cacaccugucuaaaaaguauguauuuuuaaauuuuuuuguagagacaggaucucacuauguucuc

SEQ ID NO: 67619 - RNA, 65 nt, hsa
gcacacaccaccacaccuggcuaaguuuuguauuuuuuguagagaugggguuucucuguguugcc

SEQ ID NO: 67620 - RNA, 65 nt, hsa
gcauauaccaccaugcccaacuaauuuuuuaauuuuuuguagagaugagugucacuauguugccc

SEQ ID NO: 67621 - RNA, 65 nt, hsa
caaaagggaaagaauuucuguaauugccaacccacuuuguagaagaggcaugagcccuugaauuu

SEQ ID NO: 67622 - RNA, 65 nt, hsa
acaggcaccaccacacccagcuaauuuuuguauuuuuuguagagacgggguuucgccaaguugac

SEQ ID NO: 67623 - RNA, 65 nt, hsa
caugcacaugacacuaugcccagcuaauuuuuuauuuuguagauaauaugcuggucagggcuggu

SEQ ID NO: 67624 - RNA, 65 nt, hsa
gugugugccacugugccaagcuaauuuuuuuauuuuuuguagagaugggauuucaccauguuacu

SEQ ID NO: 67625 - RNA, 65 nt, hsa
gcgcgugccaccacaccuggcuaauuuuugcauuuuuuguagagacaggguuuugccacguugcu

SEQ ID NO: 67626 - RNA, 65 nt, hsa
ugcaccccauauccagcuauuuuuuuucaauuuuuuuuguagagggggggucucccuauguugcc

SEQ ID NO: 67627 - RNA, 65 nt, hsa
agaacuuuaauugacaguuucaauugaaggugcuguuuguagacuuaacacccagugaaagccca

SEQ ID NO: 67628 - RNA, 65 nt, hsa
caucauugagauugguuugcuuaaaauuaacuuauuuuguagaagacaaaaugaauugcacuuca

SEQ ID NO: 67629 - RNA, 65 nt, hsa
aucuugugacuuaguagacugaugaugauauccauuuuguagacucaucaacaugugguuggccu

SEQ ID NO: 67630 - RNA, 65 nt, hsa
aaaucagacucuugccuuugcacuuuuuuuuaacuuuuguagauaauuuuuguuaauuuguuuug

SEQ ID NO: 67631 - RNA, 65 nt, hsa
aguauauacucuucuuuacauggugaugaguuucauuuguagaaaaauuuuguugccuucuuaaa

SEQ ID NO: 67632 - RNA, 65 nt, hsa
uugaguauaaauguauuuuugucuuguggccauucuuuguagauaauuucugcacaucuguauaa

SEQ ID NO: 67633 - RNA, 65 nt, hsa
uaaaucaaacaugauugauuuaaaacuucauggaauuuguagaaaauuauggacauuuuugguga

SEQ ID NO: 67634 - RNA, 65 nt, hsa
gaacaagagauuguuacgagaguggcagaaacccuuuuguagauugacuuguguuugugccaagc

SEQ ID NO: 67635 - RNA, 65 nt, hsa
uaaagguggauuugaccaaaauaaugcugguuaaauuuguagaaauguugaaauuggcuguguuu

SEQ ID NO: 67636 - RNA, 65 nt, hsa
agcuuuucuaaucgucucauuguaacauggcuuauuuuguagagguauucaucagccacacacuu

SEQ ID NO: 67637 - RNA, 65 nt, hsa
augccaugaagaauacauuagaagaauugagggacuuuguagagaauuuuguggcuuugguccaa

SEQ ID NO: 67638 - RNA, 65 nt, hsa
aguauuugcacuuuguacuuuaaauguaaauucacuuuguagaaaugagcuauuuaaacagacug

SEQ ID NO: 67639 - RNA, 65 nt, hsa
uggaguagacagggaggcugcagaagccauuucucuuuguagauaaaaagcauuaucuaugauug

SEQ ID NO: 67640 - RNA, 65 nt, hsa
gaaaaucaacaacgcuugaaguuaaaaagugugucuuuguagauuucauuguauaauguguauuu

SEQ ID NO: 67641 - RNA, 65 nt, hsa
ccacgugcuuuuguaugcccauguauucauguuuguuuguagauguuugucugaugcauuucauu

SEQ ID NO: 67642 - RNA, 65 nt, hsa
gaaauacugucugguuuuuguaaauguuaucuauuuuuguagauauuuuauauaaaaaugaaaua

SEQ ID NO: 67643 - RNA, 65 nt, hsa
uguaacuuaaaauuuuuaaugaaggauaaugaauauuuguagagucucuaugguucugucaaugc

SEQ ID NO: 67644 - RNA, 65 nt, hsa
ucaugcuagaaauuuucuauuguuuauagaaacuuuuuguagaaacauuaacucuaaagcacauc

SEQ ID NO: 67645 - RNA, 65 nt, hsa
aauuagucccuguuauaaccaguuauuuaucuuuuuuuguagauucucggucuugaagucauuug

SEQ ID NO: 67646 - RNA, 65 nt, hsa
aggcacaagcuggcugccaugcugaguaaguccucuuuguagaugauguauuuugcuugggcacc

SEQ ID NO: 67647 - RNA, 65 nt, hsa
aaaccauacuguagcaacauaauauauggagcuaauuuguagaauuauuuuuacgauuuccaaac

SEQ ID NO: 67648 - RNA, 65 nt, hsa
uaaauuucuaugugcuguguuuuguucguuuguauuuuguagagauggggucucguuuugucgcc

SEQ ID NO: 67649 - RNA, 65 nt, hsa
uaguacaucuguuaauuuaguguuucuuuguguguuuuguagacuaguguucuuccauccuucaa

SEQ ID NO: 67650 - RNA, 65 nt, hsa
uguuuuuaguuguuuuaaugguaagaauuaagacauuuguagauuuuaaagaaaaauaugaaauu

SEQ ID NO: 67651 - RNA, 65 nt, hsa
uggaaacuaaaaauagaauauuaaugacauuacuguuuguagaaugacauaugcagauuuucuca

SEQ ID NO: 67652 - RNA, 65 nt, hsa
uuuuuuuuuuauaauuaauuuuuuuuuuuuuuuuuuuuguagagacagugucucacuauguugcc

SEQ ID NO: 67653 - RNA, 65 nt, hsa
aacuucuaggaaacauccaggagguaucauauaacuuuguagaacuuaaauacuugaauauucaa

SEQ ID NO: 67654 - RNA, 65 nt, hsa
gcuuuuucuuuagcuaaaaucaauuguaaacgauuuuuguagauuauuuuuuguauguuuuagug

SEQ ID NO: 67655 - RNA, 65 nt, hsa
uaaaaaaggcuuuucauauuuaagcacauaccuauuuuguagacuuacauuguuuaauauuuauu

SEQ ID NO: 67656 - RNA, 65 nt, hsa
aucuaaccuuuuucccccccauuucaguugcaguuuuuguagaauggcuuuuucuuuuuccucuu

SEQ ID NO: 67657 - RNA, 65 nt, hsa
ccuguuuuuuuaaaauauuauugcaaagagcucuauuuguagaagcaaauuauaggcagauuacc

SEQ ID NO: 67658 - RNA, 65 nt, hsa
auauuaaucuuggcaaacugcuuaaucuuguggauuuuguagaugguuucaaaugacugaacugc

SEQ ID NO: 67659 - RNA, 65 nt, hsa
guaagucuauguuuaaauuuugaagauggugaacuuuuguagaaugagauagucgaagcuaaaac

SEQ ID NO: 67660 - RNA, 65 nt, hsa
cacacuuggguaauuaaaaaauaaauaaauacuuuuuuguagagacagggucucacuguguugcc

SEQ ID NO: 67661 - RNA, 65 nt, hsa
ggcagcggagaucagcguggacaggagcgaugcacuuuguagaugcuguggcuuuguguugcguu

SEQ ID NO: 67662 - RNA, 65 nt, hsa
uaauguguauauaacuuuaaaagaaguagaauuuuuuuguagauguauaauuacauucaaauuau

SEQ ID NO: 67663 - RNA, 65 nt, hsa
cuuuugaaauagguugucuguacauguucuaauguuuuguagaacacgugugccuguuuaagugu

SEQ ID NO: 67664 - RNA, 65 nt, hsa
aggauuuucuucaaagaauaagccacagcaaugguuuuguagaaaacuccugugcuuuugagcaa

SEQ ID NO: 67665 - RNA, 65 nt, hsa
uuauauauauuuuuuucugaaauuuccugggagcuuuuguagaagucacauuccugaacaggaua

SEQ ID NO: 67666 - RNA, 65 nt, hsa
gcgcacaccaccauccccggcuaauuuuuguauuuuuuguagagacgggguuuugccauguugcc

SEQ ID NO: 67667 - RNA, 65 nt, hsa
gcuucugaggaacaacucuaauuaguacacuuguguuuguagauuuacacuuuguauuauguauu

SEQ ID NO: 67668 - RNA, 65 nt, hsa
ucuuaaaauuccacauucauccacaaucucaucccuuuguagaaauucuugccugaauucucacc

SEQ ID NO: 67669 - RNA, 65 nt, hsa
auauaaauuccccauauuuguguucaguuccagcuuuuguagauggcacuuuagugauugcuuuu

SEQ ID NO: 67670 - RNA, 65 nt, hsa
aggcaaaugcaucccgccuugugauguaucagcuauuuguagauaaauaaauugcaggugggggc

SEQ ID NO: 67671 - RNA, 65 nt, hsa
ggugggggugacuuuuggcagcccgagacccagaguuuguagaguuuagaucucccaaugucagu

SEQ ID NO: 67672 - RNA, 65 nt, hsa
gauuuuuuuacaguuguguuuuuauacagaaauucuuuguagaaauuacuauuuuuuguuaaaga

SEQ ID NO: 67673 - RNA, 65 nt, hsa
ugcugucuaauagaacuuucugugacgauggauauuuuguagacuuuugcuguccagugugguag

SEQ ID NO: 67674 - RNA, 65 nt, hsa
acuacagguguucgccaccaugcccagcuaauuuuuuuguagagauggaguuuugccaugugguc

SEQ ID NO: 67675 - RNA, 65 nt, hsa
acauuugaguuauacucugugcugccugagcaagauuuguagaaucauauaauuaccuuuucaug

SEQ ID NO: 67676 - RNA, 65 nt, hsa
uuguauuacauugggaugcauugucaugcauauuuuuuguagaauaaauucuccuuugcuauaag

SEQ ID NO: 67677 - RNA, 65 nt, hsa
uuuaaauuuuuucuguaauuuuggaaugauguaucuuuguagaguuaaugauuuuguacauuugc

SEQ ID NO: 67678 - RNA, 65 nt, hsa
augcagcuuuugaggagucuuuuacacugggaaaguuuguagaaauuuuaaaauaaguuuuauga

SEQ ID NO: 67679 - RNA, 65 nt, hsa
ccaugcugcacuuacuccuuuugcuaauaaaaguguuuguagauugucaucuucuagccugggcc

SEQ ID NO: 67680 - RNA, 65 nt, hsa
caacagcugcuaugggggggcuaaauuaucucuauuuuguagagaggaucuauauuuguaggggu

SEQ ID NO: 67681 - RNA, 65 nt, hsa
cgcgcaccaccacgccuagcugauuuuuguauuuuuuuguagagacggggguuuggccauguugc

SEQ ID NO: 67682 - RNA, 65 nt, hsa
acaaaauugaccacagugauuagaugaaaaaauuauuuguagauaggauaaucuauugacugaau

SEQ ID NO: 67683 - RNA, 65 nt, hsa
auauuuuuaugauauuggcacacugagaaauucauuuuguagagcuauggauaaggcuugcuaug

SEQ ID NO: 67684 - RNA, 65 nt, hsa
uuuuucaaccuuuauuaaaaagacaaauaaacuauuuuguagaagaucagacuccuacuuaacug

SEQ ID NO: 67685 - RNA, 65 nt, hsa
ugguuaauauaaaugauuuugauuuggaggccuaauuuguagauugugaaagcagcuuuuaguuu

SEQ ID NO: 67686 - RNA, 65 nt, hsa
aaaauguucacugcauguagguugauuucuuauguuuuguagacucauuguuauuuuucaauccc

SEQ ID NO: 67687 - RNA, 65 nt, hsa
ccgggcgaguuacgcggccucucugugccgcuucauuuguagagggcuguaacagugaccucgca

SEQ ID NO: 67688 - RNA, 65 nt, hsa
auuuuuuuuuuacuuucucagaauuaccuaaauguuuuguagaguuuugacuaguaaucaaucaa

SEQ ID NO: 67689 - RNA, 65 nt, hsa
caguugggauaugauccauuuuuuuaaacaaguuuuuuguagaucccuuguaaaauaauaauaau

SEQ ID NO: 67690 - RNA, 65 nt, hsa
gaauucuaaacauguaaaaugugacagccugcaauuuuguagacagugaaguaauggcugcuauu

SEQ ID NO: 67691 - RNA, 65 nt, hsa
gugggcacugccacaccguacuaauuuuuguauuuuuuguagagacgaggucccaccauguugcc

SEQ ID NO: 67692 - RNA, 65 nt, hsa
ugcaaauacuguauucaagugaaaaaaauacaguauuuguagauaaccauagcuacuacacaguu

SEQ ID NO: 67693 - RNA, 65 nt, hsa
auaagaauguuuugauuuugaucauacaaauaacuuuuguagauuuuuguuuacuuuuggggggg

SEQ ID NO: 67694 - RNA, 65 nt, hsa
acuugcuugugucugaacucuagugcacuuaugauuuuguagaccaugugaaauuuaauaagaua

SEQ ID NO: 67695 - RNA, 65 nt, hsa
guguacacccccacacaaggcuaaguuuuguauuuuuuguagagacaggguuucaacauauuauc

SEQ ID NO: 67696 - RNA, 65 nt, hsa
uacauuuuguauuauacaguaccuuucucagacauuuuguagaauucauuucggcagcucacuag

SEQ ID NO: 67697 - RNA, 65 nt, hsa
uucuauaaauuuaagaaaacaaguauauaauuuacuuuguagacuguuucacauugcacucauca

SEQ ID NO: 67698 - RNA, 65 nt, hsa
aggugggcaccaugccuggcuacuuuuuuguauuuuuuguagagacagguucuugccagguggcu

SEQ ID NO: 67699 - RNA, 65 nt, hsa
agcaggggguugugaauuuccagguacuuggacuuuuuguagaaggagagagaagaagaugaagu

SEQ ID NO: 67700 - RNA, 65 nt, hsa
uucuucauuguucaucaacauuuaagaaauuuaauuuuguagauguuuuuacuaaagaggguaac

SEQ ID NO: 67701 - RNA, 65 nt, hsa
uacuuagcaaauacaaacacauccaaaugaaaaauuuuguagauaccauauccccugaaauagca

SEQ ID NO: 67702 - RNA, 65 nt, hsa
cugggaaaugauaggaguauugcaaauaaguugaguuuguagaggguaacaaaguaaaguaaaac

SEQ ID NO: 67703 - RNA, 65 nt, hsa
acugaugaaugaguaaaaguaaguuuugcuggauuuuuguagaacucuggacguugaggauucau

SEQ ID NO: 67704 - RNA, 65 nt, hsa
uuuguaaaggauaucaaugccuugauuagaccuaauuuguagacuuaagacuuuuuauuuucuaa

SEQ ID NO: 67705 - RNA, 65 nt, hsa
aauauguuuucaguguucucuaauuuuuuggaauuuuuguagacuuuacaccuggaaaaaaagau

SEQ ID NO: 67706 - RNA, 65 nt, hsa
cguuucuaugagcgcauuuuaagagauguucgguguuuguagaucccauccauccggcugcuagg

SEQ ID NO: 67707 - RNA, 65 nt, hsa
ugcuaacaucacugucauagaauucccaaauuucauuuguagauacugaacuaagggcuaauguc

SEQ ID NO: 67708 - RNA, 65 nt, hsa
aaaguguguauugcuguguaauauuacuagcaaauuuuguagauuuuuuuccauuugucuauaaa

SEQ ID NO: 67709 - RNA, 65 nt, hsa
uuguuauacugcccauccccuaaagccaacagagauuuguagauuuaaagggaucacauuugaag

SEQ ID NO: 67710 - RNA, 65 nt, hsa
uauacuucacucuucuuuuuuuuuccccacaagcuuuuguagaugcauuguaguagucuagcuua

SEQ ID NO: 67711 - RNA, 65 nt, hsa
gaggcacgcaccaccgcgccuaccuuuuuauuuuuuuuguagagacagggucucacuguguugcc

SEQ ID NO: 67712 - RNA, 65 nt, hsa
aagugaccuuagugaugcagaguuccugagugguguuuguagaaugaguuuaucauacauucuuu

SEQ ID NO: 67713 - RNA, 65 nt, hsa
aucauuuuuucaacuggaauaaaacaccagguuuguuuguagaugucuuaggcaacacucagagc

SEQ ID NO: 67714 - RNA, 65 nt, hsa
cccaaaguuuuguaccugguuauuuuucacuuaaguuuguagacgaaaugugccauuauauuagc

SEQ ID NO: 67715 - RNA, 65 nt, hsa
aucauuccagaguuauuuucuauuagucaaacuuuuuuguagaaccuucuuucccuuacccuggc

SEQ ID NO: 67716 - RNA, 65 nt, hsa
acucugccaaauuuguggaacuaugaaauguauuauuuguagacauaaagacuugauugcuuucc

SEQ ID NO: 67717 - RNA, 65 nt, hsa
uauuauacaaauagauggaaagaaaagugaacacguuuguagaacuuucauaagcacacaguugc

SEQ ID NO: 67718 - RNA, 65 nt, hsa
uuuguuugagggagacuuccccuuucuggauuguauuuguagaguguuacgaguguaucauguga

SEQ ID NO: 67719 - RNA, 65 nt, hsa
aucaaacaguaaucuagguguggcugugaagguauuuuguagaugugauuaacaucuacaaucag

SEQ ID NO: 67720 - RNA, 65 nt, hsa
uaagacuuuauacuugggucaaucucucacuuuauuuuguagaaccauuugaaauccuaggaugu

SEQ ID NO: 67721 - RNA, 65 nt, hsa
ccccccacacuacugcgucuuuguuucuaucagucuuuguagaagcagguggugguggaaauucc

SEQ ID NO: 67722 - RNA, 65 nt, hsa
ggcugggaauacaauggaaaggauuaaauauguauuuuguagacucuuucccggucuccaagaac

SEQ ID NO: 67723 - RNA, 65 nt, hsa
agcacugcacacuggaaucauugcucuuccuggacuuuguagaaaucagucucaagugcuucaag

SEQ ID NO: 67724 - RNA, 65 nt, hsa
ggauuuaccagacugucuuuucacuguuuguggguuuuguagaaguuacacauuuuuaugguaga

SEQ ID NO: 67725 - RNA, 65 nt, hsa
cuccucuuccagagucaccuuuccccacuccuauuuuuguagaugcuauucuuucugaugucuuc

SEQ ID NO: 67726 - RNA, 65 nt, hsa
uuucuguuccuugcaguucaccucacuuuccguccuuuguagagcaguggugucuccaaugaacu

SEQ ID NO: 67727 - RNA, 65 nt, hsa
uguacuuccgauuuacggacaucauuuuauugcuauuuguagacgugauaacaugaacaugagua

SEQ ID NO: 67728 - RNA, 65 nt, hsa
uuucacuguuuguaauauuuaagaaaugcucauucuuuguagaacaaaaauguauuaaauauuuu

SEQ ID NO: 67729 - RNA, 65 nt, hsa
agggucuggaaucugaccuuacucuagcaggaguuuuuguagacucucccugauaguuuaguuuu

SEQ ID NO: 67730 - RNA, 65 nt, hsa
acuuuugacaaugcucauuaauauuauuuuuucuauuuguagaccauaucugaaagaaauaacau

SEQ ID NO: 67731 - RNA, 65 nt, hsa
ucuaucagugacuucugaauccuuagaauggccucuuuguagaacccugugguauagaggaguau

SEQ ID NO: 67732 - RNA, 65 nt, hsa
aucccuacucaccgaguguugagcccaaggggggauuuguagaacaagcccccaugagaaacagc

SEQ ID NO: 67733 - RNA, 65 nt, hsa
uuggucuccacaccuaaaaucgucugccuguguacuuuguagaugugaaugguacuauucaacgg

SEQ ID NO: 67734 - RNA, 65 nt, hsa
cacuuucucauuaagauauauauauagaaccacuuuuuguagauuaguauaagaaaaauauuuac

SEQ ID NO: 67735 - RNA, 65 nt, hsa
aauguauuuguuuuuuugugcugugagaauugauguuuguagauuaauaaucauuuuguuuagaa

SEQ ID NO: 67736 - RNA, 65 nt, hsa
gcgugcgugaccaagcccagcuaauuuuugcauuuuuuguagagaugggguuuugccauguugcu

SEQ ID NO: 67737 - RNA, 65 nt, hsa
cuuuaaaaaauagauuuuuucccuaagaaagaauguuuguagaauuuaaaguggacagaugccug

SEQ ID NO: 67738 - RNA, 65 nt, hsa
uuuuauauguucaggggaauuuuaaagucaaaucuuuuguagauaauuuaaaaaaucaguguggu

SEQ ID NO: 67739 - RNA, 65 nt, hsa
uucuuguagauguauccuucacguuguaaauauguuuuguagagugaagccaugggaagccaugu

SEQ ID NO: 67740 - RNA, 59 nt, hsa
agggaaauuacucugggugaagucagaacuuuguagaacacagaacauaaagggugaga

SEQ ID NO: 67741 - RNA, 65 nt, hsa
uuugaaauuacuuccauuuucaaaaaccaucauguuuuguagauacauuuugagaaaaaccauca

SEQ ID NO: 67742 - RNA, 65 nt, hsa
guacauagucuuuuauguaauuuacuggcauauguuuuguagacuguuuaaugacuggauaucuu

SEQ ID NO: 67743 - RNA, 65 nt, hsa
uaaaaacaaaaaaaaaaauaaugaaacacagugaauuuguagaguggggguauuugacauauuuu

SEQ ID NO: 67744 - RNA, 65 nt, hsa
auuuuaucauuuauuagcgcugaagagccaacauauuuguagauuuuuaauaucucaugauucug

SEQ ID NO: 67745 - RNA, 65 nt, hsa
caaaagagagaaagagaaaggaaugcugguuuaucuuuguagauuguaaucgaauggagaaauuu

SEQ ID NO: 67746 - RNA, 65 nt, hsa
gcucacuuucucccuuuuuauuuuucaccaaaccauuuguagagcuacaaaagguauccuuucuu

SEQ ID NO: 67747 - RNA, 65 nt, hsa
aggcccauuaaaaaucuggcccuaaaaguucaacuuuuguagaguuuauuguucagagagguuua

SEQ ID NO: 67748 - RNA, 65 nt, hsa
ugauacaguggguaccaagcuccucugcuccccacuuuguagagccuagcaugagguggcaugua

SEQ ID NO: 67749 - RNA, 65 nt, hsa
cugaucauguuugguuuucuucuuccuuauuuuauuuuguagaaaccgggugguauuuuauugcu

SEQ ID NO: 67750 - RNA, 65 nt, hsa
cgcccagcuaauuuuuguauuucuuuuuuuuuuuuuuuguagagauggaguuucaccauguuggc

SEQ ID NO: 67751 - RNA, 65 nt, hsa
ccccagggcacucgccccccuccuuagcauuuucuuuuguagaaguuucucgaaggugcuuggcg

SEQ ID NO: 67752 - RNA, 65 nt, hsa
uugauuggcuauugaacccuucugggaaauguauuuuuguagacuuuaauagagaaguugauugu

SEQ ID NO: 67753 - RNA, 65 nt, hsa
gcagcauuaaacauauaugugaagaguccccgauguuuguagaccuuaugugaguaugcaaauau

SEQ ID NO: 67754 - RNA, 65 nt, hsa
aaaggagaucagagaaagccaaagaaugucagaaauuuguagaaaaugacuucuuguuugaauau

SEQ ID NO: 67755 - RNA, 65 nt, hsa
uacaacugucuuuguucucaaauaacaugauugucuuuguagaaaauucuaaauaacaaaaaccu

SEQ ID NO: 67756 - RNA, 65 nt, hsa
guaaacucaauaaguuuauuucuuaaaucuaguaauuuguagauuccucuggauuuuguauaugc

SEQ ID NO: 67757 - RNA, 65 nt, hsa
uuuaauugccuuucuuuuccccuccuccuuuguauuuuguagauuucauuaauggaucuugugaa

SEQ ID NO: 67758 - RNA, 65 nt, hsa
uagaaguaaaaguaguagcuuuucaaagcuuuaaauuuguagaacucaucuaacuaaaguaaauu

SEQ ID NO: 67759 - RNA, 65 nt, hsa
ugauuugucggacugugguuacucugucgucacauuuuguagaauuaguucuauaaaaguauugu

SEQ ID NO: 67760 - RNA, 65 nt, hsa
ggaaggauccggaaccaggacccagaagcaccuccuuuguagacagagggccacggcugcgugcg

SEQ ID NO: 67761 - RNA, 65 nt, hsa
guuuggggccugcugcaauggggaugagaugguuuuuuguagaauuauacuuacguuccuuggau

SEQ ID NO: 67762 - RNA, 65 nt, hsa
cacuggcauauuuagaauaucucuaaaaggacuuguuuguagaauaaggaauuuucuauguuuca

SEQ ID NO: 67763 - RNA, 65 nt, hsa
uucccuuggcuuuagcagauguuuuuaaaguuucuuuuguagaccgaacuucugaagaguaauac

SEQ ID NO: 67764 - RNA, 65 nt, hsa
acaggcaugaaccacugugcuuggccuuuuaaaauuuuguagagaugcagucuuacuauguugcc

SEQ ID NO: 67765 - RNA, 65 nt, hsa
ucugggaaaugggcuaggccugaggcagucaccuauuuguagaacucaauugauccccaaccugc

SEQ ID NO: 67766 - RNA, 65 nt, hsa
uuucuucuucucucucuuuuuucugaucggucguguuuguagaaaauucauaacauauauaggcc

SEQ ID NO: 67767 - RNA, 65 nt, hsa
cacgguucccucaaaguuuguugaauaaagcaacuuuuguagaugcuguuucauacagcacuuag

SEQ ID NO: 67768 - RNA, 65 nt, hsa
agaauugauccuguggcugguuucucagaaaucaguuuguagaaauauuuagcuucaggaauacu

SEQ ID NO: 67769 - RNA, 65 nt, hsa
guugaaaccugcuuuuaucauuuucaagaugguuauuuguagaaggcaaggaaccaauuaugcuu

SEQ ID NO: 67770 - RNA, 65 nt, hsa
aaugugucagagacacaugggacagaacccuacuuuuuguagaggaacuuaaucugaauaaaguc

SEQ ID NO: 67771 - RNA, 65 nt, hsa
ccguuuggggcuguguccuuauuuuauuuuauuuuuuuguagaauguaaaaagucauuuuagaug

SEQ ID NO: 67772 - RNA, 65 nt, hsa
uaccucagaaaucauuuuuggugauuauuuuuuguuuuguagaauugcacuucaguuuauuuucu

SEQ ID NO: 67773 - RNA, 65 nt, hsa
cugcugcuucuguccaccuuaauauucuccuucuauuuguagauaugauagacuccuauuuuucu

SEQ ID NO: 67774 - RNA, 65 nt, hsa
uccgcagaaagcaaaguuuggggagggcugacgauuuuguagaacacaacagugacaauuuuuuu

SEQ ID NO: 67775 - RNA, 65 nt, hsa
uuaacuggagcuccgauuuaacugggaaccccuucuuuguagaacugcccauuuccauggugcaa

SEQ ID NO: 67776 - RNA, 65 nt, hsa
aaaauucaagaaaauaaauguagcuggugggagacuuuguagauguugggcuauauguuggggug

SEQ ID NO: 67777 - RNA, 65 nt, hsa
aauuuugcugagguuuucuuaauguuguagagcauuuuguagagugguuuaaauaguugaaaaua

SEQ ID NO: 67778 - RNA, 65 nt, hsa
agcauaccaccaugccugacuaauuuuuuguguuuuuuguagaggugggguuucaccauauugcc

SEQ ID NO: 67779 - RNA, 65 nt, hsa
gaugugggauacuacuguuaguauuauuuaacuauuuuguagauuuaaaagauuucugguuaagg

SEQ ID NO: 67780 - RNA, 65 nt, hsa
acauuaucucuagagucugcuuuuuugugggccaguuuguagagauguaacaugaagccauucca

SEQ ID NO: 67781 - RNA, 65 nt, hsa
aagccuguuaguauuuucauuggacuuacauggaauuuguagauuuugaaaaaacagauauuuuu

SEQ ID NO: 67782 - RNA, 65 nt, hsa
uguccuguggcccccugucggauggaugcgugccguuuguagagaagagccuuugggcccauuca

SEQ ID NO: 67783 - RNA, 65 nt, hsa
gaagacuugcaucaguugcuuaaacuuucagaaaauuuguagagaaacccaacaaaucucauaaa

SEQ ID NO: 67784 - RNA, 65 nt, hsa
ugcuucuucauggaaugcugaccuucauugcuccauuuguagauuuuugcucuucucaguuuacu

SEQ ID NO: 67785 - RNA, 65 nt, hsa
uaaugaaaugguucccuuuuaaaaaauaaaaauacuuuguagauuaaaaauaaaucagaauuuca

SEQ ID NO: 67786 - RNA, 65 nt, hsa
gcauauucaaaaggccucggaauuccaauuuuccauuuguagaguuaaacuuugaaugugccaaa

SEQ ID NO: 67787 - RNA, 65 nt, hsa
aggaagcaggggaaggugaccugaggaggcucggcuuuguagagccccgcucaggcacagggagg

SEQ ID NO: 67788 - RNA, 65 nt, hsa
aucuggaggaacaucauacauaguaggugaaucguuuuguagagugaagaaugcuaauguaaagc

SEQ ID NO: 67789 - RNA, 65 nt, hsa
uugagccucacuggugccaggaagccaaagcuuacuuuguagaacugacacuaaacuacccgaag

SEQ ID NO: 67790 - RNA, 65 nt, hsa
cauuugugccagaggaauccuggcagcccagagacuuuguagauccuuagagguccucuggagcc

SEQ ID NO: 67791 - RNA, 65 nt, hsa
uucaugaaugugcuggugaacacugugaccaggcuuuuguagauggcgauguguuauagacggug

SEQ ID NO: 67792 - RNA, 65 nt, hsa
gcuugagccaccgugccaggccuguuuuguuuguuuuuguagagagaugggguuucgccauguug

SEQ ID NO: 67793 - RNA, 65 nt, hsa
aaaauuaucaguuauauuuugcuguuuaugaucuauuuguagauuaggauuaaaauggauuuaau

SEQ ID NO: 67794 - RNA, 65 nt, hsa
aauucccuuucucucuaaguccaccauuuucaagauuuguagauaguguauuaguuaagacagcu

SEQ ID NO: 67795 - RNA, 65 nt, hsa
cuuggcaaacuggcuucugauccauaucauauuuauuuguagaagauggcgaaacaguuuagcug

SEQ ID NO: 67796 - RNA, 65 nt, hsa
caauuuacacacuugucucagaaagucccucaggguuuguagaggacugcaggggggcauccgcu

SEQ ID NO: 67797 - RNA, 65 nt, hsa
uugcuauauccccuaauuuguugguugugcuaaucuuuguagaaagaggucucguauuugcugca

SEQ ID NO: 67798 - RNA, 65 nt, hsa
acuagcacaagcccgguugcuccuugucaggagaauuuguagaucauucucacuucaaauuccug

SEQ ID NO: 67799 - RNA, 65 nt, hsa
aucugcuaauguaagggacaucuguauuuaacuccuuuguagacaugaauuucuaucaaaauguu

SEQ ID NO: 67800 - RNA, 65 nt, hsa
acccuucacaccuggcugauuuuucaaaaaguuuuuuuguagaaacagggucucaccauguuguc

SEQ ID NO: 67801 - RNA, 65 nt, hsa
uugaauacauucagaaucaccuccucuccccaaaauuuguagaaauaguuuuugaggaagccaaa

SEQ ID NO: 67802 - RNA, 65 nt, hsa
ucgcugcagcaaaaacuguuacuguguuuauuauauuuguagaaguauuagaaaaauauucuauu

SEQ ID NO: 67803 - RNA, 65 nt, hsa
uuuuacuucaaauguuauuuaaaguagaaauuuaauuuguagauauaaccuuuaaaaauuuucuc

SEQ ID NO: 67804 - RNA, 65 nt, hsa
augaccucaaggaagcuacgggcacaacuggaagcuuuguagaaauuaaacauauucaaggagca

SEQ ID NO: 67805 - RNA, 65 nt, hsa
aaaguaugggggaagacagcaaucaaaacuaacuuuuuguagauagccauuucauuucuuuaaac

SEQ ID NO: 67806 - RNA, 65 nt, hsa
aaacuuacaccacauacuuggugggugaauccaauuuuguagaauuccuacacaggcaaaauagc

SEQ ID NO: 67807 - RNA, 65 nt, hsa
cacuaugcccggcaaauuuuuuguauuuuguauuuuuuguagaaacaggauuucgccauguuggc

SEQ ID NO: 67808 - RNA, 65 nt, hsa
cuaccagcuuuagacaaaaccccaauccccgcagguuuguagauaaauuuuuaucaaggagugau

SEQ ID NO: 67809 - RNA, 65 nt, hsa
caccaugcccagcuaauuuucuuuuuuuguuuuguuuuguagagauguggucucacuauguuucc

SEQ ID NO: 67810 - RNA, 65 nt, hsa
uacagagaacuaacacuauuuuaugcaaauauuuuuuuguagaugaaaaagcauguacaguguuc

SEQ ID NO: 67811 - RNA, 65 nt, hsa
ggugcgugccaccaugccuggcuaauuucugguauuuuguagagacaggguuucgccauguuggc

SEQ ID NO: 67812 - RNA, 65 nt, hsa
acaggcgugcaccaccaugcauagcuaauuuauuuuuuguagagacagggucucccuguguugac

SEQ ID NO: 67813 - RNA, 65 nt, hsa
cuuuuuuuuuuuuuuuuuuuugcuuuuuuuugcuuuuuguagaagagauugagaaugguacucua

SEQ ID NO: 67814 - RNA, 65 nt, hsa
caugcgccaccgugaccagcuaauuuuuuuguauuuuuguagagaugggguuucaccauguuggc

SEQ ID NO: 67815 - RNA, 65 nt, hsa
ugaguguaaaagcuuucagaaauaaguuacaaaucuuuguagaugaaaauaauggaaggaaugug

SEQ ID NO: 67816 - RNA, 65 nt, hsa
caucuuggacuucaggaaaugcaauuaugauaacguuuguagacagucacgucauguuagguguu

SEQ ID NO: 67817 - RNA, 65 nt, hsa
cucaguauaguacugucaagggaagccauacacuuuuuguagacauggguaccaaaaauacccaa

SEQ ID NO: 67818 - RNA, 65 nt, hsa
ugcaugccaccaugccaggcuaauuuuugguguuuuuuguagagacuggguuuugccauguugac

SEQ ID NO: 67819 - RNA, 65 nt, hsa
uaagaauagaauuucuuucccuaaagaacauaccuuuuguagaugaacucuucucaacucuguuu

SEQ ID NO: 67820 - RNA, 65 nt, hsa
cacuuuacuaaaagcuuauuucugucaauaucauauuuguagaaaucauccauauguuuauacau

SEQ ID NO: 67821 - RNA, 65 nt, hsa
augugaacuuugaaugguuuaacaaaagauuuguuuuuguagagauuuuaaagggggagaauucu

SEQ ID NO: 67822 - RNA, 65 nt, hsa
aauuuuccagaaccaggaaugaguaucuaauagcuuuuguagaaccuuccagaauauguggggaa

SEQ ID NO: 67823 - RNA, 65 nt, hsa
agaaaaaauaagugauucaaaaugaaaauauuuacuuuguagaauaugacuuuagacauaucacu

SEQ ID NO: 67824 - RNA, 65 nt, hsa
uuacauaaguuuuuuuuaaccccuagaauuuaauauuuguagaugcagguaaauauauauacuua

SEQ ID NO: 67825 - RNA, 65 nt, hsa
uuauguuuauaaaugauacagaucuguuuacaagguuuguagauacuuuuuuuguuccuguucau

SEQ ID NO: 67826 - RNA, 65 nt, hsa
augcauuguauauugcaauuuauuacugucagagauuuguagacaguuucuuauuuucauauuga

SEQ ID NO: 67827 - RNA, 65 nt, hsa
gugaaacuaacuagcaaagacaaaaauucaggcaguuuguagacaccaguaauuuuaagaaccug

SEQ ID NO: 67828 - RNA, 65 nt, hsa
ugguucaacuuuuaaguuaagggaaaaacuuuuacuuuguagauaauauaaaauaaaaacuuaaa

SEQ ID NO: 67829 - RNA, 65 nt, hsa
acaaaaaaucguaaaauacaaaaaccaguuaauguuuuguagacccugggaaaagaauuuucagc

SEQ ID NO: 67830 - RNA, 65 nt, hsa
gaaggaugaguguuaauuuuaauuaacuuugccguuuuguagagaaaacuauucacaagauaaau

SEQ ID NO: 67831 - RNA, 65 nt, hsa
gaaauauuuugaaaaguaauaacauaaaacuaguauuuguagaagauuauguguuguauauaaca

SEQ ID NO: 67832 - RNA, 65 nt, hsa
aacaguagcaaaucagauuuuccagaagcacaaacuuuguagaauacaguuuaguauaauuccuc

SEQ ID NO: 67833 - RNA, 65 nt, hsa
gagaccaagaauucaagaugguugguggccagauuuuuguagacagagauggugauuuguuuagu

SEQ ID NO: 67834 - RNA, 65 nt, hsa
agacuauggacauucaaaucaugggagaaaauaauuuuguagauuauguuccauugcuaaugaau

SEQ ID NO: 67835 - RNA, 65 nt, hsa
caaguauauuuuuaaaguuguuuuauaagagagacuuuguagaagugccuagauuuugccagacu

SEQ ID NO: 67836 - RNA, 65 nt, hsa
acuaaaagguaaauuaugggaaucacugaaauauuuuuguagauuaauuguuguaacauugucuu

SEQ ID NO: 67837 - RNA, 65 nt, hsa
cuauugaaaggugcuuugaugauuuucuccuuugguuuguagaauuaggacugaacuuuugacuc

SEQ ID NO: 67838 - RNA, 65 nt, hsa
gauauguugcaaugcaaaguaaucuaguaguacuguuuguagaacagacaaguguguccaauuua

SEQ ID NO: 67839 - RNA, 65 nt, hsa
aaugaaagagaaggaaguuaaaaccuauagguuauuuuguagagcugaguguuaauacgggccga

SEQ ID NO: 67840 - RNA, 65 nt, hsa
caggugccugcccccauggcuaauuuuuuguauuuuuuguagagaugggguuucaccauguuggc

SEQ ID NO: 67841 - RNA, 65 nt, hsa
ugacauuugacauuuuaaugggcgccauggcucauuuuguagauugagaaggugcgucuccccug

SEQ ID NO: 67842 - RNA, 65 nt, hsa
uggaaggagggaauuuaaaaaugggacuugagugguuuguagaauuuguguucauaaguucagau

SEQ ID NO: 67843 - RNA, 65 nt, hsa
uagagaccucuguaguccugggaggccucauaauguuuguagaucagaaaagggagaucugcauc

SEQ ID NO: 67844 - RNA, 65 nt, hsa
augucuucugcaaauuuucuaguauaacagaaauuuuuguagaugaaaaaaaucauuauguuuag

SEQ ID NO: 67845 - RNA, 65 nt, hsa
uuucugugaauuaaggaauagauguuaaccauuauuuuguagaaaagugauuuguaugugguuaa

SEQ ID NO: 67846 - RNA, 65 nt, hsa
cugagcuuuacacagcuggggucugcuacucgcguuuuguagacuuuuguguaacuauuuguacc

SEQ ID NO: 67847 - RNA, 65 nt, hsa
gcauuauuuuuauuuaaaguauugcuaguaaaugauuuguagaaacuugguuuucuaagcauagu

SEQ ID NO: 67848 - RNA, 65 nt, hsa
ugacucucuuaauaaaacugcauuaaguuuuugauuuuguagaaauuagcuuuugucuaggcaac

SEQ ID NO: 67849 - RNA, 65 nt, hsa
guaacagauuccuuuauauguaguggaaaucacuauuuguagaaacugucaggucaaaauauuua

SEQ ID NO: 67850 - RNA, 65 nt, hsa
uuccuuuaggagcuuggcccguucuuauagaugauuuuguagaauaugcacggccaguagucaca

SEQ ID NO: 67851 - RNA, 65 nt, hsa
ggugauaacuuuaaauaaaacucaaauuuuuacuguuuguagacaggaaugcuguccuagagaac

SEQ ID NO: 67852 - RNA, 65 nt, hsa
uuggguccuagaaccuguugaguuucuaaugaauauuuguagaaucucauaaaacaguuuaaaua

SEQ ID NO: 67853 - RNA, 65 nt, hsa
uauuuguuaauuaucugcuuaguauuaacacuaaauuuguagaaugacuuucagguuuguugaac

SEQ ID NO: 67854 - RNA, 65 nt, hsa
aaagucucauacuaccucaucuuuauuguggcgcuuuuguagaucacugagaagcuuaucuuauu

SEQ ID NO: 67855 - RNA, 53 nt, hsa
auacccagcuaauuuuuuaauuuuuuguagagguggggucucauuauguugcc

SEQ ID NO: 67856 - RNA, 65 nt, hsa
ggauuuggaagggggguuggguugggcuggauaucuuuguagauguggaccaccaagggguuguu

SEQ ID NO: 67857 - RNA, 65 nt, hsa
cacaauaguugcagaucaacaaucaucaccugccuuuuguagaaaagaaaaacaaaaaaaguaaa

SEQ ID NO: 67858 - RNA, 65 nt, hsa
cuuugaagacauugugagaucuguaauuuuuuuuuuuuguagaaaaugugaauuuuuugguccuc

SEQ ID NO: 67859 - RNA, 65 nt, hsa
ugaagucaaauuuggauuuuccaccaaauucugaauuuguagacauacuuguacgcucacuugcc

SEQ ID NO: 67860 - RNA, 65 nt, hsa
gaaaaaugcuuuuccaguucuuagaaaauucuuuuuuuguagacaaauauucuauaaacuagaau

SEQ ID NO: 67861 - RNA, 65 nt, hsa
aaggugccauuuuaaauuuuauuuuuauuacuuuuuuuguagaugaacuugagcucuguaacuua

SEQ ID NO: 67862 - RNA, 65 nt, hsa
guaugguuugagacaacauauggaaaauguucacauuuguagauuaagcuggaauuauaaugaga

SEQ ID NO: 67863 - RNA, 65 nt, hsa
agccucugggaaaaaacaaacauguuacaguguuuuuuguagauucucguucuauaucucaucac

SEQ ID NO: 67864 - RNA, 65 nt, hsa
gaagugugguuguacuuacguuaauaguaaguguauuuguagaaaguuuuucauaaagaagagau

SEQ ID NO: 67865 - RNA, 65 nt, hsa
uuuauuagaaagcuaaauggauaaauacuucccuuuuuguagauauuuuucugugcauuguaagu

SEQ ID NO: 67866 - RNA, 65 nt, hsa
cucucagucuucauaccccagaaauuauugguauauuuguagauaccgagaaugaucccucaguc

SEQ ID NO: 67867 - RNA, 65 nt, hsa
gcccuccaguguuguccaaggaaauguagaaucacuuuguagauauggagaugaagaagacaaau

SEQ ID NO: 67868 - RNA, 65 nt, hsa
ugcguuuuuaaucagaaaacaaaauagaggcagcuuuuguagauuuuaaauggguugugcaagca

SEQ ID NO: 67869 - RNA, 65 nt, hsa
aaugucauugaagacaaaggucaaauauuugucuguuuguagaucacaggcaccaguuggucuuc

SEQ ID NO: 67870 - RNA, 65 nt, hsa
cuagguucuacuuuguuuauuugauaucaaauagguuuguagauguuuauggcauuucuaauugu

SEQ ID NO: 67871 - RNA, 65 nt, hsa
uggcuccccuugcccugccacccuuucccuagucuuuuguagauugcacuaauuuacauccuagc

SEQ ID NO: 67872 - RNA, 65 nt, hsa
aagcacgaaaaguuaagauaucugcuuacauugauuuuguagacacauuaagucaagauuuggaa

SEQ ID NO: 67873 - RNA, 65 nt, hsa
ccaggggguucugcuucacuagguuaaauguagguuuuguagaggagaucugcacuggagcaagu

SEQ ID NO: 67874 - RNA, 65 nt, hsa
augaggaacauaaggaagaauuauaauugucauuauuuguagacaauaaaacugccuaccuguaa

SEQ ID NO: 67875 - RNA, 65 nt, hsa
cugugcagugacuguaguuacuuaagagaaaaugcuuuguagaacagagcaguagaaaagcagga

SEQ ID NO: 67876 - RNA, 65 nt, hsa
acagaacuacucucccaaggaaaauauugccaccauuuguagaccacguaaccuucaaguaugug

SEQ ID NO: 67877 - RNA, 65 nt, hsa
agaagagaucaguccacccagaguuagacauuguuuuuguagaaaacaggcauuuauuaugucua

SEQ ID NO: 67878 - RNA, 65 nt, hsa
uaacaccauacuuggcuaaauuaaaaaaaugguuuuuuguagagaugaggucucaccauguugcc

SEQ ID NO: 67879 - RNA, 65 nt, hsa
cccucgaggccaagaguucaugaccagccuggucuuuuguagagacccugucucuacaaaaauau

SEQ ID NO: 67880 - RNA, 65 nt, hsa
uuuuguauuaggacacaaagauaauuuaaacuuuguuuguagauaaaauagagcacaaacuguga

SEQ ID NO: 67881 - RNA, 52 nt, hsa
gucauuacaguaguuuguaacauuuguagauuggauagcauuuuuaugauuu

SEQ ID NO: 67882 - RNA, 65 nt, hsa
caauauauuuagugcuacucgcagcuauuuauuauuuuguagaccugccuuaugcaccuuacugc

SEQ ID NO: 67883 - RNA, 65 nt, hsa
cuccgccacacugagucccuggggcugggguuuuguuuguagaaggcucuggggacuccuaauuu

SEQ ID NO: 67884 - RNA, 65 nt, hsa
agaaauauagcauuuauuguagcaaagacuuaaauuuuguagauacaauaugaaucuuuucaugu

SEQ ID NO: 67885 - RNA, 65 nt, hsa
ccgccgcuucacaggcugaguccaggccugugugcuuuguagagccagcugcuugcucacagcca

SEQ ID NO: 67886 - RNA, 65 nt, hsa
agccaggauggucucacguuuuguuuuuuuaacuuuuuguagagauaggguuucauuacauugcu

SEQ ID NO: 67887 - RNA, 65 nt, hsa
uugcuucuuuguacuuuuucuacuuuuccuacuuuuuuguagaaaaaaaagauaaugccucugcu

SEQ ID NO: 67888 - RNA, 65 nt, hsa
augcgccaccacuccuggccaauuuuuaaaauuuuuuuguagagauggggaucuccuuauguugu

SEQ ID NO: 67889 - RNA, 65 nt, hsa
gaacaugacaaugaagcucuuuuagagaaaagaccuuuguagauucaacaauuaugauaggauuu

SEQ ID NO: 67890 - RNA, 65 nt, hsa
uuggggaaauagccuggaggucuuuccugaaucuguuuguagacauaauaaaauuugugugcugu

SEQ ID NO: 67891 - RNA, 65 nt, hsa
ugagucaccaagcccaguuaaucuuuaguuuuauuuuuguagagccagggucucacuauguugcc

SEQ ID NO: 67892 - RNA, 65 nt, hsa
gaacuaagaauuuuauuuuauuuuauuuuuuauuuuuuguagaaauaggaucucacuauguugcc

SEQ ID NO: 67893 - RNA, 65 nt, hsa
gcgccaccacagccggcuaauuuuuuauuuaauuuuuuguagagacgagguuucgccauguugcc

SEQ ID NO: 67894 - RNA, 65 nt, hsa
gggauuugggucuaucuaugccuuucuggcugauuuuuguagagacgggguuuugccauguuacc

SEQ ID NO: 67895 - RNA, 65 nt, hsa
cugaggggucucagcccaccgcccuuggugccuucuuuguagagcccaccgcuaccucccucucc

SEQ ID NO: 67896 - RNA, 65 nt, hsa
aucuuuuauugguaaaauauaaauguauaauuauguuuguagagcuuuaccaaggaguuucccuc

SEQ ID NO: 67897 - RNA, 65 nt, hsa
aaaguaugcauucuuaucaccuaguauauaguuaguuuguagagugauuuccccccaguuucuug

SEQ ID NO: 67898 - RNA, 65 nt, hsa
ccuucaauuauaguuagucuuggugaaguaagauguuuguagacuuuagaguucuuuaauucuug

SEQ ID NO: 67899 - RNA, 65 nt, hsa
uuguugaacagauaaauacgaaacugccaucaucauuuguagaaaaacuguuuauaccaucaucu

SEQ ID NO: 67900 - RNA, 65 nt, hsa
uugccuaucgccucucucucccauucagacaaguguuuguagacucugaagccuaauguuacuca

SEQ ID NO: 67901 - RNA, 65 nt, hsa; identical to SEQ ID NO: 67899

SEQ ID NO: 67902 - RNA, 65 nt, hsa
cugucuuacacagcauuuuuaaaaaauacaauaaauuuguagagauaggaugaccaaggacaaca

SEQ ID NO: 67903 - RNA, 65 nt, hsa
ugucaaguccaguaaaugacauuuuuagagaugcuuuuguagacaagcauauggaauaugugauu

SEQ ID NO: 67904 - RNA, 65 nt, hsa
aaauucaugacuugucuuacugaacuacagccugguuuguagacuuccaacaucuacacugcugc

SEQ ID NO: 67905 - RNA, 65 nt, hsa
caugcaccaccacgcccagcuaauuuuucuuauuuuuuguagagacagggucucacuguguugcc

SEQ ID NO: 67906 - RNA, 65 nt, hsa
ugugucugugaaagugccaagaaccccuccccacauuuguagauccaugacccuuuuuauaagcu

SEQ ID NO: 67907 - RNA, 65 nt, hsa
ugugggccuugggguccaugaaccccaugaaauuauuuguagacuuguauguacauuuuucuggg

SEQ ID NO: 67908 - RNA, 65 nt, hsa
ucacuaggaauuuuuauucccaguccgucaggaauuuuguagaagggcuucaugugcugguacca

SEQ ID NO: 67909 - RNA, 65 nt, hsa
gguaucuuuguggagcuuucuaauuuacaaaaugcuuuguagaccccauugucuuuaaaccauac

SEQ ID NO: 67910 - RNA, 65 nt, hsa
cuggccuuguacuugcuuguauuguaaauguggauuuuguagauguuaggguauaaguugcugua

SEQ ID NO: 67911 - RNA, 65 nt, hsa
gcguauuuagacuguggccauauaugcuguauuucuuuguagaauaaaugguuucucauuaaacu

SEQ ID NO: 67912 - RNA, 65 nt, hsa
guguguaccaucacaccuggcuaauuuuuguauuuuuuguagacacaggguuucgccauguugcc

SEQ ID NO: 67913 - RNA, 65 nt, hsa
uacuucacuuuaauaacuguugcuuaguaauuggcuuuguagagaagcuggaaaaaaaugguuuu

SEQ ID NO: 67914 - RNA, 65 nt, hsa
ggccuaccgcaguggccccggcugucugcacauuuuuuguagacacauuagagucgguugaggcc

SEQ ID NO: 67915 - RNA, 65 nt, hsa
uugguuccuagugcuacuuguuuuacaaacuacacuuuguagaauugauuagauuaccuuguuua

SEQ ID NO: 67916 - RNA, 65 nt, hsa
gcuuuacccuuugagaaaaaggcagcccuccagauuuuguagacauuuuucuuaauauuuuuaac

SEQ ID NO: 67917 - RNA, 65 nt, hsa
guucaugccaccauggccagccaacuuuugcauguuuuguagagauggggucucacaguguugcc

SEQ ID NO: 67918 - RNA, 65 nt, hsa
ggcugagccuaucagggcacaaagccagaaugugguuuguagaaucccagccccagcaucuccaa

SEQ ID NO: 67919 - RNA, 65 nt, hsa
uaagaauguaaauaaacauguuuguugaaguacuguuuguagaggggggcaaagccccaacugca

SEQ ID NO: 67920 - RNA, 65 nt, hsa
ugccuuauuggagaaaaucacccuuucccuuuuucuuuguagaagcaggagcaagaguguuuggc

SEQ ID NO: 67921 - RNA, 65 nt, hsa
gaauaaauguuucuggaaaagaacuauguuaugauuuuguagaaauguaaagauuacuugaggug

SEQ ID NO: 67922 - RNA, 65 nt, hsa
ccauacccccaagacagugucuugucuuucugugauuuguagaggagggcuuguucuccaacacc

SEQ ID NO: 67923 - RNA, 65 nt, hsa
agauccugggaucugggcccagcaucucuuccuccuuuguagaugcuggagcccagccaaggucu

SEQ ID NO: 67924 - RNA, 65 nt, hsa
cucccccugcuccccuacuucucaguccccuucaauuuguagacucuugcuccugcuucuccuga

SEQ ID NO: 67925 - RNA, 65 nt, hsa
ucuaccucaucauuuaaaaugacaugggugucgguuuuguagaucuuugguuuuuuugucagguu

SEQ ID NO: 67926 - RNA, 65 nt, hsa
ucucgcucucguacauaagaugauuggugacacuuuuuguagaacccauguuguauacaguuuuc

SEQ ID NO: 67927 - RNA, 65 nt, hsa
uggcacagcaguaucccuugaagaaauccugaggcuuuguagagugcuccuugaccauguuuaau

SEQ ID NO: 67928 - RNA, 65 nt, hsa
caaauucaggguuuuuuuuuuuaaauaaaggaaaauuuguagacucuuuauaauagaacuugugg

SEQ ID NO: 67929 - RNA, 65 nt, hsa
guaccccgaaucccuccugcaggcucauugccacuuuuguagagaauguucucuaucaguaucgu

SEQ ID NO: 67930 - RNA, 65 nt, hsa
aagaaagagauacauuuuguaugcuuucuuuuccuuuuguagauucccaguuuauuuucuaagac

SEQ ID NO: 67931 - RNA, 65 nt, hsa
ucgcaagucucaaaacgugauaauauuuaagcccauuuguagaagaaaucuuguauauacuauua

SEQ ID NO: 67932 - RNA, 65 nt, hsa
uauaaagauuguuuugagugcugauuuguuuacuuuuuguagauuugcuuuauccaugauauuca

SEQ ID NO: 67933 - RNA, 65 nt, hsa
guucuuaauauucauuagugagaaucacaaaguauuuuguagaaggcccaaaucacagaauaaag

SEQ ID NO: 67934 - RNA, 65 nt, hsa
cugccuuccugacagguucugagauaaguguuauguuuguagauagagugaaauauauuuauaua

SEQ ID NO: 67935 - RNA, 65 nt, hsa
guuuuguuuuguuuuugucuugaaaauaauagacauuuguagaauauggagacuaacuccuagga

SEQ ID NO: 67936 - RNA, 65 nt, hsa
cccuaaaacuaagcgugcugcuucugcaaaagauuuuuguagaugagcugugugccucagaauug

SEQ ID NO: 67937 - RNA, 65 nt, hsa
augccaccacaccuggcuaauuuuuuauuuuccuuuuuguagagacagggucuugcuauguugcc

SEQ ID NO: 67938 - RNA, 65 nt, hsa
cucaggagaaagaagcuaaaucugcauagauuuaguuuguagaauuuaauuuaaaauuuaaauuu

SEQ ID NO: 67939 - RNA, 65 nt, hsa
aagaaaauccuuuuugcuuuaacuugccuugcagguuuguagaaaacucaauuguugaaauuugg

SEQ ID NO: 67940 - RNA, 65 nt, hsa
uggggguugagauauggggaugaggaugaagaacuuuuguagaaaucgggguucccucuuucucu

SEQ ID NO: 67941 - RNA, 65 nt, hsa
aggguuguagugccuuuacuuguaucacagaucuuuuuguagacauuuucuucuagaggaaaacu

SEQ ID NO: 67942 - RNA, 65 nt, hsa
uauuuguauauaauguuaagaggaguaaaagauuuuuuguagaauaauaacuauauucggauuau

SEQ ID NO: 67943 - RNA, 65 nt, hsa
aauucagugcccgacagaugcucuggcacagaugcuuuguagaucucuguugagagaaugcauag

SEQ ID NO: 67944 - RNA, 65 nt, hsa
gcuaccauacccagcuaauuuaaacaaauuuuuuuuuuguagagauggggucuuggugcccaagc

SEQ ID NO: 67945 - RNA, 65 nt, hsa
acaggcaugugccaccacaccuaauuucuauauuuuuuguagagacuagguuucaccauguuguc

SEQ ID NO: 67946 - RNA, 65 nt, hsa
gaaagagaaaagguuuggguccacugaacaucauguuuguagacgcugacaggugggguccuaau

SEQ ID NO: 67947 - RNA, 65 nt, hsa
gugugaaucaccaugcccggcuaacuuuuaaauuuuuuguagagauggggucuugcuacguugcc

SEQ ID NO: 67948 - RNA, 65 nt, hsa
ccagcugaccagggugcuuggggaggguggggcuuuuuguagaaacuguggauucuuuuucucuc

SEQ ID NO: 67949 - RNA, 65 nt, hsa
gguccuuucacauucuugagcugccauguugugcuuuuguagagagaugauuauuguacuguggg

SEQ ID NO: 67950 - RNA, 65 nt, hsa
guguguaccaccacaccgggcuaauuuuuguauuuuuuguagagacgugggucucacuaugcugc

SEQ ID NO: 67951 - RNA, 65 nt, hsa
caccaccacaccugguuaauuuuuuauuuuuauuuuuuguagagacaggugucucucuacguugc

SEQ ID NO: 67952 - RNA, 65 nt, hsa
caccacaucuggcugaauuuuuuuuuuuuuaauuuuuuguagagacgaaguuucaccauguuggc

SEQ ID NO: 67953 - RNA, 54 nt, hsa
agcccucgaagccacaaugagauuuuuguagagacugaagcaguuguuucuguu

SEQ ID NO: 67954 - RNA, 65 nt, hsa
caucguuauuauauucaucaucaucaguauuauuauuuguagaaaggcuuuuuaacuucugcaga

SEQ ID NO: 67955 - RNA, 65 nt, hsa
uaacaccuuucuaaccuucuuaacgucagagaauuuuuguagaaauguaguccugugauugucau

SEQ ID NO: 67956 - RNA, 65 nt, hsa
uuuuuuuuuuuuuuuuuuuuuuuuuaaaugcuagguuuguagaggcuuacuuaaccuuaauggaa

SEQ ID NO: 67957 - RNA, 65 nt, hsa
augugagccaccaugccuggcuaauuuuuguacuuuuuguagaaauggagucucacuauguuucc

SEQ ID NO: 67958 - RNA, 65 nt, hsa
gccaccaugccuggcccggauaauuuuuuuuaauuuuuguagagacgaggucuugugauauugcc

SEQ ID NO: 67959 - RNA, 65 nt, hsa
caaaaugaaacaaauacuuguuguaaaaaugaugguuuguagaggggucaaacaucaaauguaau

SEQ ID NO: 67960 - RNA, 65 nt, hsa
gauauggaaaacauuuuucguaaaauaugggagaauuuguagaaaagaaaaacucuugaaaguaa

SEQ ID NO: 67961 - RNA, 65 nt, hsa
guguauuuauauguuuuuaaucauuuugaucaauguuuguagauuucaagguacaaacuucucac

SEQ ID NO: 67962 - RNA, 65 nt, hsa
cuuauuugcacauguuuuuaucacuuugaucaauguuuguagauuugaagguagaaacuucucaa

SEQ ID NO: 67963 - RNA, 65 nt, hsa
uccucagaguucucacauauggaaaggauacacacuuuguagaaacaagaacuuuauguuaucca

SEQ ID NO: 67964 - RNA, 65 nt, hsa
uggccaacucacauuuuucuuucuauuauuuauuuuuuguagagaugagucucacuauguugccc

SEQ ID NO: 67965 - RNA, 65 nt, hsa
gggcaugcaucgccacgucuggcuaauuauuauuuuuuguagacagggucucacuguguugccca

SEQ ID NO: 67966 - RNA, 65 nt, hsa
aucaaggagcaaguuggaguguuucagguguauauuuuguagaacccaaaagauuggagccuuaa

SEQ ID NO: 67967 - RNA, 65 nt, hsa
gugugcugaguucuauaauauaagcugccauauauuuuguagacaaguauggcuccuccauaucu

SEQ ID NO: 67968 - RNA, 65 nt, hsa
uuuuuaacaccuuuuacucuucuuacuggugcuauuuuguagaauaaggaacaacguugacaagu

SEQ ID NO: 67969 - RNA, 65 nt, hsa
agaaucuagggcacuguuuccuccccauccuucucuuuguagagaauagagacguuugucuuguc

SEQ ID NO: 67970 - RNA, 65 nt, hsa
ucuuaauacuguccuuuuuuuuuuuuuaacaguguuuuguagauuucagaugacuaugcagaggc

SEQ ID NO: 67971 - RNA, 65 nt, hsa
cuaaggaaaugguggcaugaagacccucucccuucuuuguagaauuaagauaacuuugauuuuau

SEQ ID NO: 67972 - RNA, 65 nt, hsa
aggugugacuggaaagcaugauauucuaggguugguuuguagauucaaauaauccagaaauauac

SEQ ID NO: 67973 - RNA, 65 nt, hsa
ugguuucgacauguaaaauguguuugaaaaccugcuuuguagaugcagagagaagcuauaggaaa

SEQ ID NO: 67974 - RNA, 65 nt, hsa
aacacaggcuuguacacagauguuuuacacucacguuuguagaugaaacagaucacugugcuguc

SEQ ID NO: 67975 - RNA, 65 nt, hsa
gccugagaugcuggcuguacucagccuuugcaauuuuuguagauguagcuuaggacgugaguuau

SEQ ID NO: 67976 - RNA, 65 nt, hsa
agguggcuuuucaguuacagaguccaguggaccauuuuguagaaccaugcagcucccugcggaag

SEQ ID NO: 67977 - RNA, 65 nt, hsa; identical to SEQ ID NO: 67627

SEQ ID NO: 67978 - RNA, 65 nt, hsa
gcaugugccaccaugcccagcuaauuuuuuuauuuuuuguagagacaaggucuugcuauguuguc

SEQ ID NO: 67979 - RNA, 65 nt, hsa
caaguacacacuaccacgcccagcuaauguguguuuuuguagagaugggauuuugccauguugcc

SEQ ID NO: 67980 - RNA, 65 nt, hsa
uauuccuuuucaaaaaggaaaaagcuguagaacauuuuguagaugaaacuacuguuuaagauuaa

SEQ ID NO: 67981 - RNA, 65 nt, hsa
uucuuagaagcagggugucagcuacugggaauauuuuuguagagcugcauugugaaaaaaagaug

SEQ ID NO: 67982 - RNA, 65 nt, hsa
ugugcaccacaaugccuagcuaauuuuuuuuguauuuuguagaaaugggguuucgccauguugcu

SEQ ID NO: 67983 - RNA, 65 nt, hsa
acgcagggugcgcuggguugggacguggguccacuuuuguagaccagcuguuuggagagcuguau

SEQ ID NO: 67984 - RNA, 65 nt, hsa
uccacagggcuaaugccaccaucuccccucaaaauuuuguagagguucuaaaaagaaagugguau

SEQ ID NO: 67985 - RNA, 65 nt, hsa
uguuuccagaggcgucuuagucucacccaaugugauuuguagaagcacgagacgcacuuuuauau

SEQ ID NO: 67986 - RNA, 65 nt, hsa
acgugcugcccgugacagcacauugagccacagcauuuguagacaggacagaggggugccugccc

SEQ ID NO: 67987 - RNA, 65 nt, hsa
gguggugugauuuuuuuuuccuccugucuuuuucauuuguagaaacuggagacguguaaagaaga

SEQ ID NO: 67988 - RNA, 65 nt, hsa
uuuauuaguuaugacaauaaauuaguauucugauauuuguagauuauuuuaaugauaaaaaugac

SEQ ID NO: 67989 - RNA, 65 nt, hsa
gugagugccaccacacucagcuaauuuucaaauuuuuuguagacagggucucccuauguugccca

SEQ ID NO: 67990 - RNA, 65 nt, hsa
uuguccauuccuuuaaggggagcagccugcacucuuuuguagauuacuuuugggggauauauuuu

SEQ ID NO: 67991 - RNA, 65 nt, hsa
cacacuacauucccucugucuucuagacuuuuuuuuuuguagaagaaucagaaaacaauuuacua

SEQ ID NO: 67992 - RNA, 65 nt, hsa
aacuucuaguuugcacugccuuggagcaagcacacuuuguagaggagggauuugcaguuacuugg

SEQ ID NO: 67993 - RNA, 65 nt, hsa
caaauauugugcauuuuaacaguaauauuugaagauuuguagaauauucaccuuuaaaacuaguu

SEQ ID NO: 67994 - RNA, 65 nt, hsa
uuuuacuuguuuuuuuaagagugugugauguguguuuuguagauuucuugacagugcuguaauac

SEQ ID NO: 67995 - RNA, 65 nt, hsa
ucccuauucugcguguauguguuugcacaugaguguuuguagaccauagaccauuaaaaaauacg

SEQ ID NO: 67996 - RNA, 65 nt, hsa
uuucaauguguuuuauauuguuuugacugccuuuuuuuguagaaauaaaaauugaccuuagaauu

SEQ ID NO: 67997 - RNA, 65 nt, hsa
aucagacacuaaucuagguauuucugugaagguauuuuguagaugugacagaaguccauucccaa

SEQ ID NO: 67998 - RNA, 65 nt, hsa
caugccaccacacccagcugauuaucauauuuuuuuuuguagagguggggaagugcagugaugca

SEQ ID NO: 67999 - RNA, 65 nt, hsa
caugccaccacacccagcugauuaucauauuuuuuuuuguagaggugggguuuuaccauucccag

SEQ ID NO: 68000 - RNA, 65 nt, hsa
cugacuuacagcaagcgaguuaucgucuucuguauuuuguagacuuucuaaauaaagucaaauuc

SEQ ID NO: 68001 - RNA, 65 nt, hsa
aaguuauauauuuaacaguuuuuauauguuguauauuuguagaaaauccuauuuaacaauuaacg

SEQ ID NO: 68002 - RNA, 65 nt, hsa
ggcaggugggagcugugacacagugugaaaaagcauuuguagagagacuuuuucucagcagccaa

SEQ ID NO: 68003 - RNA, 65 nt, hsa
gaacacaauuguguguguuuugguuaaucacaaauuuuguagauaacacuuaauacuauacuaag

SEQ ID NO: 68004 - RNA, 65 nt, hsa
augaauauuuugugaaucuuucuuaaaagcucaaauuuguagacuucuaaauagaauaaacacuu

SEQ ID NO: 68005 - RNA, 65 nt, hsa
gggccccugcugaagcccuauuuugaaauuucccuuuuguagagcuuuuuuccuuuccuaagccc

SEQ ID NO: 68006 - RNA, 65 nt, hsa
gagccccaaacuccucggccucacugggaggccccuuuguagaccagggcuccccuccucuuguu

SEQ ID NO: 68007 - RNA, 65 nt, hsa
guggaaucauuuuucugcccuuuagucguuuuuguuuuguagaaaguaucucucaaaauauauua

SEQ ID NO: 68008 - RNA, 65 nt, hsa
aaguuggccugcccuaacaauacuucuacagaacguuuguagagauauuggccuugaagcagaaa

SEQ ID NO: 68009 - RNA, 65 nt, hsa
uuuuuucugccuauuuaaagacaaauuaugggacguuuguagaaccugaguauuuuucuuuuuac

SEQ ID NO: 68010 - RNA, 65 nt, hsa
aagaaauguuucuggagcuaguuaugucucacaauuuuguagaaucuuacagcaucuuugauaaa

SEQ ID NO: 68011 - RNA, 65 nt, hsa
auuaauucaugaugcuucugauaugaugagucaucuuuguagaguuacuaagcauuagcaaagga

SEQ ID NO: 68012 - RNA, 65 nt, hsa
aguggccuuaccccugccuuugggagcaggauuuuuuuguagagagucuuaucugagcugagcca

SEQ ID NO: 68013 - RNA, 65 nt, hsa
auauuccuaguagauggaagcaaaauuaaguugucuuuguagaaaaugaagagccuuucuuccag

SEQ ID NO: 68014 - RNA, 65 nt, hsa
guaauuuccuaucguaauuauaacauucccauucuuuuguagaugaaacuucuacauauugaacc

SEQ ID NO: 68015 - RNA, 65 nt, hsa
acgagucacuuaaaauaucgacgguaaacuacuauuuuguagagaaacucaggaagauuuaaaug

SEQ ID NO: 68016 - RNA, 65 nt, hsa
caaacuuuucaaaugaaaauggauauuuaguguauuuuguagaagaucuccaaagaucuuuugug

SEQ ID NO: 68017 - RNA, 65 nt, hsa
aaacucaggauugauguaagcacuggaauauuuuauuuguagaaauguguaucgcaauuacuuaa

SEQ ID NO: 68018 - RNA, 65 nt, hsa
cuuccuguaguucuauucaaguguuacaauaaauauuuguagauaauagucaauacuuguguaug

SEQ ID NO: 68019 - RNA, 65 nt, hsa
gcgauuacaggaaugcaccaccacgcccagcuaauuuuguagagaugggguuucuccauguuggu

SEQ ID NO: 68020 - RNA, 65 nt, hsa
uuuaauuuaaaaguauuucucuuagcaguuuuuguuuuguagacaguucccauaaaaauauuuua

SEQ ID NO: 68021 - RNA, 65 nt, hsa
uuuuguauuuauuuucuacuguguaaauguauuccuuuguagaaucaugguuguuuugucucacg

SEQ ID NO: 68022 - RNA, 65 nt, hsa
uucuaacuuucuuuacuccaucauggcugcuugauuuuguagagaaauuagaacccauaaccaua

SEQ ID NO: 68023 - RNA, 65 nt, hsa
caguuuuaagauuaugccaucaccuaggguaauguuuuguagaaucaguccuucguguaacaacu

SEQ ID NO: 68024 - RNA, 65 nt, hsa
uaaaauuuggcacauguguggaaacaaauguauaauuuguagacaugcaaaaaauguugccuuuc

SEQ ID NO: 68025 - RNA, 65 nt, hsa; identical to SEQ ID NO: 68024

SEQ ID NO: 68026 - RNA, 65 nt, hsa
aaaucacauucauuuguuuaaaaauguaaagcuauuuuguagaggcucaguacuuuuccaaugca

SEQ ID NO: 68027 - RNA, 65 nt, hsa
cacaccuguuuuguuuuucuuaaguucaacauacuuuuguagaauuuguaaaauaaauguucgua

SEQ ID NO: 68028 - RNA, 65 nt, hsa
cuugauuuuaggcuuguuuuuuguaaacccauguguuuguagagauuuuaggcgucuucggauau

SEQ ID NO: 68029 - RNA, 65 nt, hsa
aaugaugaggaucucuuuuugcccccucuccuuuuuuuguagacccauucaaaaccauuaauaag

SEQ ID NO: 68030 - RNA, 65 nt, hsa
uuuguucuuuuggaagucuuacuucguguccuuccuuuguagagaaagugacagagcaggcgggu

SEQ ID NO: 68031 - RNA, 65 nt, hsa
uuucuagcccuuuaguucuuuuucauguugacagauuuguagacaauuacaaaagccaaaaaagg

SEQ ID NO: 68032 - RNA, 65 nt, hsa
gcagucuuggcccucauccagguaucugguuuuuuuuuguagaaagcacagauaagugguaaaug

SEQ ID NO: 68033 - RNA, 65 nt, hsa
uuugagcuagagagcuguaggaagcucaacauuucuuuguagagaacguugcuuuuuuuggauug

SEQ ID NO: 68034 - RNA, 65 nt, hsa
gcgcggccucuccccgccgcugcgcacugcaguuauuuguagacaaaggcaccccugauuuuugu

SEQ ID NO: 68035 - RNA, 65 nt, hsa
gaaugguuagaagugagggaguuugccccguucuguuuguagagucucauaguuggacuuucuag

SEQ ID NO: 68036 - RNA, 65 nt, hsa; identical to SEQ ID NO: 68015

SEQ ID NO: 68037 - RNA, 64 nt, hsa; identical to SEQ ID NO: 48511

SEQ ID NO: 68038 - RNA, 64 nt, hsa; identical to SEQ ID NO: 48512

SEQ ID NO: 68039 - RNA, 64 nt, hsa; identical to SEQ ID NO: 48513

SEQ ID NO: 68040 - RNA, 64 nt, hsa; identical to SEQ ID NO: 48514

SEQ ID NO: 68041 - RNA, 64 nt, hsa; identical to SEQ ID NO: 48515

SEQ ID NO: 68042 - RNA, 64 nt, hsa; identical to SEQ ID NO: 48516

SEQ ID NO: 68043 - RNA, 64 nt, hsa; identical to SEQ ID NO: 48517

SEQ ID NO: 68044 - RNA, 64 nt, hsa; identical to SEQ ID NO: 48518

SEQ ID NO: 68045 - RNA, 64 nt, hsa; identical to SEQ ID NO: 48519

SEQ ID NO: 68046 - RNA, 64 nt, hsa; identical to SEQ ID NO: 48520

SEQ ID NO: 68047 - RNA, 64 nt, hsa; identical to SEQ ID NO: 48521

SEQ ID NO: 68048 - RNA, 64 nt, hsa; identical to SEQ ID NO: 48522

SEQ ID NO: 68049 - RNA, 64 nt, hsa; identical to SEQ ID NO: 48523

SEQ ID NO: 68050 - RNA, 64 nt, hsa; identical to SEQ ID NO: 48524

SEQ ID NO: 68051 - RNA, 64 nt, hsa; identical to SEQ ID NO: 48525

SEQ ID NO: 68052 - RNA, 64 nt, hsa; identical to SEQ ID NO: 48526

SEQ ID NO: 68053 - RNA, 64 nt, hsa; identical to SEQ ID NO: 48527

SEQ ID NO: 68054 - RNA, 64 nt, hsa; identical to SEQ ID NO: 48528

SEQ ID NO: 68055 - RNA, 63 nt, hsa
aagggguggggagauauauaaauaaaucaugaaaucaauacauaugccuggcucagauuccuc

SEQ ID NO: 68056 - RNA, 64 nt, hsa
cuucuuguuucucacuuugauauuuaaaagauguucaauacacuguuugaaugugcugguaacu

SEQ ID NO: 68057 - RNA, 64 nt, hsa
auuucccaucugcaccccuucucuccuccccaaaucaauacacuaguuguuucuaccccuggcu

SEQ ID NO: 68058 - RNA, 64 nt, hsa
ucucauguguucaaauuaacauaaauauuacacgucaauacacuguacauggugguaauagacu

SEQ ID NO: 68059 - RNA, 64 nt, hsa
agugagcaucugcuguuagcuagacacuguugaaucaauacagugaaacagacagguaagcagg

SEQ ID NO: 68060 - RNA, 64 nt, hsa
ggaaaaggugucuugcuggcuugccucuugcaauucaauacagaucaguuuagcaaaucuacug

SEQ ID NO: 68061 - RNA, 64 nt, hsa
ggucuauuuggugucguggaaccucuuacugcuuucaauacacgauuaguaaucaacuguuuug

SEQ ID NO: 68062 - RNA, 64 nt, hsa
uuccacaucagaccuuccacuuaaggguaccaauucaauacaaaagagaaaagaagaaccucuc

SEQ ID NO: 68063 - RNA, 64 nt, hsa
cagaucaguuaguaggcuuucguugucuucucuuucaauacauguacaucuuuacuguuugaaa

SEQ ID NO: 68064 - RNA, 64 nt, hsa
gcaccuccgucggaagcauuuggcacacacaccuucaauacacgucaaggucgcuuccaguuuu

SEQ ID NO: 68065 - RNA, 64 nt, hsa
aacauuccgaagagggaauggauggggagaauggucaauacacauaagaccgugucccaaggag

SEQ ID NO: 68066 - RNA, 64 nt, hsa
uaagauagaugguguugauuccacuggguuuugaucaauacaauaacaaaccuuuuuccuuuga

SEQ ID NO: 68067 - RNA, 64 nt, hsa
ccccuuccaccugcugcgggcugggcugguuuucucaauacaaaauuguaagaggauccuuguc

SEQ ID NO: 68068 - RNA, 64 nt, hsa
auaauauucaucgauaccauuauucaaauauugcucaauacagcaaauuagcuccuaaccuaac

SEQ ID NO: 68069 - RNA, 64 nt, hsa
gggauuuacuaguaguguaaauaaaauucacucuucaauacaugaauggaaacuuaaauuuuuu

SEQ ID NO: 68070 - RNA, 64 nt, hsa
gaaauugaguauuuucugacauaagaauauauuaucaauacaguuuuaugcaguaagcucuccu

SEQ ID NO: 68071 - RNA, 64 nt, hsa
ccugcuuucuuuucuccucagucuugcauuucccucaauacaagcuguagccucuuuccucguu

SEQ ID NO: 68072 - RNA, 64 nt, hsa
auugaauauauuauaaucuuccauacuucuucauucaauacaagugugguagggacuuaaaaaa

SEQ ID NO: 68073 - RNA, 64 nt, hsa
cauagaaaugaauggcagaaagaggagucauauuucaauacaucaugaaauuccuuauaaaaua

SEQ ID NO: 68074 - RNA, 64 nt, hsa
aaauucuuucccugguaaugaaaagagcccuuuaucaauacagugcugcaauuucuggauauca

SEQ ID NO: 68075 - RNA, 64 nt, hsa
uuccaggggccccacacuccguggugagccaccaucaauacagaaagugaccuaagauguacca

SEQ ID NO: 68076 - RNA, 64 nt, hsa
aauugggggaaaaaacuuuuaaucacaauuuucuucaauacaaggggaaaauauucuugcggau

SEQ ID NO: 68077 - RNA, 64 nt, hsa
ccugcagaugccugacucuuguuagccuuacuauucaauacaguccuuagauucacgguaugcc

SEQ ID NO: 68078 - RNA, 64 nt, hsa
cacaacaguuagcaagcugacuuuuguaaugugcucaauacaaauacuugugaacuuuuaauau

SEQ ID NO: 68079 - RNA, 64 nt, hsa
aguaucuaaaaauuuuaucaccaggggaauaaacucaauacacauucauuaaacuuuuguugua

SEQ ID NO: 68080 - RNA, 64 nt, hsa
cucuaacaagaaaaaugucuagauuuacacauugucaauacaguauauuaguucugcaaaugca

SEQ ID NO: 68081 - RNA, 64 nt, hsa
ugauauuuauggaaaaguacuuucaaguacaaggucaauacauaagccagagugaaugauacua

SEQ ID NO: 68082 - RNA, 64 nt, hsa
uuucuaauucaguucugaaguuauaaacuuauaaucaauacaaaccagcaacuaauaaaaccuc

SEQ ID NO: 68083 - RNA, 64 nt, hsa
uuguaauucuucagaauugauuauuuuuauugugucaauacagagaaagccuuucagaucuuug

SEQ ID NO: 68084 - RNA, 64 nt, hsa
caauccucaaguuuuaauugauuuuaaauauuuuucaauacaacaguuuagguuuaagaugacc

SEQ ID NO: 68085 - RNA, 64 nt, hsa
aucuguuacuguucuaaaaauguuuaaaagaaacucaauacagauaaagauaaauaugugacua

SEQ ID NO: 68086 - RNA, 64 nt, hsa
auauuucauuccccaggcagacauuuuuuagaaaucaauacaugccccaauauuggaaagacuu

SEQ ID NO: 68087 - RNA, 64 nt, hsa
aauaagauauuggaauuuauuaaaagauuuuuguucaauacauuuuagauuaggauugacaagu

SEQ ID NO: 68088 - RNA, 64 nt, hsa
uuccaugacgacauacaugcuacuuuuuuuuaguucaauacagugaaggucuuuguuaugacag

SEQ ID NO: 68089 - RNA, 64 nt, hsa
ggcccugggccacccugugcuaucugaaaugaccucaauacacuaaugccaaccucagcgucau

SEQ ID NO: 68090 - RNA, 64 nt, hsa
uacaguaacaauagacagcacaacacaaacucucucaauacagauaaacucacacauacuggag

SEQ ID NO: 68091 - RNA, 64 nt, hsa
ccaagaguguguugcuauuuguaagccccauggaucaauacauaaacuaugcauaaaaauaaaa

SEQ ID NO: 68092 - RNA, 64 nt, hsa
agugagcaagcuguguacacuggaaaacacugaaucaauacaaugcguuugugauuaucauuag

SEQ ID NO: 68093 - RNA, 64 nt, hsa
uacuccuaaaguaagaguuggguccuuuuuuucuucaauacaacugugcuguaccuuguaaagu

SEQ ID NO: 68094 - RNA, 64 nt, hsa
uuuucugucaacuaccaugcccaugagauguuuaucaauacaacugccauuuuagcuauguggu

SEQ ID NO: 68095 - RNA, 64 nt, hsa
caaacuuugaggcgugauuucauucauugaagaaucaauacauauuuuguuucaaaauguuuga

SEQ ID NO: 68096 - RNA, 64 nt, hsa
gaaaguguauguaaacuaccugaaaggaugacaaucaauacaaugacaaauaugccaguuuauu

SEQ ID NO: 68097 - RNA, 64 nt, hsa
ugaguuucagauaaaacauuauaaaacauuaaauucaauacauacugcuccuuugaaauuuggg

SEQ ID NO: 68098 - RNA, 64 nt, hsa
caaacuucuuuuaaaacaauauccacacacugcaucaauacauaacuuuaggucuaagucuugc

SEQ ID NO: 68099 - RNA, 64 nt, hsa
cuucaacuuuguguuuuuaaauguuuugacgauuucaauacaagauaaaaaggauagugaauca

SEQ ID NO: 68100 - RNA, 64 nt, hsa
acacccacgaauggcaaaucuccacgcuagacacucaauacagguaaauaggccaccaguuaau

SEQ ID NO: 68101 - RNA, 64 nt, hsa
uuuugccuuguguaguuaaaaauuaaggggcuggucaauacaaaaacuuguacacaaauauuua

SEQ ID NO: 68102 - RNA, 64 nt, hsa
aauaagugcauucuucugcuuuucaccccagcuaucaauacaugcaucuuuaucagcagccaaa

SEQ ID NO: 68103 - RNA, 64 nt, hsa
gcauugggguugcaagauaaugcacaguccgagcucaauacaugucuucauguaccuguaugua

SEQ ID NO: 68104 - RNA, 64 nt, hsa
aacagugcuuuguaaauuguguugucuucagcagucaauacaaauagauuuuuguuuuuguugu

SEQ ID NO: 68105 - RNA, 64 nt, hsa
aggcucaaaacauuacccuaacaaaguaaaguuuucaauacaaauucuuugccuuguggauauc

SEQ ID NO: 68106 - RNA, 64 nt, hsa
cauggaggaucaaacacugucagaauugcugaaaucaauacacaaagagauaaaguuuagcuuc

SEQ ID NO: 68107 - RNA, 64 nt, hsa
ucauuacagauaaucaacauuucuuuuguauaauucaauacaugaucaucaaguuaauugguaa

SEQ ID NO: 68108 - RNA, 64 nt, hsa
cuuuaaaucacgaauguugaaguaccagugagacucaauacauauuuuugaagauaguccaugg

SEQ ID NO: 68109 - RNA, 64 nt, hsa
cugauugaauauaagcacaaccauauuaaaugaaucaauacaagaaaauuauuucugauacuau

SEQ ID NO: 68110 - RNA, 64 nt, hsa
auuauuuuagaaauaguaggaaguauugcagaagucaauacacaaaugugccaggcagaggugg

SEQ ID NO: 68111 - RNA, 64 nt, hsa
gaaaguuuguagauauugccaagauuucccaggcucaauacaguguaauuauuuuauguuuuaa

SEQ ID NO: 68112 - RNA, 64 nt, hsa
uuccauagggccauguugccagaaucuguauguaucaauacaggguuuuuccaagccaggaaac

SEQ ID NO: 68113 - RNA, 64 nt, hsa
uuucacaaucacacugagacaagcucaggccuauucaauacaauuuacugacaugacaaccuag

SEQ ID NO: 68114 - RNA, 64 nt, hsa
uauauuuauuucguauugucuacagcuguaguguucaauacauuagccacuagccacauguggu

SEQ ID NO: 68115 - RNA, 64 nt, hsa
uuucggcgaggguuuucuuacccacauuccccaaucaauacacacacacugcagaacccagaac

SEQ ID NO: 68116 - RNA, 64 nt, hsa
ugauguugcacuuucuguauuuuacaggaauuagucaauacauguugaaauguuuaacauuuua

SEQ ID NO: 68117 - RNA, 64 nt, hsa
ucauuguuuucauuauuugugaucauguugucuuucaauacaggcauaaaccuuccacucuuga

SEQ ID NO: 68118 - RNA, 64 nt, hsa
gagcucuuaaagacagacuaaaaagaguaauaaaucaauacaacaacauuaaaagccagacuag

SEQ ID NO: 68119 - RNA, 64 nt, hsa
gauccugaguuuucugggacaauuccagcuuuaaucaauacauuuuguuaaaugugccauaaaa

SEQ ID NO: 68120 - RNA, 64 nt, hsa
gacuuguuaaaucuauucccaugccagaaucuuaucaauacauaagaaauuuaggaagauuagg

SEQ ID NO: 68121 - RNA, 64 nt, hsa
uaaaagauuuuuaaagagcauauaaauaauuugaucaauacaacaguauagauaaaagaauuau

SEQ ID NO: 68122 - RNA, 64 nt, hsa
ggcacacauucuauucaucgugggaaccauggugucaauacauaucauguagcuucugaaaaac

SEQ ID NO: 68123 - RNA, 64 nt, hsa
ucuccccuccucuauuccuuuuagggaauaauauucaauacacaguacuuccucccagcauugc

SEQ ID NO: 68124 - RNA, 64 nt, hsa
gcucaacaagucuggguauauucacuauugugagucaauacaccauagcucuguugaaauuccu

SEQ ID NO: 68125 - RNA, 64 nt, hsa
uccuaaaacaauccugacuuuuauuuugccaaaaucaauacaauccuuugaauuuuuuaucugc

SEQ ID NO: 68126 - RNA, 64 nt, hsa
gcuagguacuaauuugcagaugucuuuacauauuucaauacagaaacuauaacauucaauagug

SEQ ID NO: 68127 - RNA, 64 nt, hsa
gaggauuugauauauaugcuuaauggccuggggcucaauacaggugugaaucuauacaaaguga

SEQ ID NO: 68128 - RNA, 64 nt, hsa
uuuuuacaauuuaaugagaaaaaguuuaaaauucucaauacaaaucaaacaauuuaaauauuuu

SEQ ID NO: 68129 - RNA, 64 nt, hsa
gccugugccucggcucacuuacagaaguucugacucaauacaucugggauuucuacuuucaaag

SEQ ID NO: 68130 - RNA, 64 nt, hsa
cuaagaucauguuccaagcuaacugaaucccacuucaauacacacucaugaacuccugauggaa

SEQ ID NO: 68131 - RNA, 64 nt, hsa
guauugauguaugugcugaaucuucacagacuugucaauacacaggcaguauucuaaaauagca

SEQ ID NO: 68132 - RNA, 64 nt, hsa
uuauauagaggcuucuauuucucuuaagucagcaucaauacaacggccggaguuucuguuuuug

SEQ ID NO: 68133 - RNA, 64 nt, hsa
guugggugaggguaaagcuuuucuauaaucaagcucaauacaccaaggaaacuggauccagaau

SEQ ID NO: 68134 - RNA, 64 nt, hsa
cuccgugccgagggcugcaugcuaccgcacuaagucaauacaugggcuccccgauucgcagcug

SEQ ID NO: 68135 - RNA, 64 nt, hsa
aggaccaagaaaaccaaaacggaagaggagaaacucaauacaaagacaaguacaacuccauuag

SEQ ID NO: 68136 - RNA, 64 nt, hsa
auaaucaaaaaguaaacuuucuuuaguaguauguucaauacaucauuuaauuuuuuaaguuauc

SEQ ID NO: 68137 - RNA, 64 nt, hsa
cccucagcaccacagcucaagaaaaccuaaaguuucaauacaagccauaggcucacagaaaaag

SEQ ID NO: 68138 - RNA, 64 nt, hsa
cuuucccacagucuuuuauauaauuaaauauaugucaauacacauuagaaucagauuugaaaaa

SEQ ID NO: 68139 - RNA, 64 nt, hsa
uuuuuaaguuuuguuuuuaucuugccuguuggcuucaauacauuugagaauacgcugaagaggg

SEQ ID NO: 68140 - RNA, 64 nt, hsa
gaaaaucagugucaacucagaagugacugauuuaucaauacauggacaaaaaguaaaucauuga

SEQ ID NO: 68141 - RNA, 64 nt, hsa
cauuauguaaugcuugcuuuacuaaaauuuaaauucaauacaugguuuuuaacaaaacagaaca

SEQ ID NO: 68142 - RNA, 64 nt, hsa
cuuccuuccauaugauaaaucauucuucuucacgucaauacacuucauauuaauuucuaguaca

SEQ ID NO: 68143 - RNA, 64 nt, hsa
gcacguugcaugacaucuggaacacagaaagcccucaauacauugaagcucuuaggauuuucac

SEQ ID NO: 68144 - RNA, 64 nt, hsa
aucuuuaaaacuagauucuugcuucugauauguuucaauacauuguugauggcauugugccauu

SEQ ID NO: 68145 - RNA, 64 nt, hsa
ccaaguauugccucucugcaauagacagcuacugucaauacaugcuguaauuugacauucuggg

SEQ ID NO: 68146 - RNA, 64 nt, hsa
uauaguggcagcauaaaguguuuauuucagaauaucaauacaguuuugucuucauuuuucaaca

SEQ ID NO: 68147 - RNA, 64 nt, hsa
gggugcccaggacggucugugcccgagguuccugucaauacagguuuuauuuuaucacuugccg

SEQ ID NO: 68148 - RNA, 64 nt, hsa
uuauucuuuuauuucccucuguauaacugcaucuucaauacaaguaucaguauauuaaauaggg

SEQ ID NO: 68149 - RNA, 64 nt, hsa
auuauugucauaaugcauuauuccauguguggugucaauacauuuuagcggacaaagaagaaac

SEQ ID NO: 68150 - RNA, 64 nt, hsa
uauucuuuacaacagcaaccaaagaaaacauaccucaauacacucaaaacugaagacauagagg

SEQ ID NO: 68151 - RNA, 62 nt, hsa
gcuaggauucuagagaauugauuauaaaauauuuucaauacauccaacauugcacuucucau

SEQ ID NO: 68152 - RNA, 64 nt, hsa
ccuguaacagguguggggacacagcagugaguaaucaauacagacaagguucugcccuuaugga

SEQ ID NO: 68153 - RNA, 64 nt, hsa
cugccccuaagcugggguggaaccggaauuugggucaauacauccuuuugucucccaagggaag

SEQ ID NO: 68154 - RNA, 64 nt, hsa
agaacauugguagguaacaagaugcaagaggaugucaauacaagauugucugccuguuuuucuu

SEQ ID NO: 68155 - RNA, 64 nt, hsa
gcauguuccauuauacgugucuucuaagagcuguucaauacaguauucacucuagaaacaauua

SEQ ID NO: 68156 - RNA, 64 nt, hsa
aggcccagagcgaggaaaggauuuuaccaaagcaucaauacaaccagcccaaccaucgguccac

SEQ ID NO: 68157 - RNA, 64 nt, hsa
uaacagugcagggcaaaauauucacugggccaauucaauacaaacaaucucuuaaauuggguuc

SEQ ID NO: 68158 - RNA, 64 nt, hsa
guuuaaguaauuugguuuaauaaucagaaaauauucaauacaguguuggauauucugucaugca

SEQ ID NO: 68159 - RNA, 64 nt, hsa
ccgauuucaaaaccagauucacugagcauaaaagucaauacauauuugaggaauaagucuccua

SEQ ID NO: 68160 - RNA, 64 nt, hsa
ucaguguccuccaugccaagcagaaaacucauagucaauacaaguauuuuuaaaaaugucuaau

SEQ ID NO: 68161 - RNA, 64 nt, hsa
aaucugacaaaguaauuuacauacuguuuguguaucaauacaauuuuguguucuugguauucuu

SEQ ID NO: 68162 - RNA, 64 nt, hsa
auaauuguucauaucaaugaaggugcugaccagcucaauacaaaguuaagcacaagaucuaaag

SEQ ID NO: 68163 - RNA, 64 nt, hsa
cugugccauaaaauuucaguguaauaagacuucuucaauacaucuuccaauaaggggugcuucu

SEQ ID NO: 68164 - RNA, 64 nt, hsa
uauagauuucuaguacugcccaggaaaucuaauuucaauacauuuauccuagguuucaugaaag

SEQ ID NO: 68165 - RNA, 64 nt, hsa
ccccacccccagguuuuugcccauccucccaaucucaauacagccugaauaaaccaagacaaga

SEQ ID NO: 68166 - RNA, 64 nt, hsa
gauacuaauucaauguaauuuauaauuuucuaugucaauacaaaaauacaucacagccuucuca

SEQ ID NO: 68167 - RNA, 64 nt, hsa
uuucuuuuuaauaaaaaggcaccuauaaaacaggucaauacaguacaggcagcacagagacccc

SEQ ID NO: 68168 - RNA, 64 nt, hsa
uucuuuauguuuuuaugaccaaagcaguuucuugucaauacacgggguucaguaugacacagaa

SEQ ID NO: 68169 - RNA, 64 nt, hsa
ugagaccuuacaaaugacucagcccacgugccacucaauacaaauguucugcuauaggguuggu

SEQ ID NO: 68170 - RNA, 64 nt, hsa
gaaggaaauugggacuaguuuauaggagaacguaucaauacaguuuauaaagccaagaauugcu

SEQ ID NO: 68171 - RNA, 64 nt, hsa
aucuguaaugcccugugauuuuuaugauacuucuucaauacaaaguguuaauaugugucaucag

SEQ ID NO: 68172 - RNA, 64 nt, hsa
gcucucccagcuguccuccugucucauuguuuggucaauacacugaagauggagaauuuggagc

SEQ ID NO: 68173 - RNA, 64 nt, hsa
cucacaguugagugggggaagaaacagccagaauucaauacaacaaagagcgggaguuaguaua

SEQ ID NO: 68174 - RNA, 64 nt, hsa
uuugcuuuuauuguugauuuuuuaacuuugaacaucaauacauuuuacuugaauacauauaguc

SEQ ID NO: 68175 - RNA, 64 nt, hsa
acauuuuuaaaaauugcucuuaauuuuuaaacucucaauacaauauauuuugaccuuaccauua

SEQ ID NO: 68176 - RNA, 64 nt, hsa
gagcaauaugaaagggaaauguucuuuauuaaaaucaauacauuaucuuauuaaacaaagaucc

SEQ ID NO: 68177 - RNA, 64 nt, hsa
auugagaaaugauggaauaauagacauaauuaauucaauacacuacuguuaaaaucauuugcaa

SEQ ID NO: 68178 - RNA, 64 nt, hsa
cauuuuaaugagucagagaaaaauuaauuuuucuucaauacaauaauagaacaaguagccuauu

SEQ ID NO: 68179 - RNA, 64 nt, hsa
cauuacugguaaagccucauuugaaugugugaauucaauacaggcuauguaaaauuuuuacuaa

SEQ ID NO: 68180 - RNA, 64 nt, hsa
ugaagaagacacaagaaucaaaguacaaguugccucaauacaugcuaauaacuaagcuucuauu

SEQ ID NO: 68181 - RNA, 64 nt, hsa
ccauguacuuggugcuuugguauauguucuaccuucaauacaucuuucccuuucucuucuucau

SEQ ID NO: 68182 - RNA, 64 nt, hsa
uuuccagggacgacuguccccucuaaaguuaaagucaauacaagaaaacugucuauuuuuagcc

SEQ ID NO: 68183 - RNA, 64 nt, hsa
aaauagauaacuucguaaccaccagggggcagauucaauacaucacagaauggcugaggaagau

SEQ ID NO: 68184 - RNA, 64 nt, hsa
uuauuguggaggaggaggaucuaauauauaauauucaauacaauuguaauguagaaauauaaga

SEQ ID NO: 68185 - RNA, 64 nt, hsa
acccaucuccccagucagacaagguuuauacguuucaauacauacugcauucugugcuacacaa

SEQ ID NO: 68186 - RNA, 64 nt, hsa
aggcuggggugggcccugucauucgugguugauuucaauacacucaagugccauucauccuuua

SEQ ID NO: 68187 - RNA, 64 nt, hsa
gaauauacuccauugaaaggaaaaauaaggaaauucaauacaaacugcacuaugauuugcuuua

SEQ ID NO: 68188 - RNA, 64 nt, hsa
auaaaauuaaauauuuuuguuucaaagaaacaucucaauacacuuagggguguauuguuuccca

SEQ ID NO: 68189 - RNA, 64 nt, hsa
uccauuugggggauuuuuaagaauuugauguauuucaauacacuguucaaaauuaaauuguuua

SEQ ID NO: 68190 - RNA, 64 nt, hsa
aaacaagaaagacgcacuuuggcuuauaauucuuucaauacagauauauuuucuuucucuuccu

SEQ ID NO: 68191 - RNA, 64 nt, hsa
aagauagucagugauaaccacugaccagaugcuaucaauacacuauguguccuuuuuagaauaa

SEQ ID NO: 68192 - RNA, 64 nt, hsa
uuuuuauauuauaagugauugaguuuaguucauuucaauacauuguacaugaaaaaaugaaaag

SEQ ID NO: 68193 - RNA, 64 nt, hsa
uugaacagcgcucccugugguuugugcccacugcucaauacagccuccgauccucacucuugaa

SEQ ID NO: 68194 - RNA, 64 nt, hsa
cccuccccucucccugccaaaaggcaguuacauaucaauacagagacucaaggucacuagaaau

SEQ ID NO: 68195 - RNA, 64 nt, hsa
caacagccagacagggcuccagggcuugucccagucaauacagaguucccucugcugucuggcc

SEQ ID NO: 68196 - RNA, 64 nt, hsa
uggaacuuacguucuuauaccaauaaaagguaccucaauacauguucuuucaauuucuguuuug

SEQ ID NO: 68197 - RNA, 64 nt, hsa
acccagacuagaauaggguucuuaaaaucaaguaucaauacaaaauagaacacaauuaaaaucu

SEQ ID NO: 68198 - RNA, 64 nt, hsa
aguggucaugggccacugcuuuucccuuugugagucaauacauagugcugcugugugcuuuuuu

SEQ ID NO: 68199 - RNA, 64 nt, hsa
cggggaggaaauaccaaaugcauuguuguucugcucaauacaucucacuuguuucuaauaaaga

SEQ ID NO: 68200 - RNA, 64 nt, hsa
ccguucaggaucccggcuacauaaucuguggggcucaauacaaaauaaaaauguaggggcuccu

SEQ ID NO: 68201 - RNA, 64 nt, hsa
uuuugacauguuauguuguggucaucuuuucaugucaauacauagauuaaucuuuuauuucaaa

SEQ ID NO: 68202 - RNA, 64 nt, hsa
augccuggcaaauuaccugacacagagcagacauucaauacauuuuaguuuccuuguuucucug

SEQ ID NO: 68203 - RNA, 64 nt, hsa
uggacccugcuucacccucacccccuccuggcaaucaauacagcuucauuaucugaguugcaua

SEQ ID NO: 68204 - RNA, 64 nt, hsa
auagaguuaaaaacuaaagaaugggagacucaguucaauacauggucauuuuguuagcuugcaa

SEQ ID NO: 68205 - RNA, 64 nt, hsa
gcguugugacaaacaugcaaugugcuguaaaaauucaauacaguuuaaauaaaaucucuauauu

SEQ ID NO: 68206 - RNA, 64 nt, hsa
gccccaagcucaucacaccagggggccauccuucucaauacagccugcccuugcagucccuauu

SEQ ID NO: 68207 - RNA, 64 nt, hsa
guauucuauguggagaccuugcaccuuguaaucaucaauacauccaccaaaaauauauaaugua

SEQ ID NO: 68208 - RNA, 64 nt, hsa
agauuugauuuuuuuaaaaaagccugcgaccuauucaauacauuaugcuuaaauuagcaguuuc

SEQ ID NO: 68209 - RNA, 64 nt, hsa
guggggagaaauguaaacaaucagcucacaggcaucaauacaaccagauuugaaguaaaauaau

SEQ ID NO: 68210 - RNA, 64 nt, hsa
aauauuuuuuuuuaaucugcugccauauuguagcucaauacaaugugaauuuguuuuucguuuu

SEQ ID NO: 68211 - RNA, 64 nt, hsa
uaguggggacuagugaaugacuugaccugugaccucaauacaauaaaugugaucccccacccaa

SEQ ID NO: 68212 - RNA, 64 nt, hsa
aaaagcaaaguaaauccugccaccauguuguagcucaauacaaugugaacucacuuuuuuuuuu

SEQ ID NO: 68213 - RNA, 64 nt, hsa
uugggugauuauaucuugaugauacauuacuuguucaauacagccacugauggaaugcuuccuu

SEQ ID NO: 68214 - RNA, 64 nt, hsa
acgcauuuuggauguuauuauuaagaaccaaaugucaauacagaauucauguugccgguuuccc

SEQ ID NO: 68215 - RNA, 64 nt, hsa
auuucuuuucuuuuaguuuagaagacaaaaaauuucaauacagauacuucuuuuagaaguaaau

SEQ ID NO: 68216 - RNA, 64 nt, hsa
ugcagagggugaccacagucuguaauuccccacuucaauacaaagggugucguucuuuuccaac

SEQ ID NO: 68217 - RNA, 64 nt, hsa
uguucuaauauuuauuuuuauggcaucucauuuuucaauacaugcucuuuugauuaaagaaacu

SEQ ID NO: 68218 - RNA, 64 nt, hsa
gucucauuauuuuuguuuuuauuuaacccuuucuucaauacaaaaagccaacaaaccaagacua

SEQ ID NO: 68219 - RNA, 64 nt, hsa
gaauaaccuucguguccaccugugggggacugauucaauacauaugcacguccacagcagagaa

SEQ ID NO: 68220 - RNA, 64 nt, hsa
uuuauauuucaagaauaaaguacuaagauugugcucaauacacagaaaaguuucaaaccuacua

SEQ ID NO: 68221 - RNA, 64 nt, hsa
uaaaaagauguuacugaggaccuagaagaaaugcucaauacauacuuugaaagcaaaaauacaa

SEQ ID NO: 68222 - RNA, 64 nt, hsa
ccaagcccuggagacccauuaccaccguuaacccucaauacagcucugcuaguaagggauucgu

SEQ ID NO: 68223 - RNA, 64 nt, hsa
uguucaucuuuugggagggaauaagcuagagccaucaauacaauuccgcuuguggggaaauuua

SEQ ID NO: 68224 - RNA, 64 nt, hsa
aacaauugaaauauuuugucuuaaaucacuugguucaauacaugcuuauuuguuuuaaaaccug

SEQ ID NO: 68225 - RNA, 64 nt, hsa
uuaaauuauaacguuuuggcuuaagugucuuuuaucaauacaaugauaagacaccuuaauccug

SEQ ID NO: 68226 - RNA, 64 nt, hsa
aagcuuaggagcccuggagccuuugugcucccacucaauacaaaaaggccccucucuacaucug

SEQ ID NO: 68227 - RNA, 64 nt, hsa
uugucuggguuccaaaauauugacauugaauggaucaauacacacacacagacauauauauaua

SEQ ID NO: 68228 - RNA, 64 nt, hsa
aguagcacaccugccccugcauuucagugggaugucaauacacuugaccccaagucccccggcc

SEQ ID NO: 68229 - RNA, 64 nt, hsa
guuuuuauuuugaagacuuuuaaaauggacauuuucaauacauaaaaauaaacagugcuuuaua

SEQ ID NO: 68230 - RNA, 64 nt, hsa
ucaagcauggaacaaagcauguuucaggaucagaucaauacaaucuuggagucaaaaggcaaau

SEQ ID NO: 68231 - RNA, 64 nt, hsa
augagggaaaguaaauccucaugaggaaaaguacaaauggaaaucguauuaauuugugaggcag

SEQ ID NO: 68232 - RNA, 64 nt, hsa
uuugacauuugcaccuuaggagaggcagauguuaaaauggaauccaaagaccaccuagggcggg

SEQ ID NO: 68233 - RNA, 64 nt, hsa
caaacacacaguucgucucugaggaaaguaaaauaaauggaauaagaguaaauuggguaaggag

SEQ ID NO: 68234 - RNA, 64 nt, hsa
cccagagacaugcaagucaugggucacaccugacaaauggaaggaguuccucuaacauuugcaa

SEQ ID NO: 68235 - RNA, 64 nt, hsa
cugacaaauggaaggaguuccucuaacauuugcaaaauggaaauguaauaauaaugaaugucau

SEQ ID NO: 68236 - RNA, 64 nt, hsa
aaagguuguuuuaauaucuacuugguuuuucucaaaauggaaauaauuuuaaaaucaggaaaga

SEQ ID NO: 68237 - RNA, 64 nt, hsa
acucuuaaugaaacuuuaauuuuacuuaauuaagaaauggaauuuauauacaaaaauauuuucc

SEQ ID NO: 68238 - RNA, 64 nt, hsa
auggcuugaaaugcuaugucugcaugauaauuuaaaauggaagauuuaaacuuugcacuccaaa

SEQ ID NO: 68239 - RNA, 64 nt, hsa
ucuuugccuaaauaacaguuuuauaugcacauugaaauggaauuauacuucaacuauauuauua

SEQ ID NO: 68240 - RNA, 64 nt, hsa
caccccaguccuauuuguccaaggcugcauggucaaauggaaucuugaagagaacaccuggaca

SEQ ID NO: 68241 - RNA, 64 nt, hsa
aggacaggaaaguaacauuaaauguagaaaacaaaaauggaacauuuauucgcaacucaaauac

SEQ ID NO: 68242 - RNA, 64 nt, hsa
agaaauguguuuauaaucuacuguaauuuccacuaaauggaacccaaauauuaauguuauggua

SEQ ID NO: 68243 - RNA, 64 nt, hsa
agagaauacugacaucuucaaccuagcacauuucaaauggaaacuacuguucuauuugcaauau

SEQ ID NO: 68244 - RNA, 64 nt, hsa
ugcuguuuuauacauuugcaacaauuucucuuguaaauggaaugguuugggguuuuuaaauaag

SEQ ID NO: 68245 - RNA, 64 nt, hsa
aaugcuuuuauguauuucaaaacuuucauauguuaaauggaaauuguuuuaaauguguuugagu

SEQ ID NO: 68246 - RNA, 64 nt, hsa
ucccccucaccuucaauaagguuuuucaaaaaggaaauggaaacuuuuuaaccaauuugugaau

SEQ ID NO: 68247 - RNA, 64 nt, hsa
uuaaauuauuuuuaauaccaaaagaguucuuuugaaauggaacugauuaaaagggcagaggguc

SEQ ID NO: 68248 - RNA, 64 nt, hsa
uugguaaaagaacuauuuuggaaacaguauuuguaaauggaacuaaugcuauauuuaaaaacac

SEQ ID NO: 68249 - RNA, 64 nt, hsa
guuucaccaaagucuguuuauaucaacacacacaaaauggaauaauucugagucacuaggcaau

SEQ ID NO: 68250 - RNA, 64 nt, hsa
ucauuuugaaaaucuuggaugaaaggugcuauguaaauggaaauacaaaggauucuuacuaaca

SEQ ID NO: 68251 - RNA, 64 nt, hsa
gaccaucaauaaaaaagagagcauguuuaaauugaaauggaacuuagagaacuugagcuuacuu

SEQ ID NO: 68252 - RNA, 64 nt, hsa
gcacuccacuugucagcuggacuucugccuugugaaauggaagcagccuuuguuccuuucuggc

SEQ ID NO: 68253 - RNA, 64 nt, hsa
uacuaaagucauguggaauaaagccauuggaaacaaauggaaagccugucgggacuucugggcu

SEQ ID NO: 68254 - RNA, 64 nt, hsa
ccaaaguauaacacuaucaauuugugaggauaauaaauggaaugccauuaguguagaugucugu

SEQ ID NO: 68255 - RNA, 64 nt, hsa
ugccauuaauccuaauucagugcuauccaguuauaaauggaaucuugagacaaaaccuuaacaa

SEQ ID NO: 68256 - RNA, 64 nt, hsa
acacagucagcccaggaaaaagagaagcagggccaaauggaaagaacacauaauaaacaagaaa

SEQ ID NO: 68257 - RNA, 64 nt, hsa
ggcugagaagagccagaucaaccucauugauaagaaauggaagccccugcaagguguggggaac

SEQ ID NO: 68258 - RNA, 64 nt, hsa
auuagguggugguagagaagcaaguaaaaaggcuaaauggaagggcaaguuuccaucaucuaua

SEQ ID NO: 68259 - RNA, 64 nt, hsa
uaaaauacauuguauauauguguaugcacaguaaaaauggaaacuauauugaccuaaaugugaa

SEQ ID NO: 68260 - RNA, 64 nt, hsa
aauaagacacucaaauaugaguacaaaugccuuaaaauggaauugaaaaacucuuuauuuuccc

SEQ ID NO: 68261 - RNA, 64 nt, hsa
uaaaauaaugcugcaaacuuaauguucuuaugcaaaauggaacgcuaaugaaacacagcuuaca

SEQ ID NO: 68262 - RNA, 64 nt, hsa
gaagaaggccuaaucucucucuuuuucagugaauaaauggaacaccauuucuggauucuagucc

SEQ ID NO: 68263 - RNA, 64 nt, hsa
aauacuucuuuuuuccccuggaguccgagaaggaaaauggaauucugguucauacugugguccc

SEQ ID NO: 68264 - RNA, 64 nt, hsa
gaugaauugagcuccuggcccuucugaugcuuugaaauggaaggauuguuccuuagagcuucuc

SEQ ID NO: 68265 - RNA, 64 nt, hsa
cguaagaggcaacagagccaucuagaagaacaagaaauggaaauagugacucuuggauuacagc

SEQ ID NO: 68266 - RNA, 64 nt, hsa
ugguuuggggcuucauuuauuuaucucaugaguaaaauggaauaauaccuaacaggcaggcucu

SEQ ID NO: 68267 - RNA, 64 nt, hsa
gacuaauucucuuucuagcccauccaaauuugauaaauggaaccagagguuauauacaacuaca

SEQ ID NO: 68268 - RNA, 64 nt, hsa
uccuguuugcaggcccagaggagccaagucauuaaaauggaaguggauucuggauggccgggcu

SEQ ID NO: 68269 - RNA, 64 nt, hsa
gcugcaaacauuguacauccaaauuaaaggaaaaaaauggaaaccaucaguuguugcuguguga

SEQ ID NO: 68270 - RNA, 64 nt, hsa
ucucuuccuuuacuuagccuauaaaacuaguuaaaaauggaauuucuuuuagcaauucaguuua

SEQ ID NO: 68271 - RNA, 64 nt, hsa
uguaauucaggcuugugucuaccucuuccaugaaaaauggaaagggaugaaaauaaugggagua

SEQ ID NO: 68272 - RNA, 64 nt, hsa
ucacugacuugauugagggauaagugugauuuagaaauggaauggccuuggaugucuaucagug

SEQ ID NO: 68273 - RNA, 64 nt, hsa
ugucuuuuuuuaaaaaguuaaggcacucugaaacaaauggaaaguccuaugaaacuguauugua

SEQ ID NO: 68274 - RNA, 64 nt, hsa
uggggaaaacauuuuuuaucauuuucuauuaagaaaauggaaaacuuaaauaugguguuaaaaa

SEQ ID NO: 68275 - RNA, 64 nt, hsa
auuaagaaaauggaaaacuuaaauaugguguuaaaaauggaaauauaugugauauuugcauuau

SEQ ID NO: 68276 - RNA, 64 nt, hsa
auggaacuaaagauagaaggaggacuguaggaagaaauggaauaauuuaaaugugaggaaagau

SEQ ID NO: 68277 - RNA, 64 nt, hsa
agauaaauggguauguaggaugaaggguuauuuaaaauggaacuaaagauagaaggaggacugu

SEQ ID NO: 68278 - RNA, 64 nt, hsa
ccccggaccaguuacauucguuccuggcaaaagcaaauggaaauggucuccugucuccagccug

SEQ ID NO: 68279 - RNA, 64 nt, hsa
aauuugaaauaauuucaccaggcuaaauaaaggaaaauggaaaccaguuaagaggcacagugua

SEQ ID NO: 68280 - RNA, 64 nt, hsa
auggcagugguuugaaaaacuaaaacagaaaaaaaaauggaagccaacacaucacucauuuuag

SEQ ID NO: 68281 - RNA, 64 nt, hsa
guuuaaaauguuagauguuuuuaauuuuuuaaauaaauggaauacuuuuuuuuuuuuuuuaaag

SEQ ID NO: 68282 - RNA, 64 nt, hsa
uuuuauaacuuuuaaauggaaaaaccuauuagguaaauggaaauaauccuugaaaauaguuuuu

SEQ ID NO: 68283 - RNA, 64 nt, hsa
ucuguuuucucuuuuuaaauauuuuauaacuuuuaaauggaaaaaccuauuagguaaauggaaa

SEQ ID NO: 68284 - RNA, 64 nt, hsa
acagaaauaugaaugucgaggggcuuggaauucuaaauggaagauuuuagaaggaacuuugcuc

SEQ ID NO: 68285 - RNA, 64 nt, hsa
auggaaggaaccaccugaauuauaucugcaaacaaaauggaaauaguuguugaauaguucccca

SEQ ID NO: 68286 - RNA, 64 nt, hsa
uuguuuuauagcuucaaaguguggcuugacauucaaauggaaggaaccaccugaauuauaucug

SEQ ID NO: 68287 - RNA, 64 nt, hsa
auagaugcuauuguucugauggcccggcugaauaaaauggaaauucuaguuuguuagaauuaug

SEQ ID NO: 68288 - RNA, 64 nt, hsa
aagguuuuaaucauucuucuauaaaauacauuuaaaauggaaaaauacuuaauaucacuaaaua

SEQ ID NO: 68289 - RNA, 64 nt, hsa
gauuggcuagguuucucccguguguuuuauacaaaaauggaauugauaaaccauuuuuuacaaa

SEQ ID NO: 68290 - RNA, 64 nt, hsa
auaauggggauauguggaauuuuuaacaacaguuaaauggaaaagcauagacaauuacuguaga

SEQ ID NO: 68291 - RNA, 64 nt, hsa
uaaauguuguauuucauauuuauuuauauaauacaaauggaaaucaaaacugaaauagccuccc

SEQ ID NO: 68292 - RNA, 64 nt, hsa
uauugacuuuuggaaaccaaccaaauuacuuaagaaauggaaaaguagucacagagaaauuuag

SEQ ID NO: 68293 - RNA, 64 nt, hsa
cuugguguccuuuuuucucccaaacuuuauuuagaaauggaaggaguucaauuuuuucuuguuc

SEQ ID NO: 68294 - RNA, 64 nt, hsa
gacuguacuuaaugccacugaacuguacacuuuaaaauggaaaauuuauauguauuuuuaccac

SEQ ID NO: 68295 - RNA, 64 nt, hsa
cacuuaacaggaaguuuaguuuguuaugcacuuuaaauggaauaauuagcuuguuacaauucua

SEQ ID NO: 68296 - RNA, 64 nt, hsa
uauauuuaaaucauuuuaacuucuauagguuuuuaaauggaauuuucuaauauaaugacuuaua

SEQ ID NO: 68297 - RNA, 64 nt, hsa
auggugggcaauauugcaauauuugaaaugguaaaaauggaaagaagaacaaaauaugaugaga

SEQ ID NO: 68298 - RNA, 64 nt, hsa
ccugauucaaauuaccuagacccccuagagaaauaaauggaauauacauaaauaaucauuuuca

SEQ ID NO: 68299 - RNA, 64 nt, hsa
gaauuuauuggaguaacucaaauugccugaggaaaaauggaaaaauuauccaccagucgauuca

SEQ ID NO: 68300 - RNA, 64 nt, hsa
agucagccagaaaucacagauacugcuuucacuuaaauggaaacaauucuccgauaaugcuuug

SEQ ID NO: 68301 - RNA, 64 nt, hsa
agcagccauugggaaauugggagaaaugauaaacaaauggaaaaagaagaugucccuaaccuac

SEQ ID NO: 68302 - RNA, 64 nt, hsa
gggagcuacugauggacaugugaaaaguaaguauaaauggaauaaaauuaauuaggcuaauagg

SEQ ID NO: 68303 - RNA, 64 nt, hsa
uuuggcaaaagcuggugccugguaaguagaaacgaaauggaaacagaaauaacauuugugaaau

SEQ ID NO: 68304 - RNA, 64 nt, hsa
uguauuuugaucugcauugacaccagcucuuaauaaauggaaacuuauuuauuuucacaguuga

SEQ ID NO: 68305 - RNA, 64 nt, hsa
uggaaaagaauuuuacaugcacuuuaaaauaguaaaauggaaagugaauuuuuaaaauauaugc

SEQ ID NO: 68306 - RNA, 64 nt, hsa
guauuucccuucuucaaauuaauuaccuaccaaaaaauggaaaagaauuuuacaugcacuuuaa

SEQ ID NO: 68307 - RNA, 64 nt, hsa
uuguacugaaggcucagcagcaauagagcuaaugaaauggaagcugggcagugcugagucccug

SEQ ID NO: 68308 - RNA, 64 nt, hsa
uuuucuugacaggcacaccuuucugaaauccaagaaauggaauccaaaauaaauuuuccaauug

SEQ ID NO: 68309 - RNA, 64 nt, hsa
uauuuauuauguauaaaauguugaauaauaaaaaaaauggaauuauguuuucuaaguuuuaaua

SEQ ID NO: 68310 - RNA, 64 nt, hsa
uagacuaauagaaaggaggcuguggcuaaagcagaaauggaacuuccggaucugaaauuagcca

SEQ ID NO: 68311 - RNA, 64 nt, hsa
gcaguuuuuggaauuacuugauaagaacuuuugaaaauggaaggauuaguauggccuauuuuua

SEQ ID NO: 68312 - RNA, 64 nt, hsa
acauaaaauguuuuauuuuguuauuugguuaugaaaauggaauccuuguucuugcacaacugua

SEQ ID NO: 68313 - RNA, 64 nt, hsa
uuaugguggaccuauuacccuauggguaagaaauaaauggaaauaugacaucggauguuucagc

SEQ ID NO: 68314 - RNA, 64 nt, hsa
acaccacucagugugauaauugugucuacagcuaaaauggaaauaguuuuaucuguacaguugu

SEQ ID NO: 68315 - RNA, 64 nt, hsa
agaagcuaaaagccacuggcagcacaggcugacaaaauggaagcaaagcaagagguggcaacaa

SEQ ID NO: 68316 - RNA, 64 nt, hsa
ucacccaccucuccagggcccauccccccucgggaaauggaaggaaugucuaaggaggaggagg

SEQ ID NO: 68317 - RNA, 64 nt, hsa
uacaccuaccauguacccauaaaaauuuaaaaagaaauggaauggcaaauaauggaacauaaac

SEQ ID NO: 68318 - RNA, 64 nt, hsa
aaauagcuuacagacagucuaugcuuuguuuaagaaauggaauggcacuucauauauucucauu

SEQ ID NO: 68319 - RNA, 64 nt, hsa
uuuccuaaggccaaggauaauguacuaguuguuaaaauggaaauaaaagugaagugguaaauag

SEQ ID NO: 68320 - RNA, 64 nt, hsa
auggacuacuuuuguaacuuaccuguuuguuaggaaauggaauggucucuuugauuuaaaauaa

SEQ ID NO: 68321 - RNA, 64 nt, hsa
auggaacaucccaagaagaggauaaggaugcuuaaaauggaaaucauucuccaacgauauacaa

SEQ ID NO: 68322 - RNA, 64 nt, hsa
guagaauuuguguucauaaguucagauggguagcaaauggaauagaacuuacuuaaaaauuggg

SEQ ID NO: 68323 - RNA, 64 nt, hsa
uugacuucauauacaaagccuguaauuuuaggcgaaauggaagcagaaaucuaggaaguugugc

SEQ ID NO: 68324 - RNA, 64 nt, hsa
agcaccaagggcugccuaucuguagauagcuguaaaauggaauauuuuuaaaugaaggcaaaua

SEQ ID NO: 68325 - RNA, 64 nt, hsa
ggcuuuagcgguucuugccucauuuugggauucuaaauggaagcuuucaacagagcauuccauu

SEQ ID NO: 68326 - RNA, 64 nt, hsa
auaacuuuguuucucaaauuuucguugucagaacaaauggaaggagaauauuauuuagacuaau

SEQ ID NO: 68327 - RNA, 64 nt, hsa
ggaauguauccccugccuauuuuccuuguguaacaaauggaaaacauucuccccugugagaaau

SEQ ID NO: 68328 - RNA, 64 nt, hsa
cugcaugggaaagcaaagcagaaaacagugccccaaauggaaaaaagauacucacacagaacaa

SEQ ID NO: 68329 - RNA, 64 nt, hsa
gagauagaaaaauuuuuauuacucaaaguaaaauaaauggaaauaucacugagcaguuguuuau

SEQ ID NO: 68330 - RNA, 64 nt, hsa
caccauguucaaccaucugucaugacuguuuggcaaauggaaaccgcuggagaaacaaaauugc

SEQ ID NO: 68331 - RNA, 64 nt, hsa
uaagggacauagaggauuuaacuuuuguuaucauaaauggaacuugcaggcauauaucaagaac

SEQ ID NO: 68332 - RNA, 64 nt, hsa
gaaucauuuaguugacucuauaauucuaaggucaaaauggaacuugauaguuuuuuaaauuaaa

SEQ ID NO: 68333 - RNA, 64 nt, hsa
uaugguaaugcucuuacggauauaaaccucaguuaaauggaauuaucuaugggaugugugguuc

SEQ ID NO: 68334 - RNA, 64 nt, hsa
aguaauguguuauguaguacaguuuuaaagcuauaaauggaauuuuguguaaauucacaaaaau

SEQ ID NO: 68335 - RNA, 64 nt, hsa
gcaaguguacuuuguggaguguugaguaaguggaaaauggaaagccaguugcauuuagagauga

SEQ ID NO: 68336 - RNA, 64 nt, hsa
caaugcuucuuguguguguucuggaagaucuucuaaauggaaugcuuguugcacuguucccagg

SEQ ID NO: 68337 - RNA, 64 nt, hsa
cuuucuccuguuuguuugcuuguuaguuuguuuaaaauggaaaaagggguucucuguguucugc

SEQ ID NO: 68338 - RNA, 64 nt, hsa
uucaagggugauaggaaccauuauguugagcccaaaauggaaguaauaauaaaugccuccugga

SEQ ID NO: 68339 - RNA, 64 nt, hsa
acaaaccuccaaguagcuccaaaugcaauuuuuaaaauggaaaacaaaaaucugaaagaaacgu

SEQ ID NO: 68340 - RNA, 64 nt, hsa
ccaggucuuccaagcucugcuuccucaguuuccaaaauggaaccaccucaccuccgcagcaccc

SEQ ID NO: 68341 - RNA, 64 nt, hsa
uagcaugcaugcacaacaauacaauuuauaugguaaauggaaccaaauaauggcuucacugaau

SEQ ID NO: 68342 - RNA, 64 nt, hsa
uuuuaucuaccaucaaccugauaaggcacaugugaaauggaaauguucucuuuccucugaagca

SEQ ID NO: 68343 - RNA, 64 nt, hsa
ucaaaauaaaaggauggaggaagaucuacgaagcaaauggaaaacaaacaaaaaaagaggcagg

SEQ ID NO: 68344 - RNA, 64 nt, hsa
accacugcuuaacgaaauaaaagaggaugcaaagaaauggaagagcauuccaugcucaugggua

SEQ ID NO: 68345 - RNA, 64 nt, hsa
gcuuuggcccucaagagcccacuguaugcuggggaaauggaaccauggugcaguaguguggagu

SEQ ID NO: 68346 - RNA, 64 nt, hsa
auaaggccagaaacuucugagcagauaacuccacaaauggaaauuuaguacuuucuuccugaug

SEQ ID NO: 68347 - RNA, 64 nt, hsa
auauccuuccacccuugacugccaaaaaugugugaaauggaaaguugauggcagcagggccgac

SEQ ID NO: 68348 - RNA, 64 nt, hsa
cucuauagauuugccaguuuggggcauuucauauaaauggaaucaucuguauguaagugguuaa

SEQ ID NO: 68349 - RNA, 64 nt, hsa
auuuuauuggagaaaagcaaguuauauguucacaaaauggaaggcuuucuaccuaaauuuauuu

SEQ ID NO: 68350 - RNA, 64 nt, hsa
aaguuagauuuuccuggagcuucggaagaaaugaaaauggaaacaugaugaagauauagucacu

SEQ ID NO: 68351 - RNA, 64 nt, hsa
cugaauagccccccacugaaugcuugccuugcccaaauggaauggaggaagauugauuuucucc

SEQ ID NO: 68352 - RNA, 64 nt, hsa
gcuacugaauggcuugcaguuguuccuccacucuaaauggaaugagcuugcugugugugugugu

SEQ ID NO: 68353 - RNA, 62 nt, hsa
ugggcaggcugcagccucaugccaugucucucucccacuaccugaugggcacauggacaggc

SEQ ID NO: 68354 - RNA, 62 nt, hsa
ggccuugcaguggguguguggggaagucacugucccacuaugggucuccacuacccagucac

SEQ ID NO: 68355 - RNA, 64 nt, hsa
aguaguuggcgcccaauggggggucccugagacuugcauguaaaacuagucuagaugucuucuu

SEQ ID NO: 68356 - RNA, 64 nt, hsa
ucuucuuuuuuuguaaguuuuauuuuuguaauugugcauguaaagcaucauugaaucaauggau

SEQ ID NO: 68357 - RNA, 64 nt, hsa
uuaacuucuguuguguuuugaaucucuccagaguugcauguagauagcauuuauuucugugccc

SEQ ID NO: 68358 - RNA, 64 nt, hsa
uucuugaacaggcaaaugaaagcuuauuauagaaugcauguauuuucuuuuaucuuuggaacau

SEQ ID NO: 68359 - RNA, 64 nt, hsa
aguagaaucaaaggugcagcugacugagacgacaugcauguaagauccacaaaaugagacaaug

SEQ ID NO: 68360 - RNA, 64 nt, hsa
acgacaugcauguaagauccacaaaaugagacaaugcauguaaauccaugcucauguucuaaac

SEQ ID NO: 68361 - RNA, 64 nt, hsa
uugggaauaauauuauaaacccuuacaaauuuuaugcauguaucuacugcauccuucaacucuc

SEQ ID NO: 68362 - RNA, 64 nt, hsa
uauuuuuacaguaaccuugaauucuucugaguuuugcauguauuaaauucaauuaaugcugaac

SEQ ID NO: 68363 - RNA, 64 nt, hsa
ccggugcuugguguccuugcaugacauggaguuuugcauguagaucaauuuaaaauguaccucu

SEQ ID NO: 68364 - RNA, 64 nt, hsa
ugcagcuaaucuaaaaaacuggugauauuuaauaugcauguauguaucuaaacacccacauaua

SEQ ID NO: 68365 - RNA, 64 nt, hsa
uaaaacacuggcaaugacccacuccccuuggaaaugcauguaugaacuacccuaugaaauguaa

SEQ ID NO: 68366 - RNA, 64 nt, hsa
gaucccccauccccuccagaauaagagcauguucugcauguauuaaucuuuuaugcuguuuaug

SEQ ID NO: 68367 - RNA, 64 nt, hsa
cauaucuacccagaauuaacuccauuccagucucugcauguaaucaguuuuauccacagaaaca

SEQ ID NO: 68368 - RNA, 64 nt, hsa
auauuauuguauuuaaaauguguuucuuacagacugcauguaguuggguauaauuuuuauccag

SEQ ID NO: 68369 - RNA, 64 nt, hsa
guuagccauaguggguucccuuggucagcaacagugcauguaccucuggaugucaucugaggug

SEQ ID NO: 68370 - RNA, 64 nt, hsa
caggggggcaguuguggucgccccuccccaguugugcauguacccggcuacuuagguaugcuua

SEQ ID NO: 68371 - RNA, 64 nt, hsa
uuugguuuuaaaaauauuaagcuuuuugcucauuugcauguauacuuuucucucaacauuguuu

SEQ ID NO: 68372 - RNA, 64 nt, hsa
uuguuucuauaaaucaaauacacaugugauaauaugcauguaaauacauaacuauccucaucau

SEQ ID NO: 68373 - RNA, 64 nt, hsa
gggaaaaaaaucaaaugucaguccuagcagauguugcauguaaauugguagcaaguaaugauua

SEQ ID NO: 68374 - RNA, 64 nt, hsa
uuuuggaugaccucagcuugaguuucuccauaugugcauguacaucuagcauucugccuacagu

SEQ ID NO: 68375 - RNA, 58 nt, hsa
aggaguuacccaguccuugagaaggaggugcauguacguaccuaugugcauacacuua

SEQ ID NO: 68376 - RNA, 64 nt, hsa
uuacuuuuugucauuauaaccauaacuaaauaucugcauguaccaagagucccuaagccacccc

SEQ ID NO: 68377 - RNA, 64 nt, hsa
aaacccuugguguucauucuaaauauagaaguguugcauguauaggauuucauaaaggcuaauu

SEQ ID NO: 68378 - RNA, 64 nt, hsa
agaaaauucauaacauauauaggccaaggaaaucugcauguauuuuuggaaauauucuuggcuc

SEQ ID NO: 68379 - RNA, 64 nt, hsa
auuaagagaagccauuaaaauuuuacuaaaauugugcauguaaauuaauugucagcauuccaug

SEQ ID NO: 68380 - RNA, 64 nt, hsa
cuuucagaagauuuuucuaacuuagggucugucuugcauguauuacaaccagaauacaguguuu

SEQ ID NO: 68381 - RNA, 64 nt, hsa
uauauuuaagucuuuauagauauaaagcuuuacuuagauauaacuugagugaguagggaaaaaa

SEQ ID NO: 68382 - RNA, 64 nt, hsa
aauucauaaauacaaaaauauauuuaagucuuuauagauauaaagcuuuacuuagauauaacuu

SEQ ID NO: 68383 - RNA, 64 nt, hsa
aucaacugucaaaaacuucaacccuuuuaaaaccuagauauaaaugcuuacauguaaagaaagg

SEQ ID NO: 68384 - RNA, 64 nt, hsa
uuuauuuccauuuauaauuucuauucaauauugcuagauauauuaacaugaaggaauggggaag

SEQ ID NO: 68385 - RNA, 64 nt, hsa
gaugagagacugggaagggaaaagcauauauauauagauauauagagauauagauauauauaca

SEQ ID NO: 68386 - RNA, 64 nt, hsa
gggaaaagcauauauauauagauauauagagauauagauauauauacaggaaacaccgcauccu

SEQ ID NO: 68387 - RNA, 64 nt, hsa
gauaucuauggauauagaucuacaucuauagauauagauauacacacauauauauacucacaca

SEQ ID NO: 68388 - RNA, 64 nt, hsa
uagauagauaucuauggauauagaucuacaucuauagauauagauauacacacauauauauacu

SEQ ID NO: 68389 - RNA, 64 nt, hsa
aaaugcaaaugugcauuuuucugacgaguguccauagauauaaagccauuuggucuuaauucug

SEQ ID NO: 68390 - RNA, 64 nt, hsa
acuacaguaaagucuguuucugcuuccuuacacauagauauaauuauguuauuuagucauuaug

SEQ ID NO: 68391 - RNA, 64 nt, hsa
uuguucuaaaugcucuaaacauucucaaaacaucacaucacauuagcagaacuauaaaaaaaaa

SEQ ID NO: 68392 - RNA, 64 nt, hsa
gugguuuguucuaaaugcucuaaacauucucaaaacaucacaucacauuagcagaacuauaaaa

SEQ ID NO: 68393 - RNA, 64 nt, hsa
caauaguguggaaagccacaucacaaaaaaagccacaucacaaaaaaaagccagugccuauuga

SEQ ID NO: 68394 - RNA, 64 nt, hsa
gggauucuggacuucuacaauaguguggaaagccacaucacaaaaaaagccacaucacaaaaaa

SEQ ID NO: 68395 - RNA, 64 nt, hsa
gcagcuggccgcccaguuugagaauugguguaagacaucacaaucccauuauucagagcgcgua

SEQ ID NO: 68396 - RNA, 63 nt, hsa
cagcuggccgcccaguuugagaauugguguaagacaucacaaucccauuauucagagcgcgua

SEQ ID NO: 68397 - RNA, 64 nt, hsa
uuaaauacauuuuuaaaauuucagauguaauuuaacaucacauuuguuuuucagguauugaguu

SEQ ID NO: 68398 - RNA, 64 nt, hsa
aguauuauuguuauauauauaguuaauauguuguacaucacaauaauauauaauucagucucua

SEQ ID NO: 68399 - RNA, 64 nt, hsa
cuuuccuugauuguuaugaaaaagugucauugugacaucacagguauuaauuuacaaauuagag

SEQ ID NO: 68400 - RNA, 64 nt, hsa
auuauaguaacguauuguccuuccguuaacagaaacaucacaauucaaaagugaguuuucuuau

SEQ ID NO: 68401 - RNA, 64 nt, hsa
cauaugcaauguuuuuauuacauacuucuacuggacaucacagaauucuuuggguucuuuguaa

SEQ ID NO: 68402 - RNA, 64 nt, hsa
guuugcauuuuacuucaguaaacaauugcuaaagacaucacacuagaaacauaugcaauguuuu

SEQ ID NO: 68403 - RNA, 64 nt, hsa
cagaacucagaacccaagucugaucaggagaaaaacaucacacaaauuccaauugagaagcauu

SEQ ID NO: 68404 - RNA, 64 nt, hsa
ugaacaaugagaacacauggagacaggaaggggaacaucacacucuagggacuguuguggggug

SEQ ID NO: 68405 - RNA, 64 nt, hsa
uacaaaugugaagaauguggcaaagcuuuuaaccaguccucacaccuuaugagacauaagaaaa

SEQ ID NO: 68406 - RNA, 64 nt, hsa
uacaaaugugaacaguguggcaaggucuuuaagaaguccucaacucuuacugcacauaagauca

SEQ ID NO: 68407 - RNA, 64 nt, hsa
cagcaugccaguguggagagcgccucuucccaccaguccucagccaccuucuccacggcagcga

SEQ ID NO: 68408 - RNA, 64 nt, hsa
cuugggaccucaagcccccaacaucccaguccucaguccucagucaucuugguagguauacauu

SEQ ID NO: 68409 - RNA, 64 nt, hsa
acuacuucuugggaccucaagcccccaacaucccaguccucaguccucagucaucuugguaggu

SEQ ID NO: 68410 - RNA, 64 nt, hsa
guagaaaacacuuccuccucuccugagucugugaaguccucagugguccuuuuuggauucuagg

SEQ ID NO: 68411 - RNA, 64 nt, hsa
agucucgccagcgcccacccccauggcucgggucaguccucaucgcucccccuccccaccccgc

SEQ ID NO: 68412 - RNA, 64 nt, hsa
uacaaaugugaagaauguggcaaagccuuuauccaguccucaacuccuaguaaacauaauuaau

SEQ ID NO: 68413 - RNA, 64 nt, hsa
uacaacugugaagaauguggcaaagcuuuuaaccaguccucaaacuuuauugaacaaaauaauu

SEQ ID NO: 68414 - RNA, 64 nt, hsa
uacaaaugugaagaaugugacaaagccuuuaaccaguccucaauuuuuacuaaacauaagaaaa

SEQ ID NO: 68415 - RNA, 64 nt, hsa
uaugauugugaaaaauauggcaaaggcuuuaacuaguccucaguucuuaacacacauacgauaa

SEQ ID NO: 68416 - RNA, 64 nt, hsa
auggucugggugccaccuguuuuuaaacucuuaaaccuggaacuccuuaaaugggguagguggg

SEQ ID NO: 68417 - RNA, 64 nt, hsa
aaacccucaggucugagauaggaguucucuaggaaccuggaaugaguuccugucuccugaauga

SEQ ID NO: 68418 - RNA, 64 nt, hsa
gaaauggccucaggcaauuucacauucccuaauuaccuggaaaguucuacaguaauuaauaugc

SEQ ID NO: 68419 - RNA, 64 nt, hsa
gcuuacagaaaugacugccggucauuugaaugagaccuggaacaaaucguuucucagaaguacu

SEQ ID NO: 68420 - RNA, 64 nt, hsa
ggcuauuacaaagcaguacugcaguaugucuuggaccuggaaaguuggacauguguguggcuca

SEQ ID NO: 68421 - RNA, 64 nt, hsa
ugggcugaccuacuaaaaccugcuccauguauggaccuggaaggccauugcugccauggcacuu

SEQ ID NO: 68422 - RNA, 64 nt, hsa
uuugugcuuuacaaaacugugaaggauuguggucaccuggaacaggucuccaaucuauguuagc

SEQ ID NO: 68423 - RNA, 64 nt, hsa
gggaaaaacaauuuuauuaccugcuuaaugguccaccuggaacuaaaagggauacuauuuucua

SEQ ID NO: 68424 - RNA, 64 nt, hsa
cugacacagccccagaccccacaaagccuucuggaccuggaaagccuggggaaggacugacaga

SEQ ID NO: 68425 - RNA, 64 nt, hsa
cgacucccacuuccagaagcuaggagggagggauaccuggaagacuccggucaccuccuucuug

SEQ ID NO: 68426 - RNA, 64 nt, hsa
uuuuaguacuugaugacucuaauuacaugaaugcaccuggaaugacauuuguaacagaagacgg

SEQ ID NO: 68427 - RNA, 64 nt, hsa
aaguacucaggauagugccuggcauguaggaagcaccuggaaaauauucgcugugauuaccauc

SEQ ID NO: 68428 - RNA, 64 nt, hsa
aucagugagugggucccaucgacaggguuccaggaccuggaacacuuuaacagaaggaaaugcc

SEQ ID NO: 68429 - RNA, 64 nt, hsa
uacaguauaaugacuacuauggcuucaaucuuaaaccuggaaacaaauaucccuuuuuuucccc

SEQ ID NO: 68430 - RNA, 64 nt, hsa
ggaagugcaaccacccaaugucucuggaagugccaccuggaagugccaccuggaagugucucug

SEQ ID NO: 68431 - RNA, 64 nt, hsa
cccaaugucucuggaagugccaccuggaagugccaccuggaagugucucuggaagagcacccac

SEQ ID NO: 68432 - RNA, 64 nt, hsa
ugacaauuuacaggaauguagcagcgauggaauuaccuggaacaguuuuuuguuuuuguuuuug

SEQ ID NO: 68433 - RNA, 64 nt, hsa
ccucugcccucucccugcagaauguggcaggcggaccuggaauguguuggagggaagggggagu

SEQ ID NO: 68434 - RNA, 64 nt, hsa
ucccacgagcugaugcacccccaggcuucaaaccaccuggaaugcacagcucagggaagcuggu

SEQ ID NO: 68435 - RNA, 64 nt, hsa
cccugcuucagugcccaccugggcccccccagggaccuggaaacagugcuggggaguucugccu

SEQ ID NO: 68436 - RNA, 64 nt, hsa
cucacugagauccauguaaggggcuccucuucccaccuggaacuugugaguggggacccaugau

SEQ ID NO: 68437 - RNA, 64 nt, hsa
ggcccaggaccauggcuggggaggauaugucagcaccuggaaguggagugcaggcugcagcgcc

SEQ ID NO: 68438 - RNA, 64 nt, hsa
gaugauuuuggccucauuacuuuaccacccccacaccuggaaagcauauacuauauuacaaaau

SEQ ID NO: 68439 - RNA, 64 nt, hsa
acuuggugauauguccuauauuggcuaaauugaaaccuggaauuguggggcaaucuauuaauag

SEQ ID NO: 68440 - RNA, 64 nt, hsa
aacaaacaagcacucagcccagcuccucaauacuaccuggaaaaagcauuggcauuauuuucaa

SEQ ID NO: 68441 - RNA, 64 nt, hsa
accuacagacuaccaccuuucgagaucaggaccaaccuggaaaaugccagaguuggcuaugccu

SEQ ID NO: 68442 - RNA, 64 nt, hsa
ggaggcugguuaaguugcagccgcuggguccucgggggcuuacucaucucccuuuuuuaaacaa

SEQ ID NO: 68443 - RNA, 64 nt, hsa
gucauugcugcaaaccucggcaggugccgugugaggggcuuaaugaccaccacagggagcucag

SEQ ID NO: 68444 - RNA, 64 nt, hsa
ccuauuuuccucuacauuuuuguaauuaacucugggggcuuacuuguuuuggcaguacugaaau

SEQ ID NO: 68445 - RNA, 64 nt, hsa
caaagccacaccacagucgguggugaugcaacugggggcuuacucugaggaaaccuaggaaauc

SEQ ID NO: 68446 - RNA, 64 nt, hsa
uaggaaugacauaccugggcucaggggaagcaagggggcuuagaauuugugggguauucccaaa

SEQ ID NO: 68447 - RNA, 64 nt, hsa
uaaaacugcucugcacuguuuaauccauuuccaaggggcuuagaaaagcuaacaaggguguguc

SEQ ID NO: 68448 - RNA, 64 nt, hsa
aacuccaaaccuccuguuagcuguuauuucuauuuuuguagaaguaggaagugaaaauagguau

SEQ ID NO: 68449 - RNA, 64 nt, hsa
auacaguggauuaauuaaaugcagcgaaccaauauuuguagaaggguuauauuuuacuacugug

SEQ ID NO: 68450 - RNA, 64 nt, hsa
uggccuuuucaaggccuagucccagggaaaacauuuuguagaguauaggggagugggaggaagg

SEQ ID NO: 68451 - RNA, 64 nt, hsa
gauaggaaguuucucgaguuagccuucaugcaauuuuguagauuaaaacauaaaauuuguccag

SEQ ID NO: 68452 - RNA, 64 nt, hsa
acuucagggcuuggaggugguguuugcacugcuuuuuguagagagggucaccuacuagaagaga

SEQ ID NO: 68453 - RNA, 64 nt, hsa
cugacugacccuccugaacugcacuacaagacacuuuguagaagaggagaugagaguuucuagu

SEQ ID NO: 68454 - RNA, 64 nt, hsa
acugucacguauauaaauugcuucuucauuuuaauuuguagaaguacuuuacaguaggaaacgc

SEQ ID NO: 68455 - RNA, 64 nt, hsa
uuuuguuuuuuuuuaauugugucuuacagucaaguuuguagauuuucauaagccacaauuuuaa

SEQ ID NO: 68456 - RNA, 64 nt, hsa
cuaccuguaauaaguguggauuauauuuuuggguuuuguagaauauugcaaauuaaccacacaa

SEQ ID NO: 68457 - RNA, 64 nt, hsa
aacuauacagcgaagagacaaucucuggcaaguuuuuguagaaaaaauguuucagugccuaguc

SEQ ID NO: 68458 - RNA, 64 nt, hsa
caugagccaccgagccuggccaauuuuuguguuuuuuguagagacgagguuuugccauguugcc

SEQ ID NO: 68459 - RNA, 64 nt, hsa
uuccaauuuuucauuuuuuguuuguuauuuguuuuuuguagacagcacucugucacccaggcug

SEQ ID NO: 68460 - RNA, 64 nt, hsa
accuuucauuuucucuuuauguuauucuuucacuuuuguagauuacauuuaauagcuuguuacc

SEQ ID NO: 68461 - RNA, 64 nt, hsa
acaaugccaguuugcaauaguugauuuugaugccuuuguagaauauuuuuucugaauccuuaug

SEQ ID NO: 68462 - RNA, 64 nt, hsa
ugcacaccaccacaccuggcuaauuuuuguguuuuuuguagagauggagauucacucgacuaau

SEQ ID NO: 68463 - RNA, 64 nt, hsa
ggaaauaaaggaaaaucaaguauaaucccugagauuuguagacuaaaggcaaugaugugggacu

SEQ ID NO: 68464 - RNA, 64 nt, hsa
ccccugaagacgaggugaaaagucaauuuuacaauuuguagaacucuaaugaagaaaaacgagc

SEQ ID NO: 68465 - RNA, 54 nt, hsa; identical to SEQ ID NO: 67612

SEQ ID NO: 68466 - RNA, 64 nt, hsa
aaggaagaagaguaaaauuggcauauuuagguuuuuuguagaagaaagauacaagugaaaauua

SEQ ID NO: 68467 - RNA, 64 nt, hsa
acaccugucuaaaaaguauguauuuuuaaauuuuuuuguagagacaggaucucacuauguucuc

SEQ ID NO: 68468 - RNA, 64 nt, hsa
ucuugugacuuaguagacugaugaugauauccauuuuguagacucaucaacaugugguuggccu

SEQ ID NO: 68469 - RNA, 64 nt, hsa
aaucagacucuugccuuugcacuuuuuuuuaacuuuuguagauaauuuuuguuaauuuguuuug

SEQ ID NO: 68470 - RNA, 64 nt, hsa
aaaaucaacaacgcuugaaguuaaaaagugugucuuuguagauuucauuguauaauguguauuu

SEQ ID NO: 68471 - RNA, 64 nt, hsa
cacgugcuuuuguaugcccauguauucauguuuguuuguagauguuugucugaugcauuucauu

SEQ ID NO: 68472 - RNA, 64 nt, hsa
aaauacugucugguuuuuguaaauguuaucuauuuuuguagauauuuuauauaaaaaugaaaua

SEQ ID NO: 68473 - RNA, 64 nt, hsa
auuagucccuguuauaaccaguuauuuaucuuuuuuuguagauucucggucuugaagucauuug

SEQ ID NO: 68474 - RNA, 64 nt, hsa
ggcacaagcuggcugccaugcugaguaaguccucuuuguagaugauguauuuugcuugggcacc

SEQ ID NO: 68475 - RNA, 64 nt, hsa
uaagucuauguuuaaauuuugaagauggugaacuuuuguagaaugagauagucgaagcuaaaac

SEQ ID NO: 68476 - RNA, 64 nt, hsa
acacuuggguaauuaaaaaauaaauaaauacuuuuuuguagagacagggucucacuguguugcc

SEQ ID NO: 68477 - RNA, 64 nt, hsa
gcugucuaauagaacuuucugugacgauggauauuuuguagacuuuugcuguccagugugguag

SEQ ID NO: 68478 - RNA, 64 nt, hsa
cuacagguguucgccaccaugcccagcuaauuuuuuuguagagauggaguuuugccaugugguc

SEQ ID NO: 68479 - RNA, 64 nt, hsa
uguuauacugcccauccccuaaagccaacagagauuuguagauuuaaagggaucacauuugaag

SEQ ID NO: 68480 - RNA, 64 nt, hsa
auacuucacucuucuuuuuuuuuccccacaagcuuuuguagaugcauuguaguagucuagcuua

SEQ ID NO: 68481 - RNA, 64 nt, hsa
acuuucucauuaagauauauauauagaaccacuuuuuguagauuaguauaagaaaaauauuuac

SEQ ID NO: 68482 - RNA, 64 nt, hsa
auguauuuguuuuuuugugcugugagaauugauguuuguagauuaauaaucauuuuguuuagaa

SEQ ID NO: 68483 - RNA, 64 nt, hsa
cagcauuaaacauauaugugaagaguccccgauguuuguagaccuuaugugaguaugcaaauau

SEQ ID NO: 68484 - RNA, 64 nt, hsa
aaggagaucagagaaagccaaagaaugucagaaauuuguagaaaaugacuucuuguuugaauau

SEQ ID NO: 68485 - RNA, 64 nt, hsa
cugggaaaugggcuaggccugaggcagucaccuauuuguagaacucaauugauccccaaccugc

SEQ ID NO: 68486 - RNA, 64 nt, hsa
uucuucuucucucucuuuuuucugaucggucguguuuguagaaaauucauaacauauauaggcc

SEQ ID NO: 68487 - RNA, 64 nt, hsa
cccuucacaccuggcugauuuuucaaaaaguuuuuuuguagaaacagggucucaccauguuguc

SEQ ID NO: 68488 - RNA, 64 nt, hsa
ugaauacauucagaaucaccuccucuccccaaaauuuguagaaauaguuuuugaggaagccaaa

SEQ ID NO: 68489 - RNA, 64 nt, hsa
cgcugcagcaaaaacuguuacuguguuuauuauauuuguagaaguauuagaaaaauauucuauu

SEQ ID NO: 68490 - RNA, 64 nt, hsa
aucuuggacuucaggaaaugcaauuaugauaacguuuguagacagucacgucauguuagguguu

SEQ ID NO: 68491 - RNA, 64 nt, hsa
ucaguauaguacugucaagggaagccauacacuuuuuguagacauggguaccaaaaauacccaa

SEQ ID NO: 68492 - RNA, 64 nt, hsa
agaccaagaauucaagaugguugguggccagauuuuuguagacagagauggugauuuguuuagu

SEQ ID NO: 68493 - RNA, 64 nt, hsa
gacuauggacauucaaaucaugggagaaaauaauuuuguagauuauguuccauugcuaaugaau

SEQ ID NO: 68494 - RNA, 64 nt, hsa
aaguauauuuuuaaaguuguuuuauaagagagacuuuguagaagugccuagauuuugccagacu

SEQ ID NO: 68495 - RNA, 64 nt, hsa
cuaaaagguaaauuaugggaaucacugaaauauuuuuguagauuaauuguuguaacauugucuu

SEQ ID NO: 68496 - RNA, 64 nt, hsa
ggaaggagggaauuuaaaaaugggacuugagugguuuguagaauuuguguucauaaguucagau

SEQ ID NO: 68497 - RNA, 64 nt, hsa
agagaccucuguaguccugggaggccucauaauguuuguagaucagaaaagggagaucugcauc

SEQ ID NO: 68498 - RNA, 64 nt, hsa
gacucucuuaauaaaacugcauuaaguuuuugauuuuguagaaauuagcuuuugucuaggcaac

SEQ ID NO: 68499 - RNA, 64 nt, hsa
uaacagauuccuuuauauguaguggaaaucacuauuuguagaaacugucaggucaaaauauuua

SEQ ID NO: 68500 - RNA, 64 nt, hsa
gugauaacuuuaaauaaaacucaaauuuuuacuguuuguagacaggaaugcuguccuagagaac

SEQ ID NO: 68501 - RNA, 64 nt, hsa
uggguccuagaaccuguugaguuucuaaugaauauuuguagaaucucauaaaacaguuuaaaua

SEQ ID NO: 68502 - RNA, 64 nt, hsa
aagugugguuguacuuacguuaauaguaaguguauuuguagaaaguuuuucauaaagaagagau

SEQ ID NO: 68503 - RNA, 64 nt, hsa
uuauuagaaagcuaaauggauaaauacuucccuuuuuguagauauuuuucugugcauuguaagu

SEQ ID NO: 68504 - RNA, 64 nt, hsa
aaguaugcauucuuaucaccuaguauauaguuaguuuguagagugauuuccccccaguuucuug

SEQ ID NO: 68505 - RNA, 64 nt, hsa
cuucaauuauaguuagucuuggugaaguaagauguuuguagacuuuagaguucuuuaauucuug

SEQ ID NO: 68506 - RNA, 64 nt, hsa
aucguuauuauauucaucaucaucaguauuauuauuuguagaaaggcuuuuuaacuucugcaga

SEQ ID NO: 68507 - RNA, 64 nt, hsa
aacaccuuucuaaccuucuuaacgucagagaauuuuuguagaaauguaguccugugauugucau

SEQ ID NO: 68508 - RNA, 64 nt, hsa
ggccaacucacauuuuucuuucuauuauuuauuuuuuguagagaugagucucacuauguugccc

SEQ ID NO: 68509 - RNA, 64 nt, hsa
ggcaugcaucgccacgucuggcuaauuauuauuuuuuguagacagggucucacuguguugccca

SEQ ID NO: 68510 - RNA, 64 nt, hsa
ugugcugaguucuauaauauaagcugccauauauuuuguagacaaguauggcuccuccauaucu

SEQ ID NO: 68511 - RNA, 64 nt, hsa
uuuuaacaccuuuuacucuucuuacuggugcuauuuuguagaauaaggaacaacguugacaagu

SEQ ID NO: 68512 - RNA, 64 nt, hsa
uaaggaaaugguggcaugaagacccucucccuucuuuguagaauuaagauaacuuugauuuuau

SEQ ID NO: 68513 - RNA, 64 nt, hsa
ggugugacuggaaagcaugauauucuaggguugguuuguagauucaaauaauccagaaauauac

SEQ ID NO: 68514 - RNA, 64 nt, hsa
ccugagaugcuggcuguacucagccuuugcaauuuuuguagauguagcuuaggacgugaguuau

SEQ ID NO: 68515 - RNA, 64 nt, hsa
gguggcuuuucaguuacagaguccaguggaccauuuuguagaaccaugcagcucccugcggaag

SEQ ID NO: 68516 - RNA, 64 nt, hsa
augccaccacacccagcugauuaucauauuuuuuuuuguagagguggggaagugcagugaugca

SEQ ID NO: 68517 - RNA, 64 nt, hsa
augccaccacacccagcugauuaucauauuuuuuuuuguagaggugggguuuuaccauucccag

SEQ ID NO: 68518 - RNA, 64 nt, hsa
cgauuacaggaaugcaccaccacgcccagcuaauuuuguagagaugggguuucuccauguuggu

SEQ ID NO: 68519 - RNA, 64 nt, hsa
uuaauuuaaaaguauuucucuuagcaguuuuuguuuuguagacaguucccauaaaaauauuuua

SEQ ID NO: 68520 - RNA, 64 nt, hsa
uccaccuggacugaugggcacaggaggcaccaauagcgauuauugggggcaaugcgaggucucc

SEQ ID NO: 68521 - RNA, 64 nt, hsa
accauugugauuuguuccugccccaccuuaacugagcgauuaaccugugaacuuccuucuccug

SEQ ID NO: 68522 - RNA, 64 nt, hsa
uuuuaaaugggcuuugagaaaaaaaacagaaacaagcgauuauuucaaaucaaccaaccaacuc

SEQ ID NO: 68523 - RNA, 64 nt, hsa
cauuauaucaauaauugcauaauaggcaaccucuagcgauuaccauaauuuugcucauugaagg

SEQ ID NO: 68524 - RNA, 64 nt, hsa
ugaguggugaaauaauguuuggagacauaaugaaagcgauuaacauuuggcaaaauauaauaaa

SEQ ID NO: 68525 - RNA, 64 nt, hsa
uauuggcgugacuguaaacacaucguugaaguaaagcgauuacauauugaguaugucagcuuuu

SEQ ID NO: 68526 - RNA, 64 nt, hsa
gugauauguugguagauucuaauggcuuuauugcagcgauuaauaacaggcaaaaggaagcagg

SEQ ID NO: 68527 - RNA, 64 nt, hsa
ggaauuuucauuguucuauaacaacaacaacaaaagcgauuauuauuuuagagcaucucauuua

SEQ ID NO: 68528 - RNA, 64 nt, hsa
acuguugguugaacuaugcugaagagggaaagugagcgauuaguugagcccuugccgggccuuu

SEQ ID NO: 68529 - RNA, 64 nt, hsa
agaccuuguuuugaggauuuuacaagaccuuuguagcgauuagauuuuuuuucuacauugaaaa

SEQ ID NO: 68530 - RNA, 64 nt, hsa
agguuaggcuuuaaaauaaagcauguuauacagaagcgauuaggauuuuucgcuugcgagcaag

SEQ ID NO: 68531 - RNA, 64 nt, hsa
acuauuaaaaaaguaauaguauuacagaaaaaugagcgauuaaauaguaauggauacaauuaag

SEQ ID NO: 68532 - RNA, 64 nt, hsa
uuuaucaaggaagucuucaaauuugauucuaaauagcgauuauaaucuccaacuuuauuuugaa

SEQ ID NO: 68533 - RNA, 64 nt, hsa
ugguauaccagcucggcagaacaguuccccacccagcgauuagggagcugggcuggccaguaca

SEQ ID NO: 68534 - RNA, 64 nt, hsa
augggugaagcagaugcauggugagggucagcucagcgauuagaaauuuaaaaaugggagauca

SEQ ID NO: 68535 - RNA, 52 nt, hsa
gcaaaaguucagacucauaaaaagcgauuaagaggccuaugccuguaauuuc

SEQ ID NO: 68536 - RNA, 64 nt, hsa
ugaauuuguucuuacauuauggcucccgaggggaagcgauuacuuuuuuuaauuuuaaauuuuu

SEQ ID NO: 68537 - RNA, 64 nt, hsa
ucgaccuuuagauuuuugaaagcgcaaugucagaagcgauuaugaaagcaacaaagaaauccgg

SEQ ID NO: 68538 - RNA, 64 nt, hsa
ccacuuugauuuaguuuuaaauauguuuaaaaauagcgauuaaaauuauguaagcaaggagccu

SEQ ID NO: 68539 - RNA, 64 nt, hsa
gguugcaacaauaauucaucaaguaaucauggccagcgauuauugaucaaaaucaaaagguaau

SEQ ID NO: 68540 - RNA, 64 nt, hsa
agcuggggaacaugucggugcacagcugaaagucagcgauuaugccggcgguuagaaaugugcc

SEQ ID NO: 68541 - RNA, 64 nt, hsa
ucaaauauucucuuaucccgguccaaaaggauuaagcgauuaaagaacguaaaauggagaugua

SEQ ID NO: 68542 - RNA, 64 nt, hsa
uguaaccucagcucugggagaggauuuuuuucugagcgauuauuaucuaaaguguguuguugcu

SEQ ID NO: 68543 - RNA, 64 nt, hsa
auuuacuguguaauacacgaguuuaaaaauuaagagcgauuagcuguucacuuugguaacaggu

SEQ ID NO: 68544 - RNA, 64 nt, hsa
auuuuauuuuuuacauaaggucacuuaaaugaaaagcgauuaaaagacaucuuuccugcauugc

SEQ ID NO: 68545 - RNA, 64 nt, hsa
aaauccaaaacgauaguguagcuauugaaacucaagcgauuacagacaauugcucugaagaaag

SEQ ID NO: 68546 - RNA, 64 nt, hsa
ggaacuugggaaaggaaucagagagcugcccuucagcgauuauuuaaauuauuguuaaagaaua

SEQ ID NO: 68547 - RNA, 64 nt, hsa
ucucagcucacugcaaccucugccuccugguucaagcgauuauugugccucagccuccagagua

SEQ ID NO: 68548 - RNA, 64 nt, hsa
ugauuugcugguaggauuuuguacaguuuagagaagcgauuauuuauugugaaacuguucucca

SEQ ID NO: 68549 - RNA, 64 nt, hsa
agaggcaggacggcagagccaugauuucccaccgagcgauuacgagaaccucuucccccaauag

SEQ ID NO: 68550 - RNA, 64 nt, hsa
cucgccucccugguucaagcaauucuccugccucagcgauuacaggaaugcaccaccacgccca

SEQ ID NO: 68551 - RNA, 64 nt, hsa
cacacuaauuuucuuauagaguaaaugaguaagaauucaucauuuuuuccaucucccuucuccc

SEQ ID NO: 68552 - RNA, 64 nt, hsa
uaugugugagggcuuuauucucaggcaguaguuuauucaucauuugguaagccccuccccacac

SEQ ID NO: 68553 - RNA, 64 nt, hsa
aauaacuuuuuuucaauugccagcuacugcuuuuauucaucaaaauaaaauaacuuguucugaa

SEQ ID NO: 68554 - RNA, 64 nt, hsa
aaacaagaauugaguugaugguccuaugugucacauucaucacagguuucauaccaacacaggc

SEQ ID NO: 68555 - RNA, 64 nt, hsa
cugcaugauaacuuugcagcugagauaguuccuaauucaucaacguaacaaacaaagcuauugg

SEQ ID NO: 68556 - RNA, 64 nt, hsa
auaagaaaaucuuuuucucccaauuaauuuaccaauucaucauuuuuuuuuuuuuguagaacuc

SEQ ID NO: 68557 - RNA, 64 nt, hsa
uacuuuuuaacuggcuucauuuuaggaauaauaaauucaucagaauccuuggcugaauuaaaau

SEQ ID NO: 68558 - RNA, 64 nt, hsa
augacauuuuuuucugauuuguccugcagugcucauucaucacuccaaaaacagcaggccaucu

SEQ ID NO: 68559 - RNA, 64 nt, hsa
gugcuagaagguucgaugccucuggaaugcaugugauacucaucuccauuuuguuuccuugauu

SEQ ID NO: 68560 - RNA, 64 nt, hsa
ccacccccggcccuuuguuugacuugcgucgucugauacucaguauuguagcuuuuuguccgca

SEQ ID NO: 68561 - RNA, 64 nt, hsa
ggaacuccgguccgguucuuucucuggagcucuagauacucacuuuuugugccccccaaaugaa

SEQ ID NO: 68562 - RNA, 64 nt, hsa
gaucagauaaauauagaaaaguaaaauggaaaaugauacucaauaccuaguuaaacucauuuca

SEQ ID NO: 68563 - RNA, 64 nt, hsa
acuuuaauuuccuguguaguuuacacccagagcagauacucauaaaguauaaaguaaaaacuuu

SEQ ID NO: 68564 - RNA, 64 nt, hsa
uucugaaucucuaccagcugcucccagaaucacagauacucaggaccaucucaggcauccaggc

SEQ ID NO: 68565 - RNA, 64 nt, hsa
uacagauagucguacugaucaugagagacuggcugauacucaaaguugcaguuacuuagcugca

SEQ ID NO: 68566 - RNA, 64 nt, hsa
ugcaugagcuagaauuuguucuagucuucugugugauacucauacuugcuguccagagggagua

SEQ ID NO: 68567 - RNA, 64 nt, hsa
cuggcuuaccagucuccuggaagcagagcaugcagauacucaugcggauacccauuggaaugac

SEQ ID NO: 68568 - RNA, 64 nt, hsa
ccccugggguucucugcagauggucccaguaauagauacucagcacuagacuaacauaacaggu

SEQ ID NO: 68569 - RNA, 64 nt, hsa
gagagagaccuucuuauauuguuuuauauuguuugauacucaguaccuguuuuaagaaaaaaca

SEQ ID NO: 68570 - RNA, 57 nt, hsa
accuguggcgucgccagugauggagcagauacucaaggaggcacugggcucagccug

SEQ ID NO: 68571 - RNA, 64 nt, hsa
gcugaaguggcuuagaaggccucagccaugcuuggauacucacauuaggaggaccaugugguug

SEQ ID NO: 68572 - RNA, 64 nt, hsa
aagaacuuuugaaaaacuuuuuauacucuaaagugauacucagaacaaaagaaagucauaaaac

SEQ ID NO: 68573 - RNA, 64 nt, hsa
cagaaaaauucaaguagcuuugcaaauacuaguugauacucagugaaaucacgucacuauuuug

SEQ ID NO: 68574 - RNA, 64 nt, hsa
uagccgggcgugguggugcaugccuguaauccaagauacucaggaggcugaggcaggagaaucg

SEQ ID NO: 68575 - RNA, 64 nt, hsa
uuuuuuguuaauuuagcuaaagcaauugaauguagauacucagaagaaauaaaaaaugauguuu

SEQ ID NO: 68576 - RNA, 64 nt, hsa
uacgggugaaaugaaagcuuuuuugcauguacuugauacucagucuguaaacucagacuucgcu

SEQ ID NO: 68577 - RNA, 64 nt, hsa
uguuguaauuuuauacagauuauaugagggauaagauacucaucaaauugcaaauucuuuuuuu

SEQ ID NO: 68578 - RNA, 64 nt, hsa
auugcauuucccaagugcuauugcaauaacaguugauacucauuuuagguaccaaaccuuuuga

SEQ ID NO: 68579 - RNA, 64 nt, hsa
ugagaaugaagaguaucacagugacgaacaaaaugauacucagaagcaauuuugugaagaacag

SEQ ID NO: 68580 - RNA, 64 nt, hsa
aaacuaaacaaucuugcuccuagaguuuauguuggauacucaauucuuaaccaaaaucuugguc

SEQ ID NO: 68581 - RNA, 64 nt, hsa
accacaacauuagcacggugccuugugcagaauagauacucaauaugugaauaugugucuacua

SEQ ID NO: 68582 - RNA, 64 nt, hsa
acauugagaaacuaaacccucuucuugggguccugauacucauucccauuugucccagugcuga

SEQ ID NO: 68583 - RNA, 64 nt, hsa
aguuuuauuuucuuaugaaaucaaaaaaugcauugauacucauuaaugcaaauucauuauuuaa

SEQ ID NO: 68584 - RNA, 64 nt, hsa
cuuuuuaacucugacaccguugccauaaaucccugauacucaaagucuaacaagaaagacaugg

SEQ ID NO: 68585 - RNA, 64 nt, hsa
gccacauugagacuuucuucuagugcuuuucagugauacucacguuugcuuaaacccuuuagug

SEQ ID NO: 68586 - RNA, 64 nt, hsa
aaaacacuucuggucccuagcauuuuggauaagggauacucagcuuguaccuauauauucauau

SEQ ID NO: 68587 - RNA, 64 nt, hsa
cauguauaccagaggcuuaggaggcguuugagaggauacucaucuuuuuggaauccugaccuua

SEQ ID NO: 68588 - RNA, 64 nt, hsa
uugucuuacuuucagauuucucuacauaaaucuagauacucauuaaguagccuuaugacaaaca

SEQ ID NO: 68589 - RNA, 64 nt, hsa
gguuccaggacuccugaagaucccaaaaucugaggauacucaagucccuuauauaaaauggugu

SEQ ID NO: 68590 - RNA, 64 nt, hsa
aaguugauuaaaaaccugcaguacaacaguuuuagauacucauuagugacuucaaagggaaauc

SEQ ID NO: 68591 - RNA, 64 nt, hsa
agaaacacacuggauuggguaugucuaccuggcagauacucagaaauguaguuugcacuuaagc

SEQ ID NO: 68592 - RNA, 64 nt, hsa
aauuuggaaagcaguuuuaauguuuacaguuuaagauacucauuuucaguaacuaguguuaaag

SEQ ID NO: 68593 - RNA, 64 nt, hsa
gcuaguaacccuaccgaguuuuauauaugagugggauacucaaucuggccuuaaaaagauacac

SEQ ID NO: 68594 - RNA, 64 nt, hsa
ccaguuucuguuccuugugggaugcugcucuagggauacucagggggcuccugcucuccuuccc

SEQ ID NO: 68595 - RNA, 64 nt, hsa
uugcaccauucuuucuuggugcauucgcgguuaagauacucaagcagguuucuugcuucuggcu

SEQ ID NO: 68596 - RNA, 54 nt, hsa
ucagucaagacaaugcuuaguucagauacucaaaaaugucuucacucugucuua

SEQ ID NO: 68597 - RNA, 64 nt, hsa
uuaaaaucuaacaggucuguuuggcccauugauagauacucaaauggugucuccuucugguuau

SEQ ID NO: 68598 - RNA, 64 nt, hsa
aacuuauuaaauuaaugcauacuggaaguacuuugauacucaaguuguuucacaagauuuauaa

SEQ ID NO: 68599 - RNA, 64 nt, hsa
uugauagcugauguugaaacugcuugagcaucaggauacucaaaguggaaaggaucacagauuu

SEQ ID NO: 68600 - RNA, 64 nt, hsa
cugggcuuccuaggcagaaauucauauaaacugugauacucacauuccuugaagcuaugagcau

SEQ ID NO: 68601 - RNA, 64 nt, hsa
cugccagugcagcccacaccaaaucacaacccaagauacucagauaggaagacuccuuccucuc

SEQ ID NO: 68602 - RNA, 64 nt, hsa
cuucaguagaauacagcagggccaaaacuagagugauacucaucucaggcacaaauauauaugg

SEQ ID NO: 68603 - RNA, 64 nt, hsa
acuuuccuccacuguggaggaagaaucccuaagagauacucaaaugauuaaauuaaaauuggau

SEQ ID NO: 68604 - RNA, 64 nt, hsa
cacugaauaaaaacauaauccaugaguucaugcugauacucaaauuucuuuuuaaaaaggagaa

SEQ ID NO: 68605 - RNA, 64 nt, hsa
ucugagugcaagcugcacugugagcuggcugugggauacucacacauucccacauucuccuuuc

SEQ ID NO: 68606 - RNA, 64 nt, hsa
augcaauaaagcugcuaaagucacauuugugguugauacucaagccuuguacaagcacauauga

SEQ ID NO: 68607 - RNA, 64 nt, hsa
ugauaaauuuaaaugaccucagaucuuugcaccagauacucaucauauacaaauguuuuaguaa

SEQ ID NO: 68608 - RNA, 64 nt, hsa
auaaagcuacaagcacgcacugaagcacuuuacugauacucauucaauuauucauaugacaguu

SEQ ID NO: 68609 - RNA, 64 nt, hsa
uucauagguagaaauauuagcauuuuuauugaaagauacucacaggauuuuccagaggcuaaau

SEQ ID NO: 68610 - RNA, 64 nt, hsa
gcacagagcucaguggauuugauucuuccauucagauacucauagcgauugcacacuuuauucu

SEQ ID NO: 68611 - RNA, 64 nt, hsa
uagcugggcguggugacgggcgccuguaaucccagauacucaggaggcugagguaggagaauca

SEQ ID NO: 68612 - RNA, 64 nt, hsa
ugcaccgcggucacuauuucagaaacacgguccugauacucauccugauaaucucuuaagagcg

SEQ ID NO: 68613 - RNA, 64 nt, hsa
uacaaauguaaagaauguggaaaagcuuuucaccgauacucaauccuuaguacacauaagaaaa

SEQ ID NO: 68614 - RNA, 64 nt, hsa
agugccccuuagaaaguuaaaagaauguagaaaagauacucagucuuaauccuaugcaaaaaaa

SEQ ID NO: 68615 - RNA, 64 nt, hsa
aguauaaucaauacccuagguuaugcgucuauaugauacucaucugugaauauuauugguuuug

SEQ ID NO: 68616 - RNA, 64 nt, hsa
uuugucuuuguacuccagugccuaguauauaagagauacucaauaaauaaauauuugucaaauc

SEQ ID NO: 68617 - RNA, 64 nt, hsa
uccuucgucagcagcgccuccccagacccacgaggauacucacacugcacgccugaggcucucc

SEQ ID NO: 68618 - RNA, 50 nt, hsa
ccuauuauuucuauaauugagauacucauucuucccuucaaaacccagcc

SEQ ID NO: 68619 - RNA, 64 nt, hsa
uugaauaagagaauacuaauuguuuugguaugaugauacucagaaauggagauauuauaggaaa

SEQ ID NO: 68620 - RNA, 64 nt, hsa
ccucaaauuuuuaggggaggguggguuagggacugauacucagauuguggauaauaauugaauu

SEQ ID NO: 68621 - RNA, 64 nt, hsa
caaaaauaguuuuuuuuaaauuguuuuaaacuaagauacucaaugauauaaaaacauccugauc

SEQ ID NO: 68622 - RNA, 64 nt, hsa
uugggucauuuacauguacacuacauagcaaguugauacucauguugcauguucuuuuaaauua

SEQ ID NO: 68623 - RNA, 64 nt, hsa
gcaauggagggagacgaucuagcuauagauucuugauacucaccucacucucaacagcuuauug

SEQ ID NO: 68624 - RNA, 64 nt, hsa
uuuucuaaagcugugcugucggugauacagagaugauacucaaauuauaauaaaacucuucauu

SEQ ID NO: 68625 - RNA, 64 nt, hsa
ucagaaacguaauucuuacauugugauugcaauggauacucauggaagaaaguggguaguggcc

SEQ ID NO: 68626 - RNA, 64 nt, hsa
cuagcuacuugguuccccucagaaaaaaauucaugauacucauuucuuaugaaucuuuccaggg

SEQ ID NO: 68627 - RNA, 64 nt, hsa
ccuuguaaacaugaaggggcagauaaaggaaggagauacucauguugauaaagagagcccuggu

SEQ ID NO: 68628 - RNA, 64 nt, hsa
auaagacagggcaccuuuuaacucuaaaacuagugauacucagugacauagacuuugucuuaua

SEQ ID NO: 68629 - RNA, 64 nt, hsa
acccccauccccgcaucuaaaaccaaggauuucagauacucauugcaguuguggaguuuaaucc

SEQ ID NO: 68630 - RNA, 64 nt, hsa
cagcaguccuucagaauuaaaauacuuaggcuuggauacucauucucgaaaaaagagacaacuc

SEQ ID NO: 68631 - RNA, 64 nt, hsa
gaaaaauaaaaugaaaguacuuuuuacuuuuuaugauacucagaaauuaggaugaagaacuuuu

SEQ ID NO: 68632 - RNA, 64 nt, hsa
cagaaauacccacagcauagugaccucagacccugauacucaccacaaaacuuuuaagaugcug

SEQ ID NO: 68633 - RNA, 64 nt, hsa
cucccuaagagacugaagagaggaacaggugucagauacucauaggcacugagaucuacaaaug

SEQ ID NO: 68634 - RNA, 64 nt, hsa
ucaaccacuuaauaacugagcaaaguuauauugugauacucaaauucacagcagaguaguuuug

SEQ ID NO: 68635 - RNA, 64 nt, hsa
caguuucagagaaccaggagguuugggguuaagagauacucaaaaauuuucacaagccaaguag

SEQ ID NO: 68636 - RNA, 64 nt, hsa
ggucuuccaucuagaacuguuuacaugaagauaagauacucacuguucaugaauacacuugaug

SEQ ID NO: 68637 - RNA, 64 nt, hsa
ugaaguucugggauguuuucaguuugaucagucugauacucaguggcacuuuauuaaaacauca

SEQ ID NO: 68638 - RNA, 64 nt, hsa
ucuucauaugcuggcaggaacaacuauuaauacagauacucagaagccaauaacaugacaggag

SEQ ID NO: 68639 - RNA, 64 nt, hsa
uucuguccuaagcgucaucuugagccuugcacaugauacucagauuccucacccuugcuuagga

SEQ ID NO: 68640 - RNA, 64 nt, hsa
agacaaagcacuuuugcucuccaaagcacuuuuggauacucaggaggaaagauaagauacaugu

SEQ ID NO: 68641 - RNA, 64 nt, hsa
caauaaugauugauaccucaaauguaagaugcgugauacucaacauuucaucguccaccuuccc

SEQ ID NO: 68642 - RNA, 64 nt, hsa
gaccuuuguagguugugggaaaaagucgcagaaagauacucaaaguggagcagggaauggagac

SEQ ID NO: 68643 - RNA, 64 nt, hsa
uucuucauagguagaaacaaauacuugacucagugauacucaugaccauuagaauagucauacc

SEQ ID NO: 68644 - RNA, 64 nt, hsa
ccccaagucacuacagcaucuggagccccuaggagauacucagggaagcaaauccuuguuuggg

SEQ ID NO: 68645 - RNA, 64 nt, hsa
gauuguacuuagagaugugacuaccaaucaguuugauacucaaggaaaggggguuauucaagaa

SEQ ID NO: 68646 - RNA, 64 nt, hsa
ccccaucuuuacugaauagaaaugaauucuuggagauacucaugcucccagauuccagaggguu

SEQ ID NO: 68647 - RNA, 64 nt, hsa
auggagcauacucauauuucuacauaggugggaagauacucaucuuucuacauagacgggaaca

SEQ ID NO: 68648 - RNA, 64 nt, hsa
uugcagccgggaaagccagggugugccgggccaagauacucacaggcuggccacagcugggcaa

SEQ ID NO: 68649 - RNA, 64 nt, hsa
uaaaagcaugcagucgguuuuucagccacuuuuagauacucaugcaacauagccuacuuuuaua

SEQ ID NO: 68650 - RNA, 64 nt, hsa
gugacucacagguaccuccaacccaucauguggagauacucauccuguucccccuagagcugcu

SEQ ID NO: 68651 - RNA, 64 nt, hsa
gcauaggagcuggccaagagcuuuuaauuuuauugauacucaaaaccaaguuuguguuuuuuug

SEQ ID NO: 68652 - RNA, 64 nt, hsa
auagagaacaggauauagcaauaauagcuccuuagauacucaguggcuucugacuccaaucaag

SEQ ID NO: 68653 - RNA, 64 nt, hsa
uguaaaaccaguguuggcaauugguaucaucaaugauacucauuuuuuaauaaccaaaggcagg

SEQ ID NO: 68654 - RNA, 60 nt, hsa
auuaauuuuuuuucuagugaugaacaaaaugauacucagaagcaacuuucugaagaacag

SEQ ID NO: 68655 - RNA, 64 nt, hsa
aaggguucacaucuuaaccugugcaauucagauugauacucagaauauggguugauuugaauau

SEQ ID NO: 68656 - RNA, 64 nt, hsa
ucuuuuguuauuucugccuaauaugauuugccccgauacucaucuugcacggccagaacuguuu

SEQ ID NO: 68657 - RNA, 64 nt, hsa
gcaaagcagaaaacagugccccaaauggaaaaaagauacucacacagaacaaaacaguucuugg

SEQ ID NO: 68658 - RNA, 64 nt, hsa
ugagaaugaacaguaucacagugaugaacaaaaugauacucagaagcaacuuucugaagaacag

SEQ ID NO: 68659 - RNA, 64 nt, hsa
ggagguagaccuugaagacaaugaagagaaugccgauacucagacugcagcuggaccggcaagc

SEQ ID NO: 68660 - RNA, 64 nt, hsa
uguuucccuuuaaaccagauccuggagacagugagauacucagggcguuguuaacagggagugg

SEQ ID NO: 68661 - RNA, 64 nt, hsa
cucagguuuagauuguuuaaaauuaguugcuuuugauacucagcugucauguuuauaauucaaa

SEQ ID NO: 68662 - RNA, 64 nt, hsa
gcuccucucacaaguaguuguaaugcuguagcaugauacucaggaucaguagcuugagaugcua

SEQ ID NO: 68663 - RNA, 64 nt, hsa
augagaaaauacaaagcuuucuuuguaucuggcugauacucauuuggaugauucugugacucau

SEQ ID NO: 68664 - RNA, 64 nt, hsa
aucuaccugagccccaucuccaguauuuccuuuggauacucaggaaugggaaaaggacagcaca

SEQ ID NO: 68665 - RNA, 64 nt, hsa
aagggaugggauuucugggucccagagcgggugggauacucacgcacagcuucuucacuggugg

SEQ ID NO: 68666 - RNA, 64 nt, hsa
accaccauuccuuggccagccuuuugccucccucgauacucaacaaagagaagcaaagccuccu

SEQ ID NO: 68667 - RNA, 64 nt, hsa
acuggaucgccaucugcuacaacaacugccuggagauacucagaguguaguguugguggcgcug

SEQ ID NO: 68668 - RNA, 64 nt, hsa
cagaggccagucugggccuuggcccugggugucugauacucacagagugaaacugugacccucu

SEQ ID NO: 68669 - RNA, 64 nt, hsa
auucagaagaagucugaagaagugcaauauguuagauacucagcagaaguaucagaaguagugg

SEQ ID NO: 68670 - RNA, 64 nt, hsa
uggagucuaggaagggcgugucccaugggaaguggauacucaagucuggaucuuucuaaaaauc

SEQ ID NO: 68671 - RNA, 64 nt, hsa
ucagccaucccggcuggguuugccaucagcccaggauacucaccgugucacagcuguguccccu

SEQ ID NO: 68672 - RNA, 64 nt, hsa
uuuaaaccguuaaagggaaguucgguguuggagcgauacucaauguagucagucuacaccugga

SEQ ID NO: 68673 - RNA, 64 nt, hsa
gucugaggcacaugggagugggaccagcagaaaagauacucaggucaguuaacuaaugaggcgg

SEQ ID NO: 68674 - RNA, 64 nt, hsa
aucaaagauuucccaaugugaucucaucaucauggauacucaauuuguuuuuucuuauagagaa

SEQ ID NO: 68675 - RNA, 64 nt, hsa
gggaggugacgcuagugucacgcugacgcuggccgauacucaggguaugcuaucuggaggccug

SEQ ID NO: 68676 - RNA, 64 nt, hsa
uguccuagguaauaccacuaucaggccuguaggagauacucaguggagccucugcccuucuuuu

SEQ ID NO: 68677 - RNA, 64 nt, hsa
accccucaccucuaggauccuugaauuugucaaugauacucaucaaguaugcuuggauccuuug

SEQ ID NO: 68678 - RNA, 64 nt, hsa
cgagucuccgugcugguguuuaagucauuaaaaagauacucaaagagaauggccugccugaugc

SEQ ID NO: 68679 - RNA, 64 nt, hsa
cugggaagaggcggggagaugucucugugcccaagauacucacugccucucugggugagcacag

SEQ ID NO: 68680 - RNA, 64 nt, hsa
gugcccacccugcacuggggggagggugggcagggauacucagggacagggcaucaugggggau

SEQ ID NO: 68681 - RNA, 64 nt, hsa
cuagugguccuugcuggccugcccaggaggcauggauacucaggaaggaacacacacccauuau

SEQ ID NO: 68682 - RNA, 64 nt, hsa
agaugcugucuacaagguagauaauauacuguuugauacucaaaacauuuuucauuuuguuuaa

SEQ ID NO: 68683 - RNA, 64 nt, hsa
gcccuggaaugugcauuccugccacugguuucaggauacucaucaguccugauuagccucccgg

SEQ ID NO: 68684 - RNA, 64 nt, hsa
cucguuuugcccguuguaucauaauuuacauguagauacucauuucuuauuuuuauuuuuuucu

SEQ ID NO: 68685 - RNA, 64 nt, hsa
uggacagcaaugcucgaguuugugaauuuggagagauacucaaaagagcuaaaacugcagcauu

SEQ ID NO: 68686 - RNA, 64 nt, hsa
uuucggaguccaggacuggcaggacaggucaucagauacucagaggcuguaucucugcccugcc

SEQ ID NO: 68687 - RNA, 56 nt, hsa
cucuuuuugcuacuacauaaaagaaagauacucauuuauaguuacguucauuucag

SEQ ID NO: 68688 - RNA, 64 nt, hsa
ccuaggcguggaagagaaaaugugagguuguuuagauacucaucaggaccucacaggagcugag

SEQ ID NO: 68689 - RNA, 64 nt, hsa
gccuucacaggauggaaguagaaugauuucaguagauacucauucuuggaaaaugccauaguuu

SEQ ID NO: 68690 - RNA, 64 nt, hsa
aggaggacaaggcugacaagcaauccagggacaagauacucaccaggaccaggaaggggacucu

SEQ ID NO: 68691 - RNA, 64 nt, hsa; identical to SEQ ID NO: 68690

SEQ ID NO: 68692 - RNA, 64 nt, hsa
aggcagacaaggcugacaagcaauccagggacaagauacucaccaggaugaggaagaggacuuu

SEQ ID NO: 68693 - RNA, 64 nt, hsa
uugauuccuagccccguucuguggggcacugggugauacucaguuucuuguuccuggccgugga

SEQ ID NO: 68694 - RNA, 64 nt, hsa
ucaguagcaagugcuggaaaaggcacaugccgaagauacucaagagcucccaagauuugcuuga

SEQ ID NO: 68695 - RNA, 64 nt, hsa
agccuccaacuuaaauuacauuagucaacuuauagauacucauaugaucacuuuucuuuuuaga

SEQ ID NO: 68696 - RNA, 64 nt, hsa
acucaucauuuaccacugugcuuggcagagagcggauacucaaguaaguuuuguuaaaugaaug

SEQ ID NO: 68697 - RNA, 64 nt, hsa
cgggcaggacagggaaacaggggggaggacaauggauacucaguuuuuuguguuuuuuugugug

SEQ ID NO: 68698 - RNA, 64 nt, hsa
auuuacaauaugacuuuaacauuaagguuuaugggauacucaagauauuuacucaugcauuuac

SEQ ID NO: 68699 - RNA, 64 nt, hsa
gacuuguuucagaaagaugagagagaacucuguggauacucauggguacagagaaaugguugau

SEQ ID NO: 68700 - RNA, 64 nt, hsa
aacgaccaaaaaaaaaaaaaaaaaaaucugcucagauacucagccaguagcucagagagaugcu

SEQ ID NO: 68701 - RNA, 64 nt, hsa
cugggauuacaggugugagccacugcacccgaccgauacucacauuuuuaaacuuuuuuuuuaa

SEQ ID NO: 68702 - RNA, 64 nt, hsa
caaagaguaaagaggcugagugugacuuuauaaagauacucauaaaaaauauaaacaacaaaac

SEQ ID NO: 68703 - RNA, 64 nt, hsa
uuccugagggccaaggcauugcuguaagaaaaggucuagaaauaggugaaagugagaggugggg

SEQ ID NO: 68704 - RNA, 64 nt, hsa
uuaggaaaauacauucugccccugaaugauucugucuagaaaagcucuggaguauugaucacua

SEQ ID NO: 68705 - RNA, 64 nt, hsa
aaguuggaaaguccccgucccccagaaccucaagucuagaaaccaguauggaagggaggggucc

SEQ ID NO: 68706 - RNA, 64 nt, hsa
gagagguucuggggaggaagggccaggagagagaucuagaaaguggguucacuagagcugggaa

SEQ ID NO: 68707 - RNA, 64 nt, hsa
gcuuucuagagauaugaugauuuugaaacugauuucuagaaaaagcugacuccauuuuuguccc

SEQ ID NO: 68708 - RNA, 64 nt, hsa
gaaggaaagucccccugugugguaacuguauuguucuagaaauaugcuuucuagagauaugaug

SEQ ID NO: 68709 - RNA, 64 nt, hsa
ucuucuuuauccuuaauugugacuaagauggaaaucuagaaaauauucaugcuucuaaguuucu

SEQ ID NO: 68710 - RNA, 64 nt, hsa
cauuugccauguugaagaguguguauaggaaaggucuagaaauaaauaggcuugugcauaccua

SEQ ID NO: 68711 - RNA, 64 nt, hsa
aaaacauaaccauauguguuuugcguuuacuuccucuagaaaagaauuugcaggcaaccauguu

SEQ ID NO: 68712 - RNA, 64 nt, hsa
guacaagguuuuuaacauggaugguaaacaauugucuagaaauucuggcagguuuuuuguauug

SEQ ID NO: 68713 - RNA, 64 nt, hsa
guauguaugaggaguuagggauggggagucaaguucuagaaaguuuugucugaaaaccuuugaa

SEQ ID NO: 68714 - RNA, 64 nt, hsa
agaauaaauauuaauuuuuccacuucaguuuuauucuagaaaauacccuuuuuagaaauccagu

SEQ ID NO: 68715 - RNA, 64 nt, hsa
uauauagaccuauccucuaaauaugugacaaggaucuagaaauucugagaggggaaaaugugau

SEQ ID NO: 68716 - RNA, 64 nt, hsa
uacauuauacauuauuauaauauucuuuuuuuuuucuagaaacugggggcagccucaaaaucau

SEQ ID NO: 68717 - RNA, 64 nt, hsa
cauaucaaaauacaugaacaaauggaaaguuacuucuagaaaagcaaagaaauuggguaucauu

SEQ ID NO: 68718 - RNA, 64 nt, hsa
ucccaccaucacuuaacgccgggauuauacacauucuagaaaugauucugagaggaguguauag

SEQ ID NO: 68719 - RNA, 64 nt, hsa
acugugucaaaaugauaauuuuguuauguuagccucuagaaaauuuaaguucagaaaaaugcac

SEQ ID NO: 68720 - RNA, 64 nt, hsa
aaguuaacguagaaaauauccaaaaagcaguauuucuagaaaguguccaaaaagcaguauuucu

SEQ ID NO: 68721 - RNA, 64 nt, hsa
caaguuuaaaauugccugcggaaugugugcaguaucuagaaaaaugaaccguaguuuuuguuuu

SEQ ID NO: 68722 - RNA, 64 nt, hsa
acaagagcuccuccugaucacuauuacauauuuuucuagaaaaucuaaaguucagaagagaaug

SEQ ID NO: 68723 - RNA, 64 nt, hsa
aauaucuauuccauuuguauuguacauaaaauuuucuagaaauacacuuuuuuccaaaguguaa

SEQ ID NO: 68724 - RNA, 64 nt, hsa
aucuuuucagugugauggcaaggugcuuguuaugucuagaaaguaagaaaacaauaugaggaga

SEQ ID NO: 68725 - RNA, 64 nt, hsa
ugagaacaaggcuuugaaacugaacaagauaacuucuagaaaugaacuguacuaaucccuuucc

SEQ ID NO: 68726 - RNA, 64 nt, hsa
ggcccugaacaaagccaaaaauuguagaaaccagucuagaaaaaguccugcucaucuguggcca

SEQ ID NO: 68727 - RNA, 64 nt, hsa
uuguaguacauguuuuuacuaauaauucuuguucucuagaaagcuuucuauuucuaaccuaugg

SEQ ID NO: 68728 - RNA, 64 nt, hsa
ugguuaaaauuauauugacugguggccuuagggaucuagaaacuucuacuaaacagagaaauuu

SEQ ID NO: 68729 - RNA, 64 nt, hsa
gaauauuuuaagaacuguagagcugcuuucaauaucuagaaauuuuuaauugaguguaaacaca

SEQ ID NO: 68730 - RNA, 64 nt, hsa
caacauuuuuugugcuuuaaacuguaguaguuggucuagaaacaaaauacuccaagaaaaagaa

SEQ ID NO: 68731 - RNA, 64 nt, hsa
ggggaugaaaucccacauccucccaagugacuggucuagaaauaaucuugaccuugacuuugca

SEQ ID NO: 68732 - RNA, 64 nt, hsa
uaaauaaacuuuauggcuguuuguucuacaauguucuagaaauucucacucagguacacagugc

SEQ ID NO: 68733 - RNA, 64 nt, hsa
guguugugaaacuguaaauuucauacauuugacuucuagaaaacauuuuuguggcuuaugacag

SEQ ID NO: 68734 - RNA, 64 nt, hsa
cuuugaacuuucacgcugaaacaugcuagugauaucuagaaagggcuaauuaggucucauccuu

SEQ ID NO: 68735 - RNA, 64 nt, hsa
acuauguauauuuaaauuuaguaauuuucuaaucucuagaaaucucugcuguucaaaagguggc

SEQ ID NO: 68736 - RNA, 64 nt, hsa
cauuccugguaguauaagucaccuaaaaaagacuucuagaaauauguacuuuaauuauuuguuu

SEQ ID NO: 68737 - RNA, 64 nt, hsa
guuucuuuuggggaaauguuuauauuugguaacuucuagaaagccagaaaauggacucugauuu

SEQ ID NO: 68738 - RNA, 64 nt, hsa
aacguuucuacuuugggguuccauuuaggagcuuucuagaaaguugaggauguuugaagcuucc

SEQ ID NO: 68739 - RNA, 64 nt, hsa
gcucccugggacauucuucaauuccacaucuguuucuagaaaccagcccuuuuuccccccacuu

SEQ ID NO: 68740 - RNA, 64 nt, hsa
ucaggacgugaugagguacucgugguucuggagcucuagaaacacuucugaugcaugaaaaaug

SEQ ID NO: 68741 - RNA, 64 nt, hsa
uccuaugaaaggaugcaauauaaugacccgcuuuucuagaaaguucauaaucagcucuggaaca

SEQ ID NO: 68742 - RNA, 64 nt, hsa
caaacacuaacugggggauuuuauuuauaagggcucuagaaaaaacgaguuauucacaccagca

SEQ ID NO: 68743 - RNA, 64 nt, hsa
aacuauagugauauaucaguguuugagagugaccucuagaaaaaagaaaaguguuuuuagaaau

SEQ ID NO: 68744 - RNA, 64 nt, hsa
gaagaucauguuccucggcuccauuguggguuauucuagaaauccagucuuaaaucucuccgcu

SEQ ID NO: 68745 - RNA, 64 nt, hsa
gaagaucaugucccuuagcugcauuguggguuauucuagaaauccaauguuaaaugccucuacu

SEQ ID NO: 68746 - RNA, 64 nt, hsa
aacuauagugauauaucaguguuugggagugaccucuagaaaaaagaaaacuguuuuuagaaau

SEQ ID NO: 68747 - RNA, 64 nt, hsa
aagaggugguagguuggaguaagaugcuacagaugcucucaagucaggaauagaaacugaugag

SEQ ID NO: 68748 - RNA, 64 nt, hsa
uuacauuuguacagcaugaugaccuuuacaaagugcucucaaugcauuuacccauucguuauau

SEQ ID NO: 68749 - RNA, 62 nt, hsa
ccaguugugaagaaaaauagaaucaauggcauuacuauuaguaaaaugcacaccuuuuucug

SEQ ID NO: 68750 - RNA, 64 nt, hsa
uacuauuaguaaaaugcacaccuuuuucugaauuuacuauuauauuuguuuucaauuucauuuu

SEQ ID NO: 68751 - RNA, 64 nt, hsa
auuacuaguacuaguacuaugacacuguuaauaguacuauuaacaacccauaggcacuugggau

SEQ ID NO: 68752 - RNA, 64 nt, hsa
cuauugcuaguacuaguacuauugcuauuacuaguacuauuacuaguacuaguacuaugacacu

SEQ ID NO: 68753 - RNA, 64 nt, hsa
cuauuaguauuauuaacacuaauaauaguacuauuacuauuacuauuuuuauuuuaaaauaaaa

SEQ ID NO: 68754 - RNA, 64 nt, hsa
uauuaacuauuaguauuauuaacacuaauaauaguacuauuacuauuacuauuuuuauuuuaaa

SEQ ID NO: 68755 - RNA, 64 nt, hsa
ugacuaauucacaaaaaaaguaauuguaaacuaguacuauuauggaauuacucuacuguucuuu

SEQ ID NO: 68756 - RNA, 64 nt, hsa
ucaaccaccuuucugacuuuuuauuuuugaugauuacuauuacuauuauuauggaaaaauuaaa

SEQ ID NO: 68757 - RNA, 64 nt, hsa
accuuucugacuuuuuauuuuugaugauuacuauuacuauuauuauggaaaaauuaaaaugucu

SEQ ID NO: 68758 - RNA, 64 nt, hsa
gugguuugucuuugaaauuacgguuaauacuuuuagacaguaaguccggcugguugcagggcua

SEQ ID NO: 68759 - RNA, 64 nt, hsa
agaaaaaucaaccaaucuguagguguugauaacuagacaguacuguguauguuacgugccugug

SEQ ID NO: 68760 - RNA, 64 nt, hsa
agcuucguucacaugcuauuuaaaugcacaaaauagacaguaaggauuuaucuguucaguuuuu

SEQ ID NO: 68761 - RNA, 64 nt, hsa
agacaucauucagugaauaaauuacuguagucaaagacaguaugggcuggcaguuuguguaauu

SEQ ID NO: 68762 - RNA, 64 nt, hsa
ugugcuuauuacacaaaauuacuuugugguaaacagacaguauuguaaucccaucaaaagauga

SEQ ID NO: 68763 - RNA, 64 nt, hsa
cacuucugugauccauuuuaauuuccaggccacaagacaguagugaugcucugaaaugaaaguu

SEQ ID NO: 68764 - RNA, 64 nt, hsa
uuaaaaauaaguuuuaucuuaaaaucauauuugaagacaguaagacaguaaacuauuuuaggaa

SEQ ID NO: 68765 - RNA, 64 nt, hsa
aaguuuuaucuuaaaaucauauuugaagacaguaagacaguaaacuauuuuaggaagucaaccc

SEQ ID NO: 68766 - RNA, 64 nt, hsa
agaaacuuuguaugugcacacaaaaguauucaagagacaguauugcuaacaucucaucuuaaug

SEQ ID NO: 68767 - RNA, 64 nt, hsa
uugaugaauucuuuugugaaacuugaaagagaauagacaguaugacauauagaauuaauacaaa

SEQ ID NO: 68768 - RNA, 64 nt, hsa
ugccuucuauguagggggcucuaaggccagcccugacccagaccuugacccagaccugagucgg

SEQ ID NO: 68769 - RNA, 64 nt, hsa
agggggcucuaaggccagcccugacccagaccuugacccagaccugagucggcugcucuugggg

SEQ ID NO: 68770 - RNA, 64 nt, hsa
uaagguguaccaccaggcacaccucagucuucuugacccagagccugaaaacuguuuucacugg

SEQ ID NO: 68771 - RNA, 64 nt, hsa
guuuggagaaagagggcaaucaggacucuucugggacccagaugaguucuucacuagcccuucu

SEQ ID NO: 68772 - RNA, 64 nt, hsa
agauacuccuguuaguucagggaccaaguuuuaugacccagaggcuuaaugauguuuggauaua

SEQ ID NO: 68773 - RNA, 64 nt, hsa
ccugaugaauaaucugauauuaaaguaguauuuggacccagagccagaacucggugguggaggc

SEQ ID NO: 68774 - RNA, 64 nt, hsa
cucagcagaaagacccugaaggcaggcugcaaaugacccagaagagggaccugggaguccuggu

SEQ ID NO: 68775 - RNA, 64 nt, hsa
aggccagggcugggcugugcaccugccucccacugacccagacccacuuccuccagagaggccu

SEQ ID NO: 68776 - RNA, 64 nt, hsa
uagcucaaagaagggguuaaugaugcuaacuagagacccagaacgucugaaaacguccugauau

SEQ ID NO: 68777 - RNA, 64 nt, hsa
caucugaugccucuacuaucauuaccucuauugggacccagaaaccaauaccccaaaauauggu

SEQ ID NO: 68778 - RNA, 64 nt, hsa
ccgggccugcucuagugaggagugccuaagccaggacccagaaacucagaguugauggugagag

SEQ ID NO: 68779 - RNA, 64 nt, hsa
ccucucagccaggugccguguuggccuuggcuaggacccagagccacacugcagccuccgccga

SEQ ID NO: 68780 - RNA, 64 nt, hsa
gagaaggugagaggaaggcaaaggccagggaggggacccagagaggccuggcacacaaggccca

SEQ ID NO: 68781 - RNA, 64 nt, hsa
gccuuccuguccaggucugcauggagcacucggugacccagagcagggacuggaggcaccccca

SEQ ID NO: 68782 - RNA, 64 nt, hsa
guuugcagagagcagacagcuagagauaacucgggacccagaguuggucgacagauguuagaug

SEQ ID NO: 68783 - RNA, 64 nt, hsa
cugaacauaccuguguaaucagcaucuagacccagacccagagcgucacaaauaucccccaucc

SEQ ID NO: 68784 - RNA, 64 nt, hsa
cacaaacugaacauaccuguguaaucagcaucuagacccagacccagagcgucacaaauauccc

SEQ ID NO: 68785 - RNA, 64 nt, hsa
guuguggugaggccaccaggcugaagucagcucagacccagaccucccugcuuaggccacucga

SEQ ID NO: 68786 - RNA, 64 nt, hsa
cugugcuuguguuugcugcuaauguccagcuacagacccagaggauaagccacugggcacuggg

SEQ ID NO: 68787 - RNA, 64 nt, hsa
gagcaggcgggcugaggagaguggaaaaggaagcgacccagaaauggcagggacacuucucuug

SEQ ID NO: 68788 - RNA, 64 nt, hsa
uccaggauacaaaaaaaaacauuuaaaaauccgagacccagaacacuucuggucccaagcauuu

SEQ ID NO: 68789 - RNA, 64 nt, hsa
aaggcaguccccccacgcccgagaaagccugggggacccagacaccuguccccacagucaaagc

SEQ ID NO: 68790 - RNA, 64 nt, hsa
acccagacaccuguccccacagucaaagccuggggacccagacauccuguccccacagucagcc

SEQ ID NO: 68791 - RNA, 64 nt, hsa
aacagacccggacagacagacacagccugaaacagacccagacaaacagacagacagacacagc

SEQ ID NO: 68792 - RNA, 64 nt, hsa
cagacaaacagacagacagacacagccugaaacagacccagacagacagacagacagccugaaa

SEQ ID NO: 68793 - RNA, 64 nt, hsa
cagacccagacagacagacagacagccugaaacagacccagacacagccugaaacagauccgga

SEQ ID NO: 68794 - RNA, 64 nt, hsa
gauccggacagacagacagaaacagccugaaacagacccagacagacagacagacacagccuga

SEQ ID NO: 68795 - RNA, 64 nt, hsa
aacagaccuagacagacagacacagauugaaacagacccagacaaacagacagacacagccuga

SEQ ID NO: 68796 - RNA, 64 nt, hsa
gacccagacaaacagacagacacagccugaaacagacccagacacagccugaaacagacccgga

SEQ ID NO: 68797 - RNA, 64 nt, hsa
gacccggacagacagacagacacagccugaaacagacccagacagacagacagacacagccuga

SEQ ID NO: 68798 - RNA, 64 nt, hsa
gacccagacagacagacagacacagccugaaacagacccagacagacagaccgacgcagccuga

SEQ ID NO: 68799 - RNA, 64 nt, hsa
gacccagacagacagaccgacgcagccugaaagagacccagacagagagacaggcagacacagc

SEQ ID NO: 68800 - RNA, 64 nt, hsa
cagaucagaacaacggaggauagcuuugugccuggacccagagagugugggacuccccgcuuca

SEQ ID NO: 68801 - RNA, 64 nt, hsa
uuuugcuuccugcuggaggcagggcaccugcugcgacccagauucuucugcaggaugugucugu

SEQ ID NO: 68802 - RNA, 59 nt, hsa
ccacucuggccauccacuaauccaggggggacccagaccccacaagccauggagacuca

SEQ ID NO: 68803 - RNA, 64 nt, hsa
guauacugcucuggccauccacuagcccagggaggacccagaccuccacacuccauggagacuc

SEQ ID NO: 68804 - RNA, 64 nt, hsa
aacaaaaagagccagugggggagggagggacagagacccagagggcagcgucagacacccagag

SEQ ID NO: 68805 - RNA, 64 nt, hsa
gauagagggacagagccaaaaggauagagaaagagacccagaaaaaggaagagguggaaaccca

SEQ ID NO: 68806 - RNA, 64 nt, hsa
cugacacccugggcuuccugagccagcccuccuugacccagaaguccagaagggucaucugccc

SEQ ID NO: 68807 - RNA, 64 nt, hsa
gagaagcucggacuuggcacuccuggacaaccuggacccagaugcaagacacugugccaccgcc

SEQ ID NO: 68808 - RNA, 64 nt, hsa
gaaacacacaggaacagagaaaugguugaugucagacccagacauagaauguuggagcaaaagc

SEQ ID NO: 68809 - RNA, 64 nt, hsa
gauacucauggguacagagaaaugguugauucuggacccagaucaagaaugugugagcaaagau

SEQ ID NO: 68810 - RNA, 64 nt, hsa
gaaacccguagauacagagaaguggucgauuccagacccagacauagaauguuugaacaaagac

SEQ ID NO: 68811 - RNA, 64 nt, hsa
ucaccccuuccuuuacagguccugggguccaggagacccagaaugaaggugucaguugggcaug

SEQ ID NO: 68812 - RNA, 64 nt, hsa
ggaacacuuugcccaagauuacucacaaagccaagacccagaguccagcuuagagaauagaguu

SEQ ID NO: 68813 - RNA, 64 nt, hsa
uuguauuggcuguucauguauguaggaguuaaaauaggccaaacuggagaaauaaacgcauucu

SEQ ID NO: 68814 - RNA, 64 nt, hsa
agucuucaggacaccauuagaugggcuuucccaauaggccaaaaaaaugcugcgcauacccaga

SEQ ID NO: 68815 - RNA, 64 nt, hsa
ucucauuuguguagcuuuccagauauuuucgauuccacuguaaguccacaugucaucaguuuuc

SEQ ID NO: 68816 - RNA, 64 nt, hsa
cuguugcuggauacuugcaguucugccaucaccuccacuguaccaagacuuggugggaaguaag

SEQ ID NO: 68817 - RNA, 64 nt, hsa
cgggaggcagagguugcagugagcugagauggugccacuguacuccagccugggugauaggaug

SEQ ID NO: 68818 - RNA, 64 nt, hsa
cagccucccaaaaugcugggauuacaggcaugagccacuguacccagccaaaauuguuuucuuu

SEQ ID NO: 68819 - RNA, 64 nt, hsa
gugccauaaauguuuuucaguaauauuuuuugguccacuguauuccugugacacagugcauuau

SEQ ID NO: 68820 - RNA, 64 nt, hsa
ugucaaaugcaaaguuuuuauucauuccaagccaccacuguaaggaauaaagcuuagcuucugu

SEQ ID NO: 68821 - RNA, 64 nt, hsa
caggaguuugaggcugcagugagcuaugauugcaccacuguacuccugccuuaaaaaaaaaaaa

SEQ ID NO: 68822 - RNA, 64 nt, hsa
ugaggagcacuuuccaggcauaguuacagcuuccccacuguauuuacaagccagaauugugcaa

SEQ ID NO: 68823 - RNA, 64 nt, hsa
auuuagacuauuuuaauaauacauauuauuuaccccacuguaacaucauguaaacuaaguaugu

SEQ ID NO: 68824 - RNA, 64 nt, hsa
cagauuaggguauaggcaucuagagaugcacuguccacuguaaauacuauaaugagagccacau

SEQ ID NO: 68825 - RNA, 64 nt, hsa
aggccaccacuggacuauugguuucaauauuagaccacuguagccgaaucagaggccagagagc

SEQ ID NO: 68826 - RNA, 64 nt, hsa
uggcaauggccacccugguguuggcauauuggccccacuguaacuuuugggggcuucccggucu

SEQ ID NO: 68827 - RNA, 64 nt, hsa
ugcuugaacuugggagguggaggccaagauuguaccacuguauuccagcccgggugacagagca

SEQ ID NO: 68828 - RNA, 64 nt, hsa
ggaacaccuucuucuuuuugucaaucggcacagaccacuguaaggaaaugcaguguguugcagu

SEQ ID NO: 68829 - RNA, 64 nt, hsa
ucccaaaguguugaugagccacuguaccccgauaccacuguauaaaaaauuuaaaaaaaauugu

SEQ ID NO: 68830 - RNA, 64 nt, hsa
uccucacgccucagccucccaaaguguugaugagccacuguaccccgauaccacuguauaaaaa

SEQ ID NO: 68831 - RNA, 64 nt, hsa
agcguagcuauguguuggcccuggggcggcccaccccugccaagcuugccaacuucccugaggu

SEQ ID NO: 68832 - RNA, 64 nt, hsa
gaccuuuagugcucccugcaccaaccucccaucccccugccaagauccuugaaggacccuggaa

SEQ ID NO: 68833 - RNA, 64 nt, hsa
cuuggcagguuccagguggaaguugguagaaggccccugccaggucacagcaaugcucuccuug

SEQ ID NO: 68834 - RNA, 64 nt, hsa
auguguuugauaaacaaccagauuguuucugguucccugccacuauaaaaacaccaugagagca

SEQ ID NO: 68835 - RNA, 64 nt, hsa
uucuaccugggugcucaggaauguuccucgucaccccugccacucuguggucggugcccugcuu

SEQ ID NO: 68836 - RNA, 64 nt, hsa
gagggcugcccuauaggucuucucuucccgccuccccugccaugcaaccagauguguugugagu

SEQ ID NO: 68837 - RNA, 64 nt, hsa
ucuggggaaagcauccaucacagaaccuccccuucccugccacgcaccuuccuuggccagcucc

SEQ ID NO: 68838 - RNA, 64 nt, hsa
guguguaauguccaguccccagccaggcucuguccccugccauaccuagacuguguguuucaua

SEQ ID NO: 68839 - RNA, 64 nt, hsa
gcugugccaaagccagguccgaggccaaaguucucccugccauccuuggugccguccugccccu

SEQ ID NO: 68840 - RNA, 64 nt, hsa
uggcuggaaugaugaaggggauacgcuggaguugcccugccaucgccuccaucagccagacgag

SEQ ID NO: 68841 - RNA, 64 nt, hsa
ccaucuccuaggggacuggcgccaaauggucucucccugccaauuuugguaucuucucuggccu

SEQ ID NO: 68842 - RNA, 64 nt, hsa
gucaguguccuguugguccuagcccauuucagcacccugccacuuggaguggaccccuccuacu

SEQ ID NO: 68843 - RNA, 64 nt, hsa
cuucuccagggacccuuagaucacaucacuccaccccugccaggccccagguuaggaauagugg

SEQ ID NO: 68844 - RNA, 64 nt, hsa
gcuuuggagaccuccaggauuauuucucugucagcccugccacauaucacuaaugacuugaacu

SEQ ID NO: 68845 - RNA, 64 nt, hsa
gccucuuccuugaagaacugcaggcccuggccuccccugccaccaggccaccuccccagcauuc

SEQ ID NO: 68846 - RNA, 64 nt, hsa
cuaugccugacgcgggagccaugcgcccccuccgcccugccacucacuaggcccccacuugccu

SEQ ID NO: 68847 - RNA, 64 nt, hsa
uggagggaggugggaaaccucaucauccggugggcccugccaaucuuaacccagaacccuuagg

SEQ ID NO: 68848 - RNA, 64 nt, hsa
cugacugcagagguccgugcagccacacccucuucccugccagcaagcugucugcggcucaucg

SEQ ID NO: 68849 - RNA, 64 nt, hsa
ugcucugagccuagacccuggccccugccuggcucccugccaggcucccugccaccccucacga

SEQ ID NO: 68850 - RNA, 64 nt, hsa
agacccuggccccugccuggcucccugccaggcucccugccaccccucacgaccucugaugguc

SEQ ID NO: 68851 - RNA, 64 nt, hsa
auuaggauuccuuccacggcuccggccgcuaggacccugccaggucccgcgcaccaucccugcc

SEQ ID NO: 68852 - RNA, 64 nt, hsa
gaucagcccguaucaucugaggccugccugcccacccugccacccuccccucccuugcugcucu

SEQ ID NO: 68853 - RNA, 64 nt, hsa
cacccugccacccuccccucccuugcugcucugccccugccagugcccagcccagcggcucugg

SEQ ID NO: 68854 - RNA, 64 nt, hsa
gggcaaguuccuuucccucuuuggagcuugguuucccugccagaggaaacugagcuggaggagc

SEQ ID NO: 68855 - RNA, 64 nt, hsa
gccacaucuccccaccucucacccccacccucuccccugccaggcuggggcuuccucaggcaug

SEQ ID NO: 68856 - RNA, 64 nt, hsa
ucugacucagguuggcagauaaacuguccccagacccugccacacauggaagagacagcucagg

SEQ ID NO: 68857 - RNA, 64 nt, hsa
ugcacccggugguggugauguugggaagauguuucccugccaucuugagauuuuuuacuuuuuu

SEQ ID NO: 68858 - RNA, 64 nt, hsa
augaugguggaucccaaaaccccucugggucgcacccugccagagccuuccuuggugccugucc

SEQ ID NO: 68859 - RNA, 64 nt, hsa
guuaaacucuuuucuccuuaauucuccuuuauuccccugccacccaguaguucucauguaggac

SEQ ID NO: 68860 - RNA, 64 nt, hsa
agauggaaaugagaggaccuccacagccccgccucccugccaggaugcuagauuauuggcuggg

SEQ ID NO: 68861 - RNA, 64 nt, hsa
gacucugcggaucagugcuacaggaguacaucugcccugccacaugacuccagaagucucugac

SEQ ID NO: 68862 - RNA, 64 nt, hsa
gcuagggagagaggggugcugucugccacuugcucccugccaacuuucuggagaggugccaaac

SEQ ID NO: 68863 - RNA, 64 nt, hsa
ccuacaauauauaaggugacuucuggccaugcugcccugccauuggcggcucuguguguuaaua

SEQ ID NO: 68864 - RNA, 64 nt, hsa
aagcagccucgggcaggggucucaggcccguggccccugccacagggcacuggaauggacagca

SEQ ID NO: 68865 - RNA, 64 nt, hsa
gagcgcacggugaugcucgggucugcccccgacccccugccacaggccggaagccgcagggggc

SEQ ID NO: 68866 - RNA, 64 nt, hsa
gccugggcaacgagagugaaacuccguccccacccccugccaaaaaaaaaaaaaaaaaagccag

SEQ ID NO: 68867 - RNA, 64 nt, hsa
aaccugcacccugggaccaagaggcagcagucaucccugccaccagccagagcacaggaagagc

SEQ ID NO: 68868 - RNA, 64 nt, hsa
cgcagcuagagcugggccuaccuuccccagccagcccugccacacaccuggcugaggcaugucu

SEQ ID NO: 68869 - RNA, 64 nt, hsa
agaggcaccugcacaacgacaaacuugaguguuucccugccacuucugugccuccacagccugc

SEQ ID NO: 68870 - RNA, 64 nt, hsa
guugcagcccugcugcugccugccuggacuuggccccugccaccuccugccucagguguccgcu

SEQ ID NO: 68871 - RNA, 64 nt, hsa
caagggaccugcuucuauuagcccuucuccauggcccugccaugcucuccaaaccacuuuuugc

SEQ ID NO: 68872 - RNA, 64 nt, hsa
aacaggaccacaaccccugccagcagcccugggacccugccagcagcccugggaaaaggcugug

SEQ ID NO: 68873 - RNA, 64 nt, hsa
gcggcgucgcuccucugcucaacaggaccacaaccccugccagcagcccugggacccugccagc

SEQ ID NO: 68874 - RNA, 64 nt, hsa
aguggaucugcuugccagaguccuuuuugccccucccugccaccuccccguguuuccaagucag

SEQ ID NO: 68875 - RNA, 64 nt, hsa
uguguuccccaagaguaucugauuccucugcugucccugccaggagcugaagggugggaacaac

SEQ ID NO: 68876 - RNA, 64 nt, hsa
uggucagagacacggucacugauucacacccagucccugccacagaccgucucagacacgcaca

SEQ ID NO: 68877 - RNA, 64 nt, hsa
gcacagugggccugcugcaugauucacacccagucccugccacagaccgucucagacacgcaca

SEQ ID NO: 68878 - RNA, 64 nt, hsa; identical to SEQ ID NO: 68877

SEQ ID NO: 68879 - RNA, 64 nt, hsa
ccaagucggcacugaguggcccagcaccgccuagcccugccaccccacugcccuccugggccuu

SEQ ID NO: 68880 - RNA, 64 nt, hsa
ucccaccccugacaacccgagagggcauauggggcccugccaacaccacuuccucagcagaaac

SEQ ID NO: 68881 - RNA, 64 nt, hsa
ugcgugcauccuacuauguggucagugggaaugacccugccaauggcgagccaagccgggcugu

SEQ ID NO: 68882 - RNA, 64 nt, hsa
gagaggaccucgccccaagcaagccagugagcagcccugccagacuacugccagacugagaaac

SEQ ID NO: 68883 - RNA, 64 nt, hsa
gcagugccggccacacccaugcacugaagcuccucccugccacaccccaaggcgguugccggag

SEQ ID NO: 68884 - RNA, 64 nt, hsa
cccaggagcuggguccugccgcccaggagcugggcccugccacccaggccgggcuagggacaug

SEQ ID NO: 68885 - RNA, 64 nt, hsa
uuggcuccuccaggaaggcucaggagcccuaccucccugccauuauagcugcuccccgccagaa

SEQ ID NO: 68886 - RNA, 64 nt, hsa
gacaaaaucaauaaaacuaaugucccuccccucucccugccaaaaggcaguuacauaucaauac

SEQ ID NO: 68887 - RNA, 64 nt, hsa
ggcuugggaagaccgcccugccaagugcggcugccccugccagaggcucaggccugggucuaag

SEQ ID NO: 68888 - RNA, 64 nt, hsa
ugccaaggugaagaagugaggcuugggaagaccgcccugccaagugcggcugccccugccagag

SEQ ID NO: 68889 - RNA, 64 nt, hsa
aggcuugggcacgggagguuagaacucccccaggcccugccauuggguugucugucuccgucau

SEQ ID NO: 68890 - RNA, 64 nt, hsa
cuccagguuuggggcuccuuccuuccacuccccucccugccagagucugucuuggccagugcca

SEQ ID NO: 68891 - RNA, 64 nt, hsa
ccaccuccaggguccugaccaggucagagauguccccugccaugcagagcaggaagccucagcu

SEQ ID NO: 68892 - RNA, 64 nt, hsa
agccucagcugggccuggagugucccugcuccagcccugccagggacagguuucucccuggaua

SEQ ID NO: 68893 - RNA, 64 nt, hsa
ugcccugcuccuaaggguagaaaacuccaggguccccugccaccgacugcccagccacuccaag

SEQ ID NO: 68894 - RNA, 64 nt, hsa
gggacaggcuggaaugagggaggcgucuucaucucccugccaucccccucucacgccacccccg

SEQ ID NO: 68895 - RNA, 64 nt, hsa
ugggcuguaguuacauuaaugcccagccagccaccccugccacucacccuuccuggcccaggcc

SEQ ID NO: 68896 - RNA, 64 nt, hsa
gaaguuguguggaagccaaggcugggucugacaucccugccaggaagcagguuggacagaaacc

SEQ ID NO: 68897 - RNA, 64 nt, hsa
uggugggauccacacagaugggcaucuuggcucucccugccagaaaaaugugcucugcaguguc

SEQ ID NO: 68898 - RNA, 64 nt, hsa
augccucugccuucgcauagcacacugcuugaggcccugccaggcaccaagcacugcccugggc

SEQ ID NO: 68899 - RNA, 64 nt, hsa
cccccaccucgacucggccucugccagcugccuucccugccagagaacaaaggcugagauggca

SEQ ID NO: 68900 - RNA, 64 nt, hsa
gcccccaccacagcucuaugacucuguucucccucccugccauuguggacucuuguauuugagg

SEQ ID NO: 68901 - RNA, 64 nt, hsa
cccuugucuuauugucccccuacccuaaaugccccccugccauaacuuggggagggcaguuuug

SEQ ID NO: 68902 - RNA, 64 nt, hsa
gcuuugggaccacauggucaguaggcacacugcccccugccaccccuccccagucaccaguucu

SEQ ID NO: 68903 - RNA, 64 nt, hsa
gaaccugaauccaucccccuccugaccugugacccccugccacaauccuuagcccccauaucug

SEQ ID NO: 68904 - RNA, 64 nt, hsa
agacagccucuccuucucagugcagggacgucaccccugccaggcaagcccagggcacagaugc

SEQ ID NO: 68905 - RNA, 64 nt, hsa
aggauggcuucucccucucagugcgaggcuucaccccugccaggcaagcccagggcauagaugc

SEQ ID NO: 68906 - RNA, 64 nt, hsa
agacagccucucccucucagugcagggacgucaccccugccaggcaagcccagggcacagaggc

SEQ ID NO: 68907 - RNA, 64 nt, hsa
ggauggccccucccucucagugcgggaacgucaccccugccaggcaagcccagggcacagaugc

SEQ ID NO: 68908 - RNA, 64 nt, hsa
ccacagagucuucagcgcaucccccaacagcagccccugccagucccucggguccaggcaaggc

SEQ ID NO: 68909 - RNA, 64 nt, hsa
gccugccagcagcgccucagugcccgagcugguccccugccauuccgggaccucucuggaguac

SEQ ID NO: 68910 - RNA, 64 nt, hsa
aggucugagccgacgcccuugccccugccccuaccccugccagcgcccacccccagccagggcc

SEQ ID NO: 68911 - RNA, 64 nt, hsa
cacccacccagaaucugcccaguccccacuucuucccugccacgcgugugugugcgugugccac

SEQ ID NO: 68912 - RNA, 64 nt, hsa
ccuuaccccaggagccaccccuguaccccccuugcccugccauucacccuccaccccuaccccu

SEQ ID NO: 68913 - RNA, 64 nt, hsa
ccaaccaccagagaaaaaagacuguggggcccuccccugccaacuccccuucccuggccgccca

SEQ ID NO: 68914 - RNA, 64 nt, hsa
cgggcucucccucacagccuccagagggaaccagcccugccaccaccuugacccuggacuucug

SEQ ID NO: 68915 - RNA, 64 nt, hsa
gaaucugaaacaggaucaaacucugcuuccugggcccugccagcaucucuggcucggcuuucug

SEQ ID NO: 68916 - RNA, 64 nt, hsa
caaagugcuaggauaacaggugugagccaccgcacccugccaaguuauuuuaaaauguaccauu

SEQ ID NO: 68917 - RNA, 64 nt, hsa
gugugugugugguacccauuaaccuuccccaucucccugccagccccuaacuacccuccccagc

SEQ ID NO: 68918 - RNA, 64 nt, hsa
guuucugaugacaguguuaucccaagacccugcccccugccagccgacccuccuggccuuccuc

SEQ ID NO: 68919 - RNA, 64 nt, hsa
ucugaccguuuucacuugucuccuuucugacugucccugccaaugcuccagcugucgucugacu

SEQ ID NO: 68920 - RNA, 64 nt, hsa
ugugugugugaggguugguugaguugccuagaaccccugccagggcugggggugagaaggggag

SEQ ID NO: 68921 - RNA, 64 nt, hsa
cugccagauaagcuguaggggcucaggccacccucccugccacguggagacgcagaggccgaac

SEQ ID NO: 68922 - RNA, 64 nt, hsa
uggcccccucaggccuaugucugugaggaaggggcccugccacucuccccaagagggccuccau

SEQ ID NO: 68923 - RNA, 64 nt, hsa
acaaagcccaggccugucaagagacgcagagggccccugccaggguuggccccagggacccugg

SEQ ID NO: 68924 - RNA, 64 nt, hsa
cccccaaaggugccaccgugcgggucuccuagcucccugccagcuuccugucccugugcucacu

SEQ ID NO: 68925 - RNA, 64 nt, hsa
aagcccgggcacccgcccagccgggcugggcccucccugccacacuagcuucccagggcugccc

SEQ ID NO: 68926 - RNA, 64 nt, hsa
cccugccacccagcauagacacaccucacagcugcccugccaugcagagcccuggccgcuggag

SEQ ID NO: 68927 - RNA, 64 nt, hsa
ccaaguuucuguggcucauuacagggcaucugaccccugccacccagcauagacacaccucaca

SEQ ID NO: 68928 - RNA, 64 nt, hsa
ggcccacccaucacgugugauugacauguagguacccugccacggccuaugccccaccugcccu

SEQ ID NO: 68929 - RNA, 64 nt, hsa
ucccugugucugccaaccccaggaucccagggcucccugccauuuuagugucuugguguagugu

SEQ ID NO: 68930 - RNA, 64 nt, hsa
cccaggcaucaccaacacggccucccugcagcugcccugccaccgacagaccccgauuaaaccc

SEQ ID NO: 68931 - RNA, 64 nt, hsa
uagagcuugcccugggucagaggaccggggcagccccugccaccaaaggacuugaucugaguug

SEQ ID NO: 68932 - RNA, 64 nt, hsa
aaaaagggaggaagugggggcuggauaugcccaccccugccaaaagcccugaccccagggaagg

SEQ ID NO: 68933 - RNA, 64 nt, hsa
ucccagacugauuacaugagacuggggaguccuucccugccaguuuucucauuuauuacagccu

SEQ ID NO: 68934 - RNA, 64 nt, hsa
acaugggaccuggaggagccuaccuggggccugccccugccagcaggugccagggcuggugagg

SEQ ID NO: 68935 - RNA, 64 nt, hsa
cagaugccaaugccaauuccaaggccagccacaacccugccaccuuggggaauccagccuggag

SEQ ID NO: 68936 - RNA, 64 nt, hsa
gcuuaauaccaauuucucugaguuucuugaaaugucuuuaaaacagacauuuuucucaccaaac

SEQ ID NO: 68937 - RNA, 64 nt, hsa
auguauacauuuuaggaaauguuacuuuuguuaaucuuuaaaaaauacaccuaaugaaagacau

SEQ ID NO: 68938 - RNA, 64 nt, hsa
uacacuuuggcuaugaacaaauaauaaaaauuauucuuuaaaguaaugucuuuaaaggcaaagg

SEQ ID NO: 68939 - RNA, 64 nt, hsa
gaacaaauaauaaaaauuauucuuuaaaguaaugucuuuaaaggcaaagggaaggguaaagucg

SEQ ID NO: 68940 - RNA, 64 nt, hsa
ggaaugucagucagucucuguaguuaaaacuuuuucuuuaaaauucaauuaagguacuucuccc

SEQ ID NO: 68941 - RNA, 64 nt, hsa
ggaaugucagucagucucuguaguuaaaacuuuuucuuuaaaauucaauuaaguuacaccagaa

SEQ ID NO: 68942 - RNA, 64 nt, hsa
uuucucuauuuagacuguuuuuguacuuuacuaaucuuuaaacuaucaggaaaaaaaccaaaac

SEQ ID NO: 68943 - RNA, 64 nt, hsa
cacuaaucugauuuucacucugauuuuuaacguuucuuuaaauauuuauaauguagcuucuuuc

SEQ ID NO: 68944 - RNA, 64 nt, hsa
uaguguuaguacuuuaaaauuuuuaauuuaccagucuuuaaagcaacauccagaaaaaaaaaag

SEQ ID NO: 68945 - RNA, 64 nt, hsa
uuucauagacuauuuccuuuuucaucuuugucauucuuuaaaaguguauguacugguuacauca

SEQ ID NO: 68946 - RNA, 64 nt, hsa
ucccuuauaaacaaugagcaguucuugaugaaccucuuuaaauuuaaaucuccugacucacauu

SEQ ID NO: 68947 - RNA, 64 nt, hsa
aaugcugaaaagccauuguuuauuauccuauaauucuuuaaagaaaugaugacuguuuuugaaa

SEQ ID NO: 68948 - RNA, 64 nt, hsa
agucaugaaguugguuugcuccagcauccgguagucuuuaaacauucuuuuagugaaauuguca

SEQ ID NO: 68949 - RNA, 64 nt, hsa
uauucaguaagagaauagaauuuucauuuguuuuucuuuaaauccuuuacuaauuauauaauuu

SEQ ID NO: 68950 - RNA, 64 nt, hsa
uguaaaaacaaaacuauaauggaucuccuauuuuucuuuaaauacaaaaaaaaaaagguaaaug

SEQ ID NO: 68951 - RNA, 64 nt, hsa
gugcuacuaaacaagaagccuaugaaaaauuucuucuuuaaacuuguuuuuucucuuuccagua

SEQ ID NO: 68952 - RNA, 64 nt, hsa
caccaauugacuuugaaaaguggagaaaguguauucuuuaaagagaauuuacuucuaaaagcca

SEQ ID NO: 68953 - RNA, 64 nt, hsa
uuuacaaauuaaaaaaacauuuuuuucuugguagucuuuaaaaauuaggggauugaaaggaucc

SEQ ID NO: 68954 - RNA, 64 nt, hsa
aaacauuuugcauguguaaagcuucaugaaguucucuuuaaaaaauaccaaagcuuguuuauuu

SEQ ID NO: 68955 - RNA, 64 nt, hsa
uaguuauuugcuuuaaaauaaacucuucuuuuuuucuuuaaaguauacuaucucaaaacucauu

SEQ ID NO: 68956 - RNA, 64 nt, hsa
uaacugaaauuugcugcugauauguugaguuuguucuuuaaaaaauagcucauauaucucaucu

SEQ ID NO: 68957 - RNA, 64 nt, hsa
uccaaaguucagccaguuaucaguagauacaauaucuuuaaaugaacacacgaguguaugucuc

SEQ ID NO: 68958 - RNA, 64 nt, hsa
auacacaagugugcauauacaguuaaugaaacuaucuuuaaauguuauucaugcuauaaagagu

SEQ ID NO: 68959 - RNA, 64 nt, hsa
cuucccacucuccccgacuucauucacucaaacuucuuuaaauggggaaaaauauuugugacuc

SEQ ID NO: 68960 - RNA, 64 nt, hsa
agauaguuagaaaaagauuuucauugaugacauaucuuuaaacuuucuugcaucaguauucuaa

SEQ ID NO: 68961 - RNA, 64 nt, hsa
agaaaugugauuacaaagaagucugacuaccaugucuuuaaacauauggcaucucucaacuuuu

SEQ ID NO: 68962 - RNA, 64 nt, hsa
uuguuuuucuauauaaaaagagcugacugacauaucuuuaaauacuuuguacuaacuuuaucac

SEQ ID NO: 68963 - RNA, 64 nt, hsa
uuaaaugacugcugaaugacauauuuuaucuuguucuuuaaaaucacaacacagagcugcuauu

SEQ ID NO: 68964 - RNA, 64 nt, hsa
ggaaucuguaucagaaagauucuagcuauuauuuucuuuaaagaaugcuggguguugcauuucu

SEQ ID NO: 68965 - RNA, 64 nt, hsa
uaacugaaauuugcugcugauauguugaguuuguucuuuaaaaaauaucucauauaucucgucu

SEQ ID NO: 68966 - RNA, 64 nt, hsa
uaguuauuugcuuuaaaauaaacucuucuuuuuuucuuuaaaguauacuaccucaaaacucauu

SEQ ID NO: 68967 - RNA, 64 nt, hsa
uuuucuaacuggacugguucaaauguuguucucuucuuuaaagggauggcaagaugugggcagu

SEQ ID NO: 68968 - RNA, 64 nt, hsa
uuaucucaaaacugcacugucaagaugaugaugaucuuuaaaauacacacucaaaucaagaaac

SEQ ID NO: 68969 - RNA, 64 nt, hsa
uugcuggcaccugcuauacuggaguauugcuaugucuuuaaaaaauuuuuuuuauuauauuuua

SEQ ID NO: 68970 - RNA, 64 nt, hsa
uguucuuuuauaaauguaauaaggaauaucuugcucuuuaaaauuuauuaggauuuuuaugagu

SEQ ID NO: 68971 - RNA, 64 nt, hsa
cugcccaucuuggaggugcauggcccaucagggaucuuuaaagugggagcaggaaaggcugcua

SEQ ID NO: 68972 - RNA, 64 nt, hsa
aguucuuuggggcuuauuuucuggguaaggcucaucuuuaaaaacuggcuucagaggggagagg

SEQ ID NO: 68973 - RNA, 64 nt, hsa
gacaaaaccaaaagaaauuaacaggccacagguuucuuuaaagcuguguuaacauaucuugccu

SEQ ID NO: 68974 - RNA, 64 nt, hsa
acauuuugggaccagauguauuuggggauagaauucuuuaaauguaugggacuucaugcuuccu

SEQ ID NO: 68975 - RNA, 64 nt, hsa
uuucugaguugaccaauaaauaaaaauaccacuuucuuuaaaaaagccuagggaauugaagcuc

SEQ ID NO: 68976 - RNA, 64 nt, hsa
aaaaaaagaaaagaaaaagcagcauccuuauauuucuuuaaaauacauagaaauaaaguuagua

SEQ ID NO: 68977 - RNA, 64 nt, hsa
agaauuauuguauuuaaaaaaaaacuaauacuuaucuuuaaaauaguaaauaggauuuuaaaca

SEQ ID NO: 68978 - RNA, 64 nt, hsa
auuaaauaauuuuggccucucauaguuuucucucucuuuaaagagaauaaauagagggccaggu

SEQ ID NO: 68979 - RNA, 64 nt, hsa
uaaguaauuugaauuggcagcuuucuuugcuaaaucuuuaaauucuguuaagauccucaaguaa

SEQ ID NO: 68980 - RNA, 64 nt, hsa
aggcucccaucaugccauuuuuuguucauuuuaaucuuuaaaaaauaaaaauuaggcauauuaa

SEQ ID NO: 68981 - RNA, 64 nt, hsa
aaagauaacauuuucaaauacuuagcuuuugcuuucuuuaaaauacauugguuuaugacauaug

SEQ ID NO: 68982 - RNA, 62 nt, hsa
uuuccuccaagggcaaauaaguaaacaguuacucuuuaaagcaaguuaucuuuuaguuuauu

SEQ ID NO: 68983 - RNA, 64 nt, hsa
auaaaauaguucaccauggguaugagauauuuauucuuuaaaucaaaguaaauuagaauuuuua

SEQ ID NO: 68984 - RNA, 64 nt, hsa
aguucauguuaggggaagcauuuuuccaucaguuucuuuaaaauuggauugucuggugaguuuu

SEQ ID NO: 68985 - RNA, 64 nt, hsa
aagucugggacgacaucuuuuauuuuuacaugaaucuuuaaacaauucugugagcaaaguuugu

SEQ ID NO: 68986 - RNA, 64 nt, hsa
ugaaaaaucaucgaaauguauaaaaauugcaguaucuuuaaaaucaguaaaauggacuagcaua

SEQ ID NO: 68987 - RNA, 64 nt, hsa
aguucucuucuuucuuuagcaaaucagagugacuucuuuaaaccacagguuguugaaauggcca

SEQ ID NO: 68988 - RNA, 64 nt, hsa
gugcaugacacuaagauuuuauguuggagauacuucuuuaaauaaccuacagcuugggucuaug

SEQ ID NO: 68989 - RNA, 64 nt, hsa
auaccuauuuuauaugaugggggaaaaaaaguaaucuuuaaacuggcuggcccagaguuuacau

SEQ ID NO: 68990 - RNA, 64 nt, hsa
ugauacucucagauuuuaagggggaaaacuguucucuuuaaaauauuugucuuuaaacagcaac

SEQ ID NO: 68991 - RNA, 64 nt, hsa
uuaagggggaaaacuguucucuuuaaaauauuugucuuuaaacagcaacuacagaaguggaagu

SEQ ID NO: 68992 - RNA, 64 nt, hsa
agggagauggauuaaugugaguaacaggaaugugucuuuaaaaagcuagagugguuacauuuaa

SEQ ID NO: 68993 - RNA, 64 nt, hsa
ucccacaacugggguaggaagcucaggacuuuuuucuuuaaagcuagucauuucaaaagcauau

SEQ ID NO: 68994 - RNA, 64 nt, hsa
gggaaaauuguuuagguuauaugggaaaaguagcucuuuaaaaaucauauugcccaacagaaac

SEQ ID NO: 68995 - RNA, 64 nt, hsa
uugaauugugcaacuccuguguaaaguaaggauuucuuuaaauagcauuuuugcaccaguaaaa

SEQ ID NO: 68996 - RNA, 64 nt, hsa
cucugcuuguauuuugcgaugaagaugugauacaucuuuaaaugaaaauauaccaaaauuuagu

SEQ ID NO: 68997 - RNA, 64 nt, hsa
caucaguacgugagacaagcaguuaauaguaugaucuuuaaaguuuugacaauauaaaauaaac

SEQ ID NO: 68998 - RNA, 64 nt, hsa
aacaaaagaaagauugccugcuaggauugugccaucuuuaaaauuuuuacuauuggucauuugc

SEQ ID NO: 68999 - RNA, 64 nt, hsa
gugugacuugaaauucaguaguaaaagaauuucuucuuuaaagcuuuaauuaccuucagacauu

SEQ ID NO: 69000 - RNA, 64 nt, hsa
ccccuuaaagauaauguacaugcuucaugucaugucuuuaaaauaauuuaaucaacuuuauugu

SEQ ID NO: 69001 - RNA, 64 nt, hsa
cgaucuuuaaguuguuacuauuguguuauucaugucuuuaaaucagauaccaaauauuuuuuag

SEQ ID NO: 69002 - RNA, 64 nt, hsa
uaugguuucugucugaauuauucugccuacguucucuuuaaaagcuguuguacguacuacggag

SEQ ID NO: 69003 - RNA, 64 nt, hsa
auaauagcaaacauuucuaacucuauuaaugaggucuuuaaaccuuucauaauuuuuaaagguu

SEQ ID NO: 69004 - RNA, 64 nt, hsa
ucuggacuuaagaguuucugcuucccuacaaagaucuuuaaaguuauuuuuaggcacauuugug

SEQ ID NO: 69005 - RNA, 64 nt, hsa
guaugaucugugguuccuuagaauauugaggaucucuuuaaaaaaugaaauuucugaucucacc

SEQ ID NO: 69006 - RNA, 64 nt, hsa
caaauuauguuggggaaaauaaagauuuaauauuucuuuaaauagaaaaagaauuugguuuugc

SEQ ID NO: 69007 - RNA, 64 nt, hsa
gugcuccuucuuagcaaucaauauuuuucugcauucuuuaaaagacaagagaauuugguuauaa

SEQ ID NO: 69008 - RNA, 64 nt, hsa
ccaaguuuguauauugaauuacauuaaggaguguucuuuaaaaagagaaauaaauauacaauua

SEQ ID NO: 69009 - RNA, 64 nt, hsa
uggacacuagguugccacagaccuaugcuaggugucuuuaaaaaauuaaggugacaaagcacau

SEQ ID NO: 69010 - RNA, 64 nt, hsa
aauauucuuaguaccacaagauaugucauagguaucuuuaaaugaaauucuuagcuggaaaagu

SEQ ID NO: 69011 - RNA, 64 nt, hsa
caugaaagucauugguaggccauuagcauugauaucuuuaaaacaucuacccuaaaccaucugc

SEQ ID NO: 69012 - RNA, 64 nt, hsa
agaccagccugggcaacauaccaagacccccgucucuuuaaaaauauauauauuuuaaauauac

SEQ ID NO: 69013 - RNA, 64 nt, hsa
uauuuuaaauauacuuaaauauauauuucuaauaucuuuaaauauauauauauauuuuaaagac

SEQ ID NO: 69014 - RNA, 64 nt, hsa
cuuuuuuuuauuuugcaauucucuguauucuaugucuuuaaaaauuugaucuugacauuuaaug

SEQ ID NO: 69015 - RNA, 64 nt, hsa
augaauuauuguuuuucauacuuuuuugcuuguuucuuuaaaguuuucugacgugcauaaugca

SEQ ID NO: 69016 - RNA, 64 nt, hsa
uuuccagugucuucgccacauaaaauagccauuuucuuuaaaauaguuuuggacuaacgaagcu

SEQ ID NO: 69017 - RNA, 64 nt, hsa
gcucauuuuaacaaauaugaccgagucuaguuuuucuuuaaaaggauaguuuaugaguaaucuu

SEQ ID NO: 69018 - RNA, 64 nt, hsa
cuaguuuuucuuuaaaaggauaguuuaugaguaaucuuuaaaaccauuuccauaccaucuguau

SEQ ID NO: 69019 - RNA, 64 nt, hsa
uuauuaccacauaguauuuuuauguuacccaucaucuuuaaaaacauuauaggcugggcauggu

SEQ ID NO: 69020 - RNA, 64 nt, hsa
uaacucucuccagaaaauggauggagauaacuugucuuuaaaacuguaggccagccuuagccac

SEQ ID NO: 69021 - RNA, 64 nt, hsa
uccuuccauagacagcugccucaaagggaaauccucuuuaaaccguaguuggcgcagaggucag

SEQ ID NO: 69022 - RNA, 64 nt, hsa
uugaagcuucaguauaccauguuugcauaguuuaucuuuaaaaacaacuuuaaagguucuuuug

SEQ ID NO: 69023 - RNA, 64 nt, hsa
aacguagcugcaguuguccacgauggauauugguucuuuaaaauauaucugaaaguaguaguca

SEQ ID NO: 69024 - RNA, 64 nt, hsa
aaccaaaaguuaaauauucuaguuaaggauuguuucuuuaaacaacuuucagauucuguugaca

SEQ ID NO: 69025 - RNA, 64 nt, hsa
ucagaauaccuaagcugcuucuuuaacauagagaucuuuaaaaagggaaggucaagcaaagaac

SEQ ID NO: 69026 - RNA, 64 nt, hsa
guaauaugaucaaaguuaagcaauagugguaaaaucuuuaaaacuagauucuugcuucugauau

SEQ ID NO: 69027 - RNA, 64 nt, hsa
auauuagugguuuacaaugcgcuuuagacauauuucuuuaaaaugcaagcagugagaaauaaga

SEQ ID NO: 69028 - RNA, 64 nt, hsa
aaacauaucaauauaauuacaguguuugggggugucuuuaaauauauuagguuauacauuaguc

SEQ ID NO: 69029 - RNA, 64 nt, hsa
aaaaguguuguuuucaaagccaucuuuaaauaguucuuuaaaaauaggucuuuuuuuuauauuu

SEQ ID NO: 69030 - RNA, 64 nt, hsa
uuuguuguaaauaaaaguguuguuuucaaagccaucuuuaaauaguucuuuaaaaauaggucuu

SEQ ID NO: 69031 - RNA, 64 nt, hsa
aaaauuaaccuuugugcaauaccaagaaaauagcucuuuaaaagaaugucuuuguaugucucaa

SEQ ID NO: 69032 - RNA, 64 nt, hsa
uaaauaucuuuacguguguuuuuuagagcuugguucuuuaaagauuuggagaagauauguaaau

SEQ ID NO: 69033 - RNA, 64 nt, hsa
ucagaaucguggagagaauacucagaaaugaaccucuuuaaagccuugcaggaaugagucacuc

SEQ ID NO: 69034 - RNA, 64 nt, hsa
uuuauuguuugaagcgaguuaauauucucaguugucuuuaaaaaucaguuacucuaauuccagg

SEQ ID NO: 69035 - RNA, 64 nt, hsa
uggcauuuucucuacacacucacccucuuccaguucuuuaaaaacguuuaugauauuaagauca

SEQ ID NO: 69036 - RNA, 64 nt, hsa
auuaugcuucauauguuuuugcuuuuacuguauuucuuuaaaaacucuaaaucuuuauucaugu

SEQ ID NO: 69037 - RNA, 64 nt, hsa
uuaucaguuaguggaaauagaacggaaagagugcucuuuaaacaaugagggagcucaguguuua

SEQ ID NO: 69038 - RNA, 64 nt, hsa
uagcaugcaucuguuuauucuauaguuauuaaguucuuuaaaauguaaagccaugcuggaaaau

SEQ ID NO: 69039 - RNA, 64 nt, hsa
caaaugccugacuagggagccauguuucacaaggucuuuaaagugacuaauggcaugagaaaua

SEQ ID NO: 69040 - RNA, 64 nt, hsa
ggggcauccucuuuuuccaacuuggcugcaggaaucuuuaaaagaugcuuuuaacagagucuga

SEQ ID NO: 69041 - RNA, 64 nt, hsa
aaauuuucuacucuuuuuguuuuuuguguuuuguucuuuaaagucagguccaauuuguaaaaac

SEQ ID NO: 69042 - RNA, 64 nt, hsa
gggcugggcuuagacagaguugaucuguagaauaucuuuaaaggagagaugucaacuuucugca

SEQ ID NO: 69043 - RNA, 64 nt, hsa
acuuaagcaaaagaaaaagauuacccaaaaacugucuuuaaaagagagagagagaaaaaaaaaa

SEQ ID NO: 69044 - RNA, 64 nt, hsa
cucacauugccaggaugauaaguuccuuuccuuuucuuuaaagaaguugaaguuuaggaauccu

SEQ ID NO: 69045 - RNA, 64 nt, hsa
auucauacuucgggaauauuuuauaaguaauauaucuuuaaaagaaaauuacccuuugacuuuu

SEQ ID NO: 69046 - RNA, 64 nt, hsa
auuuuauuugggguucuugagauaucuaugcuguucuuuaaaucuacagcagggguaaacauuc

SEQ ID NO: 69047 - RNA, 64 nt, hsa
gagaagcaauuuuggggaaggguuugaauuguuuucuuuaaagauguaaugucccuuucagaga

SEQ ID NO: 69048 - RNA, 64 nt, hsa
gcacacuuguaggauaagugaaauggauacuacaucuuuaaacaguauuucauugccuguguau

SEQ ID NO: 69049 - RNA, 64 nt, hsa
aacccuaucuagucaacugggcauaaugacauuuucuuuaaauuagacucuauuuugaauuaaa

SEQ ID NO: 69050 - RNA, 64 nt, hsa
ucuuuuaugcauuuauuacuaacauagcuuuaaaucuuuaaauguauugaagcauugugcuguc

SEQ ID NO: 69051 - RNA, 64 nt, hsa
uuaaaucuuaaaauugcugaauuuacccucauauucuuuaaaaaacuuaaagcauuaugaaugu

SEQ ID NO: 69052 - RNA, 64 nt, hsa
ucagcuucuuuauuuccuccuaauggaaacauuaucuuuaaaaguugcauauaggaaauauaca

SEQ ID NO: 69053 - RNA, 64 nt, hsa
ucuaccuugugccuguaaaaucgaaagauuuuuuucuuuaaaucauucaugugcuucuguuguc

SEQ ID NO: 69054 - RNA, 64 nt, hsa
augcagggacucugcaaguuuggcuuuuaugaagucuuuaaagucuuguauagcaauaugcuug

SEQ ID NO: 69055 - RNA, 64 nt, hsa
gcuuucccaaaaucaaaguagacuaaagcagccaucuuuaaaauccaggaucaucaaugcuauu

SEQ ID NO: 69056 - RNA, 64 nt, hsa
ucucccccacaggaacaaaacacugccuccagagucuuuaaauucucaguuaucaacgccaagg

SEQ ID NO: 69057 - RNA, 64 nt, hsa
caugucaccuuagguaguaggaagaauuacaauuucuuuaaaucauuuaucuggauuuuuaugu

SEQ ID NO: 69058 - RNA, 64 nt, hsa
ucuauauauacaaugaguaaaaucacagauuuuuucuuuaaauaaaaauaagucauuuuaauaa

SEQ ID NO: 69059 - RNA, 64 nt, hsa
augcauagaucagaauuuuaaauuaaagguuuuuucuuuaaaugauuuguauuacuuuauuaaa

SEQ ID NO: 69060 - RNA, 64 nt, hsa
auaacucaauuuggaguauuuuuuaaaugcuguaucuuuaaagaaaaguaaaauugucuuaaau

SEQ ID NO: 69061 - RNA, 64 nt, hsa
aauuuuauugaauauaauggccucuuaaaaauuaucuuuaaaacuuacuaugguauauauuuug

SEQ ID NO: 69062 - RNA, 64 nt, hsa
ucugauacuuauuuauaacauuguaaaugauaugucuuuaaaaugauucacuuuuauuguauaa

SEQ ID NO: 69063 - RNA, 64 nt, hsa
uccuaguucuauguguuuguuucccuauaugcagucuuuaaaggauuacaacacuuaaaauuga

SEQ ID NO: 69064 - RNA, 64 nt, hsa
uuaagggaacuuccugaauuuuguguauuaauguucuuuaaaaguuuaaguauucuacaaaaaa

SEQ ID NO: 69065 - RNA, 64 nt, hsa
agugugcuuuaguacauagccacaaguucuucauucuuuaaaauguuuugacagaucaucucau

SEQ ID NO: 69066 - RNA, 64 nt, hsa
acaugacuguuguuugcacuauauuaucaugucuucuuuaaaaguaaauauuuuugguuucugu

SEQ ID NO: 69067 - RNA, 64 nt, hsa
gcucuuaaauaugcauauuuucugccaacucacuucuuuaaacaucuuucagcccagcgcugcg

SEQ ID NO: 69068 - RNA, 64 nt, hsa
guguuuaaucgcaguggguaaucuuaucugauugucuuuaaaagugaaaaggauuaagauuuua

SEQ ID NO: 69069 - RNA, 64 nt, hsa
auuaucaaaaaauucuuugucuaauauauuggagucuuuaaaaguguugaagaauaaaauauua

SEQ ID NO: 69070 - RNA, 64 nt, hsa
cuucuaguauuuucuuauuucacuuuuacaccuaucuuuaaaaggaauuuaaauuuuguuuaua

SEQ ID NO: 69071 - RNA, 64 nt, hsa
cacaggacagcgggaaaaaucgaugagcgccaccucuuuaaaaacucacuuacguuuguccuuu

SEQ ID NO: 69072 - RNA, 64 nt, hsa
cauaugcucuuuuaaauguuugguuuauauauuuucuuuaaaaauccugggcuggcacauugac

SEQ ID NO: 69073 - RNA, 64 nt, hsa
uuccaagaucucacuucugcauuaucuuuauggcucuuuaaaccagccaccuagccaaucaagg

SEQ ID NO: 69074 - RNA, 64 nt, hsa
cuuaaaugccgucacuccugcugagauaaaugcgucuuuaaaaauagucucuguggcaggucac

SEQ ID NO: 69075 - RNA, 64 nt, hsa
gauuaagugcuuuuuuuucaucacuugauuauuuucuuuaaaaucagcuauuacaggauauuuu

SEQ ID NO: 69076 - RNA, 64 nt, hsa
ucugaaagauggguucaucuauguuuguguuugcucuuuaaacuauuguuucuccuaucccaag

SEQ ID NO: 69077 - RNA, 64 nt, hsa
ugaagacuagugagauuucuguaauaauuuuaauucuuuaaaaagugaaagcuuguuguaaaga

SEQ ID NO: 69078 - RNA, 64 nt, hsa
ugacauuccauacuaauauacauuguuuaugcuuucuuuaaaauaacuagaagaacauaaaaga

SEQ ID NO: 69079 - RNA, 64 nt, hsa
augucaaguuaaaccauucugggauuugggaacuucuuuaaaggaaaauuguaguagaggucau

SEQ ID NO: 69080 - RNA, 64 nt, hsa
aagagcaagaagcucucuuaagaaaagggaauucucuuuaaagaaaccaccaccaacaacaaaa

SEQ ID NO: 69081 - RNA, 64 nt, hsa
ucuccucagcuccucugagcagccaccuaugugaucuuuaaauccaaccccaaugggagaaaag

SEQ ID NO: 69082 - RNA, 64 nt, hsa
gcgugugugcguguguguggauuuuuaaagaaauucuuuaaagguuuaacgcuagauugugagg

SEQ ID NO: 69083 - RNA, 64 nt, hsa
gaauacuguaacaauauguuuucuuggauuguugucuuuaaaaaggauuuuugugaagcaauug

SEQ ID NO: 69084 - RNA, 64 nt, hsa
gucugucccacccugauccuuuucaauauauauuucuuuaaaccuugugcuacuuaguaaaaau

SEQ ID NO: 69085 - RNA, 64 nt, hsa
uaacacauuuuuaaagucuaaacuguuaaacaacucuuuaaaggauaauuauccaauaaaaaaa

SEQ ID NO: 69086 - RNA, 64 nt, hsa
cagucuuuugggaaccaaaguauuuuacuguaaaucuuuaaaauaacagaauucagugcucuuu

SEQ ID NO: 69087 - RNA, 64 nt, hsa
augcauuauugauuuaaauaaugcugacacguacucuuuaaaaguguucuuuaacacugacuac

SEQ ID NO: 69088 - RNA, 64 nt, hsa
agaauuguagaacuauguuauaguccagucuacuucuuuaaaaaccauuuaaacugcuagauag

SEQ ID NO: 69089 - RNA, 64 nt, hsa
agaauaguccaauagaaaauucauucuuuauaggucuuuaaaaauuacuuuuauuauauuguuu

SEQ ID NO: 69090 - RNA, 64 nt, hsa
ugccuccagugcauccuuacuuagguauuauacuucuuuaaaaagcucugaagcugcuacaaua

SEQ ID NO: 69091 - RNA, 64 nt, hsa
cugauuccuuuuguccacuuauauaguuauuuucucuuuaaaaaaaaauuuuuuuuaauguauu

SEQ ID NO: 69092 - RNA, 64 nt, hsa
aaacuaaacacguguuuuugggauauguuuccaaucuuuaaaugaccuugcccuguccaauaaa

SEQ ID NO: 69093 - RNA, 64 nt, hsa
ucagugauauucagaaguguguaccaaucaaggcucuuuaaaauacggaacgacucacuuaaua

SEQ ID NO: 69094 - RNA, 64 nt, hsa
caccuccuuuggugaaaccacggccaauguuccuuagcugcaccaggcccgaagcuguucccau

SEQ ID NO: 69095 - RNA, 64 nt, hsa
augcuauaccccacugcugcccgacacugcccuuuagcugcagagcuggauuagcuguugacca

SEQ ID NO: 69096 - RNA, 64 nt, hsa
aucaaagguuuuguaaaacuuuugaaaaugaacuuagcugcaaaauauagcuaaccacuuucca

SEQ ID NO: 69097 - RNA, 64 nt, hsa
uacgucgucauucuuguuacaucacucauacuuuuagcugcaaccacacuaauucacauuuuua

SEQ ID NO: 69098 - RNA, 64 nt, hsa
augaugggaguuauuuuuaccauccgggcgcugauagcugcacuauuaauaaauugcauguguu

SEQ ID NO: 69099 - RNA, 64 nt, hsa
ucaggggccaaacuuacuaccuugacuucaucucuagcugcagaaacacuaagucucaagggcu

SEQ ID NO: 69100 - RNA, 64 nt, hsa
aacuuauuucuuaaucaaaaggcaguacaaaaaaaguaauaauguuuuauaagauuguagaguu

SEQ ID NO: 69101 - RNA, 64 nt, hsa
gaaauguaaaaugugaaaacuuuagaucauuuguaguaauaaauauuuuuaacuucauucauac

SEQ ID NO: 69102 - RNA, 64 nt, hsa
gaaccagaauguagaagaguagucauguaacagcaguaauaacauacuucagcuuccauauagg

SEQ ID NO: 69103 - RNA, 64 nt, hsa
agugaaaaaaaugagugggaagaaugaauauaaaaguaauaauauaaggaaaaagggaaaguaa

SEQ ID NO: 69104 - RNA, 64 nt, hsa
uccacuaccaaaagacauuagagaaaaccuuaaaaguaauaaagagaaauauauuugucacuua

SEQ ID NO: 69105 - RNA, 64 nt, hsa
cuggcuugaaguuuuucuauuuagcaaaauaauuaguaauaaguuuugacuaggucuaaagaau

SEQ ID NO: 69106 - RNA, 64 nt, hsa
caaaauuaugaauaggauauacuaauaaauacaaaguaauaacaaaagucaaagcaguguucua

SEQ ID NO: 69107 - RNA, 64 nt, hsa
uagugauuaugauucuuaucccaaaauucuagaaaguaauaaauucuguaugaauaagcauaaa

SEQ ID NO: 69108 - RNA, 64 nt, hsa
caauuaggcuugucagguuaguaauaaacugaacaguaauaaaacuguggaaguaauuggaucu

SEQ ID NO: 69109 - RNA, 64 nt, hsa
gagugaaauguuacccaauuaggcuugucagguuaguaauaaacugaacaguaauaaaacugug

SEQ ID NO: 69110 - RNA, 64 nt, hsa
ccccucuaugggaaggaugccuuuacucuuuaucaguaauaaauuaugacuguuuucauauugc

SEQ ID NO: 69111 - RNA, 64 nt, hsa
uauauuuuguauagaaucacaguuguggagaaaaaguaauaauuucucaaugaauuuuaaaaau

SEQ ID NO: 69112 - RNA, 64 nt, hsa
uuucccugggaaaaccuucagcugcuuuauuuuuaguaauaaauuucucuugucaauucuguuu

SEQ ID NO: 69113 - RNA, 64 nt, hsa
auugaggacaacacaaaugggauugguacuuuauaguaauaaaucugaccagcagagggaggga

SEQ ID NO: 69114 - RNA, 64 nt, hsa
augagaagaaaugauucauaaauuuugaacuaacaguaauaacuucuugaaaauccaauaaaau

SEQ ID NO: 69115 - RNA, 64 nt, hsa
uugaaaaaaaauuuuuugauaugacuacucuaacaguaauaacuauaaaucucacuuuaaauaa

SEQ ID NO: 69116 - RNA, 64 nt, hsa
ugcccagcuccaaaucaccuugauucauaucagcaguaauaaucacuuguguucugaaagaaag

SEQ ID NO: 69117 - RNA, 64 nt, hsa
uauggaagaauucaaauauaaauaaaaaauugugaguaauaaaaugaacucacaguuucaacaa

SEQ ID NO: 69118 - RNA, 64 nt, hsa
gacagugguagugcuccauuuaauaacaguaauaaguaauaaaguguuuuuauuuguuaaccag

SEQ ID NO: 69119 - RNA, 64 nt, hsa
augacuugacagugguagugcuccauuuaauaacaguaauaaguaauaaaguguuuuuauuugu

SEQ ID NO: 69120 - RNA, 64 nt, hsa
augaagccaucuuaauaauuaguaauaauuaauuaguaauaauuaguaagcauuuucucaaugc

SEQ ID NO: 69121 - RNA, 64 nt, hsa
uagaccauuuggggaugaagccaucuuaauaauuaguaauaauuaauuaguaauaauuaguaag

SEQ ID NO: 69122 - RNA, 64 nt, hsa
uuuaagguguuuucaaugugauuuuaguauuuacaguaauaaauaaaauuuauacaaaguuuca

SEQ ID NO: 69123 - RNA, 64 nt, hsa
cauuucaaaggaaauaaaucaguguccguuugccaguaauaaauuuaauauucuguuuuauacu

SEQ ID NO: 69124 - RNA, 64 nt, hsa
aaaauucuuacuagauagauauauuccuuccucccaggaguauuagacuagcuaauaguaaagg

SEQ ID NO: 69125 - RNA, 64 nt, hsa
cuuugggaggccaagggaggugaucacuugagcccaggaguaaagaccagccugggcaacauag

SEQ ID NO: 69126 - RNA, 64 nt, hsa
gagcccgguggucuggauuggaguauggccagggcaggaguacacagaauagaauuuagacugu

SEQ ID NO: 69127 - RNA, 64 nt, hsa
aacaugugucuaccugagggcuaguugaaggauccaggaguauuuucuucuugggugggcccug

SEQ ID NO: 69128 - RNA, 64 nt, hsa
uguucaucauugaguaauggauuaagugaaaauccaggaguauccaucugcaguuaugugcuga

SEQ ID NO: 69129 - RNA, 64 nt, hsa
gggauagagguggcagaaugaaccugguguagggcaggaguauguuguguaguuacaucaauuu

SEQ ID NO: 69130 - RNA, 61 nt, hsa
ccuggaccugggaggccccugugagggccagcucuggaaaaaccugggaguugaugccgga

SEQ ID NO: 69131 - RNA, 61 nt, hsa
caacugucacgugugcuagaagguucgaugccucuggaaugcaugugauacucaucuccau

SEQ ID NO: 69132 - RNA, 61 nt, hsa
ggacacagggauggauaccaccuacccucgccucuggaauggccuacccaacccgagaaga

SEQ ID NO: 69133 - RNA, 61 nt, hsa
gaaaccaaagucugccgcccaccucgcuccccucuggaaucuuccccaagggccaaaccca

SEQ ID NO: 69134 - RNA, 61 nt, hsa
ucuccugacccucccacucccaucuccuuaccucuggaaccccccaggcccuacaaugcuc

SEQ ID NO: 69135 - RNA, 61 nt, hsa
gacugucacucggcucucccuacccauuuggcucuggaagcugcuuggcccccccagauca

SEQ ID NO: 69136 - RNA, 61 nt, hsa
uucuggaccaccaccugggaccaaccuucagcucuggaaccuucauaaagcaggucagcgu

SEQ ID NO: 69137 - RNA, 61 nt, hsa
auccaugcucuguggccaggugccugccacccucuggaacucacaaaagcuggcuuuuauu

SEQ ID NO: 69138 - RNA, 61 nt, hsa
gggaguuauggggucaucaaggaccuugccucucuggaaucugucaacccaguuuugggcu

SEQ ID NO: 69139 - RNA, 61 nt, hsa
cgaccccaccugccauuaccuucagggccuccucuggaagagaacccauucucagagugca

SEQ ID NO: 69140 - RNA, 61 nt, hsa
agacagacagaaagccagaggcuuagggaaacucuggaacccagacaagaaucuuuucgcu

SEQ ID NO: 69141 - RNA, 61 nt, hsa
acucccaaauugucaaguccugcuuaacuuucucuggaaaauagaccccuucucaacauca

SEQ ID NO: 69142 - RNA, 61 nt, hsa
uauuauuaauaacccccucugaauuucaugucucuggaauugaggugguagugaacagcag

SEQ ID NO: 69143 - RNA, 52 nt, hsa
aagccaaauauggauucuagggcucuggaacugauugcucccaggaucuccu

SEQ ID NO: 69144 - RNA, 61 nt, hsa
cguccugugacucgccuugccacaucugugucucuggaacccaggaccucuggaccucagg

SEQ ID NO: 69145 - RNA, 61 nt, hsa
accccagccuaaugaaacccuagguguugggcucuggaaugggacuuugucccuucuaauu

SEQ ID NO: 69146 - RNA, 61 nt, hsa
uauauauauaaaaccagagcugacaaugacacucuggaacauugcauaccuucuguacauu

SEQ ID NO: 69147 - RNA, 61 nt, hsa
aggcagagggaugaaaugccaagacucuaugcucuggaaaaccugaggccaaauauugauc

SEQ ID NO: 69148 - RNA, 61 nt, hsa
uacuauguuaugaaugguauuaaauuuuagucucuggaacauccaaaaccaagcaaaggga

SEQ ID NO: 69149 - RNA, 61 nt, hsa
cagcaggauguugaauugaucaucagaugcccucuggaaugguuagcauccaaggugacag

SEQ ID NO: 69150 - RNA, 61 nt, hsa
aggcuagauccuucccauaguaucaucuguccucuggaaugacucuccugucccuaaaggg

SEQ ID NO: 69151 - RNA, 61 nt, hsa
cucuugcuccucauuccuccccugcccuuuucucuggaauaucuaagaugugagcugcauu

SEQ ID NO: 69152 - RNA, 61 nt, hsa
acgagacugagguuaaacaucagaaaaaaaccucuggaaugaccuuccucauuccaggagg

SEQ ID NO: 69153 - RNA, 61 nt, hsa
uuuguuacuuaaauauauagagaccaguuuucucuggaaguuuguuuaaaugacagaagcg

SEQ ID NO: 69154 - RNA, 61 nt, hsa
uaaccccucccucaauaaauacauuacuguacucuggaauuuaggcaaaaccuuaaaucuc

SEQ ID NO: 69155 - RNA, 61 nt, hsa
auuuuugaaguaaauuaaacauuuuucacaucucuggaaauuuagaguucuagaccucugg

SEQ ID NO: 69156 - RNA, 61 nt, hsa
auauuuauuguuagaaaaugacuuauuucugcucuggaauaaaguugcagaugauucaaac

SEQ ID NO: 69157 - RNA, 61 nt, hsa
cuacgugguggccgucugccaacuccagcaucucuggaaaaucuccacgcugaaugugauu

SEQ ID NO: 69158 - RNA, 61 nt, hsa
ggacaucaagggcggacaccaccaaggggcccucuggaacuugagaccacuggaggcacac

SEQ ID NO: 69159 - RNA, 61 nt, hsa
ugugacccugcucuuccagcuccugggccagcucuggaagggcuguauuugggccuaaucc

SEQ ID NO: 69160 - RNA, 61 nt, hsa
auauggucauuuacaagacacaucuugugcccucuggaagcucauaggguugugaggcaaa

SEQ ID NO: 69161 - RNA, 61 nt, hsa
ucguggcuuggauagaauccagggcucguggcucuggaaugugucugaacuugcugccucc

SEQ ID NO: 69162 - RNA, 61 nt, hsa
agacgauagggcauaugaaauucacuaaacucucuggaaaaaaaauauguauauauuaaaa

SEQ ID NO: 69163 - RNA, 61 nt, hsa
aaaaccaucaaauuuuauaauugagaugauacucuggaaaaacaugucauuucauuuucag

SEQ ID NO: 69164 - RNA, 61 nt, hsa
cuccaggccacuaggccucccuugcagccaacucuggaaggcagaggaguaagagaggaag

SEQ ID NO: 69165 - RNA, 61 nt, hsa
ucaaucucuucuucaaaucaaaaugagaauucucuggaauaacagauucuuguuugguaaa

SEQ ID NO: 69166 - RNA, 61 nt, hsa
uuuccuagaauuuaaaaauaaaaaagucuuccucuggaaagagaagucacacagacaauca

SEQ ID NO: 69167 - RNA, 61 nt, hsa
guuuugaugcuagugaucuucagaucuuucucucuggaaaugugcagagagugucaguuuc

SEQ ID NO: 69168 - RNA, 61 nt, hsa
agaaacaaaacuaauuuuuggagcagauggucucuggaauugcauauccugcuagugauuu

SEQ ID NO: 69169 - RNA, 61 nt, hsa
auaggcucuuuuugcugccugugagcagucccucuggaaagaaacaugugaguaagugaga

SEQ ID NO: 69170 - RNA, 57 nt, hsa
ggccuguccgggggcacugagaacucccucuggaauucuugggggguguuggggaga

SEQ ID NO: 69171 - RNA, 61 nt, hsa
agagccuggggaggagcuuaaaacucaaccacucuggaauuuacccauagaagacgggaag

SEQ ID NO: 69172 - RNA, 61 nt, hsa
ggcuggagacagggguuugaggugggggccucucuggaagcacauuuggagggaaagacaa

SEQ ID NO: 69173 - RNA, 61 nt, hsa
uggggugauagggugggcuaaaaaccaugcacucuggaauuuguuguauuuucucccagua

SEQ ID NO: 69174 - RNA, 61 nt, hsa
uugugaucuaggcugcugggcugaauucucccucuggaaacugaguuacaaccaccaauac

SEQ ID NO: 69175 - RNA, 61 nt, hsa
ggcucauacacacuuaaaaggcuuaauguuucucuggaaagcgucccagaauauuagccag

SEQ ID NO: 69176 - RNA, 61 nt, hsa
cccuauuuguuuucuucuguauguuagggugcucuggaagagaggaaugccugugugagca

SEQ ID NO: 69177 - RNA, 61 nt, hsa
cccacuucuucccuccagccugcaugcccuccucuggaacugggauuaaacagauacccaa

SEQ ID NO: 69178 - RNA, 61 nt, hsa
uacagaggugaccaggccuggcaguugaaaucucuggaagagggaacauguggggacuacu

SEQ ID NO: 69179 - RNA, 61 nt, hsa
gaugacccucugcgguugucaggcgugaauccucuggaaggaacuguuugcaguuguaugc

SEQ ID NO: 69180 - RNA, 61 nt, hsa
ucucuuaacagguugaaguuauugcaaaacacucuggaaaguaauaauuacaucauaauca

SEQ ID NO: 69181 - RNA, 61 nt, hsa
ugcagaugcuacugacugcuugcuagguagccucuggaaagcauuccccauccaucacucc

SEQ ID NO: 69182 - RNA, 61 nt, hsa
ccccuaccccagucacucgccccuuccucaucucuggaauuuggccaggcagucccagaag

SEQ ID NO: 69183 - RNA, 61 nt, hsa
ugagagcccgucacaguccuggguguggcugcucuggaagaauuaggaggcagccauaaua

SEQ ID NO: 69184 - RNA, 61 nt, hsa
uaauggguuauuucucuuugaggguggcuuucucuggaacauugguuagagcagcuuuguu

SEQ ID NO: 69185 - RNA, 61 nt, hsa
gaugcagggauuggccagcuggguugguuugcucuggaauggcuaacucuugccugcuuug

SEQ ID NO: 69186 - RNA, 61 nt, hsa
accaggcuguaaaagcaaaaccucguaucagcucuggaacaauaccugcaguuauucuuca

SEQ ID NO: 69187 - RNA, 61 nt, hsa
cgaggugcccuugcaggugaccgggcgccgccucuggaagaacguguacgacgagcugggg

SEQ ID NO: 69188 - RNA, 61 nt, hsa
caguccugaguuugcuacuuacuucuguggccucuggaaccuuauccaaccucuuggugcu

SEQ ID NO: 69189 - RNA, 61 nt, hsa
aaaccaccaggaaugaauucacuccccacuucucuggaaccucaggacccgcccauuucuc

SEQ ID NO: 69190 - RNA, 61 nt, hsa
ccucuggguacaaaagugccucaacgacaugcucuggaaaucccaaaugccacagucugag

SEQ ID NO: 69191 - RNA, 61 nt, hsa
ggagaaggcgcuaccugcgugggacccucuucucuggaaaccuaauccuccuuucauuucc

SEQ ID NO: 69192 - RNA, 61 nt, hsa
uuuuuuuuccccaguauugcccuggagcugucucuggaaaguagcuggcgagguuaccuua

SEQ ID NO: 69193 - RNA, 61 nt, hsa
auucaagauagcugugauuucucucaccguucucuggaaauggcaucagauuuaaggauaa

SEQ ID NO: 69194 - RNA, 61 nt, hsa
gccucucccugccaaagcccaacucccagggcucuggaaauggugaggcgaggggcuugag

SEQ ID NO: 69195 - RNA, 61 nt, hsa
cauuccuccauguccucacggcuggauuucucucuggaaaggauuuucauucaucauggug

SEQ ID NO: 69196 - RNA, 61 nt, hsa
cucuguaggccaguaguucucaaaguguggucucuggaagagcaguaucagcaucaucugg

SEQ ID NO: 69197 - RNA, 61 nt, hsa
uaucuuacugaacaccuguagucccagcuuucucuggaaguggucguauuugagcaggaug

SEQ ID NO: 69198 - RNA, 61 nt, hsa
ggaagggggcagggacgugaccuugacuuaccucuggaaagggucccagccuagacugcuu

SEQ ID NO: 69199 - RNA, 61 nt, hsa
ccgguugcuggucagguccccauggcuuguucucuggaaccugacuuuagauguuuuggga

SEQ ID NO: 69200 - RNA, 61 nt, hsa
ggguggcgcucagaccccacccuacgcucaucucuggaaggggcagcccugaguggucacu

SEQ ID NO: 69201 - RNA, 61 nt, hsa
gggcaagcacuaccaggcugugggucugcaccucuggaagguagagaagcggcgggucaau

SEQ ID NO: 69202 - RNA, 61 nt, hsa
cuccccuuuaaauuaaaaaaaauguauguaucucuggaagucaauaauuuccagugagcgg

SEQ ID NO: 69203 - RNA, 61 nt, hsa
auguucaguuuagaaccauuuugucugcucccucuggaagccuugcgcagagcuuacuuug

SEQ ID NO: 69204 - RNA, 61 nt, hsa
ggucuucuuagaguugcaggauacacuugcucucuggaaguguguccuuacccuucugcag

SEQ ID NO: 69205 - RNA, 61 nt, hsa
cugaucaggugucuauaacauuuuucauucucucuggaaacagacucagguuucuuuggac

SEQ ID NO: 69206 - RNA, 61 nt, hsa
uuccccuaaguccuaacagaaugguauauuccucuggaaaaagaugaacgucaccaaugga

SEQ ID NO: 69207 - RNA, 61 nt, hsa
ugagcacaggccgauggaggugguucaaauccucuggaacauagccaagaccaggagaaga

SEQ ID NO: 69208 - RNA, 61 nt, hsa; identical to SEQ ID NO: 69189

SEQ ID NO: 69209 - RNA, 61 nt, hsa
ucacauuaagaaugugccugaggcugcuuuacucuggaauagucucagaucuaaaauuucc

SEQ ID NO: 69210 - RNA, 61 nt, hsa
caguugaucagacugaaaaacgguuuuuagucucuggaaaaagacugauuuugcuuuuuuu

SEQ ID NO: 69211 - RNA, 61 nt, hsa
cuucaaucuagaauucuccaguagguaccaucucuggaaaaaagcugggucucauguuuga

SEQ ID NO: 69212 - RNA, 61 nt, hsa
cugguucccugccucuguauucagguguggccucuggaaccugacuccguuaggacgaaca

SEQ ID NO: 69213 - RNA, 61 nt, hsa
auggaucagugacuguaguaggaguuugaggcucuggaacucucacauauucaagucuuua

SEQ ID NO: 69214 - RNA, 61 nt, hsa
ugaaggcaagugacuucaguugagggcaagucucuggaaaagaggcuguaggcaucuggca

SEQ ID NO: 69215 - RNA, 61 nt, hsa
cccuggccucugccugccucccgccugugcacucuggaaccucuggccucaggggaccugc

SEQ ID NO: 69216 - RNA, 61 nt, hsa
uucucuugugucccuacucauugaaaccaaacucuggaaaggacccaauguaccaguauuu

SEQ ID NO: 69217 - RNA, 61 nt, hsa
caguccacuugcugaagaaguugugucauuucucuggaagaauuuccaaaauucuggauuu

SEQ ID NO: 69218 - RNA, 61 nt, hsa
ucaauauccacuucuuucagccuacuguagacucuggaaguauacuuuuugcauauguaag

SEQ ID NO: 69219 - RNA, 61 nt, hsa
uuauaggccuugccaggguuucgagaagcugcucuggaauuugcaagucauggcugugccc

SEQ ID NO: 69220 - RNA, 61 nt, hsa
aagcauuugugguaguaaaggaaaaccaacccucuggaaaauacauuuugagaaucucaaa

SEQ ID NO: 69221 - RNA, 61 nt, hsa
uggcuugauguggcaagccgaaaccacuuggcucuggaaaucuaaguucauacugguuuaa

SEQ ID NO: 69222 - RNA, 61 nt, hsa
uuuuacuuuuauauuuuugcuugaaucuuaacucuggaaaucaccugauguagaagaagac

SEQ ID NO: 69223 - RNA, 61 nt, hsa
aggaaucgugcucucaaugcaaagugucauucucuggaauugcaccuggcucaggaaagga

SEQ ID NO: 69224 - RNA, 61 nt, hsa
ggccuauggagagacaggccuuucucucagccucuggaagccaccugcucuuuugcucuag

SEQ ID NO: 69225 - RNA, 61 nt, hsa
cuccuagagaagaacaauccucauggagaaacucuggaaaccuugacaauggcaacagugu

SEQ ID NO: 69226 - RNA, 61 nt, hsa
cucuccaagcccuccucugaaccagcuaucccucuggaaugcagcugaccaaacaaauucc

SEQ ID NO: 69227 - RNA, 61 nt, hsa
ugcaauaacaggaacaugagacuucgcaaaucucuggaaaauaauauccaaaugaaauuaa

SEQ ID NO: 69228 - RNA, 61 nt, hsa
uguuuucaauauaauucuugauuucauuuuucucuggaauauauuggccuucuacagcuau

SEQ ID NO: 69229 - RNA, 61 nt, hsa
ccagggaagccccugguucugucccuggagacucuggaaauccuuuugcauuaaaaggacu

SEQ ID NO: 69230 - RNA, 61 nt, hsa
ugaccuggucuggucaggcaaugcccugcggcucuggaaagcaacuucaucccagcugcug

SEQ ID NO: 69231 - RNA, 61 nt, hsa
guuaugcccaucuccauagccagaccaagcacucuggaagccaggguugggugcuuauuua

SEQ ID NO: 69232 - RNA, 61 nt, hsa
uaugaaccugaagauuaaaacugaagauuuccucuggaagcuaccacaugcaaacauacaa

SEQ ID NO: 69233 - RNA, 61 nt, hsa
cuucagccugugaggggaggguugagggaggcucuggaaagcccagccacaccugaguccc

SEQ ID NO: 69234 - RNA, 61 nt, hsa
ccuccaggaucuagccuucuaucuaccucuucucuggaauguuuauggugguucagaagaa

SEQ ID NO: 69235 - RNA, 61 nt, hsa
agaagccaccuggaagacccaguguuuccaucucuggaaucucuguuuuaugcuaaaugga

SEQ ID NO: 69236 - RNA, 61 nt, hsa
gaguaaaauggaauaauaccuaacaggcaggcucuggaaguuggaaaucacauacacacac

SEQ ID NO: 69237 - RNA, 61 nt, hsa
aaugaaccaccugauuacaagagccucauuccucuggaacgugcagucaucaauggucagu

SEQ ID NO: 69238 - RNA, 61 nt, hsa
cuguguuuaaauaaauugaaaacuacguaaacucuggaaaguauucuauaagaaaaagcug

SEQ ID NO: 69239 - RNA, 61 nt, hsa
guccaguaaagagauugauuuguuuguauggcucuggaauaacucauucguuuaugaacac

SEQ ID NO: 69240 - RNA, 61 nt, hsa
acuuuguauuuuugaagcggcaaacucuguucucuggaaugcucugaaguuauggcuggga

SEQ ID NO: 69241 - RNA, 61 nt, hsa
gcccaugggggcuggaggggggcagcugggacucuggaaucuucuuuauaauaaaagccuu

SEQ ID NO: 69242 - RNA, 61 nt, hsa
agacccccuccagaagcauacuggaagccaccucuggaaaagccucauauggugauaugcc

SEQ ID NO: 69243 - RNA, 61 nt, hsa
ccuuugccagacagcucugucuccccauguccucuggaacagcugggcaugggucauggcc

SEQ ID NO: 69244 - RNA, 61 nt, hsa
guaaacaauggugauuuuauuuauuuuuacucucuggaaaaggagauaauacaauuccaga

SEQ ID NO: 69245 - RNA, 61 nt, hsa
aaaauugaucggauugauuaaaaaacaaauucucuggaauuugugcguucaugcuuuuucg

SEQ ID NO: 69246 - RNA, 61 nt, hsa
uuuuuguuucucagucugcuuuagcuuuuaacucuggaagcgcaugcacacugaacucugc

SEQ ID NO: 69247 - RNA, 61 nt, hsa
aaaauagccuauccuuaauaaauccuccacucucuggaaggagacugaggggcuuuguaaa

SEQ ID NO: 69248 - RNA, 61 nt, hsa
guauaguuccccguguucacuaacaugcccucucuggaaagcauauguauauaacaugugu

SEQ ID NO: 69249 - RNA, 61 nt, hsa
uggccauuggugcguguuucauucagaucaccucuggaaucucugugguugugaaggcaau

SEQ ID NO: 69250 - RNA, 61 nt, hsa
agcacagggagcuucuguuguucugaucuaucucuggaaaaccagccauuccuccucccug

SEQ ID NO: 69251 - RNA, 61 nt, hsa
cgagccucaggccaaggaccccugaugcagacucuggaaucccuggcccaaaggccugucu

SEQ ID NO: 69252 - RNA, 61 nt, hsa
accugauggcuguucucccaccgggucugggcucuggaaggagccagaugcccccagaaag

SEQ ID NO: 69253 - RNA, 61 nt, hsa
cccgaaguaauaagugaggacgaaugcacugcucuggaacauaacccagugcuaacugggg

SEQ ID NO: 69254 - RNA, 61 nt, hsa
auugcuuuucucuuaccaguaugauuuguaacucuggaacacuauucuuacagaaugccuu

SEQ ID NO: 69255 - RNA, 61 nt, hsa
auuaagaugagcccuaauauguaagauuuuccucuggaauggaugugagaaauguaaauuu

SEQ ID NO: 69256 - RNA, 61 nt, hsa
gaacuaaauuguuucuaaauguagauggucccucuggaaaagcaguuuucagcaggggugg

SEQ ID NO: 69257 - RNA, 61 nt, hsa
ugcagaaaaaaaagugcugcaguuuagauaccucuggaauuuuuccacagugucacagguu

SEQ ID NO: 69258 - RNA, 61 nt, hsa
aaacuugaaucaggauuuuaugccccacauacucuggaacuugaaguauaauauacuuaau

SEQ ID NO: 69259 - RNA, 61 nt, hsa
aucuguaucuuaaauggccccaggcaucugccucuggaaaacuauugagccuugcauguac

SEQ ID NO: 69260 - RNA, 61 nt, hsa
ggguggcagccccugguagaaugcuggauuucucuggaaucuagaagugccauauuuuagu

SEQ ID NO: 69261 - RNA, 61 nt, hsa
auccgucucuguccgcguccuuuccucuccucucuggaagguuuugcuucuuacgaacgcc

SEQ ID NO: 69262 - RNA, 61 nt, hsa
cucagcuaccacuuccccuucccucugcacccucuggaacccuggcccaauuccucagacc

SEQ ID NO: 69263 - RNA, 61 nt, hsa
cuagauuuucuucugugcuucucucuaucugcucuggaauggaugagugaauguguucugg

SEQ ID NO: 69264 - RNA, 61 nt, hsa
agcuucagaaauguuuuaaaagggacuuuagcucuggaacucaaaaucaauuuauuaagag

SEQ ID NO: 69265 - RNA, 61 nt, hsa
aauuuuagcagaugguacuuuucucagugaccucuggaauaaaagaacugacuuuugauag

SEQ ID NO: 69266 - RNA, 61 nt, hsa
uaaccaggagacuacuccugugacuguggagcucuggaaggcuuggugggagugaauuugc

SEQ ID NO: 69267 - RNA, 61 nt, hsa
ucacuuagcuccucauaacaagucuaacuggcucuggaaagcugaaagggcugcacuggaa

SEQ ID NO: 69268 - RNA, 61 nt, hsa
uccuucuccugaaguucagccacccugaggccucuggaaagcaaagggcuccucuccaguc

SEQ ID NO: 69269 - RNA, 61 nt, hsa
auccugcuaaaggagcaaagccuuguauuaccucuggaagacaacaaaaacaauuggcaac

SEQ ID NO: 69270 - RNA, 61 nt, hsa
aaucaguaucuagaugguuuuuaaauguauucucuggaaauuguuuuauguaaaauaaaug

SEQ ID NO: 69271 - RNA, 61 nt, hsa
cagauaugaagagcauuuuaagaggugcagccucuggaaguggaucaaacuagaacucaua

SEQ ID NO: 69272 - RNA, 59 nt, hsa
ugacgguucccugucucugaaagaccuuucucuggaagaggagucugcauuguaguguc

SEQ ID NO: 69273 - RNA, 61 nt, hsa
uauuuuguguccccaccuugauguuacaugacucuggaacaauaugaacuggauuuaagaa

SEQ ID NO: 69274 - RNA, 61 nt, hsa
uucuuuuacuuaaccaggcuuauggcaugaucucuggaacaaauuuguaggaaaaaauuac

SEQ ID NO: 69275 - RNA, 61 nt, hsa
agggcaccaaguuuuccuuuuuucuaaauagcucuggaaccaggcuuguaauccauagcau

SEQ ID NO: 69276 - RNA, 61 nt, hsa
uguagaaaagguuuccucuagaacugaauuccucuggaauugagugauggacuucacaaca

SEQ ID NO: 69277 - RNA, 61 nt, hsa
auaucugggccuuggaaggaaggacacagggcucuggaaggaggaggcugcaugccugaag

SEQ ID NO: 69278 - RNA, 61 nt, hsa
acuccaguugccucagguugguucugcugugcucuggaaaguaacugcagccaccagguau

SEQ ID NO: 69279 - RNA, 61 nt, hsa
uguuuuuagaggggcaaaaauauuuugcaagcucuggaauuguugaauguauucuuuuaua

SEQ ID NO: 69280 - RNA, 61 nt, hsa
auucuugagggacaaugccaauagguauauccucuggaaaaggcuuucaugauuuggcaug

SEQ ID NO: 69281 - RNA, 61 nt, hsa
gaagaaaagagcugggacaauaaaacacuggcucuggaaucuggaauguuaaguccaggcc

SEQ ID NO: 69282 - RNA, 61 nt, hsa
uuauucaagauugugcucuucuaucaaaagccucuggaaauaaauguuccgggaucauguu

SEQ ID NO: 69283 - RNA, 61 nt, hsa
aggaaaaacuaagagaaugaaaaguauuugccucuggaaagaacaacuggcaggacuguug

SEQ ID NO: 69284 - RNA, 61 nt, hsa
gaccauuaagaaccagaaaaauaauuaaucucucuggaaaaaggaaagcuaaagaagacua

SEQ ID NO: 69285 - RNA, 61 nt, hsa
uagaauguaauauguaaacugugauuugguccucuggaaaaaaaaaaaugaaaugaagagu

SEQ ID NO: 69286 - RNA, 61 nt, hsa
ucuccugugaucugugcuagcugugaggcagcucuggaacgugaagagcuguuugguuuga

SEQ ID NO: 69287 - RNA, 61 nt, hsa
ucccaucucaagcauauaaguugaccugcaucucuggaaggaccuugagauugaugcauuu

SEQ ID NO: 69288 - RNA, 61 nt, hsa
ucuuauccuuugcucuguuuuucucuucaggcucuggaaaaucagaucugugacuuaaucu

SEQ ID NO: 69289 - RNA, 61 nt, hsa
auaagaaggcccuguugacgggcugucuuggcucuggaauucaugcauccuggccuugcca

SEQ ID NO: 69290 - RNA, 61 nt, hsa
uuuuuacacuuauuuauuaucauucucacuucucuggaagccacaacuggugucagggcuc

SEQ ID NO: 69291 - RNA, 61 nt, hsa
agccgccugcccgggagaacccugccugaagcucuggaaacuuguggguggggcccaggga

SEQ ID NO: 69292 - RNA, 61 nt, hsa
aaacacccugcugcuggcugccaggcaggcccucuggaagggaaggggcaggacucaucag

SEQ ID NO: 69293 - RNA, 61 nt, hsa
uguagcagaguacauaacuacauaaugccaacucuggaaucaaauuuccuuguuugaaucc

SEQ ID NO: 69294 - RNA, 61 nt, hsa
cuguggaugccagcuuuggaaucagagccgccucuggaauaccugugcuuccagaguuagc

SEQ ID NO: 69295 - RNA, 61 nt, hsa
caggcgcgguggcucaggccuguaaucccagcucuggaagcugaaggauagcuugagccca

SEQ ID NO: 69296 - RNA, 61 nt, hsa
uuccuaucauuuuauuaucaccaugcaaugccucuggaauaaaacauacaggagucugucu

SEQ ID NO: 69297 - RNA, 61 nt, hsa
ugugaccacauacguguuaggaggcugcaugcucuggaagccuggacucuaagcuggagcu

SEQ ID NO: 69298 - RNA, 61 nt, hsa
uucuagauggaggaggcacugaugcuuguaacucuggaaagaggccuacacccaagggcua

SEQ ID NO: 69299 - RNA, 61 nt, hsa
aagaugauauuucagaagaguuggcugccuucucuggaaacaaggaaaacccaauaauucc

SEQ ID NO: 69300 - RNA, 61 nt, hsa
gccugaagccuuccucuggcuucacagaaugcucuggaacucuggggucuggucagggagu

SEQ ID NO: 69301 - RNA, 61 nt, hsa
uucagggcccccucagcugucuccucccucccucuggaaaggaggguggggcucaggggcc

SEQ ID NO: 69302 - RNA, 61 nt, hsa
aaaaugccaucucuuuuuaguugaaggaaaacucuggaaguaggugccauuggucauucug

SEQ ID NO: 69303 - RNA, 61 nt, hsa
gcucucucgacagcaaaugguuuccccucaccucuggaauuaaagaaggaacuccaaaguu

SEQ ID NO: 69304 - RNA, 61 nt, hsa
uacaaaaccacuucagagaccaggguaucuccucuggaaggaucuaagagaagguaagaca

SEQ ID NO: 69305 - RNA, 61 nt, hsa
cgugugaucuuugaaaaccuuggcuuuagcccucuggaaucagagcuuacccaccauagua

SEQ ID NO: 69306 - RNA, 61 nt, hsa
auggagcagauugaaaugcaaaaacccacaccucuggaagauaccuucacggccgcugcug

SEQ ID NO: 69307 - RNA, 61 nt, hsa
ugaguaaucaacaaaaucugccagagagucccucuggaaccauauaaaguuccuggcuuug

SEQ ID NO: 69308 - RNA, 61 nt, hsa
gggaguagagagacacacuaacagccacacccucuggaaaucugauacaguaaauauauga

SEQ ID NO: 69309 - RNA, 61 nt, hsa
uuucucuuccccaaauacagggagggacuuucucuggaauuuccugauaugaccaagaaag

SEQ ID NO: 69310 - RNA, 61 nt, hsa
aagaaggaagaaaagaaggaguggaggaagacucuggaacccuggaagcuguaugccacag

SEQ ID NO: 69311 - RNA, 61 nt, hsa
uugaccacgaccuuggccccagcucugcacucucuggaauaagggcccgaugcagcauuuu

SEQ ID NO: 69312 - RNA, 61 nt, hsa
gugcuacuaaaacauuuucuucucuccuggccucuggaagcaucuuuagcuuugacuuugg

SEQ ID NO: 69313 - RNA, 61 nt, hsa
cccacuuucccuuccccaccccacuuguaugcucuggaaucuguggagacgccagcccugc

SEQ ID NO: 69314 - RNA, 61 nt, hsa
agcagacaucuuccacguggagaagcugcagcucuggaaagaggguuuaagaugcuaggau

SEQ ID NO: 69315 - RNA, 61 nt, hsa
uccuccucucaaaccuggcagaugggggccucucuggaagagggaggggcccugucacugu

SEQ ID NO: 69316 - RNA, 61 nt, hsa
accucccugccccaauccuggcuccaacccucucuggaaaaucgaagugaaacauuugucu

SEQ ID NO: 69317 - RNA, 61 nt, hsa
auauaauuauuuucaguuacuaucccugacacucuggaaucuucuccauuucucccuauca

SEQ ID NO: 69318 - RNA, 61 nt, hsa
uggucauuuugccacacuuaaccauaagggacucuggaagcuguagguuagcucugcccag

SEQ ID NO: 69319 - RNA, 61 nt, hsa
uugauagugaaaccauuagaucauugaauuccucuggaauuagaaaaccagagagucccau

SEQ ID NO: 69320 - RNA, 61 nt, hsa
gacaggacaucuuacaagagaauuugcacaucucuggaagcuuagcaaucuuauugcacac

SEQ ID NO: 69321 - RNA, 61 nt, hsa
uccacggguagugcgaccucgguucugugggcucuggaaggccaccaggguagggucuccc

SEQ ID NO: 69322 - RNA, 61 nt, hsa
uucugaccucagacggcucugagccuuauuucucuggaagcggcuaagggacgguuggggg

SEQ ID NO: 69323 - RNA, 61 nt, hsa
auuguuuacaggauauuccaaaauaaaaggacucuggaagauuuucauugaggauaaauug

SEQ ID NO: 69324 - RNA, 61 nt, hsa
ccuacaggggcuccucugugggugaggggcccucuggaauggcaucccaugagcuuguggc

SEQ ID NO: 69325 - RNA, 61 nt, hsa
uuauuuaaugauguaauuuauuguugcguuccucuggaagcugugacuggaauaaaccccc

SEQ ID NO: 69326 - RNA, 61 nt, hsa
gaggcuggugcuguggccagggugagagcugcucuggaaaaugugacccagauccucacaa

SEQ ID NO: 69327 - RNA, 61 nt, hsa
ugauuccaauauuauuacuuauaacacugaccucuggaaaauauuuuguucacaagaaaua

SEQ ID NO: 69328 - RNA, 61 nt, hsa
auaauuucuaccuauugggccuuguucuguucucuggaacuaaacagaacaaccauuuacc

SEQ ID NO: 69329 - RNA, 61 nt, hsa
uagggcccgagcuucagcuuccaggaugcuucucuggaaccucaaggcaggcagcccaggc

SEQ ID NO: 69330 - RNA, 61 nt, hsa
ucuguugccgccuaacuuucucauccucggucucuggaaagucaggcugagaaauccuuuc

SEQ ID NO: 69331 - RNA, 61 nt, hsa
aacgggggugcggcaggagcaggaacagagacucuggaagccccccaccuuucucgcugga

SEQ ID NO: 69332 - RNA, 61 nt, hsa
ccccuugggcuaggucugaccccaggugucccucuggaaggggcuggcuggugcccuauuu

SEQ ID NO: 69333 - RNA, 61 nt, hsa
cagagacccauucuaaacaagggcauucacucucuggaaguagcauggccuugugaacuua

SEQ ID NO: 69334 - RNA, 61 nt, hsa
uuaggggacaaacuccauccagguugacucucucuggaaugcgguaauaagagcuggcaag

SEQ ID NO: 69335 - RNA, 61 nt, hsa
gcccucuccucaccuccuuuucucucagugacucuggaaccugaaugcagcuuacaagaca

SEQ ID NO: 69336 - RNA, 61 nt, hsa
gagcuagcagaaaauaacucaaaguugaagacucuggaagauuuugcuuuaaccuaacucg

SEQ ID NO: 69337 - RNA, 61 nt, hsa
gccugcuggcucucccccagccccacauccccucuggaagagaauguaaaauaaaccugga

SEQ ID NO: 69338 - RNA, 61 nt, hsa
cuugaacccuacuuucuggaaguggaguugacucuggaaguuuucuagcaacugaacaaaa

SEQ ID NO: 69339 - RNA, 61 nt, hsa
gccuucaguaagaccacaagucugcaggaaacucuggaaucaggaagaaaagcuauguuca

SEQ ID NO: 69340 - RNA, 61 nt, hsa
acaaacuccuacuacgucgucuaaauugcugcucuggaauaaggugauuucugcccccaga

SEQ ID NO: 69341 - RNA, 61 nt, hsa
accuacccaaaccuuuuguucuguaaaacugcucuggaaauaccgggaagcccaguuuucu

SEQ ID NO: 69342 - RNA, 61 nt, hsa
ccuguuaaauuuacaacacuaacgauguagacucuggaaaugccuaauaagucaaagaaga

SEQ ID NO: 69343 - RNA, 61 nt, hsa
cucaaagaggaauugggaaaaauaaauugaacucuggaaucuucucucucaaguccuaaaa

SEQ ID NO: 69344 - RNA, 61 nt, hsa
cacuauucuuggaccaugccagauucugccucucuggaaagaggcucuggacagcagaagc

SEQ ID NO: 69345 - RNA, 61 nt, hsa
ucccuaccugcuucacguuggccggcggcuacucuggaauguuuuucccuccccagaauca

SEQ ID NO: 69346 - RNA, 61 nt, hsa
gcacgacacagggcuggugaccucccugggccucuggaagcuuuguuucuucuguacccgg

SEQ ID NO: 69347 - RNA, 61 nt, hsa
uauacugcuugcaauuucuguauuuauuguucucuggaaauaaauauaguuauuaaaggau

SEQ ID NO: 69348 - RNA, 61 nt, hsa
ucauaggggcagcagucucaggggguguaaacucuggaauccacuaugguuuaccuugagu

SEQ ID NO: 69349 - RNA, 61 nt, hsa
cuuaggaccauuugagcuugugggucacccacucuggaagaaauagucaugcuucuuuauu

SEQ ID NO: 69350 - RNA, 61 nt, hsa
aaauuaaaaacauaacuauugccagauuuagcucuggaauguuuagaaucaggcuagaaua

SEQ ID NO: 69351 - RNA, 54 nt, hsa
guaaugugaagggucccuaaaggacucuggaaagccagaagacugcaguggauu

SEQ ID NO: 69352 - RNA, 61 nt, hsa
acuucaguuguggccucauucagcagaaugacucuggaaccauccucuguuacccgcagau

SEQ ID NO: 69353 - RNA, 61 nt, hsa
gacugacuguacacucccugaucagccagcacucuggaagcuuugggaucccaggaaccau

SEQ ID NO: 69354 - RNA, 61 nt, hsa
cucagacuucuacuuuaccaaguaccacacacucuggaaugcuuuaguuuccuuuuccccu

SEQ ID NO: 69355 - RNA, 61 nt, hsa
gagcacacuguccccaccgccuccccuuucucucuggaaaguugaaguaucuccaaaggcc

SEQ ID NO: 69356 - RNA, 61 nt, hsa
ugauuuuuguuucuuuuggccugauuuguaucucuggaaugcauuuauucuugaaauauuu

SEQ ID NO: 69357 - RNA, 61 nt, hsa
ccugggaucccuuccuggagaggcaggcugucucuggaaaaagccuccauugcccacccgc

SEQ ID NO: 69358 - RNA, 61 nt, hsa
guuuggcacagcuuuggccacagccaggccccucuggaauuguccuuauuaaaccaguuuc

SEQ ID NO: 69359 - RNA, 61 nt, hsa
ggccaggcugcacaccuggugggagaacacacucuggaauucucuauucuccuggucgggg

SEQ ID NO: 69360 - RNA, 61 nt, hsa
gaccaguugcccucauuuccaaagaacugcacucuggaauuaaagggacucuuccauuuug

SEQ ID NO: 69361 - RNA, 61 nt, hsa
uucagauucccaaagaagccagcuacagagccucuggaacacuauggucuuacaagcagua

SEQ ID NO: 69362 - RNA, 61 nt, hsa
cgcauggcaagucacaugcguaaacgacacucucuggaagcccuggagacccucgcccaac

SEQ ID NO: 69363 - RNA, 61 nt, hsa
cugcacugcccagugggccacuaggggcagucucuggaagggcugguucaaggcuguuugg

SEQ ID NO: 69364 - RNA, 61 nt, hsa
gaugucacaggauuaaaugugcaguuuggggcucuggaauuugggucagaaccuucucucu

SEQ ID NO: 69365 - RNA, 61 nt, hsa
uuaggcacacagauccccuggaaacccaccucucuggaaggccccuucccuggcagguggc

SEQ ID NO: 69366 - RNA, 61 nt, hsa
ugcaggaaaccugaacccagcucucaggucccucuggaacuuuggcucuucuuuguuuugu

SEQ ID NO: 69367 - RNA, 61 nt, hsa
aaauuuguaauguguugcuucuacauaaguucucuggaaauaucuacaacuaauaggacac

SEQ ID NO: 69368 - RNA, 61 nt, hsa
aguaaaacuugagaagcuuuuggggucagaucucuggaacaucaugugaugaagcugacau

SEQ ID NO: 69369 - RNA, 61 nt, hsa
ggcauccuccuugaaagaggaggacagaccucucuggaagcagcaagaggaaccaguagcu

SEQ ID NO: 69370 - RNA, 61 nt, hsa
gucugugaaagucagaacacagggcucgagccucuggaacugacccuuugcaagucuuuac

SEQ ID NO: 69371 - RNA, 61 nt, hsa
uggcuuccuuaccagaaaagccucagccuuccucuggaagcaucccccguucugggcaagg

SEQ ID NO: 69372 - RNA, 61 nt, hsa
gcagcuggggcugccaucccauuucuccugccucuggaagguggguggggcccugcaccgu

SEQ ID NO: 69373 - RNA, 61 nt, hsa
ggggugauccucccuccugcgugguggcugucucuggaaagcaucccuugccgcugccaug

SEQ ID NO: 69374 - RNA, 61 nt, hsa
ggaccacucgcugccuuaggugccuucugcucucuggaaccagaggacuagcugacuuuug

SEQ ID NO: 69375 - RNA, 54 nt, hsa
cuccaaggacguguccuuaggcggcucuggaaggcccagcgccagcccccgucc

SEQ ID NO: 69376 - RNA, 61 nt, hsa
ucaccauagggguuauaguuggcuugugcuacucuggaaucauuuuacuguuuguuuuuau

SEQ ID NO: 69377 - RNA, 61 nt, hsa
auuuucccacagacuuccuggccuccugugacucuggaaagcaaaggauuggcuguguauu

SEQ ID NO: 69378 - RNA, 61 nt, hsa
agggugcugcccgcucaaugcccagcagcagcucuggaaggcagugcucagccccaucacc

SEQ ID NO: 69379 - RNA, 61 nt, hsa
agaaaucuaaaaaacgaaaagucuccaaagucucuggaauuugaaacacuuugcauaacgu

SEQ ID NO: 69380 - RNA, 61 nt, hsa
ggccuccccuaagaggcuuuccccgaggcagcucuggaaucugugcccaccuggggccugg

SEQ ID NO: 69381 - RNA, 61 nt, hsa
augcuaguauggaggcugugaaguccccaagcucuggaagcccacacuauuuguuggugau

SEQ ID NO: 69382 - RNA, 61 nt, hsa
ucaggaauauugugguaagcugggaguaucacucuggaagaaaguaacaucuccagaugag

SEQ ID NO: 69383 - RNA, 61 nt, hsa
cucauuguggaaacaagccaaaccaaaugaacucuggaaaaccuaaaacaaauguacauuu

SEQ ID NO: 69384 - RNA, 61 nt, hsa
aagccugugcucagguugccuugaauguggacucuggaagagccaggggcccagaaugccg

SEQ ID NO: 69385 - RNA, 61 nt, hsa
aucagcagucuucaaucgaucaauaauucugcucuggaagagaaggaacagggagcagaga

SEQ ID NO: 69386 - RNA, 61 nt, hsa
cucaccucugcuccugucuucaucaccuucucucuggaagggaagaggaguuggaaggucu

SEQ ID NO: 69387 - RNA, 61 nt, hsa
gcagagcgaguggaugcacuucccagcucaucucuggaagccuuugcuacucaagcuccuc

SEQ ID NO: 69388 - RNA, 61 nt, hsa
cuccgggaucgugcagugacgucgcaagccucucuggaaagagugugcugccccuccccau

SEQ ID NO: 69389 - RNA, 61 nt, hsa
agaugcagcagcagucuuuagccagagaacucucuggaaccauuaaagaauuccugggggc

SEQ ID NO: 69390 - RNA, 61 nt, hsa
uaacucauuauuuaauugaacauuuccaaagcucuggaaaggcaugcauuuguaggugcac

SEQ ID NO: 69391 - RNA, 61 nt, hsa
acauggugggaugggcauguggucccagcuacucuggaagcugaggugagaggaucacuug

SEQ ID NO: 69392 - RNA, 58 nt, hsa
uccaucaccagaaaaacuaaugagauuucucuggaauacaagcugauauugcuacauc

SEQ ID NO: 69393 - RNA, 61 nt, hsa
gucuggauagauagcuuacagcaguagugggcucuggaaugcccaagggaagaggcaaggu

SEQ ID NO: 69394 - RNA, 61 nt, hsa
acauccuggagggagacuggauuugccugcacucuggaaggcugggaaacuccuggaagac

SEQ ID NO: 69395 - RNA, 61 nt, hsa
ugugcaauaagaacauagauccuaaaggauccucuggaagcuguauuucuugaauuagaau

SEQ ID NO: 69396 - RNA, 61 nt, hsa
aaaacuuguuuccacauuaagagucagccagcucuggaauggucuggaaaugucuuccugg

SEQ ID NO: 69397 - RNA, 61 nt, hsa
gcuucuuaaucaauccaaauuucauuuacagcucuggaacacuuuggggcugauuugucuc

SEQ ID NO: 69398 - RNA, 61 nt, hsa
ucugauucagcuggggcuagcugggccgcuccucuggaagcccacacuuguggggacuuag

SEQ ID NO: 69399 - RNA, 61 nt, hsa
auuguguuuguuuuucauguuggaacaaucucucuggaagugccucuucuuguggcuuuua

SEQ ID NO: 69400 - RNA, 61 nt, hsa
gugaucuaccacaccuggccaaucccaacuacucuggaagcugaagcagcaagaucacuug

SEQ ID NO: 69401 - RNA, 61 nt, hsa
acaaugccuggguguccucauccuugcuuuacucuggaaaguguggggauggagaggaugg

SEQ ID NO: 69402 - RNA, 61 nt, hsa
gcuccuugaagaaucucuccucucucucucucucuggaaagacccaacuuucucacugcug

SEQ ID NO: 69403 - RNA, 61 nt, hsa
aagcaaugcuguucuguaaauuuauugaaaccucuggaacauuucaccuuuagagauggag

SEQ ID NO: 69404 - RNA, 61 nt, hsa
gugagauugagagaacuaugaccugcagcaacucuggaaaccuggccugacagacaagcag

SEQ ID NO: 69405 - RNA, 61 nt, hsa
uauucucacucccuugaucucaagggcguaacucuggaagcacagcuugacuacacgucau

SEQ ID NO: 69406 - RNA, 61 nt, hsa
ugggcaagggacaaggugcuagaauccuaagcucuggaaauauuucaugacacugguguau

SEQ ID NO: 69407 - RNA, 61 nt, hsa
cugccccugauggaacucauggagaaugaagcucuggaaauccucaccaaagcccuccgga

SEQ ID NO: 69408 - RNA, 61 nt, hsa
ccccucucugaagagacuguccuugggccuccucuggaagcagcacccccagaggacaggg

SEQ ID NO: 69409 - RNA, 61 nt, hsa
gcaugggcuaagucacucugcccuucggagccucuggaagcuuagggcacauugguuccag

SEQ ID NO: 69410 - RNA, 61 nt, hsa
cuuauauaaaguaccagguuuuuuccccauucucuggaaauguuuguccucccuuaauuuu

SEQ ID NO: 69411 - RNA, 61 nt, hsa
cauuauggauguugaaauggacagggaaggacucuggaagucucuuccuccuccuccucuu

SEQ ID NO: 69412 - RNA, 61 nt, hsa
aagucccucuucuugccguuggccuuucugacucuggaaugaccacuguucauugaaaaau

SEQ ID NO: 69413 - RNA, 61 nt, hsa
caugaggaaauagaagauucaggggccugagcucuggaagcugcaagcaaaagggauggga

SEQ ID NO: 69414 - RNA, 61 nt, hsa
uggccgcaguguguguguauccgauaccccacucuggaaggaaccauccaguaaaggucuu

SEQ ID NO: 69415 - RNA, 61 nt, hsa
gugccuaugaaacaaacacuaagugcagugucucuggaacugccuuacucacaggcuucca

SEQ ID NO: 69416 - RNA, 61 nt, hsa
cgaaggccucugaaggacccuucagagguggcucuggaaugacaugugucaagcugcuugg

SEQ ID NO: 69417 - RNA, 61 nt, hsa
uucuucuaguucgaggccuuggguccccauccucuggaaccagggggaggccuggaaggag

SEQ ID NO: 69418 - RNA, 61 nt, hsa
ccaucucucaagccccaaggacuggagccaccucuggaauaauguguuaaauaucuguaua

SEQ ID NO: 69419 - RNA, 60 nt, hsa
uccuucgacaggggacguagccuuuucuugcucuggaagcccagggagguugagcaguga

SEQ ID NO: 69420 - RNA, 61 nt, hsa
guuuccuuuugcgugaucucuguugauggcacucuggaauuguuucaguuaagucauuuua

SEQ ID NO: 69421 - RNA, 61 nt, hsa
auggaaacuuucuaccugcuuggccuggggccucuggaagucugcugugaauuuguauucc

SEQ ID NO: 69422 - RNA, 61 nt, hsa
uuuacuguuccucugggaaaggagcagggaccucuggaauucccaucuguuucacugucuc

SEQ ID NO: 69423 - RNA, 61 nt, hsa
uuacaucucagguaauguguagauuguacuucucuggaaccaaauguaguuuucuacacuc

SEQ ID NO: 69424 - RNA, 61 nt, hsa
ucugugaaagcaaauacuaaaggaugccauccucuggaauccuaauggcaggcaaagggag

SEQ ID NO: 69425 - RNA, 61 nt, hsa
gagaacugaagugcagccaucagguggaagccucuggaaccugaggcggcugcuugaaccu

SEQ ID NO: 69426 - RNA, 61 nt, hsa
ggacaaagaaaacugcacaauaaaaccaagccucuggaaucuguccucguguccaccuggc

SEQ ID NO: 69427 - RNA, 61 nt, hsa
ucccgucucaacagccccaggccuaugggggcucuggaaggaugggccagcuugcaggggu

SEQ ID NO: 69428 - RNA, 61 nt, hsa
gccacaguggcucacgccuguaaucccagaacucuggaaggcugaggcaggcggaucaccu

SEQ ID NO: 69429 - RNA, 61 nt, hsa
ugggacaguuuuccauauccuugcuguggagcucuggaacacucucuaaauuucccucuau

SEQ ID NO: 69430 - RNA, 61 nt, hsa
cucccuccagcaugggccugugucucaggcucucuggaagguggcccugccccggacccuc

SEQ ID NO: 69431 - RNA, 61 nt, hsa
cuuucccccacccugucucuuccuuguccuucucuggaaaaugccaaaauacacgauguga

SEQ ID NO: 69432 - RNA, 61 nt, hsa
gauuauagcaucuccuucugaguguuugggacucuggaaucugagacccauguucacauug

SEQ ID NO: 69433 - RNA, 61 nt, hsa
aauggcaaaaauauuuccaguugcacuguaucucuggaagugaugcaugaauucgauugga

SEQ ID NO: 69434 - RNA, 61 nt, hsa
ucaaccagagaacagcuccccuagacauggccucuggaaaaaggaaaucuuugguggccaa

SEQ ID NO: 69435 - RNA, 61 nt, hsa
cauuacuaauagaaacacagccuuuccaauccucuggaacauauucugucuggguuuuuaa

SEQ ID NO: 69436 - RNA, 61 nt, hsa
guacaaaauccuacuuuucagagccuuccagcucuggaaccucaaacauccucaugcucuc

SEQ ID NO: 69437 - RNA, 61 nt, hsa
aacuauugaugaauuguuuccugggucacaucucuggaaaauagauguuacaguucuuaaa

SEQ ID NO: 69438 - RNA, 61 nt, hsa
aaggcaucugcaacuccaaguccaugcagaacucuggaaggccaaguucaucgcagcaugu

SEQ ID NO: 69439 - RNA, 61 nt, hsa
ugucuuuauuuccucaaagucaagcagcuuucucuggaaaaugaaugcuaauuagugugaa

SEQ ID NO: 69440 - RNA, 61 nt, hsa
cagcccuagcccuuuagccuuucacccugugcucuggaaaggcuaccaaauacuggccaag

SEQ ID NO: 69441 - RNA, 61 nt, hsa
caauaaugucaccacacacacuucaugaagccucuggaaaacucuacaguauacuugugag

SEQ ID NO: 69442 - RNA, 61 nt, hsa
ucggggucuuuccucagccucgaaaagugggcucuggaaucccuuuguaaauagguguguu

SEQ ID NO: 69443 - RNA, 61 nt, hsa
ucuggugagggacauuguaguucgcaugguucucuggaaacgcgccaggaaaagcuuccgu

SEQ ID NO: 69444 - RNA, 59 nt, hsa
caaaccuaagagcacagugaauuugaaggcucuggaagaaaagaaaaaagucuuugagu

SEQ ID NO: 69445 - RNA, 61 nt, hsa
aagcucaucccucccguccgaggcuaguuuccucuggaaccacauuuuuaucuagaugaaa

SEQ ID NO: 69446 - RNA, 61 nt, hsa
uguguguucucagugaaauaacuaccuuccacucuggaaccuuauuccagcaguuguucca

SEQ ID NO: 69447 - RNA, 61 nt, hsa
gaaacccagaucgcuguguuacuaaugaucacucuggaaaugcaaauagaauaggagggga

SEQ ID NO: 69448 - RNA, 61 nt, hsa
gguagucccucucaccugcuuccucagacgacucuggaagcuucccucuaccacugggcac

SEQ ID NO: 69449 - RNA, 52 nt, hsa
aagaaccuaugaaucucuaaggcucuggaaccaucugcccgcccaccaugcc

SEQ ID NO: 69450 - RNA, 61 nt, hsa
ugugguguuauagugguaacugcaguuccuccucuggaauguagacuguauauguuuaaua

SEQ ID NO: 69451 - RNA, 61 nt, hsa
gauaugacaguccagcaucgaugccugugcccucuggaaaaauuuccuccuagcccuucca

SEQ ID NO: 69452 - RNA, 61 nt, hsa
uguugcauuuaacugaaugucauguuuucuccucuggaacuucuuauguaugcaagcuccc

SEQ ID NO: 69453 - RNA, 61 nt, hsa
ccaccccacuucugcaaacccaucccgaggccucuggaaugggacuccuucucccucccua

SEQ ID NO: 69454 - RNA, 61 nt, hsa
acuuugcacuuguaguuuugagucuuugucucucuggaauaugaacagguuuauaaaacau

SEQ ID NO: 69455 - RNA, 61 nt, hsa
guuuucuaagcucagggucuucauuagagaccucuggaaauacauuaaggauggugggggu

SEQ ID NO: 69456 - RNA, 61 nt, hsa
gagauuuauaaaguuuugauauuuuucccuacucuggaauuugaacuuucuucauguuugc

SEQ ID NO: 69457 - RNA, 61 nt, hsa
auugacagcaaugguuucccgggcccagaaacucuggaaagauuuuguccagaagaauuca

SEQ ID NO: 69458 - RNA, 61 nt, hsa
gugcuugaccuccuguauucugaauggugaacucuggaagcagggauugugucuggcucuu

SEQ ID NO: 69459 - RNA, 61 nt, hsa
gcccuccuuaauuugggaagguuuguguuuucucuggaaugguacaugucuuccauguauc

SEQ ID NO: 69460 - RNA, 61 nt, hsa
auuuucuaagcagccagcagugaaucuaaaacucuggaagaagucuucuguuugaaaggcu

SEQ ID NO: 69461 - RNA, 61 nt, hsa
uauuguuuuuauuccacacuuccuacuuggucucuggaaguuuuaccacauguaacagauu

SEQ ID NO: 69462 - RNA, 61 nt, hsa
aguguuaucuggaagguuuaaauuuuuagaucucuggaacacauucuuaaugguaaguguc

SEQ ID NO: 69463 - RNA, 61 nt, hsa
ggugguaggagguuuuuuuuuuuacccagggcucuggaaggacaccaaacuguucugcuug

SEQ ID NO: 69464 - RNA, 61 nt, hsa
cuuguccaagccuuuaagacagcacugccuucucuggaacuaaaauuacaauugaaguaaa

SEQ ID NO: 69465 - RNA, 61 nt, hsa
uuuggcagaacuaguugauuaguuuagggaucucuggaaaugucaguuuccugaagagcca

SEQ ID NO: 69466 - RNA, 61 nt, hsa
uccuucaaaacuauaugguugccuagauucucucuggaaacugacuuugucaaauaaauag

SEQ ID NO: 69467 - RNA, 61 nt, hsa
gagcauccgaccucuuggagcaaguuucugccucuggaaagggggcgggcccuuuucacaa

SEQ ID NO: 69468 - RNA, 61 nt, hsa
cuaggguggaggucacugcacuaccacccaccucuggaagacuggcugugaaaagucaggu

SEQ ID NO: 69469 - RNA, 61 nt, hsa
aggcucucccugcucccuucucuacaggaaucucuggaaaacuaucagaagacaaaguuug

SEQ ID NO: 69470 - RNA, 61 nt, hsa
gauaguuuuuaacucuauggucauuguaucacucuggaaaauguggaguagcuguaauaaa

SEQ ID NO: 69471 - RNA, 61 nt, hsa
gcuaaaaagauuacagcgucaucugguugaacucuggaaaaaaaaaaaaaaaugaaaaaaa

SEQ ID NO: 69472 - RNA, 61 nt, hsa
ucccaaggcccuaaggucccucaccugguugcucuggaagcucuugcugauaggaaugaua

SEQ ID NO: 69473 - RNA, 61 nt, hsa
gaccuguacuuauuuuucucuucccgccucccucuggaauggauauauugguugguucaua

SEQ ID NO: 69474 - RNA, 61 nt, hsa
cugagcccaccagccacagugcccauguccccucuggaagacaaacuaccaauuucucguu

SEQ ID NO: 69475 - RNA, 61 nt, hsa
uauuuauuuagcauagacauuaaagauaacucucuggaaaaugacuugacuaaggcucuca

SEQ ID NO: 69476 - RNA, 61 nt, hsa
gcaccuuucuuccgucuguucacucugcggccucuggaaucccagcucuucucucucagaa

SEQ ID NO: 69477 - RNA, 61 nt, hsa
ggaaccuggaccccagccuuggugggggagccucuggaaugcauggggcggguccuagcug

SEQ ID NO: 69478 - RNA, 61 nt, hsa
guagcaugauugcgcucauggauacagauggcucuggaaagcucaaccugcaggaguucca

SEQ ID NO: 69479 - RNA, 61 nt, hsa
uggaaagcucaaccugcaggaguuccaccaccucuggaacaagauuaaggccuggcaggug

SEQ ID NO: 69480 - RNA, 61 nt, hsa
guccccaccacuccuggagucccaaugacuucucuggaaagacaaagagguuaucacaaaa

SEQ ID NO: 69481 - RNA, 61 nt, hsa
uuguuuuauaaagaacgugauuuccagugaucucuggaagcgcuaaagcuaaaauuucugu

SEQ ID NO: 69482 - RNA, 61 nt, hsa
gaggcauacacuuuuuacagauggacaaaagcucuggaacccuguggcuucaaauccuuug

SEQ ID NO: 69483 - RNA, 60 nt, hsa
aguagauaaaacagcugcaauauaaacaguccucuggaauaaugguuugugguggaugcu

SEQ ID NO: 69484 - RNA, 61 nt, hsa
gaaaugcagaccugugggcucuaccacaggccucuggaaucagaaucuucaggguggggcc

SEQ ID NO: 69485 - RNA, 61 nt, hsa
cuaggcuuacaggccauccugagccaggggccucuggaaauucucuuccugaugguccuuu

SEQ ID NO: 69486 - RNA, 61 nt, hsa
ggggcauuuugcuggggggagaugaggcagccucuggaauggcucagggauucagcccucc

SEQ ID NO: 69487 - RNA, 61 nt, hsa
gccacccaggaaggaagcacagagcugggggcucuggaaacgcccugugucucuggcuaca

SEQ ID NO: 69488 - RNA, 61 nt, hsa
cuccggacucuggcacgcuccagcagcccuccucuggaagcugcguccccucacccccugu

SEQ ID NO: 69489 - RNA, 61 nt, hsa
gcagggaguggggauugguccuacuuucuuucucuggaaaggaaagccuccaagacuccau

SEQ ID NO: 69490 - RNA, 61 nt, hsa
ugacugagacaauucuguccauguaaagauccucuggaaaaagacuccgagaguuauaacu

SEQ ID NO: 69491 - RNA, 61 nt, hsa
ugccuggcugauucuuccuuaaaacuaaaaucucuggaaaauggauuugcuucuuacccug

SEQ ID NO: 69492 - RNA, 61 nt, hsa
cuccagcuuccagcuaggccagaagggcaugcucuggaacccagcaggaucacagcugccu

SEQ ID NO: 69493 - RNA, 61 nt, hsa
cucgaugugcacugugaugccuggaaccuuccucuggaagugcugauuuuauggacugagg

SEQ ID NO: 69494 - RNA, 61 nt, hsa
gcgucuccaauaugacuauuaaaacugucaccucuggaaauacacuagugugagccuucag

SEQ ID NO: 69495 - RNA, 61 nt, hsa
aagggcuuggccagcgcuguugagggguccccucuggaaugcacugaauaaagcacgugca

SEQ ID NO: 69496 - RNA, 61 nt, hsa
caucagccuugaagggccucgaugaagccuucucuggaaccacuccagcccagcuccaccu

SEQ ID NO: 69497 - RNA, 61 nt, hsa
uccuuaggccucugagaagcucugaagaacucucuggaagccccugggcccaguaccuagc

SEQ ID NO: 69498 - RNA, 61 nt, hsa
ucagucacaacucaccuagcgaccugacuuacucuggaaucuuggcgggcaucgccgaccc

SEQ ID NO: 69499 - RNA, 61 nt, hsa
agacggccaguucuggcggccagauguggugcucuggaauccagucccauuuccuuccugg

SEQ ID NO: 69500 - RNA, 61 nt, hsa
ugggacauacuugcccccuacuuccucuucucucuggaacggcucacaaugagugugacau

SEQ ID NO: 69501 - RNA, 61 nt, hsa
agaugauguagcuguacauuuuaaauguaugcucuggaaugagucacuuuuuuucccugag

SEQ ID NO: 69502 - RNA, 61 nt, hsa
aggccgggggagcagacagggccggugcucccucuggaagcuugggugaccggggcccugg

SEQ ID NO: 69503 - RNA, 61 nt, hsa
ccucggccagcuggacccacaugagggccaccucuggaaccuucuucgaggcccuggccag

SEQ ID NO: 69504 - RNA, 61 nt, hsa
gcaccucucugucccuuccgugucucacugucucuggaagcuucagcccauguguguccug

SEQ ID NO: 69505 - RNA, 61 nt, hsa
cucuguguggauagacuccccagcguuuuuccucuggaaaugcccacagggcuugccgcgu

SEQ ID NO: 69506 - RNA, 61 nt, hsa
cuccccacaguuuuaggaucuaaaugauugccucuggaacuauucuucuagacuaucccac

SEQ ID NO: 69507 - RNA, 61 nt, hsa
ucuacaucagcugaaccugaaacucaggggacucuggaacaccauggacccugggggcugu

SEQ ID NO: 69508 - RNA, 61 nt, hsa
cagagccccaggugccuggccuggccuagaccucuggaauugagauuaaacaauuuggagu

SEQ ID NO: 69509 - RNA, 61 nt, hsa
ccugcugugacugaccuacaguggacuuucucucuggaauggaaccuucuuaggccuccug

SEQ ID NO: 69510 - RNA, 61 nt, hsa
caccagcuugggcaacguaagaagaccgugucucuggaauuuuuuuuuuuuuuuaauuagc

SEQ ID NO: 69511 - RNA, 61 nt, hsa
ucuugggaacgcuggagagcuugugcacagccucuggaaggaaaggcagcgcugacuucgu

SEQ ID NO: 69512 - RNA, 61 nt, hsa
acagacugacacguuucccacuguacuggaacucuggaaagaggggcuccccgaccugccc

SEQ ID NO: 69513 - RNA, 61 nt, hsa
cuacauucuucccgaggcuccaggccgcugucucuggaaguaaaagagccuugucugaccu

SEQ ID NO: 69514 - RNA, 61 nt, hsa
acagucaggggccuccacaugccuggccuggcucuggaagucacgucuuagcuucugaaca

SEQ ID NO: 69515 - RNA, 61 nt, hsa
agucuggaaaguugggauuugcaaauaaaggcucuggaagcauugcugguccugaagcuuu

SEQ ID NO: 69516 - RNA, 61 nt, hsa
uggggggcuauagccucagagaccacucauccucuggaaucaaccucuuucuaauacccuc

SEQ ID NO: 69517 - RNA, 61 nt, hsa
aguacauguuuaaaagaagagcucauggaaccucuggaaaggacagggaaguugaguuagc

SEQ ID NO: 69518 - RNA, 61 nt, hsa
auuacuuggaaaacagugggaagugguaggacucuggaagaggccacacacccgagagcug

SEQ ID NO: 69519 - RNA, 61 nt, hsa
gucgauggaacuggccacgcacaggcucuggcucuggaaggagggaugaugagugggcguu

SEQ ID NO: 69520 - RNA, 61 nt, hsa
gcuuguuuguuuuuagauuccugagagaugucucuggaagggaaaguuuugagaacuaaug

SEQ ID NO: 69521 - RNA, 61 nt, hsa
gacuuaaauguaaaaccccaaacuauaaaaacucuggaagauaaccuaggcaauaccauuc

SEQ ID NO: 69522 - RNA, 61 nt, hsa
ggccuggccugaccaaugagaggccagaacacucuggaacaucggaagaggaguucuuugc

SEQ ID NO: 69523 - RNA, 61 nt, hsa
gggagacggcuuuguccuggggacacuuucccucuggaaucucaagacgacguggcacaca

SEQ ID NO: 69524 - RNA, 61 nt, hsa
gagagcuggaggacaauauccagggacauggcucuggaaaauaacuuuuuuuuuuuuaaga

SEQ ID NO: 69525 - RNA, 61 nt, hsa
uagggaggugaguccucucuaucuccucuggcucuggaagcaccuugaaaaugugcauuuu

SEQ ID NO: 69526 - RNA, 61 nt, hsa
auuacaagacggggagugagacuccugauugcucuggaagccugcugauuucuacaacuga

SEQ ID NO: 69527 - RNA, 61 nt, hsa
cugcucugugucuguguugugaagcuugagacucuggaaagaaauggggagggggggcagg

SEQ ID NO: 69528 - RNA, 61 nt, hsa
ccaucagcccuugcaagucccccacucaggccucuggaagguccagggaugggcucugaug

SEQ ID NO: 69529 - RNA, 61 nt, hsa
cuaugaggguguauauauuuuuuacccaaagcucuggaauuguacauuuauuuuuuaaaac

SEQ ID NO: 69530 - RNA, 61 nt, hsa
cgagccaguggcggcugguaucccgcggcggcucuggaagcuggacgcggaccacggcccg

SEQ ID NO: 69531 - RNA, 61 nt, hsa
aacugggaacauugcauccauggguugaugucucuggaagugcaaccacccaaugucucug

SEQ ID NO: 69532 - RNA, 61 nt, hsa
ugaugucucuggaagugcaaccacccaaugucucuggaagugccaccuggaagugccaccu

SEQ ID NO: 69533 - RNA, 61 nt, hsa
agugccaccuggaagugccaccuggaagugucucuggaagagcacccaccacuguucagcc

SEQ ID NO: 69534 - RNA, 61 nt, hsa
ggcagaggcuccgcggcaggaggagccggugcucuggaagaccugaaagaagcccaggugg

SEQ ID NO: 69535 - RNA, 61 nt, hsa
uuagaacauauuugcauaagauagcuauuuacucuggaaaccaacaacuuuugagauuucc

SEQ ID NO: 69536 - RNA, 61 nt, hsa
gaauuuugauagaaaaccauggggccaagagcucuggaagccuggccggaaagaccaaggu

SEQ ID NO: 69537 - RNA, 61 nt, hsa
gagagucggagauaugacugacugauuccuucucuggaauaguuacuuuacaacacggucu

SEQ ID NO: 69538 - RNA, 61 nt, hsa
cucucccuucccugcugccuugcagugaccccucuggaacucaggacucgauuuuaaggac

SEQ ID NO: 69539 - RNA, 61 nt, hsa
ugccuucccuagaaccggaggccccggacuucucuggaaaaccgccugucugcaggcccga

SEQ ID NO: 69540 - RNA, 61 nt, hsa
cuacauaaaugggaucauuuuauacauggugcucuggaacccacauuuuucaugcagucau

SEQ ID NO: 69541 - RNA, 60 nt, hsa
ugaggaaucuggucaagugagcgggccuuacucuggaaggaggccucagagguuucucca

SEQ ID NO: 69542 - RNA, 61 nt, hsa
auucaagggaaaggcacuaaaugguuuuuuccucuggaagaugagauuguaggugauauuu

SEQ ID NO: 69543 - RNA, 61 nt, hsa
aggaggucagcaaaggucuugaauagauuuucucuggaaauaaagaauccuuagaugccua

SEQ ID NO: 69544 - RNA, 61 nt, hsa
gcuggauauccugggggaggaggggaaugcgcucuggaaacacccuuccggaacccuucgg

SEQ ID NO: 69545 - RNA, 61 nt, hsa
cgcaaguccauuuuauuuccuucuugugcugcucuggaagagaggcaguagcaaagagaug

SEQ ID NO: 69546 - RNA, 61 nt, hsa
caccuugagcagccucagaucaucucugucacucuggaagggacaccccagccagggacgg

SEQ ID NO: 69547 - RNA, 61 nt, hsa
ccccuuccagggccucugcuccaaaggaggccucuggaacccaggacucugggguuuuaca

SEQ ID NO: 69548 - RNA, 61 nt, hsa
ccaagccuagagccaccagcccagcuuccuucucuggaaaagccuggaaacugggcacaga

SEQ ID NO: 69549 - RNA, 61 nt, hsa
ccaugagaucaggcgccaucuguaaagucuccucuggaaaugccaauccauccuuccccca

SEQ ID NO: 69550 - RNA, 61 nt, hsa
cgugcgucccucuuaggagagaugagucacacucuggaacuguccaagaacgaaccugcca

SEQ ID NO: 69551 - RNA, 61 nt, hsa
agaaaaugagcagauuucuuuccauugugggcucuggaaaccacauggcuucaccuguccc

SEQ ID NO: 69552 - RNA, 61 nt, hsa
ucuaccaaguacgaugucuucagacaacuuucucuggaagggucuggacuagguguugaag

SEQ ID NO: 69553 - RNA, 61 nt, hsa
aacaggcagccucaagaaugugcugagauuucucuggaaaacaagcucugccucuccgggu

SEQ ID NO: 69554 - RNA, 61 nt, hsa
gagcuccaagcacagcaaagccugacagaaucucuggaaugcaccguggcagaaaccgagg

SEQ ID NO: 69555 - RNA, 61 nt, hsa
gagaucuuggaacugaaacgcacagccagugcucuggaaauugagcuccaagcacagcaaa

SEQ ID NO: 69556 - RNA, 61 nt, hsa
cauuuccuguuuuccuuuuuucuuuggcauucucuggaaugcaaggaggagacuucauuua

SEQ ID NO: 69557 - RNA, 61 nt, hsa
ucuuuggaagccuugaguucagaaucugcugcucuggaauauuucccuucgaucuuaucuc

SEQ ID NO: 69558 - RNA, 61 nt, hsa
uauuuuaaaauagugaauauacguaaauuuucucuggaaggcugaggcacacuucaccauc

SEQ ID NO: 69559 - RNA, 61 nt, hsa
uuuggggaaacacuuugcugaaauguugggacucuggaacuagccaagaaaagagaauauu

SEQ ID NO: 69560 - RNA, 61 nt, hsa
acugcuuuuuauacauuuuguauaaggacaacucuggaaacaagccuauuuccuccagcca

SEQ ID NO: 69561 - RNA, 61 nt, hsa
uugcugaaaaaagcucuggggcugucugaggcucuggaaugcucucuggaggguuaacucu

SEQ ID NO: 69562 - RNA, 61 nt, hsa
ugacccgcuuuucuagaaaguucauaaucagcucuggaacaagcacacuugauuccucacu

SEQ ID NO: 69563 - RNA, 61 nt, hsa
gaacugcagcucacgagaccuuuugcagggacucuggaauguccucacgguauauugaugu

SEQ ID NO: 69564 - RNA, 61 nt, hsa
gcuccucugauccuuuaggguuggcgagcaucucuggaaauagcuuuugcagaggaguggu

SEQ ID NO: 69565 - RNA, 61 nt, hsa
ucugcagggcugcccucucuaacuggccuggcucuggaagggcuggugaggacucugccuc

SEQ ID NO: 69566 - RNA, 61 nt, hsa
auucaauacauuaugcuuaaauuagcaguuucucuggaauuccugucucuccuuuaaaaga

SEQ ID NO: 69567 - RNA, 61 nt, hsa
uugauaucgucauauaaagccauugcaaggacucuggaaacugccgccaaugaccaauuuc

SEQ ID NO: 69568 - RNA, 61 nt, hsa
cagcuuggcauucuucuuauucuagaggucucucuggaaaagauggagaaaaugaacagga

SEQ ID NO: 69569 - RNA, 61 nt, hsa
cucacccauaaacaguaaugacucucugacccucuggaaauauguaaugcuuccaaucuug

SEQ ID NO: 69570 - RNA, 60 nt, hsa
guguaccauacaacaaauaacaccaggaaacucuggaaugaacaguaucacauucuagga

SEQ ID NO: 69571 - RNA, 61 nt, hsa
uacuggcucugucugaguaagaaacagaauccucuggaacuugaggaagugaacauuucgg

SEQ ID NO: 69572 - RNA, 61 nt, hsa
ccucugcugucacugcucgaagcagcagucucucuggaagcaucugugucauggccaucgc

SEQ ID NO: 69573 - RNA, 61 nt, hsa
agauggacucuagaagcacugagcucccugucucuggaaguauuuaagaaaaggcugggcc

SEQ ID NO: 69574 - RNA, 61 nt, hsa
aaaaauaaaaauaaauauuggcgggggaacccucuggaaucaauaaaggcuuccuuaacca

SEQ ID NO: 69575 - RNA, 61 nt, hsa
accccauuccagauauagaauguuucuaucucucuggaagguuccugcauguuauauggcu

SEQ ID NO: 69576 - RNA, 61 nt, hsa
cuugcugaaccguuugugauugccauuugagcucuggaagccucuauugccaugagaguuc

SEQ ID NO: 69577 - RNA, 61 nt, hsa
gauucuguccgugaaaugaauuggguagagucucuggaagguuuuaagcccauuuucaguu

SEQ ID NO: 69578 - RNA, 61 nt, hsa
agcccaugcucuucuguacugucaugcccgucucuggaauguccacucccagagccugccc

SEQ ID NO: 69579 - RNA, 61 nt, hsa
ggggaggcccagggcuggugagucuagaaugcucuggaacccuacaccuagugaugugugu

SEQ ID NO: 69580 - RNA, 61 nt, hsa
ucuguccccucauuuuugagaucccccaauucucuggaacuauucugcugccccuuuuuau

SEQ ID NO: 69581 - RNA, 61 nt, hsa
ccuaggucugggugggcaguggccccauagccucuggaacugugcguucugcauagaauuc

SEQ ID NO: 69582 - RNA, 61 nt, hsa
cgcuggggccucggagacuuggaggaggacgcucuggaaccaucaucccgcuucucuccgg

SEQ ID NO: 69583 - RNA, 61 nt, hsa
ucuccccgccaccccagggccuccaagccaccucuggaaauacuuggcucugccccauggg

SEQ ID NO: 69584 - RNA, 61 nt, hsa
cccaggaggagccccgcuucaccccuucugacucuggaaaccgcaccuuuaacuuugcaga

SEQ ID NO: 69585 - RNA, 61 nt, hsa
ucccauuuucgcuuuccucugguuugaaagccucuggaaaacucaggauucucacgacucu

SEQ ID NO: 69586 - RNA, 61 nt, hsa
gggcggcccuguacuuuuuguggcuugguuucucuggaaaugucaccuuuucgggcgcagc

SEQ ID NO: 69587 - RNA, 61 nt, hsa
ggggccaaugggggccucagggggaggcccccucuggaaaugugguucccagggaugggcc

SEQ ID NO: 69588 - RNA, 61 nt, hsa
ugcacgcccaccccaugaaacucgagcaggucucuggaagccauuuguuaaaaaaaaaaaa

SEQ ID NO: 69589 - RNA, 61 nt, hsa
ccgcagacccuuaaaaaaaucacccacaacccucuggaaguggccuugcccgguccccuuc

SEQ ID NO: 69590 - RNA, 61 nt, hsa
ccuucacucagggucagcgggcaccagguugcucuggaagagcuugaggaugugguucucg

SEQ ID NO: 69591 - RNA, 61 nt, hsa
cugccgugaaaccccagccagccacaccagacucuggaacccuuuuucgacugccccaacu

SEQ ID NO: 69592 - RNA, 61 nt, hsa
uaguuggccagcgucuugcucuguucacagucucuggaaaagcugggguaguuggugagca

SEQ ID NO: 69593 - RNA, 61 nt, hsa
aagcacaaguacguuaaacaagugcuaaacgcucuggaaagcauggcuuuauuuucuuaau

SEQ ID NO: 69594 - RNA, 61 nt, hsa
auuaacugacgcuuccuuccacgaaagauuucucuggaacaugagauguuguuugauagca

SEQ ID NO: 69595 - RNA, 61 nt, hsa
ucuugaggacccccacccuccugcauccucucucuggaaggcugcauguauuguagcugug

SEQ ID NO: 69596 - RNA, 61 nt, hsa
ccccaacugggaauugagagguaaggucuuucucuggaaauccagcaguagaggaagggac

SEQ ID NO: 69597 - RNA, 61 nt, hsa
cugccccuuccauggaaaagcuggaaaaaaacucuggaacccauauccaggcuuggugagg

SEQ ID NO: 69598 - RNA, 61 nt, hsa
agugaagccuguuucguugaacuaauucuggcucuggaaauguuuuuguuuuauaguuauu

SEQ ID NO: 69599 - RNA, 61 nt, hsa
cauuauuaacugauuaaugcacuuugaaguucucuggaauuaauuauuuuaacuuggccua

SEQ ID NO: 69600 - RNA, 61 nt, hsa
acuucccacugauccauggggccuuuaagcccucuggaagcuuccauuaaagaugauuauu

SEQ ID NO: 69601 - RNA, 61 nt, hsa
gcaacugcugcaggaugccuguaguagggaacucuggaaguguauugggcugaggugggau

SEQ ID NO: 69602 - RNA, 61 nt, hsa
ucccugcacucccuccuggagcucugugggucucuggaagaggaaccaggagaagggcugg

SEQ ID NO: 69603 - RNA, 61 nt, hsa
aaaauuguuuauacacucuuuccuccaugagcucuggaagguauaugcaucuucuguaaua

SEQ ID NO: 69604 - RNA, 61 nt, hsa
ugauagucccuugaacacacaugcugccgagcucuggaaaaaccccacaggugaguccuca

SEQ ID NO: 69605 - RNA, 61 nt, hsa
ccauuuucugguucuguguccucugccugggcucuggaagaggccuucccauggccauuuc

SEQ ID NO: 69606 - RNA, 61 nt, hsa
uggcagagaugcauuccagagaugcacuccgcucuggaacucacucucagccacagggagc

SEQ ID NO: 69607 - RNA, 61 nt, hsa
acuguaggccaauauagauuugccuuuaaaacucuggaagagcuacauagucaucauuagu

SEQ ID NO: 69608 - RNA, 61 nt, hsa
cucguuguggacuguaauuaaaugcuuugcccucuggaacuugauuuuuguguaucugaga

SEQ ID NO: 69609 - RNA, 61 nt, hsa
gcuuaccugccacagagcuuuucugcaugaacucuggaacagaaaggcccuguaaagcccu

SEQ ID NO: 69610 - RNA, 61 nt, hsa
ugggcgcaucccaagacagccagcagguugucucuggaaacgaccagaguuaagcucucgg

SEQ ID NO: 69611 - RNA, 61 nt, hsa
uuucaaaagcuuaaggcccaaauacaaacuucucuggaauaaacgugguguuuuauuuucu

SEQ ID NO: 69612 - RNA, 61 nt, hsa
aagccuuggcucguucucuucucucuucaaucucuggaaaaauaaguacauauaguugaua

SEQ ID NO: 69613 - RNA, 61 nt, hsa
ccuggaaauuaaacccugccccacuucucuacucuggaaguccccgggagccucuccuugc

SEQ ID NO: 69614 - RNA, 61 nt, hsa
gccagugagcauuacuuuuaaauaggaccuucucuggaaaauuauuuugguuaauguaaua

SEQ ID NO: 69615 - RNA, 61 nt, hsa
ucccucccauauuuucuuuuugcugcuuuugcucuggaacuuugcuuuuagcagggaaagc

SEQ ID NO: 69616 - RNA, 61 nt, hsa
ucaugaacacuaagauuaauugugucuguaucucuggaacugggugcucauguugguuuua

SEQ ID NO: 69617 - RNA, 61 nt, hsa
uggacuccguggggcuccaccagccagaagccucuggaaggcaacgaaggcaaugcugcuc

SEQ ID NO: 69618 - RNA, 61 nt, hsa
cuggaaccucugugacgccaguucucccugacucuggaaccucugugauccuuugcagguu

SEQ ID NO: 69619 - RNA, 61 nt, hsa
ucacucagcugcuccucucaguucucccugacucuggaaccucugugacgccaguucuccc

SEQ ID NO: 69620 - RNA, 61 nt, hsa
ucuguguacagcgcugugcauguuacauuugcucuggaaacaucucugggguuugcuuguu

SEQ ID NO: 69621 - RNA, 61 nt, hsa
cugugaugcucccaagcaaaggaaaugcaagcucuggaaauucguuaauguauuugauguc

SEQ ID NO: 69622 - RNA, 61 nt, hsa
agggccuccagcccucucacugugucccucucucuggaaaggaggaaggagccuauggcau

SEQ ID NO: 69623 - RNA, 61 nt, hsa
agaagcacuuggcuggcugagcaaauucauccucuggaaauauucucucucagccacagug

SEQ ID NO: 69624 - RNA, 61 nt, hsa
acccugccccuggcugggagcuccccuggggcucuggaaccugaagcccugagaaggagag

SEQ ID NO: 69625 - RNA, 61 nt, hsa
gacuuugauuccugcgccuuuuaguuuugaacucuggaauuccucugcccccuccccaaca

SEQ ID NO: 69626 - RNA, 61 nt, hsa
ggaauacccaaggucauguagccagugagugcucuggaaagccaaagcagcucaucccuuc

SEQ ID NO: 69627 - RNA, 61 nt, hsa
ugguaagaguagcuggguuuucuaagccacucucuggaaucucuuuguguuagggucucga

SEQ ID NO: 69628 - RNA, 61 nt, hsa
ucacuccagucccaccccacgccugacuccccucuggaaacugcaggccagaugguugcug

SEQ ID NO: 69629 - RNA, 61 nt, hsa
guaugcauucauuuauuccuugcuggacaaacucuggaagcagcgugugaaacagcggggg

SEQ ID NO: 69630 - RNA, 61 nt, hsa
gguagcagcuggugggacacugaucugugagcucuggaaugucugcuuagaauucugagag

SEQ ID NO: 69631 - RNA, 61 nt, hsa
ucacgccaggaggcuguggcugcugugggcccucuggaauugugcuccucacaaaguuucc

SEQ ID NO: 69632 - RNA, 61 nt, hsa
uggcgucuguucugggagcacggaugauaagcucuggaagcuggcaguguguaaagcacug

SEQ ID NO: 69633 - RNA, 61 nt, hsa
agugggcgcaggcacgccaggccuucuuuagcucuggaaagaauaaggcugccuuggaggc

SEQ ID NO: 69634 - RNA, 61 nt, hsa
ggauuuguggcagggauuccacucagaaccucucuggaauuugugccugaugugccuucca

SEQ ID NO: 69635 - RNA, 61 nt, hsa
uccuacaaguuaaccaguugcacuacauaaucucuggaaauuaauuuucucuuuaggagaa

SEQ ID NO: 69636 - RNA, 61 nt, hsa
ugucuacccaaucaacaguuuucccucuuugcucuggaaauauuuguacucauauagcaua

SEQ ID NO: 69637 - RNA, 61 nt, hsa
aaugcuuuuccaacccaugagugcuaagagccucuggaagggagggcuucaggcccgaagg

SEQ ID NO: 69638 - RNA, 61 nt, hsa
gaaauuaccugauaacuuaagacucugugaucucuggaaucaccauauguuucuuuuuugu

SEQ ID NO: 69639 - RNA, 61 nt, hsa
caggggugguuacauagaccagcagcuacagcucuggaaauugaaaucauaaucugucaau

SEQ ID NO: 69640 - RNA, 61 nt, hsa
gcuguggaguaagagggaaugcggugaggcacucuggaauaugacccuaccagagguugga

SEQ ID NO: 69641 - RNA, 61 nt, hsa
uaacucuagaaauucucaguaugggguuucccucuggaaaaagaaaaucugaagacauuac

SEQ ID NO: 69642 - RNA, 61 nt, hsa
uuaaacaaaccauccauaacuuggaauacugcucuggaaugaaaaggaacuaacuguugau

SEQ ID NO: 69643 - RNA, 61 nt, hsa
ugcccuuugauguccuugagcuacucuucagcucuggaaguuguggacaaaccguaggaau

SEQ ID NO: 69644 - RNA, 61 nt, hsa
guguuuccgugacuuagcugugucccuguagcucuggaacugaaggaacuagguaggagag

SEQ ID NO: 69645 - RNA, 61 nt, hsa
agcaccccgggaucauuuucuagguucauuucucuggaacauuugcuguagcaucuggucu

SEQ ID NO: 69646 - RNA, 61 nt, hsa
auucccagagcagacuuaccuggucaccgcucucuggaaaaccaaggcuccccgugcuucu

SEQ ID NO: 69647 - RNA, 61 nt, hsa
aagacuugcacaaauacggauccugcacugacucuggaaaaggcauauauguacuaguggc

SEQ ID NO: 69648 - RNA, 61 nt, hsa
guaaguacauaauugugaauucauaaguuaucucuggaaagagacaugagaaccugguaac

SEQ ID NO: 69649 - RNA, 61 nt, hsa
aacaguaucuuaaguuuaacugggcacuucccucuggaaaucacaguguugugcaccagga

SEQ ID NO: 69650 - RNA, 61 nt, hsa
gcucuuuaaaaauaaauugcucuggucccaccucuggaaaucugauucagccagcauggau

SEQ ID NO: 69651 - RNA, 61 nt, hsa
agaaaagaaaagcagagucagcuacugagagcucuggaaagaaggaugucaagaaggugaa

SEQ ID NO: 69652 - RNA, 61 nt, hsa
agagagaugacauaaccauaugucauguagccucuggaaaaguccucuguauccucaugag

SEQ ID NO: 69653 - RNA, 62 nt, hsa
uccuggaccugggaggccccugugagggccagcucuggaaaaaccugggaguugaugccgga

SEQ ID NO: 69654 - RNA, 62 nt, hsa
gcaacugucacgugugcuagaagguucgaugccucuggaaugcaugugauacucaucuccau

SEQ ID NO: 69655 - RNA, 62 nt, hsa
aggacacagggauggauaccaccuacccucgccucuggaauggccuacccaacccgagaaga

SEQ ID NO: 69656 - RNA, 62 nt, hsa
agaaaccaaagucugccgcccaccucgcuccccucuggaaucuuccccaagggccaaaccca

SEQ ID NO: 69657 - RNA, 62 nt, hsa
aucuccugacccucccacucccaucuccuuaccucuggaaccccccaggcccuacaaugcuc

SEQ ID NO: 69658 - RNA, 62 nt, hsa
ugacugucacucggcucucccuacccauuuggcucuggaagcugcuuggcccccccagauca

SEQ ID NO: 69659 - RNA, 62 nt, hsa
auucuggaccaccaccugggaccaaccuucagcucuggaaccuucauaaagcaggucagcgu

SEQ ID NO: 69660 - RNA, 62 nt, hsa
uauccaugcucuguggccaggugccugccacccucuggaacucacaaaagcuggcuuuuauu

SEQ ID NO: 69661 - RNA, 62 nt, hsa
ugggaguuauggggucaucaaggaccuugccucucuggaaucugucaacccaguuuugggcu

SEQ ID NO: 69662 - RNA, 62 nt, hsa
gcgaccccaccugccauuaccuucagggccuccucuggaagagaacccauucucagagugca

SEQ ID NO: 69663 - RNA, 62 nt, hsa
cagacagacagaaagccagaggcuuagggaaacucuggaacccagacaagaaucuuuucgcu

SEQ ID NO: 69664 - RNA, 62 nt, hsa
aacucccaaauugucaaguccugcuuaacuuucucuggaaaauagaccccuucucaacauca

SEQ ID NO: 69665 - RNA, 62 nt, hsa
auauuauuaauaacccccucugaauuucaugucucuggaauugaggugguagugaacagcag

SEQ ID NO: 69666 - RNA, 52 nt, hsa; identical to SEQ ID NO: 69143

SEQ ID NO: 69667 - RNA, 62 nt, hsa
gcguccugugacucgccuugccacaucugugucucuggaacccaggaccucuggaccucagg

SEQ ID NO: 69668 - RNA, 62 nt, hsa
aaccccagccuaaugaaacccuagguguugggcucuggaaugggacuuugucccuucuaauu

SEQ ID NO: 69669 - RNA, 62 nt, hsa
auauauauauaaaaccagagcugacaaugacacucuggaacauugcauaccuucuguacauu

SEQ ID NO: 69670 - RNA, 62 nt, hsa
aaggcagagggaugaaaugccaagacucuaugcucuggaaaaccugaggccaaauauugauc

SEQ ID NO: 69671 - RNA, 62 nt, hsa
auacuauguuaugaaugguauuaaauuuuagucucuggaacauccaaaaccaagcaaaggga

SEQ ID NO: 69672 - RNA, 62 nt, hsa
acagcaggauguugaauugaucaucagaugcccucuggaaugguuagcauccaaggugacag

SEQ ID NO: 69673 - RNA, 62 nt, hsa
aaggcuagauccuucccauaguaucaucuguccucuggaaugacucuccugucccuaaaggg

SEQ ID NO: 69674 - RNA, 62 nt, hsa
ccucuugcuccucauuccuccccugcccuuuucucuggaauaucuaagaugugagcugcauu

SEQ ID NO: 69675 - RNA, 62 nt, hsa
gacgagacugagguuaaacaucagaaaaaaaccucuggaaugaccuuccucauuccaggagg

SEQ ID NO: 69676 - RNA, 62 nt, hsa
auuuguuacuuaaauauauagagaccaguuuucucuggaaguuuguuuaaaugacagaagcg

SEQ ID NO: 69677 - RNA, 62 nt, hsa
cuaaccccucccucaauaaauacauuacuguacucuggaauuuaggcaaaaccuuaaaucuc

SEQ ID NO: 69678 - RNA, 62 nt, hsa
uauuuuugaaguaaauuaaacauuuuucacaucucuggaaauuuagaguucuagaccucugg

SEQ ID NO: 69679 - RNA, 62 nt, hsa
uauauuuauuguuagaaaaugacuuauuucugcucuggaauaaaguugcagaugauucaaac

SEQ ID NO: 69680 - RNA, 62 nt, hsa
gcuacgugguggccgucugccaacuccagcaucucuggaaaaucuccacgcugaaugugauu

SEQ ID NO: 69681 - RNA, 62 nt, hsa
cggacaucaagggcggacaccaccaaggggcccucuggaacuugagaccacuggaggcacac

SEQ ID NO: 69682 - RNA, 62 nt, hsa
gugugacccugcucuuccagcuccugggccagcucuggaagggcuguauuugggccuaaucc

SEQ ID NO: 69683 - RNA, 62 nt, hsa
gauauggucauuuacaagacacaucuugugcccucuggaagcucauaggguugugaggcaaa

SEQ ID NO: 69684 - RNA, 62 nt, hsa
cucguggcuuggauagaauccagggcucguggcucuggaaugugucugaacuugcugccucc

SEQ ID NO: 69685 - RNA, 62 nt, hsa
gagacgauagggcauaugaaauucacuaaacucucuggaaaaaaaauauguauauauuaaaa

SEQ ID NO: 69686 - RNA, 62 nt, hsa
uaaaaccaucaaauuuuauaauugagaugauacucuggaaaaacaugucauuucauuuucag

SEQ ID NO: 69687 - RNA, 62 nt, hsa
gcuccaggccacuaggccucccuugcagccaacucuggaaggcagaggaguaagagaggaag

SEQ ID NO: 69688 - RNA, 62 nt, hsa
uucaaucucuucuucaaaucaaaaugagaauucucuggaauaacagauucuuguuugguaaa

SEQ ID NO: 69689 - RNA, 62 nt, hsa
cuuuccuagaauuuaaaaauaaaaaagucuuccucuggaaagagaagucacacagacaauca

SEQ ID NO: 69690 - RNA, 62 nt, hsa
gguuuugaugcuagugaucuucagaucuuucucucuggaaaugugcagagagugucaguuuc

SEQ ID NO: 69691 - RNA, 62 nt, hsa
gagaaacaaaacuaauuuuuggagcagauggucucuggaauugcauauccugcuagugauuu

SEQ ID NO: 69692 - RNA, 62 nt, hsa
cauaggcucuuuuugcugccugugagcagucccucuggaaagaaacaugugaguaagugaga

SEQ ID NO: 69693 - RNA, 57 nt, hsa; identical to SEQ ID NO: 69170

SEQ ID NO: 69694 - RNA, 62 nt, hsa
aagagccuggggaggagcuuaaaacucaaccacucuggaauuuacccauagaagacgggaag

SEQ ID NO: 69695 - RNA, 62 nt, hsa
aggcuggagacagggguuugaggugggggccucucuggaagcacauuuggagggaaagacaa

SEQ ID NO: 69696 - RNA, 62 nt, hsa
guggggugauagggugggcuaaaaaccaugcacucuggaauuuguuguauuuucucccagua

SEQ ID NO: 69697 - RNA, 62 nt, hsa
auugugaucuaggcugcugggcugaauucucccucuggaaacugaguuacaaccaccaauac

SEQ ID NO: 69698 - RNA, 62 nt, hsa
uggcucauacacacuuaaaaggcuuaauguuucucuggaaagcgucccagaauauuagccag

SEQ ID NO: 69699 - RNA, 62 nt, hsa
ucccuauuuguuuucuucuguauguuagggugcucuggaagagaggaaugccugugugagca

SEQ ID NO: 69700 - RNA, 62 nt, hsa
ccccacuucuucccuccagccugcaugcccuccucuggaacugggauuaaacagauacccaa

SEQ ID NO: 69701 - RNA, 62 nt, hsa
cuacagaggugaccaggccuggcaguugaaaucucuggaagagggaacauguggggacuacu

SEQ ID NO: 69702 - RNA, 62 nt, hsa
ugaugacccucugcgguugucaggcgugaauccucuggaaggaacuguuugcaguuguaugc

SEQ ID NO: 69703 - RNA, 62 nt, hsa
aucucuuaacagguugaaguuauugcaaaacacucuggaaaguaauaauuacaucauaauca

SEQ ID NO: 69704 - RNA, 62 nt, hsa
cugcagaugcuacugacugcuugcuagguagccucuggaaagcauuccccauccaucacucc

SEQ ID NO: 69705 - RNA, 62 nt, hsa
accccuaccccagucacucgccccuuccucaucucuggaauuuggccaggcagucccagaag

SEQ ID NO: 69706 - RNA, 62 nt, hsa
gugagagcccgucacaguccuggguguggcugcucuggaagaauuaggaggcagccauaaua

SEQ ID NO: 69707 - RNA, 62 nt, hsa
uuaauggguuauuucucuuugaggguggcuuucucuggaacauugguuagagcagcuuuguu

SEQ ID NO: 69708 - RNA, 62 nt, hsa
agaugcagggauuggccagcuggguugguuugcucuggaauggcuaacucuugccugcuuug

SEQ ID NO: 69709 - RNA, 62 nt, hsa
uaccaggcuguaaaagcaaaaccucguaucagcucuggaacaauaccugcaguuauucuuca

SEQ ID NO: 69710 - RNA, 61 nt, hsa; identical to SEQ ID NO: 69187

SEQ ID NO: 69711 - RNA, 62 nt, hsa
ccaguccugaguuugcuacuuacuucuguggccucuggaaccuuauccaaccucuuggugcu

SEQ ID NO: 69712 - RNA, 62 nt, hsa
aaaaccaccaggaaugaauucacuccccacuucucuggaaccucaggacccgcccauuucuc

SEQ ID NO: 69713 - RNA, 62 nt, hsa
gccucuggguacaaaagugccucaacgacaugcucuggaaaucccaaaugccacagucugag

SEQ ID NO: 69714 - RNA, 62 nt, hsa
gggagaaggcgcuaccugcgugggacccucuucucuggaaaccuaauccuccuuucauuucc

SEQ ID NO: 69715 - RNA, 62 nt, hsa
uuuuuuuuuccccaguauugcccuggagcugucucuggaaaguagcuggcgagguuaccuua

SEQ ID NO: 69716 - RNA, 62 nt, hsa
gauucaagauagcugugauuucucucaccguucucuggaaauggcaucagauuuaaggauaa

SEQ ID NO: 69717 - RNA, 62 nt, hsa
agccucucccugccaaagcccaacucccagggcucuggaaauggugaggcgaggggcuugag

SEQ ID NO: 69718 - RNA, 62 nt, hsa
acauuccuccauguccucacggcuggauuucucucuggaaaggauuuucauucaucauggug

SEQ ID NO: 69719 - RNA, 62 nt, hsa
ccucuguaggccaguaguucucaaaguguggucucuggaagagcaguaucagcaucaucugg

SEQ ID NO: 69720 - RNA, 62 nt, hsa
uuaucuuacugaacaccuguagucccagcuuucucuggaaguggucguauuugagcaggaug

SEQ ID NO: 69721 - RNA, 62 nt, hsa
aggaagggggcagggacgugaccuugacuuaccucuggaaagggucccagccuagacugcuu

SEQ ID NO: 69722 - RNA, 62 nt, hsa
cccgguugcuggucagguccccauggcuuguucucuggaaccugacuuuagauguuuuggga

SEQ ID NO: 69723 - RNA, 62 nt, hsa
gggguggcgcucagaccccacccuacgcucaucucuggaaggggcagcccugaguggucacu

SEQ ID NO: 69724 - RNA, 62 nt, hsa
cgggcaagcacuaccaggcugugggucugcaccucuggaagguagagaagcggcgggucaau

SEQ ID NO: 69725 - RNA, 62 nt, hsa
ccuccccuuuaaauuaaaaaaaauguauguaucucuggaagucaauaauuuccagugagcgg

SEQ ID NO: 69726 - RNA, 62 nt, hsa
gauguucaguuuagaaccauuuugucugcucccucuggaagccuugcgcagagcuuacuuug

SEQ ID NO: 69727 - RNA, 62 nt, hsa
uggucuucuuagaguugcaggauacacuugcucucuggaaguguguccuuacccuucugcag

SEQ ID NO: 69728 - RNA, 62 nt, hsa
acugaucaggugucuauaacauuuuucauucucucuggaaacagacucagguuucuuuggac

SEQ ID NO: 69729 - RNA, 62 nt, hsa
uuuccccuaaguccuaacagaaugguauauuccucuggaaaaagaugaacgucaccaaugga

SEQ ID NO: 69730 - RNA, 62 nt, hsa
cugagcacaggccgauggaggugguucaaauccucuggaacauagccaagaccaggagaaga

SEQ ID NO: 69731 - RNA, 62 nt, hsa; identical to SEQ ID NO: 69712

SEQ ID NO: 69732 - RNA, 62 nt, hsa
uucacauuaagaaugugccugaggcugcuuuacucuggaauagucucagaucuaaaauuucc

SEQ ID NO: 69733 - RNA, 62 nt, hsa
gcaguugaucagacugaaaaacgguuuuuagucucuggaaaaagacugauuuugcuuuuuuu

SEQ ID NO: 69734 - RNA, 62 nt, hsa
acuucaaucuagaauucuccaguagguaccaucucuggaaaaaagcugggucucauguuuga

SEQ ID NO: 69735 - RNA, 62 nt, hsa
ccugguucccugccucuguauucagguguggccucuggaaccugacuccguuaggacgaaca

SEQ ID NO: 69736 - RNA, 62 nt, hsa
uauggaucagugacuguaguaggaguuugaggcucuggaacucucacauauucaagucuuua

SEQ ID NO: 69737 - RNA, 62 nt, hsa
uugaaggcaagugacuucaguugagggcaagucucuggaaaagaggcuguaggcaucuggca

SEQ ID NO: 69738 - RNA, 62 nt, hsa
gcccuggccucugccugccucccgccugugcacucuggaaccucuggccucaggggaccugc

SEQ ID NO: 69739 - RNA, 62 nt, hsa
uuucucuugugucccuacucauugaaaccaaacucuggaaaggacccaauguaccaguauuu

SEQ ID NO: 69740 - RNA, 62 nt, hsa
gcaguccacuugcugaagaaguugugucauuucucuggaagaauuuccaaaauucuggauuu

SEQ ID NO: 69741 - RNA, 62 nt, hsa
uucaauauccacuucuuucagccuacuguagacucuggaaguauacuuuuugcauauguaag

SEQ ID NO: 69742 - RNA, 62 nt, hsa
guuauaggccuugccaggguuucgagaagcugcucuggaauuugcaagucauggcugugccc

SEQ ID NO: 69743 - RNA, 62 nt, hsa
gaagcauuugugguaguaaaggaaaaccaacccucuggaaaauacauuuugagaaucucaaa

SEQ ID NO: 69744 - RNA, 62 nt, hsa
guggcuugauguggcaagccgaaaccacuuggcucuggaaaucuaaguucauacugguuuaa

SEQ ID NO: 69745 - RNA, 62 nt, hsa
uuuuuacuuuuauauuuuugcuugaaucuuaacucuggaaaucaccugauguagaagaagac

SEQ ID NO: 69746 - RNA, 62 nt, hsa
aaggaaucgugcucucaaugcaaagugucauucucuggaauugcaccuggcucaggaaagga

SEQ ID NO: 69747 - RNA, 62 nt, hsa
uggccuauggagagacaggccuuucucucagccucuggaagccaccugcucuuuugcucuag

SEQ ID NO: 69748 - RNA, 62 nt, hsa
gcuccuagagaagaacaauccucauggagaaacucuggaaaccuugacaauggcaacagugu

SEQ ID NO: 69749 - RNA, 62 nt, hsa
ccucuccaagcccuccucugaaccagcuaucccucuggaaugcagcugaccaaacaaauucc

SEQ ID NO: 69750 - RNA, 62 nt, hsa
cugcaauaacaggaacaugagacuucgcaaaucucuggaaaauaauauccaaaugaaauuaa

SEQ ID NO: 69751 - RNA, 62 nt, hsa
cuguuuucaauauaauucuugauuucauuuuucucuggaauauauuggccuucuacagcuau

SEQ ID NO: 69752 - RNA, 62 nt, hsa
cccagggaagccccugguucugucccuggagacucuggaaauccuuuugcauuaaaaggacu

SEQ ID NO: 69753 - RNA, 62 nt, hsa
gugaccuggucuggucaggcaaugcccugcggcucuggaaagcaacuucaucccagcugcug

SEQ ID NO: 69754 - RNA, 62 nt, hsa
gguuaugcccaucuccauagccagaccaagcacucuggaagccaggguugggugcuuauuua

SEQ ID NO: 69755 - RNA, 62 nt, hsa
auaugaaccugaagauuaaaacugaagauuuccucuggaagcuaccacaugcaaacauacaa

SEQ ID NO: 69756 - RNA, 62 nt, hsa
acuucagccugugaggggaggguugagggaggcucuggaaagcccagccacaccugaguccc

SEQ ID NO: 69757 - RNA, 62 nt, hsa
uccuccaggaucuagccuucuaucuaccucuucucuggaauguuuauggugguucagaagaa

SEQ ID NO: 69758 - RNA, 62 nt, hsa
cagaagccaccuggaagacccaguguuuccaucucuggaaucucuguuuuaugcuaaaugga

SEQ ID NO: 69759 - RNA, 62 nt, hsa
ugaguaaaauggaauaauaccuaacaggcaggcucuggaaguuggaaaucacauacacacac

SEQ ID NO: 69760 - RNA, 62 nt, hsa
caaugaaccaccugauuacaagagccucauuccucuggaacgugcagucaucaauggucagu

SEQ ID NO: 69761 - RNA, 62 nt, hsa
gcuguguuuaaauaaauugaaaacuacguaaacucuggaaaguauucuauaagaaaaagcug

SEQ ID NO: 69762 - RNA, 62 nt, hsa
uguccaguaaagagauugauuuguuuguauggcucuggaauaacucauucguuuaugaacac

SEQ ID NO: 69763 - RNA, 62 nt, hsa
aacuuuguauuuuugaagcggcaaacucuguucucuggaaugcucugaaguuauggcuggga

SEQ ID NO: 69764 - RNA, 62 nt, hsa
agcccaugggggcuggaggggggcagcugggacucuggaaucuucuuuauaauaaaagccuu

SEQ ID NO: 69765 - RNA, 62 nt, hsa
aagacccccuccagaagcauacuggaagccaccucuggaaaagccucauauggugauaugcc

SEQ ID NO: 69766 - RNA, 62 nt, hsa
cccuuugccagacagcucugucuccccauguccucuggaacagcugggcaugggucauggcc

SEQ ID NO: 69767 - RNA, 62 nt, hsa
aguaaacaauggugauuuuauuuauuuuuacucucuggaaaaggagauaauacaauuccaga

SEQ ID NO: 69768 - RNA, 62 nt, hsa
uaaaauugaucggauugauuaaaaaacaaauucucuggaauuugugcguucaugcuuuuucg

SEQ ID NO: 69769 - RNA, 62 nt, hsa
uuuuuuguuucucagucugcuuuagcuuuuaacucuggaagcgcaugcacacugaacucugc

SEQ ID NO: 69770 - RNA, 62 nt, hsa
caaaauagccuauccuuaauaaauccuccacucucuggaaggagacugaggggcuuuguaaa

SEQ ID NO: 69771 - RNA, 62 nt, hsa
uguauaguuccccguguucacuaacaugcccucucuggaaagcauauguauauaacaugugu

SEQ ID NO: 69772 - RNA, 62 nt, hsa
cuggccauuggugcguguuucauucagaucaccucuggaaucucugugguugugaaggcaau

SEQ ID NO: 69773 - RNA, 62 nt, hsa
gagcacagggagcuucuguuguucugaucuaucucuggaaaaccagccauuccuccucccug

SEQ ID NO: 69774 - RNA, 62 nt, hsa
ccgagccucaggccaaggaccccugaugcagacucuggaaucccuggcccaaaggccugucu

SEQ ID NO: 69775 - RNA, 62 nt, hsa
caccugauggcuguucucccaccgggucugggcucuggaaggagccagaugcccccagaaag

SEQ ID NO: 69776 - RNA, 62 nt, hsa
ucccgaaguaauaagugaggacgaaugcacugcucuggaacauaacccagugcuaacugggg

SEQ ID NO: 69777 - RNA, 62 nt, hsa
aauugcuuuucucuuaccaguaugauuuguaacucuggaacacuauucuuacagaaugccuu

SEQ ID NO: 69778 - RNA, 62 nt, hsa
cauuaagaugagcccuaauauguaagauuuuccucuggaauggaugugagaaauguaaauuu

SEQ ID NO: 69779 - RNA, 62 nt, hsa
agaacuaaauuguuucuaaauguagauggucccucuggaaaagcaguuuucagcaggggugg

SEQ ID NO: 69780 - RNA, 62 nt, hsa
augcagaaaaaaaagugcugcaguuuagauaccucuggaauuuuuccacagugucacagguu

SEQ ID NO: 69781 - RNA, 62 nt, hsa
aaaacuugaaucaggauuuuaugccccacauacucuggaacuugaaguauaauauacuuaau

SEQ ID NO: 69782 - RNA, 62 nt, hsa
caucuguaucuuaaauggccccaggcaucugccucuggaaaacuauugagccuugcauguac

SEQ ID NO: 69783 - RNA, 62 nt, hsa
uggguggcagccccugguagaaugcuggauuucucuggaaucuagaagugccauauuuuagu

SEQ ID NO: 69784 - RNA, 62 nt, hsa
cauccgucucuguccgcguccuuuccucuccucucuggaagguuuugcuucuuacgaacgcc

SEQ ID NO: 69785 - RNA, 62 nt, hsa
gcucagcuaccacuuccccuucccucugcacccucuggaacccuggcccaauuccucagacc

SEQ ID NO: 69786 - RNA, 62 nt, hsa
ucuagauuuucuucugugcuucucucuaucugcucuggaauggaugagugaauguguucugg

SEQ ID NO: 69787 - RNA, 62 nt, hsa
cagcuucagaaauguuuuaaaagggacuuuagcucuggaacucaaaaucaauuuauuaagag

SEQ ID NO: 69788 - RNA, 62 nt, hsa
gaauuuuagcagaugguacuuuucucagugaccucuggaauaaaagaacugacuuuugauag

SEQ ID NO: 69789 - RNA, 62 nt, hsa
uuaaccaggagacuacuccugugacuguggagcucuggaaggcuuggugggagugaauuugc

SEQ ID NO: 69790 - RNA, 62 nt, hsa
aucacuuagcuccucauaacaagucuaacuggcucuggaaagcugaaagggcugcacuggaa

SEQ ID NO: 69791 - RNA, 62 nt, hsa
auccuucuccugaaguucagccacccugaggccucuggaaagcaaagggcuccucuccaguc

SEQ ID NO: 69792 - RNA, 62 nt, hsa
aauccugcuaaaggagcaaagccuuguauuaccucuggaagacaacaaaaacaauuggcaac

SEQ ID NO: 69793 - RNA, 62 nt, hsa
aaaucaguaucuagaugguuuuuaaauguauucucuggaaauuguuuuauguaaaauaaaug

SEQ ID NO: 69794 - RNA, 62 nt, hsa
gcagauaugaagagcauuuuaagaggugcagccucuggaaguggaucaaacuagaacucaua

SEQ ID NO: 69795 - RNA, 59 nt, hsa; identical to SEQ ID NO: 69272

SEQ ID NO: 69796 - RNA, 62 nt, hsa
auauuuuguguccccaccuugauguuacaugacucuggaacaauaugaacuggauuuaagaa

SEQ ID NO: 69797 - RNA, 62 nt, hsa
auucuuuuacuuaaccaggcuuauggcaugaucucuggaacaaauuuguaggaaaaaauuac

SEQ ID NO: 69798 - RNA, 62 nt, hsa
gagggcaccaaguuuuccuuuuuucuaaauagcucuggaaccaggcuuguaauccauagcau

SEQ ID NO: 69799 - RNA, 62 nt, hsa
uuguagaaaagguuuccucuagaacugaauuccucuggaauugagugauggacuucacaaca

SEQ ID NO: 69800 - RNA, 62 nt, hsa
aauaucugggccuuggaaggaaggacacagggcucuggaaggaggaggcugcaugccugaag

SEQ ID NO: 69801 - RNA, 62 nt, hsa
gacuccaguugccucagguugguucugcugugcucuggaaaguaacugcagccaccagguau

SEQ ID NO: 69802 - RNA, 62 nt, hsa
auguuuuuagaggggcaaaaauauuuugcaagcucuggaauuguugaauguauucuuuuaua

SEQ ID NO: 69803 - RNA, 62 nt, hsa
uauucuugagggacaaugccaauagguauauccucuggaaaaggcuuucaugauuuggcaug

SEQ ID NO: 69804 - RNA, 62 nt, hsa
ggaagaaaagagcugggacaauaaaacacuggcucuggaaucuggaauguuaaguccaggcc

SEQ ID NO: 69805 - RNA, 62 nt, hsa
uuuauucaagauugugcucuucuaucaaaagccucuggaaauaaauguuccgggaucauguu

SEQ ID NO: 69806 - RNA, 62 nt, hsa
aaggaaaaacuaagagaaugaaaaguauuugccucuggaaagaacaacuggcaggacuguug

SEQ ID NO: 69807 - RNA, 62 nt, hsa
ugaccauuaagaaccagaaaaauaauuaaucucucuggaaaaaggaaagcuaaagaagacua

SEQ ID NO: 69808 - RNA, 62 nt, hsa
uuagaauguaauauguaaacugugauuugguccucuggaaaaaaaaaaaugaaaugaagagu

SEQ ID NO: 69809 - RNA, 62 nt, hsa
aucuccugugaucugugcuagcugugaggcagcucuggaacgugaagagcuguuugguuuga

SEQ ID NO: 69810 - RNA, 62 nt, hsa
uucccaucucaagcauauaaguugaccugcaucucuggaaggaccuugagauugaugcauuu

SEQ ID NO: 69811 - RNA, 62 nt, hsa
gucuuauccuuugcucuguuuuucucuucaggcucuggaaaaucagaucugugacuuaaucu

SEQ ID NO: 69812 - RNA, 62 nt, hsa
aauaagaaggcccuguugacgggcugucuuggcucuggaauucaugcauccuggccuugcca

SEQ ID NO: 69813 - RNA, 62 nt, hsa
cuuuuuacacuuauuuauuaucauucucacuucucuggaagccacaacuggugucagggcuc

SEQ ID NO: 69814 - RNA, 62 nt, hsa
cagccgccugcccgggagaacccugccugaagcucuggaaacuuguggguggggcccaggga

SEQ ID NO: 69815 - RNA, 62 nt, hsa
caaacacccugcugcuggcugccaggcaggcccucuggaagggaaggggcaggacucaucag

SEQ ID NO: 69816 - RNA, 62 nt, hsa
uuguagcagaguacauaacuacauaaugccaacucuggaaucaaauuuccuuguuugaaucc

SEQ ID NO: 69817 - RNA, 62 nt, hsa
ucuguggaugccagcuuuggaaucagagccgccucuggaauaccugugcuuccagaguuagc

SEQ ID NO: 69818 - RNA, 62 nt, hsa
ccaggcgcgguggcucaggccuguaaucccagcucuggaagcugaaggauagcuugagccca

SEQ ID NO: 69819 - RNA, 62 nt, hsa
uuuccuaucauuuuauuaucaccaugcaaugccucuggaauaaaacauacaggagucugucu

SEQ ID NO: 69820 - RNA, 62 nt, hsa
augugaccacauacguguuaggaggcugcaugcucuggaagccuggacucuaagcuggagcu

SEQ ID NO: 69821 - RNA, 62 nt, hsa
auucuagauggaggaggcacugaugcuuguaacucuggaaagaggccuacacccaagggcua

SEQ ID NO: 69822 - RNA, 62 nt, hsa
uaagaugauauuucagaagaguuggcugccuucucuggaaacaaggaaaacccaauaauucc

SEQ ID NO: 69823 - RNA, 62 nt, hsa
cgccugaagccuuccucuggcuucacagaaugcucuggaacucuggggucuggucagggagu

SEQ ID NO: 69824 - RNA, 62 nt, hsa
auucagggcccccucagcugucuccucccucccucuggaaaggaggguggggcucaggggcc

SEQ ID NO: 69825 - RNA, 62 nt, hsa
gaaaaugccaucucuuuuuaguugaaggaaaacucuggaaguaggugccauuggucauucug

SEQ ID NO: 69826 - RNA, 62 nt, hsa
agcucucucgacagcaaaugguuuccccucaccucuggaauuaaagaaggaacuccaaaguu

SEQ ID NO: 69827 - RNA, 62 nt, hsa
auacaaaaccacuucagagaccaggguaucuccucuggaaggaucuaagagaagguaagaca

SEQ ID NO: 69828 - RNA, 62 nt, hsa
acgugugaucuuugaaaaccuuggcuuuagcccucuggaaucagagcuuacccaccauagua

SEQ ID NO: 69829 - RNA, 62 nt, hsa
cauggagcagauugaaaugcaaaaacccacaccucuggaagauaccuucacggccgcugcug

SEQ ID NO: 69830 - RNA, 62 nt, hsa
augaguaaucaacaaaaucugccagagagucccucuggaaccauauaaaguuccuggcuuug

SEQ ID NO: 69831 - RNA, 62 nt, hsa
ugggaguagagagacacacuaacagccacacccucuggaaaucugauacaguaaauauauga

SEQ ID NO: 69832 - RNA, 62 nt, hsa
agcgcuaaguaaacuugccaaggagggacuuucucuggaauuuccugauaugaccaagaaag

SEQ ID NO: 69833 - RNA, 62 nt, hsa
aaagaaggaagaaaagaaggaguggaggaagacucuggaacccuggaagcuguaugccacag

SEQ ID NO: 69834 - RNA, 62 nt, hsa
uuugaccacgaccuuggccccagcucugcacucucuggaauaagggcccgaugcagcauuuu

SEQ ID NO: 69835 - RNA, 62 nt, hsa
agugcuacuaaaacauuuucuucucuccuggccucuggaagcaucuuuagcuuugacuuugg

SEQ ID NO: 69836 - RNA, 62 nt, hsa
ccccacuuucccuuccccaccccacuuguaugcucuggaaucuguggagacgccagcccugc

SEQ ID NO: 69837 - RNA, 62 nt, hsa
gagcagacaucuuccacguggagaagcugcagcucuggaaagaggguuuaagaugcuaggau

SEQ ID NO: 69838 - RNA, 62 nt, hsa
uuccuccucucaaaccuggcagaugggggccucucuggaagagggaggggcccugucacugu

SEQ ID NO: 69839 - RNA, 62 nt, hsa
caccucccugccccaauccuggcuccaacccucucuggaaaaucgaagugaaacauuugucu

SEQ ID NO: 69840 - RNA, 62 nt, hsa
uauauaauuauuuucaguuacuaucccugacacucuggaaucuucuccauuucucccuauca

SEQ ID NO: 69841 - RNA, 62 nt, hsa
cuggucauuuugccacacuuaaccauaagggacucuggaagcuguagguuagcucugcccag

SEQ ID NO: 69842 - RNA, 62 nt, hsa
auugauagugaaaccauuagaucauugaauuccucuggaauuagaaaaccagagagucccau

SEQ ID NO: 69843 - RNA, 62 nt, hsa
ugacaggacaucuuacaagagaauuugcacaucucuggaagcuuagcaaucuuauugcacac

SEQ ID NO: 69844 - RNA, 62 nt, hsa
cuccacggguagugcgaccucgguucugugggcucuggaaggccaccaggguagggucuccc

SEQ ID NO: 69845 - RNA, 62 nt, hsa
cuucugaccucagacggcucugagccuuauuucucuggaagcggcuaagggacgguuggggg

SEQ ID NO: 69846 - RNA, 62 nt, hsa
gauuguuuacaggauauuccaaaauaaaaggacucuggaagauuuucauugaggauaaauug

SEQ ID NO: 69847 - RNA, 62 nt, hsa
uccuacaggggcuccucugugggugaggggcccucuggaauggcaucccaugagcuuguggc

SEQ ID NO: 69848 - RNA, 62 nt, hsa
uuuauuuaaugauguaauuuauuguugcguuccucuggaagcugugacuggaauaaaccccc

SEQ ID NO: 69849 - RNA, 62 nt, hsa
agaggcuggugcuguggccagggugagagcugcucuggaaaaugugacccagauccucacaa

SEQ ID NO: 69850 - RNA, 62 nt, hsa
cugauuccaauauuauuacuuauaacacugaccucuggaaaauauuuuguucacaagaaaua

SEQ ID NO: 69851 - RNA, 62 nt, hsa
uauaauuucuaccuauugggccuuguucuguucucuggaacuaaacagaacaaccauuuacc

SEQ ID NO: 69852 - RNA, 62 nt, hsa
guagggcccgagcuucagcuuccaggaugcuucucuggaaccucaaggcaggcagcccaggc

SEQ ID NO: 69853 - RNA, 62 nt, hsa
uucuguugccgccuaacuuucucauccucggucucuggaaagucaggcugagaaauccuuuc

SEQ ID NO: 69854 - RNA, 62 nt, hsa
uaacgggggugcggcaggagcaggaacagagacucuggaagccccccaccuuucucgcugga

SEQ ID NO: 69855 - RNA, 62 nt, hsa
accccuugggcuaggucugaccccaggugucccucuggaaggggcuggcuggugcccuauuu

SEQ ID NO: 69856 - RNA, 62 nt, hsa
ucagagacccauucuaaacaagggcauucacucucuggaaguagcauggccuugugaacuua

SEQ ID NO: 69857 - RNA, 62 nt, hsa
uuuaggggacaaacuccauccagguugacucucucuggaaugcgguaauaagagcuggcaag

SEQ ID NO: 69858 - RNA, 62 nt, hsa
ugcccucuccucaccuccuuuucucucagugacucuggaaccugaaugcagcuuacaagaca

SEQ ID NO: 69859 - RNA, 62 nt, hsa
ggagcuagcagaaaauaacucaaaguugaagacucuggaagauuuugcuuuaaccuaacucg

SEQ ID NO: 69860 - RNA, 62 nt, hsa
ugccugcuggcucucccccagccccacauccccucuggaagagaauguaaaauaaaccugga

SEQ ID NO: 69861 - RNA, 62 nt, hsa
ucuugaacccuacuuucuggaaguggaguugacucuggaaguuuucuagcaacugaacaaaa

SEQ ID NO: 69862 - RNA, 62 nt, hsa
ggccuucaguaagaccacaagucugcaggaaacucuggaaucaggaagaaaagcuauguuca

SEQ ID NO: 69863 - RNA, 62 nt, hsa
uacaaacuccuacuacgucgucuaaauugcugcucuggaauaaggugauuucugcccccaga

SEQ ID NO: 69864 - RNA, 62 nt, hsa
gaccuacccaaaccuuuuguucuguaaaacugcucuggaaauaccgggaagcccaguuuucu

SEQ ID NO: 69865 - RNA, 62 nt, hsa
uccuguuaaauuuacaacacuaacgauguagacucuggaaaugccuaauaagucaaagaaga

SEQ ID NO: 69866 - RNA, 62 nt, hsa
gcucaaagaggaauugggaaaaauaaauugaacucuggaaucuucucucucaaguccuaaaa

SEQ ID NO: 69867 - RNA, 62 nt, hsa
ucacuauucuuggaccaugccagauucugccucucuggaaagaggcucuggacagcagaagc

SEQ ID NO: 69868 - RNA, 62 nt, hsa
gucccuaccugcuucacguuggccggcggcuacucuggaauguuuuucccuccccagaauca

SEQ ID NO: 69869 - RNA, 62 nt, hsa
ugcacgacacagggcuggugaccucccugggccucuggaagcuuuguuucuucuguacccgg

SEQ ID NO: 69870 - RNA, 62 nt, hsa
auauacugcuugcaauuucuguauuuauuguucucuggaaauaaauauaguuauuaaaggau

SEQ ID NO: 69871 - RNA, 62 nt, hsa
gucauaggggcagcagucucaggggguguaaacucuggaauccacuaugguuuaccuugagu

SEQ ID NO: 69872 - RNA, 62 nt, hsa
acuuaggaccauuugagcuugugggucacccacucuggaagaaauagucaugcuucuuuauu

SEQ ID NO: 69873 - RNA, 62 nt, hsa
gaaauuaaaaacauaacuauugccagauuuagcucuggaauguuuagaaucaggcuagaaua

SEQ ID NO: 69874 - RNA, 54 nt, hsa; identical to SEQ ID NO: 69351

SEQ ID NO: 69875 - RNA, 62 nt, hsa
cacuucaguuguggccucauucagcagaaugacucuggaaccauccucuguuacccgcagau

SEQ ID NO: 69876 - RNA, 62 nt, hsa
ggacugacuguacacucccugaucagccagcacucuggaagcuuugggaucccaggaaccau

SEQ ID NO: 69877 - RNA, 62 nt, hsa
acucagacuucuacuuuaccaaguaccacacacucuggaaugcuuuaguuuccuuuuccccu

SEQ ID NO: 69878 - RNA, 62 nt, hsa
agagcacacuguccccaccgccuccccuuucucucuggaaaguugaaguaucuccaaaggcc

SEQ ID NO: 69879 - RNA, 62 nt, hsa
uugauuuuuguuucuuuuggccugauuuguaucucuggaaugcauuuauucuugaaauauuu

SEQ ID NO: 69880 - RNA, 62 nt, hsa
gccugggaucccuuccuggagaggcaggcugucucuggaaaaagccuccauugcccacccgc

SEQ ID NO: 69881 - RNA, 62 nt, hsa
cguuuggcacagcuuuggccacagccaggccccucuggaauuguccuuauuaaaccaguuuc

SEQ ID NO: 69882 - RNA, 62 nt, hsa
aggccaggcugcacaccuggugggagaacacacucuggaauucucuauucuccuggucgggg

SEQ ID NO: 69883 - RNA, 62 nt, hsa
ggaccaguugcccucauuuccaaagaacugcacucuggaauuaaagggacucuuccauuuug

SEQ ID NO: 69884 - RNA, 62 nt, hsa
cuucagauucccaaagaagccagcuacagagccucuggaacacuauggucuuacaagcagua

SEQ ID NO: 69885 - RNA, 62 nt, hsa
gcgcauggcaagucacaugcguaaacgacacucucuggaagcccuggagacccucgcccaac

SEQ ID NO: 69886 - RNA, 62 nt, hsa
ccugcacugcccagugggccacuaggggcagucucuggaagggcugguucaaggcuguuugg

SEQ ID NO: 69887 - RNA, 62 nt, hsa
agaugucacaggauuaaaugugcaguuuggggcucuggaauuugggucagaaccuucucucu

SEQ ID NO: 69888 - RNA, 62 nt, hsa
auuaggcacacagauccccuggaaacccaccucucuggaaggccccuucccuggcagguggc

SEQ ID NO: 69889 - RNA, 62 nt, hsa
gugcaggaaaccugaacccagcucucaggucccucuggaacuuuggcucuucuuuguuuugu

SEQ ID NO: 69890 - RNA, 62 nt, hsa
aaaauuuguaauguguugcuucuacauaaguucucuggaaauaucuacaacuaauaggacac

SEQ ID NO: 69891 - RNA, 62 nt, hsa
uaguaaaacuugagaagcuuuuggggucagaucucuggaacaucaugugaugaagcugacau

SEQ ID NO: 69892 - RNA, 62 nt, hsa
gggcauccuccuugaaagaggaggacagaccucucuggaagcagcaagaggaaccaguagcu

SEQ ID NO: 69893 - RNA, 62 nt, hsa
ugucugugaaagucagaacacagggcucgagccucuggaacugacccuuugcaagucuuuac

SEQ ID NO: 69894 - RNA, 62 nt, hsa
cuggcuuccuuaccagaaaagccucagccuuccucuggaagcaucccccguucugggcaagg

SEQ ID NO: 69895 - RNA, 62 nt, hsa
ggcagcuggggcugccaucccauuucuccugccucuggaagguggguggggcccugcaccgu

SEQ ID NO: 69896 - RNA, 62 nt, hsa
uggggugauccucccuccugcgugguggcugucucuggaaagcaucccuugccgcugccaug

SEQ ID NO: 69897 - RNA, 62 nt, hsa
uggaccacucgcugccuuaggugccuucugcucucuggaaccagaggacuagcugacuuuug

SEQ ID NO: 69898 - RNA, 54 nt, hsa; identical to SEQ ID NO: 69375

SEQ ID NO: 69899 - RNA, 62 nt, hsa
uucaccauagggguuauaguuggcuugugcuacucuggaaucauuuuacuguuuguuuuuau

SEQ ID NO: 69900 - RNA, 62 nt, hsa
cauuuucccacagacuuccuggccuccugugacucuggaaagcaaaggauuggcuguguauu

SEQ ID NO: 69901 - RNA, 62 nt, hsa
gagggugcugcccgcucaaugcccagcagcagcucuggaaggcagugcucagccccaucacc

SEQ ID NO: 69902 - RNA, 62 nt, hsa
gagaaaucuaaaaaacgaaaagucuccaaagucucuggaauuugaaacacuuugcauaacgu

SEQ ID NO: 69903 - RNA, 62 nt, hsa
gggccuccccuaagaggcuuuccccgaggcagcucuggaaucugugcccaccuggggccugg

SEQ ID NO: 69904 - RNA, 62 nt, hsa
aaugcuaguauggaggcugugaaguccccaagcucuggaagcccacacuauuuguuggugau

SEQ ID NO: 69905 - RNA, 62 nt, hsa
aucaggaauauugugguaagcugggaguaucacucuggaagaaaguaacaucuccagaugag

SEQ ID NO: 69906 - RNA, 62 nt, hsa
ccucauuguggaaacaagccaaaccaaaugaacucuggaaaaccuaaaacaaauguacauuu

SEQ ID NO: 69907 - RNA, 62 nt, hsa
caagccugugcucagguugccuugaauguggacucuggaagagccaggggcccagaaugccg

SEQ ID NO: 69908 - RNA, 62 nt, hsa
aaucagcagucuucaaucgaucaauaauucugcucuggaagagaaggaacagggagcagaga

SEQ ID NO: 69909 - RNA, 62 nt, hsa
ccucaccucugcuccugucuucaucaccuucucucuggaagggaagaggaguuggaaggucu

SEQ ID NO: 69910 - RNA, 62 nt, hsa
ugcagagcgaguggaugcacuucccagcucaucucuggaagccuuugcuacucaagcuccuc

SEQ ID NO: 69911 - RNA, 62 nt, hsa
acuccgggaucgugcagugacgucgcaagccucucuggaaagagugugcugccccuccccau

SEQ ID NO: 69912 - RNA, 62 nt, hsa
cagaugcagcagcagucuuuagccagagaacucucuggaaccauuaaagaauuccugggggc

SEQ ID NO: 69913 - RNA, 62 nt, hsa
uuaacucauuauuuaauugaacauuuccaaagcucuggaaaggcaugcauuuguaggugcac

SEQ ID NO: 69914 - RNA, 62 nt, hsa
gacauggugggaugggcauguggucccagcuacucuggaagcugaggugagaggaucacuug

SEQ ID NO: 69915 - RNA, 58 nt, hsa; identical to SEQ ID NO: 69392

SEQ ID NO: 69916 - RNA, 62 nt, hsa
ggucuggauagauagcuuacagcaguagugggcucuggaaugcccaagggaagaggcaaggu

SEQ ID NO: 69917 - RNA, 62 nt, hsa
gacauccuggagggagacuggauuugccugcacucuggaaggcugggaaacuccuggaagac

SEQ ID NO: 69918 - RNA, 62 nt, hsa
augugcaauaagaacauagauccuaaaggauccucuggaagcuguauuucuugaauuagaau

SEQ ID NO: 69919 - RNA, 62 nt, hsa
caaaacuuguuuccacauuaagagucagccagcucuggaauggucuggaaaugucuuccugg

SEQ ID NO: 69920 - RNA, 62 nt, hsa
ugcuucuuaaucaauccaaauuucauuuacagcucuggaacacuuuggggcugauuugucuc

SEQ ID NO: 69921 - RNA, 62 nt, hsa
cucugauucagcuggggcuagcugggccgcuccucuggaagcccacacuuguggggacuuag

SEQ ID NO: 69922 - RNA, 62 nt, hsa
cauuguguuuguuuuucauguuggaacaaucucucuggaagugccucuucuuguggcuuuua

SEQ ID NO: 69923 - RNA, 62 nt, hsa
cgugaucuaccacaccuggccaaucccaacuacucuggaagcugaagcagcaagaucacuug

SEQ ID NO: 69924 - RNA, 62 nt, hsa
cacaaugccuggguguccucauccuugcuuuacucuggaaaguguggggauggagaggaugg

SEQ ID NO: 69925 - RNA, 62 nt, hsa
ugcuccuugaagaaucucuccucucucucucucucuggaaagacccaacuuucucacugcug

SEQ ID NO: 69926 - RNA, 62 nt, hsa
caagcaaugcuguucuguaaauuuauugaaaccucuggaacauuucaccuuuagagauggag

SEQ ID NO: 69927 - RNA, 62 nt, hsa
ugugagauugagagaacuaugaccugcagcaacucuggaaaccuggccugacagacaagcag

SEQ ID NO: 69928 - RNA, 62 nt, hsa
guauucucacucccuugaucucaagggcguaacucuggaagcacagcuugacuacacgucau

SEQ ID NO: 69929 - RNA, 62 nt, hsa
uugggcaagggacaaggugcuagaauccuaagcucuggaaauauuucaugacacugguguau

SEQ ID NO: 69930 - RNA, 62 nt, hsa
acugccccugauggaacucauggagaaugaagcucuggaaauccucaccaaagcccuccgga

SEQ ID NO: 69931 - RNA, 62 nt, hsa
gccccucucugaagagacuguccuugggccuccucuggaagcagcacccccagaggacaggg

SEQ ID NO: 69932 - RNA, 62 nt, hsa
ggcaugggcuaagucacucugcccuucggagccucuggaagcuuagggcacauugguuccag

SEQ ID NO: 69933 - RNA, 62 nt, hsa
ccuuauauaaaguaccagguuuuuuccccauucucuggaaauguuuguccucccuuaauuuu

SEQ ID NO: 69934 - RNA, 62 nt, hsa
ccauuauggauguugaaauggacagggaaggacucuggaagucucuuccuccuccuccucuu

SEQ ID NO: 69935 - RNA, 62 nt, hsa
uaagucccucuucuugccguuggccuuucugacucuggaaugaccacuguucauugaaaaau

SEQ ID NO: 69936 - RNA, 62 nt, hsa
gcaugaggaaauagaagauucaggggccugagcucuggaagcugcaagcaaaagggauggga

SEQ ID NO: 69937 - RNA, 62 nt, hsa
cuggccgcaguguguguguauccgauaccccacucuggaaggaaccauccaguaaaggucuu

SEQ ID NO: 69938 - RNA, 62 nt, hsa
agugccuaugaaacaaacacuaagugcagugucucuggaacugccuuacucacaggcuucca

SEQ ID NO: 69939 - RNA, 62 nt, hsa
acgaaggccucugaaggacccuucagagguggcucuggaaugacaugugucaagcugcuugg

SEQ ID NO: 69940 - RNA, 62 nt, hsa
guucuucuaguucgaggccuuggguccccauccucuggaaccagggggaggccuggaaggag

SEQ ID NO: 69941 - RNA, 62 nt, hsa
accaucucucaagccccaaggacuggagccaccucuggaauaauguguuaaauaucuguaua

SEQ ID NO: 69942 - RNA, 60 nt, hsa; identical to SEQ ID NO: 69419

SEQ ID NO: 69943 - RNA, 62 nt, hsa
uguuuccuuuugcgugaucucuguugauggcacucuggaauuguuucaguuaagucauuuua

SEQ ID NO: 69944 - RNA, 62 nt, hsa
gauggaaacuuucuaccugcuuggccuggggccucuggaagucugcugugaauuuguauucc

SEQ ID NO: 69945 - RNA, 62 nt, hsa
cuuuacuguuccucugggaaaggagcagggaccucuggaauucccaucuguuucacugucuc

SEQ ID NO: 69946 - RNA, 62 nt, hsa
uuuacaucucagguaauguguagauuguacuucucuggaaccaaauguaguuuucuacacuc

SEQ ID NO: 69947 - RNA, 62 nt, hsa
uucugugaaagcaaauacuaaaggaugccauccucuggaauccuaauggcaggcaaagggag

SEQ ID NO: 69948 - RNA, 62 nt, hsa
agagaacugaagugcagccaucagguggaagccucuggaaccugaggcggcugcuugaaccu

SEQ ID NO: 69949 - RNA, 62 nt, hsa
aggacaaagaaaacugcacaauaaaaccaagccucuggaaucuguccucguguccaccuggc

SEQ ID NO: 69950 - RNA, 62 nt, hsa
cucccgucucaacagccccaggccuaugggggcucuggaaggaugggccagcuugcaggggu

SEQ ID NO: 69951 - RNA, 62 nt, hsa
ggccacaguggcucacgccuguaaucccagaacucuggaaggcugaggcaggcggaucaccu

SEQ ID NO: 69952 - RNA, 62 nt, hsa
augggacaguuuuccauauccuugcuguggagcucuggaacacucucuaaauuucccucuau

SEQ ID NO: 69953 - RNA, 62 nt, hsa
ucucccuccagcaugggccugugucucaggcucucuggaagguggcccugccccggacccuc

SEQ ID NO: 69954 - RNA, 62 nt, hsa
ucuuucccccacccugucucuuccuuguccuucucuggaaaaugccaaaauacacgauguga

SEQ ID NO: 69955 - RNA, 62 nt, hsa
ugauuauagcaucuccuucugaguguuugggacucuggaaucugagacccauguucacauug

SEQ ID NO: 69956 - RNA, 62 nt, hsa
caauggcaaaaauauuuccaguugcacuguaucucuggaagugaugcaugaauucgauugga

SEQ ID NO: 69957 - RNA, 62 nt, hsa
gucaaccagagaacagcuccccuagacauggccucuggaaaaaggaaaucuuugguggccaa

SEQ ID NO: 69958 - RNA, 62 nt, hsa
ccauuacuaauagaaacacagccuuuccaauccucuggaacauauucugucuggguuuuuaa

SEQ ID NO: 69959 - RNA, 62 nt, hsa
gguacaaaauccuacuuuucagagccuuccagcucuggaaccucaaacauccucaugcucuc

SEQ ID NO: 69960 - RNA, 62 nt, hsa
aaacuauugaugaauuguuuccugggucacaucucuggaaaauagauguuacaguucuuaaa

SEQ ID NO: 69961 - RNA, 62 nt, hsa
gaaggcaucugcaacuccaaguccaugcagaacucuggaaggccaaguucaucgcagcaugu

SEQ ID NO: 69962 - RNA, 62 nt, hsa
cugucuuuauuuccucaaagucaagcagcuuucucuggaaaaugaaugcuaauuagugugaa

SEQ ID NO: 69963 - RNA, 62 nt, hsa
ccagcccuagcccuuuagccuuucacccugugcucuggaaaggcuaccaaauacuggccaag

SEQ ID NO: 69964 - RNA, 62 nt, hsa
gcaauaaugucaccacacacacuucaugaagccucuggaaaacucuacaguauacuugugag

SEQ ID NO: 69965 - RNA, 62 nt, hsa
cucggggucuuuccucagccucgaaaagugggcucuggaaucccuuuguaaauagguguguu

SEQ ID NO: 69966 - RNA, 62 nt, hsa
uucuggugagggacauuguaguucgcaugguucucuggaaacgcgccaggaaaagcuuccgu

SEQ ID NO: 69967 - RNA, 59 nt, hsa; identical to SEQ ID NO: 69444

SEQ ID NO: 69968 - RNA, 62 nt, hsa
uaagcucaucccucccguccgaggcuaguuuccucuggaaccacauuuuuaucuagaugaaa

SEQ ID NO: 69969 - RNA, 62 nt, hsa
auguguguucucagugaaauaacuaccuuccacucuggaaccuuauuccagcaguuguucca

SEQ ID NO: 69970 - RNA, 62 nt, hsa
ugaaacccagaucgcuguguuacuaaugaucacucuggaaaugcaaauagaauaggagggga

SEQ ID NO: 69971 - RNA, 62 nt, hsa
ggguagucccucucaccugcuuccucagacgacucuggaagcuucccucuaccacugggcac

SEQ ID NO: 69972 - RNA, 52 nt, hsa; identical to SEQ ID NO: 69449

SEQ ID NO: 69973 - RNA, 62 nt, hsa
cugugguguuauagugguaacugcaguuccuccucuggaauguagacuguauauguuuaaua

SEQ ID NO: 69974 - RNA, 62 nt, hsa
ggauaugacaguccagcaucgaugccugugcccucuggaaaaauuuccuccuagcccuucca

SEQ ID NO: 69975 - RNA, 62 nt, hsa
auguugcauuuaacugaaugucauguuuucuccucuggaacuucuuauguaugcaagcuccc

SEQ ID NO: 69976 - RNA, 62 nt, hsa
uccaccccacuucugcaaacccaucccgaggccucuggaaugggacuccuucucccucccua

SEQ ID NO: 69977 - RNA, 62 nt, hsa
aacuuugcacuuguaguuuugagucuuugucucucuggaauaugaacagguuuauaaaacau

SEQ ID NO: 69978 - RNA, 62 nt, hsa
aguuuucuaagcucagggucuucauuagagaccucuggaaauacauuaaggauggugggggu

SEQ ID NO: 69979 - RNA, 62 nt, hsa
ggagauuuauaaaguuuugauauuuuucccuacucuggaauuugaacuuucuucauguuugc

SEQ ID NO: 69980 - RNA, 62 nt, hsa
uauugacagcaaugguuucccgggcccagaaacucuggaaagauuuuguccagaagaauuca

SEQ ID NO: 69981 - RNA, 62 nt, hsa
agugcuugaccuccuguauucugaauggugaacucuggaagcagggauugugucuggcucuu

SEQ ID NO: 69982 - RNA, 62 nt, hsa
ugcccuccuuaauuugggaagguuuguguuuucucuggaaugguacaugucuuccauguauc

SEQ ID NO: 69983 - RNA, 62 nt, hsa
uauuuucuaagcagccagcagugaaucuaaaacucuggaagaagucuucuguuugaaaggcu

SEQ ID NO: 69984 - RNA, 62 nt, hsa
uuauuguuuuuauuccacacuuccuacuuggucucuggaaguuuuaccacauguaacagauu

SEQ ID NO: 69985 - RNA, 62 nt, hsa
uaguguuaucuggaagguuuaaauuuuuagaucucuggaacacauucuuaaugguaaguguc

SEQ ID NO: 69986 - RNA, 62 nt, hsa
gggugguaggagguuuuuuuuuuuacccagggcucuggaaggacaccaaacuguucugcuug

SEQ ID NO: 69987 - RNA, 62 nt, hsa
ucuuguccaagccuuuaagacagcacugccuucucuggaacuaaaauuacaauugaaguaaa

SEQ ID NO: 69988 - RNA, 62 nt, hsa
uuuuggcagaacuaguugauuaguuuagggaucucuggaaaugucaguuuccugaagagcca

SEQ ID NO: 69989 - RNA, 62 nt, hsa
guccuucaaaacuauaugguugccuagauucucucuggaaacugacuuugucaaauaaauag

SEQ ID NO: 69990 - RNA, 62 nt, hsa
agagcauccgaccucuuggagcaaguuucugccucuggaaagggggcgggcccuuuucacaa

SEQ ID NO: 69991 - RNA, 62 nt, hsa
ccuaggguggaggucacugcacuaccacccaccucuggaagacuggcugugaaaagucaggu

SEQ ID NO: 69992 - RNA, 62 nt, hsa
uaggcucucccugcucccuucucuacaggaaucucuggaaaacuaucagaagacaaaguuug

SEQ ID NO: 69993 - RNA, 62 nt, hsa
ugauaguuuuuaacucuauggucauuguaucacucuggaaaauguggaguagcuguaauaaa

SEQ ID NO: 69994 - RNA, 62 nt, hsa
ggcuaaaaagauuacagcgucaucugguugaacucuggaaaaaaaaaaaaaaaugaaaaaaa

SEQ ID NO: 69995 - RNA, 62 nt, hsa
uucccaaggcccuaaggucccucaccugguugcucuggaagcucuugcugauaggaaugaua

SEQ ID NO: 69996 - RNA, 62 nt, hsa
ugaccuguacuuauuuuucucuucccgccucccucuggaauggauauauugguugguucaua

SEQ ID NO: 69997 - RNA, 62 nt, hsa
acugagcccaccagccacagugcccauguccccucuggaagacaaacuaccaauuucucguu

SEQ ID NO: 69998 - RNA, 62 nt, hsa
uuauuuauuuagcauagacauuaaagauaacucucuggaaaaugacuugacuaaggcucuca

SEQ ID NO: 69999 - RNA, 62 nt, hsa
agcaccuuucuuccgucuguucacucugcggccucuggaaucccagcucuucucucucagaa

SEQ ID NO: 70000 - RNA, 62 nt, hsa
uggaaccuggaccccagccuuggugggggagccucuggaaugcauggggcggguccuagcug

SEQ ID NO: 70001 - RNA, 62 nt, hsa
cguagcaugauugcgcucauggauacagauggcucuggaaagcucaaccugcaggaguucca

SEQ ID NO: 70002 - RNA, 62 nt, hsa
cuggaaagcucaaccugcaggaguuccaccaccucuggaacaagauuaaggccuggcaggug

SEQ ID NO: 70003 - RNA, 62 nt, hsa
uguccccaccacuccuggagucccaaugacuucucuggaaagacaaagagguuaucacaaaa

SEQ ID NO: 70004 - RNA, 62 nt, hsa
auuguuuuauaaagaacgugauuuccagugaucucuggaagcgcuaaagcuaaaauuucugu

SEQ ID NO: 70005 - RNA, 62 nt, hsa
agaggcauacacuuuuuacagauggacaaaagcucuggaacccuguggcuucaaauccuuug

SEQ ID NO: 70006 - RNA, 61 nt, hsa
gaguagauaaaacagcugcaauauaaacaguccucuggaauaaugguuugugguggaugcu

SEQ ID NO: 70007 - RNA, 62 nt, hsa
agaaaugcagaccugugggcucuaccacaggccucuggaaucagaaucuucaggguggggcc

SEQ ID NO: 70008 - RNA, 62 nt, hsa
ccuaggcuuacaggccauccugagccaggggccucuggaaauucucuuccugaugguccuuu

SEQ ID NO: 70009 - RNA, 62 nt, hsa
gggggcauuuugcuggggggagaugaggcagccucuggaauggcucagggauucagcccucc

SEQ ID NO: 70010 - RNA, 62 nt, hsa
agccacccaggaaggaagcacagagcugggggcucuggaaacgcccugugucucuggcuaca

SEQ ID NO: 70011 - RNA, 62 nt, hsa
ccuccggacucuggcacgcuccagcagcccuccucuggaagcugcguccccucacccccugu

SEQ ID NO: 70012 - RNA, 62 nt, hsa
ggcagggaguggggauugguccuacuuucuuucucuggaaaggaaagccuccaagacuccau

SEQ ID NO: 70013 - RNA, 62 nt, hsa
cugacugagacaauucuguccauguaaagauccucuggaaaaagacuccgagaguuauaacu

SEQ ID NO: 70014 - RNA, 62 nt, hsa
cugccuggcugauucuuccuuaaaacuaaaaucucuggaaaauggauuugcuucuuacccug

SEQ ID NO: 70015 - RNA, 62 nt, hsa
ccuccagcuuccagcuaggccagaagggcaugcucuggaacccagcaggaucacagcugccu

SEQ ID NO: 70016 - RNA, 62 nt, hsa
ucucgaugugcacugugaugccuggaaccuuccucuggaagugcugauuuuauggacugagg

SEQ ID NO: 70017 - RNA, 62 nt, hsa
agcgucuccaauaugacuauuaaaacugucaccucuggaaauacacuagugugagccuucag

SEQ ID NO: 70018 - RNA, 62 nt, hsa
gaagggcuuggccagcgcuguugagggguccccucuggaaugcacugaauaaagcacgugca

SEQ ID NO: 70019 - RNA, 62 nt, hsa
ccaucagccuugaagggccucgaugaagccuucucuggaaccacuccagcccagcuccaccu

SEQ ID NO: 70020 - RNA, 62 nt, hsa
guccuuaggccucugagaagcucugaagaacucucuggaagccccugggcccaguaccuagc

SEQ ID NO: 70021 - RNA, 62 nt, hsa
aucagucacaacucaccuagcgaccugacuuacucuggaaucuuggcgggcaucgccgaccc

SEQ ID NO: 70022 - RNA, 62 nt, hsa
gagacggccaguucuggcggccagauguggugcucuggaauccagucccauuuccuuccugg

SEQ ID NO: 70023 - RNA, 62 nt, hsa
uugggacauacuugcccccuacuuccucuucucucuggaacggcucacaaugagugugacau

SEQ ID NO: 70024 - RNA, 62 nt, hsa
uagaugauguagcuguacauuuuaaauguaugcucuggaaugagucacuuuuuuucccugag

SEQ ID NO: 70025 - RNA, 62 nt, hsa
gaggccgggggagcagacagggccggugcucccucuggaagcuugggugaccggggcccugg

SEQ ID NO: 70026 - RNA, 62 nt, hsa
accucggccagcuggacccacaugagggccaccucuggaaccuucuucgaggcccuggccag

SEQ ID NO: 70027 - RNA, 62 nt, hsa
ggcaccucucugucccuuccgugucucacugucucuggaagcuucagcccauguguguccug

SEQ ID NO: 70028 - RNA, 62 nt, hsa
ucucuguguggauagacuccccagcguuuuuccucuggaaaugcccacagggcuugccgcgu

SEQ ID NO: 70029 - RNA, 62 nt, hsa
acuccccacaguuuuaggaucuaaaugauugccucuggaacuauucuucuagacuaucccac

SEQ ID NO: 70030 - RNA, 62 nt, hsa
aucuacaucagcugaaccugaaacucaggggacucuggaacaccauggacccugggggcugu

SEQ ID NO: 70031 - RNA, 62 nt, hsa
ccagagccccaggugccuggccuggccuagaccucuggaauugagauuaaacaauuuggagu

SEQ ID NO: 70032 - RNA, 62 nt, hsa
gccugcugugacugaccuacaguggacuuucucucuggaauggaaccuucuuaggccuccug

SEQ ID NO: 70033 - RNA, 62 nt, hsa
acaccagcuugggcaacguaagaagaccgugucucuggaauuuuuuuuuuuuuuuaauuagc

SEQ ID NO: 70034 - RNA, 62 nt, hsa
cucuugggaacgcuggagagcuugugcacagccucuggaaggaaaggcagcgcugacuucgu

SEQ ID NO: 70035 - RNA, 62 nt, hsa
cacagacugacacguuucccacuguacuggaacucuggaaagaggggcuccccgaccugccc

SEQ ID NO: 70036 - RNA, 62 nt, hsa
ccuacauucuucccgaggcuccaggccgcugucucuggaaguaaaagagccuugucugaccu

SEQ ID NO: 70037 - RNA, 62 nt, hsa
cacagucaggggccuccacaugccuggccuggcucuggaagucacgucuuagcuucugaaca

SEQ ID NO: 70038 - RNA, 62 nt, hsa
uagucuggaaaguugggauuugcaaauaaaggcucuggaagcauugcugguccugaagcuuu

SEQ ID NO: 70039 - RNA, 62 nt, hsa
guggggggcuauagccucagagaccacucauccucuggaaucaaccucuuucuaauacccuc

SEQ ID NO: 70040 - RNA, 62 nt, hsa
caguacauguuuaaaagaagagcucauggaaccucuggaaaggacagggaaguugaguuagc

SEQ ID NO: 70041 - RNA, 62 nt, hsa
aauuacuuggaaaacagugggaagugguaggacucuggaagaggccacacacccgagagcug

SEQ ID NO: 70042 - RNA, 62 nt, hsa
ggucgauggaacuggccacgcacaggcucuggcucuggaaggagggaugaugagugggcguu

SEQ ID NO: 70043 - RNA, 62 nt, hsa
ugcuuguuuguuuuuagauuccugagagaugucucuggaagggaaaguuuugagaacuaaug

SEQ ID NO: 70044 - RNA, 62 nt, hsa
agacuuaaauguaaaaccccaaacuauaaaaacucuggaagauaaccuaggcaauaccauuc

SEQ ID NO: 70045 - RNA, 62 nt, hsa
uggccuggccugaccaaugagaggccagaacacucuggaacaucggaagaggaguucuuugc

SEQ ID NO: 70046 - RNA, 62 nt, hsa
ugggagacggcuuuguccuggggacacuuucccucuggaaucucaagacgacguggcacaca

SEQ ID NO: 70047 - RNA, 62 nt, hsa
ugagagcuggaggacaauauccagggacauggcucuggaaaauaacuuuuuuuuuuuuaaga

SEQ ID NO: 70048 - RNA, 62 nt, hsa
auagggaggugaguccucucuaucuccucuggcucuggaagcaccuugaaaaugugcauuuu

SEQ ID NO: 70049 - RNA, 62 nt, hsa
aauuacaagacggggagugagacuccugauugcucuggaagccugcugauuucuacaacuga

SEQ ID NO: 70050 - RNA, 62 nt, hsa
ccugcucugugucuguguugugaagcuugagacucuggaaagaaauggggagggggggcagg

SEQ ID NO: 70051 - RNA, 62 nt, hsa
cccaucagcccuugcaagucccccacucaggccucuggaagguccagggaugggcucugaug

SEQ ID NO: 70052 - RNA, 62 nt, hsa
gcuaugaggguguauauauuuuuuacccaaagcucuggaauuguacauuuauuuuuuaaaac

SEQ ID NO: 70053 - RNA, 62 nt, hsa
ccgagccaguggcggcugguaucccgcggcggcucuggaagcuggacgcggaccacggcccg

SEQ ID NO: 70054 - RNA, 62 nt, hsa
gaacugggaacauugcauccauggguugaugucucuggaagugcaaccacccaaugucucug

SEQ ID NO: 70055 - RNA, 62 nt, hsa
uugaugucucuggaagugcaaccacccaaugucucuggaagugccaccuggaagugccaccu

SEQ ID NO: 70056 - RNA, 62 nt, hsa
aagugccaccuggaagugccaccuggaagugucucuggaagagcacccaccacuguucagcc

SEQ ID NO: 70057 - RNA, 62 nt, hsa
aggcagaggcuccgcggcaggaggagccggugcucuggaagaccugaaagaagcccaggugg

SEQ ID NO: 70058 - RNA, 62 nt, hsa
auuagaacauauuugcauaagauagcuauuuacucuggaaaccaacaacuuuugagauuucc

SEQ ID NO: 70059 - RNA, 62 nt, hsa
agaauuuugauagaaaaccauggggccaagagcucuggaagccuggccggaaagaccaaggu

SEQ ID NO: 70060 - RNA, 62 nt, hsa
cgagagucggagauaugacugacugauuccuucucuggaauaguuacuuuacaacacggucu

SEQ ID NO: 70061 - RNA, 62 nt, hsa
ccucucccuucccugcugccuugcagugaccccucuggaacucaggacucgauuuuaaggac

SEQ ID NO: 70062 - RNA, 62 nt, hsa
augccuucccuagaaccggaggccccggacuucucuggaaaaccgccugucugcaggcccga

SEQ ID NO: 70063 - RNA, 62 nt, hsa
ucuacauaaaugggaucauuuuauacauggugcucuggaacccacauuuuucaugcagucau

SEQ ID NO: 70064 - RNA, 60 nt, hsa; identical to SEQ ID NO: 69541

SEQ ID NO: 70065 - RNA, 62 nt, hsa
gauucaagggaaaggcacuaaaugguuuuuuccucuggaagaugagauuguaggugauauuu

SEQ ID NO: 70066 - RNA, 62 nt, hsa
gaggaggucagcaaaggucuugaauagauuuucucuggaaauaaagaauccuuagaugccua

SEQ ID NO: 70067 - RNA, 62 nt, hsa
agcuggauauccugggggaggaggggaaugcgcucuggaaacacccuuccggaacccuucgg

SEQ ID NO: 70068 - RNA, 62 nt, hsa
ccgcaaguccauuuuauuuccuucuugugcugcucuggaagagaggcaguagcaaagagaug

SEQ ID NO: 70069 - RNA, 62 nt, hsa
ucaccuugagcagccucagaucaucucugucacucuggaagggacaccccagccagggacgg

SEQ ID NO: 70070 - RNA, 62 nt, hsa
cccccuuccagggccucugcuccaaaggaggccucuggaacccaggacucugggguuuuaca

SEQ ID NO: 70071 - RNA, 62 nt, hsa
uccaagccuagagccaccagcccagcuuccuucucuggaaaagccuggaaacugggcacaga

SEQ ID NO: 70072 - RNA, 62 nt, hsa
cccaugagaucaggcgccaucuguaaagucuccucuggaaaugccaauccauccuuccccca

SEQ ID NO: 70073 - RNA, 62 nt, hsa
ccgugcgucccucuuaggagagaugagucacacucuggaacuguccaagaacgaaccugcca

SEQ ID NO: 70074 - RNA, 62 nt, hsa
aagaaaaugagcagauuucuuuccauugugggcucuggaaaccacauggcuucaccuguccc

SEQ ID NO: 70075 - RNA, 62 nt, hsa
gucuaccaaguacgaugucuucagacaacuuucucuggaagggucuggacuagguguugaag

SEQ ID NO: 70076 - RNA, 62 nt, hsa
uaacaggcagccucaagaaugugcugagauuucucuggaaaacaagcucugccucuccgggu

SEQ ID NO: 70077 - RNA, 62 nt, hsa
ugagcuccaagcacagcaaagccugacagaaucucuggaaugcaccguggcagaaaccgagg

SEQ ID NO: 70078 - RNA, 62 nt, hsa
ggagaucuuggaacugaaacgcacagccagugcucuggaaauugagcuccaagcacagcaaa

SEQ ID NO: 70079 - RNA, 62 nt, hsa
gcauuuccuguuuuccuuuuuucuuuggcauucucuggaaugcaaggaggagacuucauuua

SEQ ID NO: 70080 - RNA, 62 nt, hsa
aucuuuggaagccuugaguucagaaucugcugcucuggaauauuucccuucgaucuuaucuc

SEQ ID NO: 70081 - RNA, 62 nt, hsa
cuauuuuaaaauagugaauauacguaaauuuucucuggaaggcugaggcacacuucaccauc

SEQ ID NO: 70082 - RNA, 62 nt, hsa
cuuuggggaaacacuuugcugaaauguugggacucuggaacuagccaagaaaagagaauauu

SEQ ID NO: 70083 - RNA, 62 nt, hsa
aacugcuuuuuauacauuuuguauaaggacaacucuggaaacaagccuauuuccuccagcca

SEQ ID NO: 70084 - RNA, 62 nt, hsa
uuugcugaaaaaagcucuggggcugucugaggcucuggaaugcucucuggaggguuaacucu

SEQ ID NO: 70085 - RNA, 62 nt, hsa
augacccgcuuuucuagaaaguucauaaucagcucuggaacaagcacacuugauuccucacu

SEQ ID NO: 70086 - RNA, 62 nt, hsa
ugaacugcagcucacgagaccuuuugcagggacucuggaauguccucacgguauauugaugu

SEQ ID NO: 70087 - RNA, 62 nt, hsa
ggcuccucugauccuuuaggguuggcgagcaucucuggaaauagcuuuugcagaggaguggu

SEQ ID NO: 70088 - RNA, 62 nt, hsa
cucugcagggcugcccucucuaacuggccuggcucuggaagggcuggugaggacucugccuc

SEQ ID NO: 70089 - RNA, 62 nt, hsa
uauucaauacauuaugcuuaaauuagcaguuucucuggaauuccugucucuccuuuaaaaga

SEQ ID NO: 70090 - RNA, 62 nt, hsa
guugauaucgucauauaaagccauugcaaggacucuggaaacugccgccaaugaccaauuuc

SEQ ID NO: 70091 - RNA, 62 nt, hsa
gcagcuuggcauucuucuuauucuagaggucucucuggaaaagauggagaaaaugaacagga

SEQ ID NO: 70092 - RNA, 62 nt, hsa
ucucacccauaaacaguaaugacucucugacccucuggaaauauguaaugcuuccaaucuug

SEQ ID NO: 70093 - RNA, 60 nt, hsa; identical to SEQ ID NO: 69570

SEQ ID NO: 70094 - RNA, 62 nt, hsa
auacuggcucugucugaguaagaaacagaauccucuggaacuugaggaagugaacauuucgg

SEQ ID NO: 70095 - RNA, 62 nt, hsa
accucugcugucacugcucgaagcagcagucucucuggaagcaucugugucauggccaucgc

SEQ ID NO: 70096 - RNA, 62 nt, hsa
cagauggacucuagaagcacugagcucccugucucuggaaguauuuaagaaaaggcugggcc

SEQ ID NO: 70097 - RNA, 62 nt, hsa
uaaaaauaaaaauaaauauuggcgggggaacccucuggaaucaauaaaggcuuccuuaacca

SEQ ID NO: 70098 - RNA, 62 nt, hsa
caccccauuccagauauagaauguuucuaucucucuggaagguuccugcauguuauauggcu

SEQ ID NO: 70099 - RNA, 62 nt, hsa
ucuugcugaaccguuugugauugccauuugagcucuggaagccucuauugccaugagaguuc

SEQ ID NO: 70100 - RNA, 62 nt, hsa
cgauucuguccgugaaaugaauuggguagagucucuggaagguuuuaagcccauuuucaguu

SEQ ID NO: 70101 - RNA, 62 nt, hsa
cagcccaugcucuucuguacugucaugcccgucucuggaauguccacucccagagccugccc

SEQ ID NO: 70102 - RNA, 62 nt, hsa
gggggaggcccagggcuggugagucuagaaugcucuggaacccuacaccuagugaugugugu

SEQ ID NO: 70103 - RNA, 62 nt, hsa
aucuguccccucauuuuugagaucccccaauucucuggaacuauucugcugccccuuuuuau

SEQ ID NO: 70104 - RNA, 62 nt, hsa
cccuaggucugggugggcaguggccccauagccucuggaacugugcguucugcauagaauuc

SEQ ID NO: 70105 - RNA, 62 nt, hsa
ccgcuggggccucggagacuuggaggaggacgcucuggaaccaucaucccgcuucucuccgg

SEQ ID NO: 70106 - RNA, 62 nt, hsa
cucuccccgccaccccagggccuccaagccaccucuggaaauacuuggcucugccccauggg

SEQ ID NO: 70107 - RNA, 62 nt, hsa
ucccaggaggagccccgcuucaccccuucugacucuggaaaccgcaccuuuaacuuugcaga

SEQ ID NO: 70108 - RNA, 62 nt, hsa
uucccauuuucgcuuuccucugguuugaaagccucuggaaaacucaggauucucacgacucu

SEQ ID NO: 70109 - RNA, 62 nt, hsa
agggcggcccuguacuuuuuguggcuugguuucucuggaaaugucaccuuuucgggcgcagc

SEQ ID NO: 70110 - RNA, 62 nt, hsa
gggggccaaugggggccucagggggaggcccccucuggaaaugugguucccagggaugggcc

SEQ ID NO: 70111 - RNA, 62 nt, hsa
cugcacgcccaccccaugaaacucgagcaggucucuggaagccauuuguuaaaaaaaaaaaa

SEQ ID NO: 70112 - RNA, 62 nt, hsa
cccgcagacccuuaaaaaaaucacccacaacccucuggaaguggccuugcccgguccccuuc

SEQ ID NO: 70113 - RNA, 62 nt, hsa
gccuucacucagggucagcgggcaccagguugcucuggaagagcuugaggaugugguucucg

SEQ ID NO: 70114 - RNA, 62 nt, hsa
ucugccgugaaaccccagccagccacaccagacucuggaacccuuuuucgacugccccaacu

SEQ ID NO: 70115 - RNA, 62 nt, hsa
cuaguuggccagcgucuugcucuguucacagucucuggaaaagcugggguaguuggugagca

SEQ ID NO: 70116 - RNA, 62 nt, hsa
gaagcacaaguacguuaaacaagugcuaaacgcucuggaaagcauggcuuuauuuucuuaau

SEQ ID NO: 70117 - RNA, 62 nt, hsa
cauuaacugacgcuuccuuccacgaaagauuucucuggaacaugagauguuguuugauagca

SEQ ID NO: 70118 - RNA, 62 nt, hsa
cucuugaggacccccacccuccugcauccucucucuggaaggcugcauguauuguagcugug

SEQ ID NO: 70119 - RNA, 62 nt, hsa
cccccaacugggaauugagagguaaggucuuucucuggaaauccagcaguagaggaagggac

SEQ ID NO: 70120 - RNA, 62 nt, hsa
acugccccuuccauggaaaagcuggaaaaaaacucuggaacccauauccaggcuuggugagg

SEQ ID NO: 70121 - RNA, 62 nt, hsa
uagugaagccuguuucguugaacuaauucuggcucuggaaauguuuuuguuuuauaguuauu

SEQ ID NO: 70122 - RNA, 62 nt, hsa
ccauuauuaacugauuaaugcacuuugaaguucucuggaauuaauuauuuuaacuuggccua

SEQ ID NO: 70123 - RNA, 62 nt, hsa
cacuucccacugauccauggggccuuuaagcccucuggaagcuuccauuaaagaugauuauu

SEQ ID NO: 70124 - RNA, 62 nt, hsa
ugcaacugcugcaggaugccuguaguagggaacucuggaaguguauugggcugaggugggau

SEQ ID NO: 70125 - RNA, 62 nt, hsa
cucccugcacucccuccuggagcucugugggucucuggaagaggaaccaggagaagggcugg

SEQ ID NO: 70126 - RNA, 62 nt, hsa
caaaauuguuuauacacucuuuccuccaugagcucuggaagguauaugcaucuucuguaaua

SEQ ID NO: 70127 - RNA, 62 nt, hsa
uugauagucccuugaacacacaugcugccgagcucuggaaaaaccccacaggugaguccuca

SEQ ID NO: 70128 - RNA, 62 nt, hsa
accauuuucugguucuguguccucugccugggcucuggaagaggccuucccauggccauuuc

SEQ ID NO: 70129 - RNA, 62 nt, hsa
cuggcagagaugcauuccagagaugcacuccgcucuggaacucacucucagccacagggagc

SEQ ID NO: 70130 - RNA, 62 nt, hsa
aacuguaggccaauauagauuugccuuuaaaacucuggaagagcuacauagucaucauuagu

SEQ ID NO: 70131 - RNA, 62 nt, hsa
gcucguuguggacuguaauuaaaugcuuugcccucuggaacuugauuuuuguguaucugaga

SEQ ID NO: 70132 - RNA, 62 nt, hsa
agcuuaccugccacagagcuuuucugcaugaacucuggaacagaaaggcccuguaaagcccu

SEQ ID NO: 70133 - RNA, 62 nt, hsa
cugggcgcaucccaagacagccagcagguugucucuggaaacgaccagaguuaagcucucgg

SEQ ID NO: 70134 - RNA, 62 nt, hsa
uuuucaaaagcuuaaggcccaaauacaaacuucucuggaauaaacgugguguuuuauuuucu

SEQ ID NO: 70135 - RNA, 62 nt, hsa
caagccuuggcucguucucuucucucuucaaucucuggaaaaauaaguacauauaguugaua

SEQ ID NO: 70136 - RNA, 62 nt, hsa
gccuggaaauuaaacccugccccacuucucuacucuggaaguccccgggagccucuccuugc

SEQ ID NO: 70137 - RNA, 62 nt, hsa
agccagugagcauuacuuuuaaauaggaccuucucuggaaaauuauuuugguuaauguaaua

SEQ ID NO: 70138 - RNA, 62 nt, hsa
aucccucccauauuuucuuuuugcugcuuuugcucuggaacuuugcuuuuagcagggaaagc

SEQ ID NO: 70139 - RNA, 62 nt, hsa
cucaugaacacuaagauuaauugugucuguaucucuggaacugggugcucauguugguuuua

SEQ ID NO: 70140 - RNA, 62 nt, hsa
guggacuccguggggcuccaccagccagaagccucuggaaggcaacgaaggcaaugcugcuc

SEQ ID NO: 70141 - RNA, 62 nt, hsa
ucuggaaccucugugacgccaguucucccugacucuggaaccucugugauccuuugcagguu

SEQ ID NO: 70142 - RNA, 62 nt, hsa
uucacucagcugcuccucucaguucucccugacucuggaaccucugugacgccaguucuccc

SEQ ID NO: 70143 - RNA, 62 nt, hsa
cucuguguacagcgcugugcauguuacauuugcucuggaaacaucucugggguuugcuuguu

SEQ ID NO: 70144 - RNA, 62 nt, hsa
ucugugaugcucccaagcaaaggaaaugcaagcucuggaaauucguuaauguauuugauguc

SEQ ID NO: 70145 - RNA, 62 nt, hsa
cagggccuccagcccucucacugugucccucucucuggaaaggaggaaggagccuauggcau

SEQ ID NO: 70146 - RNA, 62 nt, hsa
gagaagcacuuggcuggcugagcaaauucauccucuggaaauauucucucucagccacagug

SEQ ID NO: 70147 - RNA, 62 nt, hsa
gacccugccccuggcugggagcuccccuggggcucuggaaccugaagcccugagaaggagag

SEQ ID NO: 70148 - RNA, 62 nt, hsa
ugacuuugauuccugcgccuuuuaguuuugaacucuggaauuccucugcccccuccccaaca

SEQ ID NO: 70149 - RNA, 62 nt, hsa
uggaauacccaaggucauguagccagugagugcucuggaaagccaaagcagcucaucccuuc

SEQ ID NO: 70150 - RNA, 62 nt, hsa
uugguaagaguagcuggguuuucuaagccacucucuggaaucucuuuguguuagggucucga

SEQ ID NO: 70151 - RNA, 62 nt, hsa
uucacuccagucccaccccacgccugacuccccucuggaaacugcaggccagaugguugcug

SEQ ID NO: 70152 - RNA, 62 nt, hsa
uguaugcauucauuuauuccuugcuggacaaacucuggaagcagcgugugaaacagcggggg

SEQ ID NO: 70153 - RNA, 62 nt, hsa
ggguagcagcuggugggacacugaucugugagcucuggaaugucugcuuagaauucugagag

SEQ ID NO: 70154 - RNA, 62 nt, hsa
gucacgccaggaggcuguggcugcugugggcccucuggaauugugcuccucacaaaguuucc

SEQ ID NO: 70155 - RNA, 62 nt, hsa
uuggcgucuguucugggagcacggaugauaagcucuggaagcuggcaguguguaaagcacug

SEQ ID NO: 70156 - RNA, 62 nt, hsa
gagugggcgcaggcacgccaggccuucuuuagcucuggaaagaauaaggcugccuuggaggc

SEQ ID NO: 70157 - RNA, 62 nt, hsa
gggauuuguggcagggauuccacucagaaccucucuggaauuugugccugaugugccuucca

SEQ ID NO: 70158 - RNA, 62 nt, hsa
uuccuacaaguuaaccaguugcacuacauaaucucuggaaauuaauuuucucuuuaggagaa

SEQ ID NO: 70159 - RNA, 62 nt, hsa
uugucuacccaaucaacaguuuucccucuuugcucuggaaauauuuguacucauauagcaua

SEQ ID NO: 70160 - RNA, 62 nt, hsa
aaaugcuuuuccaacccaugagugcuaagagccucuggaagggagggcuucaggcccgaagg

SEQ ID NO: 70161 - RNA, 62 nt, hsa
ugaaauuaccugauaacuuaagacucugugaucucuggaaucaccauauguuucuuuuuugu

SEQ ID NO: 70162 - RNA, 62 nt, hsa
ucaggggugguuacauagaccagcagcuacagcucuggaaauugaaaucauaaucugucaau

SEQ ID NO: 70163 - RNA, 62 nt, hsa
ggcuguggaguaagagggaaugcggugaggcacucuggaauaugacccuaccagagguugga

SEQ ID NO: 70164 - RNA, 62 nt, hsa
uuaacucuagaaauucucaguaugggguuucccucuggaaaaagaaaaucugaagacauuac

SEQ ID NO: 70165 - RNA, 62 nt, hsa
guuaaacaaaccauccauaacuuggaauacugcucuggaaugaaaaggaacuaacuguugau

SEQ ID NO: 70166 - RNA, 62 nt, hsa
cugcccuuugauguccuugagcuacucuucagcucuggaaguuguggacaaaccguaggaau

SEQ ID NO: 70167 - RNA, 62 nt, hsa
gguguuuccgugacuuagcugugucccuguagcucuggaacugaaggaacuagguaggagag

SEQ ID NO: 70168 - RNA, 62 nt, hsa
gagcaccccgggaucauuuucuagguucauuucucuggaacauuugcuguagcaucuggucu

SEQ ID NO: 70169 - RNA, 62 nt, hsa
aauucccagagcagacuuaccuggucaccgcucucuggaaaaccaaggcuccccgugcuucu

SEQ ID NO: 70170 - RNA, 62 nt, hsa
aaagacuugcacaaauacggauccugcacugacucuggaaaaggcauauauguacuaguggc

SEQ ID NO: 70171 - RNA, 62 nt, hsa
gguaaguacauaauugugaauucauaaguuaucucuggaaagagacaugagaaccugguaac

SEQ ID NO: 70172 - RNA, 62 nt, hsa
caacaguaucuuaaguuuaacugggcacuucccucuggaaaucacaguguugugcaccagga

SEQ ID NO: 70173 - RNA, 62 nt, hsa
agcucuuuaaaaauaaauugcucuggucccaccucuggaaaucugauucagccagcauggau

SEQ ID NO: 70174 - RNA, 62 nt, hsa
cagaaaagaaaagcagagucagcuacugagagcucuggaaagaaggaugucaagaaggugaa

SEQ ID NO: 70175 - RNA, 62 nt, hsa
gagagagaugacauaaccauaugucauguagccucuggaaaaguccucuguauccucaugag

SEQ ID NO: 70176 - RNA, 63 nt, hsa
auccuggaccugggaggccccugugagggccagcucuggaaaaaccugggaguugaugccgga

SEQ ID NO: 70177 - RNA, 63 nt, hsa
ggcaacugucacgugugcuagaagguucgaugccucuggaaugcaugugauacucaucuccau

SEQ ID NO: 70178 - RNA, 63 nt, hsa
caggacacagggauggauaccaccuacccucgccucuggaauggccuacccaacccgagaaga

SEQ ID NO: 70179 - RNA, 63 nt, hsa
aagaaaccaaagucugccgcccaccucgcuccccucuggaaucuuccccaagggccaaaccca

SEQ ID NO: 70180 - RNA, 63 nt, hsa
caucuccugacccucccacucccaucuccuuaccucuggaaccccccaggcccuacaaugcuc

SEQ ID NO: 70181 - RNA, 63 nt, hsa
cugacugucacucggcucucccuacccauuuggcucuggaagcugcuuggcccccccagauca

SEQ ID NO: 70182 - RNA, 63 nt, hsa
gauucuggaccaccaccugggaccaaccuucagcucuggaaccuucauaaagcaggucagcgu

SEQ ID NO: 70183 - RNA, 63 nt, hsa
guauccaugcucuguggccaggugccugccacccucuggaacucacaaaagcuggcuuuuauu

SEQ ID NO: 70184 - RNA, 63 nt, hsa
gugggaguuauggggucaucaaggaccuugccucucuggaaucugucaacccaguuuugggcu

SEQ ID NO: 70185 - RNA, 63 nt, hsa
agcgaccccaccugccauuaccuucagggccuccucuggaagagaacccauucucagagugca

SEQ ID NO: 70186 - RNA, 63 nt, hsa
gcagacagacagaaagccagaggcuuagggaaacucuggaacccagacaagaaucuuuucgcu

SEQ ID NO: 70187 - RNA, 63 nt, hsa
aaacucccaaauugucaaguccugcuuaacuuucucuggaaaauagaccccuucucaacauca

SEQ ID NO: 70188 - RNA, 63 nt, hsa
aauauuauuaauaacccccucugaauuucaugucucuggaauugaggugguagugaacagcag

SEQ ID NO: 70189 - RNA, 52 nt, hsa; identical to SEQ ID NO: 69143

SEQ ID NO: 70190 - RNA, 63 nt, hsa
ggcguccugugacucgccuugccacaucugugucucuggaacccaggaccucuggaccucagg

SEQ ID NO: 70191 - RNA, 63 nt, hsa
aaaccccagccuaaugaaacccuagguguugggcucuggaaugggacuuugucccuucuaauu

SEQ ID NO: 70192 - RNA, 63 nt, hsa
aauauauauauaaaaccagagcugacaaugacacucuggaacauugcauaccuucuguacauu

SEQ ID NO: 70193 - RNA, 63 nt, hsa
gaaggcagagggaugaaaugccaagacucuaugcucuggaaaaccugaggccaaauauugauc

SEQ ID NO: 70194 - RNA, 63 nt, hsa
aauacuauguuaugaaugguauuaaauuuuagucucuggaacauccaaaaccaagcaaaggga

SEQ ID NO: 70195 - RNA, 63 nt, hsa
aacagcaggauguugaauugaucaucagaugcccucuggaaugguuagcauccaaggugacag

SEQ ID NO: 70196 - RNA, 63 nt, hsa
uaaggcuagauccuucccauaguaucaucuguccucuggaaugacucuccugucccuaaaggg

SEQ ID NO: 70197 - RNA, 63 nt, hsa
accucuugcuccucauuccuccccugcccuuuucucuggaauaucuaagaugugagcugcauu

SEQ ID NO: 70198 - RNA, 63 nt, hsa
agacgagacugagguuaaacaucagaaaaaaaccucuggaaugaccuuccucauuccaggagg

SEQ ID NO: 70199 - RNA, 63 nt, hsa
aauuuguuacuuaaauauauagagaccaguuuucucuggaaguuuguuuaaaugacagaagcg

SEQ ID NO: 70200 - RNA, 63 nt, hsa
ccuaaccccucccucaauaaauacauuacuguacucuggaauuuaggcaaaaccuuaaaucuc

SEQ ID NO: 70201 - RNA, 63 nt, hsa
auauuuuugaaguaaauuaaacauuuuucacaucucuggaaauuuagaguucuagaccucugg

SEQ ID NO: 70202 - RNA, 63 nt, hsa
uuauauuuauuguuagaaaaugacuuauuucugcucuggaauaaaguugcagaugauucaaac

SEQ ID NO: 70203 - RNA, 63 nt, hsa
agcuacgugguggccgucugccaacuccagcaucucuggaaaaucuccacgcugaaugugauu

SEQ ID NO: 70204 - RNA, 63 nt, hsa
gcggacaucaagggcggacaccaccaaggggcccucuggaacuugagaccacuggaggcacac

SEQ ID NO: 70205 - RNA, 63 nt, hsa
agugugacccugcucuuccagcuccugggccagcucuggaagggcuguauuugggccuaaucc

SEQ ID NO: 70206 - RNA, 63 nt, hsa
ggauauggucauuuacaagacacaucuugugcccucuggaagcucauaggguugugaggcaaa

SEQ ID NO: 70207 - RNA, 63 nt, hsa
ccucguggcuuggauagaauccagggcucguggcucuggaaugugucugaacuugcugccucc

SEQ ID NO: 70208 - RNA, 63 nt, hsa
ggagacgauagggcauaugaaauucacuaaacucucuggaaaaaaaauauguauauauuaaaa

SEQ ID NO: 70209 - RNA, 63 nt, hsa
auaaaaccaucaaauuuuauaauugagaugauacucuggaaaaacaugucauuucauuuucag

SEQ ID NO: 70210 - RNA, 63 nt, hsa
ugcuccaggccacuaggccucccuugcagccaacucuggaaggcagaggaguaagagaggaag

SEQ ID NO: 70211 - RNA, 63 nt, hsa
auucaaucucuucuucaaaucaaaaugagaauucucuggaauaacagauucuuguuugguaaa

SEQ ID NO: 70212 - RNA, 63 nt, hsa
gcuuuccuagaauuuaaaaauaaaaaagucuuccucuggaaagagaagucacacagacaauca

SEQ ID NO: 70213 - RNA, 63 nt, hsa
agguuuugaugcuagugaucuucagaucuuucucucuggaaaugugcagagagugucaguuuc

SEQ ID NO: 70214 - RNA, 63 nt, hsa
ugagaaacaaaacuaauuuuuggagcagauggucucuggaauugcauauccugcuagugauuu

SEQ ID NO: 70215 - RNA, 63 nt, hsa
gcauaggcucuuuuugcugccugugagcagucccucuggaaagaaacaugugaguaagugaga

SEQ ID NO: 70216 - RNA, 57 nt, hsa; identical to SEQ ID NO: 69170

SEQ ID NO: 70217 - RNA, 63 nt, hsa
aaagagccuggggaggagcuuaaaacucaaccacucuggaauuuacccauagaagacgggaag

SEQ ID NO: 70218 - RNA, 63 nt, hsa
gaggcuggagacagggguuugaggugggggccucucuggaagcacauuuggagggaaagacaa

SEQ ID NO: 70219 - RNA, 63 nt, hsa
gguggggugauagggugggcuaaaaaccaugcacucuggaauuuguuguauuuucucccagua

SEQ ID NO: 70220 - RNA, 63 nt, hsa
aauugugaucuaggcugcugggcugaauucucccucuggaaacugaguuacaaccaccaauac

SEQ ID NO: 70221 - RNA, 63 nt, hsa
guggcucauacacacuuaaaaggcuuaauguuucucuggaaagcgucccagaauauuagccag

SEQ ID NO: 70222 - RNA, 63 nt, hsa
uucccuauuuguuuucuucuguauguuagggugcucuggaagagaggaaugccugugugagca

SEQ ID NO: 70223 - RNA, 63 nt, hsa
cccccacuucuucccuccagccugcaugcccuccucuggaacugggauuaaacagauacccaa

SEQ ID NO: 70224 - RNA, 63 nt, hsa
gcuacagaggugaccaggccuggcaguugaaaucucuggaagagggaacauguggggacuacu

SEQ ID NO: 70225 - RNA, 63 nt, hsa
cugaugacccucugcgguugucaggcgugaauccucuggaaggaacuguuugcaguuguaugc

SEQ ID NO: 70226 - RNA, 63 nt, hsa
uaucucuuaacagguugaaguuauugcaaaacacucuggaaaguaauaauuacaucauaauca

SEQ ID NO: 70227 - RNA, 63 nt, hsa
gcugcagaugcuacugacugcuugcuagguagccucuggaaagcauuccccauccaucacucc

SEQ ID NO: 70228 - RNA, 63 nt, hsa
caccccuaccccagucacucgccccuuccucaucucuggaauuuggccaggcagucccagaag

SEQ ID NO: 70229 - RNA, 63 nt, hsa
ggugagagcccgucacaguccuggguguggcugcucuggaagaauuaggaggcagccauaaua

SEQ ID NO: 70230 - RNA, 63 nt, hsa
uuuaauggguuauuucucuuugaggguggcuuucucuggaacauugguuagagcagcuuuguu

SEQ ID NO: 70231 - RNA, 63 nt, hsa
gagaugcagggauuggccagcuggguugguuugcucuggaauggcuaacucuugccugcuuug

SEQ ID NO: 70232 - RNA, 63 nt, hsa
uuaccaggcuguaaaagcaaaaccucguaucagcucuggaacaauaccugcaguuauucuuca

SEQ ID NO: 70233 - RNA, 61 nt, hsa; identical to SEQ ID NO: 69187

SEQ ID NO: 70234 - RNA, 63 nt, hsa
uccaguccugaguuugcuacuuacuucuguggccucuggaaccuuauccaaccucuuggugcu

SEQ ID NO: 70235 - RNA, 63 nt, hsa
uaaaaccaccaggaaugaauucacuccccacuucucuggaaccucaggacccgcccauuucuc

SEQ ID NO: 70236 - RNA, 63 nt, hsa
ugccucuggguacaaaagugccucaacgacaugcucuggaaaucccaaaugccacagucugag

SEQ ID NO: 70237 - RNA, 63 nt, hsa
ggggagaaggcgcuaccugcgugggacccucuucucuggaaaccuaauccuccuuucauuucc

SEQ ID NO: 70238 - RNA, 63 nt, hsa
uuuuuuuuuuccccaguauugcccuggagcugucucuggaaaguagcuggcgagguuaccuua

SEQ ID NO: 70239 - RNA, 63 nt, hsa
agauucaagauagcugugauuucucucaccguucucuggaaauggcaucagauuuaaggauaa

SEQ ID NO: 70240 - RNA, 63 nt, hsa
cagccucucccugccaaagcccaacucccagggcucuggaaauggugaggcgaggggcuugag

SEQ ID NO: 70241 - RNA, 63 nt, hsa
gacauuccuccauguccucacggcuggauuucucucuggaaaggauuuucauucaucauggug

SEQ ID NO: 70242 - RNA, 63 nt, hsa
cccucuguaggccaguaguucucaaaguguggucucuggaagagcaguaucagcaucaucugg

SEQ ID NO: 70243 - RNA, 63 nt, hsa
auuaucuuacugaacaccuguagucccagcuuucucuggaaguggucguauuugagcaggaug

SEQ ID NO: 70244 - RNA, 63 nt, hsa
uaggaagggggcagggacgugaccuugacuuaccucuggaaagggucccagccuagacugcuu

SEQ ID NO: 70245 - RNA, 63 nt, hsa
ccccgguugcuggucagguccccauggcuuguucucuggaaccugacuuuagauguuuuggga

SEQ ID NO: 70246 - RNA, 63 nt, hsa
agggguggcgcucagaccccacccuacgcucaucucuggaaggggcagcccugaguggucacu

SEQ ID NO: 70247 - RNA, 63 nt, hsa
ccgggcaagcacuaccaggcugugggucugcaccucuggaagguagagaagcggcgggucaau

SEQ ID NO: 70248 - RNA, 63 nt, hsa
accuccccuuuaaauuaaaaaaaauguauguaucucuggaagucaauaauuuccagugagcgg

SEQ ID NO: 70249 - RNA, 63 nt, hsa
ggauguucaguuuagaaccauuuugucugcucccucuggaagccuugcgcagagcuuacuuug

SEQ ID NO: 70250 - RNA, 63 nt, hsa
uuggucuucuuagaguugcaggauacacuugcucucuggaaguguguccuuacccuucugcag

SEQ ID NO: 70251 - RNA, 63 nt, hsa
aacugaucaggugucuauaacauuuuucauucucucuggaaacagacucagguuucuuuggac

SEQ ID NO: 70252 - RNA, 63 nt, hsa
uuuuccccuaaguccuaacagaaugguauauuccucuggaaaaagaugaacgucaccaaugga

SEQ ID NO: 70253 - RNA, 63 nt, hsa
ccugagcacaggccgauggaggugguucaaauccucuggaacauagccaagaccaggagaaga

SEQ ID NO: 70254 - RNA, 63 nt, hsa; identical to SEQ ID NO: 70235

SEQ ID NO: 70255 - RNA, 63 nt, hsa
uuucacauuaagaaugugccugaggcugcuuuacucuggaauagucucagaucuaaaauuucc

SEQ ID NO: 70256 - RNA, 63 nt, hsa
agcaguugaucagacugaaaaacgguuuuuagucucuggaaaaagacugauuuugcuuuuuuu

SEQ ID NO: 70257 - RNA, 63 nt, hsa
uacuucaaucuagaauucuccaguagguaccaucucuggaaaaaagcugggucucauguuuga

SEQ ID NO: 70258 - RNA, 63 nt, hsa
accugguucccugccucuguauucagguguggccucuggaaccugacuccguuaggacgaaca

SEQ ID NO: 70259 - RNA, 63 nt, hsa
uuauggaucagugacuguaguaggaguuugaggcucuggaacucucacauauucaagucuuua

SEQ ID NO: 70260 - RNA, 63 nt, hsa
uuugaaggcaagugacuucaguugagggcaagucucuggaaaagaggcuguaggcaucuggca

SEQ ID NO: 70261 - RNA, 63 nt, hsa
agcccuggccucugccugccucccgccugugcacucuggaaccucuggccucaggggaccugc

SEQ ID NO: 70262 - RNA, 63 nt, hsa
uuuucucuugugucccuacucauugaaaccaaacucuggaaaggacccaauguaccaguauuu

SEQ ID NO: 70263 - RNA, 63 nt, hsa
ugcaguccacuugcugaagaaguugugucauuucucuggaagaauuuccaaaauucuggauuu

SEQ ID NO: 70264 - RNA, 63 nt, hsa
cuucaauauccacuucuuucagccuacuguagacucuggaaguauacuuuuugcauauguaag

SEQ ID NO: 70265 - RNA, 63 nt, hsa
aguuauaggccuugccaggguuucgagaagcugcucuggaauuugcaagucauggcugugccc

SEQ ID NO: 70266 - RNA, 63 nt, hsa
agaagcauuugugguaguaaaggaaaaccaacccucuggaaaauacauuuugagaaucucaaa

SEQ ID NO: 70267 - RNA, 63 nt, hsa
uguggcuugauguggcaagccgaaaccacuuggcucuggaaaucuaaguucauacugguuuaa

SEQ ID NO: 70268 - RNA, 63 nt, hsa
cuuuuuacuuuuauauuuuugcuugaaucuuaacucuggaaaucaccugauguagaagaagac

SEQ ID NO: 70269 - RNA, 63 nt, hsa
gaaggaaucgugcucucaaugcaaagugucauucucuggaauugcaccuggcucaggaaagga

SEQ ID NO: 70270 - RNA, 63 nt, hsa
guggccuauggagagacaggccuuucucucagccucuggaagccaccugcucuuuugcucuag

SEQ ID NO: 70271 - RNA, 63 nt, hsa
agcuccuagagaagaacaauccucauggagaaacucuggaaaccuugacaauggcaacagugu

SEQ ID NO: 70272 - RNA, 63 nt, hsa
uccucuccaagcccuccucugaaccagcuaucccucuggaaugcagcugaccaaacaaauucc

SEQ ID NO: 70273 - RNA, 63 nt, hsa
gcugcaauaacaggaacaugagacuucgcaaaucucuggaaaauaauauccaaaugaaauuaa

SEQ ID NO: 70274 - RNA, 63 nt, hsa
ucuguuuucaauauaauucuugauuucauuuuucucuggaauauauuggccuucuacagcuau

SEQ ID NO: 70275 - RNA, 63 nt, hsa
gcccagggaagccccugguucugucccuggagacucuggaaauccuuuugcauuaaaaggacu

SEQ ID NO: 70276 - RNA, 63 nt, hsa
ugugaccuggucuggucaggcaaugcccugcggcucuggaaagcaacuucaucccagcugcug

SEQ ID NO: 70277 - RNA, 63 nt, hsa
ugguuaugcccaucuccauagccagaccaagcacucuggaagccaggguugggugcuuauuua

SEQ ID NO: 70278 - RNA, 63 nt, hsa
gauaugaaccugaagauuaaaacugaagauuuccucuggaagcuaccacaugcaaacauacaa

SEQ ID NO: 70279 - RNA, 63 nt, hsa
gacuucagccugugaggggaggguugagggaggcucuggaaagcccagccacaccugaguccc

SEQ ID NO: 70280 - RNA, 63 nt, hsa
auccuccaggaucuagccuucuaucuaccucuucucuggaauguuuauggugguucagaagaa

SEQ ID NO: 70281 - RNA, 63 nt, hsa
ucagaagccaccuggaagacccaguguuuccaucucuggaaucucuguuuuaugcuaaaugga

SEQ ID NO: 70282 - RNA, 63 nt, hsa
augaguaaaauggaauaauaccuaacaggcaggcucuggaaguuggaaaucacauacacacac

SEQ ID NO: 70283 - RNA, 63 nt, hsa
acaaugaaccaccugauuacaagagccucauuccucuggaacgugcagucaucaauggucagu

SEQ ID NO: 70284 - RNA, 63 nt, hsa
ugcuguguuuaaauaaauugaaaacuacguaaacucuggaaaguauucuauaagaaaaagcug

SEQ ID NO: 70285 - RNA, 63 nt, hsa
cuguccaguaaagagauugauuuguuuguauggcucuggaauaacucauucguuuaugaacac

SEQ ID NO: 70286 - RNA, 63 nt, hsa
aaacuuuguauuuuugaagcggcaaacucuguucucuggaaugcucugaaguuauggcuggga

SEQ ID NO: 70287 - RNA, 63 nt, hsa
gagcccaugggggcuggaggggggcagcugggacucuggaaucuucuuuauaauaaaagccuu

SEQ ID NO: 70288 - RNA, 63 nt, hsa
gaagacccccuccagaagcauacuggaagccaccucuggaaaagccucauauggugauaugcc

SEQ ID NO: 70289 - RNA, 63 nt, hsa
gcccuuugccagacagcucugucuccccauguccucuggaacagcugggcaugggucauggcc

SEQ ID NO: 70290 - RNA, 63 nt, hsa
uaguaaacaauggugauuuuauuuauuuuuacucucuggaaaaggagauaauacaauuccaga

SEQ ID NO: 70291 - RNA, 63 nt, hsa
guaaaauugaucggauugauuaaaaaacaaauucucuggaauuugugcguucaugcuuuuucg

SEQ ID NO: 70292 - RNA, 63 nt, hsa
guuuuuuguuucucagucugcuuuagcuuuuaacucuggaagcgcaugcacacugaacucugc

SEQ ID NO: 70293 - RNA, 63 nt, hsa
acaaaauagccuauccuuaauaaauccuccacucucuggaaggagacugaggggcuuuguaaa

SEQ ID NO: 70294 - RNA, 63 nt, hsa
auguauaguuccccguguucacuaacaugcccucucuggaaagcauauguauauaacaugugu

SEQ ID NO: 70295 - RNA, 63 nt, hsa
ucuggccauuggugcguguuucauucagaucaccucuggaaucucugugguugugaaggcaau

SEQ ID NO: 70296 - RNA, 63 nt, hsa
ggagcacagggagcuucuguuguucugaucuaucucuggaaaaccagccauuccuccucccug

SEQ ID NO: 70297 - RNA, 63 nt, hsa
uccgagccucaggccaaggaccccugaugcagacucuggaaucccuggcccaaaggccugucu

SEQ ID NO: 70298 - RNA, 63 nt, hsa
ccaccugauggcuguucucccaccgggucugggcucuggaaggagccagaugcccccagaaag

SEQ ID NO: 70299 - RNA, 63 nt, hsa
uucccgaaguaauaagugaggacgaaugcacugcucuggaacauaacccagugcuaacugggg

SEQ ID NO: 70300 - RNA, 63 nt, hsa
gaauugcuuuucucuuaccaguaugauuuguaacucuggaacacuauucuuacagaaugccuu

SEQ ID NO: 70301 - RNA, 63 nt, hsa
acauuaagaugagcccuaauauguaagauuuuccucuggaauggaugugagaaauguaaauuu

SEQ ID NO: 70302 - RNA, 63 nt, hsa
gagaacuaaauuguuucuaaauguagauggucccucuggaaaagcaguuuucagcaggggugg

SEQ ID NO: 70303 - RNA, 63 nt, hsa
uaugcagaaaaaaaagugcugcaguuuagauaccucuggaauuuuuccacagugucacagguu

SEQ ID NO: 70304 - RNA, 63 nt, hsa
uaaaacuugaaucaggauuuuaugccccacauacucuggaacuugaaguauaauauacuuaau

SEQ ID NO: 70305 - RNA, 63 nt, hsa
ucaucuguaucuuaaauggccccaggcaucugccucuggaaaacuauugagccuugcauguac

SEQ ID NO: 70306 - RNA, 63 nt, hsa
auggguggcagccccugguagaaugcuggauuucucuggaaucuagaagugccauauuuuagu

SEQ ID NO: 70307 - RNA, 63 nt, hsa
ccauccgucucuguccgcguccuuuccucuccucucuggaagguuuugcuucuuacgaacgcc

SEQ ID NO: 70308 - RNA, 63 nt, hsa
agcucagcuaccacuuccccuucccucugcacccucuggaacccuggcccaauuccucagacc

SEQ ID NO: 70309 - RNA, 63 nt, hsa
cucuagauuuucuucugugcuucucucuaucugcucuggaauggaugagugaauguguucugg

SEQ ID NO: 70310 - RNA, 63 nt, hsa
ucagcuucagaaauguuuuaaaagggacuuuagcucuggaacucaaaaucaauuuauuaagag

SEQ ID NO: 70311 - RNA, 63 nt, hsa
agaauuuuagcagaugguacuuuucucagugaccucuggaauaaaagaacugacuuuugauag

SEQ ID NO: 70312 - RNA, 63 nt, hsa
guuaaccaggagacuacuccugugacuguggagcucuggaaggcuuggugggagugaauuugc

SEQ ID NO: 70313 - RNA, 63 nt, hsa
aaucacuuagcuccucauaacaagucuaacuggcucuggaaagcugaaagggcugcacuggaa

SEQ ID NO: 70314 - RNA, 63 nt, hsa
gauccuucuccugaaguucagccacccugaggccucuggaaagcaaagggcuccucuccaguc

SEQ ID NO: 70315 - RNA, 63 nt, hsa
gaauccugcuaaaggagcaaagccuuguauuaccucuggaagacaacaaaaacaauuggcaac

SEQ ID NO: 70316 - RNA, 63 nt, hsa
aaaaucaguaucuagaugguuuuuaaauguauucucuggaaauuguuuuauguaaaauaaaug

SEQ ID NO: 70317 - RNA, 63 nt, hsa
ugcagauaugaagagcauuuuaagaggugcagccucuggaaguggaucaaacuagaacucaua

SEQ ID NO: 70318 - RNA, 59 nt, hsa; identical to SEQ ID NO: 69272

SEQ ID NO: 70319 - RNA, 63 nt, hsa
cauauuuuguguccccaccuugauguuacaugacucuggaacaauaugaacuggauuuaagaa

SEQ ID NO: 70320 - RNA, 63 nt, hsa
cauucuuuuacuuaaccaggcuuauggcaugaucucuggaacaaauuuguaggaaaaaauuac

SEQ ID NO: 70321 - RNA, 63 nt, hsa
ggagggcaccaaguuuuccuuuuuucuaaauagcucuggaaccaggcuuguaauccauagcau

SEQ ID NO: 70322 - RNA, 63 nt, hsa
uuuguagaaaagguuuccucuagaacugaauuccucuggaauugagugauggacuucacaaca

SEQ ID NO: 70323 - RNA, 63 nt, hsa
uaauaucugggccuuggaaggaaggacacagggcucuggaaggaggaggcugcaugccugaag

SEQ ID NO: 70324 - RNA, 63 nt, hsa
ggacuccaguugccucagguugguucugcugugcucuggaaaguaacugcagccaccagguau

SEQ ID NO: 70325 - RNA, 63 nt, hsa
gauguuuuuagaggggcaaaaauauuuugcaagcucuggaauuguugaauguauucuuuuaua

SEQ ID NO: 70326 - RNA, 63 nt, hsa
guauucuugagggacaaugccaauagguauauccucuggaaaaggcuuucaugauuuggcaug

SEQ ID NO: 70327 - RNA, 63 nt, hsa
aggaagaaaagagcugggacaauaaaacacuggcucuggaaucuggaauguuaaguccaggcc

SEQ ID NO: 70328 - RNA, 63 nt, hsa
uuuuauucaagauugugcucuucuaucaaaagccucuggaaauaaauguuccgggaucauguu

SEQ ID NO: 70329 - RNA, 63 nt, hsa
gaaggaaaaacuaagagaaugaaaaguauuugccucuggaaagaacaacuggcaggacuguug

SEQ ID NO: 70330 - RNA, 63 nt, hsa
augaccauuaagaaccagaaaaauaauuaaucucucuggaaaaaggaaagcuaaagaagacua

SEQ ID NO: 70331 - RNA, 63 nt, hsa
uuuagaauguaauauguaaacugugauuugguccucuggaaaaaaaaaaaugaaaugaagagu

SEQ ID NO: 70332 - RNA, 63 nt, hsa
aaucuccugugaucugugcuagcugugaggcagcucuggaacgugaagagcuguuugguuuga

SEQ ID NO: 70333 - RNA, 63 nt, hsa
uuucccaucucaagcauauaaguugaccugcaucucuggaaggaccuugagauugaugcauuu

SEQ ID NO: 70334 - RNA, 63 nt, hsa
ggucuuauccuuugcucuguuuuucucuucaggcucuggaaaaucagaucugugacuuaaucu

SEQ ID NO: 70335 - RNA, 63 nt, hsa
aaauaagaaggcccuguugacgggcugucuuggcucuggaauucaugcauccuggccuugcca

SEQ ID NO: 70336 - RNA, 63 nt, hsa
ucuuuuuacacuuauuuauuaucauucucacuucucuggaagccacaacuggugucagggcuc

SEQ ID NO: 70337 - RNA, 63 nt, hsa
gcagccgccugcccgggagaacccugccugaagcucuggaaacuuguggguggggcccaggga

SEQ ID NO: 70338 - RNA, 63 nt, hsa
ccaaacacccugcugcuggcugccaggcaggcccucuggaagggaaggggcaggacucaucag

SEQ ID NO: 70339 - RNA, 63 nt, hsa
uuuguagcagaguacauaacuacauaaugccaacucuggaaucaaauuuccuuguuugaaucc

SEQ ID NO: 70340 - RNA, 63 nt, hsa
uucuguggaugccagcuuuggaaucagagccgccucuggaauaccugugcuuccagaguuagc

SEQ ID NO: 70341 - RNA, 63 nt, hsa
gccaggcgcgguggcucaggccuguaaucccagcucuggaagcugaaggauagcuugagccca

SEQ ID NO: 70342 - RNA, 63 nt, hsa
auuuccuaucauuuuauuaucaccaugcaaugccucuggaauaaaacauacaggagucugucu

SEQ ID NO: 70343 - RNA, 63 nt, hsa
caugugaccacauacguguuaggaggcugcaugcucuggaagccuggacucuaagcuggagcu

SEQ ID NO: 70344 - RNA, 63 nt, hsa
uauucuagauggaggaggcacugaugcuuguaacucuggaaagaggccuacacccaagggcua

SEQ ID NO: 70345 - RNA, 63 nt, hsa
cuaagaugauauuucagaagaguuggcugccuucucuggaaacaaggaaaacccaauaauucc

SEQ ID NO: 70346 - RNA, 63 nt, hsa
ucgccugaagccuuccucuggcuucacagaaugcucuggaacucuggggucuggucagggagu

SEQ ID NO: 70347 - RNA, 63 nt, hsa
gauucagggcccccucagcugucuccucccucccucuggaaaggaggguggggcucaggggcc

SEQ ID NO: 70348 - RNA, 63 nt, hsa
agaaaaugccaucucuuuuuaguugaaggaaaacucuggaaguaggugccauuggucauucug

SEQ ID NO: 70349 - RNA, 63 nt, hsa
aagcucucucgacagcaaaugguuuccccucaccucuggaauuaaagaaggaacuccaaaguu

SEQ ID NO: 70350 - RNA, 63 nt, hsa
aauacaaaaccacuucagagaccaggguaucuccucuggaaggaucuaagagaagguaagaca

SEQ ID NO: 70351 - RNA, 63 nt, hsa
uacgugugaucuuugaaaaccuuggcuuuagcccucuggaaucagagcuuacccaccauagua

SEQ ID NO: 70352 - RNA, 63 nt, hsa
gcauggagcagauugaaaugcaaaaacccacaccucuggaagauaccuucacggccgcugcug

SEQ ID NO: 70353 - RNA, 63 nt, hsa
aaugaguaaucaacaaaaucugccagagagucccucuggaaccauauaaaguuccuggcuuug

SEQ ID NO: 70354 - RNA, 63 nt, hsa
cugggaguagagagacacacuaacagccacacccucuggaaaucugauacaguaaauauauga

SEQ ID NO: 70355 - RNA, 63 nt, hsa
cagcgcuaaguaaacuugccaaggagggacuuucucuggaauuuccugauaugaccaagaaag

SEQ ID NO: 70356 - RNA, 63 nt, hsa
caaagaaggaagaaaagaaggaguggaggaagacucuggaacccuggaagcuguaugccacag

SEQ ID NO: 70357 - RNA, 63 nt, hsa
uuuugaccacgaccuuggccccagcucugcacucucuggaauaagggcccgaugcagcauuuu

SEQ ID NO: 70358 - RNA, 63 nt, hsa
gagugcuacuaaaacauuuucuucucuccuggccucuggaagcaucuuuagcuuugacuuugg

SEQ ID NO: 70359 - RNA, 63 nt, hsa
cccccacuuucccuuccccaccccacuuguaugcucuggaaucuguggagacgccagcccugc

SEQ ID NO: 70360 - RNA, 63 nt, hsa
agagcagacaucuuccacguggagaagcugcagcucuggaaagaggguuuaagaugcuaggau

SEQ ID NO: 70361 - RNA, 63 nt, hsa
cuuccuccucucaaaccuggcagaugggggccucucuggaagagggaggggcccugucacugu

SEQ ID NO: 70362 - RNA, 63 nt, hsa
ucaccucccugccccaauccuggcuccaacccucucuggaaaaucgaagugaaacauuugucu

SEQ ID NO: 70363 - RNA, 63 nt, hsa
cuauauaauuauuuucaguuacuaucccugacacucuggaaucuucuccauuucucccuauca

SEQ ID NO: 70364 - RNA, 63 nt, hsa
gcuggucauuuugccacacuuaaccauaagggacucuggaagcuguagguuagcucugcccag

SEQ ID NO: 70365 - RNA, 63 nt, hsa
gauugauagugaaaccauuagaucauugaauuccucuggaauuagaaaaccagagagucccau

SEQ ID NO: 70366 - RNA, 63 nt, hsa
cugacaggacaucuuacaagagaauuugcacaucucuggaagcuuagcaaucuuauugcacac

SEQ ID NO: 70367 - RNA, 63 nt, hsa
gcuccacggguagugcgaccucgguucugugggcucuggaaggccaccaggguagggucuccc

SEQ ID NO: 70368 - RNA, 63 nt, hsa
ucuucugaccucagacggcucugagccuuauuucucuggaagcggcuaagggacgguuggggg

SEQ ID NO: 70369 - RNA, 63 nt, hsa
ugauuguuuacaggauauuccaaaauaaaaggacucuggaagauuuucauugaggauaaauug

SEQ ID NO: 70370 - RNA, 63 nt, hsa
uuccuacaggggcuccucugugggugaggggcccucuggaauggcaucccaugagcuuguggc

SEQ ID NO: 70371 - RNA, 63 nt, hsa
guuuauuuaaugauguaauuuauuguugcguuccucuggaagcugugacuggaauaaaccccc

SEQ ID NO: 70372 - RNA, 63 nt, hsa
aagaggcuggugcuguggccagggugagagcugcucuggaaaaugugacccagauccucacaa

SEQ ID NO: 70373 - RNA, 63 nt, hsa
acugauuccaauauuauuacuuauaacacugaccucuggaaaauauuuuguucacaagaaaua

SEQ ID NO: 70374 - RNA, 63 nt, hsa
cuauaauuucuaccuauugggccuuguucuguucucuggaacuaaacagaacaaccauuuacc

SEQ ID NO: 70375 - RNA, 63 nt, hsa
gguagggcccgagcuucagcuuccaggaugcuucucuggaaccucaaggcaggcagcccaggc

SEQ ID NO: 70376 - RNA, 63 nt, hsa
guucuguugccgccuaacuuucucauccucggucucuggaaagucaggcugagaaauccuuuc

SEQ ID NO: 70377 - RNA, 63 nt, hsa
cuaacgggggugcggcaggagcaggaacagagacucuggaagccccccaccuuucucgcugga

SEQ ID NO: 70378 - RNA, 63 nt, hsa
aaccccuugggcuaggucugaccccaggugucccucuggaaggggcuggcuggugcccuauuu

SEQ ID NO: 70379 - RNA, 63 nt, hsa
uucagagacccauucuaaacaagggcauucacucucuggaaguagcauggccuugugaacuua

SEQ ID NO: 70380 - RNA, 63 nt, hsa
auuuaggggacaaacuccauccagguugacucucucuggaaugcgguaauaagagcuggcaag

SEQ ID NO: 70381 - RNA, 63 nt, hsa
uugcccucuccucaccuccuuuucucucagugacucuggaaccugaaugcagcuuacaagaca

SEQ ID NO: 70382 - RNA, 63 nt, hsa
aggagcuagcagaaaauaacucaaaguugaagacucuggaagauuuugcuuuaaccuaacucg

SEQ ID NO: 70383 - RNA, 63 nt, hsa
cugccugcuggcucucccccagccccacauccccucuggaagagaauguaaaauaaaccugga

SEQ ID NO: 70384 - RNA, 63 nt, hsa
uucuugaacccuacuuucuggaaguggaguugacucuggaaguuuucuagcaacugaacaaaa

SEQ ID NO: 70385 - RNA, 63 nt, hsa
gggccuucaguaagaccacaagucugcaggaaacucuggaaucaggaagaaaagcuauguuca

SEQ ID NO: 70386 - RNA, 63 nt, hsa
cuacaaacuccuacuacgucgucuaaauugcugcucuggaauaaggugauuucugcccccaga

SEQ ID NO: 70387 - RNA, 63 nt, hsa
ugaccuacccaaaccuuuuguucuguaaaacugcucuggaaauaccgggaagcccaguuuucu

SEQ ID NO: 70388 - RNA, 63 nt, hsa
guccuguuaaauuuacaacacuaacgauguagacucuggaaaugccuaauaagucaaagaaga

SEQ ID NO: 70389 - RNA, 63 nt, hsa
agcucaaagaggaauugggaaaaauaaauugaacucuggaaucuucucucucaaguccuaaaa

SEQ ID NO: 70390 - RNA, 63 nt, hsa
cucacuauucuuggaccaugccagauucugccucucuggaaagaggcucuggacagcagaagc

SEQ ID NO: 70391 - RNA, 63 nt, hsa
agucccuaccugcuucacguuggccggcggcuacucuggaauguuuuucccuccccagaauca

SEQ ID NO: 70392 - RNA, 63 nt, hsa
uugcacgacacagggcuggugaccucccugggccucuggaagcuuuguuucuucuguacccgg

SEQ ID NO: 70393 - RNA, 63 nt, hsa
cauauacugcuugcaauuucuguauuuauuguucucuggaaauaaauauaguuauuaaaggau

SEQ ID NO: 70394 - RNA, 63 nt, hsa
ugucauaggggcagcagucucaggggguguaaacucuggaauccacuaugguuuaccuugagu

SEQ ID NO: 70395 - RNA, 63 nt, hsa
cacuuaggaccauuugagcuugugggucacccacucuggaagaaauagucaugcuucuuuauu

SEQ ID NO: 70396 - RNA, 63 nt, hsa
agaaauuaaaaacauaacuauugccagauuuagcucuggaauguuuagaaucaggcuagaaua

SEQ ID NO: 70397 - RNA, 54 nt, hsa; identical to SEQ ID NO: 69351

SEQ ID NO: 70398 - RNA, 63 nt, hsa
ucacuucaguuguggccucauucagcagaaugacucuggaaccauccucuguuacccgcagau

SEQ ID NO: 70399 - RNA, 63 nt, hsa
aggacugacuguacacucccugaucagccagcacucuggaagcuuugggaucccaggaaccau

SEQ ID NO: 70400 - RNA, 63 nt, hsa
aacucagacuucuacuuuaccaaguaccacacacucuggaaugcuuuaguuuccuuuuccccu

SEQ ID NO: 70401 - RNA, 63 nt, hsa
cagagcacacuguccccaccgccuccccuuucucucuggaaaguugaaguaucuccaaaggcc

SEQ ID NO: 70402 - RNA, 63 nt, hsa
auugauuuuuguuucuuuuggccugauuuguaucucuggaaugcauuuauucuugaaauauuu

SEQ ID NO: 70403 - RNA, 63 nt, hsa
ugccugggaucccuuccuggagaggcaggcugucucuggaaaaagccuccauugcccacccgc

SEQ ID NO: 70404 - RNA, 63 nt, hsa
ccguuuggcacagcuuuggccacagccaggccccucuggaauuguccuuauuaaaccaguuuc

SEQ ID NO: 70405 - RNA, 63 nt, hsa
gaggccaggcugcacaccuggugggagaacacacucuggaauucucuauucuccuggucgggg

SEQ ID NO: 70406 - RNA, 63 nt, hsa
aggaccaguugcccucauuuccaaagaacugcacucuggaauuaaagggacucuuccauuuug

SEQ ID NO: 70407 - RNA, 63 nt, hsa
acuucagauucccaaagaagccagcuacagagccucuggaacacuauggucuuacaagcagua

SEQ ID NO: 70408 - RNA, 63 nt, hsa
agcgcauggcaagucacaugcguaaacgacacucucuggaagcccuggagacccucgcccaac

SEQ ID NO: 70409 - RNA, 63 nt, hsa
gccugcacugcccagugggccacuaggggcagucucuggaagggcugguucaaggcuguuugg

SEQ ID NO: 70410 - RNA, 63 nt, hsa
cagaugucacaggauuaaaugugcaguuuggggcucuggaauuugggucagaaccuucucucu

SEQ ID NO: 70411 - RNA, 63 nt, hsa
gauuaggcacacagauccccuggaaacccaccucucuggaaggccccuucccuggcagguggc

SEQ ID NO: 70412 - RNA, 63 nt, hsa
agugcaggaaaccugaacccagcucucaggucccucuggaacuuuggcucuucuuuguuuugu

SEQ ID NO: 70413 - RNA, 63 nt, hsa
caaaauuuguaauguguugcuucuacauaaguucucuggaaauaucuacaacuaauaggacac

SEQ ID NO: 70414 - RNA, 63 nt, hsa
auaguaaaacuugagaagcuuuuggggucagaucucuggaacaucaugugaugaagcugacau

SEQ ID NO: 70415 - RNA, 63 nt, hsa
agggcauccuccuugaaagaggaggacagaccucucuggaagcagcaagaggaaccaguagcu

SEQ ID NO: 70416 - RNA, 63 nt, hsa
cugucugugaaagucagaacacagggcucgagccucuggaacugacccuuugcaagucuuuac

SEQ ID NO: 70417 - RNA, 63 nt, hsa
gcuggcuuccuuaccagaaaagccucagccuuccucuggaagcaucccccguucugggcaagg

SEQ ID NO: 70418 - RNA, 63 nt, hsa
gggcagcuggggcugccaucccauuucuccugccucuggaagguggguggggcccugcaccgu

SEQ ID NO: 70419 - RNA, 63 nt, hsa
cuggggugauccucccuccugcgugguggcugucucuggaaagcaucccuugccgcugccaug

SEQ ID NO: 70420 - RNA, 63 nt, hsa
guggaccacucgcugccuuaggugccuucugcucucuggaaccagaggacuagcugacuuuug

SEQ ID NO: 70421 - RNA, 54 nt, hsa; identical to SEQ ID NO: 69375

SEQ ID NO: 70422 - RNA, 63 nt, hsa
uuucaccauagggguuauaguuggcuugugcuacucuggaaucauuuuacuguuuguuuuuau

SEQ ID NO: 70423 - RNA, 63 nt, hsa
acauuuucccacagacuuccuggccuccugugacucuggaaagcaaaggauuggcuguguauu

SEQ ID NO: 70424 - RNA, 63 nt, hsa
agagggugcugcccgcucaaugcccagcagcagcucuggaaggcagugcucagccccaucacc

SEQ ID NO: 70425 - RNA, 63 nt, hsa
ugagaaaucuaaaaaacgaaaagucuccaaagucucuggaauuugaaacacuuugcauaacgu

SEQ ID NO: 70426 - RNA, 63 nt, hsa
ugggccuccccuaagaggcuuuccccgaggcagcucuggaaucugugcccaccuggggccugg

SEQ ID NO: 70427 - RNA, 63 nt, hsa
caaugcuaguauggaggcugugaaguccccaagcucuggaagcccacacuauuuguuggugau

SEQ ID NO: 70428 - RNA, 63 nt, hsa
aaucaggaauauugugguaagcugggaguaucacucuggaagaaaguaacaucuccagaugag

SEQ ID NO: 70429 - RNA, 63 nt, hsa
uccucauuguggaaacaagccaaaccaaaugaacucuggaaaaccuaaaacaaauguacauuu

SEQ ID NO: 70430 - RNA, 63 nt, hsa
ucaagccugugcucagguugccuugaauguggacucuggaagagccaggggcccagaaugccg

SEQ ID NO: 70431 - RNA, 63 nt, hsa
caaucagcagucuucaaucgaucaauaauucugcucuggaagagaaggaacagggagcagaga

SEQ ID NO: 70432 - RNA, 63 nt, hsa
uccucaccucugcuccugucuucaucaccuucucucuggaagggaagaggaguuggaaggucu

SEQ ID NO: 70433 - RNA, 63 nt, hsa
augcagagcgaguggaugcacuucccagcucaucucuggaagccuuugcuacucaagcuccuc

SEQ ID NO: 70434 - RNA, 62 nt, hsa; identical to SEQ ID NO: 69911

SEQ ID NO: 70435 - RNA, 63 nt, hsa
acagaugcagcagcagucuuuagccagagaacucucuggaaccauuaaagaauuccugggggc

SEQ ID NO: 70436 - RNA, 63 nt, hsa
guuaacucauuauuuaauugaacauuuccaaagcucuggaaaggcaugcauuuguaggugcac

SEQ ID NO: 70437 - RNA, 63 nt, hsa
ggacauggugggaugggcauguggucccagcuacucuggaagcugaggugagaggaucacuug

SEQ ID NO: 70438 - RNA, 58 nt, hsa; identical to SEQ ID NO: 69392

SEQ ID NO: 70439 - RNA, 63 nt, hsa
uggucuggauagauagcuuacagcaguagugggcucuggaaugcccaagggaagaggcaaggu

SEQ ID NO: 70440 - RNA, 63 nt, hsa
ugacauccuggagggagacuggauuugccugcacucuggaaggcugggaaacuccuggaagac

SEQ ID NO: 70441 - RNA, 63 nt, hsa
caugugcaauaagaacauagauccuaaaggauccucuggaagcuguauuucuugaauuagaau

SEQ ID NO: 70442 - RNA, 63 nt, hsa
ccaaaacuuguuuccacauuaagagucagccagcucuggaauggucuggaaaugucuuccugg

SEQ ID NO: 70443 - RNA, 63 nt, hsa
cugcuucuuaaucaauccaaauuucauuuacagcucuggaacacuuuggggcugauuugucuc

SEQ ID NO: 70444 - RNA, 63 nt, hsa
gcucugauucagcuggggcuagcugggccgcuccucuggaagcccacacuuguggggacuuag

SEQ ID NO: 70445 - RNA, 63 nt, hsa
ucauuguguuuguuuuucauguuggaacaaucucucuggaagugccucuucuuguggcuuuua

SEQ ID NO: 70446 - RNA, 63 nt, hsa
gcgugaucuaccacaccuggccaaucccaacuacucuggaagcugaagcagcaagaucacuug

SEQ ID NO: 70447 - RNA, 63 nt, hsa
gcacaaugccuggguguccucauccuugcuuuacucuggaaaguguggggauggagaggaugg

SEQ ID NO: 70448 - RNA, 63 nt, hsa
augcuccuugaagaaucucuccucucucucucucucuggaaagacccaacuuucucacugcug

SEQ ID NO: 70449 - RNA, 63 nt, hsa
acaagcaaugcuguucuguaaauuuauugaaaccucuggaacauuucaccuuuagagauggag

SEQ ID NO: 70450 - RNA, 63 nt, hsa
uugugagauugagagaacuaugaccugcagcaacucuggaaaccuggccugacagacaagcag

SEQ ID NO: 70451 - RNA, 63 nt, hsa
uguauucucacucccuugaucucaagggcguaacucuggaagcacagcuugacuacacgucau

SEQ ID NO: 70452 - RNA, 63 nt, hsa
auugggcaagggacaaggugcuagaauccuaagcucuggaaauauuucaugacacugguguau

SEQ ID NO: 70453 - RNA, 63 nt, hsa
cacugccccugauggaacucauggagaaugaagcucuggaaauccucaccaaagcccuccgga

SEQ ID NO: 70454 - RNA, 63 nt, hsa
agccccucucugaagagacuguccuugggccuccucuggaagcagcacccccagaggacaggg

SEQ ID NO: 70455 - RNA, 63 nt, hsa
cggcaugggcuaagucacucugcccuucggagccucuggaagcuuagggcacauugguuccag

SEQ ID NO: 70456 - RNA, 63 nt, hsa
uccuuauauaaaguaccagguuuuuuccccauucucuggaaauguuuguccucccuuaauuuu

SEQ ID NO: 70457 - RNA, 63 nt, hsa
cccauuauggauguugaaauggacagggaaggacucuggaagucucuuccuccuccuccucuu

SEQ ID NO: 70458 - RNA, 63 nt, hsa
auaagucccucuucuugccguuggccuuucugacucuggaaugaccacuguucauugaaaaau

SEQ ID NO: 70459 - RNA, 63 nt, hsa
agcaugaggaaauagaagauucaggggccugagcucuggaagcugcaagcaaaagggauggga

SEQ ID NO: 70460 - RNA, 63 nt, hsa
ccuggccgcaguguguguguauccgauaccccacucuggaaggaaccauccaguaaaggucuu

SEQ ID NO: 70461 - RNA, 63 nt, hsa
cagugccuaugaaacaaacacuaagugcagugucucuggaacugccuuacucacaggcuucca

SEQ ID NO: 70462 - RNA, 63 nt, hsa
aacgaaggccucugaaggacccuucagagguggcucuggaaugacaugugucaagcugcuugg

SEQ ID NO: 70463 - RNA, 63 nt, hsa
gguucuucuaguucgaggccuuggguccccauccucuggaaccagggggaggccuggaaggag

SEQ ID NO: 70464 - RNA, 63 nt, hsa
caccaucucucaagccccaaggacuggagccaccucuggaauaauguguuaaauaucuguaua

SEQ ID NO: 70465 - RNA, 60 nt, hsa; identical to SEQ ID NO: 69419

SEQ ID NO: 70466 - RNA, 63 nt, hsa
auguuuccuuuugcgugaucucuguugauggcacucuggaauuguuucaguuaagucauuuua

SEQ ID NO: 70467 - RNA, 63 nt, hsa
ggauggaaacuuucuaccugcuuggccuggggccucuggaagucugcugugaauuuguauucc

SEQ ID NO: 70468 - RNA, 63 nt, hsa
acuuuacuguuccucugggaaaggagcagggaccucuggaauucccaucuguuucacugucuc

SEQ ID NO: 70469 - RNA, 63 nt, hsa
cuuuacaucucagguaauguguagauuguacuucucuggaaccaaauguaguuuucuacacuc

SEQ ID NO: 70470 - RNA, 63 nt, hsa
cuucugugaaagcaaauacuaaaggaugccauccucuggaauccuaauggcaggcaaagggag

SEQ ID NO: 70471 - RNA, 63 nt, hsa
cagagaacugaagugcagccaucagguggaagccucuggaaccugaggcggcugcuugaaccu

SEQ ID NO: 70472 - RNA, 63 nt, hsa
gaggacaaagaaaacugcacaauaaaaccaagccucuggaaucuguccucguguccaccuggc

SEQ ID NO: 70473 - RNA, 63 nt, hsa
ucucccgucucaacagccccaggccuaugggggcucuggaaggaugggccagcuugcaggggu

SEQ ID NO: 70474 - RNA, 63 nt, hsa
cggccacaguggcucacgccuguaaucccagaacucuggaaggcugaggcaggcggaucaccu

SEQ ID NO: 70475 - RNA, 63 nt, hsa
gaugggacaguuuuccauauccuugcuguggagcucuggaacacucucuaaauuucccucuau

SEQ ID NO: 70476 - RNA, 63 nt, hsa
cucucccuccagcaugggccugugucucaggcucucuggaagguggcccugccccggacccuc

SEQ ID NO: 70477 - RNA, 63 nt, hsa
gucuuucccccacccugucucuuccuuguccuucucuggaaaaugccaaaauacacgauguga

SEQ ID NO: 70478 - RNA, 63 nt, hsa
cugauuauagcaucuccuucugaguguuugggacucuggaaucugagacccauguucacauug

SEQ ID NO: 70479 - RNA, 63 nt, hsa
gcaauggcaaaaauauuuccaguugcacuguaucucuggaagugaugcaugaauucgauugga

SEQ ID NO: 70480 - RNA, 63 nt, hsa
ugucaaccagagaacagcuccccuagacauggccucuggaaaaaggaaaucuuugguggccaa

SEQ ID NO: 70481 - RNA, 63 nt, hsa
gccauuacuaauagaaacacagccuuuccaauccucuggaacauauucugucuggguuuuuaa

SEQ ID NO: 70482 - RNA, 63 nt, hsa
agguacaaaauccuacuuuucagagccuuccagcucuggaaccucaaacauccucaugcucuc

SEQ ID NO: 70483 - RNA, 63 nt, hsa
uaaacuauugaugaauuguuuccugggucacaucucuggaaaauagauguuacaguucuuaaa

SEQ ID NO: 70484 - RNA, 63 nt, hsa
ggaaggcaucugcaacuccaaguccaugcagaacucuggaaggccaaguucaucgcagcaugu

SEQ ID NO: 70485 - RNA, 63 nt, hsa
ccugucuuuauuuccucaaagucaagcagcuuucucuggaaaaugaaugcuaauuagugugaa

SEQ ID NO: 70486 - RNA, 63 nt, hsa
cccagcccuagcccuuuagccuuucacccugugcucuggaaaggcuaccaaauacuggccaag

SEQ ID NO: 70487 - RNA, 63 nt, hsa
agcaauaaugucaccacacacacuucaugaagccucuggaaaacucuacaguauacuugugag

SEQ ID NO: 70488 - RNA, 63 nt, hsa
ucucggggucuuuccucagccucgaaaagugggcucuggaaucccuuuguaaauagguguguu

SEQ ID NO: 70489 - RNA, 63 nt, hsa
auucuggugagggacauuguaguucgcaugguucucuggaaacgcgccaggaaaagcuuccgu

SEQ ID NO: 70490 - RNA, 59 nt, hsa; identical to SEQ ID NO: 69444

SEQ ID NO: 70491 - RNA, 63 nt, hsa
auaagcucaucccucccguccgaggcuaguuuccucuggaaccacauuuuuaucuagaugaaa

SEQ ID NO: 70492 - RNA, 63 nt, hsa
gauguguguucucagugaaauaacuaccuuccacucuggaaccuuauuccagcaguuguucca

SEQ ID NO: 70493 - RNA, 63 nt, hsa
gugaaacccagaucgcuguguuacuaaugaucacucuggaaaugcaaauagaauaggagggga

SEQ ID NO: 70494 - RNA, 63 nt, hsa
gggguagucccucucaccugcuuccucagacgacucuggaagcuucccucuaccacugggcac

SEQ ID NO: 70495 - RNA, 52 nt, hsa; identical to SEQ ID NO: 69449

SEQ ID NO: 70496 - RNA, 63 nt, hsa
ucugugguguuauagugguaacugcaguuccuccucuggaauguagacuguauauguuuaaua

SEQ ID NO: 70497 - RNA, 63 nt, hsa
aggauaugacaguccagcaucgaugccugugcccucuggaaaaauuuccuccuagcccuucca

SEQ ID NO: 70498 - RNA, 63 nt, hsa
cauguugcauuuaacugaaugucauguuuucuccucuggaacuucuuauguaugcaagcuccc

SEQ ID NO: 70499 - RNA, 63 nt, hsa
auccaccccacuucugcaaacccaucccgaggccucuggaaugggacuccuucucccucccua

SEQ ID NO: 70500 - RNA, 63 nt, hsa
caacuuugcacuuguaguuuugagucuuugucucucuggaauaugaacagguuuauaaaacau

SEQ ID NO: 70501 - RNA, 63 nt, hsa
gaguuuucuaagcucagggucuucauuagagaccucuggaaauacauuaaggauggugggggu

SEQ ID NO: 70502 - RNA, 63 nt, hsa
aggagauuuauaaaguuuugauauuuuucccuacucuggaauuugaacuuucuucauguuugc

SEQ ID NO: 70503 - RNA, 63 nt, hsa
uuauugacagcaaugguuucccgggcccagaaacucuggaaagauuuuguccagaagaauuca

SEQ ID NO: 70504 - RNA, 63 nt, hsa
cagugcuugaccuccuguauucugaauggugaacucuggaagcagggauugugucuggcucuu

SEQ ID NO: 70505 - RNA, 63 nt, hsa
cugcccuccuuaauuugggaagguuuguguuuucucuggaaugguacaugucuuccauguauc

SEQ ID NO: 70506 - RNA, 63 nt, hsa
cuauuuucuaagcagccagcagugaaucuaaaacucuggaagaagucuucuguuugaaaggcu

SEQ ID NO: 70507 - RNA, 63 nt, hsa
uuuauuguuuuuauuccacacuuccuacuuggucucuggaaguuuuaccacauguaacagauu

SEQ ID NO: 70508 - RNA, 63 nt, hsa
uuaguguuaucuggaagguuuaaauuuuuagaucucuggaacacauucuuaaugguaaguguc

SEQ ID NO: 70509 - RNA, 63 nt, hsa
ugggugguaggagguuuuuuuuuuuacccagggcucuggaaggacaccaaacuguucugcuug

SEQ ID NO: 70510 - RNA, 63 nt, hsa
aucuuguccaagccuuuaagacagcacugccuucucuggaacuaaaauuacaauugaaguaaa

SEQ ID NO: 70511 - RNA, 63 nt, hsa
auuuuggcagaacuaguugauuaguuuagggaucucuggaaaugucaguuuccugaagagcca

SEQ ID NO: 70512 - RNA, 63 nt, hsa
aguccuucaaaacuauaugguugccuagauucucucuggaaacugacuuugucaaauaaauag

SEQ ID NO: 70513 - RNA, 63 nt, hsa
cagagcauccgaccucuuggagcaaguuucugccucuggaaagggggcgggcccuuuucacaa

SEQ ID NO: 70514 - RNA, 63 nt, hsa
gccuaggguggaggucacugcacuaccacccaccucuggaagacuggcugugaaaagucaggu

SEQ ID NO: 70515 - RNA, 63 nt, hsa
guaggcucucccugcucccuucucuacaggaaucucuggaaaacuaucagaagacaaaguuug

SEQ ID NO: 70516 - RNA, 63 nt, hsa
gugauaguuuuuaacucuauggucauuguaucacucuggaaaauguggaguagcuguaauaaa

SEQ ID NO: 70517 - RNA, 63 nt, hsa
uggcuaaaaagauuacagcgucaucugguugaacucuggaaaaaaaaaaaaaaaugaaaaaaa

SEQ ID NO: 70518 - RNA, 63 nt, hsa
auucccaaggcccuaaggucccucaccugguugcucuggaagcucuugcugauaggaaugaua

SEQ ID NO: 70519 - RNA, 63 nt, hsa
cugaccuguacuuauuuuucucuucccgccucccucuggaauggauauauugguugguucaua

SEQ ID NO: 70520 - RNA, 63 nt, hsa
cacugagcccaccagccacagugcccauguccccucuggaagacaaacuaccaauuucucguu

SEQ ID NO: 70521 - RNA, 63 nt, hsa
guuauuuauuuagcauagacauuaaagauaacucucuggaaaaugacuugacuaaggcucuca

SEQ ID NO: 70522 - RNA, 63 nt, hsa
gagcaccuuucuuccgucuguucacucugcggccucuggaaucccagcucuucucucucagaa

SEQ ID NO: 70523 - RNA, 63 nt, hsa
cuggaaccuggaccccagccuuggugggggagccucuggaaugcauggggcggguccuagcug

SEQ ID NO: 70524 - RNA, 63 nt, hsa
ccguagcaugauugcgcucauggauacagauggcucuggaaagcucaaccugcaggaguucca

SEQ ID NO: 70525 - RNA, 63 nt, hsa
ucuggaaagcucaaccugcaggaguuccaccaccucuggaacaagauuaaggccuggcaggug

SEQ ID NO: 70526 - RNA, 63 nt, hsa
auguccccaccacuccuggagucccaaugacuucucuggaaagacaaagagguuaucacaaaa

SEQ ID NO: 70527 - RNA, 63 nt, hsa
cauuguuuuauaaagaacgugauuuccagugaucucuggaagcgcuaaagcuaaaauuucugu

SEQ ID NO: 70528 - RNA, 63 nt, hsa
cagaggcauacacuuuuuacagauggacaaaagcucuggaacccuguggcuucaaauccuuug

SEQ ID NO: 70529 - RNA, 62 nt, hsa
ggaguagauaaaacagcugcaauauaaacaguccucuggaauaaugguuugugguggaugcu

SEQ ID NO: 70530 - RNA, 63 nt, hsa
uagaaaugcagaccugugggcucuaccacaggccucuggaaucagaaucuucaggguggggcc

SEQ ID NO: 70531 - RNA, 63 nt, hsa
accuaggcuuacaggccauccugagccaggggccucuggaaauucucuuccugaugguccuuu

SEQ ID NO: 70532 - RNA, 63 nt, hsa
ugggggcauuuugcuggggggagaugaggcagccucuggaauggcucagggauucagcccucc

SEQ ID NO: 70533 - RNA, 63 nt, hsa
aagccacccaggaaggaagcacagagcugggggcucuggaaacgcccugugucucuggcuaca

SEQ ID NO: 70534 - RNA, 63 nt, hsa
gccuccggacucuggcacgcuccagcagcccuccucuggaagcugcguccccucacccccugu

SEQ ID NO: 70535 - RNA, 63 nt, hsa
uggcagggaguggggauugguccuacuuucuuucucuggaaaggaaagccuccaagacuccau

SEQ ID NO: 70536 - RNA, 63 nt, hsa
gcugacugagacaauucuguccauguaaagauccucuggaaaaagacuccgagaguuauaacu

SEQ ID NO: 70537 - RNA, 63 nt, hsa
ccugccuggcugauucuuccuuaaaacuaaaaucucuggaaaauggauuugcuucuuacccug

SEQ ID NO: 70538 - RNA, 63 nt, hsa
uccuccagcuuccagcuaggccagaagggcaugcucuggaacccagcaggaucacagcugccu

SEQ ID NO: 70539 - RNA, 63 nt, hsa
uucucgaugugcacugugaugccuggaaccuuccucuggaagugcugauuuuauggacugagg

SEQ ID NO: 70540 - RNA, 63 nt, hsa
aagcgucuccaauaugacuauuaaaacugucaccucuggaaauacacuagugugagccuucag

SEQ ID NO: 70541 - RNA, 63 nt, hsa
ggaagggcuuggccagcgcuguugagggguccccucuggaaugcacugaauaaagcacgugca

SEQ ID NO: 70542 - RNA, 63 nt, hsa
gccaucagccuugaagggccucgaugaagccuucucuggaaccacuccagcccagcuccaccu

SEQ ID NO: 70543 - RNA, 63 nt, hsa
gguccuuaggccucugagaagcucugaagaacucucuggaagccccugggcccaguaccuagc

SEQ ID NO: 70544 - RNA, 63 nt, hsa
aaucagucacaacucaccuagcgaccugacuuacucuggaaucuuggcgggcaucgccgaccc

SEQ ID NO: 70545 - RNA, 63 nt, hsa
ggagacggccaguucuggcggccagauguggugcucuggaauccagucccauuuccuuccugg

SEQ ID NO: 70546 - RNA, 63 nt, hsa
uuugggacauacuugcccccuacuuccucuucucucuggaacggcucacaaugagugugacau

SEQ ID NO: 70547 - RNA, 63 nt, hsa
auagaugauguagcuguacauuuuaaauguaugcucuggaaugagucacuuuuuuucccugag

SEQ ID NO: 70548 - RNA, 63 nt, hsa
agaggccgggggagcagacagggccggugcucccucuggaagcuugggugaccggggcccugg

SEQ ID NO: 70549 - RNA, 63 nt, hsa
gaccucggccagcuggacccacaugagggccaccucuggaaccuucuucgaggcccuggccag

SEQ ID NO: 70550 - RNA, 63 nt, hsa
gggcaccucucugucccuuccgugucucacugucucuggaagcuucagcccauguguguccug

SEQ ID NO: 70551 - RNA, 63 nt, hsa
uucucuguguggauagacuccccagcguuuuuccucuggaaaugcccacagggcuugccgcgu

SEQ ID NO: 70552 - RNA, 63 nt, hsa
cacuccccacaguuuuaggaucuaaaugauugccucuggaacuauucuucuagacuaucccac

SEQ ID NO: 70553 - RNA, 63 nt, hsa
uaucuacaucagcugaaccugaaacucaggggacucuggaacaccauggacccugggggcugu

SEQ ID NO: 70554 - RNA, 63 nt, hsa
cccagagccccaggugccuggccuggccuagaccucuggaauugagauuaaacaauuuggagu

SEQ ID NO: 70555 - RNA, 63 nt, hsa
ggccugcugugacugaccuacaguggacuuucucucuggaauggaaccuucuuaggccuccug

SEQ ID NO: 70556 - RNA, 63 nt, hsa
aacaccagcuugggcaacguaagaagaccgugucucuggaauuuuuuuuuuuuuuuaauuagc

SEQ ID NO: 70557 - RNA, 63 nt, hsa
ucucuugggaacgcuggagagcuugugcacagccucuggaaggaaaggcagcgcugacuucgu

SEQ ID NO: 70558 - RNA, 63 nt, hsa
ucacagacugacacguuucccacuguacuggaacucuggaaagaggggcuccccgaccugccc

SEQ ID NO: 70559 - RNA, 63 nt, hsa
gccuacauucuucccgaggcuccaggccgcugucucuggaaguaaaagagccuugucugaccu

SEQ ID NO: 70560 - RNA, 63 nt, hsa
ccacagucaggggccuccacaugccuggccuggcucuggaagucacgucuuagcuucugaaca

SEQ ID NO: 70561 - RNA, 63 nt, hsa
auagucuggaaaguugggauuugcaaauaaaggcucuggaagcauugcugguccugaagcuuu

SEQ ID NO: 70562 - RNA, 63 nt, hsa
aguggggggcuauagccucagagaccacucauccucuggaaucaaccucuuucuaauacccuc

SEQ ID NO: 70563 - RNA, 63 nt, hsa
ccaguacauguuuaaaagaagagcucauggaaccucuggaaaggacagggaaguugaguuagc

SEQ ID NO: 70564 - RNA, 63 nt, hsa
aaauuacuuggaaaacagugggaagugguaggacucuggaagaggccacacacccgagagcug

SEQ ID NO: 70565 - RNA, 63 nt, hsa
aggucgauggaacuggccacgcacaggcucuggcucuggaaggagggaugaugagugggcguu

SEQ ID NO: 70566 - RNA, 63 nt, hsa
uugcuuguuuguuuuuagauuccugagagaugucucuggaagggaaaguuuugagaacuaaug

SEQ ID NO: 70567 - RNA, 63 nt, hsa
aagacuuaaauguaaaaccccaaacuauaaaaacucuggaagauaaccuaggcaauaccauuc

SEQ ID NO: 70568 - RNA, 63 nt, hsa
cuggccuggccugaccaaugagaggccagaacacucuggaacaucggaagaggaguucuuugc

SEQ ID NO: 70569 - RNA, 63 nt, hsa
gugggagacggcuuuguccuggggacacuuucccucuggaaucucaagacgacguggcacaca

SEQ ID NO: 70570 - RNA, 63 nt, hsa
cugagagcuggaggacaauauccagggacauggcucuggaaaauaacuuuuuuuuuuuuaaga

SEQ ID NO: 70571 - RNA, 63 nt, hsa
gauagggaggugaguccucucuaucuccucuggcucuggaagcaccuugaaaaugugcauuuu

SEQ ID NO: 70572 - RNA, 63 nt, hsa
caauuacaagacggggagugagacuccugauugcucuggaagccugcugauuucuacaacuga

SEQ ID NO: 70573 - RNA, 63 nt, hsa
gccugcucugugucuguguugugaagcuugagacucuggaaagaaauggggagggggggcagg

SEQ ID NO: 70574 - RNA, 63 nt, hsa
acccaucagcccuugcaagucccccacucaggccucuggaagguccagggaugggcucugaug

SEQ ID NO: 70575 - RNA, 63 nt, hsa
ugcuaugaggguguauauauuuuuuacccaaagcucuggaauuguacauuuauuuuuuaaaac

SEQ ID NO: 70576 - RNA, 63 nt, hsa
gccgagccaguggcggcugguaucccgcggcggcucuggaagcuggacgcggaccacggcccg

SEQ ID NO: 70577 - RNA, 63 nt, hsa
agaacugggaacauugcauccauggguugaugucucuggaagugcaaccacccaaugucucug

SEQ ID NO: 70578 - RNA, 63 nt, hsa
guugaugucucuggaagugcaaccacccaaugucucuggaagugccaccuggaagugccaccu

SEQ ID NO: 70579 - RNA, 63 nt, hsa
gaagugccaccuggaagugccaccuggaagugucucuggaagagcacccaccacuguucagcc

SEQ ID NO: 70580 - RNA, 63 nt, hsa
uaggcagaggcuccgcggcaggaggagccggugcucuggaagaccugaaagaagcccaggugg

SEQ ID NO: 70581 - RNA, 63 nt, hsa
aauuagaacauauuugcauaagauagcuauuuacucuggaaaccaacaacuuuugagauuucc

SEQ ID NO: 70582 - RNA, 63 nt, hsa
cagaauuuugauagaaaaccauggggccaagagcucuggaagccuggccggaaagaccaaggu

SEQ ID NO: 70583 - RNA, 63 nt, hsa
gcgagagucggagauaugacugacugauuccuucucuggaauaguuacuuuacaacacggucu

SEQ ID NO: 70584 - RNA, 63 nt, hsa
cccucucccuucccugcugccuugcagugaccccucuggaacucaggacucgauuuuaaggac

SEQ ID NO: 70585 - RNA, 63 nt, hsa
caugccuucccuagaaccggaggccccggacuucucuggaaaaccgccugucugcaggcccga

SEQ ID NO: 70586 - RNA, 63 nt, hsa
uucuacauaaaugggaucauuuuauacauggugcucuggaacccacauuuuucaugcagucau

SEQ ID NO: 70587 - RNA, 60 nt, hsa; identical to SEQ ID NO: 69541

SEQ ID NO: 70588 - RNA, 63 nt, hsa
agauucaagggaaaggcacuaaaugguuuuuuccucuggaagaugagauuguaggugauauuu

SEQ ID NO: 70589 - RNA, 63 nt, hsa
agaggaggucagcaaaggucuugaauagauuuucucuggaaauaaagaauccuuagaugccua

SEQ ID NO: 70590 - RNA, 63 nt, hsa
aagcuggauauccugggggaggaggggaaugcgcucuggaaacacccuuccggaacccuucgg

SEQ ID NO: 70591 - RNA, 63 nt, hsa
cccgcaaguccauuuuauuuccuucuugugcugcucuggaagagaggcaguagcaaagagaug

SEQ ID NO: 70592 - RNA, 63 nt, hsa
cucaccuugagcagccucagaucaucucugucacucuggaagggacaccccagccagggacgg

SEQ ID NO: 70593 - RNA, 63 nt, hsa
acccccuuccagggccucugcuccaaaggaggccucuggaacccaggacucugggguuuuaca

SEQ ID NO: 70594 - RNA, 63 nt, hsa
uuccaagccuagagccaccagcccagcuuccuucucuggaaaagccuggaaacugggcacaga

SEQ ID NO: 70595 - RNA, 63 nt, hsa
ucccaugagaucaggcgccaucuguaaagucuccucuggaaaugccaauccauccuuccccca

SEQ ID NO: 70596 - RNA, 63 nt, hsa
gccgugcgucccucuuaggagagaugagucacacucuggaacuguccaagaacgaaccugcca

SEQ ID NO: 70597 - RNA, 63 nt, hsa
aaagaaaaugagcagauuucuuuccauugugggcucuggaaaccacauggcuucaccuguccc

SEQ ID NO: 70598 - RNA, 63 nt, hsa
cgucuaccaaguacgaugucuucagacaacuuucucuggaagggucuggacuagguguugaag

SEQ ID NO: 70599 - RNA, 63 nt, hsa
auaacaggcagccucaagaaugugcugagauuucucuggaaaacaagcucugccucuccgggu

SEQ ID NO: 70600 - RNA, 63 nt, hsa
uugagcuccaagcacagcaaagccugacagaaucucuggaaugcaccguggcagaaaccgagg

SEQ ID NO: 70601 - RNA, 63 nt, hsa
uggagaucuuggaacugaaacgcacagccagugcucuggaaauugagcuccaagcacagcaaa

SEQ ID NO: 70602 - RNA, 63 nt, hsa
ugcauuuccuguuuuccuuuuuucuuuggcauucucuggaaugcaaggaggagacuucauuua

SEQ ID NO: 70603 - RNA, 63 nt, hsa
aaucuuuggaagccuugaguucagaaucugcugcucuggaauauuucccuucgaucuuaucuc

SEQ ID NO: 70604 - RNA, 63 nt, hsa
ccuauuuuaaaauagugaauauacguaaauuuucucuggaaggcugaggcacacuucaccauc

SEQ ID NO: 70605 - RNA, 63 nt, hsa
acuuuggggaaacacuuugcugaaauguugggacucuggaacuagccaagaaaagagaauauu

SEQ ID NO: 70606 - RNA, 63 nt, hsa
aaacugcuuuuuauacauuuuguauaaggacaacucuggaaacaagccuauuuccuccagcca

SEQ ID NO: 70607 - RNA, 63 nt, hsa
guuugcugaaaaaagcucuggggcugucugaggcucuggaaugcucucuggaggguuaacucu

SEQ ID NO: 70608 - RNA, 63 nt, hsa
aaugacccgcuuuucuagaaaguucauaaucagcucuggaacaagcacacuugauuccucacu

SEQ ID NO: 70609 - RNA, 63 nt, hsa
augaacugcagcucacgagaccuuuugcagggacucuggaauguccucacgguauauugaugu

SEQ ID NO: 70610 - RNA, 63 nt, hsa
cggcuccucugauccuuuaggguuggcgagcaucucuggaaauagcuuuugcagaggaguggu

SEQ ID NO: 70611 - RNA, 63 nt, hsa
acucugcagggcugcccucucuaacuggccuggcucuggaagggcuggugaggacucugccuc

SEQ ID NO: 70612 - RNA, 63 nt, hsa
cuauucaauacauuaugcuuaaauuagcaguuucucuggaauuccugucucuccuuuaaaaga

SEQ ID NO: 70613 - RNA, 63 nt, hsa
uguugauaucgucauauaaagccauugcaaggacucuggaaacugccgccaaugaccaauuuc

SEQ ID NO: 70614 - RNA, 63 nt, hsa
ugcagcuuggcauucuucuuauucuagaggucucucuggaaaagauggagaaaaugaacagga

SEQ ID NO: 70615 - RNA, 63 nt, hsa
cucucacccauaaacaguaaugacucucugacccucuggaaauauguaaugcuuccaaucuug

SEQ ID NO: 70616 - RNA, 60 nt, hsa; identical to SEQ ID NO: 69570

SEQ ID NO: 70617 - RNA, 63 nt, hsa
aauacuggcucugucugaguaagaaacagaauccucuggaacuugaggaagugaacauuucgg

SEQ ID NO: 70618 - RNA, 63 nt, hsa
caccucugcugucacugcucgaagcagcagucucucuggaagcaucugugucauggccaucgc

SEQ ID NO: 70619 - RNA, 63 nt, hsa
ucagauggacucuagaagcacugagcucccugucucuggaaguauuuaagaaaaggcugggcc

SEQ ID NO: 70620 - RNA, 63 nt, hsa
auaaaaauaaaaauaaauauuggcgggggaacccucuggaaucaauaaaggcuuccuuaacca

SEQ ID NO: 70621 - RNA, 63 nt, hsa
ccaccccauuccagauauagaauguuucuaucucucuggaagguuccugcauguuauauggcu

SEQ ID NO: 70622 - RNA, 63 nt, hsa
uucuugcugaaccguuugugauugccauuugagcucuggaagccucuauugccaugagaguuc

SEQ ID NO: 70623 - RNA, 62 nt, hsa; identical to SEQ ID NO: 70100

SEQ ID NO: 70624 - RNA, 63 nt, hsa
gcagcccaugcucuucuguacugucaugcccgucucuggaauguccacucccagagccugccc

SEQ ID NO: 70625 - RNA, 63 nt, hsa
agggggaggcccagggcuggugagucuagaaugcucuggaacccuacaccuagugaugugugu

SEQ ID NO: 70626 - RNA, 63 nt, hsa
caucuguccccucauuuuugagaucccccaauucucuggaacuauucugcugccccuuuuuau

SEQ ID NO: 70627 - RNA, 63 nt, hsa
ccccuaggucugggugggcaguggccccauagccucuggaacugugcguucugcauagaauuc

SEQ ID NO: 70628 - RNA, 63 nt, hsa
gccgcuggggccucggagacuuggaggaggacgcucuggaaccaucaucccgcuucucuccgg

SEQ ID NO: 70629 - RNA, 63 nt, hsa
ccucuccccgccaccccagggccuccaagccaccucuggaaauacuuggcucugccccauggg

SEQ ID NO: 70630 - RNA, 63 nt, hsa
uucccaggaggagccccgcuucaccccuucugacucuggaaaccgcaccuuuaacuuugcaga

SEQ ID NO: 70631 - RNA, 63 nt, hsa
guucccauuuucgcuuuccucugguuugaaagccucuggaaaacucaggauucucacgacucu

SEQ ID NO: 70632 - RNA, 63 nt, hsa
cagggcggcccuguacuuuuuguggcuugguuucucuggaaaugucaccuuuucgggcgcagc

SEQ ID NO: 70633 - RNA, 63 nt, hsa
agggggccaaugggggccucagggggaggcccccucuggaaaugugguucccagggaugggcc

SEQ ID NO: 70634 - RNA, 63 nt, hsa
ccugcacgcccaccccaugaaacucgagcaggucucuggaagccauuuguuaaaaaaaaaaaa

SEQ ID NO: 70635 - RNA, 63 nt, hsa
acccgcagacccuuaaaaaaaucacccacaacccucuggaaguggccuugcccgguccccuuc

SEQ ID NO: 70636 - RNA, 63 nt, hsa
ggccuucacucagggucagcgggcaccagguugcucuggaagagcuugaggaugugguucucg

SEQ ID NO: 70637 - RNA, 63 nt, hsa
uucugccgugaaaccccagccagccacaccagacucuggaacccuuuuucgacugccccaacu

SEQ ID NO: 70638 - RNA, 63 nt, hsa
ucuaguuggccagcgucuugcucuguucacagucucuggaaaagcugggguaguuggugagca

SEQ ID NO: 70639 - RNA, 63 nt, hsa
agaagcacaaguacguuaaacaagugcuaaacgcucuggaaagcauggcuuuauuuucuuaau

SEQ ID NO: 70640 - RNA, 63 nt, hsa
acauuaacugacgcuuccuuccacgaaagauuucucuggaacaugagauguuguuugauagca

SEQ ID NO: 70641 - RNA, 63 nt, hsa
acucuugaggacccccacccuccugcauccucucucuggaaggcugcauguauuguagcugug

SEQ ID NO: 70642 - RNA, 63 nt, hsa
ccccccaacugggaauugagagguaaggucuuucucuggaaauccagcaguagaggaagggac

SEQ ID NO: 70643 - RNA, 63 nt, hsa
aacugccccuuccauggaaaagcuggaaaaaaacucuggaacccauauccaggcuuggugagg

SEQ ID NO: 70644 - RNA, 63 nt, hsa
cuagugaagccuguuucguugaacuaauucuggcucuggaaauguuuuuguuuuauaguuauu

SEQ ID NO: 70645 - RNA, 63 nt, hsa
uccauuauuaacugauuaaugcacuuugaaguucucuggaauuaauuauuuuaacuuggccua

SEQ ID NO: 70646 - RNA, 63 nt, hsa
acacuucccacugauccauggggccuuuaagcccucuggaagcuuccauuaaagaugauuauu

SEQ ID NO: 70647 - RNA, 63 nt, hsa
gugcaacugcugcaggaugccuguaguagggaacucuggaaguguauugggcugaggugggau

SEQ ID NO: 70648 - RNA, 63 nt, hsa
ucucccugcacucccuccuggagcucugugggucucuggaagaggaaccaggagaagggcugg

SEQ ID NO: 70649 - RNA, 63 nt, hsa
ucaaaauuguuuauacacucuuuccuccaugagcucuggaagguauaugcaucuucuguaaua

SEQ ID NO: 70650 - RNA, 63 nt, hsa
auugauagucccuugaacacacaugcugccgagcucuggaaaaaccccacaggugaguccuca

SEQ ID NO: 70651 - RNA, 63 nt, hsa
gaccauuuucugguucuguguccucugccugggcucuggaagaggccuucccauggccauuuc

SEQ ID NO: 70652 - RNA, 63 nt, hsa
gcuggcagagaugcauuccagagaugcacuccgcucuggaacucacucucagccacagggagc

SEQ ID NO: 70653 - RNA, 63 nt, hsa
uaacuguaggccaauauagauuugccuuuaaaacucuggaagagcuacauagucaucauuagu

SEQ ID NO: 70654 - RNA, 63 nt, hsa
ugcucguuguggacuguaauuaaaugcuuugcccucuggaacuugauuuuuguguaucugaga

SEQ ID NO: 70655 - RNA, 63 nt, hsa
cagcuuaccugccacagagcuuuucugcaugaacucuggaacagaaaggcccuguaaagcccu

SEQ ID NO: 70656 - RNA, 63 nt, hsa
gcugggcgcaucccaagacagccagcagguugucucuggaaacgaccagaguuaagcucucgg

SEQ ID NO: 70657 - RNA, 63 nt, hsa
auuuucaaaagcuuaaggcccaaauacaaacuucucuggaauaaacgugguguuuuauuuucu

SEQ ID NO: 70658 - RNA, 63 nt, hsa
ccaagccuuggcucguucucuucucucuucaaucucuggaaaaauaaguacauauaguugaua

SEQ ID NO: 70659 - RNA, 63 nt, hsa
ugccuggaaauuaaacccugccccacuucucuacucuggaaguccccgggagccucuccuugc

SEQ ID NO: 70660 - RNA, 63 nt, hsa
aagccagugagcauuacuuuuaaauaggaccuucucuggaaaauuauuuugguuaauguaaua

SEQ ID NO: 70661 - RNA, 63 nt, hsa
uaucccucccauauuuucuuuuugcugcuuuugcucuggaacuuugcuuuuagcagggaaagc

SEQ ID NO: 70662 - RNA, 63 nt, hsa
ccucaugaacacuaagauuaauugugucuguaucucuggaacugggugcucauguugguuuua

SEQ ID NO: 70663 - RNA, 63 nt, hsa
gguggacuccguggggcuccaccagccagaagccucuggaaggcaacgaaggcaaugcugcuc

SEQ ID NO: 70664 - RNA, 63 nt, hsa
cucuggaaccucugugacgccaguucucccugacucuggaaccucugugauccuuugcagguu

SEQ ID NO: 70665 - RNA, 63 nt, hsa
uuucacucagcugcuccucucaguucucccugacucuggaaccucugugacgccaguucuccc

SEQ ID NO: 70666 - RNA, 63 nt, hsa
gcucuguguacagcgcugugcauguuacauuugcucuggaaacaucucugggguuugcuuguu

SEQ ID NO: 70667 - RNA, 63 nt, hsa
gucugugaugcucccaagcaaaggaaaugcaagcucuggaaauucguuaauguauuugauguc

SEQ ID NO: 70668 - RNA, 63 nt, hsa
ucagggccuccagcccucucacugugucccucucucuggaaaggaggaaggagccuauggcau

SEQ ID NO: 70669 - RNA, 63 nt, hsa
ugagaagcacuuggcuggcugagcaaauucauccucuggaaauauucucucucagccacagug

SEQ ID NO: 70670 - RNA, 63 nt, hsa
ugacccugccccuggcugggagcuccccuggggcucuggaaccugaagcccugagaaggagag

SEQ ID NO: 70671 - RNA, 63 nt, hsa
augacuuugauuccugcgccuuuuaguuuugaacucuggaauuccucugcccccuccccaaca

SEQ ID NO: 70672 - RNA, 63 nt, hsa
guggaauacccaaggucauguagccagugagugcucuggaaagccaaagcagcucaucccuuc

SEQ ID NO: 70673 - RNA, 63 nt, hsa
auugguaagaguagcuggguuuucuaagccacucucuggaaucucuuuguguuagggucucga

SEQ ID NO: 70674 - RNA, 63 nt, hsa
guucacuccagucccaccccacgccugacuccccucuggaaacugcaggccagaugguugcug

SEQ ID NO: 70675 - RNA, 63 nt, hsa
cuguaugcauucauuuauuccuugcuggacaaacucuggaagcagcgugugaaacagcggggg

SEQ ID NO: 70676 - RNA, 63 nt, hsa
aggguagcagcuggugggacacugaucugugagcucuggaaugucugcuuagaauucugagag

SEQ ID NO: 70677 - RNA, 63 nt, hsa
ugucacgccaggaggcuguggcugcugugggcccucuggaauugugcuccucacaaaguuucc

SEQ ID NO: 70678 - RNA, 63 nt, hsa
cuuggcgucuguucugggagcacggaugauaagcucuggaagcuggcaguguguaaagcacug

SEQ ID NO: 70679 - RNA, 63 nt, hsa
ggagugggcgcaggcacgccaggccuucuuuagcucuggaaagaauaaggcugccuuggaggc

SEQ ID NO: 70680 - RNA, 63 nt, hsa
ugggauuuguggcagggauuccacucagaaccucucuggaauuugugccugaugugccuucca

SEQ ID NO: 70681 - RNA, 63 nt, hsa
uuuccuacaaguuaaccaguugcacuacauaaucucuggaaauuaauuuucucuuuaggagaa

SEQ ID NO: 70682 - RNA, 63 nt, hsa
auugucuacccaaucaacaguuuucccucuuugcucuggaaauauuuguacucauauagcaua

SEQ ID NO: 70683 - RNA, 63 nt, hsa
caaaugcuuuuccaacccaugagugcuaagagccucuggaagggagggcuucaggcccgaagg

SEQ ID NO: 70684 - RNA, 63 nt, hsa
uugaaauuaccugauaacuuaagacucugugaucucuggaaucaccauauguuucuuuuuugu

SEQ ID NO: 70685 - RNA, 63 nt, hsa
aucaggggugguuacauagaccagcagcuacagcucuggaaauugaaaucauaaucugucaau

SEQ ID NO: 70686 - RNA, 63 nt, hsa
uggcuguggaguaagagggaaugcggugaggcacucuggaauaugacccuaccagagguugga

SEQ ID NO: 70687 - RNA, 63 nt, hsa
uuuaacucuagaaauucucaguaugggguuucccucuggaaaaagaaaaucugaagacauuac

SEQ ID NO: 70688 - RNA, 63 nt, hsa
gguuaaacaaaccauccauaacuuggaauacugcucuggaaugaaaaggaacuaacuguugau

SEQ ID NO: 70689 - RNA, 63 nt, hsa
ucugcccuuugauguccuugagcuacucuucagcucuggaaguuguggacaaaccguaggaau

SEQ ID NO: 70690 - RNA, 63 nt, hsa
ggguguuuccgugacuuagcugugucccuguagcucuggaacugaaggaacuagguaggagag

SEQ ID NO: 70691 - RNA, 63 nt, hsa
ggagcaccccgggaucauuuucuagguucauuucucuggaacauuugcuguagcaucuggucu

SEQ ID NO: 70692 - RNA, 63 nt, hsa
gaauucccagagcagacuuaccuggucaccgcucucuggaaaaccaaggcuccccgugcuucu

SEQ ID NO: 70693 - RNA, 63 nt, hsa
uaaagacuugcacaaauacggauccugcacugacucuggaaaaggcauauauguacuaguggc

SEQ ID NO: 70694 - RNA, 63 nt, hsa
ugguaaguacauaauugugaauucauaaguuaucucuggaaagagacaugagaaccugguaac

SEQ ID NO: 70695 - RNA, 63 nt, hsa
acaacaguaucuuaaguuuaacugggcacuucccucuggaaaucacaguguugugcaccagga

SEQ ID NO: 70696 - RNA, 63 nt, hsa
gagcucuuuaaaaauaaauugcucuggucccaccucuggaaaucugauucagccagcauggau

SEQ ID NO: 70697 - RNA, 63 nt, hsa
acagaaaagaaaagcagagucagcuacugagagcucuggaaagaaggaugucaagaaggugaa

SEQ ID NO: 70698 - RNA, 63 nt, hsa
ugagagagaugacauaaccauaugucauguagccucuggaaaaguccucuguauccucaugag

SEQ ID NO: 70699 - RNA, 62 nt, hsa
aucucuauaaaaagaaaaaauaaagaaacugcagcgccuuagaccugaggugucauaucuuu

SEQ ID NO: 70700 - RNA, 63 nt, hsa
gcuugaccgugaggccagagacacaagccuucggcgccuuaaggauguucuagcauggcugcc

SEQ ID NO: 70701 - RNA, 63 nt, hsa
cauaaccaaaguuguaggggcauggaggcaguggcgccuuauggauaggucaucucagcccaa

SEQ ID NO: 70702 - RNA, 63 nt, hsa
augcacaguugcagccuggaaaaacuuaagguggcgccuuauaguaucaauuuuaggagcuuu

SEQ ID NO: 70703 - RNA, 63 nt, hsa
cuccguauuucagacugaauggggguggggggggcgccuuagguacuuauuccagaugccuuc

SEQ ID NO: 70704 - RNA, 63 nt, hsa
gcccaaauuccuaccuaaggggucuagggagucgcgccuuacaaaucauaaauucucaucaga

SEQ ID NO: 70705 - RNA, 63 nt, hsa
ccgucccgccccaggcccgggccugacaagaaagcgccuuacguuucuccgccccccgcccgc

SEQ ID NO: 70706 - RNA, 63 nt, hsa
aaguugcccucuccgagcuaggcccggccgagagcgccuuagcucgagucggauccguguugg

SEQ ID NO: 70707 - RNA, 63 nt, hsa
uagauuuuuuagaaaaacuaagggucggcuuuugcgccuuaaagcauaucaaaugguaguuag

SEQ ID NO: 70708 - RNA, 63 nt, hsa
cugccccugugguagagcccacuauaggcccaggcgccuuacgugcuucuccccuggaccuau

SEQ ID NO: 70709 - RNA, 63 nt, hsa
cuucaccaguaugaggguagccucggacccggcgcgccuuacugguuugccaaagccauccuu

SEQ ID NO: 70710 - RNA, 63 nt, hsa
cauguuuauuuggguaggaggaagccuugccuugcgccuuaggugagaagcauaaguguaacu

SEQ ID NO: 70711 - RNA, 63 nt, hsa
guagcuccagggaacgcauguggauccuagacagcgccuuaucuaugauugaguguccgugua

SEQ ID NO: 70712 - RNA, 63 nt, hsa
cccgugcgcgcggauccucgcuccguugcacgggcgccuuaaguuauuggacuaucuaauauc

SEQ ID NO: 70713 - RNA, 63 nt, hsa
uaaaggagcucuucacagcaccugugagucugggcgccuuagagccccuaagccagcaugggc

SEQ ID NO: 70714 - RNA, 63 nt, hsa
uucuugaagaaaggcaaaucugacuuuuucugugcgccuuaaacaauucuuguaacuuucuuc

SEQ ID NO: 70715 - RNA, 63 nt, hsa
accacauccuuagagccaucaccuggcacgcaggcgccuuacauucuacgguagaacgugggg

SEQ ID NO: 70716 - RNA, 63 nt, hsa
cuagaaagcuacccugguugaccaugggauccggcgccuuacuuuccugguugcacaaaaggu

SEQ ID NO: 70717 - RNA, 63 nt, hsa
gggcugccccugccgugcagguccuggccgauggcgccuuacccugcugcccugggcuuuugg

SEQ ID NO: 70718 - RNA, 63 nt, hsa
gucaugauaggacaauauuuuaugugugugugugcgccuuauguauauaagcauauauauaau

SEQ ID NO: 70719 - RNA, 63 nt, hsa
ucucugugauacaacaauaguauuucuucaaaugcgccuuaugcuacuuaucucagaaacagg

SEQ ID NO: 70720 - RNA, 63 nt, hsa
agacagcagcaagccggauccaccaacaccgcagcgccuuaugaccccggaaccgagccagcc

SEQ ID NO: 70721 - RNA, 63 nt, hsa
aggaaugggccuggcuuuccguuccuggaggcggcgccuuagauugggaggccucauuggcca

SEQ ID NO: 70722 - RNA, 64 nt, hsa
uaaaugucugcagagagauggauggauggauggauagauggauggauggguuggggaguggggg

SEQ ID NO: 70723 - RNA, 64 nt, hsa
uggauggguuggggaguggggguggauggauggauagauggauggauggauggauggauggguu

SEQ ID NO: 70724 - RNA, 64 nt, hsa
uggauggauggguugggggguggggguggauggauagauggauggauggauggacggauggggu

SEQ ID NO: 70725 - RNA, 64 nt, hsa
uuucauuuugucuucuucuuuuuuuuucuuuuuuuagauggaguuuggcucuugucacccaggc

SEQ ID NO: 70726 - RNA, 64 nt, hsa
gcucuucuuaaauauacauuauaaagagcaagcauagauggaaagugcauauugaacacaucug

SEQ ID NO: 70727 - RNA, 64 nt, hsa
ucgaccucguugaaaagaaauccaagaaccauauuagauggauaggaucugaucuuagcaauuu

SEQ ID NO: 70728 - RNA, 64 nt, hsa
cgaaagcggagaguguaugacaucaccaaugucuuagauggaaucgaccucguugaaaagaaau

SEQ ID NO: 70729 - RNA, 64 nt, hsa
uguuugcaauuaugcugugagaauuuaaauguguuagauggaaaaugcuauuggcagggaauaa

SEQ ID NO: 70730 - RNA, 64 nt, hsa
cuuagcauugggaagacagagggcaaggaggugauagauggauauagaagcauuucucugcagg

SEQ ID NO: 70731 - RNA, 64 nt, hsa
cagcccagaacucuguaacuuuucagaacugcuauacucaaacuugcagaucucacaucaagga

SEQ ID NO: 70732 - RNA, 64 nt, hsa
uuuucuuuacauaaauauugauauauucuuuuucuacucaaagugccaaaggcuacaguuuuua

SEQ ID NO: 70733 - RNA, 64 nt, hsa
ggugacaucugcaucauuucauaggauuagaacuuacucaaaauaauguaaaucuuuaaaaaua

SEQ ID NO: 70734 - RNA, 64 nt, hsa
auacuuaauauaguaaaucuaaguaaacauguauuacucaaaguaauauauuuagaauuaugua

SEQ ID NO: 70735 - RNA, 64 nt, hsa
gaguugcuguuccuggaguaucuaacuuucaguuuacucaaaaacuuuuggguaaauaaaaaag

SEQ ID NO: 70736 - RNA, 64 nt, hsa
aguucuguaagaaaugagugguauuugauguauuuacucaaaacacaauuugcacuguacacua

SEQ ID NO: 70737 - RNA, 64 nt, hsa
aagaaauuuuagauauuaucauaacaucugggucuacucaaacacuuauuguuugaaagacuua

SEQ ID NO: 70738 - RNA, 64 nt, hsa
acaugaaucucuaacagcuccauacuucuuucacuacucaaauggcauugggcugaguaaguaa

SEQ ID NO: 70739 - RNA, 64 nt, hsa
ugaaugaaaaaacauaguuuaccaaaugucaguguacucaaacucuuuuaacugcuagcuauag

SEQ ID NO: 70740 - RNA, 64 nt, hsa
uuaaggaaggauuucaggcauggcuugauccagcuacucaaaaaagguugucagaaaugucugu

SEQ ID NO: 70741 - RNA, 64 nt, hsa
cagagaacuuuccagguuuauacuauaccucaagaccacauagauuagcuacugcuuauucuuu

SEQ ID NO: 70742 - RNA, 64 nt, hsa
uucuccuccuccagaccuaguauucuaaguuauuaccacauaguauuuuuauguuacccaucau

SEQ ID NO: 70743 - RNA, 64 nt, hsa
ggaccauuuuaucaaaguucguucauuuccguuaaccacauaacuaauaauuuaauuguuauuc

SEQ ID NO: 70744 - RNA, 64 nt, hsa
gaguuaggcuaaauacaucagaaguguucuacugaccacauaagaaguuaguauugccaaucuu

SEQ ID NO: 70745 - RNA, 64 nt, hsa
aaggcaaaaagauugucaaaauaaaaacaauaauucaaguaacaaugcccggaauauacguccu

SEQ ID NO: 70746 - RNA, 64 nt, hsa
uucuaaaaucaaggugaaauuugaacagaaugguucaaguaaaaauucucaucuggucuccccu

SEQ ID NO: 70747 - RNA, 64 nt, hsa
uauaugucugauacauauacggcuuuggagacaaucaaguaacaacugaaaaugugaaaguaac

SEQ ID NO: 70748 - RNA, 64 nt, hsa
auucauccuuaguacacagagaauauacuuuuccucaaguaauauaccuguuugaagcuuuaag

SEQ ID NO: 70749 - RNA, 64 nt, hsa
gugucagcauuccuauuaaugucucacuuuacuuucaaguaauauuggugcuauuuaacauuuu

SEQ ID NO: 70750 - RNA, 64 nt, hsa
uacacauaguucuguaauaaaacuguuugacuucucaaguaacaugacuuccuuauuucugaac

SEQ ID NO: 70751 - RNA, 64 nt, hsa
gggaaauacacuguugcuaauacugaaauuacaaucaaguaacuaaggccuugaguucauaugu

SEQ ID NO: 70752 - RNA, 64 nt, hsa
cccaacuugugaucuucuaccacuuuagagacauucaaguaauaguuuucuuagagcuuugcac

SEQ ID NO: 70753 - RNA, 64 nt, hsa; identical to SEQ ID NO: 70741

SEQ ID NO: 70754 - RNA, 64 nt, hsa; identical to SEQ ID NO: 70742

SEQ ID NO: 70755 - RNA, 64 nt, hsa; identical to SEQ ID NO: 70743

SEQ ID NO: 70756 - RNA, 64 nt, hsa; identical to SEQ ID NO: 70744

SEQ ID NO: 70757 - RNA, 64 nt, hsa; identical to SEQ ID NO: 70745

SEQ ID NO: 70758 - RNA, 64 nt, hsa; identical to SEQ ID NO: 70746

SEQ ID NO: 70759 - RNA, 64 nt, hsa; identical to SEQ ID NO: 70747

SEQ ID NO: 70760 - RNA, 64 nt, hsa; identical to SEQ ID NO: 70748

SEQ ID NO: 70761 - RNA, 64 nt, hsa; identical to SEQ ID NO: 70749

SEQ ID NO: 70762 - RNA, 64 nt, hsa; identical to SEQ ID NO: 70750

SEQ ID NO: 70763 - RNA, 64 nt, hsa; identical to SEQ ID NO: 70751

SEQ ID NO: 70764 - RNA, 64 nt, hsa; identical to SEQ ID NO: 70752

SEQ ID NO: 70765 - RNA, 64 nt, hsa
ugccugagucacccaugaagacaggacagugcuucagccugaggcugagacugcgggauggucc

SEQ ID NO: 70766 - RNA, 64 nt, hsa
ggcugcagcgagcuaugaucgcgccacuacacuccagccugagcaacagagugagacccugucu

SEQ ID NO: 70767 - RNA, 64 nt, hsa
ggacagcgucggccugauuucccguaaaggugugcagccugagagacgggaagaggaggccucu

SEQ ID NO: 70768 - RNA, 64 nt, hsa
agaggaggccucuggaccugcuggucugcacugacagccugaagggucuacacccucggcucac

SEQ ID NO: 70769 - RNA, 64 nt, hsa
ccuucucucugcuagaguugccgcucagaggcuucagccugacuuccagcggucccaagaacac

SEQ ID NO: 70770 - RNA, 64 nt, hsa
gaggugaagaggagauggacacugccucuggagccagccugacaccaaggacagcacuugucau

SEQ ID NO: 70771 - RNA, 64 nt, hsa
uccuauccucuaccacucucccacauguguugugcagccugagcugggcgcugccuuccuuucu

SEQ ID NO: 70772 - RNA, 64 nt, hsa
agaugggcggaucaugaagucaggaguucgagaccagccugaccaacauggugaaaccccgucu

SEQ ID NO: 70773 - RNA, 64 nt, hsa
gguugcagugagccgagauugugccccugcacuccagccugagcgacagugagacucugucuca

SEQ ID NO: 70774 - RNA, 64 nt, hsa
gcaaaaugugauauguaccuaacgaaguauccuucagccugaaagaggaaugaaguacucauac

SEQ ID NO: 70775 - RNA, 64 nt, hsa
ccuggggagcccgugaaggccgcacgggugccuccagccugagacaucaggggagagccugcag

SEQ ID NO: 70776 - RNA, 64 nt, hsa
uccuuaucacugucuggucuccgagcuucggcugcagccugagguguguccugggcuccucaga

SEQ ID NO: 70777 - RNA, 64 nt, hsa
aauagggaacauuuucuuaaagaacacuccaauucagccugagugcaaccugacucucugcauc

SEQ ID NO: 70778 - RNA, 64 nt, hsa
uuuucucauucaccucugcaagugcuacuggcaacagccugagggcagcuguagaaacuuuccc

SEQ ID NO: 70779 - RNA, 64 nt, hsa
cuggccacccugccuggacgccagcuguucuucucagccugagcccugucccugcccuucucug

SEQ ID NO: 70780 - RNA, 64 nt, hsa
uccccguucagaccagagugccccggccccuccccagccugagucuucuccuugcucugcgggg

SEQ ID NO: 70781 - RNA, 64 nt, hsa
agcagagacggcagccccauccuucccgcagcaccagccugagccacaguggggcccauggccc

SEQ ID NO: 70782 - RNA, 64 nt, hsa
gggucgccccuccucgggcgccugcgcuccucugcagccugagcuccacccuccccucuucuug

SEQ ID NO: 70783 - RNA, 64 nt, hsa
auccguccuggcgauccugccagcagugggugggcagccugagcucccucgggcucgccugcca

SEQ ID NO: 70784 - RNA, 64 nt, hsa
caacgccccugguggacaggaugguucggcaaagcagccugaguuauuuuuguggacggaaucg

SEQ ID NO: 70785 - RNA, 64 nt, hsa
ugccagacaacuuguccugacucaacagagacggcagccugaccuuugagcuggcuuguccagg

SEQ ID NO: 70786 - RNA, 64 nt, hsa
uauuugggaucauuugaggucaagaauucgagaucagccugaccaacauggugaaaccccaucu

SEQ ID NO: 70787 - RNA, 64 nt, hsa
cuucaccuccccgguucaagcaauucuccugccucagccugaagucgugaucugcccgccucgg

SEQ ID NO: 70788 - RNA, 64 nt, hsa
auuguuguguuucugaaaagugaaauuuaaaaagcagccugaaaaauaaaaauuuauaauuugc

SEQ ID NO: 70789 - RNA, 64 nt, hsa
ggcugcagugagccauguccacaccauugcacugcagccugaguaacaaaaugagacccuaucu

SEQ ID NO: 70790 - RNA, 64 nt, hsa
ccguaucaagcaucagucucucaaacaguugccccagccugacagugcuagucucuguuuaaug

SEQ ID NO: 70791 - RNA, 64 nt, hsa
ucugggguccucacauggcguccugcccuugcuccagccugacaacagccugagaaaucccccc

SEQ ID NO: 70792 - RNA, 64 nt, hsa
cacauggcguccugcccuugcuccagccugacaacagccugagaaauccccccguaacuuauua

SEQ ID NO: 70793 - RNA, 64 nt, hsa
ccugugucccccgaacgcucugcaccuucugacgcagccugagaaugaccugcccuggccccag

SEQ ID NO: 70794 - RNA, 64 nt, hsa
ccagucauuugauaaagauguuguuaaacugugucagccugagccuucaaaggguaaauuuaau

SEQ ID NO: 70795 - RNA, 64 nt, hsa
gcggauggaucaccugaggucgggaauucgagaccagccugaccaacauggagaaacuccaucu

SEQ ID NO: 70796 - RNA, 64 nt, hsa
gcugauccggggccacacggaggaggagccgccccagccugaggucugcaacaccaagaagugg

SEQ ID NO: 70797 - RNA, 64 nt, hsa
gggaggccuggcuguggggauaguguggggcgaacagccugagcugaggauacccagguaccug

SEQ ID NO: 70798 - RNA, 64 nt, hsa
cccuucucccaaauggcuucccuccuggaaggcccagccugaguccucgucuccuuuccagugc

SEQ ID NO: 70799 - RNA, 64 nt, hsa
uguuuccacuuaucuuggauguuuuagauugaaacagccugauucccggaagaauccucuucau

SEQ ID NO: 70800 - RNA, 64 nt, hsa
ucccacacuggggucaugagagcuaguuaguacucagccugaccccuaggucugguccugccag

SEQ ID NO: 70801 - RNA, 64 nt, hsa
cugcucugggucagcugucagggagaccucccuucagccugagccaagcugcauugggaggaga

SEQ ID NO: 70802 - RNA, 64 nt, hsa
ugagccucacauccuuuuccuugacuucucaacccagccugaaguccauugcgguuccgucacu

SEQ ID NO: 70803 - RNA, 64 nt, hsa
cuaaucacuaacuccuuccuuuuccucugcaugccagccugaaaauuccaaaucuagccucuga

SEQ ID NO: 70804 - RNA, 64 nt, hsa
auccacagacaacucuauuuguguucuucagccucagccugaaggcuuuuuuuuggcuggcuuu

SEQ ID NO: 70805 - RNA, 64 nt, hsa
gagacacagugcgcuaguacggcuguccggaggucagccugauuucaacccaggugccccuggc

SEQ ID NO: 70806 - RNA, 64 nt, hsa
agccaggagcagaagcaaagagcagacacacauacagccugaaacagaccuggacagacagaca

SEQ ID NO: 70807 - RNA, 64 nt, hsa
cauacagccugaaacagaccuggacagacagacacagccugaaacagacccggacagacagaca

SEQ ID NO: 70808 - RNA, 64 nt, hsa
gacacagccugaaacagacccggacagacagacacagccugaaacagacccagacaaacagaca

SEQ ID NO: 70809 - RNA, 64 nt, hsa
cugaaacagacccagacaaacagacagacagacacagccugaaacagacccagacagacagaca

SEQ ID NO: 70810 - RNA, 64 nt, hsa
cacagccugaaacagacccagacagacagacagacagccugaaacagacccagacacagccuga

SEQ ID NO: 70811 - RNA, 64 nt, hsa
cagacagacagacagccugaaacagacccagacacagccugaaacagauccggacagacagaca

SEQ ID NO: 70812 - RNA, 64 nt, hsa
cagccugaaacagauccggacagacagacagaaacagccugaaacagacccagacagacagaca

SEQ ID NO: 70813 - RNA, 64 nt, hsa
cagccugaaacagacccagacagacagacagacacagccugaaacagacccggacagacagaca

SEQ ID NO: 70814 - RNA, 64 nt, hsa
cagccugaaacagacccggacagacagacagacacagccugaaacagacccggacagacagaca

SEQ ID NO: 70815 - RNA, 64 nt, hsa; identical to SEQ ID NO: 70814

SEQ ID NO: 70816 - RNA, 64 nt, hsa
cagccugaaacagacccggacagacagacagacacagccugaaacagaccuagacagacagaca

SEQ ID NO: 70817 - RNA, 64 nt, hsa
cagauugaaacagacccagacaaacagacagacacagccugaaacagacccagacacagccuga

SEQ ID NO: 70818 - RNA, 64 nt, hsa
aacagacagacacagccugaaacagacccagacacagccugaaacagacccggacagacagaca

SEQ ID NO: 70819 - RNA, 64 nt, hsa
cagccugaaacagacccggacagacagacagacacagccugaaacagacccagacagacagaca

SEQ ID NO: 70820 - RNA, 64 nt, hsa
cagccugaaacagacccagacagacagacagacacagccugaaacagacccagacagacagacc

SEQ ID NO: 70821 - RNA, 64 nt, hsa
cagccugaaacagacccagacagacagaccgacgcagccugaaagagacccagacagagagaca

SEQ ID NO: 70822 - RNA, 64 nt, hsa
gaagcagcccccuguggcggccuuccgggucucgcagccugaagccuggauuccagcagugaau

SEQ ID NO: 70823 - RNA, 64 nt, hsa
caagggcacauugcccauggcugggaacaugacccagccugaaagauacaggggaucauguuaa

SEQ ID NO: 70824 - RNA, 64 nt, hsa
caccacuuucgugcaguaccaggcgccgcagcugcagccugacaggaugcagugaggggcguuc

SEQ ID NO: 70825 - RNA, 64 nt, hsa
ucuucccucuacccccgcaccaccugcugugugccagccugagacgguuccugccugucuuggg

SEQ ID NO: 70826 - RNA, 64 nt, hsa
acacucauccuugcuuuccagcccuaagccaucucagccugaugucacaacccaauaaaugggg

SEQ ID NO: 70827 - RNA, 64 nt, hsa
gcgggcagaucaccggaggucaggaguucgagaccagccugaccaacauggagaaaccccaucu

SEQ ID NO: 70828 - RNA, 64 nt, hsa
aguggaaaacaaaacccagaaagugcggcaggaccagccugacgcacacgcuccuguugucaug

SEQ ID NO: 70829 - RNA, 64 nt, hsa
cgcacgcugacggaccacgagggcugaccccuuccagccugacuugguucauggaggcuccuac

SEQ ID NO: 70830 - RNA, 64 nt, hsa
uacaugccagucauuucucagugaaauaaauacaauaccagaguacauuauggguuuuauugcu

SEQ ID NO: 70831 - RNA, 64 nt, hsa
cagaaacauuuuuuaaauaagggaaauauuuuauauaccagaugguucacaagugauggcucau

SEQ ID NO: 70832 - RNA, 64 nt, hsa
uguccucauuuuguuuccuaugaucauccucuagauaccagauagaggcccauuccugcauuug

SEQ ID NO: 70833 - RNA, 64 nt, hsa
augacaggcgggaguuuuguaccacuuuuagaagauaccagaugccucuguccucauuuuguuu

SEQ ID NO: 70834 - RNA, 64 nt, hsa
uguacagaaaugaagaugguucaguaccugcuacauaccagaucuauuacaugauaggauggaa

SEQ ID NO: 70835 - RNA, 64 nt, hsa
cccuaccuuagggaagaagaaaacauuuuaaagaauaccagaaguagaaucacauguaacaguc

SEQ ID NO: 70836 - RNA, 64 nt, hsa
cuguaaauauccaaguauaaagcccaggaacuucuagaauaacccagaugcgcuuuaauuuuuu

SEQ ID NO: 70837 - RNA, 64 nt, hsa
aauuuuuuuuaauauguuuugaucacagaacuucuagaauaacccagaugcucuuucauauucu

SEQ ID NO: 70838 - RNA, 64 nt, hsa
gagacagccaaacucugacaaaggcuuuuccuuauagaauaacccaaagccuaggugaggguug

SEQ ID NO: 70839 - RNA, 64 nt, hsa
uuguuuaucaucuaauggcuguaaacuguaguacuagaauaaaaaaaauggaaaaucagcuuuu

SEQ ID NO: 70840 - RNA, 64 nt, hsa
aaaccaauuuccugauggacuauuaaauucaucuuagaauaaauuagugaagaauuuaauuuua

SEQ ID NO: 70841 - RNA, 64 nt, hsa
ucaucuuagaauaaauuagugaagaauuuaauuuuagaauaaauaauccaaucugaaauaauua

SEQ ID NO: 70842 - RNA, 64 nt, hsa
uuucuuuaacaggauugcaccuaucaauuucuuguagaauaaaaaaaaaucuuucaacaaacug

SEQ ID NO: 70843 - RNA, 64 nt, hsa
uauuugaacaucauaguuguauauauuuuuaaaguagaauaaauaauggaaagcaacuugauau

SEQ ID NO: 70844 - RNA, 64 nt, hsa
auuaucuccuaauuguauguuagaauaauuuuauuagaauaauuucauacugaaauuauuuucu

SEQ ID NO: 70845 - RNA, 64 nt, hsa
ugaugaauaaaauaauuaucuccuaauuguauguuagaauaauuuuauuagaauaauuucauac

SEQ ID NO: 70846 - RNA, 64 nt, hsa
agaucacugaacuuuucaaaauaaagcuuuugcauagaauaaugaagaucuuuguuuuuuguuu

SEQ ID NO: 70847 - RNA, 64 nt, hsa
ucuaacugugcaaagcagagugaaauucaauucauagaauaacaacugcugggaauauccgugc

SEQ ID NO: 70848 - RNA, 64 nt, hsa
uucaagggauggcauaacuguaagaggucagugcuagaauaaaguccuguagguuuauuuugga

SEQ ID NO: 70849 - RNA, 64 nt, hsa
uaaagaacacuggauuaauaaucuuuugggaggguagaauaaaauaauugauuacuauugcugc

SEQ ID NO: 70850 - RNA, 64 nt, hsa
gccugaaauaaugggaguuuucuccuccacuuauuagaauaaggacccucagugacuaauuauu

SEQ ID NO: 70851 - RNA, 64 nt, hsa
uuauaggucuaaaauuauaucuuaagguauguuguagaauaaauuaaaaggauaaucuaaauca

SEQ ID NO: 70852 - RNA, 64 nt, hsa
guacaguucuuuguacagaaaggcaccauuauguuagaauaaauuuccagaacuuagugggaag

SEQ ID NO: 70853 - RNA, 64 nt, hsa
uauggaugucauccugugacuuugaaguacaaaguagaauaaauucuguauucauggauuggau

SEQ ID NO: 70854 - RNA, 64 nt, hsa
cuuuugguauuucauuguuaccaaguucuauuuuuagaauaaaauuguucuccuucuaaaaguu

SEQ ID NO: 70855 - RNA, 64 nt, hsa
acauuuuuauacuaaaacaaacaccaaaauauuuuagaauaaauucuuagaaaguuuugagagg

SEQ ID NO: 70856 - RNA, 64 nt, hsa
auuauaagcuguuuuuauauaugugaaauaaaaguagaauaaacacaaugguuuccaagaaagu

SEQ ID NO: 70857 - RNA, 64 nt, hsa
ucucuauuaggaaauauucuguaaucuucagaccuagaauaauacuagucuuauaauagguuug

SEQ ID NO: 70858 - RNA, 64 nt, hsa
guguauaaucagagugccucuuauacauacuuuauagaauaaaggaacauuuugacagaugagg

SEQ ID NO: 70859 - RNA, 64 nt, hsa
ucauuaucugugaaccauaauuuaaaaaucuuucuagaauaacaacagcagacuccacucuugu

SEQ ID NO: 70860 - RNA, 64 nt, hsa
uagguuauuucuuggaaauugcaauacguaguucuagaauaaaaguacaaaaaauuagaauaag

SEQ ID NO: 70861 - RNA, 64 nt, hsa
caauacguaguucuagaauaaaaguacaaaaaauuagaauaagaauucuuuaacauuuucuuua

SEQ ID NO: 70862 - RNA, 64 nt, hsa
augguggcacauuucugcuauaaugaagauuaaauagaauaacaguuccaggauaacacugauu

SEQ ID NO: 70863 - RNA, 64 nt, hsa
uauuucuauuuagaacacagaaaaugaaaauauuuagaauaaguuguacauuugaugacaaaua

SEQ ID NO: 70864 - RNA, 64 nt, hsa
cccccaaaaaaaaaauucaguaggaauuccuucauagaauaacauguuauuuauugguauugac

SEQ ID NO: 70865 - RNA, 64 nt, hsa
uucuuuaacuaccuuuggaaauacuguacaauguuagaauaauuuauuuugcuuuacaggaguu

SEQ ID NO: 70866 - RNA, 64 nt, hsa
ggugaaagucgugugaaauccuguacacuguguauagaauaauguaauuuuauguuaauuguua

SEQ ID NO: 70867 - RNA, 64 nt, hsa
ccgagagcuguggguaaaauuugaaaauuguauuuagaauaagaaauuuuacauuuuaaacccu

SEQ ID NO: 70868 - RNA, 64 nt, hsa
auuauuguuauuccuuuuuaauuuaaugugcucgcacuacaaugcaucaguauuaugauuccuc

SEQ ID NO: 70869 - RNA, 64 nt, hsa
agaaaauuguaagaauugcacucuacuuauguaucacuacaaacuuuaaaaaacuaugucuaau

SEQ ID NO: 70870 - RNA, 64 nt, hsa
aggagugaaaauagaguguaaaucuugccuuuggcacuacaaggugugugugugugugugugug

SEQ ID NO: 70871 - RNA, 64 nt, hsa
uugcuuccuaccacagauucuuuauuuucccaaacacuacaaaaaaacuuuuaaaacuuugcca

SEQ ID NO: 70872 - RNA, 64 nt, hsa
aguacauaaaucccgucaugcacuuuuuuucauacacuacaaggggauguguaauaaccaugcu

SEQ ID NO: 70873 - RNA, 62 nt, hsa
ccuucacuucaguagauuagucucagaauggacacuacaaaugccagcucucaccagauggc

SEQ ID NO: 70874 - RNA, 64 nt, hsa
uggguagcuucaaacucaaauugaagagagucuucacuacaaucuucacuacaaccuuuggccu

SEQ ID NO: 70875 - RNA, 64 nt, hsa
aacucaaauugaagagagucuucacuacaaucuucacuacaaccuuuggccuuccucucuacau

SEQ ID NO: 70876 - RNA, 64 nt, hsa
aggggaauguuacguugaucucuuaaauuguaaacacuacaaaaugucaaaauaaugagaacug

SEQ ID NO: 70877 - RNA, 64 nt, hsa
ucccagccagucaguggcuuugagcccuaucuuccacuacaaaugaccucucgaggggggacgg

SEQ ID NO: 70878 - RNA, 64 nt, hsa
cuaaugaaggccaucaucucuguaaaccacuugucacuacaaaaauacaauuacucaccaaaaa

SEQ ID NO: 70879 - RNA, 64 nt, hsa
gcccaggcuggagugcaguggcgugaucuuggcucacuacaaccuccaccuuccaggcuuaagc

SEQ ID NO: 70880 - RNA, 64 nt, hsa
aaauaaaauaaaauaaaauaaaauaauuaauaaaaugguguaguauuugcauauaaccuaugca

SEQ ID NO: 70881 - RNA, 64 nt, hsa
caaaaucugaggauacucaagucccuuauauaaaaugguguaggccgggcaugguggcucacgc

SEQ ID NO: 70882 - RNA, 64 nt, hsa
ugcgacuuucauauccuugccuagaauaggcugcaugguguaugucagugagggccacgaggcg

SEQ ID NO: 70883 - RNA, 64 nt, hsa
uggguguccagggccccguagagagacauuuaagaugguguaugacagagcauuggccuugacc

SEQ ID NO: 70884 - RNA, 64 nt, hsa
guucuugauugcuuuauuaucaucauacuaguguguucauuauagaguaucuguagaggugaau

SEQ ID NO: 70885 - RNA, 64 nt, hsa
uuaaagcaagauucaauuccuuguucauuugaguguucauuauaugccaggcauugaccaguug

SEQ ID NO: 70886 - RNA, 64 nt, hsa
aaggagacauagaaugugugcuuauucucagaagguucauuaacugaggugaugaguuaacaac

SEQ ID NO: 70887 - RNA, 64 nt, hsa
gagcagucagcuuccuaaguguuuuaggacauuuguucauuauauuuuccgucauauaacuaga

SEQ ID NO: 70888 - RNA, 64 nt, hsa
auuaaaccaguacuugucaguccaucuuaauacuguucauuaaggcacucucugucucuaaucc

SEQ ID NO: 70889 - RNA, 64 nt, hsa
guaguaaaaaauguaggguuauuuaccauaaccuguucauuaauaucagaaauuuacaauagca

SEQ ID NO: 70890 - RNA, 64 nt, hsa
uuuuaaucaagcaggaaaaaguucucaugauuaugccaacuauaauaguaauccucacugagug

SEQ ID NO: 70891 - RNA, 64 nt, hsa
ugaauucuuaccauacugccauuaaaauaaauuugccaacuaguaaugcauacuggaaaucaaa

SEQ ID NO: 70892 - RNA, 64 nt, hsa
auaacacccaucacauugucugagaauaggauuaaugagcaaaaguuaugauaauagaguuaua

SEQ ID NO: 70893 - RNA, 64 nt, hsa
uaaugccgugaaugaaacacagucuguguagggaaugagcaaaaaaguugaauuccaauugcuu

SEQ ID NO: 70894 - RNA, 64 nt, hsa
guauauguaauauauaugugggaaauacaggggaaugagcaaaucucaaagagcuggcgucuua

SEQ ID NO: 70895 - RNA, 64 nt, hsa
cccaauacauuauuagacugaacugugaccugaaaugagcaauaaacucuguauuaauucacug

SEQ ID NO: 70896 - RNA, 64 nt, hsa
uaagcucagauuauuuaaaugggaauauuuauaaaugagcaaauaucauacuguucaaugguuc

SEQ ID NO: 70897 - RNA, 64 nt, hsa
uaagaaacccucugucauucgcucccacauucugaugagcaaccgcuucccuauuuauuuauuu

SEQ ID NO: 70898 - RNA, 64 nt, hsa
acagagugauuggcaaauauuuucaagauuuaauaugagcaacccauuauuugcccuauccaaa

SEQ ID NO: 70899 - RNA, 64 nt, hsa
aauuaaaaacaacguauuccuuuguagugugaauaugagcaaucuauuuuauaugaacuuuuuu

SEQ ID NO: 70900 - RNA, 64 nt, hsa
acacacuuaccuuacuaagucuuugcuuuaauaaaugagcaacccuggguauagucuuaaaauu

SEQ ID NO: 70901 - RNA, 64 nt, hsa
aauuauuccuaaacucucuaaguguggacggagaaugagcaagccccagaaguauuuuacaacc

SEQ ID NO: 70902 - RNA, 64 nt, hsa
uuuguuuggggugggggcaaguacaggguaauucaugagcaagacauuucacugcugucgaagu

SEQ ID NO: 70903 - RNA, 64 nt, hsa
cuacucgguucacuugcccagaugucuucauaugaugagcaaggccagaagcaaggcuagauuc

SEQ ID NO: 70904 - RNA, 64 nt, hsa
guguagccaucuuugccuuuugcugcaauagaagaugagcaaaggauuaaacagaggcccacag

SEQ ID NO: 70905 - RNA, 64 nt, hsa
ugcuguuugacccugguauucgggcaaagaggacaugagcaagcguaucacaucugcccucccu

SEQ ID NO: 70906 - RNA, 64 nt, hsa
guauuguguagcuaggccuaaugaagcauucaaaaugagcaaugcuaauggguuguuuagcuuu

SEQ ID NO: 70907 - RNA, 64 nt, hsa
ucuucucaccuugauuuugagcuggaauguuucaaugagcaaaauaaauuagacaaaaguuuac

SEQ ID NO: 70908 - RNA, 64 nt, hsa
gcaguguuucucccacuuugauaugcuaacauuuaguaagcacuggcuuuaugaaagcggcuuu

SEQ ID NO: 70909 - RNA, 64 nt, hsa
agccacuacauucuguggaaggagaucucucaggaguaagcauuguuuuuuuuucacaucuugu

SEQ ID NO: 70910 - RNA, 63 nt, hsa
ucuugcaagaaagaauuugaggcgaauccauagaguaagcaaggcaaguuacuucuauauaga

SEQ ID NO: 70911 - RNA, 64 nt, hsa
uccuucugcucauaaccugacaaaaugccaaacuaguaagcaggauagcugauaccacggcuau

SEQ ID NO: 70912 - RNA, 64 nt, hsa
aagaaggaaaacuguaggggggaguaaugugcuaaguaagcagaauugccucaaaaagaaguug

SEQ ID NO: 70913 - RNA, 64 nt, hsa
ggguguaggaucuggccagaaacacuguaggaguaguaagcagauguccuccuuccccuggaca

SEQ ID NO: 70914 - RNA, 64 nt, hsa
gauuuugaggagcucuaagugguccaggaguccaaguaagcagucuggcuggaauaaggcagca

SEQ ID NO: 70915 - RNA, 64 nt, hsa
uggaacgggaauuggccucucugcucccuucuucaguaagcaaggagccccgccccucaggccc

SEQ ID NO: 70916 - RNA, 63 nt, hsa
ugagaguuuauggucuggauaauauaaauaaacaaguaagcauaugucagauguuguuaguuu

SEQ ID NO: 70917 - RNA, 64 nt, hsa
uuuacuguaaauuaugauuccguaacugacuuguaguaagcaguguuucuggccccuaaguauu

SEQ ID NO: 70918 - RNA, 64 nt, hsa
ugauucuaaaaggauuaucugaaauugaaaaacuaguaagcaaauaaaugauaaacauaaguaa

SEQ ID NO: 70919 - RNA, 64 nt, hsa
guuaaagcuguaacaacugaaauugcauggaucaaguaagcauaguuuuauccagggagaaaaa

SEQ ID NO: 70920 - RNA, 64 nt, hsa
ugcgucgcugacaaguucucaagaagaacuuaugaguaagcagucugagaacuaaagaguuuau

SEQ ID NO: 70921 - RNA, 64 nt, hsa
uggggucaaauucugugugaaugugaacuugccuaguaagcacuuugucucuguucacuacugc

SEQ ID NO: 70922 - RNA, 64 nt, hsa
acccaauuacaggggauaaauguaagcuuguuaaaguaagcaccacaccauguuucugucuccc

SEQ ID NO: 70923 - RNA, 64 nt, hsa
uggcuuccuucuccaauuagccugaaugagcuuuaguaagcaauugagagaacuguguuuuucc

SEQ ID NO: 70924 - RNA, 64 nt, hsa
aauggaggcuuuucacugccuguagagacaauacaguaagcauaguuaaggggugggucagaac

SEQ ID NO: 70925 - RNA, 64 nt, hsa
uauuauauacacaaaauuugcuauuuucacuuaaaguaagcauuuuuaaaggauuuauuuuaga

SEQ ID NO: 70926 - RNA, 64 nt, hsa
aagagcaagagucuguacauuauuaagcuuagaaaguaagcaaaacugauuuacugguuugccu

SEQ ID NO: 70927 - RNA, 64 nt, hsa
uguauuaagaauguuccuuaaagguuuaagaagcaguaagcagcaucugaagccacaaucuauu

SEQ ID NO: 70928 - RNA, 64 nt, hsa
caggcuccuugggcccuaagcaucaccagaagggaguaagcagggagagaagcaauauuacucc

SEQ ID NO: 70929 - RNA, 64 nt, hsa
caacuuuuaaaagaaauaacuaaauuuucaaaugaguaagcagugccaccaacuaguguuuugc

SEQ ID NO: 70930 - RNA, 64 nt, hsa
ugugcuuucuaucuaauuuuuauuaauuuguaagaguaagcaccuuuagaauauuaaaaauuaa

SEQ ID NO: 70931 - RNA, 64 nt, hsa
auauucucaccauccugacugaagugaacuaugaaguaagcaacaaggaugacaagaaaaacau

SEQ ID NO: 70932 - RNA, 64 nt, hsa
cauucccucccuuacucuucggggguuuccuuucaguaagcaacuuuuccaugcucuuaaugua

SEQ ID NO: 70933 - RNA, 64 nt, hsa
aagaaaauccucagcaaagugaagaauugcuugaaguaagcaacugauggcauuugagaauuua

SEQ ID NO: 70934 - RNA, 64 nt, hsa
aaggcagcuaaauuucugaaagauagccagaguaaguaagcagccacugcaagcucugaaucag

SEQ ID NO: 70935 - RNA, 64 nt, hsa
cacauuuccacaccagaacuggaacuacguagcuaguaagcauuugaguuugcaaacucuugug

SEQ ID NO: 70936 - RNA, 64 nt, hsa
agaaauuuuagauugugaauauuuuguaaaaaacaguaagcaaaauuuuccagaauucccaaaa

SEQ ID NO: 70937 - RNA, 64 nt, hsa
gacagcuuuuagauacuuuuuuguccauucuaaaaguaagcaaacaugauugccuucuuguuuu

SEQ ID NO: 70938 - RNA, 64 nt, hsa
auaauuucaagcauaagugcaauguaaauaauaaaguaagcauuuaaaauucaaaagugaggaa

SEQ ID NO: 70939 - RNA, 64 nt, hsa
ugugacaguuaaagaauauucuaguuugacaauuaguaagcaaugaguauaucaucaguacacu

SEQ ID NO: 70940 - RNA, 64 nt, hsa
gcagcacaggaccgcgcuuccuuuagcagugcugaguaagcaggcagcggcacucugagauccc

SEQ ID NO: 70941 - RNA, 64 nt, hsa
auuuaugggcucaggaucugaccgcagucccgggaguaagcauuucaaagggggaaggcagugu

SEQ ID NO: 70942 - RNA, 64 nt, hsa
uugcuuggccagucuuugccuuucauccuguaaaaguaagcauguagaaggaggaaguugugcu

SEQ ID NO: 70943 - RNA, 64 nt, hsa
accagcucaugucuuccccacaucucuucuugccaguaagcagcuuuggugggcagcagcagcu

SEQ ID NO: 70944 - RNA, 64 nt, hsa
caguucuucaaauaaggacgcaaaucuucaggacaguaagcagaacaaucagaauggaauuaaa

SEQ ID NO: 70945 - RNA, 64 nt, hsa
guucugcccucugcccuccagcuuuacccaccagaguaagcaaucuuuucuuuuuagaaaucaa

SEQ ID NO: 70946 - RNA, 64 nt, hsa
agaaaagcauuucagaggcuaauuuaaaacaaaaaguaagcaccuaaaggcaaggacuuuguuu

SEQ ID NO: 70947 - RNA, 64 nt, hsa
uugguaaagaauggaagguggagaagcucccugaaguaagcaaagacuuuccucuuagucgagc

SEQ ID NO: 70948 - RNA, 64 nt, hsa
ugaggggcaacgaggcggcugggaugccgcccucaguaagcagcuugccaaucacuccaggucu

SEQ ID NO: 70949 - RNA, 64 nt, hsa
uuuaacuuuuuuggcuguauguaauucagucauaaguaagcauuuucuaacguccauuauaucc

SEQ ID NO: 70950 - RNA, 64 nt, hsa
auuuuaaagccuuauguauaaauaaaccaaaggaaguaagcagucauauugcuaauuugcuaac

SEQ ID NO: 70951 - RNA, 64 nt, hsa
uuccucaucagaaguacuggcuucuuuagagaguaguaagcauggcugccuaugcuuggaguca

SEQ ID NO: 70952 - RNA, 64 nt, hsa
uauguuucauuuaaucuucacaaaagaucuguagaguaagcaaagagaggcaaaaacaaugucu

SEQ ID NO: 70953 - RNA, 64 nt, hsa
uguuugugggaaccacagaugguugggguugaacaguaagcacauugcugcaaugugguacgug

SEQ ID NO: 70954 - RNA, 64 nt, hsa
ucccauuugcagagcucuacuacuucauuuccacaguaagcauauauauaaugaucacuucuga

SEQ ID NO: 70955 - RNA, 64 nt, hsa
guguaugaguagccaggguaagggguaaaaggauaguaagcauagaaaccacuagaaagugggc

SEQ ID NO: 70956 - RNA, 64 nt, hsa
uggaugcuggaagcugucguugaggagaaggaguaguaagcagaacuaagcagucuuggagggc

SEQ ID NO: 70957 - RNA, 64 nt, hsa
gaggcuaugaggaaacugagucacucacauugagaguaagcacguugcccaagguugcacagca

SEQ ID NO: 70958 - RNA, 64 nt, hsa
uaacuaucagagggaucuaggucuugguuagagaaguaagcagaguucuuugcaagcuuauuua

SEQ ID NO: 70959 - RNA, 64 nt, hsa
uuuagguaagcaccuagcacaugccguggcaccaaguaagcacucaauaaaucacucaacuccu

SEQ ID NO: 70960 - RNA, 64 nt, hsa
auuuuccagagguucuccuccagacaagaccugcaguaagcaaagaguuauauucuaccucucu

SEQ ID NO: 70961 - RNA, 64 nt, hsa
gccucgcagcccccucagcaugggugcccccagaaguaagcagcucuuggacccacgagcaggg

SEQ ID NO: 70962 - RNA, 64 nt, hsa
guuuuaaaagcuaaccauuuuuauuaaaccuaugaguaagcagcucauccuaauugcgaagagu

SEQ ID NO: 70963 - RNA, 64 nt, hsa
aucuguauuuuuuacaauaccuaguguucuugccaguaagcaugguucaucuucccauuuauuu

SEQ ID NO: 70964 - RNA, 64 nt, hsa
ucaaaguuuauaugccuggugcacagugcuuagaaguaagcaauucccaggucauagcucaaga

SEQ ID NO: 70965 - RNA, 62 nt, hsa
cccaggacauuaaacucugauaggagaggaaaaguaagcaucucugcagaaagccaacaggu

SEQ ID NO: 70966 - RNA, 64 nt, hsa
uucuuuuauucucccacagugcuccauguacagaaguaagcauagcagucauaugagcaaccac

SEQ ID NO: 70967 - RNA, 64 nt, hsa
uauguuguaagcuuggguuauuaacugcuuuuauaguaagcaaaaaaauccuggucuuugucca

SEQ ID NO: 70968 - RNA, 64 nt, hsa
uauguuucuuugucagccuucugcuucuaaucccaguaagcaacuuggacaggcauuuuaaaag

SEQ ID NO: 70969 - RNA, 64 nt, hsa
ucccuguauuuccauuauucuuuauggaauauaaaguaagcaugaaagguaguuaaaacuuuca

SEQ ID NO: 70970 - RNA, 64 nt, hsa
agcugcugaagaggcaagagacagaaugauauccaguaagcacauguuuauucaugggugucag

SEQ ID NO: 70971 - RNA, 64 nt, hsa
gaaauaucuugaacuguuuauugcucagaacuuaaguaagcaugccaacauuucguuuguuuau

SEQ ID NO: 70972 - RNA, 64 nt, hsa
uucugucagucugaagcguaguaguggaagagguaguaagcaccagcugccucuuugcugcuuu

SEQ ID NO: 70973 - RNA, 64 nt, hsa
gaggggucuucucuggguuucacugaggaugagaaguaagcaaacuguggaaacaugcaaagga

SEQ ID NO: 70974 - RNA, 64 nt, hsa
gaaaaauuaauuauaugguugaaauguaaaagaaaguaagcauaaaaaucgaguaauguauaua

SEQ ID NO: 70975 - RNA, 64 nt, hsa
aauagagacuugagcuggaucuguacugcacuggaguaagcaagaaaauugggaaaacuuuuuc

SEQ ID NO: 70976 - RNA, 64 nt, hsa
agcauauccuuuacccaggccauuccuaucauauaguaagcagaagaguugccaugaaaguaaa

SEQ ID NO: 70977 - RNA, 64 nt, hsa
aaaaaauauuuuacauaauuacucauuuuuguugaguaagcaaaauuacaaaguguuuuuaaaa

SEQ ID NO: 70978 - RNA, 64 nt, hsa
cuccgguucagcuuccgacaccagaguggaacccaguaagcaccaucaggaaugaauuucacua

SEQ ID NO: 70979 - RNA, 64 nt, hsa
acagcagacaaaaugaaagaaaaugagagcagaaaguaagcauuuccagccuaucuaauuucuu

SEQ ID NO: 70980 - RNA, 64 nt, hsa
ggagaauuacuugaacccgggaggcggagguugcaguaagcagagauugugccacuggacucca

SEQ ID NO: 70981 - RNA, 64 nt, hsa
gaacacugagauuugauaggcauguagaagucagaguaagcaagagggcuugaguucaucgaug

SEQ ID NO: 70982 - RNA, 64 nt, hsa
uuuaaaguucauuggaaaucuucuucccuacagcaguaagcaaaaauuagcaaagagauagucu

SEQ ID NO: 70983 - RNA, 64 nt, hsa
ugcuuagccauaacacucauuuaacagcauggguaguaagcaugguuucuugcagaaaacacaa

SEQ ID NO: 70984 - RNA, 64 nt, hsa
cuacuguaaggcagaugcuaauuauaaggcauuaaguaagcaaauagugcccucagcuacugca

SEQ ID NO: 70985 - RNA, 64 nt, hsa
uugauuaaaaaaaaauuuuauaaucucaaaugcuaguaagcagaaagaugcucuccgaggucca

SEQ ID NO: 70986 - RNA, 64 nt, hsa
aagcaugaaccucagacuucuggcacuauuacauaguaagcacaugaaguaguuugauaauaaa

SEQ ID NO: 70987 - RNA, 64 nt, hsa
gccuucucccauacauuccaaaaggaaguucaacaguaagcagcaccuccaagacugucuccuu

SEQ ID NO: 70988 - RNA, 64 nt, hsa
gaguuuaaagagaaaagggaaaaaagaaagaaaaaguaagcagggcuggcuucgcccgcguucu

SEQ ID NO: 70989 - RNA, 64 nt, hsa
gugacaauuaauaauaaauaacgugucagcauuuaguaagcauccacuaaguguacaauacuuc

SEQ ID NO: 70990 - RNA, 64 nt, hsa
gguucaagacugucauuuucuauuucaaccgaaaaguaagcauuuaacccggugaauaaaugua

SEQ ID NO: 70991 - RNA, 64 nt, hsa
auuaaaaaaaaaaccaugaauuacgaagcaccuuaguaagcaccuucuaaugcugcauuuuuuu

SEQ ID NO: 70992 - RNA, 64 nt, hsa
agccuucccuuuugccuuaagucacccaucuuccaguaagcaguuuauucugagccccgggggu

SEQ ID NO: 70993 - RNA, 64 nt, hsa
agaauuuauauuguuuauuauaucuuuuaaaagcaguaagcaguuuucaucugacagcguagau

SEQ ID NO: 70994 - RNA, 64 nt, hsa
cugcaacccucuugaucuucucuuuuauaaauaaaguaagcacuuugaagcaaaaacuuguaua

SEQ ID NO: 70995 - RNA, 64 nt, hsa
caaaagacuuaauauauugaaguaacacuuuuuuaguaagcaagauaccuuuuuauuucaauuc

SEQ ID NO: 70996 - RNA, 64 nt, hsa
cgggaauacugucucuucuauguauuuugugaauaguaagcauaauuuuaguuuuguauuauca

SEQ ID NO: 70997 - RNA, 64 nt, hsa
uuaaaaaacaauuuuauuggccuuuugcuaacacaguaagcauguauucucuauaaggcauuca

SEQ ID NO: 70998 - RNA, 64 nt, hsa
uucuuccuucuuacugcuuuuccaaacauucuccaguaagcagguacuacauuuauaauggaag

SEQ ID NO: 70999 - RNA, 64 nt, hsa
auaugauacgugcugcuuguucaucacaaaaaucaguaagcacaauaaaguggaugccaaacca

SEQ ID NO: 71000 - RNA, 64 nt, hsa
auguaauggaugugagguagccgaaguuugguucaguaagcagggaauacagucguuccaucag

SEQ ID NO: 71001 - RNA, 64 nt, hsa
uaucugucucuuauuugcacucauggauauucacaguaagcauuguuugacauauauuaaaacc

SEQ ID NO: 71002 - RNA, 64 nt, hsa
ggauucugauuagaaagaggguugccuacagauuaguaagcaauuccuuggaucuuaugcacag

SEQ ID NO: 71003 - RNA, 64 nt, hsa
agcuucaaaagaacacauacagaguaauccugagaguaagcaaaggaaccaugagaaccgaagc

SEQ ID NO: 71004 - RNA, 64 nt, hsa
cucugguuuccucaggaggaaaugggcaaggcagaguaagcaggggagacagguuuaaggguag

SEQ ID NO: 71005 - RNA, 64 nt, hsa
aaugccggugagaauaagagagucauaaaccuuaaguaagcaacagcauaacaagguccaagau

SEQ ID NO: 71006 - RNA, 64 nt, hsa
aggauuuuaaaaagaagccauggaaaaacuuccuaguaagcaucuacuucaggccaacaagguu

SEQ ID NO: 71007 - RNA, 64 nt, hsa
uacaauagaagaaaagaucuaucaaaggcagaucaguaagcaaggucuuuguggggcaguuguc

SEQ ID NO: 71008 - RNA, 64 nt, hsa
cuuccagacaucugcguuccuucuggacucuccaaguaagcacaggcuucuguccuacucugua

SEQ ID NO: 71009 - RNA, 64 nt, hsa
cugugaacguuguaguaaacggcagcuuaagauaaguaagcagagacaguguuaaggacgaguu

SEQ ID NO: 71010 - RNA, 64 nt, hsa
gaaaaaagagaaacccguggcacuauguaaauaaaguaagcauacuuuguuguuaguaaauaga

SEQ ID NO: 71011 - RNA, 64 nt, hsa
auugguagcauguaacaguguuugacaaagaguaaguaagcaguauucuugggagucaguguua

SEQ ID NO: 71012 - RNA, 64 nt, hsa
agugucucuucccucccucuaauaguaaugguucaguaagcacuccuuaacuccuuaguauuuc

SEQ ID NO: 71013 - RNA, 64 nt, hsa
ugucuacagucuauacucaauaccuauaaaaugcaguaagcauguguuacagaaagagguucug

SEQ ID NO: 71014 - RNA, 64 nt, hsa
ugagaggaccuaaacacaaugacaccucaguaacaguaagcacaccaacugccaaguuauuagu

SEQ ID NO: 71015 - RNA, 64 nt, hsa
ucuuucaagaaguucauacuuuaugaaauugcacaguaagcauuuauuuuucagaccauuuuug

SEQ ID NO: 71016 - RNA, 64 nt, hsa
uuuuuggauauggcagcacuuguaaaaauaaagcaguaagcaaaauccuuuuaaacacagaaau

SEQ ID NO: 71017 - RNA, 64 nt, hsa
caacuuuaauaauccauauuuauacuaucgcagaaguaagcauuuggcaaacguucagccauua

SEQ ID NO: 71018 - RNA, 64 nt, hsa
gaaaugaugcauaucauucccguuugcaucgcuaaguaagcaacuuaaguugcuuuaacaaacu

SEQ ID NO: 71019 - RNA, 64 nt, hsa
guguucucaguuuaagauagcagaucaucucagcaguaagcacaccaacagaacugaguuccag

SEQ ID NO: 71020 - RNA, 64 nt, hsa
gaagcugugaucgacuuagaauccaaauuugaggaguaagcagcauaaccuucuaccuuguaau

SEQ ID NO: 71021 - RNA, 64 nt, hsa
uauauuuuucuaaagguaaauuauuuguuagaugaguaagcaagauaccauugucgucauuggu

SEQ ID NO: 71022 - RNA, 64 nt, hsa
aguuacucaguacuaggaugcacccaguggugagaguaagcaucuuugacugaugacaggucuu

SEQ ID NO: 71023 - RNA, 64 nt, hsa
ccugugucuggccccuccgcgagggcuacucagcaguaagcaggccuuaguacggcugcugcac

SEQ ID NO: 71024 - RNA, 64 nt, hsa
uucagaaccccagaugagagccaaugucagauaaaguaagcauaguaauguagcaggaacuaca

SEQ ID NO: 71025 - RNA, 64 nt, hsa
ucacaauuucuuacaaccaagcuuugugcucccgaguaagcagggauguacuaggggaauguaa

SEQ ID NO: 71026 - RNA, 64 nt, hsa
cucuccuugccgcccugucaccuucaccucccggaguaagcagcgaggaagagcagcacugguc

SEQ ID NO: 71027 - RNA, 64 nt, hsa
gaccacacacaucucugcuggaaagucaacauguaguaagcaagauuuaacuguuugauuauaa

SEQ ID NO: 71028 - RNA, 64 nt, hsa
ggaguacugucucaguuucuaaccacucugugcaaguaagcaucuuacaacuggcucuuccucc

SEQ ID NO: 71029 - RNA, 64 nt, hsa
uugaacauacaugcauugacuugacaaguuacugaguaagcagcauauucagcaggugccacua

SEQ ID NO: 71030 - RNA, 64 nt, hsa
ccuuggguucucccgucucaccaccccuuucuacaguaagcacuuggaagauuguuucagggug

SEQ ID NO: 71031 - RNA, 64 nt, hsa
uuauuuauauaacucacugggacauugccaaaugaguaagcacuuaauucgcugcuucugagac

SEQ ID NO: 71032 - RNA, 64 nt, hsa
gcucgcggaacagccccuagucggcugcuuccagaguaagcagucuuuaugggcuuucucugag

SEQ ID NO: 71033 - RNA, 64 nt, hsa
acugccaggucccaagcuucagacugcugugcuuaguaagcaagugagaagccugggguuugga

SEQ ID NO: 71034 - RNA, 64 nt, hsa
cuaagguuuccagucagaugaggcaaacagcaagaguaagcaguguuacuugcagguacuuugg

SEQ ID NO: 71035 - RNA, 64 nt, hsa
acucaaaauuccaaaaagguggucaaauucuggaaguaagcauuuccucuuuuuuaaaaauuug

SEQ ID NO: 71036 - RNA, 64 nt, hsa
gacuuuauaaugcaaccaggaguauugaaaaaaaaguaagcaaugagcucaaauaauuaaaaaa

SEQ ID NO: 71037 - RNA, 64 nt, hsa
uuaaaguaauuucugaacuguguaaugugucuagaguaagcaaauacugcuaacaauuaacuca

SEQ ID NO: 71038 - RNA, 64 nt, hsa
cuagaaaagguuauguucauuuuucaaaaagggaaguaagcaaacaaauauugccaacucuucu

SEQ ID NO: 71039 - RNA, 64 nt, hsa
uuauuuuuuuacucugagaccagcaccagauguaaguaagcaucucauauauuucagccaaaua

SEQ ID NO: 71040 - RNA, 64 nt, hsa
uaaaauuccauuuuuuccaguguuuagcauuucuaguaagcagugagguuguuugacauacagu

SEQ ID NO: 71041 - RNA, 64 nt, hsa
cuuaaauauguauaaauguacauaaagacaaacuaguaagcaugaccuggggaaauggucagac

SEQ ID NO: 71042 - RNA, 64 nt, hsa
caaguggcuguucuuguaguuuucugcauagauaaguaagcaccacugaagcaccucuguggcu

SEQ ID NO: 71043 - RNA, 64 nt, hsa
ugcugcugugucuuuagaacagugccuggcacacaguaagcacucaauaaaucuuugaugaaug

SEQ ID NO: 71044 - RNA, 64 nt, hsa
guacuugcccacugacagucaauaucugucaccuaguaagcaaccaagagacccucccuucaug

SEQ ID NO: 71045 - RNA, 64 nt, hsa
caaaacauaggcugaaagcacgaauuacucaaaaaguaagcaaaccaauaccuggugaaucuau

SEQ ID NO: 71046 - RNA, 64 nt, hsa
uaugacagcuagucaguugacagggaccacccacaguaagcaccauggucagggagguggcagg

SEQ ID NO: 71047 - RNA, 64 nt, hsa
ccauuccaugaggcauacaguaaggcugccugcuaguaagcagucacauaaguggguaccuauc

SEQ ID NO: 71048 - RNA, 64 nt, hsa
aauuugcuagaacuguggaagcuucuacuccugcaguaagcacagaucgcacugccucaauaac

SEQ ID NO: 71049 - RNA, 64 nt, hsa
acuugauucuacugguaugcaaaacaggcaugcuaguaagcagucagucguggcucagaacuua

SEQ ID NO: 71050 - RNA, 64 nt, hsa
augauuuaauuacauuguucgauguuuguacaggaguaagcauguauuuuuaucaauuuaacac

SEQ ID NO: 71051 - RNA, 64 nt, hsa
uacuacauacaguacuuguaaaguguuagcuguaaguaagcacaaaauacauuuaaaauacaaa

SEQ ID NO: 71052 - RNA, 64 nt, hsa
ugagucacuuacuucauauccucucguucaguuuaguaagcaaaggcuucuuggcuucucuggu

SEQ ID NO: 71053 - RNA, 64 nt, hsa
ucgagcacugaagucaccauuaggucacuuaagaaguaagcaacuagcugggcacaguggcuca

SEQ ID NO: 71054 - RNA, 64 nt, hsa
aguguuuaagcaacuuaauauagaaaggcugaauaguaagcacuucucagagaaugcuauucaa

SEQ ID NO: 71055 - RNA, 64 nt, hsa
ugggcuucucugugugcauuugcgucuggccuggaguaagcagguccgaccccuccuucuuuac

SEQ ID NO: 71056 - RNA, 50 nt, hsa
cagcaacuuuccaguuguagaguaagcaagcaccuuaaguaguguguuaa

SEQ ID NO: 71057 - RNA, 64 nt, hsa
agcuguuuucagccauguuucucugugcaucuccaguaagcagaaggcuacccauuccauuccu

SEQ ID NO: 71058 - RNA, 64 nt, hsa
uaucuuccagaaccuaggaggaugccuaacagagaguaagcacuuaaaaaauauuugucauaug

SEQ ID NO: 71059 - RNA, 64 nt, hsa
cgcagccgccaacagcagcgcuguuagugagcuaaguaagcacugacuucguagaaaaccauaa

SEQ ID NO: 71060 - RNA, 64 nt, hsa
gcaacucaaaugagaugggaugaaauccuaugacaguaagcaaaaacagaaccaugaaaaauga

SEQ ID NO: 71061 - RNA, 64 nt, hsa
caaugaauccuaccucuugcccagucccaggcagaguaagcagggcccaccuagggaccaagaa

SEQ ID NO: 71062 - RNA, 64 nt, hsa
uugcauuuuuauuggaggaaaaccucgcucguucaguaagcauaaucugauuaacacagagaac

SEQ ID NO: 71063 - RNA, 64 nt, hsa
augguugucaucacuaguggcaaaugaccuuccaaguaagcagaugggaacugaauuguguuuu

SEQ ID NO: 71064 - RNA, 64 nt, hsa
cugucuugucuggugucuaguauuaauguugcccaguaagcaccucucucccuuuuuuuuuuuu

SEQ ID NO: 71065 - RNA, 64 nt, hsa
uggaaaaaccuuguggauaaguggcuguuucaucaguaagcagccuuugugguuuaguuauaaa

SEQ ID NO: 71066 - RNA, 64 nt, hsa
cucuugauggauuucuauuuuuauauaacuauacaguaagcauuuguauuuucucucucuaggu

SEQ ID NO: 71067 - RNA, 64 nt, hsa
uguagacggaauuggcauacggucuaauuuguguaguaagcaccuuuguucauacuaguaguga

SEQ ID NO: 71068 - RNA, 64 nt, hsa
agcauuuauuccuaagguaggcaggguauuuccuaguaagcauacuuucuuaagacggaggcca

SEQ ID NO: 71069 - RNA, 64 nt, hsa
gagaguguuuucauuuugugucuagguuugugugaguaagcaagaaauaaaccuuuguuguugu

SEQ ID NO: 71070 - RNA, 64 nt, hsa
gcuuuauuuuagugagggcaauuacagagaaaagaguaagcagaaauguccuucugaguacugg

SEQ ID NO: 71071 - RNA, 64 nt, hsa
aauagacugguuugacuauauuguuagcugccacaguaagcaggucauuguauagguaaaugcc

SEQ ID NO: 71072 - RNA, 64 nt, hsa
auuuuuaagguuguuuuccccuaaaaggaccuuuaguaagcaaauuuauuauuaaaugugcaca

SEQ ID NO: 71073 - RNA, 64 nt, hsa
uaacccacuggaugaaaaucuaggacuguauggaaguaagcaaacauuacauuuuuagguggaa

SEQ ID NO: 71074 - RNA, 64 nt, hsa
cuuaauaauuaguaauaauuaauuaguaauaauuaguaagcauuuucucaaugcucugauucca

SEQ ID NO: 71075 - RNA, 64 nt, hsa
gaaagggacgguuguggugaaguuugucaggcacaguaagcaugcugaguggcggggaucagaa

SEQ ID NO: 71076 - RNA, 64 nt, hsa
aaggaguaacauaaaacauguuuuuaucacucaaaguaagcaauggagguaacaaauauugugc

SEQ ID NO: 71077 - RNA, 64 nt, hsa
cccacguuucuguaaaaucaggauacguggcuuuaguaagcagaccaagcgcuucguggcaggg

SEQ ID NO: 71078 - RNA, 64 nt, hsa
gggucagugcuucccuuggugucagggaccugagaguaagcacaugacagcgucugcuugcguu

SEQ ID NO: 71079 - RNA, 64 nt, hsa
acacaacauaauuggagucuuaaaauagaggaagaguaagcaaagcaugucaaguuuuuguuuu

SEQ ID NO: 71080 - RNA, 64 nt, hsa
cauugaucuuuuuugcuauauuuguauacaguacaguaagcacaauuggcacuguacaucuaaa

SEQ ID NO: 71081 - RNA, 64 nt, hsa
uugggaguggucguauuaacuucuugcccaaagaaguaagcauauugguguuuucucaauuagu

SEQ ID NO: 71082 - RNA, 64 nt, hsa
ccuucuacuucucuauacauuucagauucucuacaguaagcauguguuacauuuguaauuauaa

SEQ ID NO: 71083 - RNA, 64 nt, hsa
uagauguuucacugaagaggaucuauagauggcaaguaagcauaugaaaagcuguuaaacucca

SEQ ID NO: 71084 - RNA, 64 nt, hsa
ccuuuuuguuuaagcacucggucccuuauuuaucaguaagcagguuuuuaaaaaucuuuuauau

SEQ ID NO: 71085 - RNA, 64 nt, hsa
gaaucugggaugagaaacaggauuguuucacaauaguaagcacauaauuuuuaaggccaaggca

SEQ ID NO: 71086 - RNA, 64 nt, hsa
ggaggaaaaaagugaaucugguuacacauauggaaguaagcaaaaugaaaagcacuuauugcuu

SEQ ID NO: 71087 - RNA, 64 nt, hsa
gcucuguaucuuaggcuuauauacguagggauagaguaagcaguacaaaguguauauuuuggaa

SEQ ID NO: 71088 - RNA, 64 nt, hsa
auuuuucauugcagauacgaagagaaaauuuucuaguaagcaagguguuccuacaucuuuucug

SEQ ID NO: 71089 - RNA, 64 nt, hsa
aagcaucuggagaaaauucaguuaaaagaauaaaaguaagcagcugaggaauuacuaucacuca

SEQ ID NO: 71090 - RNA, 64 nt, hsa
aauggaccauacuaccaaggaccaguccaccugaaccacacacucuaaagaaauauuuuuuaag

SEQ ID NO: 71091 - RNA, 64 nt, hsa
cuuguuuuuucaucucauuauccaaguucugcagaccacacaggaacuugcuucauggcucuuu

SEQ ID NO: 71092 - RNA, 64 nt, hsa
agggacagaugagcuuccggagacugcucuccucaccacacagcacuaguccauccucagcacc

SEQ ID NO: 71093 - RNA, 64 nt, hsa
gcaccugagccucccucacuuggacacucaggggaccacacagagaaguggauggacacuucgc

SEQ ID NO: 71094 - RNA, 64 nt, hsa
cacaagacauuuuucuacaguauuucaggugccuaccacacaggaaaccuugaagaaaaucagu

SEQ ID NO: 71095 - RNA, 64 nt, hsa
aacagaacccaguuagcagcagggagacgagaacaccacacaagacauuuuucuacaguauuuc

SEQ ID NO: 71096 - RNA, 64 nt, hsa
aucccggaucaucagcacaauugugaaacuugucaccacacaauaaaaagcagucuuagagagu

SEQ ID NO: 71097 - RNA, 64 nt, hsa
ggacuuauuuguuuuaauguacagaugugggaaaaccacacaaauuccgcaguuuauucuggau

SEQ ID NO: 71098 - RNA, 64 nt, hsa
uccuauacucagcccagguacgagaaggaacucaaccacacacagcagcugccugguaagugga

SEQ ID NO: 71099 - RNA, 64 nt, hsa
guuccacagacuggaccgcagaucauuaccuugaaccacacagaccugguucccugccucugua

SEQ ID NO: 71100 - RNA, 64 nt, hsa
gcuguggccaccaacacacaaccacacacacacaaccacacacacaaaugggggcaaccacauc

SEQ ID NO: 71101 - RNA, 64 nt, hsa
gugacagaggcucagcuguggccaccaacacacaaccacacacacacaaccacacacacaaaug

SEQ ID NO: 71102 - RNA, 64 nt, hsa
uuuguaucuuccauauaauaaccacacacagauaaccacacaaaaaauccuuuguaaaauuucu

SEQ ID NO: 71103 - RNA, 64 nt, hsa
aaauagaauuucgguuuguaucuuccauauaauaaccacacacagauaaccacacaaaaaaucc

SEQ ID NO: 71104 - RNA, 64 nt, hsa
auauauacacacagauacaaguguacacacacacaccacacaccacacacaccccacuggcagu

SEQ ID NO: 71105 - RNA, 64 nt, hsa
cacacagauacaaguguacacacacacaccacacaccacacacaccccacuggcagucuuugug

SEQ ID NO: 71106 - RNA, 64 nt, hsa
gguacugaauugucagauguggaguauuagugacaccacacauuuaauucagcuuuguccaaag

SEQ ID NO: 71107 - RNA, 64 nt, hsa
ccuguuucagaaaucuggagcuggcacuguggagaccacacacccuuugggaaagcucuugucu

SEQ ID NO: 71108 - RNA, 64 nt, hsa
aacacaaggucauggccacacugugacacacuacaccacacacaacagccaacagcuacaacag

SEQ ID NO: 71109 - RNA, 64 nt, hsa
gcuacaacagccucacuuggucugccaggcccccaccacacaucccagcccaauccagguacgc

SEQ ID NO: 71110 - RNA, 64 nt, hsa
cagucuguucccugcucccucgcuggcaagccccaccacacaggagugaggccaggggcuagga

SEQ ID NO: 71111 - RNA, 64 nt, hsa
cccucccuggcucccugucccugggcucagcacgaccacacaggacacccagccagggaauucu

SEQ ID NO: 71112 - RNA, 64 nt, hsa
gaaauacacguaugguuaauguucaguccaacaaaccacacacaguaaauguuuauuaauaguc

SEQ ID NO: 71113 - RNA, 64 nt, hsa
gauguuuuauugagugaagccuuaaaaagcacacaccacacacagcuaacugccaaaauacauu

SEQ ID NO: 71114 - RNA, 64 nt, hsa
ucuuggcacccugauuauucauacaugucugccuaccacacacaaaauauauccuugguucuau

SEQ ID NO: 71115 - RNA, 64 nt, hsa
cacaggaacuguucaguucccacccucagugggcaccacacaccccacuuccagcagaguccug

SEQ ID NO: 71116 - RNA, 64 nt, hsa
acagauauacacaccacacacacacaccacauacaccacacacacacguucccauccacucacc

SEQ ID NO: 71117 - RNA, 64 nt, hsa
aucaggcaguccuugaggauagacagauauacacaccacacacacacaccacauacaccacaca

SEQ ID NO: 71118 - RNA, 64 nt, hsa
auaggccacacagcacaugcacacaggugcacagaccacacagcacacacaagugcacagagca

SEQ ID NO: 71119 - RNA, 64 nt, hsa
cucacacacaguauacacauacacaagugcacagaccacacacagcacuaacacaugcacacac

SEQ ID NO: 71120 - RNA, 64 nt, hsa
ugucagaaaagggcugggcuugggaaggggagguggaggccagguguccccagaccucuaaccc

SEQ ID NO: 71121 - RNA, 64 nt, hsa
cauguuccccugggccccucagaaagucgagcuuggaggccagccuggaucugucucucccuuc

SEQ ID NO: 71122 - RNA, 64 nt, hsa
gugcucuauccacugcagggccagccacucgccaggaggccacgggccacgggaagaaccaagc

SEQ ID NO: 71123 - RNA, 64 nt, hsa
guuuucccucugggagccuaaaccaggcugcaucggaggccaggacccggaucauucacuguga

SEQ ID NO: 71124 - RNA, 64 nt, hsa
gacuggagcugcuggaucccaguguggugguguaggaggccacagugagcagguggccccagcu

SEQ ID NO: 71125 - RNA, 64 nt, hsa
uccaccccaucacgguggcccugagggcugacccggaggccaguggagcugccugguguccacg

SEQ ID NO: 71126 - RNA, 64 nt, hsa
cuaagugcccugugcugguugccaggcgcagaggggaggccagcccugcccucaggaccugccu

SEQ ID NO: 71127 - RNA, 64 nt, hsa
ccuccuccuuccagcaccugccagagcuucuccaggaggccaagcagaggcuccccucaugaag

SEQ ID NO: 71128 - RNA, 64 nt, hsa
ggucugcaccacauggcgggguuggggggccgcuggaggccaccugccaaggcgugggauggga

SEQ ID NO: 71129 - RNA, 64 nt, hsa
agauggagcagcucuugggauccuuuggggaaaaggaggccauucugggccccuuggcaaaccu

SEQ ID NO: 71130 - RNA, 64 nt, hsa
gaccagcuggggggcaggggggagaggggguaauggaggccaagccugcagcuuucuggaaauu

SEQ ID NO: 71131 - RNA, 64 nt, hsa
gcagcccuagugggagcccagcacacugcuucucggaggccaggcccuccugcuggcugaggcu

SEQ ID NO: 71132 - RNA, 64 nt, hsa
gugagcagggcccucagaggaaaggcaguauggcggaggccaugggggccccucggcauucaca

SEQ ID NO: 71133 - RNA, 64 nt, hsa
caugguagcacacaccuguagucccagauacuugggaggccaaggcaggaggauugcuugagac

SEQ ID NO: 71134 - RNA, 64 nt, hsa
cacgguggcucacgccuguaaucccagcacuuugggaggccaaggugggcggaucaccugaugu

SEQ ID NO: 71135 - RNA, 64 nt, hsa
cagcguggugugugccuguagucucagcuacuugggaggccauggugggaggauggguugagca

SEQ ID NO: 71136 - RNA, 64 nt, hsa
ugcaguggcucacuccuguaauccgagcaauuugggaggccaaggugggaguuuugcuugaggc

SEQ ID NO: 71137 - RNA, 64 nt, hsa
cuucccaccccuacacacacacucccugcuugcaggaggccaaacugucccucccuugcugaac

SEQ ID NO: 71138 - RNA, 64 nt, hsa
ugccugcugggcuccccccagugggaugggacagggaggccacacgcacuggugccaaaaccag

SEQ ID NO: 71139 - RNA, 64 nt, hsa
acuauaccuuauccauaggcgcaggugcacagggggaggccauaaagaucaaacaugcauggau

SEQ ID NO: 71140 - RNA, 64 nt, hsa
cguguccccgugcaguaggggcuacugugaccauggaggccagugccagcaccugcccaguggg

SEQ ID NO: 71141 - RNA, 64 nt, hsa
gacugugacauuucagccugaccaugaagacggcggaggccaggagacguucaacgccaccgga

SEQ ID NO: 71142 - RNA, 64 nt, hsa
cgcgguggcucacgccuguaaucccagcacuuugggaggccaagguggguggaccacaugaggu

SEQ ID NO: 71143 - RNA, 64 nt, hsa
ugugguggcucacgccugugaucccagcacuuugggaggccaagacgggcggaucaugagguca

SEQ ID NO: 71144 - RNA, 64 nt, hsa
cuugccuacugucaguggcuuugccaagaugggaggaggccagugcccacuugcccaccgaccu

SEQ ID NO: 71145 - RNA, 64 nt, hsa
cacaguggcucacgccuguaaucccaacaccuugggaggccaaggcaggcagaucacgacauca

SEQ ID NO: 71146 - RNA, 64 nt, hsa
agugcaagaaucuggagcugggaaaaggguucuuggaggccaggggaauacggggucccagaga

SEQ ID NO: 71147 - RNA, 62 nt, hsa
uuaacguccucauccgcuagccgcgcaggcguggaggccaggaggcuggggccccugggcug

SEQ ID NO: 71148 - RNA, 64 nt, hsa
agacaaugaccacuacccugggugugauaucacaggaggccagagagaggcaaaggcucaggcc

SEQ ID NO: 71149 - RNA, 64 nt, hsa
ugccccuugacacacgcccuccucaaauccuaggggaggccauucccaugagacugccugucac

SEQ ID NO: 71150 - RNA, 64 nt, hsa
cccaauggcucaugccuguaaucccaacacuuugggaggccaaggugggaggauggcuuguguc

SEQ ID NO: 71151 - RNA, 64 nt, hsa
acucugggcugggcacaguggcucacacacuuugggaggccaagcgggggugcagaucaccuga

SEQ ID NO: 71152 - RNA, 64 nt, hsa
uauucuguuaaagcaucuucauaggugcuuggugggaggccaaggucgccgaauccucgugguu

SEQ ID NO: 71153 - RNA, 64 nt, hsa
aagugacagagguagaaaacaguaggcccucacaggaggccaccuucgcuagcagggaguggga

SEQ ID NO: 71154 - RNA, 64 nt, hsa
ccugccucucuucuucagcgccacaaaauuacauggaggccagcugguuuugugaggagauugu

SEQ ID NO: 71155 - RNA, 64 nt, hsa
cacugguagucauguggccccaccuggaugcagaggaggccaggaugugcagucuccacauagu

SEQ ID NO: 71156 - RNA, 64 nt, hsa
gccuggugguggcccacaccuaucuucucaccuuggaggccacacccaacuuuccaaagacccu

SEQ ID NO: 71157 - RNA, 64 nt, hsa
agcugcuccccucugcacggaccaugcgacacugggaggccagugagccacuccggccccgaau

SEQ ID NO: 71158 - RNA, 64 nt, hsa
acgagaaggaggcccagcaaguguauggugggaaggaggccaggacgugaguggggcuggggcu

SEQ ID NO: 71159 - RNA, 64 nt, hsa
guagcuuccagaacccacccugccccucuaccugggaggccaaaugggugagugggcuggggcu

SEQ ID NO: 71160 - RNA, 64 nt, hsa
gaugaccccuucccugagguggcugucuccaugaggaggccaacccuugccauugaccguggcc

SEQ ID NO: 71161 - RNA, 64 nt, hsa
gggacccacgcuccaaggcugagaccaguucccuggaggccacccacccugugccccggcaggc

SEQ ID NO: 71162 - RNA, 64 nt, hsa
gggauggggcugggggaugggccugagugagaggggaggccaagaguggccccaccuggcccuc

SEQ ID NO: 71163 - RNA, 64 nt, hsa
aggccaagaguggccccaccuggcccucucugaaggaggccaccuccuaaaaggcccagagaga

SEQ ID NO: 71164 - RNA, 64 nt, hsa
acacaguggcucaugcauguaauucuagcacuuuggaggccaaggcaggaggacugcuugagcc

SEQ ID NO: 71165 - RNA, 64 nt, hsa
cacgguagcuuaugccuguaaucucagcacuuugggaggccaaggcaggcagaucaugagguca

SEQ ID NO: 71166 - RNA, 64 nt, hsa
cacaguggcucacgccuguaaucccagcacuuugggaggccaaggcggguggauuaccuccauc

SEQ ID NO: 71167 - RNA, 64 nt, hsa
cgccugggcaggggcagccaaggcugggaaaugaggaggccaugcacaggguggggcagcuuuc

SEQ ID NO: 71168 - RNA, 64 nt, hsa
gcugcaggcaaagcuggacaugugcccuggcccaggaggccauguugggcccucguuuccauug

SEQ ID NO: 71169 - RNA, 64 nt, hsa
aaagcauagauuccccaaagugaggcucauggugggaggccacucaccuuccuagcugcugcuc

SEQ ID NO: 71170 - RNA, 64 nt, hsa
aguaccccguguucguguaccagccggccauccgggaggccaacgggaucguggagugcgggcc

SEQ ID NO: 71171 - RNA, 64 nt, hsa
aacccccagaggggcgccuguggggagggaaccaggaggccacacugggggagcgugcagccag

SEQ ID NO: 71172 - RNA, 64 nt, hsa
ugggaccagcggcuuguucuagggauuuggaccuggaggccaagggcaauaggagagggucuga

SEQ ID NO: 71173 - RNA, 64 nt, hsa
caugguggcucaugccuguaaucccagcauuuugggaggccaaggcgggcggaucacuugaggu

SEQ ID NO: 71174 - RNA, 64 nt, hsa
gcaguggcucacaccuuguaaucccagcacuuugggaggccaaggugggcggaucacccugagg

SEQ ID NO: 71175 - RNA, 64 nt, hsa
acccccuggaggaggaguaccuagcacaguugcaggaggccaaggaguacuagugacgggguug

SEQ ID NO: 71176 - RNA, 64 nt, hsa
gggaccugcccagcugcccgugugccuacccacuggaggccauggacagcccugugagccuaca

SEQ ID NO: 71177 - RNA, 64 nt, hsa
uuguucagguacaccaaagaggaagaagagcuguggaggccacccucuacaaagcuuuauagaa

SEQ ID NO: 71178 - RNA, 64 nt, hsa
augguggcucaggucuguagucuuugggucuuugggaggccagggugggaggaucacuugagcu

SEQ ID NO: 71179 - RNA, 64 nt, hsa
gucucuacaaaaaaaaauuaaaaagggggcuuugggaggccaaggcgggcagaucaugagggca

SEQ ID NO: 71180 - RNA, 64 nt, hsa
uuuuaaaacuauuugagaugcacuuuuguacucaggaggccaaggcaggaggauugcuugagcc

SEQ ID NO: 71181 - RNA, 64 nt, hsa
cacaguggcucccaccuauaauccuagcacuuugggaggccaacgcggguggauugcuugagcc

SEQ ID NO: 71182 - RNA, 64 nt, hsa
cagagcaggggcuucagccacagagacacacucaggaggccagaagccgacacucaagguguuc

SEQ ID NO: 71183 - RNA, 64 nt, hsa
caugguggcucacgccuguaaucucagcacuuugggaggccaaggcaggugggucaccuggggu

SEQ ID NO: 71184 - RNA, 64 nt, hsa
ugcaguggcucacgccuauaaucccaacacuucgggaggccaaggugagaggauaacuugaaac

SEQ ID NO: 71185 - RNA, 64 nt, hsa
uggccaucgggagagcucugaccugcacaccgcgggaggccagggugcugacugucaagcaucc

SEQ ID NO: 71186 - RNA, 64 nt, hsa
ggaggguccccacagcccgugccccacgccgccuggaggccagaggggucaguggcccugcugu

SEQ ID NO: 71187 - RNA, 64 nt, hsa
gcaguuggggguucgaguagaucucauggguacaggaggccagcagggaccaggccagucagcc

SEQ ID NO: 71188 - RNA, 64 nt, hsa
ccccagccucuagcuacccuguaucgaggcaaggggaggccaguaaaguuugccaagccugauc

SEQ ID NO: 71189 - RNA, 64 nt, hsa
aggguauuuccuaguaagcauacuuucuuaagacggaggccauuugguuccugggagaauaggc

SEQ ID NO: 71190 - RNA, 64 nt, hsa
agcguuggcuuucgccuguaaucccaacacuuugggaggccaggacagaucacuugaggucagg

SEQ ID NO: 71191 - RNA, 64 nt, hsa
cacgguggcucaugccuguaaucccagcacuuugggaggccaagacgggcggaucuuuugaggu

SEQ ID NO: 71192 - RNA, 64 nt, hsa
gccaagacgggcggaucuuuugaggucgggaguuggaggccagccuggccaaaauggcaaaacc

SEQ ID NO: 71193 - RNA, 64 nt, hsa
ugcaguggaucacgccuguaaucccagcacauugggaggccaaggcacauaggucacuugaggu

SEQ ID NO: 71194 - RNA, 64 nt, hsa
uggguucaagcgauuccucugccucagcacuuugggaggccaaggcaggcagauaacaaaguca

SEQ ID NO: 71195 - RNA, 64 nt, hsa
cgacgcagcugugaauggccggugauguaugucaggaggccacagggagcagaggagcggggca

SEQ ID NO: 71196 - RNA, 64 nt, hsa
cccaaggcuccggaccacacuggcccccugcggcggaggccaacgcagggcaccaccaccacca

SEQ ID NO: 71197 - RNA, 64 nt, hsa
uucucuaacagggccagcugagcagcacaggccaggaggccacaguguaagcaauaacagaucu

SEQ ID NO: 71198 - RNA, 64 nt, hsa
ugcggugguucgugccuguaaucccagcucuuugggaggccaaggcagguagaucacaagguca

SEQ ID NO: 71199 - RNA, 64 nt, hsa
cacucccaggcaggggugaggguggccuggcccaggaggccaggaaggagggcccugucugccu

SEQ ID NO: 71200 - RNA, 64 nt, hsa
acuccugggggcccccaaggcuccccuccuguggggaggccaccuuuuaaggcaccacuagcag

SEQ ID NO: 71201 - RNA, 64 nt, hsa
gguggccauggagacuccaccuggauccccuguaggaggccagggaggggaacucagcaguuca

SEQ ID NO: 71202 - RNA, 64 nt, hsa
ccccguggcucacaccuguaauccuagcacauugggaggccaaggcaggcacaucaccugaguu

SEQ ID NO: 71203 - RNA, 64 nt, hsa
cccacuacuuaaguacuugucauguacucuuagaggaggccaguaaugaucagaaccauuuuac

SEQ ID NO: 71204 - RNA, 64 nt, hsa
acccugcaggacuuccguggcugaggcugugaccggaggccaggaaugccguuggguggauugu

SEQ ID NO: 71205 - RNA, 64 nt, hsa
cuaucuuggagagcuggggaccagcagucugccuggaggccagggagcaguggcugaguagcuc

SEQ ID NO: 71206 - RNA, 64 nt, hsa
uccuuccuagccuugcacuuucagacucucucugggaggccauaaaauaaggagcauauguccu

SEQ ID NO: 71207 - RNA, 64 nt, hsa
cgccacagacgagcuccgagccaggucaggcuucggaggccacaagcucagccucaggcccagg

SEQ ID NO: 71208 - RNA, 64 nt, hsa
ugcgguggcucacgccuguaaucccagcacuuugggaggccaaggcaggaggaucgcuggagcc

SEQ ID NO: 71209 - RNA, 64 nt, hsa; identical to SEQ ID NO: 50174

SEQ ID NO: 71210 - RNA, 64 nt, hsa; identical to SEQ ID NO: 50175

SEQ ID NO: 71211 - RNA, 64 nt, hsa; identical to SEQ ID NO: 50176

SEQ ID NO: 71212 - RNA, 64 nt, hsa; identical to SEQ ID NO: 50177

SEQ ID NO: 71213 - RNA, 64 nt, hsa; identical to SEQ ID NO: 50178

SEQ ID NO: 71214 - RNA, 64 nt, hsa; identical to SEQ ID NO: 50179

SEQ ID NO: 71215 - RNA, 64 nt, hsa; identical to SEQ ID NO: 50180

SEQ ID NO: 71216 - RNA, 64 nt, hsa; identical to SEQ ID NO: 50181

SEQ ID NO: 71217 - RNA, 64 nt, hsa; identical to SEQ ID NO: 50182

SEQ ID NO: 71218 - RNA, 64 nt, hsa; identical to SEQ ID NO: 50183

SEQ ID NO: 71219 - RNA, 64 nt, hsa; identical to SEQ ID NO: 50184

SEQ ID NO: 71220 - RNA, 64 nt, hsa; identical to SEQ ID NO: 50185

SEQ ID NO: 71221 - RNA, 64 nt, hsa; identical to SEQ ID NO: 50186

SEQ ID NO: 71222 - RNA, 64 nt, hsa; identical to SEQ ID NO: 50187

SEQ ID NO: 71223 - RNA, 64 nt, hsa; identical to SEQ ID NO: 50188

SEQ ID NO: 71224 - RNA, 64 nt, hsa; identical to SEQ ID NO: 50189

SEQ ID NO: 71225 - RNA, 64 nt, hsa; identical to SEQ ID NO: 50190

SEQ ID NO: 71226 - RNA, 64 nt, hsa; identical to SEQ ID NO: 50191

SEQ ID NO: 71227 - RNA, 64 nt, hsa; identical to SEQ ID NO: 50192

SEQ ID NO: 71228 - RNA, 64 nt, hsa; identical to SEQ ID NO: 50193

SEQ ID NO: 71229 - RNA, 64 nt, hsa; identical to SEQ ID NO: 50194

SEQ ID NO: 71230 - RNA, 64 nt, hsa; identical to SEQ ID NO: 50195

SEQ ID NO: 71231 - RNA, 64 nt, hsa; identical to SEQ ID NO: 50196

SEQ ID NO: 71232 - RNA, 64 nt, hsa; identical to SEQ ID NO: 50197

SEQ ID NO: 71233 - RNA, 64 nt, hsa; identical to SEQ ID NO: 50198

SEQ ID NO: 71234 - RNA, 64 nt, hsa; identical to SEQ ID NO: 50199

SEQ ID NO: 71235 - RNA, 64 nt, hsa; identical to SEQ ID NO: 50200

SEQ ID NO: 71236 - RNA, 64 nt, hsa; identical to SEQ ID NO: 50201

SEQ ID NO: 71237 - RNA, 64 nt, hsa; identical to SEQ ID NO: 50202

SEQ ID NO: 71238 - RNA, 64 nt, hsa; identical to SEQ ID NO: 50203

SEQ ID NO: 71239 - RNA, 64 nt, hsa; identical to SEQ ID NO: 50204

SEQ ID NO: 71240 - RNA, 64 nt, hsa; identical to SEQ ID NO: 50205

SEQ ID NO: 71241 - RNA, 64 nt, hsa; identical to SEQ ID NO: 50206

SEQ ID NO: 71242 - RNA, 64 nt, hsa; identical to SEQ ID NO: 50207

SEQ ID NO: 71243 - RNA, 64 nt, hsa; identical to SEQ ID NO: 50208

SEQ ID NO: 71244 - RNA, 64 nt, hsa; identical to SEQ ID NO: 50209

SEQ ID NO: 71245 - RNA, 64 nt, hsa; identical to SEQ ID NO: 50210

SEQ ID NO: 71246 - RNA, 64 nt, hsa; identical to SEQ ID NO: 50211

SEQ ID NO: 71247 - RNA, 64 nt, hsa; identical to SEQ ID NO: 50212

SEQ ID NO: 71248 - RNA, 64 nt, hsa; identical to SEQ ID NO: 50213

SEQ ID NO: 71249 - RNA, 64 nt, hsa; identical to SEQ ID NO: 50214

SEQ ID NO: 71250 - RNA, 64 nt, hsa; identical to SEQ ID NO: 50215

SEQ ID NO: 71251 - RNA, 64 nt, hsa; identical to SEQ ID NO: 50216

SEQ ID NO: 71252 - RNA, 64 nt, hsa; identical to SEQ ID NO: 50217

SEQ ID NO: 71253 - RNA, 64 nt, hsa; identical to SEQ ID NO: 50218

SEQ ID NO: 71254 - RNA, 64 nt, hsa; identical to SEQ ID NO: 50219

SEQ ID NO: 71255 - RNA, 64 nt, hsa; identical to SEQ ID NO: 50220

SEQ ID NO: 71256 - RNA, 64 nt, hsa; identical to SEQ ID NO: 50221

SEQ ID NO: 71257 - RNA, 64 nt, hsa; identical to SEQ ID NO: 50222

SEQ ID NO: 71258 - RNA, 64 nt, hsa; identical to SEQ ID NO: 50223

SEQ ID NO: 71259 - RNA, 64 nt, hsa; identical to SEQ ID NO: 50224

SEQ ID NO: 71260 - RNA, 64 nt, hsa; identical to SEQ ID NO: 50225

SEQ ID NO: 71261 - RNA, 64 nt, hsa; identical to SEQ ID NO: 50226

SEQ ID NO: 71262 - RNA, 64 nt, hsa; identical to SEQ ID NO: 50227

SEQ ID NO: 71263 - RNA, 64 nt, hsa; identical to SEQ ID NO: 50228

SEQ ID NO: 71264 - RNA, 64 nt, hsa; identical to SEQ ID NO: 50229

SEQ ID NO: 71265 - RNA, 64 nt, hsa; identical to SEQ ID NO: 50230

SEQ ID NO: 71266 - RNA, 64 nt, hsa; identical to SEQ ID NO: 50231

SEQ ID NO: 71267 - RNA, 64 nt, hsa; identical to SEQ ID NO: 50232

SEQ ID NO: 71268 - RNA, 64 nt, hsa; identical to SEQ ID NO: 50233

SEQ ID NO: 71269 - RNA, 64 nt, hsa; identical to SEQ ID NO: 50234

SEQ ID NO: 71270 - RNA, 64 nt, hsa; identical to SEQ ID NO: 50235

SEQ ID NO: 71271 - RNA, 64 nt, hsa; identical to SEQ ID NO: 50236

SEQ ID NO: 71272 - RNA, 64 nt, hsa; identical to SEQ ID NO: 50237

SEQ ID NO: 71273 - RNA, 64 nt, hsa; identical to SEQ ID NO: 50238

SEQ ID NO: 71274 - RNA, 64 nt, hsa; identical to SEQ ID NO: 50239

SEQ ID NO: 71275 - RNA, 64 nt, hsa; identical to SEQ ID NO: 50240

SEQ ID NO: 71276 - RNA, 64 nt, hsa; identical to SEQ ID NO: 50241

SEQ ID NO: 71277 - RNA, 64 nt, hsa; identical to SEQ ID NO: 50242

SEQ ID NO: 71278 - RNA, 64 nt, hsa; identical to SEQ ID NO: 50243

SEQ ID NO: 71279 - RNA, 64 nt, hsa
gaccuaaagaaugcguuauccauccuauauaaaagaaagauaaaacacaggucaccaauuuucu

SEQ ID NO: 71280 - RNA, 64 nt, hsa
cauuuuuugagccuaucauuaauuagcuuaguaugaaagauaagaaaaucuccauguuguaucc

SEQ ID NO: 71281 - RNA, 64 nt, hsa
acugcacgcagugccuucagcauccauggcuaaugaaagauaccaagaacauggaggccaagaa

SEQ ID NO: 71282 - RNA, 64 nt, hsa
acgaugccaaggauuucaucagcaaucugcugaagaaagauaugaaguaaugaguugggauuuc

SEQ ID NO: 71283 - RNA, 64 nt, hsa
acuguaggaagaaauggaauaauuuaaaugugaggaaagauaucugugguagacauguccuucc

SEQ ID NO: 71284 - RNA, 64 nt, hsa
cauuaguggaggauagugcuuuugagccaucuaggaaagauauggaugaaguugaagagaaauc

SEQ ID NO: 71285 - RNA, 64 nt, hsa
cgucaccuguuacagguguacuuucuuaaugacugaaagauaaguggguagcaccgucagagag

SEQ ID NO: 71286 - RNA, 64 nt, hsa
ggggcaaguuucacccaaaugccugagacugcuugaaagauauauuuuaaguggugcacuaauu

SEQ ID NO: 71287 - RNA, 64 nt, hsa
gguaguuagcaauagguggaaagagaaaugaugugaaagauaaaugaugauucguggagcccua

SEQ ID NO: 71288 - RNA, 64 nt, hsa
uuauaaaugacagaucucaauuuuauaguagugggaaagauacaugcuaagaaagcaaauaagc

SEQ ID NO: 71289 - RNA, 64 nt, hsa
ggcccucagaagcagauuauuccuguuuuacagagaaagauacugagagugguugaguaauuug

SEQ ID NO: 71290 - RNA, 64 nt, hsa
ucugcagccagaaagaaucugaauuuaugaauuggaaagauauauauaguguauuugugaaagu

SEQ ID NO: 71291 - RNA, 64 nt, hsa
uguaacuauuuuaaauguuaagaaguaaaauaaugaaagauauguuaauuacuuuauucaguaa

SEQ ID NO: 71292 - RNA, 64 nt, hsa
caaucuuauugccaacauuccauaccagugguaggaaagauauucucauuuuuuuuauugaacc

SEQ ID NO: 71293 - RNA, 64 nt, hsa
gugugaaaaaggaauaaauuguuccaugcugguggaaagauagagauuguuuuuagagguuggu

SEQ ID NO: 71294 - RNA, 64 nt, hsa
guauguuuuuaauaugcauagaacaaaagauuuggaaagauauacaccaaacuguuaaaugugg

SEQ ID NO: 71295 - RNA, 64 nt, hsa
gcuaccucuauaucauucaauauuuucuguugaggaaagauaaaaauguaugcaauuccugagu

SEQ ID NO: 71296 - RNA, 64 nt, hsa
gggaccaaagagaaucauuuuggaagaaguucgggaaagauaccagcugcaugacagguauuga

SEQ ID NO: 71297 - RNA, 63 nt, hsa
cacaggugugauccuccuugagcauugaggaggcacauggagaacuaaaucuuuuguaguagc

SEQ ID NO: 71298 - RNA, 63 nt, hsa
uuuuucaacaauuucaacaaugacacaaaaauucacauggaaauggggaagauggucuguuuu

SEQ ID NO: 71299 - RNA, 63 nt, hsa
ucuaucuagauguguaaguguuuuuuuuaaaaucacauggaacgguuuuuuuuauacuaaaaa

SEQ ID NO: 71300 - RNA, 63 nt, hsa
caguacauguaagcagccauuaauaaacuguugcacauggauacuuauagacagacuuauugg

SEQ ID NO: 71301 - RNA, 63 nt, hsa
uggacauuggacauugcuaaguugggucacugccacauggagucuugccaugccugugugccc

SEQ ID NO: 71302 - RNA, 63 nt, hsa
gccacaucugggcauacagugucuggacacugccacauggagccacugucaugcaggucauau

SEQ ID NO: 71303 - RNA, 63 nt, hsa
ccuguuguuuuggcucaauuuggguuuguuggucacauggagcucuuccauuucguuuagcug

SEQ ID NO: 71304 - RNA, 63 nt, hsa
aaagccucaaaucuuccuuacugucucucuugucacauggaaucuacauguguuugaacuauu

SEQ ID NO: 71305 - RNA, 63 nt, hsa
uuuggcccuaauagcacuggacaacaccacgaccacauggaaacauauuuuuggaagcaaaac

SEQ ID NO: 71306 - RNA, 63 nt, hsa
agacuuaaagaauuuucuaauacacuuguuucacacauggacguugaggccauagucuuuaaa

SEQ ID NO: 71307 - RNA, 63 nt, hsa
guccuagaaagccuggucauuuuacuguccucacacauggaagacacuuguguuggcugugcc

SEQ ID NO: 71308 - RNA, 63 nt, hsa
aguaacuccccuuaaaaugucuaguaaagcuugcacauggauugauuaaaagcaaauaccugu

SEQ ID NO: 71309 - RNA, 63 nt, hsa
uuuacagacacugggcuaaaaaggguauucagacacauggacacacauuccuagaaugucauc

SEQ ID NO: 71310 - RNA, 63 nt, hsa
augugaugcaauaaaauuuaaaauaaauuucugcacauggaauauuuucagcuggcucuucug

SEQ ID NO: 71311 - RNA, 63 nt, hsa
ccuucauugcuggagacaguagaggcaugaacacacauggaugcacacacacacacgccaaug

SEQ ID NO: 71312 - RNA, 63 nt, hsa
agauaugcacacacagaugcacacacagauauacacauggaugcacgcacaugccaaugcacg

SEQ ID NO: 71313 - RNA, 63 nt, hsa
acacaccgaugugcgcacacacagauaugcacacacauggaugagcacacacacaccaaugcg

SEQ ID NO: 71314 - RNA, 64 nt, hsa
uuaugcuguacaauuaaaauaccccugacccaucaucugcuaccauucguuguggauaauucau

SEQ ID NO: 71315 - RNA, 64 nt, hsa
gcugcauaugucaguggcucuggagauuguuaccaucugcuacauauauaaauagacuugcagu

SEQ ID NO: 71316 - RNA, 64 nt, hsa
ggggcugaguccucacugagcagccacuuuccacaucugcuagaggaacagugacauggacacc

SEQ ID NO: 71317 - RNA, 64 nt, hsa
augcugagcgcccugagccggugccucuucacacaucugcuauuuccugugguguucugggcau

SEQ ID NO: 71318 - RNA, 63 nt, hsa
cuguuauuguccccuaaugauaggauauucccugcugccuaccuggagauucaguaggaucuu

SEQ ID NO: 71319 - RNA, 63 nt, hsa
ccuucaccucuguugcugaggaaaugguagaaugcugccuaucaccuccagcacaaucccagu

SEQ ID NO: 71320 - RNA, 63 nt, hsa
accgggacccccccacccacgugucucauuguggcugccuauggacucccgggccuugugugc

SEQ ID NO: 71321 - RNA, 63 nt, hsa
acagaggagucaggcccgccccaggagccuccagcugccuaaccagugccauucuuucacaac

SEQ ID NO: 71322 - RNA, 64 nt, hsa
gcuaggcuagcugguuuggaguagaauggcaacuaauucuaauuuuuauuuauuaaauauuugg

SEQ ID NO: 71323 - RNA, 64 nt, hsa
ccuccuugcuugucacccaguugccuuuaaaccaaauucuaaccagccuauccccagguagggg

SEQ ID NO: 71324 - RNA, 64 nt, hsa
cuugucauuuuaaugucauuauugaaauacuuuuaauucuaauuuucaaaagaaagcuaaaugc

SEQ ID NO: 71325 - RNA, 64 nt, hsa
ugagaggaggggaguguaugucuagaguuaccccaauucuaaauagguaccaaaagaguauuga

SEQ ID NO: 71326 - RNA, 64 nt, hsa
cugcucaguggccagguuaucaguggggggacuuaauucuaaucucauucaaauggagacgccc

SEQ ID NO: 71327 - RNA, 64 nt, hsa
uguuuaaacuucucugaccacaucgucaggauagaauucuaacuugaguuuuccaaagaccuuu

SEQ ID NO: 71328 - RNA, 64 nt, hsa
agauaaaguccugaaccuuucaaaauggaaaauuaauucuaaacuuagaaauaugcuucugccu

SEQ ID NO: 71329 - RNA, 64 nt, hsa
ccuucuuucagugacuucuucccuaaaauguagaaauucuaacuuaauguaguuacugugagcc

SEQ ID NO: 71330 - RNA, 64 nt, hsa
acccuugaccagaaauuuuucuucuaaagaauuuaauucuaaaaguuauagacauucccaaaga

SEQ ID NO: 71331 - RNA, 64 nt, hsa
uuuguuaaaauaaauaacauuuaauuugacggaaaauucuaaaaaucaacauuugguaacuuaa

SEQ ID NO: 71332 - RNA, 64 nt, hsa
auuuuguugaaugcuauggaauauuaauauaauuaauucuaaaauaucaccuaaaauaugucaa

SEQ ID NO: 71333 - RNA, 64 nt, hsa
ccccccacacucucccucccccaucaccaucuucaauucuaauaaauaaugcugauguucaaca

SEQ ID NO: 71334 - RNA, 64 nt, hsa
acauuuucagaaacuuagugauaacauuaugaacaauucuaaaagcccugugauuugaaaaaua

SEQ ID NO: 71335 - RNA, 64 nt, hsa
uuuuuuauacaggggaauauuuuauucaagguaaaauucuaaauaaaauauaauuguuuuuuau

SEQ ID NO: 71336 - RNA, 64 nt, hsa
ugcaaauucccagauuugaagacaaaaauacucuaauucuaaccagagcaagcuuuuuuauuuu

SEQ ID NO: 71337 - RNA, 64 nt, hsa
aaguuugauauucaguggauacaaauagaacaugaauucuaaguuuuggguaauguuaacucag

SEQ ID NO: 71338 - RNA, 64 nt, hsa
uuaaccucaucaaaagugugugaauuuuaaaacaaauucuaaaaaaacuauagugcuaaauugg

SEQ ID NO: 71339 - RNA, 64 nt, hsa
gcucuuuuaaaugccaauuacagucccuuacuggaauucuaacuguaauuugcuuugcaaucaa

SEQ ID NO: 71340 - RNA, 64 nt, hsa
caauaaaaaugagcccuauguagcacuagguuugaauucuaaaauucaaaacaggcauuucauu

SEQ ID NO: 71341 - RNA, 64 nt, hsa
aaguccauaucaugaauucagaacccuuuaauguaauucuaauaagcugagugacucuuuaaua

SEQ ID NO: 71342 - RNA, 64 nt, hsa
cuauauucucuguaguuacugaaaaccgaaagucaauucuaauuauucaucuuacauauuuuuc

SEQ ID NO: 71343 - RNA, 64 nt, hsa
uuuucaacuguaaacuuauucugaaauaaaguaaaauucuaauuguuuaaauacugugaugaau

SEQ ID NO: 71344 - RNA, 64 nt, hsa
gaagugcuaaauuuuaaaagcugaaacacaacagaauucuaagaaauauaguccaaacguugca

SEQ ID NO: 71345 - RNA, 64 nt, hsa
uuugaagacacuaugccuuccuaagaacuaauuuaauucuaaauauuuuuaacauuacugaggu

SEQ ID NO: 71346 - RNA, 64 nt, hsa
aauucuaauucccuguaauucgcauaagucauagaauucuaaucaggaauaauuguauguaaag

SEQ ID NO: 71347 - RNA, 64 nt, hsa
guaguagggauuaauucccauaaguuauagagagaauucuaauucccuguaauucgcauaaguc

SEQ ID NO: 71348 - RNA, 64 nt, hsa
uuaccagcaaagaauauuuuuaauguggauaucuaauucuaaagucuguuccauuagaagcaau

SEQ ID NO: 71349 - RNA, 64 nt, hsa
auauuguauuuuaaaaaugcauauugaucacuauaauucuaaaacaauuuuuuaaauaaaccag

SEQ ID NO: 71350 - RNA, 64 nt, hsa
auguacagaaaacauuagaaaaaauuuauuacagaauucuaauuccaguaugaauaguggaaac

SEQ ID NO: 71351 - RNA, 64 nt, hsa
cauacucugaauuucaguaaaaaucaaaacuuaaaauucuaaccagucauauacacuggauaau

SEQ ID NO: 71352 - RNA, 64 nt, hsa
gcgugacuucucauuuuaaauaaaauauuuuaggaauucuaaacaucuaaauuuccuaacaagg

SEQ ID NO: 71353 - RNA, 64 nt, hsa
uagguacaauucaguuguuggcuuguuuugacuuaauucuaaaauaggucucaagccuguauuu

SEQ ID NO: 71354 - RNA, 64 nt, hsa
uauccuuuaaucacauuuuauauuuuuucuucacaauucuaaccuuugaaaauauuauaacugg

SEQ ID NO: 71355 - RNA, 64 nt, hsa
aacuagaagaaauuauuaacuuuuuuucuuuuuuaauucuaauucacuuguuuauuuuggggga

SEQ ID NO: 71356 - RNA, 64 nt, hsa
uaguggcccccacaggaguggagucuugaaaucuaauucuaaaugccagucagugaugaucgca

SEQ ID NO: 71357 - RNA, 64 nt, hsa
auuuuaaugaaugugagcucuugacuuacucuagaauucuaauacagauacuuucugcacuagu

SEQ ID NO: 71358 - RNA, 64 nt, hsa
uacaacuucaaugcuuaauaauaauaaacaaauuaauucuaaaggcccaggccuccaguccuug

SEQ ID NO: 71359 - RNA, 64 nt, hsa
aauaucuguugcacuguucaacugauauuuuuaaaauucuaauaaucuucaucucaaauguagc

SEQ ID NO: 71360 - RNA, 64 nt, hsa
acuuaacguguuuucugucauaguuagaugugauaauucuaagagugucuaugacuuauuuccu

SEQ ID NO: 71361 - RNA, 64 nt, hsa
ucaaaagcagcagcaagucgucaagaagcacaccaauucuaacccacaagauuccaucuguggc

SEQ ID NO: 71362 - RNA, 64 nt, hsa
gaucaccacuuucucuucuaguucuaauuuuuuuaauucuaauaccuauauuuucaaguuaugu

SEQ ID NO: 71363 - RNA, 64 nt, hsa
uucaauuauaugcagacugacugauucuaagauaaauucuaaggagguuucuaauuuuguaauu

SEQ ID NO: 71364 - RNA, 64 nt, hsa
gguagaggcacaaagaggcaaacuaagcaagucaaauucuaauguguguacuucauaauaauuu

SEQ ID NO: 71365 - RNA, 64 nt, hsa
uuuuacucugaagucagaagagcucauauauaauaauucuaaugucccaccuauuuucacuugu

SEQ ID NO: 71366 - RNA, 64 nt, hsa
uaaugcuuucuuguaguagaauaagaaucguguaaauucuaagagauuuuagcagguuuucuuu

SEQ ID NO: 71367 - RNA, 64 nt, hsa
acaagugccaacuuacagaugauuacgcauuuugaauucuaaugaacuguuuuaaccuucagga

SEQ ID NO: 71368 - RNA, 64 nt, hsa
uauauguuggaccucugaaaaguuguaaggggccaauucuaaguauucuucacggcagccagaa

SEQ ID NO: 71369 - RNA, 64 nt, hsa
aaacaaauguaagacuacaaaaucguucaagagcaauucuaauauaauuuacauauguucacgc

SEQ ID NO: 71370 - RNA, 64 nt, hsa
cuuaaagauuauaaauuauguaaauacauuaauaaauucuaaguuucauuugacauuccauuga

SEQ ID NO: 71371 - RNA, 64 nt, hsa
ucugaaaucauauaaaaagaaugucauuaguaaaaauucuaacuucguuuuguuuaaaagacau

SEQ ID NO: 71372 - RNA, 64 nt, hsa
auuucuguaaaugauaccuacauucuaaagaguuaauucuaauuauuccgauaugaccuuaagg

SEQ ID NO: 71373 - RNA, 64 nt, hsa
agaagauauuaagucccuuucaaaauggaaaauuaauucuaaacugagaaaaauguuccuacua

SEQ ID NO: 71374 - RNA, 64 nt, hsa; identical to SEQ ID NO: 71372

SEQ ID NO: 71375 - RNA, 64 nt, hsa; identical to SEQ ID NO: 71373

SEQ ID NO: 71376 - RNA, 64 nt, hsa
uguggaagugagaaggagucacugugaugcuuagcuguccuaaaugaugguuugcucaaugcca

SEQ ID NO: 71377 - RNA, 64 nt, hsa
gggcugaggaugcagaaacaggcaggacacagugcuguccuagcagugcacuggcgggucucuc

SEQ ID NO: 71378 - RNA, 64 nt, hsa
aaaaccaacucaguauuggaaauuuucuaaaguucuguccuagaguucuuuccugaccucuagc

SEQ ID NO: 71379 - RNA, 64 nt, hsa
aacuaccuuuccauaauguucucacaucuuuacucuguccuaccucucauuuucaauccuguuu

SEQ ID NO: 71380 - RNA, 64 nt, hsa
acauauguaauuugugcagugugacauggacuugcuguccuaauggauguguugugccuugugu

SEQ ID NO: 71381 - RNA, 64 nt, hsa
gacuaaauaggcccagccuccuucccuuccagcucuguccuaggagcauaggcgggaaaucuga

SEQ ID NO: 71382 - RNA, 64 nt, hsa
cacaccuucccugccccguccugagugccccuuccuguccuaagcccccugcucucuucugagc

SEQ ID NO: 71383 - RNA, 64 nt, hsa
ccugaggacccuucccuauccugagcccccuucccuguccuaagccugacgccugcaccgggcc

SEQ ID NO: 71384 - RNA, 64 nt, hsa
ucauuugagcagggcucagcggggacagcuccuucuguccuacucugugucagguggggcagcu

SEQ ID NO: 71385 - RNA, 64 nt, hsa
cauauucuguuggccagugugacaaggauugcuacuguccuacccacccuccuuucaccacaug

SEQ ID NO: 71386 - RNA, 64 nt, hsa
ccugaggacccuuccccauccugagcccccuucccuguccuaagccugacgccugcaccgggcc

SEQ ID NO: 71387 - RNA, 64 nt, hsa; identical to SEQ ID NO: 71382

SEQ ID NO: 71388 - RNA, 64 nt, hsa; identical to SEQ ID NO: 53591

SEQ ID NO: 71389 - RNA, 64 nt, hsa; identical to SEQ ID NO: 53592

SEQ ID NO: 71390 - RNA, 64 nt, hsa; identical to SEQ ID NO: 53593

SEQ ID NO: 71391 - RNA, 64 nt, hsa; identical to SEQ ID NO: 53594

SEQ ID NO: 71392 - RNA, 64 nt, hsa; identical to SEQ ID NO: 53595

SEQ ID NO: 71393 - RNA, 64 nt, hsa; identical to SEQ ID NO: 53596

SEQ ID NO: 71394 - RNA, 64 nt, hsa; identical to SEQ ID NO: 53597

SEQ ID NO: 71395 - RNA, 64 nt, hsa; identical to SEQ ID NO: 53598

SEQ ID NO: 71396 - RNA, 64 nt, hsa; identical to SEQ ID NO: 53599

SEQ ID NO: 71397 - RNA, 64 nt, hsa; identical to SEQ ID NO: 53600

SEQ ID NO: 71398 - RNA, 64 nt, hsa; identical to SEQ ID NO: 53601

SEQ ID NO: 71399 - RNA, 64 nt, hsa; identical to SEQ ID NO: 53602

SEQ ID NO: 71400 - RNA, 64 nt, hsa; identical to SEQ ID NO: 53603

SEQ ID NO: 71401 - RNA, 64 nt, hsa; identical to SEQ ID NO: 53604

SEQ ID NO: 71402 - RNA, 64 nt, hsa; identical to SEQ ID NO: 53605

SEQ ID NO: 71403 - RNA, 64 nt, hsa; identical to SEQ ID NO: 53606

SEQ ID NO: 71404 - RNA, 64 nt, hsa; identical to SEQ ID NO: 53607

SEQ ID NO: 71405 - RNA, 64 nt, hsa; identical to SEQ ID NO: 53608

SEQ ID NO: 71406 - RNA, 64 nt, hsa; identical to SEQ ID NO: 53609

SEQ ID NO: 71407 - RNA, 64 nt, hsa; identical to SEQ ID NO: 53610

SEQ ID NO: 71408 - RNA, 64 nt, hsa; identical to SEQ ID NO: 53611

SEQ ID NO: 71409 - RNA, 64 nt, hsa; identical to SEQ ID NO: 53612

SEQ ID NO: 71410 - RNA, 64 nt, hsa; identical to SEQ ID NO: 53613

SEQ ID NO: 71411 - RNA, 64 nt, hsa; identical to SEQ ID NO: 53614

SEQ ID NO: 71412 - RNA, 64 nt, hsa; identical to SEQ ID NO: 53615

SEQ ID NO: 71413 - RNA, 64 nt, hsa; identical to SEQ ID NO: 53616

SEQ ID NO: 71414 - RNA, 64 nt, hsa; identical to SEQ ID NO: 53617

SEQ ID NO: 71415 - RNA, 64 nt, hsa; identical to SEQ ID NO: 53618

SEQ ID NO: 71416 - RNA, 64 nt, hsa; identical to SEQ ID NO: 53619

SEQ ID NO: 71417 - RNA, 64 nt, hsa; identical to SEQ ID NO: 53620

SEQ ID NO: 71418 - RNA, 64 nt, hsa; identical to SEQ ID NO: 53621

SEQ ID NO: 71419 - RNA, 64 nt, hsa; identical to SEQ ID NO: 53622

SEQ ID NO: 71420 - RNA, 64 nt, hsa; identical to SEQ ID NO: 53623

SEQ ID NO: 71421 - RNA, 64 nt, hsa; identical to SEQ ID NO: 53624

SEQ ID NO: 71422 - RNA, 64 nt, hsa; identical to SEQ ID NO: 53625

SEQ ID NO: 71423 - RNA, 64 nt, hsa
cccauaccccucagggugguucccuaccagccaggcuuacuacuucuagaagaaagcagagugc

SEQ ID NO: 71424 - RNA, 64 nt, hsa
gaagaugguguggcccuguuagucuccguguguggcuuacuagccagccuugggaacugccaac

SEQ ID NO: 71425 - RNA, 64 nt, hsa
guaagcauuuauuaaguaccugcuguaugucaaggcuuacuacugcuuuccaauccuuggugau

SEQ ID NO: 71426 - RNA, 64 nt, hsa
aggauacccagugucuauucuggguuagagaagugcuuacuaagggguuuucuaauaaaaacaa

SEQ ID NO: 71427 - RNA, 64 nt, hsa
ccucugaggugccugcuggcauccucucccccaugcuuacuaauacauucccuuccccauagcc

SEQ ID NO: 71428 - RNA, 64 nt, hsa
uaguagggaaagaagaaagcuagcauuaaugaaugcuuacuaugugccagguacuacauccugu

SEQ ID NO: 71429 - RNA, 64 nt, hsa
ucuuacucucaucagacauuuuuuuucuagggacgcuuacuaauuaaaugauuuaaguuguuuc

SEQ ID NO: 71430 - RNA, 64 nt, hsa
acuauauagagaauauucuaugcaucuaugacgugcuuacuacugcagugcauuugucauuagu

SEQ ID NO: 71431 - RNA, 64 nt, hsa
ccaagaguugcggcguauuggagacgaguuuaacgcuuacuaugcaaggaggguaaugauguuu

SEQ ID NO: 71432 - RNA, 64 nt, hsa
uguauuucugcaguuucgguuuucauuugcuucagcuuacuaagaagcuucaaaucuaacucca

SEQ ID NO: 71433 - RNA, 64 nt, hsa
auguaguucccuacucaggcuuucguagugauuagcuuacuaaggaacugaaaaugggccccuu

SEQ ID NO: 71434 - RNA, 64 nt, hsa
cuggccacaguaauuggucaugugaugcaagccagcuuacuagcacuuugagaaugagucuccu

SEQ ID NO: 71435 - RNA, 64 nt, hsa
acuucugaagggguguggcaucuguguuucugaugcuuacuacaauaugugaaccacuacuuua

SEQ ID NO: 71436 - RNA, 64 nt, hsa
caauuacagggaaaaaacgugugaugauccugaagcuuacuaugcagccuacaaacagccuuag

SEQ ID NO: 71437 - RNA, 64 nt, hsa
aacucccauuuuuaaaaccaucagaucucaugaggcuuacuaucacgagaacagcaugggaaag

SEQ ID NO: 71438 - RNA, 64 nt, hsa
ggggcuuccaccauucccagaacugaucaaaguagcuuacuauaucuaaacuguaaaacaauau

SEQ ID NO: 71439 - RNA, 64 nt, hsa
cuuuauuucuaacuccuuauugaagcuaaggggugcuuacuaaaaggaggcagccauauaggcc

SEQ ID NO: 71440 - RNA, 64 nt, hsa
uucucugcaggccacuuaccuuccccugagucaggcuuacuaaugcugcccucacugccucuuu

SEQ ID NO: 71441 - RNA, 64 nt, hsa
uucugacacauaucauucugugauuaaaucuccagcuuacuauaaaugauaucuauauucuaaa

SEQ ID NO: 71442 - RNA, 64 nt, hsa
aguccuauaugucaccuagggaacagacauuauagcuuacuagcaaaugaauauucaugccuug

SEQ ID NO: 71443 - RNA, 64 nt, hsa
uccuuauuauuaaucuguuagcucauuaucauuagcuuacuaacuugaaaguuagauuaauauc

SEQ ID NO: 71444 - RNA, 64 nt, hsa
gccucuuguuuuucaccaaaacccuacaucucaggcuuacuaauuuuugugauauuuucauguu

SEQ ID NO: 71445 - RNA, 64 nt, hsa
ggguaauuuguggucuaggccuuuuguuuucuaagcuuacuaucuuguguuuguuuauuugcuu

SEQ ID NO: 71446 - RNA, 64 nt, hsa
uuuaugaucuaugucauauauuaaaaaagagcuugcuuacuacaagaaaaauauugaaauauug

SEQ ID NO: 71447 - RNA, 64 nt, hsa
cuguggauaccaagguacaacuguauuuauuaacgcuuacuagaugugaggagagucugaauau

SEQ ID NO: 71448 - RNA, 64 nt, hsa
cacuggcugagcggaugcaucuggggaugagguugcuuacuaagcuuugccagcugcugcugga

SEQ ID NO: 71449 - RNA, 64 nt, hsa
aaagcaguuuaauuaagguaucaaaaauaucuuugcuuacuaucaagaagugucaaauagguuc

SEQ ID NO: 71450 - RNA, 64 nt, hsa
auauuguauggcuauuuucauguuugaagcuauagcuuacuaucaugagacaguuuugauuuug

SEQ ID NO: 71451 - RNA, 64 nt, hsa
aagagaaaauagaaaggcugcuuuagugccuuacgcuuacuaaauuuaaaucuuuauuuaccug

SEQ ID NO: 71452 - RNA, 64 nt, hsa
cuaguugcucuugcuuuggucuucuuccaaugaugcuuacuacagaaagcaaaucagacacaau

SEQ ID NO: 71453 - RNA, 64 nt, hsa
uuuuuuaaguaauuuuaaaaaaaauaaacacucugcuuacuacuugauuuuuuuuuucucuuuu

SEQ ID NO: 71454 - RNA, 64 nt, hsa
ugaaucaacaagauuuccacaauucuucugucaagcuuacuacagugaaagaaugggauuggca

SEQ ID NO: 71455 - RNA, 64 nt, hsa
cauaccaucugcugccccgcuuccccacagaacugcuuacuagcccugcggagccggcaccuac

SEQ ID NO: 71456 - RNA, 64 nt, hsa
auguauuccggcagaauagugaguagaaugacaugcuuacuauacagaaggcaaaaauaggacu

SEQ ID NO: 71457 - RNA, 64 nt, hsa
ugucucuucugugaaaggguucagagcagauuuugcuuacuauguaguguugcccuuaaguaca

SEQ ID NO: 71458 - RNA, 64 nt, hsa
gugacauuuucuuagccuuaacguucugauaguagcuuacuacucacuucucuuuuucaguuuu

SEQ ID NO: 71459 - RNA, 64 nt, hsa
gucagagguuguaagggaagaguuuaugcugacugcuuacuagguguuugucauggaagagaag

SEQ ID NO: 71460 - RNA, 64 nt, hsa
aucucuguuuuugaauucuuauuauuuauauuuugcuuacuaccuuuuuugccuuuuguccuuu

SEQ ID NO: 71461 - RNA, 62 nt, hsa
gugaguauggcaaaacuuaauugauccuacaagcuuacuacacauaggaaaauucauacugg

SEQ ID NO: 71462 - RNA, 64 nt, hsa
ccugcuguuucucagcaaagccuugcucucuggagcuuacuaugugcugguacuuaaagaguac

SEQ ID NO: 71463 - RNA, 64 nt, hsa
auccagguguugacuauaaccagauuuacucuuugcuuacuagguuuuccauugucaccauugg

SEQ ID NO: 71464 - RNA, 64 nt, hsa
agacaaaauaguaucaacacauuauaaauauuuagcuuacuaaauauuuguaauuauuuuuaca

SEQ ID NO: 71465 - RNA, 64 nt, hsa
uuguuuucugaauucugagucuccugaacaaaaggcuuacuauccauggucuuggaaaagauug

SEQ ID NO: 71466 - RNA, 64 nt, hsa
cucauuuuauucauucagucgucaugaguugagugcuuacuacaugcaaggcacucugcuaguu

SEQ ID NO: 71467 - RNA, 64 nt, hsa
cagaauuccguuuccuucuaacuaaugaaaaacugcuuacuaaaaaaaaauuuuauacuuuccu

SEQ ID NO: 71468 - RNA, 64 nt, hsa
uagauuacaggauuaauauauugaacaccuucaugcuuacuauuuuaugucuauauuuaaauca

SEQ ID NO: 71469 - RNA, 64 nt, hsa
uuacccccaccuuaauuagagaaacauuuauauugcuuacuacuguaggcuguacaucucuuuu

SEQ ID NO: 71470 - RNA, 64 nt, hsa
acuguauuccaucuaguacggggccuuugguguggcuuacuauuucauugugugcacccaccca

SEQ ID NO: 71471 - RNA, 64 nt, hsa
uugcccuggcuggaguucagugacaugaucucaggcuuacuacagccuccaccuucagguucaa

SEQ ID NO: 71472 - RNA, 64 nt, hsa
aaaggauuugaugcuuuucucucagcauagguaugcuuacuaugaccuuccaaguuugacuugu

SEQ ID NO: 71473 - RNA, 64 nt, hsa
cacagagaacaugagaacauaaagccauuuuuaugcuuacuacuaaaagcuguccacuguagag

SEQ ID NO: 71474 - RNA, 64 nt, hsa
uacaauaauagagaggaagccuucuuagaacucugcuuacuaauguauuaauaccacugagacc

SEQ ID NO: 71475 - RNA, 64 nt, hsa
uucuaaggcuaaauucauuuccagaaguagcaaagcuuacuagccaaaggcuccacauuuauca

SEQ ID NO: 71476 - RNA, 64 nt, hsa
ccuauguuugauugcacagucuuugacaauaguagcuuacuaagacugcucagaaugaguaagc

SEQ ID NO: 71477 - RNA, 64 nt, hsa
caagaaaagaacucugcuguccaggcacugcuuggcuuacuaucccagcaaagacugcaguuuu

SEQ ID NO: 71478 - RNA, 64 nt, hsa
guggaggcuauuuucauuaaaacugucagaauuugcuuacuauaauuaugauacaguccaaaga

SEQ ID NO: 71479 - RNA, 64 nt, hsa
aaaaggagacaauaaucaagucaaaagaauaaaugcuuacuaaucaucagaaaaucuguggcca

SEQ ID NO: 71480 - RNA, 64 nt, hsa
ucuccacccucuugcauaccuccagggacagagagcuuacuaccucccaaggcagccuccugcc

SEQ ID NO: 71481 - RNA, 64 nt, hsa
gucauauuagucucucuacaugggaagauguugugcuuacuauggccagucacuuugacaaaga

SEQ ID NO: 71482 - RNA, 64 nt, hsa
ugugggucuuucaugagcagugacggauaguuuagcuuacuauguuucccccccaauucaauga

SEQ ID NO: 71483 - RNA, 64 nt, hsa
cauggaugccaccagcuugcgguaguagcaagaugcuuacuaccacaccguuuuccucgguggc

SEQ ID NO: 71484 - RNA, 64 nt, hsa
ucaacuguuuuaagcuguauauuucuuuaauucugcuuacuauuucauggaaaaaaauaaauuu

SEQ ID NO: 71485 - RNA, 64 nt, hsa
auacuuauacaguuuagucaucaaugacuauuuugcuuacuauugugucuaugauaugugauac

SEQ ID NO: 71486 - RNA, 64 nt, hsa
ucuguuuauuuuuaaaugaucaucauaauccuuugcuuacuauuuaugcagcuucucuacccca

SEQ ID NO: 71487 - RNA, 64 nt, hsa
guuugcacuuaauccuuaacuguauuaacguucagcuuacuaaacugacugccucaaguccagg

SEQ ID NO: 71488 - RNA, 64 nt, hsa
cccccacucccacaaacucugaagccagugucuagcuuacuaaaaaaagaguuguauauaauau

SEQ ID NO: 71489 - RNA, 64 nt, hsa
aacuaacaaaaccagcaccacaucgcuagguggugcuuacuaauuaccuucucaggauuuuccu

SEQ ID NO: 71490 - RNA, 64 nt, hsa
aaaacuuuucuugagacaaacaaaaaaaaaguuugcuuacuauuugauuaaauaaaauuuacuu

SEQ ID NO: 71491 - RNA, 64 nt, hsa
auaucauacaaaucaguuaguuuuuaggucaagggcuuacuauuucugggucuuuugcuacuaa

SEQ ID NO: 71492 - RNA, 64 nt, hsa
guucccagcaacugcuuguuugugcaugaguagggcuuacuaagugcauagauguuucuacagu

SEQ ID NO: 71493 - RNA, 64 nt, hsa
cacagcccccucuagauucuuggaguuccgcagagcuuacuauacgcggucuguccuaaucuuu

SEQ ID NO: 71494 - RNA, 64 nt, hsa
uuuguguucaaaguaaaauauccucauugcugcagcuuacuaaaaauguaaagaaaauuguuuu

SEQ ID NO: 71495 - RNA, 64 nt, hsa
uacugucuccuugggccaugcuggucugacuuaugcuuacuaauaaauucuguuuacuggcaaa

SEQ ID NO: 71496 - RNA, 64 nt, hsa
uccauuucuguuaaaguggaucugcauaucuucagcuuacuaggugacccggaugcugacaucu

SEQ ID NO: 71497 - RNA, 64 nt, hsa
acaaaaggcgcucuauacauauuauaauauauucgcuuacuaaaugaauaaggacuuuccaacu

SEQ ID NO: 71498 - RNA, 64 nt, hsa
caacaggcugcauguuaaauggccaagaggugaggcuuacuauucacuaugaaaauggguucac

SEQ ID NO: 71499 - RNA, 64 nt, hsa
uaaggugagugucuuagcauauuuuaaugcaguugcuuacuaaagguuuuaaccgcacaugcac

SEQ ID NO: 71500 - RNA, 64 nt, hsa
auaaauucauccuucaggaaauggaaaugaacuugcuuacuaaugugugauuccuaguuguagc

SEQ ID NO: 71501 - RNA, 64 nt, hsa
agagaugacuuugaugacucugccccucagcagggcuuacuaagcacuaccccuuaacagggau

SEQ ID NO: 71502 - RNA, 64 nt, hsa
cuaaacacugcugcugccuuaauuuuagaaagcagcuuacuaguuuacccuugugguauaaagu

SEQ ID NO: 71503 - RNA, 64 nt, hsa
uugccuuuugaccuccccauccccuuuagucccugcuuacuacuuugacauucacauccucagu

SEQ ID NO: 71504 - RNA, 64 nt, hsa
uccaagugggucaauuccuuaguauaauauuaaggcuuacuaguaucacugcuuuuuccuuagc

SEQ ID NO: 71505 - RNA, 64 nt, hsa
uucaauauggggcagacuagggaaaccuuugcuugcuuacuauuaggaggggaagucuucagua

SEQ ID NO: 71506 - RNA, 64 nt, hsa
guagcauuuuucuaaaaccuuagucaucagauaugcuuacuaaaucuucagcauagaaggaagu

SEQ ID NO: 71507 - RNA, 64 nt, hsa
acacaaaccuggcuacggugaugaguuagcuucugcuuacuaccugugacaacccaagugggug

SEQ ID NO: 71508 - RNA, 64 nt, hsa
ccguuugaccucucccaagauacaccagcagccugcuuacuacuaaacgcaauccaaaaggccu

SEQ ID NO: 71509 - RNA, 64 nt, hsa
aagggugaggacaucagaucacucuguauucaaagcuuacuagacgaacaaucuuucauuucug

SEQ ID NO: 71510 - RNA, 64 nt, hsa
auuuuuccuaacaggauuagacagucaaggaguggcuuacuacaugugggagcuuuugguaugu

SEQ ID NO: 71511 - RNA, 64 nt, hsa
uggaauguggcaaagccuuuaaccaguccuuaaggcuuacuacauauaagacaacucauacugg

SEQ ID NO: 71512 - RNA, 64 nt, hsa
gaaggguugccuucuguaggucggaggaauggaggcuuacuaaccagguaagccuucuaugcau

SEQ ID NO: 71513 - RNA, 64 nt, hsa
uggcugucucacaggucacagagccauuacaacagcuuacuaguuuuucauggauuuguuggau

SEQ ID NO: 71514 - RNA, 64 nt, hsa
aaauaugugcuugaaaugagaaacuuugaucucugcuuacuaaugugccccauguccaagucca

SEQ ID NO: 71515 - RNA, 64 nt, hsa
ccacucugauauacuggcuucugacuuaugggcugcuuacuagucucaagagauacaguggugg

SEQ ID NO: 71516 - RNA, 64 nt, hsa
gaucgugucauuaucaucugcacuucacucaagagcuuacuaugugucuaagucauguucuagg

SEQ ID NO: 71517 - RNA, 64 nt, hsa
ccccuggccccauaauaaauuguaauuuuauacugcuuacuauaauuuuuuuaacacuguaaca

SEQ ID NO: 71518 - RNA, 64 nt, hsa
uguaaguuauaguaccuguacuugcagauaagaagcuuacuauaucauuauuauaaguagcaua

SEQ ID NO: 71519 - RNA, 64 nt, hsa
uacacacauuuccacaggagguuguucauaaggagcuuacuaacugugguuugcacccuaacac

SEQ ID NO: 71520 - RNA, 64 nt, hsa
ggcuuccuuaaagggucaagaaagcaauuuuucugcuuacuagauucauugagaucagcugugu

SEQ ID NO: 71521 - RNA, 64 nt, hsa
guugcccagacuggagugcaguggcacgaucuuggcuuacuacaaccuccgccuccuggguuca

SEQ ID NO: 71522 - RNA, 64 nt, hsa
aggcaguauuuugcuuuugcuuuaauauauacuagcuuacuauaaauuguuaacuagacuauuc

SEQ ID NO: 71523 - RNA, 64 nt, hsa
uacucuguucaagcugcguugagauguuaaacuggcuuacuauagacuucguaaaaauggcucc

SEQ ID NO: 71524 - RNA, 50 nt, hsa
cgagacaugguccagccuaagcuuacuaauacucacuuagugauuuguaa

SEQ ID NO: 71525 - RNA, 64 nt, hsa
acuguugggugcaucagugcuuuucaaaggggcugcuuacuauaggguuaacuauguauauuca

SEQ ID NO: 71526 - RNA, 64 nt, hsa
accaugcuaaguguauuuccacagugagcuuuuggcuuacuauauacauucuugguggauaaau

SEQ ID NO: 71527 - RNA, 64 nt, hsa
uagcaauaauaaauauagugaauacuuacauagugcuuacuauaugcuaagcacuauuuuuagc

SEQ ID NO: 71528 - RNA, 64 nt, hsa; identical to SEQ ID NO: 21289

SEQ ID NO: 71529 - RNA, 64 nt, hsa; identical to SEQ ID NO: 21290

SEQ ID NO: 71530 - RNA, 64 nt, hsa; identical to SEQ ID NO: 21291

SEQ ID NO: 71531 - RNA, 64 nt, hsa; identical to SEQ ID NO: 21292

SEQ ID NO: 71532 - RNA, 64 nt, hsa; identical to SEQ ID NO: 21293

SEQ ID NO: 71533 - RNA, 64 nt, hsa; identical to SEQ ID NO: 21294

SEQ ID NO: 71534 - RNA, 64 nt, hsa; identical to SEQ ID NO: 21295

SEQ ID NO: 71535 - RNA, 64 nt, hsa; identical to SEQ ID NO: 21296

SEQ ID NO: 71536 - RNA, 64 nt, hsa; identical to SEQ ID NO: 21297

SEQ ID NO: 71537 - RNA, 64 nt, hsa; identical to SEQ ID NO: 21298

SEQ ID NO: 71538 - RNA, 64 nt, hsa; identical to SEQ ID NO: 21299

SEQ ID NO: 71539 - RNA, 64 nt, hsa; identical to SEQ ID NO: 21300

SEQ ID NO: 71540 - RNA, 64 nt, hsa; identical to SEQ ID NO: 21301

SEQ ID NO: 71541 - RNA, 64 nt, hsa; identical to SEQ ID NO: 21302

SEQ ID NO: 71542 - RNA, 64 nt, hsa; identical to SEQ ID NO: 21303

SEQ ID NO: 71543 - RNA, 64 nt, hsa
accgaauuucaucauuuaucuaaagagaaaauaugcagaauaacuggucuuguuaagagugcaa

SEQ ID NO: 71544 - RNA, 64 nt, hsa
aaacagaauuauaaaagcuuacuuuaaacaggaggcagaauaauucuuuuaggaaaccauuuca

SEQ ID NO: 71545 - RNA, 64 nt, hsa
aaaaaaaaaaaaaaauccacaccguccuuggaaagcagaauaaaaggagcagaauauaaaaucc

SEQ ID NO: 71546 - RNA, 64 nt, hsa
auccacaccguccuuggaaagcagaauaaaaggagcagaauauaaaauccaaagucugaccagu

SEQ ID NO: 71547 - RNA, 64 nt, hsa
ggauuucaaaauacauuagugagaguaacagcuagcagaauaauuacaauggcuaaaacguuuu

SEQ ID NO: 71548 - RNA, 64 nt, hsa
guccuagaauuuuucugauuucuauaauccuucagcagaauauuaagaaauaaagcaugaucug

SEQ ID NO: 71549 - RNA, 64 nt, hsa
aguagacaaaugcagcagcaagucaauuguauuagcagaauauuguccucauugcauguguagu

SEQ ID NO: 71550 - RNA, 64 nt, hsa
ccauugccuuugcuuuguucauaauuucagcagggcagaauaaaaaccaugggaggcaaagaaa

SEQ ID NO: 71551 - RNA, 64 nt, hsa
cuuuuggucuuucacaccauucauauguuaaguggcagaauagccuuagugcuaccuccacuuu

SEQ ID NO: 71552 - RNA, 64 nt, hsa
aguaguggauguuuuugaaguaucuaaaauaguagcagaauauuuuauacuugguccuugcaau

SEQ ID NO: 71553 - RNA, 64 nt, hsa
aggauuggaauucucaacuagaaccgguccaaaugcagaauauuaauacaucgaacaacuucau

SEQ ID NO: 71554 - RNA, 64 nt, hsa
uuuagccaacagaacagguaauuuacuccugccugcagaauacuuuucguuggggaagagaacu

SEQ ID NO: 71555 - RNA, 64 nt, hsa
cuaauacucuccucgacaagucaugcuguuuuaugcagaauaauccaggcgugagaguguucuc

SEQ ID NO: 71556 - RNA, 64 nt, hsa
ucaacucaguaggugagaauaauuaguagguucagcagaauaaacucuuuacaauuaauaacuc

SEQ ID NO: 71557 - RNA, 64 nt, hsa
auaccuauccuguaguuacugaaaaucuggguaguaaaucuacccaauuaaaauggcacuuuau

SEQ ID NO: 71558 - RNA, 64 nt, hsa
aggcuccuggaaggugaaaaguagucauuuguucuaaaucuauacauauuacuuguaucuagug

SEQ ID NO: 71559 - RNA, 64 nt, hsa
auauuuuaugaaucagaauaaccuucaaauaaaauaaaucuaagucgguuaaaauggauuucau

SEQ ID NO: 71560 - RNA, 64 nt, hsa
auauauuuuuauagaaaaacaaaucuacauaaaauaaaucuacuguuuagugagcaguaugauu

SEQ ID NO: 71561 - RNA, 64 nt, hsa
accauauugaacacauggcauuuguagcauucuuuaaaucuaucuacugaaauguauuugacau

SEQ ID NO: 71562 - RNA, 64 nt, hsa
caucuugugucuuuuguaaauugaauuuuuuuuuuaaaucuauuaggaacuggaaaacagcaag

SEQ ID NO: 71563 - RNA, 64 nt, hsa
auuuucuaaaugcuguaauuugaagccauuuccauaaaucuauuuaaggauugcagacgcucuc

SEQ ID NO: 71564 - RNA, 64 nt, hsa
uggagaugacacaccuacugcuucuuuucuaggauaaaucuaauuacuguuuacugguggagua

SEQ ID NO: 71565 - RNA, 64 nt, hsa
uccccaaaucaugcaguauugaguuaugacuuguuaaaucuauucccaugccagaaucuuauca

SEQ ID NO: 71566 - RNA, 64 nt, hsa
augauccacaauaaucccuuugaucacguuaaucuaaaucuagaugucuuugucuaauuuuuuu

SEQ ID NO: 71567 - RNA, 64 nt, hsa
ggucuguaacaaaaguacuuucucuuuacucuauuaaaucuagaauuagccgggcauggucgcu

SEQ ID NO: 71568 - RNA, 64 nt, hsa
agcacaagguaagucauaaagaauaaugagaaaauaaaucuaugcuggugcagcugagaacugu

SEQ ID NO: 71569 - RNA, 64 nt, hsa
cccugcacucugccucacaaaggucuauauuauauaaaucuauauaaaucuauuuuauauuugu

SEQ ID NO: 71570 - RNA, 64 nt, hsa
ugccucacaaaggucuauauuauauaaaucuauauaaaucuauuuuauauuuguauaaguaaau

SEQ ID NO: 71571 - RNA, 64 nt, hsa
gguuguccugccugcaauauuugaauuuuaaaucuaaaucuauuuauuaauauuuaacauuauu

SEQ ID NO: 71572 - RNA, 64 nt, hsa
aguaaugguuguccugccugcaauauuugaauuuuaaaucuaaaucuauuuauuaauauuuaac

SEQ ID NO: 71573 - RNA, 64 nt, hsa
auaaacuuccauaacacuagguuagaccacccaauaaaucuagaaaucagcuuuuaaaaauauu

SEQ ID NO: 71574 - RNA, 64 nt, hsa
guguucagaacuuaauugggcuugaacugagauuuaaaucuaauaaacaaguuaauaaaugugu

SEQ ID NO: 71575 - RNA, 64 nt, hsa
auaaacuguuugacuugaaucauuucugaauaaguaaaucuaaauaagaaucuauuuuaauucc

SEQ ID NO: 71576 - RNA, 64 nt, hsa
uuaguacuuuaguucuguugagggcaaaauauuauaaaucuauagaaaauaaacuguuugacuu

SEQ ID NO: 71577 - RNA, 64 nt, hsa
auuuauguuuauauauguuuauauauguucuucauaaaucuauuacauauauauagauaaaaug

SEQ ID NO: 71578 - RNA, 64 nt, hsa
guucuuuccaacccugccacauguucauauauccuaaaucuauccuaaauguuccuugaaguau

SEQ ID NO: 71579 - RNA, 64 nt, hsa
uaaauaacuauguaaauagaaacagauaccagaauaaaucuacagcuagacccuuagucaauag

SEQ ID NO: 71580 - RNA, 64 nt, hsa
acaaauacauguaacuguagauaaaaccauauacuaaaucuauaagacuaagggauuuuuguua

SEQ ID NO: 71581 - RNA, 64 nt, hsa
auaucaggaaggaacuuuucaagaaauguaauuauaaaucuacaucaaacagaauuuuaaggaa

SEQ ID NO: 71582 - RNA, 64 nt, hsa
ugaaaauguguaaucuaaaauauaccagcgaauuuaaaucuaaaaaugcuccuacuuuaaguac

SEQ ID NO: 71583 - RNA, 64 nt, hsa
uaacaaauacacaauucacacauaacacuaagcguaaaucuaaucaauaaaauauauuuuugac

SEQ ID NO: 71584 - RNA, 64 nt, hsa; identical to SEQ ID NO: 71579

SEQ ID NO: 71585 - RNA, 64 nt, hsa
acaaauacauguaacuguagauaaaaccacauacuaaaucuauaagacuaagggauuuuuguua

SEQ ID NO: 71586 - RNA, 64 nt, hsa; identical to SEQ ID NO: 71581

SEQ ID NO: 71587 - RNA, 62 nt, hsa
uaaauguucuuuaggagaacauuuugcuaaagcaugacuaaacugcaaaaaaaaaaaaagag

SEQ ID NO: 71588 - RNA, 62 nt, hsa
agcuggggagaugccagugacaacauacaguucaugacuagguuuaggaauugggcacugag

SEQ ID NO: 71589 - RNA, 62 nt, hsa
ugaccuguuucaccagcaggccuguuacucuccaugacuaacuguguaagugcuuaaaaugg

SEQ ID NO: 71590 - RNA, 62 nt, hsa
aauggugauuaguguuaaaaaucaauuuaaaucaugacuaauaugguaaaaagauaaagcau

SEQ ID NO: 71591 - RNA, 62 nt, hsa
aacauaaagaaacaauguccccuacauauccccaugacuacauaauccaucaucguaggaaa

SEQ ID NO: 71592 - RNA, 62 nt, hsa
cuagcuggagaagaggggaggguccauaagcccaugacuaaaaacuaccccagcccaggcuc

SEQ ID NO: 71593 - RNA, 62 nt, hsa
auugcaguaggggucccagcugccaaguaggacaugacuaggaguguuaggggcagaaguuu

SEQ ID NO: 71594 - RNA, 62 nt, hsa
cacgcauauacgaguugguuuaucuuuguguacaugacuauaacccagugaugcugagguca

SEQ ID NO: 71595 - RNA, 62 nt, hsa
uuucagggaugauaccggggacucuccagagccaugacuagauccaauggauucugcgaugc

SEQ ID NO: 71596 - RNA, 62 nt, hsa
ucuaaaccuuucuaagcucagaugcauuuuugcaugacuaugucgaauauuucuuacugcca

SEQ ID NO: 71597 - RNA, 62 nt, hsa
guaugcucucauuccucagguguuuugagaaacaugacuaauaaccacacaauuaaguagag

SEQ ID NO: 71598 - RNA, 62 nt, hsa
cugacacagacucagcacuccgucaguguugccaugacuauuuuuauuaucauuauuaauga

SEQ ID NO: 71599 - RNA, 62 nt, hsa
uugaaguuguuuuuucaaguucuuuucuuuuucaugacuauuaaauguaaaaauauuuguaa

SEQ ID NO: 71600 - RNA, 62 nt, hsa
gcuucagagcucaugcgcguuacccacgauggcaugacuagcacagagcugaucucuguuuc

SEQ ID NO: 71601 - RNA, 62 nt, hsa
agcaaagggggaaaaauaugcauuucaccccacaugacuaggaauccacaucagaaugauac

SEQ ID NO: 71602 - RNA, 62 nt, hsa
gauuguugacguuuucccagcaaucuuaaucucaugacuauguucuucucccaaacaaggau

SEQ ID NO: 71603 - RNA, 62 nt, hsa
aagguggucugcaccccacaggaugaacuagccaugacuaggguccucaggcaguggcccag

SEQ ID NO: 71604 - RNA, 62 nt, hsa
caauaugggguuccguuggauuggggcuccuccaugacuagugggaauuacuguggguucag

SEQ ID NO: 71605 - RNA, 62 nt, hsa
aacagaauauuuugacuaauccucuauuuuuucaugacuauucaguuguguguguuuauucg

SEQ ID NO: 71606 - RNA, 62 nt, hsa
uguggcuggaugcuguuaauuucuuuaauagccaugacuauaauuuaagccuaugagaagau

SEQ ID NO: 71607 - RNA, 62 nt, hsa
uucaaugaacugugcuuuucgcuuucuuucugcaugacuauuguaacuagauagaacauuaa

SEQ ID NO: 71608 - RNA, 62 nt, hsa
gcugcagggucaggcuccugauaggaggauuucaugacuaugucauugucuccacucauuuu

SEQ ID NO: 71609 - RNA, 62 nt, hsa
aaagaaagagguuuaacggacuuacaguuccacaugacuaaggaggccucacaaucauggug

SEQ ID NO: 71610 - RNA, 62 nt, hsa
gcugaccuguuuuugguccacuuuugcccuuccaugacuaauaaggaagauauguguguauu

SEQ ID NO: 71611 - RNA, 62 nt, hsa
uugccagggccuggaggcugugagagaugaggcaugacuacuaaggguuugggguuucuuuu

SEQ ID NO: 71612 - RNA, 62 nt, hsa
uggccucugguuucucucugcugucugucuggcaugacuaauguagagggcgcugucucgcg

SEQ ID NO: 71613 - RNA, 62 nt, hsa
ugguugcucugacagaucugaacacuuugcuucaugacuauuucgucauaaagguauauguu

SEQ ID NO: 71614 - RNA, 62 nt, hsa
gaauuugucuccccgaaagggacacaauguggcaugacuaaguacuugcucucugagagcac

SEQ ID NO: 71615 - RNA, 62 nt, hsa
gaggcagagagucacuugaccauccagaaauacaugacuacaaguccuuuaugacuguuugc

SEQ ID NO: 71616 - RNA, 62 nt, hsa
aauagugcaaagcacaguuucagcaauggcuacaugacuaugucuaaaaacugaauacucag

SEQ ID NO: 71617 - RNA, 62 nt, hsa
cugcuacauaauuacuuucaauuuccuccaggcaugacuagguauaaacauauauuuacaug

SEQ ID NO: 71618 - RNA, 62 nt, hsa
ggaaauaacugauuaaacaaauccgccacuuucaugacuagagaugaggaagaacaagggau

SEQ ID NO: 71619 - RNA, 62 nt, hsa
gaaagcuauuuauuugucuucaguguucaaggcaugacuaguauuucuaauuagccuaauaa

SEQ ID NO: 71620 - RNA, 62 nt, hsa
ugagaauaauugaugcugauuaaggugcaaaucaugacuaaagacuuuucuuucuucuuuug

SEQ ID NO: 71621 - RNA, 62 nt, hsa
caagccugaagauacaagacuauuagaagaaacaugacuacccucaguguauuagaaaagag

SEQ ID NO: 71622 - RNA, 62 nt, hsa
uuuggcacuuguggguggcuauuuugauuuggcaugacuacuuaauuuuuuaaaaaaauugu

SEQ ID NO: 71623 - RNA, 62 nt, hsa
ggaaaaacccaaauuguuucuucuuugagagucaugacuaccuucugguguggagaaauugc

SEQ ID NO: 71624 - RNA, 62 nt, hsa
cugccuugggacagguguguaauguuagugugcaugacuaauguaagaaauuguuauucuac

SEQ ID NO: 71625 - RNA, 62 nt, hsa
ggguaugauuucagguccucugcacguguacacaugacuaggauaggcaggaguaagggugg

SEQ ID NO: 71626 - RNA, 62 nt, hsa
accuuuagcaacauguucaucugcuaugcugucaugacuagggggaugauuauuagucacau

SEQ ID NO: 71627 - RNA, 62 nt, hsa
gaggaaagauaucugugguagacauguccuuccaugacuaauuucuaauuguaacucaacac

SEQ ID NO: 71628 - RNA, 62 nt, hsa
uuaacauucauuucaaccacgagguuguauaucaugacuagcuuuuacucuugguuuacaga

SEQ ID NO: 71629 - RNA, 62 nt, hsa
cucauccguauucuuuguguugauaagcugcacaugacuacauaguaaguacagaacaguaa

SEQ ID NO: 71630 - RNA, 62 nt, hsa
auugaaaaauagccuuauuguauauuuuaugccaugacuaaaagugccauuuuuacugaugc

SEQ ID NO: 71631 - RNA, 62 nt, hsa
aaugaaagaauagaucagaaugauuuuguugacaugacuacagacugaaauaaugugaauga

SEQ ID NO: 71632 - RNA, 62 nt, hsa
gcugccauuaacacaucugguuacugcuguaacaugacuaauaaaaccgaacgccuguuccc

SEQ ID NO: 71633 - RNA, 62 nt, hsa
gacacaaaaacacaugagcauacaugucuacacaugacuacacaaaugcaaaccuuugcaaa

SEQ ID NO: 71634 - RNA, 62 nt, hsa
uuuccuuaaagcacauuuuucugacauaaacucaugacuaaucuuugugcaaucaugaacuu

SEQ ID NO: 71635 - RNA, 62 nt, hsa
ggugcagaaaagugaauugacuacaaaguagacaugacuaguuaacaacacagcugggaucu

SEQ ID NO: 71636 - RNA, 62 nt, hsa
uuugucuuugaacucuaguacuguuuauaguucaugacuauggacaacucgggugccacuuu

SEQ ID NO: 71637 - RNA, 62 nt, hsa
acaguuacuugguuagacaucaaaucugugugcaugacuaugugcuuauccacuuaagacaa

SEQ ID NO: 71638 - RNA, 62 nt, hsa
guauccacagcaggaaguccccaguucaccuccaugacuacagggcagcuuugcacagcccu

SEQ ID NO: 71639 - RNA, 62 nt, hsa
uucacaaguuucuguugaccuuguugauugagcaugacuacuaaauauuauguaauaaaaag

SEQ ID NO: 71640 - RNA, 62 nt, hsa
auguaaaauguuuuguugaaguauauggcuaucaugacuaagugcuagaauuuauaguuaca

SEQ ID NO: 71641 - RNA, 62 nt, hsa
caugaucaauauccuuuaggaaaugaaaaaaccaugacuaucaucaccaacauccuugggua

SEQ ID NO: 71642 - RNA, 62 nt, hsa
caucuccucuccuucccaggaauccuugaucucaugacuauuaaaauguugcucugguuuua

SEQ ID NO: 71643 - RNA, 62 nt, hsa
uagacauuaucuuuuggcucugaagaagcaaacaugacuagagacgcaccuugcugcagugu

SEQ ID NO: 71644 - RNA, 62 nt, hsa
agugcuucuugcagcagguggucaaagaaaagcaugacuaauacgaccuauuagaguaaucu

SEQ ID NO: 71645 - RNA, 62 nt, hsa
agaucaacaaccccuuuggcuaucuacugagacaugacuaggaagaaaacaugacuuuauca

SEQ ID NO: 71646 - RNA, 62 nt, hsa
agaagaugaauuucauuauguaaacgcucaggcaugacuacgcuguuugaaacagacagaug

SEQ ID NO: 71647 - RNA, 62 nt, hsa
aauuuaggauuugccgcuuccauaaaucaaagcaugacuaauagggggucucugaaauguaa

SEQ ID NO: 71648 - RNA, 62 nt, hsa
ucuuuuauuuucaucuuuuuugguuuucuuggcaugacuaagaagcuuaaauguugauaaaa

SEQ ID NO: 71649 - RNA, 62 nt, hsa
agaagaaaaaaaagaaaaagaaaucuaagcaacaugacuauucagacuaugaagacaguucc

SEQ ID NO: 71650 - RNA, 62 nt, hsa
uaacguuuacuuccuuccccucuguaaauguccaugacuauugcccagagaaggcuuacccc

SEQ ID NO: 71651 - RNA, 62 nt, hsa
ggcugcaguacccuacgcugccagcagguggccaugacuacccgugguaccaaucucagucu

SEQ ID NO: 71652 - RNA, 62 nt, hsa
aucuuaguguaguauagcuauuguaaacaguucaugacuagauuuugauucggaaaucuaua

SEQ ID NO: 71653 - RNA, 62 nt, hsa
uugucuuuccauaugguuuucauaaccaaauacaugacuauagcaugguuauuuuucuagua

SEQ ID NO: 71654 - RNA, 62 nt, hsa
uugcuuugucuugauguuucuaucaacuauaucaugacuaucuauugguuccauaacucugu

SEQ ID NO: 71655 - RNA, 62 nt, hsa
aauguauaauaaaaauguggugcuuaauuaaccaugacuauguauauauugccaauuuuagu

SEQ ID NO: 71656 - RNA, 62 nt, hsa
auuaccucauuaugcaaaaauaacauaucuuucaugacuauuuugacaaaaguuuaaaacac

SEQ ID NO: 71657 - RNA, 62 nt, hsa
aacgcguguugucucaaaccagucagggccgucaugacuacgcagcagcagcaguuuccaag

SEQ ID NO: 71658 - RNA, 62 nt, hsa
accccggccucccuggggacauuguucauaaccaugacuaaucugugugugcuguagugacc

SEQ ID NO: 71659 - RNA, 62 nt, hsa
accuuacauuccuagagagcagaaauaaaaagcaugacuauuuccaccaucaaaugcuguag

SEQ ID NO: 71660 - RNA, 62 nt, hsa
uuuuauuuucuuauguaaguuugcauaucagucaugacuagugccuagaaagcaaugugaug

SEQ ID NO: 71661 - RNA, 62 nt, hsa
ccucugcugcuggauuucaugucuuccuccagcaugacuaagucuggaacagcaggaagggu

SEQ ID NO: 71662 - RNA, 62 nt, hsa
uuucccccacugggaaugcuggcugggagagccaugacuaccagacuuuuccucaggcuccu

SEQ ID NO: 71663 - RNA, 62 nt, hsa
auacugaccuaccucaaagggcaguuuugaggcaugacuaaugcuuuuuagaaagcauuuug

SEQ ID NO: 71664 - RNA, 62 nt, hsa
acuguuguucugcuuuuccuggcacucaaauucaugacuaguuuugaggucaaaccuauguu

SEQ ID NO: 71665 - RNA, 62 nt, hsa
aucuuauauaagauuucuagguugcaucuaaccaugacuaugucauuauuuugauaauuagg

SEQ ID NO: 71666 - RNA, 62 nt, hsa
uguuccccacuguaucuaggcaacauaguauucaugacuauggauaaacuaaacacgugaca

SEQ ID NO: 71667 - RNA, 62 nt, hsa
ggugcuaaauaggcagcagaucucaauucacacaugacuaccuuugagcuaaugacugucuc

SEQ ID NO: 71668 - RNA, 62 nt, hsa
cuuucaaaugccauggguuacacuuuuaugggcaugacuauaaccauuuuuguaaagaguaa

SEQ ID NO: 71669 - RNA, 62 nt, hsa
gagaagaagaagaagaagaagaccacaaaagacaugacuauccaacuuuuuaugacaaacug

SEQ ID NO: 71670 - RNA, 62 nt, hsa
aaaucugaccuugucauuucaauaguuauuaacaugacuaaauauuaucuuaauuaagagga

SEQ ID NO: 71671 - RNA, 62 nt, hsa
aaaaugguagcgcuuuguaugcauuuagaauacaugacuaguaguuuauauuucacugguag

SEQ ID NO: 71672 - RNA, 62 nt, hsa
cugugaaagccuuuuaauuuauugaaauguuucaugacuacugcugcuagcucuucaagcca

SEQ ID NO: 71673 - RNA, 62 nt, hsa
ggugcuguggggagaguagaaagagggguuggcaugacuaaaaauaccaguauguguauuaa

SEQ ID NO: 71674 - RNA, 62 nt, hsa
ugaugagcaaauaaaggaacuucuagacuuuacaugacuaggcugauaaucuuauuuuuuag

SEQ ID NO: 71675 - RNA, 62 nt, hsa
caucuugcugacuucuguagaauuucugauugcaugacuauuauuuaucuucuuuuagugua

SEQ ID NO: 71676 - RNA, 62 nt, hsa
cccagguucaugcuuguuuggaguagucauuucaugacuacacuuucuacgcacagcuagaa

SEQ ID NO: 71677 - RNA, 62 nt, hsa
agcaauuaugccaagggccguuaggcucucaacaugacuauagagaccccgugucaucacgg

SEQ ID NO: 71678 - RNA, 62 nt, hsa
guuaaagaagcaaucuccuuacuguguuucagcaugacuauguauuuuucuauguuuuuuua

SEQ ID NO: 71679 - RNA, 62 nt, hsa
uuuuuuuuuaaguuuguucauauuuguauguacaugacuauuuaaagccaggggauuaucuu

SEQ ID NO: 71680 - RNA, 62 nt, hsa
gggagcugcccagggcagaacccacugguguucaugacuaccccuggcuccucucaccuugu

SEQ ID NO: 71681 - RNA, 62 nt, hsa
gucagauuauacaaggauguauucuuaaaccgcaugacuauucagauggcuacugaguuauc

SEQ ID NO: 71682 - RNA, 62 nt, hsa
uuaauguaacuucuuuuuugcuuaagcauuugcaugacuauuagugcuucaaagucaauuuu

SEQ ID NO: 71683 - RNA, 62 nt, hsa
gguuuucauagucgugaaguauuuaucauuugcaugacuaauggcacaggaaaaaccuauuc

SEQ ID NO: 71684 - RNA, 62 nt, hsa
ucguuuaaucaguuucugaaauguaagcauuacaugacuauuggugaguugugccuuuuaua

SEQ ID NO: 71685 - RNA, 62 nt, hsa
cacacuucuuuuggucugaagguaacccccaucaugacuagacgagaaccgucuuuacccgg

SEQ ID NO: 71686 - RNA, 62 nt, hsa
auaaacuagaaucucuauuaaaagcuauaugacaugacuaugucauuaaaacuauauuugaa

SEQ ID NO: 71687 - RNA, 62 nt, hsa
cucauaccaacuugacuauguuucacccgcuucaugacuaaaucacagguggcagaauuuuu

SEQ ID NO: 71688 - RNA, 62 nt, hsa
cccuccccuuacgaacacagaaacccagcccacaugacuagcacgcugagcucugcagggac

SEQ ID NO: 71689 - RNA, 62 nt, hsa
cucugauaggauucaaacagauaccgguuaaccaugacuaccaaaacugaucaucugagucg

SEQ ID NO: 71690 - RNA, 62 nt, hsa
auuuaagaaaaagcuaaaaagaauggaaaucgcaugacuauaacuuaagucuuucuucaaag

SEQ ID NO: 71691 - RNA, 62 nt, hsa
uccccagugccauuguucuuccaaaugcuacccaugacuacaacacgucuuucucaaacucc

SEQ ID NO: 71692 - RNA, 62 nt, hsa
cuaaaacuaaucuucauuuuaaaaggguaaaacaugacuauacagaaauuuaaauagaaaua

SEQ ID NO: 71693 - RNA, 62 nt, hsa
auugaagaaaaagcuaaaaagaauggaaaucgcaugacuauaacuuaagucuuucuucaaag

SEQ ID NO: 71694 - RNA, 62 nt, hsa
aaagucagaguucguguucccuguuuuaaucacaugacuaccugucccaguacacgaaaggg

SEQ ID NO: 71695 - RNA, 62 nt, hsa
acugauguucaucaaaaguaugcgaucuaaaacaugacuaucauuuccugacaauggggcau

SEQ ID NO: 71696 - RNA, 62 nt, hsa
acacacaucaccccccuucuauaaucuuaagccaugacuagccugguggcguguuaguuucu

SEQ ID NO: 71697 - RNA, 62 nt, hsa
aguagcugggaccacaggcaugcaccacuacgcaugacuaauuuuuuaaauauuugagacgg

SEQ ID NO: 71698 - RNA, 62 nt, hsa
guugguguuuugcucggcagcuuggauccuagcaugacuauacauugugacauggucauuac

SEQ ID NO: 71699 - RNA, 62 nt, hsa; identical to SEQ ID NO: 71698

SEQ ID NO: 71700 - RNA, 62 nt, hsa
uccccggucaucuacgacagccuaaccggccucaugacuagccuuguugccgucgaguugga

SEQ ID NO: 71701 - RNA, 62 nt, hsa
ggaaauaacuaauuaaacaaauccgccacuuucaugacuagaguugaggaagaacaggggau

SEQ ID NO: 71702 - RNA, 62 nt, hsa
guugcauugccuggcacccaauauucaggguccaugacuaagacuggucuucucagaugccc

SEQ ID NO: 71703 - RNA, 62 nt, hsa
uggcucaagaccgacauugccuugguuuguuacaugacuaucgugauggggaaacuggcugg

SEQ ID NO: 71704 - RNA, 62 nt, hsa
ugccagaacuuucuuuuccuugcccccugugucaugacuagcuuaaguguacuugacuccca

SEQ ID NO: 71705 - RNA, 62 nt, hsa
acguaaagguaucagggccgggcgcuguggcucaugacuauaaucccagcuguuugagaggc

SEQ ID NO: 71706 - RNA, 62 nt, hsa
aaacacuaggccacgcaucugaucuguagucacaugacuaagccaagaggaaggagcaagac

SEQ ID NO: 71707 - RNA, 62 nt, hsa
aaaagaaccgacuucugaaucgcagcuccacucaugacuaauaccucauuauuucagcuguc

SEQ ID NO: 71708 - RNA, 62 nt, hsa
ggugucugugugaaucuuugugccuguaugagcaugacuauauuuuggggagugggugauau

SEQ ID NO: 71709 - RNA, 62 nt, hsa
cuauccugugccugucucauauuuuggaaauacaugacuaguuugguuuucaccgguucgga

SEQ ID NO: 71710 - RNA, 62 nt, hsa
cgcuucuccuccgugccgugcgacccccaccccaugacuauugugcgauucgugagcgccgc

SEQ ID NO: 71711 - RNA, 62 nt, hsa
aagaagguccuuauuucucuuuugcguucugccaugacuaaguuuucggaggccuccccagc

SEQ ID NO: 71712 - RNA, 62 nt, hsa
auuagggcuucguuguguuaacaaguugacaccaugacuaguaaauguaaacguguauguau

SEQ ID NO: 71713 - RNA, 62 nt, hsa
auagagagauuucuauaauuuugauacaaggucaugacuauccuagaacucucugugguuuu

SEQ ID NO: 71714 - RNA, 62 nt, hsa
cuuggucucuaggauccaggcuccacagagcacaugacuagccaggccccuggcuuaagaag

SEQ ID NO: 71715 - RNA, 62 nt, hsa
cucaacagcuuuccauucagucuggauccuuccaugacuacagccauuuaaguguucagcac

SEQ ID NO: 71716 - RNA, 62 nt, hsa
aggaaauggaauugguauuucauuuuaauuuucaugacuacuaacucaccugaacuugcuau

SEQ ID NO: 71717 - RNA, 62 nt, hsa
cccuucugauagccugccucacagaguuuagacaugacuagccagcuccuacaaucacugaa

SEQ ID NO: 71718 - RNA, 62 nt, hsa
aagaaagagggcaaggaaaaaaggcuggacuccaugacuauauauacauacaucuaucuaca

SEQ ID NO: 71719 - RNA, 62 nt, hsa
ucagaaacugcgaggccaguuccuuggagggacaugacuaauuuaucgauuuuuaucaauuu

SEQ ID NO: 71720 - RNA, 62 nt, hsa
gcgggugacugucgcccagaccaggugccauucaugacuaaucaggagcagcgggcucaccc

SEQ ID NO: 71721 - RNA, 62 nt, hsa
guccccaccaccccugccccacccagggccaacaugacuaagcucucucaugacccaccuca

SEQ ID NO: 71722 - RNA, 62 nt, hsa
uuuggaaucuugaaugcuuauaaagguuaccacaugacuaggguacagccagauuuggaaac

SEQ ID NO: 71723 - RNA, 62 nt, hsa
auccacugacgaucauucuccuaaacugaacacaugacuagaauugguggugagauaucgcu

SEQ ID NO: 71724 - RNA, 64 nt, hsa
gguguccuuccaggccucuuccccuuuccuccaucucuggcaacaguucuugggguuuggcaau

SEQ ID NO: 71725 - RNA, 64 nt, hsa
gagaaauaaagauuuccuccaagccacaugaggacucuggcacccacccacaaagcaagaccug

SEQ ID NO: 71726 - RNA, 64 nt, hsa
aucaggacccccaagagugagugagggggcaaggcucuggcacaaaaccuccuccucccaggca

SEQ ID NO: 71727 - RNA, 64 nt, hsa
gaccaggaaaagcagcagcugccugcucuccagccucuggcaggaacucagggcccuggagcug

SEQ ID NO: 71728 - RNA, 64 nt, hsa
aaccaagggugugucugcucuuucccuccccauccucuggcagaaaucagcuagacgcuauacc

SEQ ID NO: 71729 - RNA, 64 nt, hsa
ugggcuccccucugggccagcacaguccccucaccucuggcagggcugcuaccuccucagaguu

SEQ ID NO: 71730 - RNA, 64 nt, hsa
uuucacacucugccauguucaugccugugggccucucuggcaggaacucugaugcaccgcgagg

SEQ ID NO: 71731 - RNA, 64 nt, hsa
ucuggauggaggcacucaggccuggguaggauuccucuggcacggagggagagacccuggguga

SEQ ID NO: 71732 - RNA, 64 nt, hsa
uagcauccuuaggucuuggacagaccucggucagcucuggcacagucaagaauccaccuugggc

SEQ ID NO: 71733 - RNA, 64 nt, hsa
ugcgccccgcaacugacgcuccugcaaggaaaagcucuggcacgccgaugacgucgccggccuc

SEQ ID NO: 71734 - RNA, 64 nt, hsa
cacugaccuguucuguugacuggggcccugcagacucuggcagagcugagaagggcagggaccu

SEQ ID NO: 71735 - RNA, 64 nt, hsa
cuuccagcucagaacccaucccucugguggguaccucuggcacccaucugcaaauaucucccuc

SEQ ID NO: 71736 - RNA, 64 nt, hsa
ccagcucugggggaggcacaggcccucauccacccucuggcacaacucugaggccaccaaccuc

SEQ ID NO: 71737 - RNA, 64 nt, hsa
uccugccccagguugaggcccacaacacggugaccucuggcaccgcaaccacagucauugagau

SEQ ID NO: 71738 - RNA, 64 nt, hsa
gagagugggucucuguggcuuucacugauguucacucuggcauacuuucgcaauuuucuuuuuc

SEQ ID NO: 71739 - RNA, 64 nt, hsa
cuuuuuaaauuucacagaagaggaaaguugccugcucuggcagguaugugcaagauagagugug

SEQ ID NO: 71740 - RNA, 64 nt, hsa; identical to SEQ ID NO: 71739

SEQ ID NO: 71741 - RNA, 64 nt, hsa; identical to SEQ ID NO: 71738

SEQ ID NO: 71742 - RNA, 64 nt, hsa
cuuucuaaaucucacagaagaggaaaguggccugcucuggcagguaugugcaggauacagugug

SEQ ID NO: 71743 - RNA, 64 nt, hsa
gagagugggucucuguggcucucacugauguucacucuggcauccuucagcauuuuucuuuuuu

SEQ ID NO: 71744 - RNA, 64 nt, hsa
cuuuguuacaaacaucccucuggcauuuccuggucucuggcacaucauaaccaauuggaaaccu

SEQ ID NO: 71745 - RNA, 64 nt, hsa
ggcuuagaguuuggcagcuuuguuacaaacaucccucuggcauuuccuggucucuggcacauca

SEQ ID NO: 71746 - RNA, 64 nt, hsa
cucugacuucuugcccuuuggaaauggugcagcacucuggcauuuaucacccccaccugggucc

SEQ ID NO: 71747 - RNA, 64 nt, hsa
uaaaggaguguccuuuacccucccagccuccaggcucuggcagaaauaaacuccaacccgacug

SEQ ID NO: 71748 - RNA, 64 nt, hsa
agcccugcccacucuuaccgagcaagguggguggcucuggcacgagucccccagggggagagca

SEQ ID NO: 71749 - RNA, 64 nt, hsa
cucaccaugaggacauuccauccuucacccccuccucuggcacaggccaccacugcggugcugu

SEQ ID NO: 71750 - RNA, 64 nt, hsa
augucucuuagaccuguucuggcugaagggcuaucucuggcaccucugagaucccuagguccug

SEQ ID NO: 71751 - RNA, 64 nt, hsa
ucacucugcagcccuugaacauggcacugcccuccucuggcacucaugcugggccugugcccac

SEQ ID NO: 71752 - RNA, 64 nt, hsa
aaacacccacaggacacugggggcugucacccugcucuggcaguccugcuaagagugucagggc

SEQ ID NO: 71753 - RNA, 64 nt, hsa
cccuuccaggcaugaucuuccccaucaggcugggcucuggcagggaccugcccaggauggagau

SEQ ID NO: 71754 - RNA, 61 nt, hsa
ugaccuccuugccucuugucuugaaccauagcaaaaggauacugcaucucucauuacugua

SEQ ID NO: 71755 - RNA, 61 nt, hsa
ugauauuacagcuaaaaaaaucauucauuagcaaaaggaaaaguggucucaaccuaacauc

SEQ ID NO: 71756 - RNA, 61 nt, hsa
auaguuuauuguagugauguuuuuauaaaagcaaaaggauauucacuuucagcgcuuauac

SEQ ID NO: 71757 - RNA, 61 nt, hsa
auauaaauuaaaugagacgagacaugucgaccaaaaggaaugugugggucuuguuuggauc

SEQ ID NO: 71758 - RNA, 61 nt, hsa
uaugguucaagauuguugauaggaacugucucaaaaggauggugguuauuuuaaauauaaa

SEQ ID NO: 71759 - RNA, 61 nt, hsa
uuuguauugcuuauuuuauuaugagcuacaacaaaaggacuucaggaacaaguaauguauu

SEQ ID NO: 71760 - RNA, 61 nt, hsa
agagaaaaaauaaagcaagaaauacuaacaucaaaaggacagguaugaugaugcgauaaua

SEQ ID NO: 71761 - RNA, 61 nt, hsa
ucggugaagagcuggaaacuuaaaaaauuaucaaaaggaauuuugguaucaucuucagaga

SEQ ID NO: 71762 - RNA, 61 nt, hsa
aaaaacaaacagaaacacaaacgauuuggaucaaaaggagaaaugauaagugacaaaagca

SEQ ID NO: 71763 - RNA, 61 nt, hsa
auguagcccuggguuuaaugucaaaucaaggcaaaaggaauuaaauaauguacuuuuggcu

SEQ ID NO: 71764 - RNA, 61 nt, hsa
aaggaacuaugaaaaccagaacaaauuuuaacaaaaggacaaccacagagggauauaguga

SEQ ID NO: 71765 - RNA, 61 nt, hsa
aguaaguugccaaaaugugauuguugaaguacaaaaggaacuaugaaaaccagaacaaauu

SEQ ID NO: 71766 - RNA, 61 nt, hsa
gcuuacauuuuauaaguuuaaggucagcugucaaaaggauaaccugugggguuagaacaua

SEQ ID NO: 71767 - RNA, 61 nt, hsa
gcagguucaacguuauuuacauguaaauagacaaaaggaaacauuugccaaaagcggcaga

SEQ ID NO: 71768 - RNA, 61 nt, hsa
cccgucccuuaaaaagacaaaaaaaauaaggcaaaaggaaagcaacuaagacacuggacua

SEQ ID NO: 71769 - RNA, 61 nt, hsa
guguaacaucuauuuguuccucuuaccaaagcaaaaggauuggcuucauacaaaauagaca

SEQ ID NO: 71770 - RNA, 61 nt, hsa
agcaccuuuuaaaccugcugcacauuggacucaaaaggaaaacuggaccaacaauaauuga

SEQ ID NO: 71771 - RNA, 61 nt, hsa
aaguuuacaagacaugauauugcugcuuuuacaaaaggacauucuauuuauuuucgcagua

SEQ ID NO: 71772 - RNA, 61 nt, hsa
cuaaucaaaacugggaguucucaagugaaugcaaaaggagcaggccauaacuuuauuuguu

SEQ ID NO: 71773 - RNA, 61 nt, hsa
aguauauccuuuaaaggacuggggguuugcucaaaaggaaauccaaaaccuauucuaaaca

SEQ ID NO: 71774 - RNA, 61 nt, hsa
ugaaacuggaggaugacaguuucccaacucacaaaaggaaggccaaaguauccaucauuag

SEQ ID NO: 71775 - RNA, 61 nt, hsa
aagacaaaagcugcagugaaaauuuuggacucaaaaggaggacaaugccauccuucauauu

SEQ ID NO: 71776 - RNA, 61 nt, hsa
uuuuuuugaaaaaagcucauuucaugcucugcaaaaggagagacucccaugaagccuuuug

SEQ ID NO: 71777 - RNA, 61 nt, hsa
uacaaggccuaugaguauggauugggggggccaaaaggaaaaagcuccaugugccucuuug

SEQ ID NO: 71778 - RNA, 61 nt, hsa
ugaaaggaugcuggcuauauauguuaaugagcaaaaggauuauaguuguuuuguuuuguuu

SEQ ID NO: 71779 - RNA, 61 nt, hsa
ggacacugccuuaggcaauggucuauauaagcaaaaggagauagagaucugaaauaauuuu

SEQ ID NO: 71780 - RNA, 61 nt, hsa
gaaagaaaaccuuucaaccaaaugauugguucaaaaggaaagaaugauucaaagcagagga

SEQ ID NO: 71781 - RNA, 61 nt, hsa
aaaucauucuaucauugaguaucguuuaaugcaaaaggacaaaaacaacucccgugauaug

SEQ ID NO: 71782 - RNA, 61 nt, hsa
aaaaaaauuauaugcugcauaaaugcugaugcaaaaggauuuuucaacacacuaaaccagg

SEQ ID NO: 71783 - RNA, 61 nt, hsa
aagccaguuaccuuugcacugaaguagaauucaaaaggagauagagguucugaauuucuuc

SEQ ID NO: 71784 - RNA, 61 nt, hsa
aaugaacuaaacauugccuugcuauauucaccaaaaggacuuaauucuuguuuuuuuccca

SEQ ID NO: 71785 - RNA, 61 nt, hsa
aaugaacuaaacauugccuugcuauauucaccaaaaggacuuacuucuuguuuuuucccag

SEQ ID NO: 71786 - RNA, 61 nt, hsa
acaaaguccaaaagucacuuuugaaugugaacaaaaggaagaaaaucaaggaaagaaugag

SEQ ID NO: 71787 - RNA, 61 nt, hsa
cacaguguccuuuauguaagaaugauauaaccaaaaggagccuacaagaaaguacgagauu

SEQ ID NO: 71788 - RNA, 61 nt, hsa
ucuucauauauaugauaucauuuauuuuucgcaaaaggagaaaaaacaguggccuuugguc

SEQ ID NO: 71789 - RNA, 61 nt, hsa
auacaauggagcuaucauaguuucugguaaacaaaaggauuauagauuuucaguugugugu

SEQ ID NO: 71790 - RNA, 61 nt, hsa
gauagcaugagauagucucaauguggccaaccaaaaggacaaaacugacaggaaugcacau

SEQ ID NO: 71791 - RNA, 61 nt, hsa
uacaaaaacucuucaugugaaucuuaacuugcaaaaggagaaagauaaaauacagaagacu

SEQ ID NO: 71792 - RNA, 61 nt, hsa
aaaacucaaucaauguaauucaguauuuuaacaaaaggaaugaaaaauuaucaucucaaua

SEQ ID NO: 71793 - RNA, 61 nt, hsa
uggagacucaguucuccuaggaccauuuauucaaaaggacugcccucucuuguucuuggaa

SEQ ID NO: 71794 - RNA, 61 nt, hsa
agguucugagcaaacaugaucuagcucucaccaaaaggaccugagcuagggucugcuggga

SEQ ID NO: 71795 - RNA, 61 nt, hsa
gagauaauggaguggggaugacuguggcaaacaaaaggagauucgaacauucuagaggggc

SEQ ID NO: 71796 - RNA, 61 nt, hsa
agaaugaaacagcuuuaaaaauagccuuaagcaaaaggauguuauuucauuaaauuugguu

SEQ ID NO: 71797 - RNA, 61 nt, hsa
ugugagccgaggcaguuccugcguucugcuacaaaaggaauggaaagggaagggaauuucc

SEQ ID NO: 71798 - RNA, 64 nt, hsa
cuccagggccgugagggcaagagggggaccugccaccagggagcuuccuggcucugggggaccc

SEQ ID NO: 71799 - RNA, 64 nt, hsa
ccuugccauucugccccuggacccuucucuccggaccagggaggcgucccucccuaggagccac

SEQ ID NO: 71800 - RNA, 64 nt, hsa
ccauuccccaaauugaauaucagcaugcggccugaccagggacucuuuagaugcaugaauuuau

SEQ ID NO: 71801 - RNA, 64 nt, hsa
uuccuaugggcaaggcccagugcucuuccugcccaccagggaccauggagcaguggcacccuau

SEQ ID NO: 71802 - RNA, 64 nt, hsa
cacccagagagggacaagauaggacauggccuggaccagggaggcaggccucccacucagaguc

SEQ ID NO: 71803 - RNA, 64 nt, hsa
ggcaugugaagcugccggaaaguggacaggccagaccagggagauguguaccugaggggcaccc

SEQ ID NO: 71804 - RNA, 64 nt, hsa
caacaacugccccuucuuuaugcagaggugcagaaccagggacuccugggcccauccaggcugc

SEQ ID NO: 71805 - RNA, 64 nt, hsa
gcccauccaggcugcucccugggguggagaagggaccagggauugcaggccccaucuccaggcu

SEQ ID NO: 71806 - RNA, 64 nt, hsa
uggguugcaggaggaggagcugggcagggccugcaccagggaggaguggaggacgagguaacuc

SEQ ID NO: 71807 - RNA, 64 nt, hsa
ccuguuucuucuaagggaggaggacaugguggagaccagggacaggagagccagcaggguggau

SEQ ID NO: 71808 - RNA, 64 nt, hsa
ccccaucauccucgcgcguccucacccugucucuaccagggaggugccuagcuuggugagguua

SEQ ID NO: 71809 - RNA, 64 nt, hsa
ccccucacaagccgcagcggcuggugcccgggcuaccagggacaugccagagggcucgaugacu

SEQ ID NO: 71810 - RNA, 64 nt, hsa
cagucucccugccccccaugccccagaccggcccaccagggacuagccgcugucgcacagccuc

SEQ ID NO: 71811 - RNA, 64 nt, hsa
cauuuuccugcggcagagcagggccugguguggaaccagggagcugugggaagccacagcagaa

SEQ ID NO: 71812 - RNA, 64 nt, hsa
aggcccuuagggcaggaagggacgaugagcaagucugccacaccaccuggugacugggaagggc

SEQ ID NO: 71813 - RNA, 64 nt, hsa
auguguggguuucccagcuaacggacaagcuccccugccacacccagugcccacgcaugcucac

SEQ ID NO: 71814 - RNA, 64 nt, hsa
uguucauaccacaucaguguuuccgucugcucaccugccacagagcccacacccaugcccacca

SEQ ID NO: 71815 - RNA, 64 nt, hsa
cucccagggcagccccaaccaggucuccucccaccugccacacagcgcuccggggccugagggc

SEQ ID NO: 71816 - RNA, 64 nt, hsa
ggucccggcucuuccuguguggaggugaugguaccugccacaccacagcugcgcacacagcugc

SEQ ID NO: 71817 - RNA, 64 nt, hsa
gugggcacugugccagggcuggggccuucugcugcugccacacccagcucaggccugggccagc

SEQ ID NO: 71818 - RNA, 64 nt, hsa
aggccacuacaaacugaccccucagcagggcuggcugccacagggcugcccugccucauaggua

SEQ ID NO: 71819 - RNA, 64 nt, hsa
gaccucaguugagcugccucuggccuuguugcugcugccacauccuaggucuaagaguugaacg

SEQ ID NO: 71820 - RNA, 64 nt, hsa
cagccuggacauuggacauugcuaaguugggucacugccacauggagucuugccaugccugugu

SEQ ID NO: 71821 - RNA, 64 nt, hsa
acgcugccacaucugggcauacagugucuggacacugccacauggagccacugucaugcagguc

SEQ ID NO: 71822 - RNA, 64 nt, hsa
augcugccacaucugggcauacagugucuggacgcugccacaucugggcauacagugucuggac

SEQ ID NO: 71823 - RNA, 64 nt, hsa
agaccuggagggcagccacacagcuggacggaugcugccacaucugggcauacagugucuggac

SEQ ID NO: 71824 - RNA, 64 nt, hsa
uuuaaaaacacaguccugagagggauggaccagacugccacagcagcucauagcacaaaaaaag

SEQ ID NO: 71825 - RNA, 64 nt, hsa
gguaagauaccauuauauuuauaugagcuauguacugccacaaaaaaagaugaaauguaauuuc

SEQ ID NO: 71826 - RNA, 64 nt, hsa
uuuaaaaaacacaaucuuaaggggauagacuagacugccacagcagcccauggcacaacuaaca

SEQ ID NO: 71827 - RNA, 64 nt, hsa
guuuuuuagccuuugaugguaagaggaauacgggcugccacauagacuuuguucucauuaauau

SEQ ID NO: 71828 - RNA, 64 nt, hsa
gacugcacugauauauauuuuuuuuaaagagcaacugccacaugcgggauuucauuucugcuuu

SEQ ID NO: 71829 - RNA, 64 nt, hsa
gcagccucgggcaggggucucaggcccguggccccugccacagggcacuggaauggacagcagg

SEQ ID NO: 71830 - RNA, 64 nt, hsa
gcgcacggugaugcucgggucugcccccgacccccugccacaggccggaagccgcagggggcac

SEQ ID NO: 71831 - RNA, 64 nt, hsa
uggggccuccccagcugcuggccagacccuggcgcugccacaguccuggcacugcccaaggcca

SEQ ID NO: 71832 - RNA, 64 nt, hsa
cuggugggaggagcgacugcccugcccaaaugaacugccacagcagggacagcuggaccgcaga

SEQ ID NO: 71833 - RNA, 64 nt, hsa
ugcucugccucagacguugccugagaagaaguggcugccacacccaggggaaggcccugaggcg

SEQ ID NO: 71834 - RNA, 64 nt, hsa
ggggagagacaggcagcccagcaguguggagacccugccacagccagaggagggcagagggaga

SEQ ID NO: 71835 - RNA, 64 nt, hsa
gugcugguacacugugccauggggguaagccgcucugccacacuuguccuggccuuccucauga

SEQ ID NO: 71836 - RNA, 64 nt, hsa
gcuucgcugcagcgcuugcuguggguccgucaggcugccacacugaaccauaucgaugaggucu

SEQ ID NO: 71837 - RNA, 64 nt, hsa
caacugcgggguccucauggggugagcccaggcccugccacaaccuacagggucacucaguaug

SEQ ID NO: 71838 - RNA, 64 nt, hsa
ccuagugcccaucuuccugaaaggauguuaguuucugccacaaugugaagaaggccuucaccuu

SEQ ID NO: 71839 - RNA, 64 nt, hsa
agcaggagagcaugcccauauuggcuuacuuugucugccacagacacagacagagggaguuggg

SEQ ID NO: 71840 - RNA, 64 nt, hsa
ccccaaacuccaccucuuggauuggcccuggcugcugccacacacauauccaagagcucagggc

SEQ ID NO: 71841 - RNA, 64 nt, hsa
ugagggcagacacagcuccagggacccaggccagcugccacacccccgacacuccugcugucca

SEQ ID NO: 71842 - RNA, 64 nt, hsa
ggguuucuugcugucuggaauucaguuuuuccaucugccacauggaaguucauagccaggauag

SEQ ID NO: 71843 - RNA, 64 nt, hsa
cauccucucacucacuucuccacccgccaggcagcugccacaggccuaaggcugagugaggugu

SEQ ID NO: 71844 - RNA, 64 nt, hsa
acgaugccagcccgaggcacugcuacgccagcagcugccacaugggaugguggcucaggcgcuc

SEQ ID NO: 71845 - RNA, 64 nt, hsa
ggccgccgagggcugagcuccagagccgcaccaucugccacaaacagaauucgagacauacuua

SEQ ID NO: 71846 - RNA, 64 nt, hsa
gucagagacacggucacugauucacacccagucccugccacagaccgucucagacacgcacagu

SEQ ID NO: 71847 - RNA, 64 nt, hsa
acagugggccugcugcaugauucacacccagucccugccacagaccgucucagacacgcacagu

SEQ ID NO: 71848 - RNA, 64 nt, hsa; identical to SEQ ID NO: 71847

SEQ ID NO: 71849 - RNA, 64 nt, hsa
ggaggcgccccgggugggcuuuggggcugcggcacugccacacauccuuucccuccuggccugc

SEQ ID NO: 71850 - RNA, 64 nt, hsa
gcggccuucagugucacagcguggccuugcuugucugccacagcgggagcuaagccggcccugg

SEQ ID NO: 71851 - RNA, 64 nt, hsa
cgccuggcaguagccucuuuccagcuacacgucgcugccacaggccccuggaaaugcuaccuac

SEQ ID NO: 71852 - RNA, 64 nt, hsa
uggggccaauccagggcagcccagagggaacauccugccacaccgccuggcaguagccucuuuc

SEQ ID NO: 71853 - RNA, 64 nt, hsa
aaaauuauaacauuuacuuuugcucccuaccugacugccacagaacugggcaacuauucaugag

SEQ ID NO: 71854 - RNA, 64 nt, hsa
ccucagccuccugaguagcugggacuacaggcgccugccacaacgcccggcuaauuuuuuguau

SEQ ID NO: 71855 - RNA, 64 nt, hsa
caagaagcucccaucacaagcuuggcauugcucucugccacacgugggcuuccucaggcuuguc

SEQ ID NO: 71856 - RNA, 64 nt, hsa
gcucucugccacacgugggcuuccucaggcuugucugccacaagcuacuucucugagcucagaa

SEQ ID NO: 71857 - RNA, 57 nt, hsa
ccuacgagaucucggugugaggacugacugccacacauccgccauggugccacgggg

SEQ ID NO: 71858 - RNA, 64 nt, hsa
gggggggcaggcgggagcaggcacgggggugaugcugccacagggggcuggugacacccagagc

SEQ ID NO: 71859 - RNA, 64 nt, hsa
guaauuaagucauauuucuuauccaggugguuaaagcauucauaaaggauuauaaaauuuuuuu

SEQ ID NO: 71860 - RNA, 64 nt, hsa
gauguaauugagugaagguuugcacugagaaauuagcauucaggccuuacccccaugaaguauu

SEQ ID NO: 71861 - RNA, 64 nt, hsa
cagugaauaugugauucuuuaaggcugcaauacaagcauucaguucccuguuucaauaagaguc

SEQ ID NO: 71862 - RNA, 64 nt, hsa
gugauuucauguuuguaaucuacaacuuuucaaaagcauucagucauggucugcuagguugcag

SEQ ID NO: 71863 - RNA, 64 nt, hsa
uggcuggcugcuucuaggaauauaagaugccucaagcauucauuauuuaugauuugaauacugu

SEQ ID NO: 71864 - RNA, 64 nt, hsa
uauuuuaauaguaaacagggaucacuuuuccuuuagcauucagaaugacaccauauucuuaaau

SEQ ID NO: 71865 - RNA, 64 nt, hsa
uuuuauauggaaaggcuuacaaaucaauauuguaagcauucauuauuuaagaauguacaaugua

SEQ ID NO: 71866 - RNA, 64 nt, hsa
ugauaaaacugauuuuguuuaacaggaaauuuuuagcauucagucauauaacaucugguuauca

SEQ ID NO: 71867 - RNA, 64 nt, hsa
acucucucugggguugugagucagucagcccacaagcauucacagagugcuuaccugccccgag

SEQ ID NO: 71868 - RNA, 64 nt, hsa
guuuugucauguggaaaaucaaaacaaguuagaaagcauucagauuguuucuuuuaaacucacu

SEQ ID NO: 71869 - RNA, 64 nt, hsa
cucugcacuggucauuugagaauuuuuuuuguacagcauucaugugugauauuuuccagauuug

SEQ ID NO: 71870 - RNA, 64 nt, hsa
uaguuggcacuugauugcaguucugugaggcuugagcauucauacaccucaccugccuuggcaa

SEQ ID NO: 71871 - RNA, 64 nt, hsa
gagagaagcucugugaauguaagcauugugggaaagcauucauaucugccaagauccuuugaau

SEQ ID NO: 71872 - RNA, 64 nt, hsa
gagagaaacccuaugaauguaaagaaugcagaaaagcauucagcuugccuacuuccuuucauag

SEQ ID NO: 71873 - RNA, 64 nt, hsa
gagaggcgcccuaagaauguaagcauugugggaaagcauucauaucugccaagaucguuugaau

SEQ ID NO: 71874 - RNA, 64 nt, hsa
ggagagaaaccuaugaauguaaggaaugcaaacaagcauucaauuauuuuucuuccuugcauau

SEQ ID NO: 71875 - RNA, 64 nt, hsa
gagagaauccguaugaauguaaggauugugggaaagcauucagcuugcuuaauugcuuucauag

SEQ ID NO: 71876 - RNA, 64 nt, hsa
cccuggagucucacucccacacaugcccauagcuagcauucaacagagaacucugucuuaagcu

SEQ ID NO: 71877 - RNA, 64 nt, hsa
cuuucuuuuuggcuagggaaggugcagguggcccagcauucagggaggagucguaagaucuuaa

SEQ ID NO: 71878 - RNA, 64 nt, hsa
uuucuguuuuucuacauuuguuaggaaacuugugagcauucacacuacagagaaacuugaaaua

SEQ ID NO: 71879 - RNA, 64 nt, hsa
gcacaucauccuucuacucuaaucaauaugaaauagcauucaguaacuccuauuaauucacucu

SEQ ID NO: 71880 - RNA, 64 nt, hsa
aaguaccuaaacauucgugaaaugauuuuuuuuagcugaaaaaugcuggcaagaagaauuuuaa

SEQ ID NO: 71881 - RNA, 64 nt, hsa
uuugaaccaaaaaaaauuguuuuuacaucuuuaugcugaaaauguguuuagauuaggaauaugg

SEQ ID NO: 71882 - RNA, 64 nt, hsa
aguagaucucaauguuuuauaauuccuuaaaacagcugaaaauugggacaacauacuuuacgca

SEQ ID NO: 71883 - RNA, 64 nt, hsa
cacuauucacaggacauuggcauuaucuacuaaggcugaaaaugugcauauuccaugacucagg

SEQ ID NO: 71884 - RNA, 64 nt, hsa
aauaauaacagacaaggucaaaaaauagaugcaggcugaaaagaaaaggaagugggcuaagaug

SEQ ID NO: 71885 - RNA, 64 nt, hsa
uggcaucuuagaauuaaacaaaacuuuuacuagggcugaaaagagaagacugauuuaauguggu

SEQ ID NO: 71886 - RNA, 64 nt, hsa
uuuuuucauuacaagccccaugagcugcuuuuaugcugaaaauggucauuucccuguucacuua

SEQ ID NO: 71887 - RNA, 64 nt, hsa
ccuuuugaaacauaagaaaaacauuuaaaccuaugcugaaaauacgauaaaagaaaaacaacuc

SEQ ID NO: 71888 - RNA, 64 nt, hsa
gagaguuuuuauuaagugaaccaucacgauauuggcugaaaaguucuacauucuauuauuguau

SEQ ID NO: 71889 - RNA, 64 nt, hsa
aaaacuacaaguuuauuuauaauuuaacaacucagcugaaaauauaacggguauauuuguuauu

SEQ ID NO: 71890 - RNA, 64 nt, hsa
acuuagaagguuuaacacuucacugauuaauggugcugaaaacacguuacaauuaccacauauc

SEQ ID NO: 71891 - RNA, 64 nt, hsa
uucuucaacaggauuacaguguagcuaccuacaugcugaaaaauauagccuuuaaaucauuuuu

SEQ ID NO: 71892 - RNA, 64 nt, hsa
ucuaguaacaauacaugagaaagaugucuauguagcugaaaauaaaaugacgucacaagacaau

SEQ ID NO: 71893 - RNA, 64 nt, hsa
uuuuuuaaauuuacagaauauuauauaacccacugcugaaaaagaaaaaaaugauuguuuuaga

SEQ ID NO: 71894 - RNA, 64 nt, hsa
ucuucaacagggaaaacagcuagcuugaaaacuugcugaaaaacacaacuuguguuuauggcau

SEQ ID NO: 71895 - RNA, 64 nt, hsa
gguccagagaaccuggcaugcaauggacauggaagcugaaaauuacuuggguauucucugauuu

SEQ ID NO: 71896 - RNA, 64 nt, hsa
uuuggggaaaggaggaggagagcccuucagguuugcugaaaagcauucagaugcacacccuucu

SEQ ID NO: 71897 - RNA, 64 nt, hsa
caacuacuuuguuauuucuacaucuuagauaaaugcugaaaaggaaaacgauuucauuguucau

SEQ ID NO: 71898 - RNA, 64 nt, hsa
ucaguagaacucauugagggugcucuugccagcugcugaaaauagaaguuggcuacucucagaa

SEQ ID NO: 71899 - RNA, 64 nt, hsa
ucccagcacaaggcagagcugggaugaaaacagggcugaaaagacucagggccaauuauuggcu

SEQ ID NO: 71900 - RNA, 64 nt, hsa
ucagggaaagaaggugauuuguauuugucuccccgcugaaaagaacaggauucaaguccagagu

SEQ ID NO: 71901 - RNA, 64 nt, hsa
auaauguuuaauuagaauugugguggugguaguggaaggggauaauuguaaauaggaaacauga

SEQ ID NO: 71902 - RNA, 64 nt, hsa
uuagaaucuaaccugcugucuucgugcucugugugaaggggaagcugggggguuagcaugaagu

SEQ ID NO: 71903 - RNA, 64 nt, hsa
aguaauagggaauucacuuauugagaaugaaagugaaggggaugauccuaaugucuuagaaagc

SEQ ID NO: 71904 - RNA, 64 nt, hsa
uacuauacauucuaagacuggugcuucugcuuuugaaggggaaaaugccaauuuuuacuguaau

SEQ ID NO: 71905 - RNA, 64 nt, hsa
aagaucaaagaagaaaagaagaaggggaagaaaagaaggggaagaagaucaaaacccaccaugc

SEQ ID NO: 71906 - RNA, 64 nt, hsa
aaaagaaggggaagaagaucaaagaagaaaagaagaaggggaagaaaagaaggggaagaagauc

SEQ ID NO: 71907 - RNA, 64 nt, hsa
gcagaaauugaaaagaaggggaaggggaagaaaagaaggggaagaagaucaaagaagaaaagaa

SEQ ID NO: 71908 - RNA, 64 nt, hsa
ugucugaauuuauugcagaaauugaaaagaaggggaaggggaagaaaagaaggggaagaagauc

SEQ ID NO: 71909 - RNA, 64 nt, hsa
uuggcuuuucucuugacgugggagaaauugaaaagaaggggaaggggaagaaaagaaggggaag

SEQ ID NO: 71910 - RNA, 64 nt, hsa
aaaaagcaaaugggauuaaggacucauggaaugggaaggggaaggggagucuuacuauaugugg

SEQ ID NO: 71911 - RNA, 64 nt, hsa
caaaugggauuaaggacucauggaaugggaaggggaaggggagucuuacuauauguggaauaaa

SEQ ID NO: 71912 - RNA, 64 nt, hsa
gaaggugaggggaggggaggcuuuuucuaccugagaaggggagugucuuugagggccuuaaaag

SEQ ID NO: 71913 - RNA, 64 nt, hsa
acagcguuaggagccguuuccuucagguguuaaggaaggggaugccccugagguucuccuggcu

SEQ ID NO: 71914 - RNA, 64 nt, hsa
gcucauuguggaaacgauggaggaaggugaaggggaaggggaagaggaagaagagugaaacaaa

SEQ ID NO: 71915 - RNA, 64 nt, hsa
agcagagcucauuguggaaacgauggaggaaggugaaggggaaggggaagaggaagaagaguga

SEQ ID NO: 71916 - RNA, 64 nt, hsa
aacuuuaguaaacccuaaguaaagucaaaauggagaaggggaaauauacagauggcuaguugca

SEQ ID NO: 71917 - RNA, 64 nt, hsa
uuucccuucuuaaacagaaauaaauauuuggaaugaaggggaauguacuagaacacccuuuuug

SEQ ID NO: 71918 - RNA, 64 nt, hsa
cuauuuuaaguuugaaaacuuuaacaaugaaggggaaggggaagauuuccaccaacugaaucau

SEQ ID NO: 71919 - RNA, 64 nt, hsa
uuagcacuauuuuaaguuugaaaacuuuaacaaugaaggggaaggggaagauuuccaccaacug

SEQ ID NO: 71920 - RNA, 64 nt, hsa
ugaaaugcgcagccggcuguggacgggggaggaggaaggggacagagggagcagguaggaaaca

SEQ ID NO: 71921 - RNA, 64 nt, hsa
ggcacacugaugggcgagcugagcgcagagcugcgaaggggaacuguuugcaguagcagccgcu

SEQ ID NO: 71922 - RNA, 64 nt, hsa
guagaauguuccuggauguucauaucuaguguuugaaggggaggagggauuuaaacugguccug

SEQ ID NO: 71923 - RNA, 64 nt, hsa
aaggaagauuguuguuuaaauucauuugaaaccagaaggggacuuuuuaguuguauguguaaca

SEQ ID NO: 71924 - RNA, 64 nt, hsa
aggagugucgccgggaggccuucagggugggggggaaggggacaugggcaggaagcaccgaggg

SEQ ID NO: 71925 - RNA, 64 nt, hsa
agaguaggccuuugcccgggggcagacuuagaaggaaggggagagacaaagggggacugaguuu

SEQ ID NO: 71926 - RNA, 64 nt, hsa
ugaggucccauccacagcuggugcucagcugcuugaaggggagacucccuccucuguaacuucu

SEQ ID NO: 71927 - RNA, 64 nt, hsa
uucuaggaaaagggagugccugagguaggccuuagaaggggaugagucagauuuuuacagagga

SEQ ID NO: 71928 - RNA, 64 nt, hsa
ugugauugacuaguaauggcuaccacgggaaagggaaggggaagcaguagcacuaaugcuaugu

SEQ ID NO: 71929 - RNA, 64 nt, hsa
agggcgcccaggggcgggcggggguacgagggaggaaggggagcaagacuugggcucacaggcu

SEQ ID NO: 71930 - RNA, 64 nt, hsa
gaguguucucaccaccacuuaugccccuagaagggaaggggagagggaaacgugcccucuguuu

SEQ ID NO: 71931 - RNA, 64 nt, hsa
uuccauggucacagagaacuagugguggcucugagaaggggaggaccucugggcuuugauucca

SEQ ID NO: 71932 - RNA, 64 nt, hsa
ggacagcaggagggaggcgucgggggccuuagcagaaggggaacaaugagggcauuucaugaac

SEQ ID NO: 71933 - RNA, 64 nt, hsa
gagggagccaggccccgagggugagcgagauggagaaggggaaggaaggggcuuugggaucugg

SEQ ID NO: 71934 - RNA, 64 nt, hsa
agaaggccacaguaggccucucuuugugggaauggaaggggacaguuugcuuuuagugcuggcc

SEQ ID NO: 71935 - RNA, 64 nt, hsa
gcaagaaagucucuucggccucgggcuuccuggagaaggggacguccauuccugcugggucuua

SEQ ID NO: 71936 - RNA, 64 nt, hsa
aaggaagcugagcaucucccgaguccugggcagggaaggggagggaaauugcugcuucuccaac

SEQ ID NO: 71937 - RNA, 64 nt, hsa
ccaggacauuccuuucccagcuccagccuggagggaaggggacaaagaccccaggaggccaaag

SEQ ID NO: 71938 - RNA, 64 nt, hsa
aguggcuuccccuucagggccacaacaggcuguagaaggggaugacgaggacaucagagguuag

SEQ ID NO: 71939 - RNA, 64 nt, hsa
aaauuuccaggccuuuuugaaguauugagaaggggaaggggauuucucacuucaauuauagauc

SEQ ID NO: 71940 - RNA, 64 nt, hsa
uaugccaaauuuccaggccuuuuugaaguauugagaaggggaaggggauuucucacuucaauua

SEQ ID NO: 71941 - RNA, 61 nt, hsa
ugagggccaugcaugcaguaugaggggucuacaccugcaaggacugagaggcuuuucuagc

SEQ ID NO: 71942 - RNA, 61 nt, hsa
gcaggcauugcacauggugugagaaggucuacaccugcaagggacgaguccccgggccugg

SEQ ID NO: 71943 - RNA, 61 nt, hsa
cacaggcauugcacacggugugaggaguguacaccugcaagggcugaggcccugggcccag

SEQ ID NO: 71944 - RNA, 61 nt, hsa
acaggcauugcacacagugugaaugggucuacaccugcaugggcugagucccugggcucag

SEQ ID NO: 71945 - RNA, 61 nt, hsa
ugcaggcauugcacacggugugaagggucuacaccugcacaggcugaguuccugggcucga

SEQ ID NO: 71946 - RNA, 61 nt, hsa
cccuccugaccccaccuagaauggaagccuccaccugcagccccaggccucccucccccgg

SEQ ID NO: 71947 - RNA, 61 nt, hsa
gcugaggggcagggccguagacucacggcugcaccugcagggagcagcacgccaaccccag

SEQ ID NO: 71948 - RNA, 61 nt, hsa
cacccuuugcugacucuuuuuggacucagcccaccugcacccaggugauuaaaaagcuuua

SEQ ID NO: 71949 - RNA, 61 nt, hsa
gugcugcaguauggccagacgugguggcucacaccugcaaucccagcaccuuaggaggccg

SEQ ID NO: 71950 - RNA, 61 nt, hsa
gggacccugccagggaaggccacuggguguucaccugcaaaguuucugguugucacugcac

SEQ ID NO: 71951 - RNA, 61 nt, hsa
ccuggcccaacagaaaaacccugccccaaugcaccugcaggcaagguacccgaagaagcag

SEQ ID NO: 71952 - RNA, 61 nt, hsa
gcacgccuggcuuuccuuggauacccacugucaccugcacuaugaagugcugcuggcuggg

SEQ ID NO: 71953 - RNA, 61 nt, hsa
cccccuuuggcuuaauuaagugugcugucugcaccugcaagguauggccacccaaucuucu

SEQ ID NO: 71954 - RNA, 61 nt, hsa
cagugcccccuuuuggagagaugagcuguaucaccugcagaugugggguaaguggggagca

SEQ ID NO: 71955 - RNA, 61 nt, hsa
ccugcaaggcugucaacagucuuggagaagccaccugcacagcagagcucauuguggaaac

SEQ ID NO: 71956 - RNA, 61 nt, hsa
gugauguuugcggggaugacgaugccaaguacaccugcaaggcugucaacagucuuggaga

SEQ ID NO: 71957 - RNA, 61 nt, hsa
gccuugccaucgggcccaguucuccgggccccaccugcaccccuuucuucccccugggaua

SEQ ID NO: 71958 - RNA, 61 nt, hsa
uuugccccagggugggugcaggugcgagugucaccugcagcugccucagucauucagaguu

SEQ ID NO: 71959 - RNA, 61 nt, hsa
cuacuaaaaauuagccaagugugguaauguucaccugcagucccagcuacuugggaggcca

SEQ ID NO: 71960 - RNA, 61 nt, hsa
aaugaugaaguugcaaauggcagugugcugucaccugcaacagaagugcguaccagaagua

SEQ ID NO: 71961 - RNA, 61 nt, hsa
ccgugcacaggcacacgugcuggucugcacacaccugcacacaccugcacacucgcuaugc

SEQ ID NO: 71962 - RNA, 61 nt, hsa
gcacacgugcuggucugcacacaccugcacacaccugcacacucgcuaugccaggccuccu

SEQ ID NO: 71963 - RNA, 61 nt, hsa
cgcaaucuggcuccuccuggaaaauuucccccaccugcagcgcugggccccaaggcuugcc

SEQ ID NO: 71964 - RNA, 61 nt, hsa
ccauacucccacuuugugccaaaugacuuugcaccugcaaauggugcuucaaugucguuuu

SEQ ID NO: 71965 - RNA, 61 nt, hsa
aauacaaaaaucagccagacaugguggcaugcaccugcaaucccagcuacucgggaggcug

SEQ ID NO: 71966 - RNA, 61 nt, hsa
uuaacaugacauuuaccagcaacuugaacuucaccugcaaagcucuguggccacauuuuca

SEQ ID NO: 71967 - RNA, 61 nt, hsa
acugccccaacuccuggaagcuguguccuugcaccugcauccguaguucccugaaaaccca

SEQ ID NO: 71968 - RNA, 61 nt, hsa
gagaaaugcauccauuccucagggacagagacaccugcaccuccccccacugcaggccccg

SEQ ID NO: 71969 - RNA, 61 nt, hsa
aguacaaaaauuagcugggcaugauggcacgcaccugcagucccagcuacuugggaggcug

SEQ ID NO: 71970 - RNA, 61 nt, hsa
cagccauguccuauuccuugaucauccaaagcaccugcagaguccagugaaaugauauauu

SEQ ID NO: 71971 - RNA, 61 nt, hsa
cggugccaucucuuguguaugcagggcuaugcaccugcaggcacguguguaugcacucccc

SEQ ID NO: 71972 - RNA, 61 nt, hsa
gccacauuuccauuugcaucauuacugccuucaccugcauagucacucuuuugaugcuggg

SEQ ID NO: 71973 - RNA, 61 nt, hsa
aagggucccaggcugucaggggcguuugcgccaccugcaagggcgugggucagagaguuuu

SEQ ID NO: 71974 - RNA, 61 nt, hsa
gcugucccggcuccaucuugguucuagccgccaccugcaugaacacaguggcccggcuuaa

SEQ ID NO: 71975 - RNA, 61 nt, hsa
guucuggucaaaacuaaaggaacucccuccccaccugcaggacuccgaagacagugcgacu

SEQ ID NO: 71976 - RNA, 61 nt, hsa
ugagucagacaagugggagcuguaggaacugcaccugcagccucuucuuacuccccauuga

SEQ ID NO: 71977 - RNA, 61 nt, hsa
uuguuggugucagggaggcuuacuggagccacaccugcaggcgcuguguucaggcaccacc

SEQ ID NO: 71978 - RNA, 61 nt, hsa
ugucagcccagaugacuccucacccauccaccaccugcagcuugagauguuaacuauuaga

SEQ ID NO: 71979 - RNA, 61 nt, hsa
gaagacgagagauagugggugugguggcucacaccugcaaucccagcacuuuggaaggccg

SEQ ID NO: 71980 - RNA, 61 nt, hsa
gacugcuggggacccucgccuucccuccucucaccugcaggcugauccuucuuuucacuuu

SEQ ID NO: 71981 - RNA, 61 nt, hsa
uacaccccgacccuccuccugucagcccccucaccugcagccuguugcccaauaaauuuaa

SEQ ID NO: 71982 - RNA, 61 nt, hsa
ugcugacccuaggauuuuccuucccugcccucaccugcaaaugaguuaaagaagaggcgug

SEQ ID NO: 71983 - RNA, 61 nt, hsa
gcacgugcacacaccugcacaccccugcacacaccugcacaccgucccucuccccggacaa

SEQ ID NO: 71984 - RNA, 61 nt, hsa
ugcccuagcaguuugccucugcacgugcacacaccugcacaccccugcacacaccugcaca

SEQ ID NO: 71985 - RNA, 61 nt, hsa
aacgcucaacuugguugcgguaccaucagcccaccugcauuuggcuuucgacuugcuuguu

SEQ ID NO: 71986 - RNA, 61 nt, hsa
uuuagauccaugccauucacugacucacuaacaccugcaaaaucuuuaaggaaaaaagcug

SEQ ID NO: 71987 - RNA, 61 nt, hsa
acuugcccugagcacuccuggugcaggucuccaccugcacauuggguggggcuccugggag

SEQ ID NO: 71988 - RNA, 61 nt, hsa
gagagacauggaaagggagacagccagguggcaccugcagcggcugcccucuggggccacu

SEQ ID NO: 71989 - RNA, 64 nt, hsa
cacugggggucuuccuccaccucccacuuuccaagggcuccaggaaucuggggccugaccacag

SEQ ID NO: 71990 - RNA, 64 nt, hsa
agcaguacccaggcuuugcagaccacgcggggcagggcuccacugaagccacccccaccccucg

SEQ ID NO: 71991 - RNA, 64 nt, hsa
cuaggggagcaccgugauggagaggacagagcaggggcuccagcaccuucuuucuggacuggcg

SEQ ID NO: 71992 - RNA, 64 nt, hsa
ucuggacuggcguucaccucccugcucagugcuugggcuccacgggcaggggucagagcacucc

SEQ ID NO: 71993 - RNA, 64 nt, hsa
ggggccggggacccagugagccgagaggcccucugggcuccacuuaugcauaugcaccaaaaaa

SEQ ID NO: 71994 - RNA, 64 nt, hsa
gccuggcagccaugaagcaggcugaaaggcagaggggcuccagguccuguuuccagcuccccuc

SEQ ID NO: 71995 - RNA, 64 nt, hsa
accagggucccugucugggagcucagacuuagcugggcuccagcagccuggcuccggacucucg

SEQ ID NO: 71996 - RNA, 64 nt, hsa
auuuggggauucacugcaugaaguuguucauuuggggcuccaguuuuugugcauuuccagacca

SEQ ID NO: 71997 - RNA, 64 nt, hsa
acucuucuuggugggggcuccuagcuguggcugggggcuccaggcgccccugugauuaccuccu

SEQ ID NO: 71998 - RNA, 64 nt, hsa
agauucaauuccuguaacccaagacugagucuuagggcuccagucuccaccugcuugguuuccu

SEQ ID NO: 71999 - RNA, 64 nt, hsa
gauaucggaugucguuuaaccugggcucgugguagggcuccagcauuucucccuccuuccuggu

SEQ ID NO: 72000 - RNA, 64 nt, hsa
guagguuucccagggaagggggguggggguaggugggcuccacaggaugggggaggagcauguc

SEQ ID NO: 72001 - RNA, 64 nt, hsa
agccacagugggaugaaccagccggggccuuaucgggcuccagccaucucaugaggggagagga

SEQ ID NO: 72002 - RNA, 64 nt, hsa
uuaaacuccugggcuccagcaauuaucccagcuugggcuccaaaagugcugggauuacaggcau

SEQ ID NO: 72003 - RNA, 64 nt, hsa
guucccuauguugcccagcuggucuuaaacuccugggcuccagcaauuaucccagcuugggcuc

SEQ ID NO: 72004 - RNA, 64 nt, hsa
agauguucuagcugagagggccuggcccuggggugggcuccaggaaaacgcugguuaggccugg

SEQ ID NO: 72005 - RNA, 64 nt, hsa
gcugcucggccucccugcagcucagcgcagcccagggcuccaagugaggcccagaagcccaugg

SEQ ID NO: 72006 - RNA, 64 nt, hsa
gcaugcccagugauccugguucccuggcuuguaggggcuccagagccugcuuccugguuccuca

SEQ ID NO: 72007 - RNA, 64 nt, hsa
aaauugcaaaaacccaucuucauuccuuuuuauggggcuccaggucauaaggaugagauauauu

SEQ ID NO: 72008 - RNA, 64 nt, hsa
agugcucugggagcgggcuccacagccuccuugugggcuccagccccuugucagccgcagccuc

SEQ ID NO: 72009 - RNA, 64 nt, hsa
ggaagugugucugaacucggagugcucugggagcgggcuccacagccuccuugugggcuccagc

SEQ ID NO: 72010 - RNA, 64 nt, hsa
cucuuggaagggguaacagugaaccgcccuccaugggcuccacaucuuuuccuuuggcuuccaa

SEQ ID NO: 72011 - RNA, 64 nt, hsa
uuuaaagaaaggagaaagccauuggaaaaaugaugggcuccauuaaggagacuaaugaaucugg

SEQ ID NO: 72012 - RNA, 64 nt, hsa
ggcgccauuccgaggccgggccuucuucugacacgggcuccaaccccaccugaccaagcccggg

SEQ ID NO: 72013 - RNA, 64 nt, hsa
accugucagagucuggggacucggcgugcagggcgggcuccaagcgcuuugcuuccggaacucc

SEQ ID NO: 72014 - RNA, 64 nt, hsa
gucucaccugcgguggggugucggcucugccugggggcuccaucccuuucagccacucguggcc

SEQ ID NO: 72015 - RNA, 64 nt, hsa
uuuaccugaggagcucuguccugcucccuguggagggcuccagauagcucagaaaugaccagcc

SEQ ID NO: 72016 - RNA, 64 nt, hsa
cccccaggccucuccucagagggcggcacaggcugggcuccagcaggugggcaggggaggucug

SEQ ID NO: 72017 - RNA, 64 nt, hsa
gggccggggcgcccaccggggaccgccuggccgggggcuccaagggcucuaggcagacccugcg

SEQ ID NO: 72018 - RNA, 64 nt, hsa
aacuaggcgguccugggauggggcauguggccaagggcuccagggccagggugugagggauggg

SEQ ID NO: 72019 - RNA, 64 nt, hsa
cuggguggggcagggccuggccugguccaggcuugggcuccauucccaucacugcugucccucc

SEQ ID NO: 72020 - RNA, 64 nt, hsa
cucucccugccucacuccuccgugagcaccaccagggcuccaggagccucauccagccucagag

SEQ ID NO: 72021 - RNA, 64 nt, hsa
uucccagaccaugggaaaugggaauugcgcucaggggcuccaugcugggucugaggccccugcc

SEQ ID NO: 72022 - RNA, 64 nt, hsa
cuggccucgaagcccugggcugcacagcccuacugggcuccaccucuauaaaccagugacuucu

SEQ ID NO: 72023 - RNA, 64 nt, hsa
ccccucagcaagggugcaaagggggaagaacuaggggcuccauuguucuucaggcgacaggaga

SEQ ID NO: 72024 - RNA, 64 nt, hsa
gcccacacagcacaacgucuuaccgugccuauuaccaagcgaguguuuguaaccauguaguuuu

SEQ ID NO: 72025 - RNA, 64 nt, hsa
gguggacucagggaggcccagggcuccucuggucccaagcgaaggcuccucugcuugggauucu

SEQ ID NO: 72026 - RNA, 64 nt, hsa
aagagaucagggagggcuaaaguugugucuuaugccaagcgaaagugaaaaauaucauuuucac

SEQ ID NO: 72027 - RNA, 64 nt, hsa
cucgacucuuucaaagcuucacaucugccucaccccaagcgaggcucucuacuggcacaaacuu

SEQ ID NO: 72028 - RNA, 64 nt, hsa
guuugguuaaguaauuuaggagcaaagcaaugcuccaagcgaggccuccugcuucaggaaagaa

SEQ ID NO: 72029 - RNA, 64 nt, hsa
gcccauguuggccuuuuacagcagugccacggcaccaagcgagcugccacaucucacacucuaa

SEQ ID NO: 72030 - RNA, 64 nt, hsa
auuucauugacugaacugcacguucuauauugugccaagcgaaaaaaaaaaaugcacugugaca

SEQ ID NO: 72031 - RNA, 64 nt, hsa
agcuuccccggccgggagaccaguguuagaggauccaagcgaccuaaacagcugcuuuaugaaa

SEQ ID NO: 72032 - RNA, 64 nt, hsa
uggaggaauacauuauuuuaucguauauuuuuguccaagcgaugagcugacggugguauugcuu

SEQ ID NO: 72033 - RNA, 64 nt, hsa
cugcuaaagacagugcggaugcaagagcaccuggccaagcgagagcagcuggguaagcgccacc

SEQ ID NO: 72034 - RNA, 64 nt, hsa
cagaucccacuaaagugucaagguguggaagggaccaagcgaccaaggaugggccaucuggggu

SEQ ID NO: 72035 - RNA, 64 nt, hsa
gcagccgaggcgcaggccgagugggccgccaggaccaagcgagguggaccccgaaacggacggc

SEQ ID NO: 72036 - RNA, 64 nt, hsa
aaaagucuuuaccaauaauauuuagagcuagucuccaagcgacgaaaaaaauguuuuaauauuu

SEQ ID NO: 72037 - RNA, 64 nt, hsa
ggaaggccaauuccuuacaaugauggcagaacccccaagcgaaugcccuauugaggagaaggac

SEQ ID NO: 72038 - RNA, 64 nt, hsa
agggcaucccggagcaggaggcuggccgggcuccccaagcgaaggcguuggugucugucauuag

SEQ ID NO: 72039 - RNA, 61 nt, hsa
uuaagcccugcgucaugugaacggaaagaggccaagcgauggccgcucucuccucuccccu

SEQ ID NO: 72040 - RNA, 64 nt, hsa
acugcgccagccuccccgcccgcucucuuuucucccaagcgaaaccaaaugcgccccuucaccu

SEQ ID NO: 72041 - RNA, 64 nt, hsa
agugcccagggaguccagcgaaugacgucuguggccaagcgaggucucaggugcaaagcaaaag

SEQ ID NO: 72042 - RNA, 64 nt, hsa
aaucuuggcucacugcaaccuccaccucccagguccaagcgauucucuugccucagccucccaa

SEQ ID NO: 72043 - RNA, 64 nt, hsa
gauuauggcucauugcagccucgacuucucggggccaagcgauccuccugccucagccuucuga

SEQ ID NO: 72044 - RNA, 64 nt, hsa
cacgcaugugugugugugcacgcacugggcugggccaagcgacugaggauucgcuugggaacgg

SEQ ID NO: 72045 - RNA, 64 nt, hsa
aguagagaugggcucgugcugaaacaucugaaugccaagcgaagucugugagcaucaaccccac

SEQ ID NO: 72046 - RNA, 64 nt, hsa
ucaaauauuuuuuuaaaacugaauugcaauugugccaagcgaauauaaugaauugaauuaaguu

SEQ ID NO: 72047 - RNA, 64 nt, hsa
aaucucugcucacugcaacaucugccucccagguccaagcgauucuccugccucagccucccgu

SEQ ID NO: 72048 - RNA, 64 nt, hsa
aacugcggcuaagucucuuuuucccuuggaucagccaagcgaaacuuggagcuuugacaaggaa

SEQ ID NO: 72049 - RNA, 64 nt, hsa
cacugcggucccgcuuagcgacccgccgccgccgccaagcgaggcugaggacuccgaucgcgau

SEQ ID NO: 72050 - RNA, 64 nt, hsa
cucuggcuggcuaacuggaagcauguaggagaauccaagcgaggucaacagagaaggcaggaau

SEQ ID NO: 72051 - RNA, 64 nt, hsa
acgugagccaacaagaagcaggggccucugagugccaagcgacguggcgggcuccacguuagcc

SEQ ID NO: 72052 - RNA, 64 nt, hsa
uccccuccuucaacucuccccagaaauagcccaaccaagcgaguggauguccccaccacuccug

SEQ ID NO: 72053 - RNA, 64 nt, hsa
uuuguaccucagaguauuuuuuaaaggauucuuuccaagcgagauuuaauuauaagguaguacc

SEQ ID NO: 72054 - RNA, 64 nt, hsa
guguaccaagggcaaggacccucuggcuuacccuccaagcgacucuguaguuuucccagauuuu

SEQ ID NO: 72055 - RNA, 64 nt, hsa
aaaacgguggcagguuuggcgagcacgaacuagaccaagcgaagggcagcccaccaccguauau

SEQ ID NO: 72056 - RNA, 64 nt, hsa
accacaaagggaccuaccugagccaccguccuagccaagcgagcaaaccugcaggggguuugga

SEQ ID NO: 72057 - RNA, 64 nt, hsa
uacguagguuuaagacuagucccuuggauaagccccaagcgaauuugucuucagauuauuaaaa

SEQ ID NO: 72058 - RNA, 64 nt, hsa
ccgagauccugccacugcacuccagccugggcaaccaagcgagacucugccuuaaaaaaaaaaa

SEQ ID NO: 72059 - RNA, 64 nt, hsa
gucacacugggacaggcgugcagcucacugaacuccaagcgagccagcccucucuuggacuaga

SEQ ID NO: 72060 - RNA, 64 nt, hsa
cccauuggccuuagcccaagacuuggagucgaccccaagcgacagagugaccagaaacccuuuu

SEQ ID NO: 72061 - RNA, 64 nt, hsa
agcugugugcaucgacguucuccuggggugugugccaagcgaaacccaggggugaauuggauuc

SEQ ID NO: 72062 - RNA, 64 nt, hsa
agcuguuaacucuaaaauguacuugggagauaggccaagcgagaggucaugggccaacuaagug

SEQ ID NO: 72063 - RNA, 64 nt, hsa
cagagcacuacagagccucugaaagaccauagcaccaagcgagccccuucagauucccccacug

SEQ ID NO: 72064 - RNA, 64 nt, hsa
auaagucaguacuuggguuguguaaucugcuaguccaagcgaacagcaaccuccugcuacccuc

SEQ ID NO: 72065 - RNA, 64 nt, hsa
cgggagaggggagagggacgcacagcacugccugccaagcgagaaugcaggccccgcccccucg

SEQ ID NO: 72066 - RNA, 64 nt, hsa
aucugaagguugcacuggccagcaugggccugucccaagcgagaggggagacacaguggacuga

SEQ ID NO: 72067 - RNA, 64 nt, hsa
uugcuauuaucugucuuuuugcuuuuagcauccuaaugaguaugaaaugcuaucuugugguuuu

SEQ ID NO: 72068 - RNA, 64 nt, hsa
uauuuccuggcaaucacggguaaggaggauuaggaaugaguauuccauuccuaggugucaucag

SEQ ID NO: 72069 - RNA, 64 nt, hsa
gaauugucaguuuagauucauaaaugaaaagguaaaugaguaaucagaauaaaccaagugauaa

SEQ ID NO: 72070 - RNA, 64 nt, hsa
uuuaaagcaagaugcgauguccagaguuacagagaaugaguagaugugucucaucgguuaauag

SEQ ID NO: 72071 - RNA, 64 nt, hsa
ccgagaagcaagcacaaaaguagacaaaaguauuaaugaguauuuccuuucuccauaagugcag

SEQ ID NO: 72072 - RNA, 51 nt, hsa
ugaacaagaaagcacaauaaaaaugaguaacagaaaaagcacauauacuag

SEQ ID NO: 72073 - RNA, 64 nt, hsa
uuugcaguucaugguaaaaugcauuuucaaaccaaaugaguacuuauauauggaucucuguaga

SEQ ID NO: 72074 - RNA, 64 nt, hsa
uuucugagaaugaaauggacgauuacacuuagaaaaugaguaauaguguuuaauaagucaguga

SEQ ID NO: 72075 - RNA, 64 nt, hsa
gaacuggaauuuuucagcauucuuuagaauuuuaaaugaguagagagcucaacuuuuauuccua

SEQ ID NO: 72076 - RNA, 64 nt, hsa
ccuucuaccugguguuuacuuuuguuaccuaaauaaugaguaggaucuuguuuuguuuuaucac

SEQ ID NO: 72077 - RNA, 64 nt, hsa
aguuguugagcgagaaccccuucauuugaaaagaaaugaguaugcuacuauagggagaguuguu

SEQ ID NO: 72078 - RNA, 64 nt, hsa
uaguacuuaccugguaggauuauggugaguauuaaaugaguaaauggaaacagcuuagaauagu

SEQ ID NO: 72079 - RNA, 64 nt, hsa
aucucaggaaaaucugugauuauuuguguguucuaaugaguaacaucuacuuaguuagccuuag

SEQ ID NO: 72080 - RNA, 64 nt, hsa
uaccugccauccaguuuuggaucuuuuuaaaacuaaugaguaugaacuugagaucuguauaaau

SEQ ID NO: 72081 - RNA, 64 nt, hsa
auaggcagucugcaucuucagauuucagagauuaaaugaguauucaguuuuauuuuuaguaaag

SEQ ID NO: 72082 - RNA, 64 nt, hsa
uacaggacugaacuccuauacacguguacuguagaaugaguauuuuuuaauaccuuaagguagg

SEQ ID NO: 72083 - RNA, 64 nt, hsa
uuuauccccaggaaucaauaauuuuuuugccuaggugccugacuccuuucagauucccucuuua

SEQ ID NO: 72084 - RNA, 64 nt, hsa
uccaagccuuuucugggagcaaagccagggccuggugccugauuuucugaagccaggagcccuc

SEQ ID NO: 72085 - RNA, 64 nt, hsa
uacauaggaacaagggggaaagucucuuacugaagugccugaaacccaaagcuagagcuucuag

SEQ ID NO: 72086 - RNA, 64 nt, hsa
gucauaagccaggaaaugaaacaaaggaaaacaggugccugaauuuccuggggaaacauggcuu

SEQ ID NO: 72087 - RNA, 64 nt, hsa
aaaaccugugguccgcccagaagagauuccuccagugccugagaaccgauuuuuacugagaaga

SEQ ID NO: 72088 - RNA, 64 nt, hsa
auccagugcuguggaaguuaagguguugaccacugugccugaaaugaaaccacaaggcuugaga

SEQ ID NO: 72089 - RNA, 64 nt, hsa
gccccaccccaccaugguagccuuagggugcugagugccugauacugccugacaagugccugac

SEQ ID NO: 72090 - RNA, 64 nt, hsa
cuuagggugcugagugccugauacugccugacaagugccugacacgcagccuaguuccuuccug

SEQ ID NO: 72091 - RNA, 64 nt, hsa
aagaaaaccagguuucuucuccccauaccacguugugccugaagaacaagccuucccguccuug

SEQ ID NO: 72092 - RNA, 64 nt, hsa
gagagaaucaaagccuugucacauggauccucuggugccugaagaaaugagauuuuauuauccc

SEQ ID NO: 72093 - RNA, 64 nt, hsa
aauaauuggauuuaauuuuuuuuaacauugaaaagugccugaaaaaugguaaauucuuaaaugu

SEQ ID NO: 72094 - RNA, 64 nt, hsa
ucccaaaguguugggauuacaggugugugucacugugccugacagcugacaguuuuaacugaca

SEQ ID NO: 72095 - RNA, 64 nt, hsa
uguccuuccuccuuccuccccggauuggcuugcugugccugacggaugggcuguagaauggggu

SEQ ID NO: 72096 - RNA, 64 nt, hsa
aaccucgaaacgaacaguuaaauugaaaugcuaugugccugacccaaugguaggcacauaguag

SEQ ID NO: 72097 - RNA, 64 nt, hsa
gagaaggugccccuucaggcaccuaggggagagcgugccugacaacccagagagauucgacagu

SEQ ID NO: 72098 - RNA, 64 nt, hsa
cugcccugcacucacaggagccaauggggucacggugccugaagagggccugacacuucacaga

SEQ ID NO: 72099 - RNA, 64 nt, hsa
agaaaaauuucuauucuuuuuuuugcauccaauugugccugaacuuuuaaaauauguaaaugcu

SEQ ID NO: 72100 - RNA, 64 nt, hsa
gcacccuagaaacaacauauugucccaugagcaggugccugagacacagaccccuuugcauuca

SEQ ID NO: 72101 - RNA, 64 nt, hsa
gcacccagguggccgcguugggcugucagccaaggugccugaaacgauacgugugcccacucca

SEQ ID NO: 72102 - RNA, 64 nt, hsa
gaaacgauacgugugcccacuccacugucacagugugccugaggaaggcugcuagggauguuag

SEQ ID NO: 72103 - RNA, 64 nt, hsa
ccccucgcccaucagugccagccccugcuggcuggugccugagccccucagacagcccccugcc

SEQ ID NO: 72104 - RNA, 64 nt, hsa
cuguccugacagcacuccucggcaggcauggcuggugccugaagaccccagaugugagggcacc

SEQ ID NO: 72105 - RNA, 64 nt, hsa
agggugggugauugaugaguugucaaaaugauaggugccugagggcagacucgggcugucuagg

SEQ ID NO: 72106 - RNA, 64 nt, hsa
auauguaaaccagggacaggacccaccuuguguagugccugacccaaagccuggcccugcacac

SEQ ID NO: 72107 - RNA, 64 nt, hsa
ugacaugaagcucccagagauaaaacuccccaaggugccugagauggcugugcccgaugugcac

SEQ ID NO: 72108 - RNA, 64 nt, hsa
gcugccaaaagucucagagaugaaacuccccaaggugccugaaauggccgugcccgaugugcac

SEQ ID NO: 72109 - RNA, 64 nt, hsa
agagaugaaagucccugagaugaagcuuccaaaggugccugagaugaaacuuccugagaugaaa

SEQ ID NO: 72110 - RNA, 64 nt, hsa
uuccuccagccugugcgcaccugcccuccuugcagcccagcacaccugcagguguaagggacga

SEQ ID NO: 72111 - RNA, 64 nt, hsa
acaccucucccaaaaagcagcccacaaggcaggggcccagcagcccagccaucacucaucuuug

SEQ ID NO: 72112 - RNA, 64 nt, hsa
ccaaguagcugggaugacaggcgcacaccaccacgcccagcaaauuuuuuguauuuuuaguaga

SEQ ID NO: 72113 - RNA, 64 nt, hsa
cuuucaggcucuuagaagccauagauuuggacaagcccagcaagauggguguccuuccaggccu

SEQ ID NO: 72114 - RNA, 64 nt, hsa
gucaucacugaucuaagcaguggcaucugagugggcccagcacauggccauagaggcccaggca

SEQ ID NO: 72115 - RNA, 64 nt, hsa
cuugaugccagagggccagcaggcuccuggcugugcccagcaggcccagcaugcaggugguggg

SEQ ID NO: 72116 - RNA, 64 nt, hsa
agagggccagcaggcuccuggcugugcccagcaggcccagcaugcagguggugggacacugggc

SEQ ID NO: 72117 - RNA, 64 nt, hsa
ccagcagccugccuauggcuccagcugugcuguggcccagcagcauggccugcaucuggaagga

SEQ ID NO: 72118 - RNA, 64 nt, hsa
gcauaucugugagcagcuguucccuguagccacugcccagcaccuccucaggccagccuggugc

SEQ ID NO: 72119 - RNA, 64 nt, hsa
gcccguguacauagugcauuguuucugugggcgggcccagcacuuuccgucaacguuguacugu

SEQ ID NO: 72120 - RNA, 64 nt, hsa
ccacgaccuaggcaguaggccggugugccugacugcccagcauuuggguaauuuagauuguaaa

SEQ ID NO: 72121 - RNA, 64 nt, hsa
gaguugagaaagcagccccaguaguuccauucuugcccagcacuuucugcauuccaaacagcau

SEQ ID NO: 72122 - RNA, 64 nt, hsa
cagagucaggagaccccaaggcaugugagcaucugcccagcaaccuguggagacaacccacacu

SEQ ID NO: 72123 - RNA, 64 nt, hsa
gugucccuccucuuccuguagugccccucccauggcccagcagcuuggcugagcccccucuccu

SEQ ID NO: 72124 - RNA, 64 nt, hsa
auuccuuagcagcucaggcgcagcccuagugggagcccagcacacugcuucucggaggccaggc

SEQ ID NO: 72125 - RNA, 64 nt, hsa
caaccgccccgucugauaaguaaggagccccucugcccagcagccgccccgucugagaagugag

SEQ ID NO: 72126 - RNA, 64 nt, hsa
cagccgccccgucugagaagugaggagccccucugcccagcagccacccugucugggaagugag

SEQ ID NO: 72127 - RNA, 64 nt, hsa
ccggcucggcccagcacccccucuccuggagggcgcccagcagccugccagcaguuacugugaa

SEQ ID NO: 72128 - RNA, 64 nt, hsa
cgaaggccgacaccacuccugccagcccggcucggcccagcacccccucuccuggagggcgccc

SEQ ID NO: 72129 - RNA, 64 nt, hsa
gcacucccgggauggguggaccaaacccuuagcagcccagcauuucccgaaggccgacaccacu

SEQ ID NO: 72130 - RNA, 64 nt, hsa
agccccucugcccagcaugcccugugaucgccuggcccagcaggagcugcuucagccgagaggg

SEQ ID NO: 72131 - RNA, 64 nt, hsa
caggugggaagaugaagccggccagagccccucugcccagcaugcccugugaucgccuggccca

SEQ ID NO: 72132 - RNA, 64 nt, hsa
augucaauuuuagcacucuccaggcacaaggacagcccagcaccagcuuuacagggcaguguuu

SEQ ID NO: 72133 - RNA, 64 nt, hsa
auguguagcuggcgaggaauuacuuccacuucuggcccagcacaagcccugcuuuggccaccug

SEQ ID NO: 72134 - RNA, 64 nt, hsa
ggagagcacacugauagaaauccuuguguccagugcccagcaacuccugccucagccucccgag

SEQ ID NO: 72135 - RNA, 64 nt, hsa
ccaaagugcugggauuacaggcgugagccacugcgcccagcauguuagacaauuuuuaauucau

SEQ ID NO: 72136 - RNA, 64 nt, hsa
cacccagcaggagaggcuccugguguagugggcagcccagcacuucccgcugcugccugccugu

SEQ ID NO: 72137 - RNA, 64 nt, hsa
cgacgugggcggugggccccagccccacagaccagcccagcauucagguuaguucuacuucuuc

SEQ ID NO: 72138 - RNA, 64 nt, hsa
gccacagcagagccaaucacagacccaccacacagcccagcagcccuucgugaauccugcacug

SEQ ID NO: 72139 - RNA, 64 nt, hsa
gcccucccucugcccucccgucugugagcucccugcccagcaccaccuccugcacugcacuucu

SEQ ID NO: 72140 - RNA, 64 nt, hsa
cugcuaguuacaguguaggcaccccggcccagcagcccagcagcccacauguguucaggacccu

SEQ ID NO: 72141 - RNA, 64 nt, hsa
gcacuaugcugcuaguuacaguguaggcaccccggcccagcagcccagcagcccacauguguuc

SEQ ID NO: 72142 - RNA, 64 nt, hsa
uuccuauggaagucuagcaaagcaauacgacucagcccagcacucucugccccaggacucaugg

SEQ ID NO: 72143 - RNA, 64 nt, hsa
gaacauugucacuguuuucacugucaugcagggagcccagcacuguggccaggauggcagagac

SEQ ID NO: 72144 - RNA, 64 nt, hsa
aaggagacacucaguuucacaagugagcccucuugcccagcacacaccuauggcuggcugggca

SEQ ID NO: 72145 - RNA, 64 nt, hsa
agagguucaaaggcagcaaggcagugagcuaugagcccagcauggaugugucucaggcaccuca

SEQ ID NO: 72146 - RNA, 64 nt, hsa
uguuucucucccaucauccggauuucugguuguggcccagcaauuaacaaaaacagcuucaacu

SEQ ID NO: 72147 - RNA, 64 nt, hsa
cucgcucuuugcugagagccccuuuugacagaaagcccagcacgacccugcuggaagaacugac

SEQ ID NO: 72148 - RNA, 64 nt, hsa
gcacugugcaggacguggaccagcuggagcugcugcccagcacagaggagagucgccgcagaug

SEQ ID NO: 72149 - RNA, 64 nt, hsa
cugguucuuuccauccucuugugguacccguagugcccagcauccagaccuuugugccccugug

SEQ ID NO: 72150 - RNA, 64 nt, hsa
ugcacugcccucacccucagccgucccaaggagugcccagcacuacucagcauguaguccagga

SEQ ID NO: 72151 - RNA, 64 nt, hsa
cacaggccucuggaaucagaaucuucaggguggggcccagcagucuguguuuuaacagguucuc

SEQ ID NO: 72152 - RNA, 64 nt, hsa
agugucuuugaugguggugagggugggugauggugcccagcaccaacaguuuuaguggccuguc

SEQ ID NO: 72153 - RNA, 50 nt, hsa
uaaacccagcugacacuugagcccagcauccuggggauccagcggaugga

SEQ ID NO: 72154 - RNA, 64 nt, hsa
uacccuggggccccagggagcaggacgcuccggggcccagcacguugcccugggccuguggccg

SEQ ID NO: 72155 - RNA, 64 nt, hsa
gggccccaccuucaggucuuagugguucacaagagcccagcagccaggcuggcuuuuucauugu

SEQ ID NO: 72156 - RNA, 64 nt, hsa
gucauagcuuucauguccauugaagaauuaccaagcccagcaaguaaaaaaaauuacaauaaca

SEQ ID NO: 72157 - RNA, 64 nt, hsa
ucaagugaggguccaggaaagcucuugcccucuugcccagcagccgcaggcauaucucaacgga

SEQ ID NO: 72158 - RNA, 64 nt, hsa
uaaacaguugaguuucuucuaaagaggaagccuugcccagcaaggaccagugagacagccggau

SEQ ID NO: 72159 - RNA, 64 nt, hsa
ccggccggagaacaucugccuugcugcaccugaggcccagcagagccguuccugggacugucag

SEQ ID NO: 72160 - RNA, 64 nt, hsa
accuccagucacugugcccagcagggugggcugugcccagcaggagucaggcuaagaaacgcca

SEQ ID NO: 72161 - RNA, 64 nt, hsa
agggacugugcagccuggaaccuccagucacugugcccagcagggugggcugugcccagcagga

SEQ ID NO: 72162 - RNA, 64 nt, hsa
ucaaaccugcccucggacgcuccuggagcuuugugcccagcacucggauucuccuggacaccau

SEQ ID NO: 72163 - RNA, 64 nt, hsa
gcuggaugugcugcaggagcuccgaggcacuguggcccagcaggugacugguucuucaggaacu

SEQ ID NO: 72164 - RNA, 64 nt, hsa
ccgagucaugcacucaggcagacagcaggcuggagcccagcauucagggguggcuucugucugu

SEQ ID NO: 72165 - RNA, 64 nt, hsa
caccaaagucagggagccuggaagccaaacaaaggcccagcagccuucugacaagcaagggcug

SEQ ID NO: 72166 - RNA, 64 nt, hsa
cugccucuuccagggccucugggagccugacagugcccagcaugaagguggggccagugcuggg

SEQ ID NO: 72167 - RNA, 64 nt, hsa
ucuuauucaccauguccaagauccugggaucugggcccagcaucucuuccuccuuuguagaugc

SEQ ID NO: 72168 - RNA, 64 nt, hsa
gggugggggagagaggaaaggagggaggggagaagcccagcagaagcugagccaggcagagggg

SEQ ID NO: 72169 - RNA, 64 nt, hsa
ccaaguggcccccacccucagcccgcuccugcccgcccagcacccccaggcccugggggaccug

SEQ ID NO: 72170 - RNA, 64 nt, hsa
cuccccagaagacacaggaaacaauguauugucugcccagcaaucaaaggcaaugcucaaacac

SEQ ID NO: 72171 - RNA, 64 nt, hsa
ccagagaggccuguggcuaguuugcccugggggggcccagcacagccccagcccggagcccagc

SEQ ID NO: 72172 - RNA, 64 nt, hsa
uaugugcuagagcccaggccagcucugagaccaagcccagcauugagaauaagcucuguucuaa

SEQ ID NO: 72173 - RNA, 64 nt, hsa
aggagaaaagcaggugcccuaagauugcucuaaggcccagcaugugguuacaguucucugacuu

SEQ ID NO: 72174 - RNA, 64 nt, hsa
caaaggcgccccuccccagagggaucccuaacgugcccagcauguagauucuggacuaacagac

SEQ ID NO: 72175 - RNA, 64 nt, hsa
acagcucacgaggcuuggaccugcuguggagggugcccagcagggggcugagcucugaggggug

SEQ ID NO: 72176 - RNA, 64 nt, hsa
acgguucacaaggcuuggaccugccauggagggugcccagcagacguggugugagagggacagc

SEQ ID NO: 72177 - RNA, 64 nt, hsa
auggcucaugaggcuuggaccugccguggagggugcccagcagacgugguaugagagggauggc

SEQ ID NO: 72178 - RNA, 64 nt, hsa
gaacggcucacgagacuuggaccugguggagggugcccagcagacguggugugagagggacggc

SEQ ID NO: 72179 - RNA, 64 nt, hsa
acggcucacgaggcuuggaccugcuguggagggugcccagcagacguggugugagaggaacggc

SEQ ID NO: 72180 - RNA, 64 nt, hsa
gacaggccaaucccuucccucccagaagcuggccgcccagcaggagggacugaggccagacuca

SEQ ID NO: 72181 - RNA, 64 nt, hsa
ccugcagcuugugcucugcccagcagugccccuggcccagcaccucagccugcucuucucucug

SEQ ID NO: 72182 - RNA, 64 nt, hsa
uagcaaugcucccagguccugcagcuugugcucugcccagcagugccccuggcccagcaccuca

SEQ ID NO: 72183 - RNA, 64 nt, hsa; identical to SEQ ID NO: 55732

SEQ ID NO: 72184 - RNA, 64 nt, hsa; identical to SEQ ID NO: 55733

SEQ ID NO: 72185 - RNA, 64 nt, hsa; identical to SEQ ID NO: 55734

SEQ ID NO: 72186 - RNA, 64 nt, hsa; identical to SEQ ID NO: 55735

SEQ ID NO: 72187 - RNA, 64 nt, hsa; identical to SEQ ID NO: 55736

SEQ ID NO: 72188 - RNA, 64 nt, hsa; identical to SEQ ID NO: 55737

SEQ ID NO: 72189 - RNA, 64 nt, hsa
gcuaauguaggacuguauagguagauccagauccagacuguaagauguuguuuuaggggcuaaa

SEQ ID NO: 72190 - RNA, 64 nt, hsa
ugacuuucuccccauccccuuccuaaauauccaaagacuguacuggccagugucauuuuauuuu

SEQ ID NO: 72191 - RNA, 64 nt, hsa
uagccaggagagcaagcacauaggacagacugaaagacuguaauuuuacacaauacacauggcu

SEQ ID NO: 72192 - RNA, 64 nt, hsa
ugcagaucugccuccaagguugaaaaggagacuaagacuguauaaacaucuucauugucaguuc

SEQ ID NO: 72193 - RNA, 64 nt, hsa
cagauuuuauucucaccugggccauuugcagaugagacuguaguuugcagaugagacuguaguu

SEQ ID NO: 72194 - RNA, 64 nt, hsa
ggccauuugcagaugagacuguaguuugcagaugagacuguaguuugcagauggcguggaagca

SEQ ID NO: 72195 - RNA, 64 nt, hsa
aguuucggguguuuuucuccagucuuguuacuguagacuguagaaagcacgggccccaggcucu

SEQ ID NO: 72196 - RNA, 64 nt, hsa
cuccuuuuucuugcuuugcgugcucaguuuuuacagacuguaaaggagauguguuguuugugaa

SEQ ID NO: 72197 - RNA, 64 nt, hsa
acugcaaagugaauuuuauaaaggcaaaauacuggagcacuaaugcccaugagauugaaggcac

SEQ ID NO: 72198 - RNA, 64 nt, hsa
cauccauaacaucuuaagcgggcagagguggauugagcacuauggagagauugucaucaagaac

SEQ ID NO: 72199 - RNA, 64 nt, hsa
gguggcacaggagcacugagccagggaauacugagagcacuaacuaugcacuaaccuagauuuu

SEQ ID NO: 72200 - RNA, 64 nt, hsa
cccagcgcaguccugcucuccugugaccuguggagagcacuaaugaucacguguguugauggaa

SEQ ID NO: 72201 - RNA, 64 nt, hsa
guagguuuaagagaauuuuuagccaugacuuuuggagcacuauuccauugucaguuauuaauaa

SEQ ID NO: 72202 - RNA, 64 nt, hsa
ucgucuguguguggugugaccaauggugugcccagagcacuacucucaaaaucacuaguguuag

SEQ ID NO: 72203 - RNA, 64 nt, hsa; identical to SEQ ID NO: 57588

SEQ ID NO: 72204 - RNA, 64 nt, hsa; identical to SEQ ID NO: 57589

SEQ ID NO: 72205 - RNA, 64 nt, hsa
cccauugccgacuugaauuuuuuuguaugaagucccuccugauuuugugugugugugucugugu

SEQ ID NO: 72206 - RNA, 64 nt, hsa
uuuuuguuuuuuuaauuuaaauugaagguagcugccuccugaaagccagcauuaagccagaaca

SEQ ID NO: 72207 - RNA, 64 nt, hsa
cgccuccuggguucaagggauucuccugucuuagccuccugaguagcugugauuacaggcaugc

SEQ ID NO: 72208 - RNA, 64 nt, hsa
gucuuuuucaauaaaaagcacuguggauuucugcccuccugaugugcauauccguacuuccaug

SEQ ID NO: 72209 - RNA, 64 nt, hsa
ccaugagguguuuucugugugcagaacauugucaccuccugaggcugugggccacagccaccuc

SEQ ID NO: 72210 - RNA, 64 nt, hsa
caccuccuggguucaagcgauucuccugccucagccuccugaguagcugggauuacaggcacac

SEQ ID NO: 72211 - RNA, 64 nt, hsa
caccauguuggccaggcuagucuugaauuccugaccuccugaccugcccaccucaaccucccaa

SEQ ID NO: 72212 - RNA, 64 nt, hsa
ggcacuagguaggcuucuaccugcaggcggggcuccuccugaaggaggcggggcucuaggaugg

SEQ ID NO: 72213 - RNA, 64 nt, hsa
cucuccgcgggugggacucuucccugggaaccgcccuccugauuaaggcguggcuucugcagga

SEQ ID NO: 72214 - RNA, 64 nt, hsa
aaugguccgcuuuccuggagccaauggcccggccccuccugacucauccgccuggcccgggaau

SEQ ID NO: 72215 - RNA, 64 nt, hsa
gcagugccucgaggcaccggcgcugcagguacuuccuccugauggccaagagcaucgugacccu

SEQ ID NO: 72216 - RNA, 64 nt, hsa
acuugcguccugcagaggaccacaguggguggcaccuccugagaaggcgaggagagugguuguu

SEQ ID NO: 72217 - RNA, 64 nt, hsa
caccucccggauucaagcgauucuccugccucagccuccugaguagcuggaacuacaugcgcgu

SEQ ID NO: 72218 - RNA, 64 nt, hsa
ccaaucccacaaucauggcucacugcagccaccaccuccugagcucaagugauccucccaucua

SEQ ID NO: 72219 - RNA, 64 nt, hsa
gaccuccugggcucaggugauccucccaccucagccuccugaguagcuaggacuacagaugcuc

SEQ ID NO: 72220 - RNA, 64 nt, hsa
accuccugggguucaagugauucuccugugucagccuccugaguagcugggauuacaggcgugu

SEQ ID NO: 72221 - RNA, 64 nt, hsa
cugagcucaccuccgaacccgccuccugaacccgccuccugaaccugccuccuuaccucccacu

SEQ ID NO: 72222 - RNA, 64 nt, hsa
acagcaccagcaccugagcucaccuccgaacccgccuccugaacccgccuccugaaccugccuc

SEQ ID NO: 72223 - RNA, 64 nt, hsa
ugccuaccggguucaagugauucuugugccucagccuccugaguagcugggauuauaggcaugc

SEQ ID NO: 72224 - RNA, 64 nt, hsa
ugccuaccgaguucaagcgauucuugugcuucagccuccugaguagcugggacuauaggccugu

SEQ ID NO: 72225 - RNA, 64 nt, hsa
ucuaccgacaaagacccuauuuccuggcaaacggccuccugaacccugacuuuuuguguacaua

SEQ ID NO: 72226 - RNA, 64 nt, hsa
ucuaagaagacugcagcaaggucagagguuuuagccuccugaggcugaccuugcuagucugccc

SEQ ID NO: 72227 - RNA, 64 nt, hsa
cgccuccuggguucaagcgauucuccagccucagccuccugaguagcuggaauuacagguacgc

SEQ ID NO: 72228 - RNA, 64 nt, hsa
uguguccucagcuugucuggaggaggccugcaucccuccugagcucuuggaggugcccaggaac

SEQ ID NO: 72229 - RNA, 64 nt, hsa
agccagcagggaagaucugggggacagaggaaggccuccugagggaggggcaggagagcaguga

SEQ ID NO: 72230 - RNA, 64 nt, hsa
ugauggcaccuauugagggugacagccacccagcccuccugaagauagccagagagcccaugag

SEQ ID NO: 72231 - RNA, 64 nt, hsa
ugccucccgggcucaccccauucuccugccucagccuccugaguagcugggacuacaggcgccc

SEQ ID NO: 72232 - RNA, 64 nt, hsa
ugccucccagguucaagcaguucuccugccucagccuccugaguagcuggcauuauaggugccc

SEQ ID NO: 72233 - RNA, 64 nt, hsa
aggagggcgacugggggcccuggcccggcacuguccuccugaggggcaggcgccggcugcaaca

SEQ ID NO: 72234 - RNA, 64 nt, hsa
gcaaccucugucucaagcgauucuccugccucagccuccugaguagcugggauuacaggugcau

SEQ ID NO: 72235 - RNA, 64 nt, hsa
auuugacaaagacuugcuugucuugggccugucaccuccugaaaggcugcuuuagcuguggaug

SEQ ID NO: 72236 - RNA, 64 nt, hsa
uccuagcaugcaguggaaagugcuuagcucucucccuccugaccucugggcagccagucaucaa

SEQ ID NO: 72237 - RNA, 64 nt, hsa
caccuccuggguucaagcgcuucuccagccucagccuccugaguagcugggauuacagguaugu

SEQ ID NO: 72238 - RNA, 64 nt, hsa
acgcuccuuacgucgagauguuggaccuugaagcccuccugaggccaacaugcaaaucuggcug

SEQ ID NO: 72239 - RNA, 64 nt, hsa
caaaaagaaguggggaaagaaccaucaaaccuuuccuccugacuuaccaaaccaggaaaacagc

SEQ ID NO: 72240 - RNA, 64 nt, hsa
ggccuuuaagacaaagcgcucaucuugcccucuaccuccugauaggcuugaggguuugccaacc

SEQ ID NO: 72241 - RNA, 64 nt, hsa
gcucaagcuuagaagccagcccugcuauuuccagccuccugaaggcucagcacggugaggccug

SEQ ID NO: 72242 - RNA, 64 nt, hsa
gcuguguguuuucugaaaccuagaggaccagaccccuccugacugggucccaaagccaauauga

SEQ ID NO: 72243 - RNA, 64 nt, hsa
ucccgucauuuaucucucugucucugucuugacuccuccugagcauaaaaccauggcagccuug

SEQ ID NO: 72244 - RNA, 64 nt, hsa
acccaggcuuguggcccagguaucaccuucccuuccuccugagaguugaggccuguaaauacaa

SEQ ID NO: 72245 - RNA, 64 nt, hsa
ggagagaaauccuccuggguacuccuggccagacccuccugaaucaucugcggcuuaaacucau

SEQ ID NO: 72246 - RNA, 64 nt, hsa
gcugccuccacugaggcgggcacacaaggcggacccuccugaaacagccuccauuuucuucaaa

SEQ ID NO: 72247 - RNA, 64 nt, hsa
cagaaauggacaaagaaaacggggggguucucccccuccugauuaaaaagggagaaagaaaacu

SEQ ID NO: 72248 - RNA, 64 nt, hsa
ccugccucagcuaccuaaugauuccgcgcggagaccuccugacaacgucucuucaagcauccuc

SEQ ID NO: 72249 - RNA, 64 nt, hsa
cuacccucccucgcauccgccucugagccaggagccuccugacccugugaugccugacacaggg

SEQ ID NO: 72250 - RNA, 64 nt, hsa
uccaggcuugggcuccauucccaucacugcugucccuccugaggucuggauuggggauggggac

SEQ ID NO: 72251 - RNA, 64 nt, hsa
gaacucccaggcucaagcgauccucccaucucagccuccugaguagcugggacuacaggcacag

SEQ ID NO: 72252 - RNA, 64 nt, hsa
uggucucaccugggugcugagggcugccugggccccuccugaagaacagaaagguguucaugug

SEQ ID NO: 72253 - RNA, 64 nt, hsa
gccuccugggguucaagugauccucccaccucagccuccugaguagcugggauuacaggcaccc

SEQ ID NO: 72254 - RNA, 64 nt, hsa
ccguuccugucacauuuccccagccccaccuuccccuccugaugcccugaaagcuuccggaauu

SEQ ID NO: 72255 - RNA, 64 nt, hsa
cgccucccggguucacgccauucuccugccucagccuccugaguagcugggacuacaggccccu

SEQ ID NO: 72256 - RNA, 64 nt, hsa
caccacguuagccaggauggucucgaucuccugaccuccugaugcgccugccucagccucccag

SEQ ID NO: 72257 - RNA, 64 nt, hsa
gaacuccugaccucaagcgaucugcccgccucggccuccugaagugcugggauuacaggcgugg

SEQ ID NO: 72258 - RNA, 64 nt, hsa
cgccuccuggguucaagugauucuccugccucagccuccugaguagcugggauuacagcacccg

SEQ ID NO: 72259 - RNA, 64 nt, hsa
cucugccucccggguucaugccauucugccucagccuccugaguagcugggacuacaggcgccc

SEQ ID NO: 72260 - RNA, 64 nt, hsa
cgccuccuguguucaagcgauucuccugucucagccuccugaguagaugggacuacaggcacag

SEQ ID NO: 72261 - RNA, 64 nt, hsa
acauguccccaucagccugcugggacacacggguccuccugagucccguagccucauuucuuac

SEQ ID NO: 72262 - RNA, 64 nt, hsa
cuuggguugugugguuugguagcuccuguggguaccuccugaagcagcagcgaauggcaauggg

SEQ ID NO: 72263 - RNA, 64 nt, hsa
uaccuccuggguucaagugauucucgugccucagccuccugaguagcugggcugacaggcaccc

SEQ ID NO: 72264 - RNA, 64 nt, hsa
gaacuccuggccuuaagugauccucccaccucagccuccugaguagcugggacuacaggcauga

SEQ ID NO: 72265 - RNA, 64 nt, hsa
cgccuccaggguucaagugauucuccugccucagccuccugaguagcugggauuacaggcaugu

SEQ ID NO: 72266 - RNA, 64 nt, hsa
ccaacucccccagccuuguugagguucucuacugccuccugaauacacaugaaccccuauacca

SEQ ID NO: 72267 - RNA, 64 nt, hsa
gucgcacacacauuuggaaugcacacagcggcugccuccugauguuuguaucauagucguauug

SEQ ID NO: 72268 - RNA, 64 nt, hsa
gcaguggcgcaaucucgccuuccugcagucuccgccuccugaguucaagcgauucuccugccuc

SEQ ID NO: 72269 - RNA, 64 nt, hsa
aaagaagcagauuuuagaugaaaagaucuacugcccuccugaggcuucugugcuccuggcuucu

SEQ ID NO: 72270 - RNA, 64 nt, hsa
uuaacagcccaugaacccaauuccagcaccguugccuccugacauaccaagcuucaaccucauu

SEQ ID NO: 72271 - RNA, 64 nt, hsa
gugguggcacaaucucggcucacugcaaccuccaccuccugaguucaagcaauucuccugccuc

SEQ ID NO: 72272 - RNA, 64 nt, hsa
aacuuguguaccuucagggauggggcucuuacucccuccugaggccagcugcucuaauaucgau

SEQ ID NO: 72273 - RNA, 64 nt, hsa
agagcuucguugauggucuuuucuguacuggaggccuccugaggccaggaacgugcaaauuugc

SEQ ID NO: 72274 - RNA, 64 nt, hsa
augagauuaugggcuggcuccauuucuuggacuuaaaaugcauuauuaguuuaaaaaucuuucu

SEQ ID NO: 72275 - RNA, 64 nt, hsa
aaccaggugcauaauugauugcccuuuggccauaaaaaugcagugucauggaucuuagagcuaa

SEQ ID NO: 72276 - RNA, 64 nt, hsa
uauguacacauacauauauauaguugacacuugaaaaaugcaggugguaggggcacugacccac

SEQ ID NO: 72277 - RNA, 64 nt, hsa
ugugauggccaguauauccaguccauggauaaagaaaaugcaucugcaucuccuaccccucuuc

SEQ ID NO: 72278 - RNA, 64 nt, hsa
aaucucuacagccuugcucuccggggugguuaauaaaaugcaacacuuggcauuuuuauguuuu

SEQ ID NO: 72279 - RNA, 64 nt, hsa
gaagaaaaauagaaucaauggcauuacuauuaguaaaaugcacaccuuuuucugaauuuacuau

SEQ ID NO: 72280 - RNA, 64 nt, hsa
uuuauucauaaauaaaguuuuguguugauuugugaaaaugcaauuacaaucugagaugugucac

SEQ ID NO: 72281 - RNA, 64 nt, hsa
uuuccuguucauagcaauauuaaaucaggaaaaaaaaaugcagggagguauuuaacagcugagc

SEQ ID NO: 72282 - RNA, 64 nt, hsa
cuuggcagggaauauuuaaagcaacuucaaguuuaaaaugcagcuguugauucuaccaaacaac

SEQ ID NO: 72283 - RNA, 64 nt, hsa
ggcuauuuucagcugaggaggggugaauauaggaaaaaugcauuuuugaaacguuugcaacaug

SEQ ID NO: 72284 - RNA, 64 nt, hsa
uuuguguagcaacacauugugugcuauguuuauuaaaaugcagcgacaacuugagugucucacu

SEQ ID NO: 72285 - RNA, 64 nt, hsa
aaaaaguuugcuaacccuugauaacagauacucuaaaaugcagguuuuucuucuucaauuuagc

SEQ ID NO: 72286 - RNA, 64 nt, hsa
acaguauuacugaauauuaauguuucuuguuuagaaaaugcaacuauaucuauaugugggaacc

SEQ ID NO: 72287 - RNA, 64 nt, hsa
uguuaauguguuugguuuggggacugguuguuauaaaaugcaauuuuuuuuuaaaucuaagcau

SEQ ID NO: 72288 - RNA, 64 nt, hsa
gaaauaccucauugaauauuauacuacuacugguaaaaugcagaagacaguguuaauguguuug

SEQ ID NO: 72289 - RNA, 64 nt, hsa
guaucagaggcauaucauaaauugauaauuuugcaaaaugcacuuuuuugagaugcagauauag

SEQ ID NO: 72290 - RNA, 64 nt, hsa
uucacagaggaauccaaaaaauacaguuugggggaaaaugcaauaauuuuugaugagaugggug

SEQ ID NO: 72291 - RNA, 64 nt, hsa
ucaguuacaaacauuaucuccuuuaguuuuucagaaaaugcaucccugauuucauucauuucca

SEQ ID NO: 72292 - RNA, 64 nt, hsa
cuuuucuugggggugggggaguuucccuuuucuaaaaaugcaaugcacuaaaacuauuuuaaga

SEQ ID NO: 72293 - RNA, 64 nt, hsa
gcuccaugucuguaagucaaauguuacacaaaaaaaaaugcaaaugguguuucauuggaauuac

SEQ ID NO: 72294 - RNA, 64 nt, hsa
uccaauguauuuggguaaaaauugcuucuuuuagaaaaugcaaagguuuauuugucuuaauaaa

SEQ ID NO: 72295 - RNA, 64 nt, hsa
uuuuauaagggguuacucuuucaagaguaacaaaaaaaugcaaacuguaaugaaacuacauugu

SEQ ID NO: 72296 - RNA, 64 nt, hsa
aacccaugugugaacugcacagagcaauucauagaaaaugcauagaaauuuguaacacuuuggu

SEQ ID NO: 72297 - RNA, 64 nt, hsa
ugaguguuugucacauuucacuuucaugguauauaaaaugcaguuugcauauauaacuugaaua

SEQ ID NO: 72298 - RNA, 64 nt, hsa
uuucagacuguuuugauagaaaaagcuaaauuuuaaaaugcauaucucacaguugccuaccugu

SEQ ID NO: 72299 - RNA, 64 nt, hsa
uuggacagcaccuuuaagcucuacccccuacaucaaaaugcacuuuagugccccuucacgguac

SEQ ID NO: 72300 - RNA, 64 nt, hsa
auaaaaggacuuguuagucuccagaacaucugcuaaaaugcaaguauauguauaagguaauagc

SEQ ID NO: 72301 - RNA, 64 nt, hsa
cucaguauuuuggauuauucaaguguaugugguaaaaaugcagaugauugcugcuuuaccccag

SEQ ID NO: 72302 - RNA, 64 nt, hsa
cacauggcaguugcaguaacuuguauggaaagagaaaaugcaaugagcccaguuacugcacuug

SEQ ID NO: 72303 - RNA, 64 nt, hsa
cugucuucugucccccacacguaccagaaagugaaaaaugcagcgaguccucugggugguuaug

SEQ ID NO: 72304 - RNA, 64 nt, hsa
aagggaagaacaguccucgggugauucagaggggaaaaugcaauccgggagguguuuccucagc

SEQ ID NO: 72305 - RNA, 64 nt, hsa
uuuccaauggaauauguauauaccagguuuuagcaaaaugcacacuuuuggcucuuuuugguau

SEQ ID NO: 72306 - RNA, 64 nt, hsa
aagugucuuaucuguacagauguaaauguugaugaaaaugcaauugggguuaauauuuuaagaa

SEQ ID NO: 72307 - RNA, 64 nt, hsa
uaacaaaauuauacaaggauagaaucucaucuagaaaaugcaaacuauuguugaaaagcaguua

SEQ ID NO: 72308 - RNA, 64 nt, hsa
gaaucccuaccagcaguaguuauuauccuuuuuaaaaaugcauugaaaauuugaaagguaaaaa

SEQ ID NO: 72309 - RNA, 64 nt, hsa
uuuuucucaguuuuuaaugcuuuaauuugaaagaaaaaugcauccuaaccauuccauccuguug

SEQ ID NO: 72310 - RNA, 64 nt, hsa
gugaagcuguggugcacuauuaauuuucuguuucaaaaugcaaucuaaagaugcaauaaauaug

SEQ ID NO: 72311 - RNA, 64 nt, hsa
uucaggguuuaauuuugaaauaaaagauuaauauaaaaugcaacaacuuuuuauauuaccuauu

SEQ ID NO: 72312 - RNA, 64 nt, hsa
uggaaugugaaauaaucaccuaggaaguugguuuaaaaugcacacuagugagcccaccuuagac

SEQ ID NO: 72313 - RNA, 64 nt, hsa
aagcuguaguucacaauucuaauaaccuucccucaaaaugcagagaaaauauaaguugucucuu

SEQ ID NO: 72314 - RNA, 64 nt, hsa
gaagcauaaagcuacuuugaaguuauagauguuaaaaaugcaguuuggcuuaugaaaugccacu

SEQ ID NO: 72315 - RNA, 64 nt, hsa
acugaaaacguuagagacacacugcauugcagauaaaaugcaggcagcacaauauggccuaaac

SEQ ID NO: 72316 - RNA, 64 nt, hsa
auggccuaaacugccauaguuuuagaaugugaaaaaaaugcauguuuacuuaccuguauacacc

SEQ ID NO: 72317 - RNA, 64 nt, hsa
aagcaaagcacccaacaaugguaaauguuuuuuaaaaaugcagaacuaagauuuuugacucuaa

SEQ ID NO: 72318 - RNA, 64 nt, hsa
uuggcagacucguauuuugauccugagagaguccaaaaugcacuggucacgaaacgucuaauac

SEQ ID NO: 72319 - RNA, 64 nt, hsa
ugcuuguuuuuauuuucuugacacauuuauuaacaaaaugcaucauggaaaaaaaaaucuaccu

SEQ ID NO: 72320 - RNA, 64 nt, hsa
cuucaacuuaacaaacacuuacguucuccuuuauaaaaugcauaguaaaccacuaacguuagcu

SEQ ID NO: 72321 - RNA, 64 nt, hsa
auaggcuugaaaaaaauuggcggguaaaaaucacaaaaugcagucgaauauauauaugaaaacu

SEQ ID NO: 72322 - RNA, 64 nt, hsa
uaaaaacucaugcugcuccaccagugggccuuggaaaaugcaucaagaaggccaaaccagcuug

SEQ ID NO: 72323 - RNA, 64 nt, hsa
uggccauuuuuaauuuacagcuaaaauauuuuuuaaaaugcauugcugagaaacguugcuuuca

SEQ ID NO: 72324 - RNA, 64 nt, hsa
uguuaaaagaaguguauucuauuuauguuguuuuaaaaugcauacugagagacaaacaucuugu

SEQ ID NO: 72325 - RNA, 64 nt, hsa
ugucacccuaaagaagcauauaaucauagcauuaaaaaugcacacauuacuccagguggaaggu

SEQ ID NO: 72326 - RNA, 64 nt, hsa
auaaaauaaaauaaaauagucgugaaucuuguucaaaaugcagauuccucagauucaauaauga

SEQ ID NO: 72327 - RNA, 64 nt, hsa
cccucugaguuuuuguauguauuauuauuaaagaaaaaugcaaucaggauuuuaaacauguaaa

SEQ ID NO: 72328 - RNA, 64 nt, hsa
acacauuucucuguagugggcucugaauacauugaaaaugcacuauauuuuucuauuuuacuug

SEQ ID NO: 72329 - RNA, 64 nt, hsa
uuugauauuguuugcuaauuggcagguagucaagaaaaugcaaguugccaagagcucugauauu

SEQ ID NO: 72330 - RNA, 64 nt, hsa
uuauacuucaugaacugauuuagcaacacagguaaaaaugcaccuuuuaaagcacuacguuuuc

SEQ ID NO: 72331 - RNA, 64 nt, hsa
cuccagcaauaugucugcauugaaaagaaccaaaaaaaugcaaacuaugaugccauuuaaaacu

SEQ ID NO: 72332 - RNA, 64 nt, hsa
ccagugccaacaauccuagugcuuuccuuuuuuaaaaaugcaaauccuaugugauuuuaacucu

SEQ ID NO: 72333 - RNA, 64 nt, hsa
ucgagacagaaccuuguuauuucucagacuuuggaaaaugcauuguaucgauguuauguaaaag

SEQ ID NO: 72334 - RNA, 64 nt, hsa
ugcucacauguaaaaacaucaguucauacuuaauaaaaugcaauuaccgucaaaucuuucagaa

SEQ ID NO: 72335 - RNA, 64 nt, hsa
aauuaucauuuuguugauugugcuuuuauguaauaaaaugcaguacuuuaaaacauuuagauug

SEQ ID NO: 72336 - RNA, 64 nt, hsa
uguuauguuagccucuagaaaauuuaaguucagaaaaaugcacuaugaccgguucguaauuuuu

SEQ ID NO: 72337 - RNA, 64 nt, hsa
aagucuaaugucagaauaacuuacagaaaaauagaaaaugcacagcuuuaaaaugggcagaguu

SEQ ID NO: 72338 - RNA, 64 nt, hsa
uugaaaauacuuuggauaauaaauuggaguuuuaaaaaugcaaauuugcuuaguaucuaauaau

SEQ ID NO: 72339 - RNA, 64 nt, hsa
gaucaaaaaaauauaugacagauuauuuuguuuaaaaaugcaguuuuaauuaucuuagucuaua

SEQ ID NO: 72340 - RNA, 64 nt, hsa
agugcacugaaauaucuuaucccaguaacaucuaaaaaugcaauucggaaaagugggcuaacac

SEQ ID NO: 72341 - RNA, 64 nt, hsa
gggcuaacaccaauucacucagcagcagauggacaaaaugcacagugucuagaacugcucauug

SEQ ID NO: 72342 - RNA, 64 nt, hsa
ucuggcuuuguauuuucuuuacagcauagauagaaaaaugcacauuuuuccacacucagcuuuc

SEQ ID NO: 72343 - RNA, 64 nt, hsa
uucucgccaccaaaaaaaaaaaaaaaaaaaaaaaaaaaugcaccacaguauuucuagcaugggg

SEQ ID NO: 72344 - RNA, 64 nt, hsa
cagccuggaugacagagcaaaacccugucucaaaaaaaugcagacuggccaggcacaguggcuc

SEQ ID NO: 72345 - RNA, 64 nt, hsa
ugccccaacugcacagcaguugggcugcuuguuaaaaaugcaggccaggugcgguggcucacac

SEQ ID NO: 72346 - RNA, 64 nt, hsa
uuuaagguguucaagauauauucuuuuugguuuuaaaaugcaaaaucuuauuggcuguucuguu

SEQ ID NO: 72347 - RNA, 64 nt, hsa
ucuuuauuaacaucacuagaugaaaccauaucuuaaaaugcagaaaugauuggaagguagaucu

SEQ ID NO: 72348 - RNA, 64 nt, hsa
uuucuggaacugaauucuuaaacauaaaacagauaaaaugcaucuuguuacuacaaauguuaua

SEQ ID NO: 72349 - RNA, 64 nt, hsa
ucuuaauaugauuugguaccuaaaguaauugaaaaaaaugcaguuuccuuuaauccuugacuau

SEQ ID NO: 72350 - RNA, 64 nt, hsa
agcuucaagaacauucaagcuguugguguguuaaaaaaugcauuguauugauuuguacugguag

SEQ ID NO: 72351 - RNA, 64 nt, hsa
ccuuuuaacugucuccguuuuuuucuuuuauuuaaaaaugcacuuuuuuucccuugugaguuau

SEQ ID NO: 72352 - RNA, 64 nt, hsa
uuuuuuuuuuagcccuagagguaacauuauaacuaaaaugcauuccugcaauucuguuugcagu

SEQ ID NO: 72353 - RNA, 64 nt, hsa
gggggauuuaaauacaggaaaacuguuuaagcaaaaaaugcacugcuuucauguaaaaugauau

SEQ ID NO: 72354 - RNA, 64 nt, hsa
agugguuuacaaugcgcuuuagacauauuucuuuaaaaugcaagcagugagaaauaagaccucu

SEQ ID NO: 72355 - RNA, 64 nt, hsa
uguugaccuguuaaguauucucugaaacauggccaaaaugcauuuuaugagcuuuuuuuuuugc

SEQ ID NO: 72356 - RNA, 64 nt, hsa
ucuaugaacuuagaguuuacuauuuuagcagcuaaaaaugcaucacauauucauauuguucaau

SEQ ID NO: 72357 - RNA, 64 nt, hsa
cuuuacaguuaaacuaguuuuaguuuaaaaagaaaaaaugcagggugauuucuuauuauuauau

SEQ ID NO: 72358 - RNA, 64 nt, hsa
gaagggaaagauugucauagaugguagggcuuugaaaaugcaggguaucagcugccacuccugg

SEQ ID NO: 72359 - RNA, 64 nt, hsa
agauaauagaagacaaagagauuaaaaggaaauaaaaaugcaugauuaaaaacuaagaauaaaa

SEQ ID NO: 72360 - RNA, 64 nt, hsa
ucuugguagccacaccugcaauguaaaauggaagaaaaugcaaagaaaccaaaugugccgagug

SEQ ID NO: 72361 - RNA, 64 nt, hsa
uuguaaaauaauauacucaucauagaaaacuugaaaaaugcagaaauguauaaaaaagcaaaaa

SEQ ID NO: 72362 - RNA, 64 nt, hsa
gaaaaucauucugugugaagucaagaggccagagaaaaugcacaaacuguaggaaacuauagga

SEQ ID NO: 72363 - RNA, 64 nt, hsa
cuagagagugguaaaucucagaaagcacaagcauaaaaugcagcucugggggcccuuuccacuu

SEQ ID NO: 72364 - RNA, 64 nt, hsa
aguguccuccucucacaugagccagaucagccagaaaaugcaacacuuggaagaguuaaaugcu

SEQ ID NO: 72365 - RNA, 64 nt, hsa
uuucuucuguacagucuaaagcuacagagaaaaaaaaaugcacucuucccuugccggcuccugg

SEQ ID NO: 72366 - RNA, 64 nt, hsa
agugaaaguacucuguaggguacuguaauuugucaaaaugcagagaauggaaaacagugaacgg

SEQ ID NO: 72367 - RNA, 64 nt, hsa
uaucuaaugcagugauaccaaaaaaaaaggaaauaaaaugcacauaaauuuggaaggaggaaau

SEQ ID NO: 72368 - RNA, 64 nt, hsa
guaucuuacagcuuaccuagaucauaaauuaaucaaaaugcacuuuuuaauaaaaacugauacu

SEQ ID NO: 72369 - RNA, 64 nt, hsa
uuuaacaugucagagagaagagaguuaaaauuuaaaaaugcaucuugggagagaaauuugucua

SEQ ID NO: 72370 - RNA, 64 nt, hsa
guaagaaaggauaaaaagguguggaagugaauauaaaaugcaucuaaacaugacauuuaauuug

SEQ ID NO: 72371 - RNA, 64 nt, hsa
accaaagagauaaagugaagucauccuuauuauuaaaaugcagccuccaaacaaauuucucaag

SEQ ID NO: 72372 - RNA, 64 nt, hsa
caaaaguuaagaagccaaagcuacuugaucaugcaaaaugcacuuauauauuuguuacacugua

SEQ ID NO: 72373 - RNA, 64 nt, hsa
cuaauaagaaauuuauuauggagauauagcccuuaaaaugcaauauuaagaacaaagaaauaga

SEQ ID NO: 72374 - RNA, 64 nt, hsa
cuacugcaaauauaaaacauaaaguuuguuuaaaaaaaugcaaaucauucuuuaccuuaagaaa

SEQ ID NO: 72375 - RNA, 64 nt, hsa
aaugugcauuuuauauaaagaugcauuuuauauaaaaaugcacaccuuuaaucucuauauggca

SEQ ID NO: 72376 - RNA, 64 nt, hsa
aucucuauauggcagcauauacauauauauauauaaaaugcacacuuuuaaucucuauauggca

SEQ ID NO: 72377 - RNA, 64 nt, hsa
uuacauucucuugaguuaauuaauauugaauagcaaaaugcauuuaaauaugcacuguucaccu

SEQ ID NO: 72378 - RNA, 64 nt, hsa
auguccauuuuuguucccuaauuuauugcuucuaaaaaugcauuauguuuuacaaagauaucua

SEQ ID NO: 72379 - RNA, 64 nt, hsa
uaaucaccuggugaggauuuggcauauccaccaaaaaaugcauccgauuuaaccaacaucucca

SEQ ID NO: 72380 - RNA, 64 nt, hsa
ucccaccuuugugugaguguguaugaaagagaagaaaaugcaauuuuuagguaaucuuuuuuuu

SEQ ID NO: 72381 - RNA, 64 nt, hsa
caauuucuugaacucaggacuagccugaaaauccaaaaugcauguagaguugacauguugacau

SEQ ID NO: 72382 - RNA, 64 nt, hsa
gguggucaagggauaugauuaaguguaguaguagaaaaugcauucuuuuuuuuuuuuuuuuuuu

SEQ ID NO: 72383 - RNA, 64 nt, hsa
uauucuucagauauucaaaaacauuuuuugcuuuaaaaugcauaucuuuaauuggguguugguc

SEQ ID NO: 72384 - RNA, 64 nt, hsa
uuauuuauuuauguuagcauuuaaaaguuuaaaaaaaaugcauuugaccaggauaaaugaggua

SEQ ID NO: 72385 - RNA, 64 nt, hsa
uccauagauagccagcaguggauguuacuccaggaaaaugcaggauuaaaauuguccuugugua

SEQ ID NO: 72386 - RNA, 64 nt, hsa
auaacgugugaaucauuuuuuuaaacugaaauuuaaaaugcaacauaguuuaaucucugauuaa

SEQ ID NO: 72387 - RNA, 64 nt, hsa
gggccacagggcgagacuccgucucaaaaaaaaaaaaaugcacauagcuaucaagugugcuuua

SEQ ID NO: 72388 - RNA, 64 nt, hsa
gucuggccaacaucgugaaacccugucucuacuaaaaaugcaaaaauuagccgggcgugguggc

SEQ ID NO: 72389 - RNA, 64 nt, hsa
ucacuguucccucugcuccuggagccuuugaauaaaaaugcacguagcugaggccggaugcggu

SEQ ID NO: 72390 - RNA, 64 nt, hsa
aggcauuauguauauuuaaaaaauauauucuucaaaaaugcauuuuggcauggugggauggaug

SEQ ID NO: 72391 - RNA, 64 nt, hsa
uggauugccaauuuuuaaaacacuaaaguugaauaaaaugcaugaacaauagaaaaaugcugaa

SEQ ID NO: 72392 - RNA, 64 nt, hsa
aucuugaauauuuucucuuuugccucguaaaaugaaaaugcauucacaguuucuguaaauuauu

SEQ ID NO: 72393 - RNA, 64 nt, hsa
aucucaauuaguucacuuuggccuagauuuaugaaaaaugcaugccucguaaagaguccacugu

SEQ ID NO: 72394 - RNA, 64 nt, hsa
uucugcugaucaggaaauuuaagaauuuaucuuaaaaaugcaaggaaaaaagacugccuuggca

SEQ ID NO: 72395 - RNA, 64 nt, hsa
uccgugagaacacaccacauguuaggacuagaagaaaaugcacaauuuguagggguuuggauga

SEQ ID NO: 72396 - RNA, 64 nt, hsa
aaaauauuuaggauuugaccacacaauggcuaugaaaaugcaaguaguuuccucgcgugaccuc

SEQ ID NO: 72397 - RNA, 64 nt, hsa
uauauuuuacacuccuuggaaacauuugaggaaaaaaaugcaauuugcacuucacuuuguugga

SEQ ID NO: 72398 - RNA, 64 nt, hsa
ucuccuguaguuugaagacacacugacuccugacaaaaugcagccugcaacuuccuggagaaca

SEQ ID NO: 72399 - RNA, 64 nt, hsa
ucauaugugguauuaguuuuaaagggucauuaggaaaaugcacauauuccaugaauuuuaagac

SEQ ID NO: 72400 - RNA, 64 nt, hsa
uuuauuuguaugauauaaaguuauuacuuuaaacaaaaugcaaguauggggggauuguuuauaa

SEQ ID NO: 72401 - RNA, 64 nt, hsa
auuuuaugauggagccucuuacagaaacauuaacaaaaugcaggaaucugccacauuucuuuuu

SEQ ID NO: 72402 - RNA, 64 nt, hsa
aucucuuagauguggaaauauuuuuucgaaccugaaaaugcagcugguagaauuucaauggaag

SEQ ID NO: 72403 - RNA, 64 nt, hsa
auccauguaaaauauauuuuaguugauauuuuguaaaaugcacuuuuuguguguguugauccug

SEQ ID NO: 72404 - RNA, 64 nt, hsa
cuuggagaacuuuucugucuuacaagaggauuguaaaaugcacccaucagugcucuguaaaaca

SEQ ID NO: 72405 - RNA, 64 nt, hsa
ccaaucagcgcucuguagcuagcaauagguuuguaaaaugcacccaucagcacucuguaaaacg

SEQ ID NO: 72406 - RNA, 64 nt, hsa
agcacucuguaaaacgcaccaaucagcacucuguaaaaugcaccaaucagcaggauucuaaaag

SEQ ID NO: 72407 - RNA, 64 nt, hsa
uaucauccgggcuccuuccgggcagaaacaacugaaaaugcacuucagacccacuuauuucugc

SEQ ID NO: 72408 - RNA, 64 nt, hsa
acugggagaauaucacagugguuuuuguuagcagaaaaugcacuccagccucuguacucaucua

SEQ ID NO: 72409 - RNA, 64 nt, hsa
accaaaucccauguuuccuacuguguuaaguuuaaaaaugcauuuauuauagaauugucuacau

SEQ ID NO: 72410 - RNA, 64 nt, hsa
auagccuuaauaugccuuauaucagaggugguacaaaaugcauuugaaacucaugcaauaauua

SEQ ID NO: 72411 - RNA, 64 nt, hsa
aacuauagacagucacuucugcagucccaauuuaaaaaugcagaacugcuuuauccaagaaugc

SEQ ID NO: 72412 - RNA, 64 nt, hsa
uuuuauuccuaagaauaaacaaaccccuacaguuaaaaugcaaagaugccugucaucuaaguau

SEQ ID NO: 72413 - RNA, 64 nt, hsa
aaauacauaccuuauuuuaugcaauaaauuguuuaaaaugcaaggugguuauucugcauacugu

SEQ ID NO: 72414 - RNA, 64 nt, hsa
gaagagcaccggguaaaaagcacaacaugcaguuaaaaugcaacuagaaaacuaauuuuaaaua

SEQ ID NO: 72415 - RNA, 64 nt, hsa
cauuuuuccugauauguagagcagucuguuggcaaaaaugcauauauuuucuuucauauuugua

SEQ ID NO: 72416 - RNA, 64 nt, hsa
cacauggggaugcuuuagggugagucuauaguacaaaaugcauaaaccauguccccaggaaauu

SEQ ID NO: 72417 - RNA, 64 nt, hsa
gaggcuguggcuuuuuauauucaacagccaauaaaaaaugcacaacaugcuaagaucaaagcaa

SEQ ID NO: 72418 - RNA, 64 nt, hsa
ugaguguaugucuauauccugaaauuuauugucuaaaaugcaugaauauauuuuuagcagucug

SEQ ID NO: 72419 - RNA, 64 nt, hsa
gauuaaaaacagaaauauggaaaagcuauguacuaaaaugcauaugaccuugggaauagggaaa

SEQ ID NO: 72420 - RNA, 64 nt, hsa
uaugggaaauucuuauguaauacuauauaucuguaaaaugcaacaaaugaaauccacauguauu

SEQ ID NO: 72421 - RNA, 64 nt, hsa
aaugaguacucagagaucaagauccccaaguaagaaaaugcagaggcucgggcuuguuugaggg

SEQ ID NO: 72422 - RNA, 64 nt, hsa
caagacaucagaacuuauuccucuugucuaacugaaaaugcaugccugaugaccaaacucuccc

SEQ ID NO: 72423 - RNA, 64 nt, hsa
aaaagagcaaaacuccaucuuaaaggaaaaaaaaaaaaugcaaugacuguggcaaacuccucau

SEQ ID NO: 72424 - RNA, 64 nt, hsa
aacgucagagaauuuaugccugagagauuccuugaaaaugcaaugacuggcugggugcaguggc

SEQ ID NO: 72425 - RNA, 64 nt, hsa
cuguguuacuaucuuguuaugaguauguaaaaguaaaaugcaugugaauuuaucauauuugcac

SEQ ID NO: 72426 - RNA, 64 nt, hsa
uuauauugcaguauccuuuaaaagcaaaaaaaaaaaaaugcauuuauauuacaguuuuccucua

SEQ ID NO: 72427 - RNA, 64 nt, hsa
uuuacuuccugcagugaauuugaauaaaugagaaaaaaugcauugucucugguuugaaaugacu

SEQ ID NO: 72428 - RNA, 64 nt, hsa
cacuugcauuagaaccaucuggagcacuuguuuuaaaaugcagauucauaggcagcaucucaga

SEQ ID NO: 72429 - RNA, 64 nt, hsa
ccagcaaugagaaggccaggaaaagaaagagcugaaaaugcagaaagccgaagaguuagaacuu

SEQ ID NO: 72430 - RNA, 64 nt, hsa
cagcaggggaggugagccauacacaggccacgacaaaaugcaggcauuuuauuagggggauaaa

SEQ ID NO: 72431 - RNA, 64 nt, hsa
cugggauuacaggcgugagccaccgcgccuggccaaaaugcagacauuuuauuagggggauaag

SEQ ID NO: 72432 - RNA, 64 nt, hsa
caccagggcagaaaugccgggcacaggccaggacaaaaugcagacuuuuuuuuuuuuuuuuuuu

SEQ ID NO: 72433 - RNA, 64 nt, hsa
aaauuauaauguauucauauuuguacuuucuguuaaaaugcaugauugcagaauuguuuagauu

SEQ ID NO: 72434 - RNA, 64 nt, hsa
ugauaaauauucacacuugaaccauaguuacuguaaaaugcaaaaaaucuuaauacuguuauuc

SEQ ID NO: 72435 - RNA, 64 nt, hsa
uccauucacuauguguugauaaaaaucuuaaccaucccuagaguuuuauauuuccaaaaauaug

SEQ ID NO: 72436 - RNA, 64 nt, hsa
ucaucucauaccuuacauauaagucucaguaguaucccuagagaaauaguguuccucucuuaua

SEQ ID NO: 72437 - RNA, 64 nt, hsa
aguuauucaaugauaacugacaaacuaaauuauuucccuagaaaggaagaugaaaggaguggag

SEQ ID NO: 72438 - RNA, 64 nt, hsa
ggaauggauaaaauauuugugguuuacuggguaaucccuagaugauguaugcuugcaguccuau

SEQ ID NO: 72439 - RNA, 64 nt, hsa
gcucaggcuuuaucagucaggaaauccuuagcccucccuagaggauuggcuguccccucuaucc

SEQ ID NO: 72440 - RNA, 64 nt, hsa
gugguucucgucgagagugcauucacacucuuguucccuagaaagccugggcaccucccacucg

SEQ ID NO: 72441 - RNA, 64 nt, hsa
uguuuuguuuuuuuuuuuuaaugggggacaaaagagagggaaagaccccuauaaaucuauauau

SEQ ID NO: 72442 - RNA, 64 nt, hsa
aacugguuugugggacaggggcagcuugcucaggagagggaauaacgcaggucccuuuucuugg

SEQ ID NO: 72443 - RNA, 64 nt, hsa
aaaguguuuucucagaacagcugaaacauuccgaagagggaauggauggggagaauggucaaua

SEQ ID NO: 72444 - RNA, 64 nt, hsa
ccaggccacuguggccagagcuggaaggcagggcagagggaauguucccugcacccuggaaagg

SEQ ID NO: 72445 - RNA, 64 nt, hsa
ccagcauccucugccuucuaggaagugcccagcaagagggaaagcagaccccuuuagucacucc

SEQ ID NO: 72446 - RNA, 64 nt, hsa
gggcuguggcucagguaauuuuugccauuuggccagagggaaucagagacuacaagcuggacag

SEQ ID NO: 72447 - RNA, 64 nt, hsa
uuugcagauggagaauaggaagggcauuccaggcagagggaaaccugugcagagaccaagaggu

SEQ ID NO: 72448 - RNA, 64 nt, hsa
cacuccugggccugccccagcuccuugcccagggagagggaaagaguuaacggugugggccacu

SEQ ID NO: 72449 - RNA, 64 nt, hsa
agggggaggguuggaaaauuuauuuuuaugaaacagagggaagacuuuauuguuguuauuuuug

SEQ ID NO: 72450 - RNA, 64 nt, hsa
gagccuccacucugggaugccagaauggaaagccagagggaaccugagaaucauccagucuuac

SEQ ID NO: 72451 - RNA, 64 nt, hsa
gugccugauccugcccugggcucagagccagcccagagggaagcaacugcacagccccacaggc

SEQ ID NO: 72452 - RNA, 64 nt, hsa
gaggugaccaggccuggcaguugaaaucucuggaagagggaacauguggggacuacucagaggc

SEQ ID NO: 72453 - RNA, 64 nt, hsa
agaggcauguucuugggcagggcuggcuacggcaagagggaaccaauuccuuuccccuuuaggc

SEQ ID NO: 72454 - RNA, 64 nt, hsa
ggugaugagagauggggagaggccauuggcucccagagggaacagugcuggcuguggcuagaga

SEQ ID NO: 72455 - RNA, 64 nt, hsa
cuacaaaccuaaaaugcugcugccccaaagcacaagagggaagagcaccgccggggccacagga

SEQ ID NO: 72456 - RNA, 64 nt, hsa
ccccuucccacccaccucuggcugaaggugcucaagagggaagcaauuauaagguggguggcag

SEQ ID NO: 72457 - RNA, 64 nt, hsa
gcauugugugauauucucagaggcaggggaaaauagagggaaaaauagagacuauugguauguu

SEQ ID NO: 72458 - RNA, 64 nt, hsa
acuggucaccacuggacgggaaggagaacagaggagagggaaagagaagcccaaccucugugau

SEQ ID NO: 72459 - RNA, 64 nt, hsa
uugggaauggacuggguuuuaaaagggagcuugaagagggaauguuugacagucacagaagguu

SEQ ID NO: 72460 - RNA, 64 nt, hsa
uaccuaaagcuaaaaaaaagcaaggguuugucauagagggaaccucuaaauaauuucaggggua

SEQ ID NO: 72461 - RNA, 64 nt, hsa
ugaaaguguaauacuguugguugaacuaugcugaagagggaaagugagcgauuaguugagcccu

SEQ ID NO: 72462 - RNA, 64 nt, hsa
acaacaguugggcugucaacauucaaagcagcagagagggaacuuugcacuauugggguaugau

SEQ ID NO: 72463 - RNA, 64 nt, hsa
auucugaguuuccaaaaucaaagauuugaccuuaagagggaagggaaaaaagugugaaaggaug

SEQ ID NO: 72464 - RNA, 64 nt, hsa
uaucuuuugccuuuaagacgauucauucuugucuagagggaaaaucuggcugauuugggaauaa

SEQ ID NO: 72465 - RNA, 64 nt, hsa
uuauuucagacgaggcuguaguuuaaauaccaaaagagggaaaauaaaaaagaaccuuuguaaa

SEQ ID NO: 72466 - RNA, 64 nt, hsa
cuccaccccccagguugugaagggcguaacuuuuagagggaacggccacuggagguagagcugg

SEQ ID NO: 72467 - RNA, 64 nt, hsa
auuaaucgguggcauauacugcacauacugaaauagagggaaaucacugaauguaaagagguuu

SEQ ID NO: 72468 - RNA, 64 nt, hsa
uuagagaugagggggcuacagcagcaucaugcaaagagggaaagaugaagggauagaagaagag

SEQ ID NO: 72469 - RNA, 64 nt, hsa
cuuuuagauuugauuauguauacaugacaccuaaagagggaacaaaaguuaguuuuauuuuuuu

SEQ ID NO: 72470 - RNA, 64 nt, hsa
gcuagucagcuaagguaaauuucauuuucaaacgagagggaaacaugggaaguaaaagauuagg

SEQ ID NO: 72471 - RNA, 64 nt, hsa
cgagauagauagccaugucugccuugggcacgggagagggaaguggcagcaugcaugcuguuuc

SEQ ID NO: 72472 - RNA, 64 nt, hsa
gagcgcuggauucguggcacagucugaggcccugagagggaaauccaugcuuuuaagaacuaau

SEQ ID NO: 72473 - RNA, 64 nt, hsa
cauaguguucuccaucucuagugaagacagaaccagagggaauaaggaucuuuuuuuuaaagac

SEQ ID NO: 72474 - RNA, 64 nt, hsa
cuaaacaaaguauaaguuugaaaugaaauggucuagagggaaaugauucaaauuuuuucauaau

SEQ ID NO: 72475 - RNA, 64 nt, hsa
ucuucuggauguuccuacagagggaaagaccuacagagggaaagacccucgggccgcuccccug

SEQ ID NO: 72476 - RNA, 64 nt, hsa
gugcuugcuuccagaaucuucuggauguuccuacagagggaaagaccuacagagggaaagaccc

SEQ ID NO: 72477 - RNA, 64 nt, hsa
guguugacuguccuuucaaggaaaaacuugcaauagagggaaaagccauuaaagcagcucccug

SEQ ID NO: 72478 - RNA, 64 nt, hsa
aaagagugcaggggguugggaggaagcauguaagagagggaacauuuccuuagauguuacccag

SEQ ID NO: 72479 - RNA, 64 nt, hsa
uuguuguuuuacucuaaagcugggaaaggaaaugagagggaaaagaccccggagagggaagaaa

SEQ ID NO: 72480 - RNA, 64 nt, hsa
gcugggaaaggaaaugagagggaaaagaccccggagagggaagaaaaucucaguauuuugaaaa

SEQ ID NO: 72481 - RNA, 64 nt, hsa
acccccaggaacagcuuggcuguuccaccagagcagagggaaucauugcuggacuggauuucuu

SEQ ID NO: 72482 - RNA, 64 nt, hsa
caccaagcaggcaaggcaaggaaggguguugcagagagggaacagcauaugcaaaggcguauca

SEQ ID NO: 72483 - RNA, 64 nt, hsa
ccagaaucucugggacacauucaaagcaguguguagagggaaauuuauagcacuaaaugcccac

SEQ ID NO: 72484 - RNA, 64 nt, hsa
uauuccuucugaaacuauuccaaucaaugggaaaagagggaauccucccuaacucauuuuauga

SEQ ID NO: 72485 - RNA, 64 nt, hsa
uuaagcacaaggucacauucucugugaucacaugagagggaaggugaugacuuaaauggcaggg

SEQ ID NO: 72486 - RNA, 64 nt, hsa
gccagggagcagccacacgucugucuguguuuagagagggaagaggguucuccagguucaccau

SEQ ID NO: 72487 - RNA, 64 nt, hsa
cggggcaggcuuagggcacaguuaggggccaaggagagggaaggccagggccccuguucuaggg

SEQ ID NO: 72488 - RNA, 64 nt, hsa
aagaucacgccauugcacuccagccugggcaacgagagggaaacucuguuucaaaaaaaaaaaa

SEQ ID NO: 72489 - RNA, 64 nt, hsa
cucuucuucuccuuccucuacauuuuaaagggggagagggaaaaguaaccgggagacaaauuga

SEQ ID NO: 72490 - RNA, 64 nt, hsa
gcccucacccaauaugacuggaguccuuaucggaagagggaaauucagacacagaugcauaggg

SEQ ID NO: 72491 - RNA, 64 nt, hsa
ggaagggagcauugcagccuaagaagaaggccagagagggaaaaggcaggugcuuuuggcagag

SEQ ID NO: 72492 - RNA, 64 nt, hsa
agauucagagaaauuuagagcuaaaaaggcccuuagagggaaucuagcccaaccuacauuccac

SEQ ID NO: 72493 - RNA, 64 nt, hsa
ccacccuguuacuuauguagaaacugaggcccagagagggaagaugaccugccccaagugguga

SEQ ID NO: 72494 - RNA, 64 nt, hsa
agugcaauaggacauugugagaaggaauuuuucagggauucaucuacuaguuuaaaaaccccac

SEQ ID NO: 72495 - RNA, 64 nt, hsa
agacugguucugguuggacagcuaaucugauuuggggauucacuguuucagaggacacagacaa

SEQ ID NO: 72496 - RNA, 64 nt, hsa
gcucuccuuugcucucugcagcuguaagccagaggggauucaagguaaauaggcuuuacaggcu

SEQ ID NO: 72497 - RNA, 64 nt, hsa
cucucucuucugagggaagguugguugcaaaagugggauucaugacccucccaggcuacaccau

SEQ ID NO: 72498 - RNA, 64 nt, hsa
gccaccaucagagccucuccccaggugccccccggggauucagggcugaaucugcccaguuccc

SEQ ID NO: 72499 - RNA, 64 nt, hsa
gcccauccuacuucuacccucacuggccuccagugggauucacuccugcccugcccccaccuuc

SEQ ID NO: 72500 - RNA, 64 nt, hsa
cuauauucauaaguucuaaaauccuucauuaugagggauucaaaguauuuauaaaaacacugcc

SEQ ID NO: 72501 - RNA, 64 nt, hsa
uaacacacauugauugagugccugcuggguacaagggauucaauuuaugccuauugauaucugc

SEQ ID NO: 72502 - RNA, 64 nt, hsa
aaagagauaccgguuacauuauuaaaugauucuagggauucacugggggauauuuuuguugcuu

SEQ ID NO: 72503 - RNA, 64 nt, hsa
ugcauggcuggacuggugauuccagggugcagaagggauucauauucccagaacgcuuuaagug

SEQ ID NO: 72504 - RNA, 64 nt, hsa
gcaacagagaaccaucccuauuuuguauugaagagggauucacaucugcaucuuaacugcucuu

SEQ ID NO: 72505 - RNA, 64 nt, hsa
uaaagccuguuuugucuuuuguuguuguucaaacgggauucacagaguauuugaaaaauguaua

SEQ ID NO: 72506 - RNA, 64 nt, hsa
cuucucccagaguuuucuuuggagaacagaaagaagaaaggaaagaaaggaaccagaggcagag

SEQ ID NO: 72507 - RNA, 64 nt, hsa
gaguuuucuuuggagaacagaaagaagaaaggaaagaaaggaaccagaggcagagagacgagga

SEQ ID NO: 72508 - RNA, 64 nt, hsa
uccucuccaucugguguggaaacacugcccagggagaaaggaggaagcucacuguggacagucu

SEQ ID NO: 72509 - RNA, 64 nt, hsa
auugugaagaggaggaaaagugaaucacggagagagaaaggaaaggauagaaucacaggcugcg

SEQ ID NO: 72510 - RNA, 64 nt, hsa
auccagcuauacuuacuugcacaguggauuggagagaaaggauucuccagugugcacacucauc

SEQ ID NO: 72511 - RNA, 64 nt, hsa
cuucacuuuacuacaguuacuuuugcaaacagacagaaaggauacacuucuaaccacauuuuac

SEQ ID NO: 72512 - RNA, 64 nt, hsa
uguaaacagaauaaaauugaacaaauuaggggguagaaaggagcaguggugucguucaccguga

SEQ ID NO: 72513 - RNA, 64 nt, hsa
ugacagccucguggacuaaaguucccagugugggagaaaggagcuaguuugcaauaaaaacagc

SEQ ID NO: 72514 - RNA, 64 nt, hsa
aauaaauaugugccaucagaccaaaaaaaaguagagaaaggagcugaacuccacucucgaugcu

SEQ ID NO: 72515 - RNA, 64 nt, hsa
gcugcaugaguucucgaaaauggugggaaaccuaagaaaggaggagggcuguauucacugaucc

SEQ ID NO: 72516 - RNA, 64 nt, hsa
cacaauggcgauguggugagaaacuccugaaugaagaaaggaaccuugucuuucagggcauaag

SEQ ID NO: 72517 - RNA, 64 nt, hsa
uuuaaaguacuucuuccccuuauccccucaauaaagaaaggaaauccaaauuugaagcaucacu

SEQ ID NO: 72518 - RNA, 64 nt, hsa
uaucuuaguuuaaagggggaaagaaaagggaagaagaaaggaaaagagaaauccaacuccuuuu

SEQ ID NO: 72519 - RNA, 64 nt, hsa
auuugcccuugauucuauuuugcuaauggaagauagaaaggagagaagguuuuuuuuuuuuuua

SEQ ID NO: 72520 - RNA, 64 nt, hsa
ggcaaaagaacuaagacuuuuuucaaacuaaauuagaaaggagugucauuauuugacuguuaaa

SEQ ID NO: 72521 - RNA, 64 nt, hsa
aauauuuuuggugggucuuuuuauggaaguuuaaagaaaggacaucaucauagauaugaucuaa

SEQ ID NO: 72522 - RNA, 64 nt, hsa
gcugggaaaguaaaggcagcacguuacagaaggaagaaaggaagccaguaacugagggcccacu

SEQ ID NO: 72523 - RNA, 64 nt, hsa
uucucuauguaagcagccauggcagucauuaaagagaaaggaguagcuuugacauuaagcuccc

SEQ ID NO: 72524 - RNA, 64 nt, hsa
acaccuuaaguguauacuguuguguaaugucucuagaaaggaauccugucuuaaaacuggguuu

SEQ ID NO: 72525 - RNA, 64 nt, hsa
caguugugcugaggucaauagaguguagaguuucagaaaggauuccagcagguuuauaugugaa

SEQ ID NO: 72526 - RNA, 64 nt, hsa
cauagcgucagagaggauaugucuggcuuccaagagaaaggaggcuccguuuugcaaaguggag

SEQ ID NO: 72527 - RNA, 64 nt, hsa
uauugggguuucccaggauggauuggucagggggagaaaggaaaaggcaaaacacuccaggacc

SEQ ID NO: 72528 - RNA, 64 nt, hsa
ccaucaguuccagccuucucucaaggagaggcaaagaaaggagauacaguggagacaucuggaa

SEQ ID NO: 72529 - RNA, 64 nt, hsa
uaaauaaauaaauaaauaaaaacaaaguugauuaagaaaggaaguauaggccaggcacaguggc

SEQ ID NO: 72530 - RNA, 64 nt, hsa
gagcugaucccuacguccgugucuacuuguugccagaaaggaagugggcaugucguaagaagac

SEQ ID NO: 72531 - RNA, 64 nt, hsa
agugaaaaauaguaggccacuuggcucacacagaagaaaggaguuaggaaaaguaaguacaaga

SEQ ID NO: 72532 - RNA, 64 nt, hsa
cuagggaaaaugaaggaaguaccacaaacuggcuagaaaggagcuuaucaaucaccagugagga

SEQ ID NO: 72533 - RNA, 64 nt, hsa
aaaucccauucacacauggccaggcuauccaaaaagaaaggagccauguucucaugugguuuac

SEQ ID NO: 72534 - RNA, 64 nt, hsa
cuccucagucccaguuucugaaaggacucagcugagaaaggacaacuggguuccgcuuuccuua

SEQ ID NO: 72535 - RNA, 64 nt, hsa
uuuauaauccuuaaugugaggcuaagguauaaggagaaaggagauugguaaggaagugugauac

SEQ ID NO: 72536 - RNA, 64 nt, hsa
cuucuuacugugcuaugcauuuuauugagaguacagaaaggaagaggaaccuuuuuuuaaucac

SEQ ID NO: 72537 - RNA, 64 nt, hsa
uuuuuaaucacuuguuuuguuuugacuauagauaagaaaggacuacagcauuugaugugugucc

SEQ ID NO: 72538 - RNA, 64 nt, hsa
uaaaaucuaacguugaguaaaugugauagugaugagaaaggaauuuuguguacuguaaccuugc

SEQ ID NO: 72539 - RNA, 64 nt, hsa
cuccuuccggccccacugggguccaggggugcccagaaaggagcuuccccugccugccugaguc

SEQ ID NO: 72540 - RNA, 64 nt, hsa
acagggagcucagaccccaacccuggaucccaggagaaaggaguggaccgaggaaggaaggaag

SEQ ID NO: 72541 - RNA, 64 nt, hsa
cucccaggcugauccuuuauucagaauaccacaaagaaaggacauucagcucaaggcucccugc

SEQ ID NO: 72542 - RNA, 64 nt, hsa
caagccaagccuuaaguguggaauucggauugauagaaaggaagacuaacguuaccuugcuuug

SEQ ID NO: 72543 - RNA, 64 nt, hsa
gcugagccuugguuaaaccagggagaaggggagcagaaaggaaacguuguuacugaugaguacc

SEQ ID NO: 72544 - RNA, 64 nt, hsa
aauuuucuaaauauuuugauaucaauuuggguaaagaaaggaauacuuuuguuagaaugagaau

SEQ ID NO: 72545 - RNA, 64 nt, hsa
cuaacuuugaaaagaccgcuguucauaaggagagagaaaggaggaagagaugagaaaggaagac

SEQ ID NO: 72546 - RNA, 64 nt, hsa
cuguucauaaggagagagaaaggaggaagagaugagaaaggaagacagagaaagaaacucuaug

SEQ ID NO: 72547 - RNA, 64 nt, hsa
ccucccuuccgcuccugcccagccugggggaaggagaaaggaggggagaaagcgggcucucacc

SEQ ID NO: 72548 - RNA, 64 nt, hsa
uacgccaccuucuggacacucccuccuugagggcagaaaggagucccaggccugucccuaggga

SEQ ID NO: 72549 - RNA, 64 nt, hsa
gagugggugugauuuuuguuuuguuuugagguuuagaaaggagacuguacuuugaaaauggauc

SEQ ID NO: 72550 - RNA, 64 nt, hsa
ccuagccugugugccauuucauggcagauauguaagaaaggaaauggcccuacuguagacagcu

SEQ ID NO: 72551 - RNA, 64 nt, hsa
uagcccauuucuguuaaccucuuaucacuaagaaagaaaggaaagaaggagaugaauagaagaa

SEQ ID NO: 72552 - RNA, 64 nt, hsa
uuuuuaaaccacagucuggagugauagcuacuguagaaaggaaauagacuuuguaugaacucuu

SEQ ID NO: 72553 - RNA, 64 nt, hsa
uuaguaggucuuugguuuugauggcacacuauggagaaaggacacacugguuuuaaucuguaga

SEQ ID NO: 72554 - RNA, 64 nt, hsa
uuggagucuagaggauauucuugccucauaaagaagaaaggaccaagaaaaccaaaacggaaga

SEQ ID NO: 72555 - RNA, 64 nt, hsa
uucuuuuaaaacuugaauauaggugggagacauaagaaaggaaagaaaagacuuaaaacuggag

SEQ ID NO: 72556 - RNA, 64 nt, hsa
gaggcuuuucuauauacuucucagagcacugaaaagaaaggaaggguuugcagaggagagugua

SEQ ID NO: 72557 - RNA, 64 nt, hsa
acauucccauuccagaaaggagaaacaggaaagaagaaaggaguaacaaguuucaagcaacucc

SEQ ID NO: 72558 - RNA, 64 nt, hsa
gguuggagaggcauaggauaaacauucccauuccagaaaggagaaacaggaaagaagaaaggag

SEQ ID NO: 72559 - RNA, 64 nt, hsa
cuuuggcuuccugcuguuggggguggaaaagacuagaaaggacauugcuuucucagccccaccc

SEQ ID NO: 72560 - RNA, 64 nt, hsa
agcacucaccuagagcugucugugccucucugggagaaaggagagaggauaagaagggaaaguu

SEQ ID NO: 72561 - RNA, 64 nt, hsa
ccccaucagacucuggacacccaggaaucaaaagagaaaggacuuuuuuggugacucaauccca

SEQ ID NO: 72562 - RNA, 64 nt, hsa
ggaagaagaaugauggauuccuuuuggaucaaucagaaaggaaacacgaaagaaaagucaggaa

SEQ ID NO: 72563 - RNA, 64 nt, hsa
gugcucuggggaugaggcauggguauaggaagggagaaaggaguuggagacaagauccucuuca

SEQ ID NO: 72564 - RNA, 64 nt, hsa
gguuaggcugagcucccagcaggacaccgccugcagaaaggaccugcccugauaaugucccuuc

SEQ ID NO: 72565 - RNA, 64 nt, hsa
ucuuuugccaauuccacuaauuguuugggugaagagaaaggaaguacagaaaacaugcagaaag

SEQ ID NO: 72566 - RNA, 64 nt, hsa
gagaaaggaaguacagaaaacaugcagaaagcacagaaaggaaaaccaagguucucaugaaucu

SEQ ID NO: 72567 - RNA, 64 nt, hsa
aggacaggagcugucuggagcuccaccuuugcaaagaaaggaaaaacacaaauugcccccagau

SEQ ID NO: 72568 - RNA, 64 nt, hsa
acucuucuaagucccacucgugaauggcaauuagagaaaggacugacaguggcggugccccaua

SEQ ID NO: 72569 - RNA, 64 nt, hsa
cagaggaauuuuuuuuguuuuguuuugucuuuuaagaaaggaaagaaaggaugaaaaaaauaaa

SEQ ID NO: 72570 - RNA, 64 nt, hsa
uuuuuuuguuuuguuuugucuuuuaagaaaggaaagaaaggaugaaaaaaauaaacagaaaacu

SEQ ID NO: 72571 - RNA, 64 nt, hsa
guuucaaucacuguccuccacacaagggaaggacagaaaggagaguggccauucuuuuuuucuu

SEQ ID NO: 72572 - RNA, 64 nt, hsa
cagcccauccauaguaacugacaugauuagcagaagaaaggaacauuuaggggcaagcaggcgc

SEQ ID NO: 72573 - RNA, 64 nt, hsa
ccugguggcucguggaggaaaccagcuuucuaugagaaaggacugaaggauugcgcacccugca

SEQ ID NO: 72574 - RNA, 64 nt, hsa
uaguagccacaucuuguucaucacauagacuaauagaaaggaggcuguggcuaaagcagaaaug

SEQ ID NO: 72575 - RNA, 64 nt, hsa
augaaagacaaagaaggaaaagaguaucaaaggcagaaaggagaucauuuaguugggucugaaa

SEQ ID NO: 72576 - RNA, 64 nt, hsa
uaacauuacugccuucaguaucaaggcugccuggagaaaggauggcagccucagggcuuccuua

SEQ ID NO: 72577 - RNA, 64 nt, hsa
uugucucagggugggaagugggaggguggggcgaagaaaggauuacaccagaagauuuaggaug

SEQ ID NO: 72578 - RNA, 64 nt, hsa
aucuaccuauuacucccagcauugauugacuauaagaaaggaugcaccuguacucucugcucua

SEQ ID NO: 72579 - RNA, 64 nt, hsa
uugucucagggugggaagugggagggcagggcaaagaaaggauuagaccagaggauuuaggaug

SEQ ID NO: 72580 - RNA, 64 nt, hsa
ucugccuguuacuucccagcauugacugacuauaagaaaggacacaucuguacucugcucugca

SEQ ID NO: 72581 - RNA, 64 nt, hsa
acuauauacuacagcagaaugacucagauuucauagaaaggagcaaccaaaaugucacaaccca

SEQ ID NO: 72582 - RNA, 64 nt, hsa
uugguuuuaugaauacaaagauaagugaaaagagagaaaggaaaagaaaaaggagaaaaacaaa

SEQ ID NO: 72583 - RNA, 64 nt, hsa
acuaggugacccggaugcugacaucugcugcugcagaaaggaagacuuuucauuguaauuucgc

SEQ ID NO: 72584 - RNA, 64 nt, hsa
gucuucucccaucauugcccugcugugacuccaaagaaaggagcuucuugcugacagugcccug

SEQ ID NO: 72585 - RNA, 64 nt, hsa
uaacagcaaaaaaaaaaaaaaaaaaaagagagaaagaaaggaguaaacagugguaauaaaaaaa

SEQ ID NO: 72586 - RNA, 64 nt, hsa
agcuaaaugacaaaacacagcaguguuuugagggagaaaggaccaucauuuauaaugcucugua

SEQ ID NO: 72587 - RNA, 64 nt, hsa
ucaggcaagagaaagaaauaaaaggcaaccaaaaagaaaggaagucgaaguaucucuguuugca

SEQ ID NO: 72588 - RNA, 64 nt, hsa
agucagggaaucaaacuaaauguccaucagugguagaaaggauaaagaaaaugugguggcaggg

SEQ ID NO: 72589 - RNA, 64 nt, hsa
ccugcaggguguggggaaggaggacacaaccucaagaaaggaagcgugaaccccagggaacagc

SEQ ID NO: 72590 - RNA, 64 nt, hsa
cuaccacccauccaaccuuugggccuaugugaaaagaaaggaacuaagcuggguguguucuguc

SEQ ID NO: 72591 - RNA, 64 nt, hsa
ggaaaaaagaaauugggaggguacaggcaacaggagaaaggaaucaaaccacagaaaaauacaa

SEQ ID NO: 72592 - RNA, 64 nt, hsa
auuauuuuuucauuguuaaauaggcaacaugaccagaaaggauggaauggcuuaaguaaacuaa

SEQ ID NO: 72593 - RNA, 64 nt, hsa
ggaaggaaucauuguuccaggcauccaucuuggaagaaaggaccagcuuugagcuccaucaagg

SEQ ID NO: 72594 - RNA, 64 nt, hsa
ccaggaacugucauggauguccaaauggcuuugcagaaaggaaaugagaugacaguauuuaauc

SEQ ID NO: 72595 - RNA, 64 nt, hsa
cacccauuuuuaagcugguuuucuccugauaagaagaaaggaagaaagccccagacgcuugguu

SEQ ID NO: 72596 - RNA, 64 nt, hsa
auaaaccgagcuuuaaaggauaaaguguuaauaaagaaaggaagcugggcacaugucaaaaagg

SEQ ID NO: 72597 - RNA, 64 nt, hsa
caaaaagggagaucgaaauguuagguaaucauuuagaaaggacagaaaauauuuaaaguggcuc

SEQ ID NO: 72598 - RNA, 64 nt, hsa
uucauucaaagcuuuagaugugucccauguggcaagaaaggagacagugaauuuugucaaacaa

SEQ ID NO: 72599 - RNA, 64 nt, hsa
acaucagcauaugagaaucucugagagguccucuagaaaggagagaaaaagcaccucuuuuggc

SEQ ID NO: 72600 - RNA, 64 nt, hsa
aguugaaaguuucaaaaacuuugguucaaucugaagaaaggaagcuugaacuguuuguucuugg

SEQ ID NO: 72601 - RNA, 64 nt, hsa
aaaaagacccagccaacugucauuaacaacuugaagaaaggagcuguugaagaugugauuucaa

SEQ ID NO: 72602 - RNA, 64 nt, hsa
gguuaaguuuaauuuucucugggggcaugaucucacaaagaauacucaagucuuuuucuucuua

SEQ ID NO: 72603 - RNA, 64 nt, hsa
gggaaguauacaagcagagccaguucugguacaaacaaagaauuugacagggacaauggaaggg

SEQ ID NO: 72604 - RNA, 64 nt, hsa
aauuuaaucaauugcaaagcaauuauauaaaaccacaaagaauguacugaaccuacuaacccuu

SEQ ID NO: 72605 - RNA, 64 nt, hsa
cuucuuaauucaacccauaaucauuaaguacuuaacaaagaauauuuuacaagugauaguauuu

SEQ ID NO: 72606 - RNA, 64 nt, hsa
ggcgucuuagaacucccuggcuuauauagcaucgacaaagaacaguaaauuuuuagagaaacaa

SEQ ID NO: 72607 - RNA, 64 nt, hsa
acaaagaacaguaaauuuuuagagaaacaacaaaacaaagaaaaagagcuuugagucuguaggg

SEQ ID NO: 72608 - RNA, 64 nt, hsa
agagagaacgaauguuagccacaugcccaaguuaacaaagaaaaaauguucucaagguuguccu

SEQ ID NO: 72609 - RNA, 64 nt, hsa
aaauuacacaacuuugaacugacacggaucucuuacaaagaacaaugcggcacugaaggaagag

SEQ ID NO: 72610 - RNA, 64 nt, hsa
uguuuguccuuaggauaggccuaugugcuagcccacaaagaauauugucucauuagccugaaug

SEQ ID NO: 72611 - RNA, 64 nt, hsa
ucagcaaaagggucuaccuuuaaaauaagcaauaacaaagaagaaaaccaaauuauuguucaaa

SEQ ID NO: 72612 - RNA, 64 nt, hsa
ugguggacucuucuaagaauacaguuugcuagucacaaagaauagucuacaaauaugcuuugcu

SEQ ID NO: 72613 - RNA, 64 nt, hsa
ugaaaauacuugauuugcucuuauuuuguagaagacaaagaaguauguaauugucacuugguuc

SEQ ID NO: 72614 - RNA, 64 nt, hsa
accacugauugguauguucaacaaauuuguguauacaaagaaauggauaaaucacugcuauaua

SEQ ID NO: 72615 - RNA, 64 nt, hsa
uauuuuuuuuuuacuauagagugagggguuguuaacaaagaauauauauuggucauucuuacaa

SEQ ID NO: 72616 - RNA, 64 nt, hsa
agcugugcuguuuagaaacaacaucucagacuuuacaaagaaaugacaaagaaggcaauugcac

SEQ ID NO: 72617 - RNA, 64 nt, hsa
uuagaaacaacaucucagacuuuacaaagaaaugacaaagaaggcaauugcacuuuuuaaggga

SEQ ID NO: 72618 - RNA, 64 nt, hsa
aacaacacuaacaaacucucccuugacuagggggacaaagaaaagcaaaacugaccauaaaaaa

SEQ ID NO: 72619 - RNA, 64 nt, hsa
gggaaauuuccccaaaucagaaaaucacauccuaacaaagaagucugucuaagacaguacaucu

SEQ ID NO: 72620 - RNA, 64 nt, hsa
uuagcaaaggcucaugcugaaauuugccaguaaaacaaagaaguuuaaagacuggcagguacac

SEQ ID NO: 72621 - RNA, 64 nt, hsa
aaaaaagaaaaaaaagaaaaaaaggaaaagaagaacaaagaaacaugacugucucaaagaguaa

SEQ ID NO: 72622 - RNA, 64 nt, hsa
augcauuucauauagcuuuuucauuuaaaacaagacaaagaaacaaauuccuaugaccaaauug

SEQ ID NO: 72623 - RNA, 64 nt, hsa
acugccuuugccagcauccuaaaucuggaguuuuacaaagaaggaaacuguaucuuuagguuaa

SEQ ID NO: 72624 - RNA, 64 nt, hsa
ugaaagucuggccaacagagcaguagaugauauaacaaagaaagcaugcuuucugaggagauag

SEQ ID NO: 72625 - RNA, 64 nt, hsa
ccuugaaaauguuuauuuaaaaaaaaaaaagaugacaaagaaaaacagagagagagaauauugg

SEQ ID NO: 72626 - RNA, 64 nt, hsa
aaacaggaacccaccaaaccaaccaaucaaccaaacaaagaaaaaauuccacaaugaaagaaug

SEQ ID NO: 72627 - RNA, 64 nt, hsa
uaucaucuauauaacuucaaaguaugauguuuauacaaagaauccuuauuucagucuagcagcu

SEQ ID NO: 72628 - RNA, 64 nt, hsa
cuguaaaauguucuaagauaaaaaaacucgagcuacaaagaaagaaugaacuaauucuuuacaa

SEQ ID NO: 72629 - RNA, 64 nt, hsa
aaacacaucuucuucaaauguuuauaucagagaaacaaagaacuagagaagaaaucuuaaaugu

SEQ ID NO: 72630 - RNA, 64 nt, hsa
gaagguccugcuauuacuaaggaguaaucuguguacaaagaaauaacaagucgaugaacuauuc

SEQ ID NO: 72631 - RNA, 64 nt, hsa
ugcuauccauuucucauguuuuccauuguuugaaacaaagaagguuaccaagaagccuuuccug

SEQ ID NO: 72632 - RNA, 64 nt, hsa
auuaaaauuauaucacaaauauauaugcuuccagacaaagaaaaguuuguuaguccugauuuuc

SEQ ID NO: 72633 - RNA, 64 nt, hsa
gcccuccucuugcacuuggguucugacucccagaacaaagaacuugggagaacaguacgggaga

SEQ ID NO: 72634 - RNA, 64 nt, hsa
uauuuuuguugcuuuuacuuucaugguuagagcuacaaagaacagugauuuuuuuuuuuucucc

SEQ ID NO: 72635 - RNA, 64 nt, hsa
ggaaagcagaacugaaguuagcuuaagcauaaaaacaaagaaaaaucuucgcuuuucauguaug

SEQ ID NO: 72636 - RNA, 64 nt, hsa
aacuugcauuagaaaaaaaagagauauauacaccacaaagaaucuaauaagaaauuuauuaugg

SEQ ID NO: 72637 - RNA, 64 nt, hsa
auggagauauagcccuuaaaaugcaauauuaagaacaaagaaauagaaaaugguuuagauaucu

SEQ ID NO: 72638 - RNA, 64 nt, hsa
uuuaagguagcccucucaucgucuuuuaguuccaacaaagaaaggugccaugucuuuacuagac

SEQ ID NO: 72639 - RNA, 64 nt, hsa
aaguuguaaaaugucaagaaauucugcuguuacgacaaagaaacauuuuacgcuagauuaaaau

SEQ ID NO: 72640 - RNA, 64 nt, hsa
uucuagaaaccuguuauaauugccagcugucuacacaaagaauaugcaggccagaagaaaaguu

SEQ ID NO: 72641 - RNA, 64 nt, hsa
caucacauccccgaugcuaaauuaaaaacagaaaacaaagaaaagcuuguauauacuuugccac

SEQ ID NO: 72642 - RNA, 64 nt, hsa
aaacuguauaaagggauugguagucaaaacauguacaaagaaauaccuguaaaacuguuuuguc

SEQ ID NO: 72643 - RNA, 64 nt, hsa
uacuguguuggacauauuauuuagacuuagucauacaaagaaacuuagcucuuuuuucaucuca

SEQ ID NO: 72644 - RNA, 64 nt, hsa
aacguaccccccucaggugagaggggacugcuguacaaagaauauaggaaggccucuagacuac

SEQ ID NO: 72645 - RNA, 64 nt, hsa
ucacaauaacaaggcugauuucagaugucucaccacaaagaaggaggauaagggagcgagguga

SEQ ID NO: 72646 - RNA, 64 nt, hsa
auuacagaggaggugugaagcagcugaagggucggucaucuauuucccagacacaggaaaacua

SEQ ID NO: 72647 - RNA, 64 nt, hsa
uuuuuuuuuucaaaaacuuuggauuuggcauauagucaucuauagggggauugguuccaggauc

SEQ ID NO: 72648 - RNA, 64 nt, hsa
ucaccacugucacaggaagaaccugccaagcuuggucaucuaugacgccacaucagcacaguag

SEQ ID NO: 72649 - RNA, 64 nt, hsa
ucaccaccgucacaggaagcacuugccaagcuuggucaucuaugacaccacaccagcacaguag

SEQ ID NO: 72650 - RNA, 64 nt, hsa
cauuuuuuuccugauauuuccaccacuuuucagagucaucuacaaaauuuuucuuuccucaaga

SEQ ID NO: 72651 - RNA, 64 nt, hsa
ugauaaggcuguauguuucuggaacaaaauauuggucaucuaaaaacuuucuguuuucuggggu

SEQ ID NO: 72652 - RNA, 64 nt, hsa
acauuauuucauaaaauaagaauuuguucuguguuaucuaaagauguaucaguauauugucaca

SEQ ID NO: 72653 - RNA, 64 nt, hsa
uaaaagccacaggggacaguuaaauaucuuaaaauaucuaaaacauuuuuuaaagcacuuagau

SEQ ID NO: 72654 - RNA, 64 nt, hsa
gaacuguaaaaucccuuggucauucauaaauaaauaucuaaauuaggaauacuaauuaauugaa

SEQ ID NO: 72655 - RNA, 64 nt, hsa
auguuuuaauugccaaccgugugaaacaacaaaauaucuaaaaacuaaucccgauuugaacaau

SEQ ID NO: 72656 - RNA, 64 nt, hsa
aucagaaaaaaaguccauauggacuguggauaccuaucuaaaagaagaaaacugauggcuaagu

SEQ ID NO: 72657 - RNA, 64 nt, hsa
ucccgucucgggggcuuaaaaaaaaaaaaugcuguaucuaaaugaaucuguguaauugggccca

SEQ ID NO: 72658 - RNA, 64 nt, hsa
acucaucuuuuuuuaaaaaccgaauuucaucauuuaucuaaagagaaaauaugcagaauaacug

SEQ ID NO: 72659 - RNA, 64 nt, hsa
caguaggugccucuguaccaaauauuuuauggaauaucuaaauacuaaaauaaacuaugaauga

SEQ ID NO: 72660 - RNA, 64 nt, hsa
caccugucuuucacuuuuugagacagacugaauauaucuaaaauuuccagcaauaaaaaaaaaa

SEQ ID NO: 72661 - RNA, 64 nt, hsa
uuuuucacuugguuagcuaaagaagauguaaaaauaucuaaaauaauguucauggugaaucuua

SEQ ID NO: 72662 - RNA, 64 nt, hsa
uaaauaaaacuggaaaaaaauuucuggaaguuuauaucuaaaaauguuaauagugcguaccucu

SEQ ID NO: 72663 - RNA, 64 nt, hsa
aacagggaagggguuggggacaggucugccaaucuaucuaaaagccacaauauggaagaaguau

SEQ ID NO: 72664 - RNA, 64 nt, hsa
aaaaaucauguauacccucacccaucuaaguugauaucuaaaauuuuaucuaaguugguaucua

SEQ ID NO: 72665 - RNA, 64 nt, hsa
ucuaaguugauaucuaaaauuuuaucuaaguugguaucuaaaauuuuucaugggaaguuaaaua

SEQ ID NO: 72666 - RNA, 64 nt, hsa
uuguuacuauuauuccuuugaaaaaaagacaaaauaucuaaaaaauguuuauaguguucaugua

SEQ ID NO: 72667 - RNA, 64 nt, hsa
uucuucccucaaaauuuucauggacaugcaaucuuaucuaaaagccugcuucagggcugggcgc

SEQ ID NO: 72668 - RNA, 64 nt, hsa
auauaguugaauuucuuuaaaaaguuuucuauuuuaucuaaaaucuuuccauuauaucuaaauu

SEQ ID NO: 72669 - RNA, 64 nt, hsa
aaaguuuucuauuuuaucuaaaaucuuuccauuauaucuaaauuagaaugaucauccugcgcaa

SEQ ID NO: 72670 - RNA, 64 nt, hsa
guaacacagugcuaaguauuuguguaucuaaacauaucuaaacauagaaaagguacaguaaaaa

SEQ ID NO: 72671 - RNA, 64 nt, hsa
guaggcgguuguaacacagugcuaaguauuuguguaucuaaacauaucuaaacauagaaaaggu

SEQ ID NO: 72672 - RNA, 64 nt, hsa
aauuuaaauuaggguugguauuucauuuuuuucuuaucuaaaucuuaguuuccuggaauaauaa

SEQ ID NO: 72673 - RNA, 64 nt, hsa
ggucuggauacgaaguuuacaguuucauaccaacuaucuaaaaccuaauugcaaauugaccaca

SEQ ID NO: 72674 - RNA, 64 nt, hsa
gaccucaguuccuggaggggggaaagggugaaagagaaaccacguauuuuguuauuauuuugga

SEQ ID NO: 72675 - RNA, 64 nt, hsa
auuauuuuggauuauuuuuuaucgaagagaucauagaaaccagagccuucuccccaggccugcc

SEQ ID NO: 72676 - RNA, 64 nt, hsa
uccucugaaggccgggacccagucauacauccuuagaaaccaaaguaugguuuuuguuuucucu

SEQ ID NO: 72677 - RNA, 64 nt, hsa
ccagccugggcaacagagcaagacccugucuuggagaaaccagaauuuuggaagagcaaauggg

SEQ ID NO: 72678 - RNA, 64 nt, hsa
aaggauggagaaaaaucugggacagugucuucucagaaaccaccagccuugacgguaaugaaac

SEQ ID NO: 72679 - RNA, 64 nt, hsa
aaggauggagaaauaucuaggaaagugucuucucagaaaccaccaaccuugaagguaaugaaac

SEQ ID NO: 72680 - RNA, 64 nt, hsa
uucucagaaaccaccaaccuugaagugucuucugagaaaccaccaggcuugaagguaaugaaac

SEQ ID NO: 72681 - RNA, 64 nt, hsa
aaggauggagaaauaucuaggaaagugucuucucagaaaccaccagccuugaagguaaugaaac

SEQ ID NO: 72682 - RNA, 64 nt, hsa
aaggauggagaaaaaucuaggacagugucuucugagaaaccaccaggcuugaagguaaugaaac

SEQ ID NO: 72683 - RNA, 64 nt, hsa
cauugagaggugauuuaguuuauauguuuuuggaagaaaccauuaauguuuaauuuaaucuuaa

SEQ ID NO: 72684 - RNA, 64 nt, hsa
agccuuaaggcugaugcaguuuacuuacaaguuuagaaaccagaaugcuuuguuuuuaccagau

SEQ ID NO: 72685 - RNA, 64 nt, hsa
uaauguuucuuaaaaguuuuugagaaaaaaaggaagaaaccaacucauucagaaggcucggauu

SEQ ID NO: 72686 - RNA, 64 nt, hsa
aagauuccugauguugcacccauuguaagugaucagaaaccaucuguaucaaagucuggacgga

SEQ ID NO: 72687 - RNA, 64 nt, hsa
uuguaguaaauaaguucaaggggaacuugggaccagaaaccacuguuauguacaaaaaaauggc

SEQ ID NO: 72688 - RNA, 64 nt, hsa
auuauguucuguuaaugggaauuuaacauauuuaagaaaccaauauuuaaaauguuggucuagg

SEQ ID NO: 72689 - RNA, 64 nt, hsa
ucagaagacucacuuuucuuucuuucuuggauagagaaaccauuuucugacacuagguuuacaa

SEQ ID NO: 72690 - RNA, 64 nt, hsa
caguuuuacuacauucugguguuuggccuauaugagaaaccaucuucucacagauuaagggcua

SEQ ID NO: 72691 - RNA, 64 nt, hsa
cuuuggggcagagacuuggcaucuucgcaguuuaagaaaccacguuuccuauccaauccgaagg

SEQ ID NO: 72692 - RNA, 64 nt, hsa
ccugaccuacccauaacucccugcuaggcuaaguagaaaccagguuauuucucccugcuuaugg

SEQ ID NO: 72693 - RNA, 64 nt, hsa
ucagacuggugauaucgugauguaccuaaaagucagaaaccacauuuucuccucagaaguaggg

SEQ ID NO: 72694 - RNA, 64 nt, hsa
acauuaaguaaaauaaaauggaccagaaaagaaaagaaaccauaaauaucgugucauauuuucc

SEQ ID NO: 72695 - RNA, 64 nt, hsa
ucuugggugggcccugaacaaagccaaaaauuguagaaaccagucuagaaaaaguccugcucau

SEQ ID NO: 72696 - RNA, 64 nt, hsa
uuguccacagauguacuggccauuacaugaaacaagaaaccaagcaucuuugcuguuguuaauu

SEQ ID NO: 72697 - RNA, 64 nt, hsa
gcaagggcagugcguggaaaggccggggaggugcagaaaccagagcccagggcaauggugucug

SEQ ID NO: 72698 - RNA, 64 nt, hsa
cacacccaccagugcagccugaaguaacucccacagaaaccaucaucgucuuuguacaucguau

SEQ ID NO: 72699 - RNA, 64 nt, hsa
cacuuggccucacuaccagaagaaggguggagucagaaaccaaagugaccuccagagcuguccu

SEQ ID NO: 72700 - RNA, 64 nt, hsa
agagcaaauauuguucuucccauuuuacagauucagaaaccaaggcuaagggacuggucuaaag

SEQ ID NO: 72701 - RNA, 64 nt, hsa
uauugcacauuagagaauugguccuggaagggaaagaaaccacagauuuuauuucaguacacaa

SEQ ID NO: 72702 - RNA, 64 nt, hsa
uuuaguaguguuugguauguuuuaugugucugguagaaaccauauuuugguuaacagcaagaaa

SEQ ID NO: 72703 - RNA, 64 nt, hsa
aauguucugauuacaucacugauugguaaugguuagaaaccauuaaccuaaaacuuacuauuua

SEQ ID NO: 72704 - RNA, 64 nt, hsa
uuaaugucuuaaguaagugcuuaauuuggaauagagaaaccaguauauuuuaaaaaagaaaaau

SEQ ID NO: 72705 - RNA, 64 nt, hsa
ccgccagcugauuggaugucuaggaaugacugaaagaaaccaaaacagccuguccacugcugcu

SEQ ID NO: 72706 - RNA, 64 nt, hsa
cuuccgccccuggcagggacuucuggguuaugggagaaaccagagaugggaaugaggaaaauau

SEQ ID NO: 72707 - RNA, 64 nt, hsa
agcaacggcuauuaaaugucacaauccuuuaauuagaaaccauuuauuggccggacgcgguggc

SEQ ID NO: 72708 - RNA, 64 nt, hsa
agcgagacuccgucucaaaaaaaaaaaaaaaaaaagaaaccauuuauuuuaaaaaugauuagau

SEQ ID NO: 72709 - RNA, 64 nt, hsa
cugcaucaauaccaaacauggggguuugguaaugagaaaccaggacaggccaucugcagugacc

SEQ ID NO: 72710 - RNA, 64 nt, hsa
ccuugcccuggggccgguucuuacccagguccagagaaaccaacgcgggaugucagacuucacc

SEQ ID NO: 72711 - RNA, 64 nt, hsa
gagaucccuuuucuuaaaaaaggcucaacccaaaagaaaccauuucuuaaaaaauuuuacauag

SEQ ID NO: 72712 - RNA, 64 nt, hsa
ggcccagcauucagggaggagucguaagaucuuaagaaaccaauccuugccucaagcaaaagca

SEQ ID NO: 72713 - RNA, 64 nt, hsa
guuuuacuggcaguucuauaguaguccagacuuuagaaaccaaacacaacaaaauggcuuguug

SEQ ID NO: 72714 - RNA, 64 nt, hsa
aauuguucauguuguuuggaugguaucgaaaaccagaaaccacuuuuaauaauguguuuaagau

SEQ ID NO: 72715 - RNA, 64 nt, hsa
agagaacacauaaaugauuuuggcauaccauuagagaaaccauuuguaaaacucaaaugaccac

SEQ ID NO: 72716 - RNA, 64 nt, hsa
ggcggcccaggcugaagccaucuccgggugucugagaaaccacccagugccucaccuccagauc

SEQ ID NO: 72717 - RNA, 64 nt, hsa
aagaccuguccaccuguagcuccgcucauuucuuagaaaccaccugcuucccagagugccaagc

SEQ ID NO: 72718 - RNA, 64 nt, hsa
cauuucaacauagagucacauaaaugucccccugagaaaccaaucccacuucuuucuaggagau

SEQ ID NO: 72719 - RNA, 64 nt, hsa
ggguuggggguagagguuuugggaugucuuaguuagaaaccagauuaauagaagaguaggccug

SEQ ID NO: 72720 - RNA, 64 nt, hsa
ucagggagguguggacuggaugaggaaacuagcuuuccgcuaccggaaagugagagaaaucuau

SEQ ID NO: 72721 - RNA, 64 nt, hsa
aguguucaauuagcaggcugauuucuuuuuccucuuccgcuaguugugaaagacaggggaaggg

SEQ ID NO: 72722 - RNA, 64 nt, hsa
ucaccuguugaacacuuugcugcuuagaaauuucuuccgcuaguuaaccuaaaucaucucucuc

SEQ ID NO: 72723 - RNA, 64 nt, hsa
uauuauuuacacugaauuccaauuucauuucugcuuccgcuaaguaagagcaccucauuccugu

SEQ ID NO: 72724 - RNA, 64 nt, hsa
cuuucuucaauaucuauaggcuauugguuuucaguuccgcuauugcuaagcauuguuucccugg

SEQ ID NO: 72725 - RNA, 64 nt, hsa
caguccaagugugcaacagcuguucugaauugucuuccgcuagccaagaaccuauauggccuuc

SEQ ID NO: 72726 - RNA, 64 nt, hsa
ccaagaugaugaguucagccuuuaucccucgugguuccgcuagauguaacuuauaggaguuaac

SEQ ID NO: 72727 - RNA, 64 nt, hsa
cucuucuccauuugccucuuccuuccuauuucccuuccgcuaaggaaaaaaauuggugucacau

SEQ ID NO: 72728 - RNA, 64 nt, hsa
aucuuugcagugaauuaugcuuugcuuuaaaacauuccgcuaaaaucauaaugggacauauaaa

SEQ ID NO: 72729 - RNA, 64 nt, hsa
cacccccugcuacucuccuccacacaccccuccguuccgcuagccuacccugucagccuuucaa

SEQ ID NO: 72730 - RNA, 64 nt, hsa
ccaaauguaaaacacuccuuaaguuccaaauguuuuccgcuaauagucuguccuaaagccuuug

SEQ ID NO: 72731 - RNA, 64 nt, hsa
gcaugguuugcaugacuuuacacuauauaaaugguuccgcuaaucucuucuaggauacacauuu

SEQ ID NO: 72732 - RNA, 64 nt, hsa
uucacuaaaagcaccgaaaucugcaaagccugucuuccgcuagaacaacgucuacaaaugugaa

SEQ ID NO: 72733 - RNA, 64 nt, hsa
gguggagaacauuugcaagaagcuuucaaaucccuuccgcuauagaauggaguguccagaaaua

SEQ ID NO: 72734 - RNA, 64 nt, hsa
uccccaagaggccaacccagugcccccucccauuuuccgcuacugaccaguucauccagcuuuc

SEQ ID NO: 72735 - RNA, 64 nt, hsa
ucagggcuauacccacuucugccgggguggccacuuccgcuacacacuacccgucuuccugcau

SEQ ID NO: 72736 - RNA, 64 nt, hsa
ucuaaggggaagggacccauagaggcuugccuguuuccgcuacuauauuaugcccaguguuccu

SEQ ID NO: 72737 - RNA, 64 nt, hsa
auacaagcuccauaacuccuuuuggugcuaaugauuccgcuauuucacagaccaaacguuuuag

SEQ ID NO: 72738 - RNA, 64 nt, hsa
caccagugcccacaucagggggcuaccaccaugauuccgcuaccuccaucuugagcucugaguu

SEQ ID NO: 72739 - RNA, 64 nt, hsa
cuguuagagucugucauaugguuagaauuuuuacuuccgcuaccccugccauuucuucugcuag

SEQ ID NO: 72740 - RNA, 64 nt, hsa
gguauuaagggagaguuaucuacauggaugagucuuccgcuauagcacaguuuagaaaaggugu

SEQ ID NO: 72741 - RNA, 64 nt, hsa
auaauauugaccugccauacguuagcacucuuaguuccgcuacugucuuuaacaggagcaaaga

SEQ ID NO: 72742 - RNA, 64 nt, hsa
aagaggaggaaacuacuugaggagggacccaacuuuccgcuaucuuuuggguucauuccaaaua

SEQ ID NO: 72743 - RNA, 64 nt, hsa
uuuuuaaaagauauaguuuuguaaauauuuaauauuccgcuaauuugauuuugaauuguaaaug

SEQ ID NO: 72744 - RNA, 64 nt, hsa
cuuggugauagauucgccaccacugggccuuguuuuccgcuaauuccagggcagauuccagggc

SEQ ID NO: 72745 - RNA, 64 nt, hsa
acagugugagugcacgugugaagcccccucacucuuccgcuagggauaaagcagauguggaugc

SEQ ID NO: 72746 - RNA, 64 nt, hsa
uucaucuaaagaugucucuggugauuuuuauauguuccgcuauauaauugaugcuuuauaguuu

SEQ ID NO: 72747 - RNA, 64 nt, hsa
ccacuuuccugugcccccacccccgccuccaguuuuccgcuaguauccggcaagguuucuugca

SEQ ID NO: 72748 - RNA, 64 nt, hsa
cccaggcacagccaccacuuugcaagugggaggaggggagaaggggagacaaaaccacugcaga

SEQ ID NO: 72749 - RNA, 64 nt, hsa
gacugggaagggcugcuucucucguaagggucuuggggagaaguaagcccgcagccugccucug

SEQ ID NO: 72750 - RNA, 64 nt, hsa
ucucugcccuuggacccauuuauuauucacagauggggagaaccuaucugcauggaccucugug

SEQ ID NO: 72751 - RNA, 64 nt, hsa
uguucuccugcauauaucauuccuggagagagaaggggagaagaauacuuuucuucaacaaauu

SEQ ID NO: 72752 - RNA, 64 nt, hsa
ccacaaauuuucaacaaucauuguagaaacuaagggggagaaaguaaucucaguuguuuuagaa

SEQ ID NO: 72753 - RNA, 64 nt, hsa
ggguagugagauggaaauggugccugcagaaguuggggagaaggauacuuuugcacagccucca

SEQ ID NO: 72754 - RNA, 64 nt, hsa
aauucuacuuuuauuuuugcuuacagaaaaacggggggagaauuaagccaaagaaguauauuua

SEQ ID NO: 72755 - RNA, 64 nt, hsa
acauaaugaucaguaugcugugccagcuucauuuggggagaaauaacuaguagaaaguucuggg

SEQ ID NO: 72756 - RNA, 64 nt, hsa
aauguggggugaaaugggaguagggggguggacaggggagaaacgaaaaccacaaaaagaaaac

SEQ ID NO: 72757 - RNA, 64 nt, hsa
cuacaggguggugucagucaaggucuuucaggugggggagaaauugguuagggcucccacugcc

SEQ ID NO: 72758 - RNA, 64 nt, hsa
uucacccucaguuuccucacuugaggagugggauggggagaacagagaguagcuguguuugaau

SEQ ID NO: 72759 - RNA, 64 nt, hsa
gagcaauuuauacuuuacccucaggcuguccucuggggagaaggugccauggucuuaggugucu

SEQ ID NO: 72760 - RNA, 64 nt, hsa
cugaaaagacaguugugugcauggaugugugcguggggagaaagaacguggguaagaugucccu

SEQ ID NO: 72761 - RNA, 64 nt, hsa
ccagucccacuccugucaccccacgcucugcacuggggagaaaacgggaggugcucgugcuggc

SEQ ID NO: 72762 - RNA, 64 nt, hsa
cugugguuauuggggccaagguggacucagcuccggggagaagggccucucugccauuucgguc

SEQ ID NO: 72763 - RNA, 64 nt, hsa
ucccuucccccuaagccaaccgcacugaaggaguggggagaagagcauacgccaggagccuccu

SEQ ID NO: 72764 - RNA, 64 nt, hsa
gcuagaaugcccgggcuggugcccaccaggggcuggggagaaggagggguggcaugaugaggaa

SEQ ID NO: 72765 - RNA, 64 nt, hsa
ucuucuuggcagcuuaacauugacuucuugguuuggggagaaauaaauuuuguuucagaauuuu

SEQ ID NO: 72766 - RNA, 64 nt, hsa
guaggaauccuuugagaaugugauuccuuuugauggggagaaagggcaaauuauuuuaauauuu

SEQ ID NO: 72767 - RNA, 64 nt, hsa
agcccagacucugcccuguugugcuggcagaaacggggagaaggguugaguuuucaugaauaga

SEQ ID NO: 72768 - RNA, 64 nt, hsa
cucgcaggaaaaugugggcuuccuuuaaagggagggggagaagccagggugauagcccagacuc

SEQ ID NO: 72769 - RNA, 64 nt, hsa
ugugugugugugugugcacauuuguuuggggaugggggagaagaagcuaaggggagaagucaac

SEQ ID NO: 72770 - RNA, 64 nt, hsa
cacauuuguuuggggaugggggagaagaagcuaaggggagaagucaacauuuaugaaauauugc

SEQ ID NO: 72771 - RNA, 64 nt, hsa
aaagaggggaaaaugaguuuuuauggggcugaacggggagaaaaggucaucaucgauucuacuu

SEQ ID NO: 72772 - RNA, 64 nt, hsa
guagcagguaccacugauuuggagauauuuauggggggagaacuuacauugugaaacuucugua

SEQ ID NO: 72773 - RNA, 64 nt, hsa
uaacaagguguggagugucagcgaggugcaauguggggagaauacauuguagaauauaagguuu

SEQ ID NO: 72774 - RNA, 64 nt, hsa
gguggacgcagaccuugagaacaaccuaaauuauggggagaauuuuaaaauguuaaacuguaau

SEQ ID NO: 72775 - RNA, 64 nt, hsa
aucggcccuguccccuggagugugucagagcccaggggagaaugcagcccaccaggagcaccug

SEQ ID NO: 72776 - RNA, 64 nt, hsa
ucccuuccugcuuccuguuaccugucuugcuccuggggagaaagaggggccugaugagacucca

SEQ ID NO: 72777 - RNA, 64 nt, hsa
aggaccagauuuucccagccauccagcaugcugcggggagaaggggcagaggcucaccucccuc

SEQ ID NO: 72778 - RNA, 64 nt, hsa
ccucccugccccucugcuggcacagccugggcaaggggagaagguggucccugcagaggggcuc

SEQ ID NO: 72779 - RNA, 64 nt, hsa
gucagacaggcugggggccucacucuguuuuccaggggagaaaccugagucucagagcagggga

SEQ ID NO: 72780 - RNA, 64 nt, hsa
cauggaggucagagccacaagggaaaggggagagggggagaaaacuguacucuguccagacaug

SEQ ID NO: 72781 - RNA, 64 nt, hsa
uauuuuguguuuagggaagggaaaauggaggaaaggggagaagagcaaagggcgcuuuuaaaga

SEQ ID NO: 72782 - RNA, 64 nt, hsa
cuaauaacaaagggguucugacacuaagacauuaggggagaauguuggguaggcagccagcacu

SEQ ID NO: 72783 - RNA, 64 nt, hsa
guaccuuucccauuguggucaugccauuuggcagggggagaaugggaggcuuggccuucuuugu

SEQ ID NO: 72784 - RNA, 64 nt, hsa
aacuuccaaauuggcucuuuggaggcgagaggaaggggagaacuuggagaauaguuuuugcuuu

SEQ ID NO: 72785 - RNA, 64 nt, hsa
caugaccugcagccaagcccagccccguggggaaggggagaaagugggggauggcuaagaaagc

SEQ ID NO: 72786 - RNA, 64 nt, hsa
ccuuccagggcuuuuccuuugggggaggcggagaggggagaagaaggaagggaagggcagaagg

SEQ ID NO: 72787 - RNA, 64 nt, hsa
gcugcuuuaaaagcucuguccuuggagccucccgcucccugaagugucucgcccccugcacagc

SEQ ID NO: 72788 - RNA, 64 nt, hsa
gucuuucccccccucacccucaccaucugaggggcucccugagaucuugguagaggaggccccu

SEQ ID NO: 72789 - RNA, 64 nt, hsa
ccucacccagauaucauccaggcccaaggccccucucccugagugaggccagguguuggcagcc

SEQ ID NO: 72790 - RNA, 64 nt, hsa
cuacuuucuggaagucuccccaggcugacuccuucucccugacugcaagggcucacucccuccu

SEQ ID NO: 72791 - RNA, 64 nt, hsa
cugcucaggcugcucauuccugcucacccucagucucccugagcuaccaccuaacuccucacuc

SEQ ID NO: 72792 - RNA, 64 nt, hsa
ccucagucucccugagcuaccaccuaacuccucacucccugaucaauggaaguccaggucagug

SEQ ID NO: 72793 - RNA, 64 nt, hsa
ccggcucagccagccucacgcugcuaggaaauggcucccugaucuaucagguaagagccagggg

SEQ ID NO: 72794 - RNA, 64 nt, hsa
cggaacugcugcggcaccuggcaaaaggcauggccucccugaugaucaccaccaaggguagccc

SEQ ID NO: 72795 - RNA, 64 nt, hsa
gcccgugcagagagaugucaugggggcaccugcucucccugauagaugcugagagcauccagaa

SEQ ID NO: 72796 - RNA, 64 nt, hsa
caggagcaugauggggacuuccaugcuggaauugcucccugauuaaaaugagauauggcuauuu

SEQ ID NO: 72797 - RNA, 64 nt, hsa
gacuggcgccccucagagaccugcggaaagcccccucccugagucgucgccacaccaggcgaca

SEQ ID NO: 72798 - RNA, 64 nt, hsa
gcguugcgggcuccuuccccgcagaggccggggccucccugacuuugcuucuucacucccaccu

SEQ ID NO: 72799 - RNA, 64 nt, hsa
ggcccucccaaggcuacauccccaccccacaguucucccugagagagaucaaccucccugagau

SEQ ID NO: 72800 - RNA, 64 nt, hsa
ccccaccccacaguucucccugagagagaucaaccucccugagaucaaccaaggcagaugugac

SEQ ID NO: 72801 - RNA, 64 nt, hsa
ugucucuccucugcuguguccucaaucucucugucucccugaggcucuauuucugucucuccuc

SEQ ID NO: 72802 - RNA, 64 nt, hsa
ugucucuccucugcuguguccucaaucucucugucucccugaggcucuauuucugucucugaug

SEQ ID NO: 72803 - RNA, 64 nt, hsa
gugccaggugcgcuucugcagguggagccaagcucucccugaggccagaggcggggccugggcc

SEQ ID NO: 72804 - RNA, 64 nt, hsa
ucucacccccucaggagugggcacgggagcccuucucccugacccugggcugcuuccugggggc

SEQ ID NO: 72805 - RNA, 64 nt, hsa
ugaggauggggcuguuucuccccuccgacuggggcucccugaggauggggcuguuucuccccuc

SEQ ID NO: 72806 - RNA, 64 nt, hsa
ugaggauggggcuguuucuccccuccgacuggggcucccugaggacagggcugugucuccccuc

SEQ ID NO: 72807 - RNA, 64 nt, hsa
ugaggacagggcugugucuccccucagccuggggcucccugagucagggcugugucuccccuca

SEQ ID NO: 72808 - RNA, 64 nt, hsa
cugagucagggcugugucuccccucagacuggggcucccugaggacggggcugugucugccuca

SEQ ID NO: 72809 - RNA, 64 nt, hsa
ucaggacagcguugugucuccccucagacugcggcucccugaggacggggcugugucucccuca

SEQ ID NO: 72810 - RNA, 64 nt, hsa
cugaggacggggcugugucucccucagacuggggcucccugaagaaagggcugcuucucccuca

SEQ ID NO: 72811 - RNA, 64 nt, hsa
cugaagaaagggcugcuucucccucagacuggagcucccugaagauggggcugugucccccuca

SEQ ID NO: 72812 - RNA, 64 nt, hsa
cuguagauuucaagacaaguagugaugucauuuucucccugagcuguaggguggaccuggaccc

SEQ ID NO: 72813 - RNA, 64 nt, hsa
acagcacuuucccaugguccucacuggccucagucucccugaccggcagugugaggggauguag

SEQ ID NO: 72814 - RNA, 64 nt, hsa
gugggacaagagcccucccugaaccccugcaacccucccugaaccccugcaaaugaaaccaaac

SEQ ID NO: 72815 - RNA, 64 nt, hsa
gcccucucccuuccccgguugugggacaagagcccucccugaaccccugcaacccucccugaac

SEQ ID NO: 72816 - RNA, 64 nt, hsa
gccucuagugccuuuugagggguucccaucaucccucccugauauuguauugaaaauauuaugc

SEQ ID NO: 72817 - RNA, 64 nt, hsa
acggggcuccugagggguacagguugggugggcccucccugagggucuggggucaggcuuuggc

SEQ ID NO: 72818 - RNA, 64 nt, hsa
caccagccugugcugcauacccaccgcccagcuucucccugagggcccaccagccugugcugua

SEQ ID NO: 72819 - RNA, 64 nt, hsa
caccagccugugcugcauacccaccgcccagcuucucccugagggcccaccagccugugcugca

SEQ ID NO: 72820 - RNA, 64 nt, hsa
ucucuaugccuaccuccccccauacccugcugaucucccugagccugccuuugagcccccguca

SEQ ID NO: 72821 - RNA, 64 nt, hsa
cgucacguugggcacugcugccaaagacucccuccucccugaugcugggaugugggcucugaau

SEQ ID NO: 72822 - RNA, 64 nt, hsa
cugcugcuucccacccagcugagaaugcccccuccucccugacuccucucugcccaugcaaauu

SEQ ID NO: 72823 - RNA, 64 nt, hsa
gauggaaagacuugacugcauaaagaugucaguucucccugaguugauugauaggcuuaauggu

SEQ ID NO: 72824 - RNA, 64 nt, hsa
ccaucccagcucuucacccaggucuccucuuccucucccugaagaaaccaucaugagagagaua

SEQ ID NO: 72825 - RNA, 64 nt, hsa
accccauggucaaugcuggugccauuguugucagcucccugaucaaggucagugccaccuuaac

SEQ ID NO: 72826 - RNA, 64 nt, hsa
caccuccugagucacuggggucccucaccagcaccucccugacaccugggcuauggagagguug

SEQ ID NO: 72827 - RNA, 64 nt, hsa
ccucaccauccucuugcguuuuggcccccauuugcucccugagcuccaagauaagaauggcccc

SEQ ID NO: 72828 - RNA, 64 nt, hsa
agaggaaaaguggucaaagaaaaacucuucauuucucccugauucuuaaacgaaggugguuaau

SEQ ID NO: 72829 - RNA, 64 nt, hsa
gugacaaggcaggacaagagccuguuucgcuuuccucccugacccugccaggugccaacucaaa

SEQ ID NO: 72830 - RNA, 64 nt, hsa
cagccugccuggaggaugggugcgcagcucugcccucccugaggcccaggacuaugccagaagc

SEQ ID NO: 72831 - RNA, 64 nt, hsa
cacccuucuuccccuucuaguugauccuuuucaccucccugauccccuucauuucuucaccgcg

SEQ ID NO: 72832 - RNA, 64 nt, hsa
ucaggaagaagugcccaggguguguguccccagucucccugaggccuggacucgcccaugaacc

SEQ ID NO: 72833 - RNA, 64 nt, hsa
cccagcauauacaaaaggggagguuuuagacaggcucccugaauguuaaccacagaggagucac

SEQ ID NO: 72834 - RNA, 64 nt, hsa
cuggggcucaaucccccuuucaccagaugccacccucccugaaccccccaccacuaccagcucc

SEQ ID NO: 72835 - RNA, 64 nt, hsa
aaaagucccagagaugaagcucccugagaugaaacucccugaggugaaacucccgaaggugccc

SEQ ID NO: 72836 - RNA, 64 nt, hsa
agaagugcagcuuccaaaagucccagagaugaagcucccugagaugaaacucccugaggugaaa

SEQ ID NO: 72837 - RNA, 64 nt, hsa
aaaggugccugagaugaaacuuccugagaugaaacucccugaagugcaacucccgaaggugccc

SEQ ID NO: 72838 - RNA, 64 nt, hsa
ucucccugacucuggaaccucugugacgccaguucucccugacucuggaaccucugugauccuu

SEQ ID NO: 72839 - RNA, 64 nt, hsa
uggaacucauuucacucagcugcuccucucaguucucccugacucuggaaccucugugacgcca

SEQ ID NO: 72840 - RNA, 64 nt, hsa
gacaccggacaugacugcccuccaggaauaaccccucccugagacauaguguccccaagaccac

SEQ ID NO: 72841 - RNA, 64 nt, hsa
uuccacgucgcguggucuccaagaccccaccuaccucccugaugcugaauggaaaccuucccac

SEQ ID NO: 72842 - RNA, 64 nt, hsa
cccccgagugcauggcuuggagagcagaaugugggcugcauauaagcacacucaucccuuuguc

SEQ ID NO: 72843 - RNA, 64 nt, hsa
ugggauaaacaagcaagauugcucacuucuggaagcugcauaugacuagaggccucuugugacu

SEQ ID NO: 72844 - RNA, 64 nt, hsa
cgcccagcuucucccugagggcccaccagccugugcugcauacccaccgcccagcuucucccug

SEQ ID NO: 72845 - RNA, 64 nt, hsa
ccccugcccugccucugagggcccaccagccugugcugcauacccaccgcccagcuucucccug

SEQ ID NO: 72846 - RNA, 64 nt, hsa
ugggacaucuguaucucuuggcuuuguaauaaaugcugcauacuuucuggagccuguaguucuu

SEQ ID NO: 72847 - RNA, 64 nt, hsa
uucagacccaaagcuuuaggcaugauuccaacuggcugcauauaggagucaguuagaaucguuu

SEQ ID NO: 72848 - RNA, 64 nt, hsa
gauaaaacuagaagaaaugaggguuuuuuuuuaaugaauagauuuugaauugauucuuuagacc

SEQ ID NO: 72849 - RNA, 64 nt, hsa
ugugucauucucuaucaucacuccuuuuaccaugugaauagauuucucugucuuggcauucuug

SEQ ID NO: 72850 - RNA, 64 nt, hsa
cauauacaaaaaaaucuaguggauaggcauuagaugaauagagaauauuaauuuugcagaaaug

SEQ ID NO: 72851 - RNA, 64 nt, hsa
aaugaagcugaaggcucacauguuaaaaugacccugaauagaauaggaagaacaauguucuuac

SEQ ID NO: 72852 - RNA, 64 nt, hsa
cuuuuuuuauuucuuuuaggucuagggacaggagugaauagaaagggaggagagcucuauuaug

SEQ ID NO: 72853 - RNA, 64 nt, hsa
cauuucuuugaggagaucaguauuguaacguaugugaauagaugauaacaauuaauauuacuaa

SEQ ID NO: 72854 - RNA, 64 nt, hsa
ggaaugcucuugaaagguggucuguggaucugucugaauagaaagagcacaguaaguaugcauu

SEQ ID NO: 72855 - RNA, 64 nt, hsa
ugcacugggccuaucuuuuuguuuuccagccaguugaauagauuaguuuuucucaguaacuuac

SEQ ID NO: 72856 - RNA, 64 nt, hsa
uucacuuauuuauuaucauaaaaauuuaccagucugaauagaucuuguaaauauuugugaauag

SEQ ID NO: 72857 - RNA, 64 nt, hsa
auuuaccagucugaauagaucuuguaaauauuugugaauagaaugaauaccuuucaugccacug

SEQ ID NO: 72858 - RNA, 64 nt, hsa
gagcaaugucauuaauccauauguggacuagugaugaauagauauuuucauaagaguuuaaaug

SEQ ID NO: 72859 - RNA, 64 nt, hsa
ugagaaguaaagauaguuggaauuuuugcgauauugaauagaacaucuucuguucccaacacug

SEQ ID NO: 72860 - RNA, 64 nt, hsa
uaaaacacuggacuagaagagauaaugauugaaacauuuaaaaaaaaaaagugcuccauucgca

SEQ ID NO: 72861 - RNA, 64 nt, hsa
uacacuccugcugaaaaauguuaauccaaauacacauuuaaacuuagggucgguccuuauucug

SEQ ID NO: 72862 - RNA, 64 nt, hsa
uuuugcaagaaaaaucuuugaauaagacuaacugcauuuaaaaggaauaaccuccuucucccuu

SEQ ID NO: 72863 - RNA, 64 nt, hsa
ccaacuacaaaaauguuuggcaacuuuguguuuacauuuaaagaucauuugcaccuuuuucaag

SEQ ID NO: 72864 - RNA, 64 nt, hsa
uguuucacucaugucugucauuuuauaagcauaucauuuaaaaagcuucuaaaaagcuauuucg

SEQ ID NO: 72865 - RNA, 64 nt, hsa
gaugaaaauauauuucccuguaagcugaauuacucauuuaaaaauuuuaacuucuauaugggac

SEQ ID NO: 72866 - RNA, 64 nt, hsa
uagugaaaaauucgcauucuggcugauuuuaagccauuuaaaauuuauauaaaacaaccuucca

SEQ ID NO: 72867 - RNA, 64 nt, hsa
auauuaggcauguuuggaggcuuuccuauucuagcauuuaaauuuaaauuuuauuaaaauuaaa

SEQ ID NO: 72868 - RNA, 64 nt, hsa
uaaauuuuauuaaaauuaaauaauuuaaaucuagcauuuaaauuuaaauaauuuaagucuagca

SEQ ID NO: 72869 - RNA, 64 nt, hsa
ugaauuaagccuucauagcguauuuuccuugaagcauuuaaauuugcuagugaugaaucaaaua

SEQ ID NO: 72870 - RNA, 64 nt, hsa
aaaaugauuaccucuugagauauauuauugaugacauuuaaagggaaaaguccuaaauuuaccu

SEQ ID NO: 72871 - RNA, 64 nt, hsa
gcacgucagcaagagccucuuugucucacuccaucauuuaaaaccaguauauucaguaguugaa

SEQ ID NO: 72872 - RNA, 64 nt, hsa
agauuugugaagacaucagauaggaauuuugacucauuuaaacuuugaugcuuaguuauguugc

SEQ ID NO: 72873 - RNA, 64 nt, hsa
uaagugggaaaugagaaguuauaccaauaaaaagcauuuaaaaauuuaggggauauuguaaccc

SEQ ID NO: 72874 - RNA, 64 nt, hsa
guuuuggaccuccuucauggcaucagaauuuucucauuuaaaggacaguuucccauaugaguaa

SEQ ID NO: 72875 - RNA, 64 nt, hsa
agcucagaauaucacauugaaauuacuauaaauacauuuaaaauuaucuauuuuagaucuaagg

SEQ ID NO: 72876 - RNA, 64 nt, hsa
aacguuuuccugaagcuguuucuggagagccacacauuuaaauacagacagcuuuccugaucau

SEQ ID NO: 72877 - RNA, 64 nt, hsa
uuagacucccuacaguccuucaauggaaaaguaacauuuaaaaauccuuuggguaauucgaauu

SEQ ID NO: 72878 - RNA, 64 nt, hsa
uuuuauaauuuuacuauuccagggugacauaaugcauuuaaauuugggauuuggguggaguauu

SEQ ID NO: 72879 - RNA, 64 nt, hsa
uacauuuaguaaaguccccaagacauuagucuuacauuuaaacuuuuuucuuuaaaacaugguu

SEQ ID NO: 72880 - RNA, 64 nt, hsa
ugaguuugaaaaagaaaaucuccagcaagcaucucauuuaaauaaagguuugucaucuuuaaaa

SEQ ID NO: 72881 - RNA, 64 nt, hsa
auaggugugacccuacuaauaauuauuagaaauacauuuaaaaacaucgaguaccucaagucag

SEQ ID NO: 72882 - RNA, 64 nt, hsa
cccauuuugaaauugccuauacagucuuagugaccauuuaaaccggacgaacuagguguuuaau

SEQ ID NO: 72883 - RNA, 64 nt, hsa
uagauaaauaauaauagcccugagauguuucuaacauuuaaauaagaaaaaaaucaaaucgaag

SEQ ID NO: 72884 - RNA, 64 nt, hsa
gcuaugcagaaauagagaucgaaccaaaaaaaaucauuuaaacuuuaaaaauauuuuaaaugga

SEQ ID NO: 72885 - RNA, 64 nt, hsa
uggcugucaugguacccaagugacuuggaagaugcauuuaaauuacucagcugaaaucacuuga

SEQ ID NO: 72886 - RNA, 64 nt, hsa
gaucacugucucaaagagauauuaaaauuuuauacauuuaaaaucauuguuaaauugauugagg

SEQ ID NO: 72887 - RNA, 64 nt, hsa
uaaaaucauuguuaaauugauugaggaaaacaaccauuuaaaaaaaaucuauguugaauccuuu

SEQ ID NO: 72888 - RNA, 64 nt, hsa
ccauugucuuggugguguuacaagacuuguuauccauuuaaaaaugguaguggaaauucuaugc

SEQ ID NO: 72889 - RNA, 64 nt, hsa
acaaugaugauuaacuaugaauucuuaagacuugcauuuaaaugugacauucuuaaaaaaagaa

SEQ ID NO: 72890 - RNA, 64 nt, hsa
auaugauuuauuagcacaacgugguacuauuugccauuuaaaacuagaacagguauauaagcua

SEQ ID NO: 72891 - RNA, 64 nt, hsa
guuuccaauggcucaggagacaaugaaaagcccccauuuaaaaaaauaacaaacauuuuuuaaa

SEQ ID NO: 72892 - RNA, 64 nt, hsa
uaagugcaccuagcuuauuacaucgugaaagguacauuuaaaauauguuaaauuggcuugaaau

SEQ ID NO: 72893 - RNA, 64 nt, hsa
gguuauuccaguaaaaggaaauaguuuucucaaccauuuaaaaauauucuucugaacucaucaa

SEQ ID NO: 72894 - RNA, 64 nt, hsa
aacuugcucugaccccucuaagcaaacuacuaagcauuuaaaagagaaucuaauuuuuaaaggu

SEQ ID NO: 72895 - RNA, 64 nt, hsa
cacccaugaaagaaaacuuuuaugcaaggucuugcauuuaaaagacagcuuugcgaauauuuug

SEQ ID NO: 72896 - RNA, 64 nt, hsa
uugauaaccauagcauuaauacgcccauuauggucauuuaaauugggguuuauuucagcaaacu

SEQ ID NO: 72897 - RNA, 64 nt, hsa
cuauaaaaugcaguaacauucuacuugcuuauuacauuuaaauccuuguguaacugaauguuua

SEQ ID NO: 72898 - RNA, 64 nt, hsa
guuuauggugagguuuaaaggauaugaaacucuacauuuaaacaaguauuuuauauuuggguac

SEQ ID NO: 72899 - RNA, 64 nt, hsa
cuggaaccagcaguucagagaucugccuuauaaacauuuaaaaccgguuugugguacacaaaga

SEQ ID NO: 72900 - RNA, 64 nt, hsa
ucagucuauucuaggaaugaaccagcaaguuguucauuuaaaacugaccaaagacaauuaauuc

SEQ ID NO: 72901 - RNA, 64 nt, hsa
aagggaauaaauuuuugucuuuguuggagugaagcauuuaaaagaguaaggguaaaaaagauaa

SEQ ID NO: 72902 - RNA, 64 nt, hsa
acaccucagaaauugaaagcacuaugaauuuguccauuuaaaaaugaucuguaguuuuuuuggu

SEQ ID NO: 72903 - RNA, 64 nt, hsa
ggugauccgaugugcagccaaaucugagaggccccauuuaaaaaagaaagaacaugggugguac

SEQ ID NO: 72904 - RNA, 64 nt, hsa
ccccaccuugcagcgcauuccaaccaccugggagcauuuaaaacuccagaugcccacaccacac

SEQ ID NO: 72905 - RNA, 64 nt, hsa
gacacaaaucaaaugugaaggauuugauuuucuacauuuaaaaugaagaaccaaaacucucuuc

SEQ ID NO: 72906 - RNA, 64 nt, hsa
cauuuuacuacauaguauacaaguuuuuaaugagcauuuaaaaaaauaaguaaaucuaggcuau

SEQ ID NO: 72907 - RNA, 64 nt, hsa
agauuuguaauggcucccaaauuccaucacaucacauuuaaauugcagacaguguuuugcacau

SEQ ID NO: 72908 - RNA, 64 nt, hsa
agagcaaagguuaauuuugugcuuuuaguaaaaacauuuaaauacaaaguucuuuauugggugg

SEQ ID NO: 72909 - RNA, 64 nt, hsa
aagaguuuaaaaguuuagcuuauugaguaguugucauuuaaaauauaauugcgaauaucagaaa

SEQ ID NO: 72910 - RNA, 64 nt, hsa
ucacauccucauacaauuuaauugcucaaccaugcauuuaaaacuccucaagaaaggauuggua

SEQ ID NO: 72911 - RNA, 64 nt, hsa
uaaacaguaauagcuacguuugggaaggaggaaacauuuaaauuauaaaggacugaauaaucua

SEQ ID NO: 72912 - RNA, 64 nt, hsa
auacuuguggcuuuuauuaucuuuaaacuuguugcauuuaaaauauuuuuaaaaccuucuuaac

SEQ ID NO: 72913 - RNA, 64 nt, hsa
aucuggcauuuuuaaacauuuaaaaauuauuaaacauuuaaaaauuaguuuauuaucagauauc

SEQ ID NO: 72914 - RNA, 64 nt, hsa
cuguuagaaauuaguuuuaucuggcauuuuuaaacauuuaaaaauuauuaaacauuuaaaaauu

SEQ ID NO: 72915 - RNA, 64 nt, hsa
uuaaauuaauuuucauguuugaaugcuguaauuccauuuaaauuccauuuauauacuuuaagga

SEQ ID NO: 72916 - RNA, 64 nt, hsa
gccaaagcuguuaguuaaaaucccaaaucuauagcauuuaaagauaccaaauagaaacaccuuc

SEQ ID NO: 72917 - RNA, 64 nt, hsa
ucuaaaaguaauaaauuccaauacaaguuacauacauuuaaaaaacauuuuacagauuuuaugg

SEQ ID NO: 72918 - RNA, 64 nt, hsa
uuuuuuauuuuaguccuauuuguauuauuuuaugcauuuaaaaacacaguccugagagggaugg

SEQ ID NO: 72919 - RNA, 64 nt, hsa
guuuuuauuucagcccuauuuguauuauuuugugcauuuaaaaaacacaaucuuaaggggauag

SEQ ID NO: 72920 - RNA, 64 nt, hsa
gaaauggauuuguucagccauuuacauuaaugagcauuuaaaugcaacagauaucauuucaggu

SEQ ID NO: 72921 - RNA, 64 nt, hsa
uuccaaaauagggucucaaacauuuuguaauuuucauuuaaauuguuaggaggcuuggagcuau

SEQ ID NO: 72922 - RNA, 64 nt, hsa
gugaacuauuaauauuuaaaaacgagaaauacaacauuuaaaaaauuaagaguauuuugcauua

SEQ ID NO: 72923 - RNA, 64 nt, hsa
ucaugagauacaauucacauaccauauaaucacacauuuaaaauacacaauucagugguuuuaa

SEQ ID NO: 72924 - RNA, 64 nt, hsa
aaauuuaaaauuucacaaaacuaaggguaaaagacauuuaaagaauuaaacuuaaauaagugug

SEQ ID NO: 72925 - RNA, 64 nt, hsa
uuuguuucagucauuuaaaauuuaaauuuucagucauuuaaaauuuuaaaaauuuaaaauuuca

SEQ ID NO: 72926 - RNA, 64 nt, hsa
auuuugaauaauaauguuuaaauuuuguuucagucauuuaaaauuuaaauuuucagucauuuaa

SEQ ID NO: 72927 - RNA, 64 nt, hsa
aaaauauugaacucaaugauagcaccuaaacuuacauuuaaaagacagacauuccuucuacaug

SEQ ID NO: 72928 - RNA, 64 nt, hsa
gguaagaggaagcuuacauuacauguccaguccacauuuaaagagcacuuacuguggaacaagc

SEQ ID NO: 72929 - RNA, 64 nt, hsa
auguguuccauagauaucuuaauguaaaauuagucauuuaaauuacacugucaauuaaaaguaa

SEQ ID NO: 72930 - RNA, 64 nt, hsa
acucaccuauaggagauuauuuuuaaguggaauccauuuaaacucaaaacaguuaugaaaagca

SEQ ID NO: 72931 - RNA, 64 nt, hsa
uccugcauuuuaaggucuaaguuuaacuggucaacauuuaaauggauuggagcuauuaguacau

SEQ ID NO: 72932 - RNA, 64 nt, hsa
agccggaccauuuuuaguauauuuucaguaaauacauuuaaacaauguuaaggccacagcacac

SEQ ID NO: 72933 - RNA, 64 nt, hsa
caaauaucuuaaagguaaaauccaucugggcacucauuuaaaguauaucuuaaaaaagcagcag

SEQ ID NO: 72934 - RNA, 64 nt, hsa
agagguuuaacagugaaauugugucaauauuuugcauuuaaaaugaauuuaauugaccgauauu

SEQ ID NO: 72935 - RNA, 64 nt, hsa
uugaaauuuacugugagacuguauguuuuaauugcauuuaaaaauauauagcuugaaagcaguu

SEQ ID NO: 72936 - RNA, 64 nt, hsa
cagggacaaagaaauccccccuucagaacagaggcauuuaaaauggaaaagagagauuggauuu

SEQ ID NO: 72937 - RNA, 64 nt, hsa
uuuaauuuccauuaaaaagcaaauagcauugacacauuuaaagcuuuucauuuaaaguagugga

SEQ ID NO: 72938 - RNA, 64 nt, hsa
aaaagcaaauagcauugacacauuuaaagcuuuucauuuaaaguaguggauguuuuugaaguau

SEQ ID NO: 72939 - RNA, 64 nt, hsa
uacagucauuuaugccuaaagccuggugauuauucauuuaaaugaagaucacauuucauaucaa

SEQ ID NO: 72940 - RNA, 64 nt, hsa
uccaauugaauuaaaguguggccucguuuuuagucauuuaaaauuguuuucuaaguaauugcug

SEQ ID NO: 72941 - RNA, 64 nt, hsa
auuuugaagaugagcauauauuacuaucuuuaagcauuuaaaaauacuguucacacuuuauuac

SEQ ID NO: 72942 - RNA, 64 nt, hsa
gagacgcgucagauggcagauuuggaaaguuaaccauuuaaaagaacauuuuucucuccaacau

SEQ ID NO: 72943 - RNA, 64 nt, hsa
uugaaaagcaaaaaauacuauuaaccuauauaaccauuuaaaauuuaaaaaauuauguuccaag

SEQ ID NO: 72944 - RNA, 64 nt, hsa
aaauaucucaaguagaaaaguuuuugaaaacuaacauuuaaaaauuaaucaguuacaguaaaga

SEQ ID NO: 72945 - RNA, 64 nt, hsa
auuucaaguuggccaauaauagcauucucucugacauuuaaaaauaauuucuauucaaaauaca

SEQ ID NO: 72946 - RNA, 64 nt, hsa
guagguacuuauauaaaaucuaguccaguucucucauuuaaaaaaaugaagacacugaaauaca

SEQ ID NO: 72947 - RNA, 64 nt, hsa
aacuugcacaauguugaacauagccuuuaagcaucauuuaaauuuuaaaggaauggaguuuuuc

SEQ ID NO: 72948 - RNA, 64 nt, hsa
cuuauuuucuuuuaaugugcaaugauggcuggaucauuuaaaguucuuuuuagaaaauaacaua

SEQ ID NO: 72949 - RNA, 64 nt, hsa
uucccuuaacauggcucaauaacuuaaaaacguucauuuaaauaaaauuuuaauacuuguuuga

SEQ ID NO: 72950 - RNA, 64 nt, hsa
uguuuauaaacauuacaacuauguuguuuuaagacauuuaaaaacgugaaauuuguuaucuuug

SEQ ID NO: 72951 - RNA, 64 nt, hsa
ucaucuauuuuuggcagucugaauuuuuaaaacccauuuaaauuuuuuuccuuaccuuuuuauu

SEQ ID NO: 72952 - RNA, 64 nt, hsa
uaauuaccaaccuguuaccuacuuugacuuuuugcauuuaaaacagacacuggcauggauauag

SEQ ID NO: 72953 - RNA, 64 nt, hsa
aguuuaaagggaauuguguggccucuagccuagucauuuaaagaaggauguaacuuauaacauu

SEQ ID NO: 72954 - RNA, 64 nt, hsa
uguacacuuccuccuuauuggaauauuuaaguugcauuuaaacuaaaacuaguauaauuuaguc

SEQ ID NO: 72955 - RNA, 64 nt, hsa
caaagacaggaucauacacaugacuuauaccucucauuuaaauauuuuauaguauaaaguauuu

SEQ ID NO: 72956 - RNA, 64 nt, hsa
uaauuuuaauaaaagugaaccagaacaaaucacucauuuaaaaaguaauucagaagaacagugu

SEQ ID NO: 72957 - RNA, 64 nt, hsa
auaugcuaaaucacauucagcauguguauuuugacauuuaaaauacuucccucaauucuguaaa

SEQ ID NO: 72958 - RNA, 64 nt, hsa
uuacaaaaguucuuauuacugggcggacugauaacauuuaaaaaauaauuguguuugaccccaa

SEQ ID NO: 72959 - RNA, 64 nt, hsa
ugauuuaaaaucaaaucaaaaagaaaaaacuaaacauuuaaacaaaaaugggauaagaauaguc

SEQ ID NO: 72960 - RNA, 64 nt, hsa
gaaaaguuuaaucuaaaugauaugugcauuuccucauuuaaaaaauccaauuggauuauucuua

SEQ ID NO: 72961 - RNA, 64 nt, hsa
cuguaaaauguggcucuaaauaacuaaugacacacauuuaaaucaguuaugguguagcugcugc

SEQ ID NO: 72962 - RNA, 64 nt, hsa
guauguugucauaacauuuaaagagauuucccuucauuuaaacuaaauuacuguuuuauguuga

SEQ ID NO: 72963 - RNA, 64 nt, hsa
agaaaagguucuucuugggaguauguugucauaacauuuaaagagauuucccuucauuuaaacu

SEQ ID NO: 72964 - RNA, 64 nt, hsa
aucacuuuccagcccagcacucuucaugcucauucauuuaaagcauucaacauuguguaaauga

SEQ ID NO: 72965 - RNA, 64 nt, hsa
aacaaagacacaacauaccagaaucucugggacacauuuaaagcaguguguagagggaaauuua

SEQ ID NO: 72966 - RNA, 64 nt, hsa
uugcauauuuaaaaauuaaucauuuugcauuuuacauuuaaauaugcuaacaucacugucauag

SEQ ID NO: 72967 - RNA, 64 nt, hsa
aaagauauuuauauauugccauacaaaaacuuaacauuuaaaacugauaauaucuguaaugaca

SEQ ID NO: 72968 - RNA, 64 nt, hsa
cuauuuuccugaaaugcuucagggauuccauaaacauuuaaacaauguucuaagguacauauac

SEQ ID NO: 72969 - RNA, 64 nt, hsa
uaguauuguuguaaaacuucaugaaacaaaagaccauuuaaauagugaauuauuaaaaaucuuu

SEQ ID NO: 72970 - RNA, 64 nt, hsa
ccaaaaggguaaggcaguuuuaaaaaugugaaaacauuuaaaaaugauaauagcagggaauucu

SEQ ID NO: 72971 - RNA, 64 nt, hsa
auguacaaacuaaauggguaagagguaaaaucuucauuuaaauauacuauguucuggaugaaaa

SEQ ID NO: 72972 - RNA, 64 nt, hsa
auucugagauuaaaaaaaauuuuuaaagagugaucauuuaaauaauuucuaaaagggucuuuuc

SEQ ID NO: 72973 - RNA, 64 nt, hsa
cuagucucagggcuuguguaauauucugggaggucauuuaaaugccagaaauggucaagcaauu

SEQ ID NO: 72974 - RNA, 64 nt, hsa
aaaauuuuuuagcaauuuuuguaaaacuguguagcauuuaaauuuccuauaccuucugauggga

SEQ ID NO: 72975 - RNA, 64 nt, hsa
agaaaguaguuuguaauugauauuaaaaguggcacauuuaaaaauuuaaaaauugaagugcaaa

SEQ ID NO: 72976 - RNA, 64 nt, hsa
aaacuucuggcuucuagacaaauuccugauagaacauuuaaaugugggaaguggcuuccccagg

SEQ ID NO: 72977 - RNA, 64 nt, hsa
cuuauuaucaaaagaauaauuaaaaucauguaaccauuuaaaugucacuguuaacacuuuucac

SEQ ID NO: 72978 - RNA, 64 nt, hsa
acuagaaugacagauucaggugguuuauuaauuacauuuaaaaaguuuucugaaaaaacuuuug

SEQ ID NO: 72979 - RNA, 64 nt, hsa
uggugcuggucagacuuuuuuuguuagauucucucauuuaaaaaaaauacuguuuguuuaaagc

SEQ ID NO: 72980 - RNA, 64 nt, hsa
aaccacuuuugacuagguaagucuuucuaaaaaccauuuaaagcuaacugggucuuagcauccu

SEQ ID NO: 72981 - RNA, 64 nt, hsa
aaagcuucuuuccauaucaaguaccauaugaguucauuuaaacugcaccuugcagaaaugcauu

SEQ ID NO: 72982 - RNA, 64 nt, hsa
uuguauuggggauauguuuuacauaaauagaacucauuuaaaaguaugguucaaguacugcucu

SEQ ID NO: 72983 - RNA, 64 nt, hsa
gacuaucaagagugaccuuugaagcaagcuaaaucauuuaaauguuuaaauugaaaaugggcca

SEQ ID NO: 72984 - RNA, 64 nt, hsa
caaaauggauucuugucuccucuucagaauuagccauuuaaaauauuuucugugacuucaaauu

SEQ ID NO: 72985 - RNA, 64 nt, hsa
gcuagaugccuuuuuccccugucaguuugacuuucauuuaaauccuucauucugauaucauuac

SEQ ID NO: 72986 - RNA, 64 nt, hsa
ccccaggggaaaaugaagguuaggauuuaacagucauuuaaaaaaaaaauuuguuuugacggau

SEQ ID NO: 72987 - RNA, 64 nt, hsa
aaaaaaauuuguuuugacggaugauuggauuauucauuuaaaaugauuagaaggcaaguuucua

SEQ ID NO: 72988 - RNA, 64 nt, hsa
gcccgccaagguugggaggauuguacacuacuuucauuuaaaggggaaaguuugauaauacgga

SEQ ID NO: 72989 - RNA, 64 nt, hsa
uuccgaaguuaggaccuaguuacuuugcucucaacauuuaaaauaaugcaguugcucuagugaa

SEQ ID NO: 72990 - RNA, 64 nt, hsa
uuauacaagauugaaaaucuuguguaaauccugccauuuaaaaaguuguagcagauuguuuccu

SEQ ID NO: 72991 - RNA, 64 nt, hsa
gcuuuauugcuuuuuuguauugguuaaaacuguacauuuaaaauugcuauguuacuauuuucua

SEQ ID NO: 72992 - RNA, 64 nt, hsa
uguuuucuuuuuucuguuuuuuucuuuguuaauucauuuaaacucauugaaaacauaguauaca

SEQ ID NO: 72993 - RNA, 64 nt, hsa
cucacccaauguacaaccaaugaaauaaaagaagcauuuaaaaggauuguauagucuuccuucu

SEQ ID NO: 72994 - RNA, 64 nt, hsa
uugucuucaaguaaucugacagcauuaaauauugcauuuaaaaauuauacuguagcaaauacau

SEQ ID NO: 72995 - RNA, 64 nt, hsa
aauauugcauuuaaaaauuauacuguagcaaauacauuuaaaaauuaaucacaacguuaagaug

SEQ ID NO: 72996 - RNA, 64 nt, hsa
acagaaaaaagcaaauauaaauuuuuaaugacuccauuuaaaaauaucacagggugggggcaag

SEQ ID NO: 72997 - RNA, 64 nt, hsa
uuuucccuccaguuuuuccucuaguucuuuuaggcauuuaaauuguuucuguuacucugugcaa

SEQ ID NO: 72998 - RNA, 64 nt, hsa
aaggguaacuaugacaaagauacuuuugagauaacauuuaaaaguacuuuauauuuuacauaau

SEQ ID NO: 72999 - RNA, 64 nt, hsa
cauuacucauuugauuucccccacccccgccaaccauuuaaaaaaguuugccggcuaggugcgg

SEQ ID NO: 73000 - RNA, 64 nt, hsa
ugacaggacagcaacuucagggaucuguaaagaucauuuaaauggagugcucaucucauugagg

SEQ ID NO: 73001 - RNA, 64 nt, hsa
uggaauuguuuuccuguuuuuccuuacuauaaaucauuuaaaaacugaauucauuuucuuagau

SEQ ID NO: 73002 - RNA, 64 nt, hsa
uuggaaguuuguaccaucuguuugaguauaugcacauuuaaaaaauaucauauaguaaaugcaa

SEQ ID NO: 73003 - RNA, 64 nt, hsa
ucacauccuuguucuuuauuuagcaacucugauucauuuaaauauguuuuuuauagaauucuau

SEQ ID NO: 73004 - RNA, 64 nt, hsa
uuucaugaagccccaaggacacaaaacauuuucccauuuaaaggaaaacacucuaguuuugcaa

SEQ ID NO: 73005 - RNA, 64 nt, hsa
cguuaggcuuugaggcuuuucagugaauucuugacauuuaaaucuucuuauagaauucuuuaug

SEQ ID NO: 73006 - RNA, 64 nt, hsa
ugauuuuauaucaguauguuaaacuuuauugccacauuuaaaggacuguauuuucauacuuuuu

SEQ ID NO: 73007 - RNA, 64 nt, hsa
uaaaaugucauguuauuaacaguuauuagguugucauuuaaaaauaaaguuccuuuauauuucu

SEQ ID NO: 73008 - RNA, 64 nt, hsa
uuugauucaguauucuuuuaucauaaauuuuuagcauuuaaaaauucacugauguacauuaagc

SEQ ID NO: 73009 - RNA, 64 nt, hsa
gaaaauauacaugaugggauuccuauugugaagucauuuaaaauaaugacuugaauuucucaga

SEQ ID NO: 73010 - RNA, 64 nt, hsa
ugucuuaaaggaagcaucaagaauucaauauuugcauuuaaaaauacuuuuuaaggccauuuua

SEQ ID NO: 73011 - RNA, 64 nt, hsa
uccuuuucuuccacuuuaauuuaaaaguucaugucauuuaaaaacaagucaagaaauuaaaauu

SEQ ID NO: 73012 - RNA, 64 nt, hsa
cagaaaauggacugaagucugaauaaggucauugcauuuaaaaagcauauaacuguacuugacu

SEQ ID NO: 73013 - RNA, 64 nt, hsa
uagguauguaggaauagucacucacuggcugauacauuuaaagcagcagugugaauagcaagga

SEQ ID NO: 73014 - RNA, 64 nt, hsa
aagaauacugagaacggcauaaagugaagaucgacauuuaaaaaaugaggugaaagaaagcuau

SEQ ID NO: 73015 - RNA, 64 nt, hsa
uugcaagaaacucuuuuauuaaacuuggaacaaccauuuaaaugaaggauuuugugagauagaa

SEQ ID NO: 73016 - RNA, 64 nt, hsa
auuguuuuuagucuugcuugaggaaugcacacuccauuuaaaaaauugugcgcucuguagauuu

SEQ ID NO: 73017 - RNA, 64 nt, hsa
uuacaaaaagaaaaaaaaaauccuguuguauuaacauuuaaaaacagaauuguguuaugugauc

SEQ ID NO: 73018 - RNA, 64 nt, hsa
uuaaaaagauacuucuguaacuuaagaaaccuggcauuuaaaucauauuuugucuuuagguaaa

SEQ ID NO: 73019 - RNA, 64 nt, hsa
uaguaacuuaauauguaaaguuguaacauacauacauuuaaaauggaaaugcagaaagcuguga

SEQ ID NO: 73020 - RNA, 64 nt, hsa
gggaaugaaacauuuauggccucaagauacuauacauuuaaagcaccccaaugucucucuuuuu

SEQ ID NO: 73021 - RNA, 64 nt, hsa
ugcugcguaucuugucucaauaaguuuuaaguaacauuuaaaaauauuaaagcauguuauuuga

SEQ ID NO: 73022 - RNA, 64 nt, hsa
uucacuuuacugcauaggaaacaaucuaccucaucauuuaaaaugacaugggugucgguuuugu

SEQ ID NO: 73023 - RNA, 64 nt, hsa
uaaugacuaucaaguuuauuuauccauuauuggacauuuaaauuucuuucuuuuuagcuauaca

SEQ ID NO: 73024 - RNA, 64 nt, hsa
uauaauuguauucuacaaacaauuuuguuuucugcauuuaaacauuuuuguguuuuuaggagau

SEQ ID NO: 73025 - RNA, 64 nt, hsa
aucccaggagccaaccucccccuuugcagggcugcauuuaaaaauuagguuugggacaguucuu

SEQ ID NO: 73026 - RNA, 64 nt, hsa
uauuuagcaccugccagaugccagaaauuuauaccauuuaaaacucaguaagucuuuuaaauau

SEQ ID NO: 73027 - RNA, 64 nt, hsa
ugaguaauuuuuacauuucuaagacauuaaaucccauuuaaauucugugugaacauuaaagaca

SEQ ID NO: 73028 - RNA, 64 nt, hsa
aaacuguacaaagaagacgacuguuuuccauuuccauuuaaacauuuuuagccacuucauuucu

SEQ ID NO: 73029 - RNA, 64 nt, hsa
ggucaaauuugucuuguuauuugugaguacaguacauuuaaaaaacauccuuaucgguuauuuu

SEQ ID NO: 73030 - RNA, 64 nt, hsa
ggacagcagauucuuuuccuucucacaaggggcucauuuaaaauuuggaggcugggugcugugg

SEQ ID NO: 73031 - RNA, 64 nt, hsa
agaagcaaauaucaggccugucgcacacgggcggcauuuaaauaggaauuucuauuuuugaaau

SEQ ID NO: 73032 - RNA, 57 nt, hsa
aagccaagguagguguuugauagaacacauuuaaacaucaguauuaugaaaacuugu

SEQ ID NO: 73033 - RNA, 64 nt, hsa
agaauuucauccaaauguuacccuguaauacuggcauuuaaaauucuuauuuaaccuuccuccc

SEQ ID NO: 73034 - RNA, 64 nt, hsa
aauauguaaaggguauacauuaauugguacguagcauuuaaaaucaggucuuauaauuaaugcu

SEQ ID NO: 73035 - RNA, 64 nt, hsa
uuucugacauagcauuuauguauaauaaaccagacauuuaaaguguacaauuugaugaguuuug

SEQ ID NO: 73036 - RNA, 64 nt, hsa
uaugccuuaucagaaucuaaaugaaaauagcgaacauuuaaaagcuaucaccauuguaguagaa

SEQ ID NO: 73037 - RNA, 64 nt, hsa
uauaacuauacuugucaaauagcaccuaucuaugcauuuaaaaaugcauuaauaucuaacauaa

SEQ ID NO: 73038 - RNA, 64 nt, hsa
cccaaguaucuguuuauauaguuaguuuucagcucauuuaaaagaggcaaaaauuaaaagcuug

SEQ ID NO: 73039 - RNA, 64 nt, hsa
ugcugcugcugugcucuguaaauucugaauaugacauuuaaacucugugccuacuaaagguauc

SEQ ID NO: 73040 - RNA, 64 nt, hsa
uauuugauacugugcuugcugucaguaugcauuacauuuaaauuauucucuauucaagugggaa

SEQ ID NO: 73041 - RNA, 64 nt, hsa
augcauuuacauccuagauuuaacauuguugggccauuuaaaaugugcauauuggagcagaaca

SEQ ID NO: 73042 - RNA, 62 nt, hsa
uauguguucuuuuuguucauuucguucuuacuucccugaagcaagagacuauauggccuuca

SEQ ID NO: 73043 - RNA, 62 nt, hsa
auuggccacacgcuggaagcugaaauugaugaucccugaagguugaacccacacacaccccu

SEQ ID NO: 73044 - RNA, 62 nt, hsa
ugauuguuuuagccugcucgaacugauacaaaucccugaaaccaugauuggcauauguuaga

SEQ ID NO: 73045 - RNA, 62 nt, hsa
uaauguuucuucauugauuauggaacuuuuguucccugaagcuaguuaacugugucuaaagu

SEQ ID NO: 73046 - RNA, 62 nt, hsa
aggacggggcugugucugccucagacugggaaucccugaagauggggccgugucucccucaa

SEQ ID NO: 73047 - RNA, 62 nt, hsa
aggacggggcugugucucccucagacuggggcucccugaagaaagggcugcuucucccucag

SEQ ID NO: 73048 - RNA, 62 nt, hsa
aagaaagggcugcuucucccucagacuggagcucccugaagauggggcugugucccccucag

SEQ ID NO: 73049 - RNA, 62 nt, hsa
uaaauagacuugaggaauccucuaccacagugucccugaaaccacaugcaucauucaggaag

SEQ ID NO: 73050 - RNA, 62 nt, hsa
ucaggaagccuucacccugugacuauucagccucccugaauaugcuuucucuauagaaccac

SEQ ID NO: 73051 - RNA, 62 nt, hsa
auuauuuuaagaugagacaagauuauugucaaucccugaaugucuggaguuaccucccaugg

SEQ ID NO: 73052 - RNA, 62 nt, hsa
uggugaccucuuccuaaacuugaagcccugccucccugaaggcuaauuaaggguugcagucc

SEQ ID NO: 73053 - RNA, 62 nt, hsa
acaucacugucaccucugaaucuccaucugcaucccugaaaaaugaagaaacagggcuggau

SEQ ID NO: 73054 - RNA, 62 nt, hsa
ggacaagagcccucccugaaccccugcaacccucccugaaccccugcaaaugaaaccaaacg

SEQ ID NO: 73055 - RNA, 62 nt, hsa
cucucccuuccccgguugugggacaagagcccucccugaaccccugcaacccucccugaacc

SEQ ID NO: 73056 - RNA, 62 nt, hsa
uugagcuggauagagguggggucucuucaccuucccugaauucagaacagacccugugccug

SEQ ID NO: 73057 - RNA, 62 nt, hsa
uggugggugcucccccucccuaagcuccagggucccugaaucuucugaaaucucaaaugagu

SEQ ID NO: 73058 - RNA, 62 nt, hsa
ucacaauuucucuaaucuuuacucauguuaugucccugaaugucuugguauagguuuaagug

SEQ ID NO: 73059 - RNA, 62 nt, hsa
aaauagaaacaagagaaugcaccuagguuaauucccugaauccuacuugaacauuguauaaa

SEQ ID NO: 73060 - RNA, 62 nt, hsa
agcauauacaaaaggggagguuuuagacaggcucccugaauguuaaccacagaggagucacu

SEQ ID NO: 73061 - RNA, 62 nt, hsa
gggcucaaucccccuuucaccagaugccacccucccugaaccccccaccacuaccagcuccc

SEQ ID NO: 73062 - RNA, 62 nt, hsa
gguggagcugggcaagauuuuggguuugcugcucccugaagcuggauucuuucauacgauac

SEQ ID NO: 73063 - RNA, 62 nt, hsa
ggcucuuacagcucucuggugccagcacgggaucccugaagugacucagccaggcagacaug

SEQ ID NO: 73064 - RNA, 62 nt, hsa
gguuuaauaaaacugguuaaaaauugagucuuucccugaaguaagugcucuuuccagaugaa

SEQ ID NO: 73065 - RNA, 62 nt, hsa
ucuguaaccagggcugucuucagaugucagggucccugaacugcugcgggcccagucaguga

SEQ ID NO: 73066 - RNA, 62 nt, hsa
uugauagcugauuaauuugcccucaauucugcucccugaacuucacacauaaaucuucccaa

SEQ ID NO: 73067 - RNA, 62 nt, hsa
ugaaaucacacucuuccucugggcauccuggaucccugaauuauccccccccccaugaagua

SEQ ID NO: 73068 - RNA, 64 nt, hsa
uaauuggauauuggacucugcucauauaagcuacagacaaaagccaaaagacucucgcuguccc

SEQ ID NO: 73069 - RNA, 64 nt, hsa
cugggcaacauggugaaacccgucucuaccaaacagacaaaaagcagccaggcgugguggcaca

SEQ ID NO: 73070 - RNA, 64 nt, hsa
gagccgagaucgcaccacugcacuccagccuaggagacaaaacgagacuucauuuaaaaaaaau

SEQ ID NO: 73071 - RNA, 64 nt, hsa
auuaauccucaguuccacgagacugcccacccacagacaaaaaaauauauauauuccuaaaguc

SEQ ID NO: 73072 - RNA, 64 nt, hsa
uuggccauuauuuucuaauccauuuuuaaaauacagacaaaacacuucuuuaaacagaacaaga

SEQ ID NO: 73073 - RNA, 64 nt, hsa
aaguauaaggagagaaauaacuuuaaaguuuauuagacaaaacagaguauagaugccaagaugu

SEQ ID NO: 73074 - RNA, 64 nt, hsa
agcuagugauuucaaaagguuucacaauuccccaagacaaaagugauuuucguucauuauaaua

SEQ ID NO: 73075 - RNA, 64 nt, hsa
uccuuccuccuagaacuuacauuuuaauggaaauagacaaaacacaucuucuuaacggauggug

SEQ ID NO: 73076 - RNA, 64 nt, hsa
cacaaaaugaaugaauaaauaaauaaaugaauaaagacaaaagccaagguguaugcucucaagu

SEQ ID NO: 73077 - RNA, 64 nt, hsa
uuauggaauuuuuaaguagguaaauaaaugguuaagacaaaauaguguuauagccuucauucuc

SEQ ID NO: 73078 - RNA, 64 nt, hsa
aggucacugaaagaacuugauuugaauuacguuuagacaaaaaugauuuaauuguaaauucuua

SEQ ID NO: 73079 - RNA, 64 nt, hsa
gcugauuguugcuugagaaauaauuacuaauucuagacaaaacucaauccuguaucuuccauca

SEQ ID NO: 73080 - RNA, 64 nt, hsa
accaaaauaauaaaaggcagcuaauggaaaggagagacaaaagcaugguuaauauauauacuua

SEQ ID NO: 73081 - RNA, 64 nt, hsa
aauucagugcuauccaguuauaaauggaaucuugagacaaaaccuuaacaaagaaauaacagua

SEQ ID NO: 73082 - RNA, 64 nt, hsa
aauaaaagcuuuucaacucaaccacuucuuuguaagacaaaacugaaguaucugugugcuucca

SEQ ID NO: 73083 - RNA, 64 nt, hsa
ccgcgcccagcccuggagugauacuuuuuauggaagacaaaagccccccaaaucuguguaaaau

SEQ ID NO: 73084 - RNA, 64 nt, hsa
gagugaccaugccuagcucacuuccagguuuaacagacaaaauaaacuuacucuaguuuccauc

SEQ ID NO: 73085 - RNA, 64 nt, hsa
aacugggcugggagagaagacggggaagugugugagacaaaacaaagccggcuuguuuccuccc

SEQ ID NO: 73086 - RNA, 64 nt, hsa
agcgugggucccagucuauggaaucgagucucccagacaaaaaaggagaggcccuggcgguccu

SEQ ID NO: 73087 - RNA, 64 nt, hsa
ggauaaaaguuugaagggcuagauugggauuugaagacaaaauuguaggaaaucuuacauuuuu

SEQ ID NO: 73088 - RNA, 64 nt, hsa
aggccaucucuagguuacaagaugauaggagguuagacaaaagugauucuuuugccaaugggug

SEQ ID NO: 73089 - RNA, 64 nt, hsa
ccuggcccuggcccuuacuauuaggaaaauaaacagacaaaaacaaguaaauauauauggucau

SEQ ID NO: 73090 - RNA, 64 nt, hsa
guaugacccacauuacuuuuuaugggugaaaauaagacaaaaauaauaguuuuagugaggaugg

SEQ ID NO: 73091 - RNA, 64 nt, hsa
gguagucacaguccggaagagaugauagaugcauagacaaaaaauuaugggauguaacuaaugc

SEQ ID NO: 73092 - RNA, 64 nt, hsa
uuagggaacauauugauagaaaugaccaccuugcagacaaaaucucucucucucuuuuuguuuu

SEQ ID NO: 73093 - RNA, 64 nt, hsa
caucucauccuaauuaaggugacuauuuucaaaaagacaaaaaauaugacagccguggugguuc

SEQ ID NO: 73094 - RNA, 64 nt, hsa
uacuucauuaauacuucacaauacuauuugcauaagacaaaauaccacagcaaaaaaaaaaauc

SEQ ID NO: 73095 - RNA, 64 nt, hsa
aacuuuauggacacuaaacuggagccaauagaaaagacaaaaaugaaagagacacaggguguau

SEQ ID NO: 73096 - RNA, 64 nt, hsa
gaagccauagcucagggucaucaagaaaaauaauagacaaaagaaaauggcacaaggaaucaca

SEQ ID NO: 73097 - RNA, 64 nt, hsa
acagugcuaauguauaugguugcaguucacauaaagacaaaagcaucuguuaugaaaugaguag

SEQ ID NO: 73098 - RNA, 64 nt, hsa
accucguuauuaaccaguguuccagucuuaaaguagacaaaauauucagagccauuuuuuuuaa

SEQ ID NO: 73099 - RNA, 64 nt, hsa
acguuguacagaagcacaugucuuuaaugucuucagacaaaaaagccuuacauuaauuuaaugu

SEQ ID NO: 73100 - RNA, 64 nt, hsa
gauugguuugcuuaaaauuaacuuauuuuguagaagacaaaaugaauugcacuucacuuaaugu

SEQ ID NO: 73101 - RNA, 64 nt, hsa
auuauaaaugaugucagcauuuuaguaaacuuuuagacaaaauuuguuagggucauucaugaaa

SEQ ID NO: 73102 - RNA, 64 nt, hsa
auauaugcauuguguaauccacucagaauuaaacagacaaaagguaugcuugcuuuggaaugau

SEQ ID NO: 73103 - RNA, 64 nt, hsa
aauuuaaaaacaaauuggcuuugucucauugaucagacaaaaagaaacuaguauuaagggaagc

SEQ ID NO: 73104 - RNA, 64 nt, hsa
uagucgaauguucuuuucuuuaccuuuacaauuaagacaaaauguuuaauaagaauagcaaaaa

SEQ ID NO: 73105 - RNA, 64 nt, hsa
uacaaagaggaaaggggaaaaaugacucagaacaagacaaaagcucugacuguuuaaaguuauc

SEQ ID NO: 73106 - RNA, 64 nt, hsa
guucacuaauaaauucugaguaaauuaguggugaagacaaaauauaacuuguuuuagugagcca

SEQ ID NO: 73107 - RNA, 64 nt, hsa
gugagccacugaggaaagaauaugcuuauuacaaagacaaaauguggugcagaaacuaucuugc

SEQ ID NO: 73108 - RNA, 64 nt, hsa
uaugccuauacacuuuaaaauguauauacauuuuagacaaaaaugcacacuccaguauuaauau

SEQ ID NO: 73109 - RNA, 64 nt, hsa
agaaaaccuaaaacaagccucuugcucaguaaagagacaaaagccacacaggaguaggugccac

SEQ ID NO: 73110 - RNA, 64 nt, hsa
aauaaaaauguuucuacagauauuaauguuaacaagacaaaauaaaugucacgcaacuuauuuu

SEQ ID NO: 73111 - RNA, 64 nt, hsa
accucaccaaaagauccagccucauaccuacaucagacaaaauaucgccguuguuccuucugua

SEQ ID NO: 73112 - RNA, 64 nt, hsa
gcuucucugaggaaaugcauaaucuguuaauaucagacaaaaugagcaauuggcagugcucaua

SEQ ID NO: 73113 - RNA, 64 nt, hsa
uuugauugauagcacagugauaaaucauaauacuagacaaaauugucuucucuuucaaaccaga

SEQ ID NO: 73114 - RNA, 64 nt, hsa
cacacagcacuugggccagcaaauccuggaaggcagacaaaaauaagagccugaagcaaugcuu

SEQ ID NO: 73115 - RNA, 64 nt, hsa
aucaguuuucagugugaauucacugaauguuuauagacaaaagaaaauacacacuaaaacuaau

SEQ ID NO: 73116 - RNA, 64 nt, hsa
acauauauccuuagcaccucguauagauaugaucagacaaaaugcagaaggaaaaaaaaacaua

SEQ ID NO: 73117 - RNA, 64 nt, hsa
auuucauuauauucucccccucuuccugcuaaaaagacaaaaaacaaaaaacaaaaaaaacaaa

SEQ ID NO: 73118 - RNA, 64 nt, hsa
cuuauaucauauuguuaaauaaacugugugcaacagacaaaaagggugguccuucuugaauuca

SEQ ID NO: 73119 - RNA, 64 nt, hsa
auuguugcuuuguuucucugauaaaacugguuuuagacaaaaaauagggaugaucacucuuaga

SEQ ID NO: 73120 - RNA, 64 nt, hsa
aauauacuuggcacagcgaaaaaauggauuuaaaagacaaaaauggagguccagguagauguaa

SEQ ID NO: 73121 - RNA, 64 nt, hsa
gacuggguuuuuuuguuguuguuguuccccuuacagacaaaaugaagacuaucaugugcaaucu

SEQ ID NO: 73122 - RNA, 64 nt, hsa
cucauauaucagucucucacauggccacaauucuagacaaaaaccaaagacccagaggccagag

SEQ ID NO: 73123 - RNA, 64 nt, hsa
aauaagucuguagcauaaagguuaaacuauuuuaagacaaaauaaaauagaguguauuuaaaca

SEQ ID NO: 73124 - RNA, 64 nt, hsa
agaacaccccugccgacucccagcccggccaaaaagacaaaacacauagacgcacacacucagg

SEQ ID NO: 73125 - RNA, 64 nt, hsa
gaagaagaagaaauaaaaacccacccaagcaagaagacaaaagguaaagacgcaacguuuccaa

SEQ ID NO: 73126 - RNA, 64 nt, hsa
ucauuguaaucaaugugggaaagcuuucagucagagacaaaaucuucuugagcaugaaaaaauu

SEQ ID NO: 73127 - RNA, 64 nt, hsa
uugaggccaaggagcuuuuuuuuuuuuuuuuucaagacaaaaggacucuguaauuccacuucua

SEQ ID NO: 73128 - RNA, 64 nt, hsa
guaaaaaaaaaaaaaaaaaaaaagacaaaacaaaagacaaaaaaaaaaaaaaaacccaacaaga

SEQ ID NO: 73129 - RNA, 64 nt, hsa
ugauaaaaaacuguaaaaaaaaaaaaaaaaaaaaagacaaaacaaaagacaaaaaaaaaaaaaa

SEQ ID NO: 73130 - RNA, 64 nt, hsa
gauucuugaacuugaaaaaaaaaaacacaaaaaaagacaaaaaaaaaaaaagaaaauauuuugg

SEQ ID NO: 73131 - RNA, 64 nt, hsa
auguuauuuauuagcccuaauuguguuugguuucagacaaaaccuuuucuccuguguaucuuug

SEQ ID NO: 73132 - RNA, 64 nt, hsa
aaguuauuuauuagcccuaauuguguuugauuucagacaaaauuaacccuuuucuccuguguau

SEQ ID NO: 73133 - RNA, 56 nt, hsa
aacuuucuucucuagaauaaaucaggagacaaaaugggguaaaaaacuucuuuuuc

SEQ ID NO: 73134 - RNA, 64 nt, hsa
uucuuggacuuugccccgaaagcacauccauaaaagacaaaaucugauauauuggacuucuuca

SEQ ID NO: 73135 - RNA, 64 nt, hsa
gcaugcauguauauguaaaauauauacuuuuccaagacaaaauggaacaucacuucucucuucu

SEQ ID NO: 73136 - RNA, 64 nt, hsa
ucuaacguguugauaaaaugugacuugacgguugagacaaaaaauacaguagagacagaaacga

SEQ ID NO: 73137 - RNA, 64 nt, hsa
ucuucauccaaaauugcaccuaagguguucauuuagacaaaauuguucgcuuagugauccacug

SEQ ID NO: 73138 - RNA, 64 nt, hsa
uguuuucuuuuucuuaaaaaaauaauaaaacuacagacaaaaacaaagugcaaacaacugagac

SEQ ID NO: 73139 - RNA, 64 nt, hsa
uuacauauuuauucauguucaugguacucuucuaagacaaaaucagauugauaacuaugaaagu

SEQ ID NO: 73140 - RNA, 64 nt, hsa
accacguuuauguuuaaauuucauuuuguucagcagacaaaauguacuucccuuaacuuucauu

SEQ ID NO: 73141 - RNA, 64 nt, hsa
acaacuggaauugagguugcacacugugauuuuuacaccgaaaagccaaaaggagcuggccauc

SEQ ID NO: 73142 - RNA, 64 nt, hsa
gagcaacuuuugaguaucuuuaguuuccugaaggacaccgaauucuccauuagauaaaccacca

SEQ ID NO: 73143 - RNA, 64 nt, hsa
uuucagugguccuacaaagguagauggugggcggacaccgaagucaacuugacuguaaaaguac

SEQ ID NO: 73144 - RNA, 64 nt, hsa
gcugcagaaauucguugccaaagauuggacagagacaccgaaggaaaugggguggugaaacccc

SEQ ID NO: 73145 - RNA, 64 nt, hsa
cagugucagcgaauccagaaggguaucagauuaaacaccgaauucagccacuggacuuuuaaaa

SEQ ID NO: 73146 - RNA, 64 nt, hsa
cuuuaggacaauguuguguaaaucuuugaaggacacaccgaagaccuuuauacugugaucuuuu

SEQ ID NO: 73147 - RNA, 64 nt, hsa
gucaaauuaugagucccugccuauuguccauuacacaccgaauguuaauuuaagaaccagaggc

SEQ ID NO: 73148 - RNA, 64 nt, hsa
caagacagggcaggaaguuaccuuccuggugcacacaccgaagugcucgagggagaggcugccg

SEQ ID NO: 73149 - RNA, 64 nt, hsa
aacaguccuuuaauaugaaccaacaaucuggagcacaccgaagggcaaucuaaauuguggcuug

SEQ ID NO: 73150 - RNA, 64 nt, hsa
auaagauuccaaagaacuuagauucauuucuucaacaccgaaaugcuggagguguuugaucagu

SEQ ID NO: 73151 - RNA, 64 nt, hsa
ggcagcaaccauucaucuuuccuuugcucuggauacaccgaaugaccagguaacaucaucaggc

SEQ ID NO: 73152 - RNA, 64 nt, hsa
ugagucccagagcuaaagaaccuucuaggcaaguacaccgaaugacucaguccagagggucaga

SEQ ID NO: 73153 - RNA, 64 nt, hsa
ccccuccccggcaucugccagcucagcacagaagacaccgaaugugcaucuggagguguugcgg

SEQ ID NO: 73154 - RNA, 64 nt, hsa
acugcacaugcuaaugacuuccucugacagccacacaccgaaucuugaugaaaaaagagaagag

SEQ ID NO: 73155 - RNA, 64 nt, hsa
aucccauggaagcugaggacuuauuccgcuuuccacaccgaacacuaaauguggaccaguauca

SEQ ID NO: 73156 - RNA, 64 nt, hsa
caguucaucagauguucaccauggccaccgcagaacaccgaaguaauuccagcauagcggggaa

SEQ ID NO: 73157 - RNA, 64 nt, hsa
cagaaaucuucuaaccuaccagagccuagaugagacaccgaauuaacauuaaaauuucaguaac

SEQ ID NO: 73158 - RNA, 63 nt, hsa
ucaggaguuggcaaauaagaauuaaaugucugcuacaccgaaaaccucacgccucucauucgu

SEQ ID NO: 73159 - RNA, 64 nt, hsa
caucauccuccaaagcaagaggcuuaagagagaaacaccgaaauucagauagcucagggacugc

SEQ ID NO: 73160 - RNA, 64 nt, hsa
uguacucauccaccccagccggcuugggacucagacaccgaagucuuuuuuuuuuucucuccga

SEQ ID NO: 73161 - RNA, 64 nt, hsa
ggccucggccuugcaccgggacgccgaguuugggacaccgaacacugggcaaaagagaaucccc

SEQ ID NO: 73162 - RNA, 64 nt, hsa
ccauauaggccauuuuagaaggccaaggagagccacaccgaaaaaggagacaguuccugugauc

SEQ ID NO: 73163 - RNA, 64 nt, hsa
aguagcucuguguuuagaguuggggacaaggaugacaccgaagguccaggaguccaggacagca

SEQ ID NO: 73164 - RNA, 50 nt, hsa
gaguguuuuguuguuucagaacaccgaaaagcuuuggaggauuucacucu

SEQ ID NO: 73165 - RNA, 64 nt, hsa
cgaauggcuuaaacuaauuugcuaugauccucuaacaccgaaauuucccauaaacuuaagugcc

SEQ ID NO: 73166 - RNA, 64 nt, hsa
ugcucugcuagucaggauugauaaacagcugggcacaccgaaacaguguaccaacgaauucacc

SEQ ID NO: 73167 - RNA, 64 nt, hsa
ugggagggcuuuagcaaugagacugcagccugugacaccgaaagagacuuuagcugaagaggag

SEQ ID NO: 73168 - RNA, 64 nt, hsa
acagucccugugcugguuagacacggagcgcugcacaccgaaagcccaaauugggagcucugcc

SEQ ID NO: 73169 - RNA, 64 nt, hsa
cuugugcauaagccugagauuuggaaagaauaaaacaccgaauugcagaagagcagcuacggag

SEQ ID NO: 73170 - RNA, 64 nt, hsa
auagagagagggaggagagcgagagagagugaggacaccgaacugggcuggcggcuccaaagca

SEQ ID NO: 73171 - RNA, 64 nt, hsa
auugcugacggaauaaaaacauaauagaacuacaacaccgaaggaaaugaaagaagcaagaagg

SEQ ID NO: 73172 - RNA, 64 nt, hsa
aucccugucgggcuccuccgacuccucgggcuggacaccgaaaccucccuucuuaaagcgugug

SEQ ID NO: 73173 - RNA, 64 nt, hsa
acaccgagguucacggucugaguaacaccucauuacaccgaagccugggccuguauucccagag

SEQ ID NO: 73174 - RNA, 64 nt, hsa
agccgucccauuucuccuggcgggguaacccauuacaccgaaguccuuuguuuucuaccacaau

SEQ ID NO: 73175 - RNA, 64 nt, hsa
caaaggacacuaugaacuuuuugaacugacaguuucuccuaacuuucugcuuuagcguaauugc

SEQ ID NO: 73176 - RNA, 64 nt, hsa
uucugucugccuaagagaaucaaccaaaggugauucuccuaaagagcagugaaggaaaugucag

SEQ ID NO: 73177 - RNA, 64 nt, hsa
guguguguguguguguguguguguguuggggggaucuccuaaauuauuucugugcaucuccuuu

SEQ ID NO: 73178 - RNA, 64 nt, hsa
uuagggaggcaccagauuggagacagaugugcuaucuccuaacagagugaugaggcuucaguug

SEQ ID NO: 73179 - RNA, 64 nt, hsa
agaguguggcuucauuuguccaugguagcccaucucuccuaagaccuuuucuagucugucuucc

SEQ ID NO: 73180 - RNA, 64 nt, hsa
gguaccuaagcaaauaggaguuggguuugguuuuucuccuaaaauaaugcucaauacuuaccua

SEQ ID NO: 73181 - RNA, 64 nt, hsa
cagcccugucaaggaauaccaacagaauauugauucuccuaaacuguauaguaaccugcuaacc

SEQ ID NO: 73182 - RNA, 64 nt, hsa
aucauguugucuguguuguguuaugugagaauuuucuccuaagucaugcagguaaugacaauau

SEQ ID NO: 73183 - RNA, 64 nt, hsa
aacagucuuuaugaugggauuaagguggacaagaucuccuaagaucugugaaugggauuaaggu

SEQ ID NO: 73184 - RNA, 64 nt, hsa
cuaagaucugugaaugggauuaagguggacaagaucuccuaagaucugaaaagaaaccuuaaua

SEQ ID NO: 73185 - RNA, 64 nt, hsa
auucuuauuugggggagugggcaaaauguugauuauuuucuaaugcuuuguagcaaagcauauc

SEQ ID NO: 73186 - RNA, 64 nt, hsa
cuuuuuuguaacuaauucugugagaguugagcucauuuucuaguuggaagaaugugauauuugu

SEQ ID NO: 73187 - RNA, 64 nt, hsa
uucuguuaucuauguagacagaauggucauguauauuuucuauuaguugaguuuuuacaucuuu

SEQ ID NO: 73188 - RNA, 64 nt, hsa
caguauaguuugaaagcggcacaauuaaaaauuaauuuucuaacaaaguugggagguuugaugg

SEQ ID NO: 73189 - RNA, 64 nt, hsa
uaacacagguaucuaggaaguaagugcugaguugauuuucuagguucuuacguauuugaaaaau

SEQ ID NO: 73190 - RNA, 64 nt, hsa
cuaucaauagucucuuuuccgcaggcaaaguggcauuuucuaaacauguuugcuuacugccagg

SEQ ID NO: 73191 - RNA, 64 nt, hsa
gugauaaauguugauguuuucuguguacaaacacauuuucuaugcaugugucucuguguauaug

SEQ ID NO: 73192 - RNA, 64 nt, hsa
guucauuucucauaacauauaugagguauacaaaauuuucuaacuccagauuguagucauuuug

SEQ ID NO: 73193 - RNA, 64 nt, hsa
uccuucaagagcaguuaucaauuguuaguuagauauuuucuauuuagagaaugcuuaagggauu

SEQ ID NO: 73194 - RNA, 64 nt, hsa
auuuuauauaccaguuaaucuuauuuauccuuauauuuucuaaauugccuagccgucacacccc

SEQ ID NO: 73195 - RNA, 64 nt, hsa
cagaaucccuuguaucuccuuucucgggaauuguauuuucuaauaaaugacauuugagaaaaaa

SEQ ID NO: 73196 - RNA, 64 nt, hsa
cuucccuacuuuauuaggacuugcccugaauaccauuuucuaccccuugccccuccauucuccu

SEQ ID NO: 73197 - RNA, 64 nt, hsa
ugacucuucaauguaaugaucagaguuuaaaaccauuuucuaauaauaaauuaaaucuucaguu

SEQ ID NO: 73198 - RNA, 64 nt, hsa
auuucauuugcaucauuaggguauccuuaaacugauuuucuauuacaauuggaaguggagaaua

SEQ ID NO: 73199 - RNA, 64 nt, hsa
uuaagaaauacuuucauuuauguuugcuagaaacauuuucuaaaugauagugauuagcugguua

SEQ ID NO: 73200 - RNA, 64 nt, hsa
uggccuauugcacaagucuugacaaacaacauauauuuucuaaaacuauccagauuucauuauc

SEQ ID NO: 73201 - RNA, 64 nt, hsa
uuuuguaaccugagcaguuaaugaaugugccaacauuuucuaggaagggacagcaagaauauuc

SEQ ID NO: 73202 - RNA, 64 nt, hsa
uacuauuuagauauaacacuauguuuauuuacuaauuuucuagauuuucuacuuuauuaauugu

SEQ ID NO: 73203 - RNA, 64 nt, hsa
gauauaacacuauguuuauuuacuaauuuucuagauuuucuacuuuauuaauuguuuugcacuu

SEQ ID NO: 73204 - RNA, 64 nt, hsa
aauaaagguguggcagaauauaauaaucuggacuauuuucuauaggauaauugcuggguuauaa

SEQ ID NO: 73205 - RNA, 64 nt, hsa
uccaguaaugucuuugaaagcaaaacuaauauuuauuuucuagauuaucccugugaauaauuga

SEQ ID NO: 73206 - RNA, 64 nt, hsa
ggagauacauuggucaaacacucaaaccuagaucauuuucuaccaacuaugguugccucaauau

SEQ ID NO: 73207 - RNA, 64 nt, hsa
auaauggguuuuauggauuucuuuguuauaauauauuuucuaccauuccaauaggagauacauu

SEQ ID NO: 73208 - RNA, 64 nt, hsa
aagaauuguaauggcuacaguuucaguuacuuccauuuucuagauggcuuuaauuuugaaagua

SEQ ID NO: 73209 - RNA, 64 nt, hsa
cuucuaaaaugcuuuuaauuaauauguucauuaaauuuucuaugcuuauuguacuuguuaucaa

SEQ ID NO: 73210 - RNA, 64 nt, hsa
cuacuaaauauuuuauaugaaauguuucacuaugauuuucuauuuuucuucuaaaaugcuuuua

SEQ ID NO: 73211 - RNA, 64 nt, hsa
gagccauguguacgaauugcaaucaugacaugguauuuucuauaauuauagagaucuuacuauu

SEQ ID NO: 73212 - RNA, 64 nt, hsa
uuuuuggcuguauguaauucagucauaaguaagcauuuucuaacguccauuauaucccuuuagg

SEQ ID NO: 73213 - RNA, 64 nt, hsa
guaguuuuucauuuccuacauuuauuagauuuucauuuucuauuaacaauugaauaccauuuca

SEQ ID NO: 73214 - RNA, 64 nt, hsa
gaagaucuagauccuagauauuagaauaaaauuuauuuucuacuguauccauuucaaauguuaa

SEQ ID NO: 73215 - RNA, 64 nt, hsa
gugugcuaugacccacuaugaccacagcaucugcauuuucuaaaaaauuccaugcagguguuuu

SEQ ID NO: 73216 - RNA, 64 nt, hsa
cucugccuuguucuuaucaacuugaaauguuggcauuuucuaaccuuguuuuguuggcuacaau

SEQ ID NO: 73217 - RNA, 64 nt, hsa
uucaaaugaguaaauagaccaaaguggggggacaauuuucuaguucuguagagggaaaaacauc

SEQ ID NO: 73218 - RNA, 64 nt, hsa
auuuggaagacacaaaucaaaugugaaggauuugauuuucuacauuuaaaaugaagaaccaaaa

SEQ ID NO: 73219 - RNA, 64 nt, hsa
gugagcgugaucucuuuucaguauaguaguuaacauuuucuaguauuuuuuauggagagaaugu

SEQ ID NO: 73220 - RNA, 64 nt, hsa
auccuuaagucugcucccacccucaguagaauuuauuuucuacaaagugguaguaauuuuuuuu

SEQ ID NO: 73221 - RNA, 64 nt, hsa
uauauuuucuaaagaaaaaaauaaaaaaaguuguauuuucuaauuuuuauuaccaauauauaag

SEQ ID NO: 73222 - RNA, 64 nt, hsa
ugcuauuguagauggcaucuuuuuaaaaaguuauauuuucuaaagaaaaaaauaaaaaaaguug

SEQ ID NO: 73223 - RNA, 64 nt, hsa
aaagaaugacuuuuccaagaguucuagauguuugauuuucuaauuaauacuuaucagaucuaca

SEQ ID NO: 73224 - RNA, 64 nt, hsa
uaaagaagggaaucuguuuaucgcuuuucaaaauauuuucuaaagugggggaagaaaguuuaua

SEQ ID NO: 73225 - RNA, 64 nt, hsa
gagaaaaaaaagcuuaauuuuuacauuauacuuaauuuucuaaaaccauguaacuccauugaac

SEQ ID NO: 73226 - RNA, 64 nt, hsa
auuuccaaggagauaaucuccuucuuggugccuaauuuucuagaugauaauaggcuaguuuuga

SEQ ID NO: 73227 - RNA, 64 nt, hsa
guauugaucugcuuugaauuuucaagcagccagaauuuucuaguuuaaauuggcagaguuauaa

SEQ ID NO: 73228 - RNA, 64 nt, hsa
uuguauuauuauauuggggaaaacauuuuuuaucauuuucuauuaagaaaauggaaaacuuaaa

SEQ ID NO: 73229 - RNA, 64 nt, hsa
ugugauguaugccauuaaaaaaauuguuuuuuuaauuuucuauauuauaaacauaaaauaagua

SEQ ID NO: 73230 - RNA, 64 nt, hsa
auuauuaaaugcugaggccaauaccaagaaguuuauuuucuauauuauacaauuaugaauuaca

SEQ ID NO: 73231 - RNA, 64 nt, hsa
guuacauuuggagaggucuuguugagaaggcaaaauuuucuaaauauuuugauaucaauuuggg

SEQ ID NO: 73232 - RNA, 64 nt, hsa
ucaaguuuuaagguuauauuuuuuaaaauaaugaauuuucuaucucuaggcaacaugucuuuau

SEQ ID NO: 73233 - RNA, 64 nt, hsa
cauuugguauguuucauucauuggaauauuucuuauuuucuacguguuugaaaagccuguaaga

SEQ ID NO: 73234 - RNA, 64 nt, hsa
uuuuuuuuuucuuaaaaucauagccauaugguaaauuuucuauuuuguuaugguucucuuuuau

SEQ ID NO: 73235 - RNA, 64 nt, hsa
uauaaaauacauuguugccuauuuagggaguaacauuuucuaguuuuuguuucugguuaaaaug

SEQ ID NO: 73236 - RNA, 64 nt, hsa
ggcuguugccaugaaggcuugcagaauugaguccauuuucuagcugccuuuauucacauaguga

SEQ ID NO: 73237 - RNA, 64 nt, hsa
gauuuuugcaauguaaaauaaaguguuucugauuauuuucuauguaaaggaacccucuccuuuc

SEQ ID NO: 73238 - RNA, 64 nt, hsa
ucuuuguuuuuaauugcagacauuuaaaaaugucauuuucuacuguuaagaguaauccucuuuc

SEQ ID NO: 73239 - RNA, 64 nt, hsa
uagaguuuauuuuauucucagaguuuggacuacaauuuucuaagauguuucugguucaagacug

SEQ ID NO: 73240 - RNA, 64 nt, hsa
caauuuucuaagauguuucugguucaagacugucauuuucuauuucaaccgaaaaguaagcauu

SEQ ID NO: 73241 - RNA, 64 nt, hsa
uuuuucuuuacacuaaucgauacauuuagaaaaaauuuucuaaguuagagacaaguuuaaaagu

SEQ ID NO: 73242 - RNA, 64 nt, hsa
gcccagugcuucuugaaacucaccucuacucuguauuuucuacaguugguucuuguguuauaaa

SEQ ID NO: 73243 - RNA, 64 nt, hsa
gaaaugauguugcuagugcaguguuucacaauucauuuucuacuaaauguguaccauuuuuuaa

SEQ ID NO: 73244 - RNA, 64 nt, hsa
uuggauuaaaucugauauuuucuaauacugaaagauuuucuaaaugucacugcugacauaacuc

SEQ ID NO: 73245 - RNA, 64 nt, hsa
gggguuggggugguuccuuuggauuaaaucugauauuuucuaauacugaaagauuuucuaaaug

SEQ ID NO: 73246 - RNA, 64 nt, hsa
acacucuccaggccgucaaauuauucucuuguucauuuucuauuuugaaucuccuuguuaguua

SEQ ID NO: 73247 - RNA, 64 nt, hsa
uaacuuguuuguauagaaaauaguaacaaggacuauuuucuauuguugucaucuauuuacuaga

SEQ ID NO: 73248 - RNA, 64 nt, hsa
agagagcuuaacagauaaaaaaugaaauuagucuauuuucuacuugccagcagaguaucugucu

SEQ ID NO: 73249 - RNA, 64 nt, hsa
ugacuuuaauuuucuuuauaucaguauuuuucagauuuucuauaugcuuuccuuuuaaaaucag

SEQ ID NO: 73250 - RNA, 64 nt, hsa
uccaguguacaugagaacauauauuuauugcaugauuuucuagauacacagucuaugcauuauu

SEQ ID NO: 73251 - RNA, 64 nt, hsa
cguuauccacccgauuuccuaauguaauugaaagauuuucuauuuugccacacacuuggagaca

SEQ ID NO: 73252 - RNA, 64 nt, hsa
uuuacaaauaugugccauugugcaacaucgguggauuuucuaaaaauaauguaaaugucuucua

SEQ ID NO: 73253 - RNA, 64 nt, hsa
aaccugaaauaauaagauaauaagaaaagcaauaauuuucuaaagcugugcugucggugauaca

SEQ ID NO: 73254 - RNA, 64 nt, hsa
uucaagcucuaacaaagucacuaacaaaugcauuauuuucuacagaauuagauguuaguaguac

SEQ ID NO: 73255 - RNA, 64 nt, hsa
uaauaauuucucaaugaauuuuaaaaaugggccuauuuucuauccccgugguucaucugauaua

SEQ ID NO: 73256 - RNA, 64 nt, hsa
uuugaacacuaccuuugcuguaauuucauuugagauuuucuaaggguagaauuuggucucacca

SEQ ID NO: 73257 - RNA, 64 nt, hsa
guguacauggagugaucauuuuacuaacauaaauauuuucuauguguguuucaguggaugacaa

SEQ ID NO: 73258 - RNA, 64 nt, hsa
uaagacguguugagauuggccugggaauaucaucauuuucuaguugacauuugaauccugugug

SEQ ID NO: 73259 - RNA, 64 nt, hsa
gucuaucauuuacaguuucaauagcacauaauuuauuuucuaugcauuauaaauggccuugcag

SEQ ID NO: 73260 - RNA, 64 nt, hsa
cugggaguuaaaacgcagaguauuacuauaguuaauuuucuaggguucucuuaugaaaaguaua

SEQ ID NO: 73261 - RNA, 64 nt, hsa
augcuuccagacaaagaaaaguuuguuaguccugauuuucuaaucguagccacucaaggaacag

SEQ ID NO: 73262 - RNA, 64 nt, hsa
aaaagugcaaaaaaaaagauucuguuauaaagugauuuucuaaguauuuccuaacuuuauuuuu

SEQ ID NO: 73263 - RNA, 64 nt, hsa
cauaucucuugccccaaagauugggcuguaagccauuuucuagcaaaugucucuaugaagguuu

SEQ ID NO: 73264 - RNA, 64 nt, hsa
guacuugucugccccucauuucaaggccagaguuauuuucuauuuauguauuagucuaggcuga

SEQ ID NO: 73265 - RNA, 64 nt, hsa
uucuguaucuucucacauucuguauacuguauccauuuucuagagaacccaguagcuuuuauac

SEQ ID NO: 73266 - RNA, 63 nt, hsa
accaagauauucugccaaaauaucaggaccagaauuuucuaccuaaggaccagaauuuuuuau

SEQ ID NO: 73267 - RNA, 64 nt, hsa
gaccaagauauucugccaaaauaucaggaccagaauuuucuaccuaaggaccagaauuuuuugu

SEQ ID NO: 73268 - RNA, 64 nt, hsa
gaccagaauauucuaccuaaauaucaaggccaggauuuucuaccuaaagaccaggacuuuuuau

SEQ ID NO: 73269 - RNA, 64 nt, hsa
gacuggaauauucuacccaaaugucaggaccaggauuuucuacccagagaccaagguguucuuc

SEQ ID NO: 73270 - RNA, 64 nt, hsa
gaccaaaauauucuacccauaugucaggaccaggauuuucuacccagagaccaagguuaucuuc

SEQ ID NO: 73271 - RNA, 64 nt, hsa
gaccaaaauauucuacccauaugucaggaccgggauuuucuacccagagaccugcauguucucu

SEQ ID NO: 73272 - RNA, 64 nt, hsa
gaccagaauauucuacccaaaugucaggaccaagauuuucuaccaaaauaucagguaaaauaga

SEQ ID NO: 73273 - RNA, 64 nt, hsa
aggggagaggauuuucuaagggcacagagaauccauuuucuacacauuaacuugagcugcugga

SEQ ID NO: 73274 - RNA, 64 nt, hsa
accaacacuuggagauuuuuccggaggggagaggauuuucuaagggcacagagaauccauuuuc

SEQ ID NO: 73275 - RNA, 64 nt, hsa
ugcucguuuucgcuggggauggaauuauuguaccauuuucuaucauggaauauuuauaggccag

SEQ ID NO: 73276 - RNA, 64 nt, hsa
ugguuaguuaaaagcccauugccauuugguguggauuuucuacuguaagaagagccauagcuga

SEQ ID NO: 73277 - RNA, 64 nt, hsa
caacacauuuauuuauacuaaauaacugucaaccauuuucuaacaaaaaguaagacugaauuga

SEQ ID NO: 73278 - RNA, 64 nt, hsa
ugggcacaaagaaaauuuagaucugacaaguauaauuuucuaaagacauuauuucaggauuaac

SEQ ID NO: 73279 - RNA, 64 nt, hsa
uuucaaaucaacuauuaaaaauuuucuaaucugcauuuucuacucaaguuuuauuuuaaaaaca

SEQ ID NO: 73280 - RNA, 64 nt, hsa
agugaaugaauacauuucaaaucaacuauuaaaaauuuucuaaucugcauuuucuacucaaguu

SEQ ID NO: 73281 - RNA, 64 nt, hsa
guuaaaccugcugcaagagccauaacuuugaggcauuuucuaaaugaacuguggggauccagga

SEQ ID NO: 73282 - RNA, 64 nt, hsa
aucagcucacucugaaacuuuaaggguaccagauauuuucuauacugcaggauuucugaugaca

SEQ ID NO: 73283 - RNA, 64 nt, hsa
uacuuaaugaauauguuaaggaccaggcuagaguauuuucuaagcuggaaacuuagugugccuu

SEQ ID NO: 73284 - RNA, 64 nt, hsa
auauuuauuucauuuaagauaauuuucaaaguuaauuuucuaaauaagauaauucucauuugug

SEQ ID NO: 73285 - RNA, 64 nt, hsa
aauaaaauuuauuaugcuuuauaaccucuucuguauuuucuaauuuuuucauugucuuugauaa

SEQ ID NO: 73286 - RNA, 64 nt, hsa
caucuaaauuucucaacuaguucagccuagcugaauuuucuaguguguuauacacuuugcuucc

SEQ ID NO: 73287 - RNA, 64 nt, hsa
auucugaacacauagaucucuuuccuaaacugacauuuucuauuuugacuguuuucauacuaua

SEQ ID NO: 73288 - RNA, 64 nt, hsa
auuuaacuuaauauuuaauuauuugauuuauuuaauuuucuauauucuuacaauguauguauga

SEQ ID NO: 73289 - RNA, 64 nt, hsa
ucauaaccauaccugauuauacuguguaacaaauauuuucuauugcaguuuucuuuccaguacu

SEQ ID NO: 73290 - RNA, 64 nt, hsa
ucucccgguaaaaaugaauugaaccauuucaacuauuuucuauauuuggagaaaguuugugccc

SEQ ID NO: 73291 - RNA, 64 nt, hsa
uugcaacagcaaguugauuucuugugaucccagaauuuucuaagaggaugaguugaaucuauag

SEQ ID NO: 73292 - RNA, 64 nt, hsa
auccauugcauuuuugccucuaaacaacuacagaauuuucuaggguuuuaaauuauguaaaaug

SEQ ID NO: 73293 - RNA, 64 nt, hsa
gacaaaucuugauaaguuuuuuuauauuaguuuuauuuucuagaaaaugucuuaugaauuucuc

SEQ ID NO: 73294 - RNA, 64 nt, hsa
agaguuuggagccauuuuggguagcugaucuugcauuuucuacgccucuacuuggucaguuucu

SEQ ID NO: 73295 - RNA, 64 nt, hsa
uccauuuuuuuuuuaauucuucccuuggauuaauauuuucuacugaaaagaaaugaaaucucag

SEQ ID NO: 73296 - RNA, 64 nt, hsa
guuaaugcuagucacagccaggaggucagaaggaauuuucuacuucuggauccaaauguuaccu

SEQ ID NO: 73297 - RNA, 64 nt, hsa
uuuccagaggcaaauuuugaauugagugccacugauuuucuagucugcuucauaguaagaaggg

SEQ ID NO: 73298 - RNA, 64 nt, hsa
cuucuucauuuuaauucuccuuuuaauguauuuaauuuucuacauagaaaacaugcaguaccuu

SEQ ID NO: 73299 - RNA, 64 nt, hsa
uugcaaauuggugauugugaaauuacagaaagugauuuucuagucugcuuuuuuuguuuaauuc

SEQ ID NO: 73300 - RNA, 64 nt, hsa
uugauuaggagauuuuucaguucuccauauaauaauuuucuacaaucagaucuaugcuguggca

SEQ ID NO: 73301 - RNA, 64 nt, hsa
uauuguauuuuauuuuuauuguuuuuuuuugaguauuuucuauuugagauugguugaaucugca

SEQ ID NO: 73302 - RNA, 64 nt, hsa
aucuagaaggaauuagaggauuagaaaaaucaccauuuucuagaccuuaauggaauaauggguc

SEQ ID NO: 73303 - RNA, 64 nt, hsa
gugaauuucagaggucucugcuagccuugguaucauuuucuagcaauaacugagagccaguuaa

SEQ ID NO: 73304 - RNA, 64 nt, hsa
uaguagaaaaaugaaguuuauuauaaguuuuuauauuuucuacuuguucauuuggugcaaacuc

SEQ ID NO: 73305 - RNA, 64 nt, hsa
gacccuaaaacaguuauauuacuuagauguuaaaauuuucuagugggcugugcaauugcugggu

SEQ ID NO: 73306 - RNA, 64 nt, hsa
uuuauacuuucugccuucagauagaguuucuaacauuuucuaguuugucaguuuuaaaauauaa

SEQ ID NO: 73307 - RNA, 64 nt, hsa
cuuauuuguaagagaaaauuaguuggacuuguuuauuuucuaguagcuuuuauaaguacacuca

SEQ ID NO: 73308 - RNA, 64 nt, hsa
aaaacauugauuuuuuuauaucuuucauaauauaauuuucuaacaaugcaauaaaaccacuaaa

SEQ ID NO: 73309 - RNA, 64 nt, hsa
uuggacuuuaugagagagucuuauaagaaucacgauuuucuacaccugucauugagccaagaaa

SEQ ID NO: 73310 - RNA, 64 nt, hsa
guauuuuggucauauugccaacuggaaagucaaaauuuucuaacaacuuuaaguaaguucuuug

SEQ ID NO: 73311 - RNA, 64 nt, hsa
aguauguagcaaauggaaagccuagaaauaucuuauuuucuaaguuuaccuuuaguuuaccuaa

SEQ ID NO: 73312 - RNA, 64 nt, hsa
uuuguguccauauuccauuagauugugauuauuaauuuucuagcuaugguauuacuauaucaca

SEQ ID NO: 73313 - RNA, 64 nt, hsa
uagggaaagugauuuaaacuuuauuuaaagagguauuuucuaauuaugcacagauaucuacuuu

SEQ ID NO: 73314 - RNA, 64 nt, hsa
guaucaucaccuuuuccagauacaaacuugccuuauuuucuaguuugugaacaagaacgaauga

SEQ ID NO: 73315 - RNA, 64 nt, hsa
acuauaauaugugcugaaacuaaauuucuuuaauauuuucuauuccugucagcaccuuuucuag

SEQ ID NO: 73316 - RNA, 64 nt, hsa
ugggaagaaguggaguuuuuugguuauuagguuaauuuucuaguaaaacacguugccuguuuuc

SEQ ID NO: 73317 - RNA, 64 nt, hsa
uuuauuuugaacuaauuucuuagagaauaguuauauuuucuauuacacaaguuuaaaaauauua

SEQ ID NO: 73318 - RNA, 64 nt, hsa
uaccacuacauuuuggugcuauuuaaggugugcaauuuucuauaggugacuuuugcaauucagg

SEQ ID NO: 73319 - RNA, 64 nt, hsa
auuuuauuauccaaaugcuagaaaacacacaugaauuuucuauaaaaucacgaauaugaaguac

SEQ ID NO: 73320 - RNA, 64 nt, hsa
aaaaggauuacgucugcaucuuuucuaacuuacuauuuucuaaaacacuuguggagcaucaagc

SEQ ID NO: 73321 - RNA, 64 nt, hsa; identical to SEQ ID NO: 73311

SEQ ID NO: 73322 - RNA, 64 nt, hsa; identical to SEQ ID NO: 73312

SEQ ID NO: 73323 - RNA, 64 nt, hsa
ccuuccuccccuuuugcccccguggggcucccggcauccugaaagccagcaaagccuccagcau

SEQ ID NO: 73324 - RNA, 64 nt, hsa
uccugaaagccagcaaagccuccagcaucuuuuccauccugaggugccucccaguggccuggcu

SEQ ID NO: 73325 - RNA, 64 nt, hsa
ucccacugcucuacaggcugugacuuuuuuuaagcauccugacaggaaauguuuucuucuacau

SEQ ID NO: 73326 - RNA, 64 nt, hsa
augaauuguucacuacaauuagagaaucauuuaacauccugaccugguaagcugccacacaccu

SEQ ID NO: 73327 - RNA, 64 nt, hsa
uuuuuagaaccacagacuaucccucuuuuuagagcauccugaucaauugcaaguacuuccacuu

SEQ ID NO: 73328 - RNA, 64 nt, hsa
accaguggcugacaaggcauauagggauauaugccauccugagaggaguaaaguguuuagauuc

SEQ ID NO: 73329 - RNA, 64 nt, hsa
uguggcaucagucccugagucaccauggaagcagcauccugaccacagcuggcagucaagccac

SEQ ID NO: 73330 - RNA, 64 nt, hsa
augccuccucuucugcacagaaugcuuccaccagcauccugagaagaaaugauuacuucugaaa

SEQ ID NO: 73331 - RNA, 64 nt, hsa
aaucaugcuggagaccuuaacucccauccugauacauccugaaguaacacuguuuuaaacuuuc

SEQ ID NO: 73332 - RNA, 64 nt, hsa
cacugauuuuaaucaugcuggagaccuuaacucccauccugauacauccugaaguaacacuguu

SEQ ID NO: 73333 - RNA, 64 nt, hsa
gaucuuucuauauaauaaauaacacaggagugaacauccugaaucagaucuuagcagagaugcu

SEQ ID NO: 73334 - RNA, 64 nt, hsa
uuccccaugacgagagccuccugucugcaguggccauccugaggauagggcagagugcccaggg

SEQ ID NO: 73335 - RNA, 64 nt, hsa
auuugcacagaggaaagcgggugcccggcauggccauccugauguugcuggcgggauccccaug

SEQ ID NO: 73336 - RNA, 64 nt, hsa
agagcaagaggucccgaguccccuccuagucuuucauccugaauuugcacagaggaaagcgggu

SEQ ID NO: 73337 - RNA, 64 nt, hsa
cuugauuuaggcuugggcugacgacaaaguuguacauccugaaccccaaagccgugagugucau

SEQ ID NO: 73338 - RNA, 64 nt, hsa
aaguacagguguucuuuggcuuaggauaggguuacauccugauaaaauaaucauaagucaaaaa

SEQ ID NO: 73339 - RNA, 64 nt, hsa
gccucacugccccucuugcagaguccccuuugcccauccugaaugcacagucucccugcucaug

SEQ ID NO: 73340 - RNA, 64 nt, hsa
ggucuuuggauggcuugccccgugcagcaucuugcauccugagucagaaguggaaauguccagc

SEQ ID NO: 73341 - RNA, 64 nt, hsa
cuauaaacaaagucuuccuggaaguaauuguaagcauccugaaauaaaaaagcaagaauaugaa

SEQ ID NO: 73342 - RNA, 64 nt, hsa
auuaaagcguaaaaggagaccuacaucaggccuucauccugaggauuuuaucaagaaagcagau

SEQ ID NO: 73343 - RNA, 64 nt, hsa
gaggaaaagucuuccuaauugugccccuaaagagcauccugauaccauucuauucuccagacau

SEQ ID NO: 73344 - RNA, 64 nt, hsa
ggagaaguaguauuugccuauuucccccuucauccauccugagccaaauuucuuuugcugaaca

SEQ ID NO: 73345 - RNA, 64 nt, hsa
cagcagccaccuccucugagaucccucaccuucuccaaaccagauccaaucaaaccucagcccg

SEQ ID NO: 73346 - RNA, 64 nt, hsa
cccccugcaugccccaugugggaggugcugagcuccaaaccagcaucacaccaacucugacaca

SEQ ID NO: 73347 - RNA, 64 nt, hsa
acccgcagaugacacgcgcucuccaccacccaacccaaaccaugagaauuugcaacaggggagg

SEQ ID NO: 73348 - RNA, 64 nt, hsa
guuagggucagccauuuuuaaugaucucggaugaccaaaccagccuucggagcguucucugucc

SEQ ID NO: 73349 - RNA, 64 nt, hsa
uacaauucaaguugagauuuguggggggacacaaccaaaccauaucagcauccuuucaagaaua

SEQ ID NO: 73350 - RNA, 64 nt, hsa
acaauuucaaguugagauuuggguggggacauagccaaaccauaucauucuaccccuggccccu

SEQ ID NO: 73351 - RNA, 64 nt, hsa
uggggaagccugucuagaugugggacucauugccccaaaccagggagaggaagagcucccacag

SEQ ID NO: 73352 - RNA, 64 nt, hsa
ggggguaaacaggucucccagcauucugaguguuccaaaccaguaauccacaugccaauucaaa

SEQ ID NO: 73353 - RNA, 64 nt, hsa
ucucgguuuucuuacacugugaucuuaaaaguuaccaaaccaaagucauuuucaguuugaggca

SEQ ID NO: 73354 - RNA, 64 nt, hsa
agaggcccuucucacugagacagcaacauuuaaaccaaaccagaggaaguauuuguggaacuca

SEQ ID NO: 73355 - RNA, 64 nt, hsa
auauauaaagauaaauaugccugagcucccauguccaaaccauccugaagggcuguaguagaga

SEQ ID NO: 73356 - RNA, 64 nt, hsa
cagaacuucuaacuugaccacacaaggcaguugcccaaaccauucugugggggaugcauccaga

SEQ ID NO: 73357 - RNA, 64 nt, hsa
cacaaacuugugagcaucagagggcugauggauuccaaaccaggacacuacccugagaucugca

SEQ ID NO: 73358 - RNA, 52 nt, hsa
ugguaaccgaaaaagaauagagccaaaccaacaccccauaugucaguguaaa

SEQ ID NO: 73359 - RNA, 64 nt, hsa
agaggagagcuugaugugauuaucuucaaacccaccaaaccaacaggauaauugacaaauaaac

SEQ ID NO: 73360 - RNA, 64 nt, hsa
caaaugcuaauguuuuauucaauguaaaggaagaccaaaccauguaccuuaugaagaccuuugu

SEQ ID NO: 73361 - RNA, 64 nt, hsa
uugaaucugguuauuauuuaaaaacuagaagcccccaaaccagcagaucuuacugaagaugaug

SEQ ID NO: 73362 - RNA, 64 nt, hsa
aaacuccagauaucaaggaauugggaaauccuggccaaaccaccccaagaugauuacacugaaa

SEQ ID NO: 73363 - RNA, 64 nt, hsa
ugaacucauugaucgagugcugucugcuaaaucuccaaaccauucccaaaccuuuccccguagu

SEQ ID NO: 73364 - RNA, 64 nt, hsa
cgaagugucagcccucaauguuggguacuuagacccaaaccaauaaauggugaguuuugaacaa

SEQ ID NO: 73365 - RNA, 64 nt, hsa
uaccauuuaaguugagauuucaguggggacacagccaaaccauaucauucuaccccuggcaccu

SEQ ID NO: 73366 - RNA, 64 nt, hsa
auaaauucaaguugcaauuucaguggggacauagccaaaccauaucacuggugaugccacuucu

SEQ ID NO: 73367 - RNA, 64 nt, hsa
agcaaagucucaccccuuugucuacguugcuuccccaaaccaugagcagagggacuucgaugcc

SEQ ID NO: 73368 - RNA, 64 nt, hsa
gcuuccccaaaccaugagcagagggacuucgaugccaaaccagacucggguccccuccugcuuc

SEQ ID NO: 73369 - RNA, 64 nt, hsa
ccccaaaccaaucaaggguuuguuuacgggagugccaaaccagcccucggcugcuaugaguugg

SEQ ID NO: 73370 - RNA, 64 nt, hsa
gacgagcuagcccgaacugacuucagcagcuaccccaaaccaaucaaggguuuguuuacgggag

SEQ ID NO: 73371 - RNA, 64 nt, hsa
ggaagacugccucaaacaaacaaaaaacaacaaaccaaaccaaaccaaaccaaaaaaaucucaa

SEQ ID NO: 73372 - RNA, 64 nt, hsa
acugccucaaacaaacaaaaaacaacaaaccaaaccaaaccaaaccaaaaaaaucucaaagcga

SEQ ID NO: 73373 - RNA, 64 nt, hsa
cucaaacaaacaaaaaacaacaaaccaaaccaaaccaaaccaaaaaaaucucaaagcgauugga

SEQ ID NO: 73374 - RNA, 64 nt, hsa
ucugccugucccuguaucagcggcuacccaccuuccaaaccacucaggacaguacccguggcac

SEQ ID NO: 73375 - RNA, 64 nt, hsa
cuuuucaugugauguggaaaccuacuucuguccuccaaaccaugaaaugugucaucuagacugc

SEQ ID NO: 73376 - RNA, 64 nt, hsa
guauaauggguauacauuuuuguaaauagcauccccaaaccagccagccuucaguuauuuacaa

SEQ ID NO: 73377 - RNA, 64 nt, hsa
cuccugcagcaugccccuuaagauuuucuacaacccaaaccaaguguauguauugauuucuagg

SEQ ID NO: 73378 - RNA, 64 nt, hsa
guuaaauaggcaagguacccagugauaacaccaaccaaaccacuccuaucugcaugauucugaa

SEQ ID NO: 73379 - RNA, 64 nt, hsa
uaugcggcauuuaugaccaaucuguacuaauucuccaaaccaguauuauuucaauuauggcacu

SEQ ID NO: 73380 - RNA, 64 nt, hsa
guguuuaaaugugacacuugugagaaggcauuugccaaaccaagccagcuggagcgccacagcc

SEQ ID NO: 73381 - RNA, 64 nt, hsa
uuaguaucgucaauggugccacauaaaacaugucccaaaccaaaucccacccgugcugggcaga

SEQ ID NO: 73382 - RNA, 64 nt, hsa
guuccucggcggacucugcugaccuccugcagacccaaaccacagccacaucccagcuucugug

SEQ ID NO: 73383 - RNA, 64 nt, hsa
ggcugccagccaggacccuggccugcagccugauccaaaccaaagacuguagaacccuggggug

SEQ ID NO: 73384 - RNA, 64 nt, hsa
ccuaggacuugacccuuaccaaaccacagagaauccaaaccaauccaugauaaugucaguagga

SEQ ID NO: 73385 - RNA, 64 nt, hsa
gguuagaaaaccuucaccuaggacuugacccuuaccaaaccacagagaauccaaaccaauccau

SEQ ID NO: 73386 - RNA, 64 nt, hsa
aauccagacucaggguuccagaaaucccccguucccaaaccaaaccaaucauggaucuucccuu

SEQ ID NO: 73387 - RNA, 64 nt, hsa
agacucaggguuccagaaaucccccguucccaaaccaaaccaaucauggaucuucccuuuaagg

SEQ ID NO: 73388 - RNA, 64 nt, hsa
caguaccuggaugauucccaccaaggaggaauggccaaaccagaugggugagaacaagcccaau

SEQ ID NO: 73389 - RNA, 64 nt, hsa
caauaguucaggucagacaucuaagauccccaggccaaaccaugccacacacgugucuguuccg

SEQ ID NO: 73390 - RNA, 64 nt, hsa
gaacagacaggcauaaaucuguucauaugguagaacacaugauguuagaguauauuuuguugaa

SEQ ID NO: 73391 - RNA, 64 nt, hsa
guguaucucuauuucuggccaucacuuuuuuaauacacaugacuuuccucucccaguuuccaga

SEQ ID NO: 73392 - RNA, 64 nt, hsa
auccugacacaaaaacacaugagcauacaugucuacacaugacuacacaaaugcaaaccuuugc

SEQ ID NO: 73393 - RNA, 64 nt, hsa
uuagucuuagucaccuuauuauccugacacaaaaacacaugagcauacaugucuacacaugacu

SEQ ID NO: 73394 - RNA, 64 nt, hsa
ccguauaugagcacaaguaagguuucagagcaacacacaugagaaagagaguaacccggaauug

SEQ ID NO: 73395 - RNA, 64 nt, hsa
gaaaguaugacagauuucuacuuaacuagaauggacacaugauccacaauuuucucuucaaggg

SEQ ID NO: 73396 - RNA, 64 nt, hsa
cauuucaugugcagacgugccucuguguaaauguacacaugaacuucaugugggcuuaauuuuc

SEQ ID NO: 73397 - RNA, 64 nt, hsa
cuggguugacuggaaaggaauggaaaauauaguaacacaugaaaaaaugcuacuccaaucugaa

SEQ ID NO: 73398 - RNA, 64 nt, hsa
ucagaaaaacucuagggaugcacugcaugugugaacacaugauaaaaaagucaugcuuuauuuu

SEQ ID NO: 73399 - RNA, 64 nt, hsa
uguaucaacaaugauuaacuccuuuauuauacauacacaugaaugugcauuuuugguaaaugca

SEQ ID NO: 73400 - RNA, 64 nt, hsa
ggaaagcguuaucucauagcucaagcuuucgaagacacaugacaaugcacacuggagauggacc

SEQ ID NO: 73401 - RNA, 64 nt, hsa
ggaaagcauuugaucaucugggaagcuuccaaagacacaugauaaggcacacuagagauggacc

SEQ ID NO: 73402 - RNA, 64 nt, hsa
gcagggaaggaacuuacugucuaauauaggaaaaacacaugagaacaggugcaauauauugacu

SEQ ID NO: 73403 - RNA, 64 nt, hsa
cuuuucauuuuuuuugucagcucuuucuuaacuaacacaugagcagucacuuuggagagaagcc

SEQ ID NO: 73404 - RNA, 64 nt, hsa
ccacuuagucauguaagugcauauacacauacacacacaugaguguagacauguguuuauuaau

SEQ ID NO: 73405 - RNA, 64 nt, hsa
uaauaauauguagaaaaauguaacuuagagaguaacacaugaacauugaaguuaaaacccagaa

SEQ ID NO: 73406 - RNA, 64 nt, hsa
cccaccagaucuccauucuuugccaugagggccaacacaugagaccccaccucccucccugccu

SEQ ID NO: 73407 - RNA, 64 nt, hsa
uucuguuguuuuguuuuuaacaacuauacuuugcacacaugaaggucacugugguuuguguguu

SEQ ID NO: 73408 - RNA, 64 nt, hsa
gcggaacuguuuuaauuacaauuauacuaacaauacacaugagaauagauauuagaaacuaaua

SEQ ID NO: 73409 - RNA, 64 nt, hsa
auacccucugauuauuggaauccauuggcuugagacacaugacccaaacauagaauggaguacc

SEQ ID NO: 73410 - RNA, 64 nt, hsa
uucuguuuauugucuguaccauuuugcuaccaguuacauugaacugcuuuaaaauaaauaauaa

SEQ ID NO: 73411 - RNA, 64 nt, hsa
ucuuagaauuugagauguucauagcauguuuuauuacauugaagaaacuaaaacauaaaugaaa

SEQ ID NO: 73412 - RNA, 64 nt, hsa
ucuagcuaaugcucaggugagaucauagcuuaaauacauugaaaaaacuaaaguaccacaauag

SEQ ID NO: 73413 - RNA, 64 nt, hsa
ccugaagagugaggacccguguaacuggcaguguuacauugaccccagccugacuguccucaug

SEQ ID NO: 73414 - RNA, 64 nt, hsa
uauggaucugugccacaggggauuuaugcugcuuuacauugacuaugcaguugaagaguugcac

SEQ ID NO: 73415 - RNA, 64 nt, hsa
aaaagagaaaaauauuuuaauuuaaaaauuguaauacauugauuuauaaaaugccuucucugau

SEQ ID NO: 73416 - RNA, 64 nt, hsa
caaccccacccuacuagcuaggucuucaguguuuuacauugaauauugguacauuuuaauuauu

SEQ ID NO: 73417 - RNA, 64 nt, hsa
gaacaaaguacacuugauaaaaacauuuucaacauacauugagccuaaacagcaguuaaguugu

SEQ ID NO: 73418 - RNA, 64 nt, hsa
uuuuuaaagccagucuuguucacauccauuacuauacauugaauuaugcuguguaaaaauagaa

SEQ ID NO: 73419 - RNA, 64 nt, hsa
uuccaaauuagcaacuucauccugcuuucuauuuuacauugaguaaaguuuuaaaaagacaaca

SEQ ID NO: 73420 - RNA, 64 nt, hsa
ccugucaaagaccuaagucuguaagcuggugccauguccauacaccaugucacuuuacucuuca

SEQ ID NO: 73421 - RNA, 64 nt, hsa
gugagagcacgauggugccuguguucugugaauguguccauaugugucuguaagagagacagag

SEQ ID NO: 73422 - RNA, 64 nt, hsa; identical to SEQ ID NO: 23640

SEQ ID NO: 73423 - RNA, 64 nt, hsa; identical to SEQ ID NO: 23641

SEQ ID NO: 73424 - RNA, 64 nt, hsa; identical to SEQ ID NO: 23642

SEQ ID NO: 73425 - RNA, 64 nt, hsa; identical to SEQ ID NO: 23643

SEQ ID NO: 73426 - RNA, 64 nt, hsa; identical to SEQ ID NO: 23644

SEQ ID NO: 73427 - RNA, 64 nt, hsa; identical to SEQ ID NO: 23645

SEQ ID NO: 73428 - RNA, 64 nt, hsa; identical to SEQ ID NO: 23646

SEQ ID NO: 73429 - RNA, 64 nt, hsa; identical to SEQ ID NO: 23647

SEQ ID NO: 73430 - RNA, 64 nt, hsa; identical to SEQ ID NO: 23648

SEQ ID NO: 73431 - RNA, 64 nt, hsa; identical to SEQ ID NO: 23649

SEQ ID NO: 73432 - RNA, 64 nt, hsa; identical to SEQ ID NO: 23650

SEQ ID NO: 73433 - RNA, 64 nt, hsa; identical to SEQ ID NO: 23651

SEQ ID NO: 73434 - RNA, 64 nt, hsa; identical to SEQ ID NO: 23652

SEQ ID NO: 73435 - RNA, 64 nt, hsa; identical to SEQ ID NO: 23653

SEQ ID NO: 73436 - RNA, 64 nt, hsa; identical to SEQ ID NO: 23654

SEQ ID NO: 73437 - RNA, 64 nt, hsa; identical to SEQ ID NO: 23655

SEQ ID NO: 73438 - RNA, 64 nt, hsa; identical to SEQ ID NO: 23656

SEQ ID NO: 73439 - RNA, 64 nt, hsa; identical to SEQ ID NO: 23657

SEQ ID NO: 73440 - RNA, 64 nt, hsa; identical to SEQ ID NO: 23658

SEQ ID NO: 73441 - RNA, 64 nt, hsa; identical to SEQ ID NO: 23659

SEQ ID NO: 73442 - RNA, 64 nt, hsa; identical to SEQ ID NO: 23660

SEQ ID NO: 73443 - RNA, 64 nt, hsa; identical to SEQ ID NO: 23661

SEQ ID NO: 73444 - RNA, 64 nt, hsa; identical to SEQ ID NO: 23662

SEQ ID NO: 73445 - RNA, 64 nt, hsa; identical to SEQ ID NO: 23663

SEQ ID NO: 73446 - RNA, 64 nt, hsa; identical to SEQ ID NO: 23664

SEQ ID NO: 73447 - RNA, 64 nt, hsa; identical to SEQ ID NO: 23665

SEQ ID NO: 73448 - RNA, 64 nt, hsa; identical to SEQ ID NO: 23666

SEQ ID NO: 73449 - RNA, 64 nt, hsa; identical to SEQ ID NO: 23667

SEQ ID NO: 73450 - RNA, 64 nt, hsa; identical to SEQ ID NO: 23668

SEQ ID NO: 73451 - RNA, 64 nt, hsa; identical to SEQ ID NO: 23669

SEQ ID NO: 73452 - RNA, 64 nt, hsa; identical to SEQ ID NO: 23670

SEQ ID NO: 73453 - RNA, 64 nt, hsa
ugccccacucccaucucuucuucccugccaccccucccugcagccuccgcggcucacuccagcc

SEQ ID NO: 73454 - RNA, 64 nt, hsa
cuccuucuauucccuuccuucugcccugccugccucccugcaccugcggccucucuaggaagcu

SEQ ID NO: 73455 - RNA, 64 nt, hsa
gguccucugggaugccagcucuccccuuugugcuucccugcagcaacccauggagggcccaggg

SEQ ID NO: 73456 - RNA, 64 nt, hsa
caguuggugggggugcgggggugcguguccccauucccugcaacagcaaauggggcuccuucuu

SEQ ID NO: 73457 - RNA, 64 nt, hsa
ugaguccuggacuggacugaacauccagaaagcuucccugcaaucuugggguuuggcuuuaguu

SEQ ID NO: 73458 - RNA, 64 nt, hsa
uugucgagaggauuuccugagacugguuuggaucucccugcaugacagucccccagaaacuuag

SEQ ID NO: 73459 - RNA, 64 nt, hsa
uggcccugccuugagaagagacacaggucucccgucccugcaccagcugagagagacuugccgc

SEQ ID NO: 73460 - RNA, 64 nt, hsa
ucuggugaaaagcuuuucacuaagugagguuccuucccugcaaaugcugaaucuagccuaauuc

SEQ ID NO: 73461 - RNA, 64 nt, hsa
gggcagccggcucuccuugcacgccucggccacgucccugcacucucagcccccgcccgucacc

SEQ ID NO: 73462 - RNA, 64 nt, hsa
ccucuccuggaucaaaaaugaaucacuucugaagucccugcagcccuuugccaaguggcauuac

SEQ ID NO: 73463 - RNA, 64 nt, hsa
cuuggggugugagugagacagcuugccagcugcaucccugcagacagaggauguguguccacau

SEQ ID NO: 73464 - RNA, 64 nt, hsa
cuaacacaggagaugaugggaaccugucccgcagucccugcaugaccauuggcccugcuggccu

SEQ ID NO: 73465 - RNA, 64 nt, hsa
uggaggaugaccuucggucggucugucuggguucucccugcagacagcuuccuagcucaugccc

SEQ ID NO: 73466 - RNA, 64 nt, hsa
acaaguaguccuugaaacugagccccauucugaaucccugcaggccaagucauugcucagccag

SEQ ID NO: 73467 - RNA, 64 nt, hsa
uaggaugugcauuuucaccugagguuucccugcaucccugcagugccaaagccccaccuucagg

SEQ ID NO: 73468 - RNA, 64 nt, hsa
aaggaauuuaggaugugcauuuucaccugagguuucccugcaucccugcagugccaaagcccca

SEQ ID NO: 73469 - RNA, 64 nt, hsa
gagcuagaaggcccugcagcuacagcugcuucauucccugcauuagugccugguuacuggguac

SEQ ID NO: 73470 - RNA, 64 nt, hsa
gagcuagaaggcccugcagcuacagcugcuucauucccugcauuagcgagcaguuauuggguac

SEQ ID NO: 73471 - RNA, 64 nt, hsa
ucugaucuaucucuggaaaaccagccauuccuccucccugcagucagaauucuuugcccugucu

SEQ ID NO: 73472 - RNA, 64 nt, hsa
auuuuguuucuggagaaggcagcaaacuuuuacuucccugcagaaguaguuaaguacauagugu

SEQ ID NO: 73473 - RNA, 64 nt, hsa
guuaccauaaagcuaaugcucuggcacaagcgagucccugcaaacuaccacugcugaggacagu

SEQ ID NO: 73474 - RNA, 64 nt, hsa
cuucccacccacccaguccauucacccucaccucucccugcauggaggcaacagcauuucaaga

SEQ ID NO: 73475 - RNA, 64 nt, hsa
acuuagcguuuggauagacuccaugccuucucucucccugcaaagaaaaaucuugaacauuuau

SEQ ID NO: 73476 - RNA, 64 nt, hsa
uacaaggacauguacuaacggcggcacccaggccucccugcagacuccaauggggccagcacug

SEQ ID NO: 73477 - RNA, 64 nt, hsa
cccuuuacucagcccagcuggccaccuagaagucucccugcacagccucuaguguccggggacc

SEQ ID NO: 73478 - RNA, 64 nt, hsa
uccauguagcugauucuguuuuucacaucuauacucccugcacccuucugacugacaguucauc

SEQ ID NO: 73479 - RNA, 64 nt, hsa
cagcgcugcggucuggucucagggcgcaaacacaucccugcacccggugguggugauguuggga

SEQ ID NO: 73480 - RNA, 64 nt, hsa
agaaaucuccauuccacacaugacugaguuccuaucccugcacugguacuggcucuuuucuccu

SEQ ID NO: 73481 - RNA, 64 nt, hsa
aagaagauucuugugaaguuuccccagcaccccuucccugcauguguuccauugugacuucucu

SEQ ID NO: 73482 - RNA, 64 nt, hsa
cuagcuuugauggcagcaagaccaaaaguagaaaucccugcacucaucacaaagcccauacaac

SEQ ID NO: 73483 - RNA, 64 nt, hsa
ccuuccuggguguuaacuggggacucucuugaccucccugcaucaaccugcagaauaaaugaga

SEQ ID NO: 73484 - RNA, 64 nt, hsa
ugauuuuggucaauuuuauuauuaauucuuaaauucccugcagagaaugcccccuuuauugcug

SEQ ID NO: 73485 - RNA, 64 nt, hsa
uggcauugcucccacugagcccuacuccacccugucccugcacucccuugguugccaaaaaaau

SEQ ID NO: 73486 - RNA, 64 nt, hsa
gaggggaugcuguguuugggggguuguuuccaagucccugcaaagaagcaccacucuagacugg

SEQ ID NO: 73487 - RNA, 64 nt, hsa
cuuccuccuggaguccggagccgccuacaacugcucccugcacggugcguccugcuggucuggc

SEQ ID NO: 73488 - RNA, 64 nt, hsa
acacagggugagaagagucagggccgcaccucugucccugcaaaccaacaggugcauggugagu

SEQ ID NO: 73489 - RNA, 64 nt, hsa
cgcucaggguugcggcagagccauggacuuccggucccugcaacgggugaccuaagcguggugc

SEQ ID NO: 73490 - RNA, 64 nt, hsa
cacgacaccaggcaggagugagccucaggccccgucccugcaccccaccccugcgugcgccucu

SEQ ID NO: 73491 - RNA, 64 nt, hsa
cgugucuggggggcgacguggcgggucggccgguucccugcauucguuuuacuuugguguccca

SEQ ID NO: 73492 - RNA, 64 nt, hsa
uuauacauuagacauuggcacuuguguaaaacugucccugcagauugagcaggaaguaaaaaca

SEQ ID NO: 73493 - RNA, 64 nt, hsa
acucuguggguugcuaggauguaauuuuaaugcuucccugcaguccaaagaugauuuuuucacc

SEQ ID NO: 73494 - RNA, 64 nt, hsa
cagccagugucuuguccuuaguaauuauuugcuuucccugcaguucaauuucuccuuggaacuc

SEQ ID NO: 73495 - RNA, 64 nt, hsa
ggguccucaccccuguccacccugugccuggcugucccugcacccagauacagcaacauggccu

SEQ ID NO: 73496 - RNA, 64 nt, hsa
uacccuaggacacuggaaugcccugggagcccccucccugcaaccagccugaguucagccccac

SEQ ID NO: 73497 - RNA, 64 nt, hsa
ucccugcugauguggcugaccccucucccaccccucccugcaggcggcuggccaggugggcagg

SEQ ID NO: 73498 - RNA, 64 nt, hsa
uauggagccucucuauuuuaccucuuuccgugcaucccugcacccgccacacccccuucagcua

SEQ ID NO: 73499 - RNA, 64 nt, hsa
cacugggggagggaggcaucuuguuucuugugguucccugcaggccaguccuguccuccuuucc

SEQ ID NO: 73500 - RNA, 64 nt, hsa
gucccgcucuuauccaacucuuccaggccccaccucccugcaccccuccccucuauagagcagg

SEQ ID NO: 73501 - RNA, 64 nt, hsa
guuuuagcugaaucccuugcuucugugcuuucccucccugcacaugggcacuguaucagauaga

SEQ ID NO: 73502 - RNA, 64 nt, hsa
gacaucgagacuccaggggguccuggcuccccugucccugcagcccugcaggucagugcaugau

SEQ ID NO: 73503 - RNA, 64 nt, hsa
cugccuguuuaaagcaggcagcaggcuuaggccuucccugcaaccccaacacccacaaguuugu

SEQ ID NO: 73504 - RNA, 64 nt, hsa
ccuguggggaaacuguucccuggaaccacuccacucccugcauccccacacuucacagcaucuu

SEQ ID NO: 73505 - RNA, 64 nt, hsa
cacugggucucagauccuucugcugacugccagaucccugcauuucaagcacuacgccuuccac

SEQ ID NO: 73506 - RNA, 64 nt, hsa
augggucauuuucaaaggggcaacagugauaccaucccugcacuccuggguccugcucuuccaa

SEQ ID NO: 73507 - RNA, 64 nt, hsa
cugggaauaaacagcugcccuagccccagagggaucccugcacccaggaggccuccugacacca

SEQ ID NO: 73508 - RNA, 64 nt, hsa
ggguuggagcucuggcacccggggagguagcauuucccugcagaugguacagauguuccugccu

SEQ ID NO: 73509 - RNA, 64 nt, hsa
uuugguagguucuucguucucuuccccgugaucuucccugcagccugggauggccagggucuga

SEQ ID NO: 73510 - RNA, 64 nt, hsa
acugugcccuggcccaggcaucaccaacacggccucccugcagcugcccugccaccgacagacc

SEQ ID NO: 73511 - RNA, 64 nt, hsa
acagaagcaccuuugguucugcaggucaugccccucccugcagggaagggaaagcuggugguag

SEQ ID NO: 73512 - RNA, 64 nt, hsa
gcagaccccacccugucugcaggccacccccaccucccugcagcuuugaggcuggcggggucug

SEQ ID NO: 73513 - RNA, 64 nt, hsa
gguacucagucagcccagugggaucuuacccacuucccugcaaggugcaccugccccaggcuca

SEQ ID NO: 73514 - RNA, 64 nt, hsa
gaccauaagguacaucauuuaucuugaacauuccgacguguaacucacagccgaagcacuccau

SEQ ID NO: 73515 - RNA, 64 nt, hsa
gaccauaagguacaucaguuaucuugaacauucugacguguaaaggaccauaagguacaucauu

SEQ ID NO: 73516 - RNA, 64 nt, hsa
acuuucugacuaagcuaaaaaugaaugaaaaugguggcuaaagaaaauagggacucugaagaug

SEQ ID NO: 73517 - RNA, 64 nt, hsa
aaaaaaguugaauuccaauugcuuuuuggccuuuuggcuaaaauaaauguagcaucuaauuuua

SEQ ID NO: 73518 - RNA, 64 nt, hsa
uguggcuuaacuacuucucccuccuuguccagcacuuuucuagcucucccguuccccaucucca

SEQ ID NO: 73519 - RNA, 64 nt, hsa
ugcccacuguuuuuucucuguugggagggaagcucuuuucuaggagugucucaguucugcuuuu

SEQ ID NO: 73520 - RNA, 64 nt, hsa
caaauuagaagcuagcugagguagcuugcagcaucuuuucuaguugaaauggugaacugauagg

SEQ ID NO: 73521 - RNA, 64 nt, hsa
uccacaguucauuuuuuuccgguaggaauaacuccuuuucuacauccacgcuccauagagucuc

SEQ ID NO: 73522 - RNA, 64 nt, hsa
aguauuucugucucugaaauaaccuuuuacuuggcuuuucuagauagcuuuauuugauuucgag

SEQ ID NO: 73523 - RNA, 64 nt, hsa
uugauuucgaguggcaaaauguuuuuuauuacggcuuuucuauugcuguaugauacagaacucu

SEQ ID NO: 73524 - RNA, 64 nt, hsa
uucacuuugucaagcaccucaguuacacauucgccuuuucuaggauugcauuucccaagugcua

SEQ ID NO: 73525 - RNA, 64 nt, hsa
cuccccauuuuaguuuucuaggacugaaaggauucuuuucuacauuauacauguguguugucau

SEQ ID NO: 73526 - RNA, 64 nt, hsa
gaguguguucucuaaucaauagugguuuagcuuucuuuucuauuucacucguuucuaggguuuu

SEQ ID NO: 73527 - RNA, 64 nt, hsa
cuggcuugaauuucuccccagaaaauggguuuuucuuuucuauugcauagucaggcugcaaauu

SEQ ID NO: 73528 - RNA, 64 nt, hsa
acuaacucacuucggucucugucugucaacuaaacuuuucuaaagguuaccaguuauccaauca

SEQ ID NO: 73529 - RNA, 64 nt, hsa
gugucuuggacaacacuauuguuugaagguuuaucuuuucuaaucaugcucuaccgcauuguag

SEQ ID NO: 73530 - RNA, 64 nt, hsa
cugcagaccuaggggaaaacugcagguggaagugcuuuucuacuaaggccucuuacuuuggggg

SEQ ID NO: 73531 - RNA, 64 nt, hsa
auccucuaaucuuucuacauggacaagcuguuuucuuuucuagguuacugauaaccccuacaau

SEQ ID NO: 73532 - RNA, 64 nt, hsa
agacucuggcaauaagccuuccaaaauucugugccuuuucuauuaucaccaaacaauauguuaa

SEQ ID NO: 73533 - RNA, 64 nt, hsa
cucuguuucaacuuuaagcccacacacucuguagcuuuucuaaaacaguacauuccauucaugc

SEQ ID NO: 73534 - RNA, 64 nt, hsa
cagggacuagggagggaggcagggaacguuuuuucuuuucuacaucuucacagguucggcuggg

SEQ ID NO: 73535 - RNA, 64 nt, hsa
uaacaaauauuguggguaguagggcugacugcugcuuuucuaaaaaguaguucuuuaguaucaa

SEQ ID NO: 73536 - RNA, 64 nt, hsa
aggauuauaggugauuucuauuuucuucuguauacuuuucuaugcuuucuagauuaucuacaug

SEQ ID NO: 73537 - RNA, 64 nt, hsa
uuuuaaaaaaaacgcuccuuuguaggguuuuaaacuuuucuaauagauuuagauucacuuuugg

SEQ ID NO: 73538 - RNA, 64 nt, hsa
ucuauucaaaguacuaauaucuacaugguccacacuuuucuauuuuaaaaaauuguguucucuu

SEQ ID NO: 73539 - RNA, 64 nt, hsa
ucauuguaaaacuaucugaaccauuaaagucgagcuuuucuaaagaaagccaccauagcugugu

SEQ ID NO: 73540 - RNA, 64 nt, hsa
cagcucugccuguuagacucuuacuuuuuaaaaucuuuucuauuuucccucgcuggggcagugc

SEQ ID NO: 73541 - RNA, 64 nt, hsa
gcagaacagggcaaacucuccauuuuacuuauggcuuuucuaauuuuuaauuaauuaauuuauu

SEQ ID NO: 73542 - RNA, 64 nt, hsa
uguuuaaagacguguuuuuaaaauuccacuaucccuuuucuaaagguuaaaggucugaagcagc

SEQ ID NO: 73543 - RNA, 64 nt, hsa
aaauaaaaugaucucucuuucucucucucucucucuuuucuaagaaacaauuaugugcacuuug

SEQ ID NO: 73544 - RNA, 64 nt, hsa
ugcuagccuacaccuucucuuugguuuaguuuuccuuuucuauaacacucugaauugcuaaucu

SEQ ID NO: 73545 - RNA, 64 nt, hsa
aacauguaaccuguaaccuuguuguuuaaguuuucuuuucuauuaauacucuguccuguggucc

SEQ ID NO: 73546 - RNA, 64 nt, hsa
aauguaauugcuuaccugcacacaguuuuuuuuccuuuucuaaauuuguuugugaucauugaca

SEQ ID NO: 73547 - RNA, 64 nt, hsa
agaaauguuuauugacaggucuuuucaaauaaugcuuuucuaauuaauagccaaagauuucaua

SEQ ID NO: 73548 - RNA, 64 nt, hsa
aaauaaaagauaaaagagcgauacacaaagcuuucuuuucuaacuuuuccaagcaaaaucuaaa

SEQ ID NO: 73549 - RNA, 64 nt, hsa
uguuucuaaagaaacccaugcugugaaauagagacuuuucuacugaucaucauaacucuguauc

SEQ ID NO: 73550 - RNA, 64 nt, hsa
caaugaaguucacaauaggucauaaggucucuuccuuuucuaaaauugaaagacaagaaauuua

SEQ ID NO: 73551 - RNA, 64 nt, hsa
uugaucuuuauauacucugaagcauuucuucaaacuuuucuacuuuuauuugucauugauaccu

SEQ ID NO: 73552 - RNA, 64 nt, hsa
agaccaaugcuugaauaaguagaccccaagcauccuuuucuaaaaagugacuuaaaauaagcca

SEQ ID NO: 73553 - RNA, 64 nt, hsa
uugugauugaguaaaagcagcuuaaauuacuuuucuuuucuacauuaagaaauauauucucaac

SEQ ID NO: 73554 - RNA, 64 nt, hsa
gcuggauuaauucccagaacccucucccuccuuucuuuucuaagugaguuguugauuuuaggag

SEQ ID NO: 73555 - RNA, 64 nt, hsa
cugucucagaccuuagguaacauaccugcagcugcuuuucuaacaaacuguugaucagcaaaaa

SEQ ID NO: 73556 - RNA, 64 nt, hsa
gaagguagauuuuuauaaaacaagcauggggauucuuuucuaagguaauauuaaugagaaggga

SEQ ID NO: 73557 - RNA, 64 nt, hsa
ucuuucuugugugugaugaaccaguauggauuugcuuuucuaagccuccuguugguuacuaauc

SEQ ID NO: 73558 - RNA, 64 nt, hsa
caaagagaaccuuucggaucacucguuuacaagccuuuucuaaguauuuggugguuuauguuua

SEQ ID NO: 73559 - RNA, 64 nt, hsa
cagcuggccgccugaggggacaccagacucagcucuuuucuagcgacugaaaguagaagucugu

SEQ ID NO: 73560 - RNA, 64 nt, hsa
acaggguggugcccuggccccgaggucaccccgacuuuucuaaaucuuguuugagugaagucau

SEQ ID NO: 73561 - RNA, 64 nt, hsa
ccccuucccugucucaacaccugcuuugacccugcuuuucuauuauuacaucagucagcaucuu

SEQ ID NO: 73562 - RNA, 64 nt, hsa
ugggcccauggcccagucacucaggggcgaguuucuuuucuaacauagcccuuucuuugccaug

SEQ ID NO: 73563 - RNA, 64 nt, hsa
uucuuugccaugaggccaugaggcccgcuucauccuuuucuauuucccuagaaccuuaauggua

SEQ ID NO: 73564 - RNA, 64 nt, hsa
uucagaucuuccaaagcacuauuuguuguaauaacuuuucuaaauguagugccuuuaaaggaaa

SEQ ID NO: 73565 - RNA, 64 nt, hsa
ugcaaaaguggguggcaauauucagugcuuaacacuuuucuagcguugguacaucugagaaaug

SEQ ID NO: 73566 - RNA, 64 nt, hsa
ucaauuacucucuucuccuacuucuguacuacugcuuuucuauugugaguuuguuuaguucauu

SEQ ID NO: 73567 - RNA, 64 nt, hsa
cuuugcucuuaacuacugauguugucuuccugaucuuuucuacaagaagcuuuuaaacuuuuug

SEQ ID NO: 73568 - RNA, 64 nt, hsa
ggugauacuggagucuuaucauuugaaguguuugcuuuucuacuuuuacaguaaaaccucauua

SEQ ID NO: 73569 - RNA, 64 nt, hsa
accacugugccuacauuuaaaaauacuucucucucuuuucuaaaaagcuuuaacuguagugccu

SEQ ID NO: 73570 - RNA, 64 nt, hsa
uugaaaagucaaaagagaccugucucucuccuuucuuuucuaucuuuaaaccagaaaaccucau

SEQ ID NO: 73571 - RNA, 64 nt, hsa
ccugaaaugccuuguaccuacaacaaugcuuaggcuuuucuaagccucuugccacuuuuaaaau

SEQ ID NO: 73572 - RNA, 64 nt, hsa
uacaggccuacaacuuuugccucagacuguuccccuuuucuaaggguauucaaguuuucaccuu

SEQ ID NO: 73573 - RNA, 64 nt, hsa
gaaggaugcacuaaaguucucacuuuagugagaacuuuucuagcuauuccaauacagaguucuu

SEQ ID NO: 73574 - RNA, 64 nt, hsa
uacauaaauuauguuuaaauggcuuggugucuuucuuuucuaauuaugcagaauaagcucuuua

SEQ ID NO: 73575 - RNA, 64 nt, hsa
aaaaaaaaagauuaaaugccagcuuuguacaggucuuuucuauuuuuuuuuguuuauuuuguua

SEQ ID NO: 73576 - RNA, 64 nt, hsa
uuccuuuucuuuguuuucuuuugacuuuuuucuccuuuucuauuugaacuguuuuauuuuccug

SEQ ID NO: 73577 - RNA, 64 nt, hsa
gaguacauauauaugaaaauuauuaugacacgcacuuuucuaaucauuguacauuucucagagu

SEQ ID NO: 73578 - RNA, 64 nt, hsa
aagaaucaaugcacaguauaaagaacuuauuguucuuuucuauucuuucaguugaauaagggcc

SEQ ID NO: 73579 - RNA, 64 nt, hsa
agguacagaagugucaacagaagcacugaugguucuuuucuacuaucuaacaggguuaauuuca

SEQ ID NO: 73580 - RNA, 64 nt, hsa
uguuccccuucccucacacccugccucgcccccacuuuucuaguuaacuuuuuccauaucccuc

SEQ ID NO: 73581 - RNA, 64 nt, hsa
gaauggcacguugcugccagugccccagacaguucuuuucuacccugcgggcccgcacguuuua

SEQ ID NO: 73582 - RNA, 64 nt, hsa
auccucauccucaucugugcaaccgcccguccuccuuuucuaguuucugauguuuguaaccaga

SEQ ID NO: 73583 - RNA, 64 nt, hsa
gcgcggcgggcagagcggggcccacucuucuuagcuuuucuacucacuguuagagagagaccua

SEQ ID NO: 73584 - RNA, 64 nt, hsa
cugagaggggcugcuggcugaauuagguuagagucuuuucuacagacuaagaguguuuaaggau

SEQ ID NO: 73585 - RNA, 64 nt, hsa
ccauuuaaugaaaagcagcccccaaaaucauuuucuuuucuaacaaagaacagccuguaaaauc

SEQ ID NO: 73586 - RNA, 64 nt, hsa
cauagaaaaacaaauguuaccaagaaauacuuaccuuuucuauaugcaguguuaucucuugucu

SEQ ID NO: 73587 - RNA, 64 nt, hsa
uccuaacugaaauccuauauauuucuuguguguucuuuucuauuuguaaaauacuguaauugua

SEQ ID NO: 73588 - RNA, 64 nt, hsa
ccccuuccccugugcucccuuucucuccucucuccuuuucuagccuguucuuuacauggggcuc

SEQ ID NO: 73589 - RNA, 64 nt, hsa
cuucugaccaagggugguuaagugacacauagaacuuuucuaagagaagacagacaaguugaca

SEQ ID NO: 73590 - RNA, 64 nt, hsa
cccaggcugaagccuggagucugcccccacuucccuuuucuauaauccacccuucugcaggccc

SEQ ID NO: 73591 - RNA, 64 nt, hsa
cugaguugcuucccauuuccucuuucuagccguccuuuucuagugugugcucacucuuccuagg

SEQ ID NO: 73592 - RNA, 64 nt, hsa
aguuguaaauucaauuuggaguuuauuuaauugacuuuucuaucacguuggggcacaugccaac

SEQ ID NO: 73593 - RNA, 64 nt, hsa
cuggcaugguguuugggcagcaggcaucauuuuccuuuucuagcuucauaggaauauugugagc

SEQ ID NO: 73594 - RNA, 64 nt, hsa
uggauuggucgccaucugcacgccaggcggcauccuuuucuaugaaguguugacuuuguaaauc

SEQ ID NO: 73595 - RNA, 64 nt, hsa
gggccaggcucaccccucacccuuuuuuugguugcuuuucuaauaaagauggaacaguugucuu

SEQ ID NO: 73596 - RNA, 64 nt, hsa
cugccuugcccguuugccuguuccuauucagugucuuuucuauuuuuuccucucucguucaugc

SEQ ID NO: 73597 - RNA, 64 nt, hsa
uugguggccauguuuucuacccagacaggcccugcuuuucuaggauguggccuuagagcaagaa

SEQ ID NO: 73598 - RNA, 64 nt, hsa
ugaaguugggcgugcucugugguaccagcugugacuuuucuauuucuccuaguuuuagguuguu

SEQ ID NO: 73599 - RNA, 64 nt, hsa
uugugacuuacacagagcaaaauugugcuaaaggcuuuucuacucugagaucucaaugcgaaau

SEQ ID NO: 73600 - RNA, 64 nt, hsa
gaggagaaagacuuuuucacuucuuuguugcuuucuuuucuauugagucugggcuuguuugugu

SEQ ID NO: 73601 - RNA, 64 nt, hsa
ccuuguucuuuugaagcuugugcugagguuuuagcuuuucuauguuuuauaugccgcugcuuug

SEQ ID NO: 73602 - RNA, 64 nt, hsa
agugcgccaggugcuggcccugcggauagacuuccgcagugaagauaucaagaggcugcgccug

SEQ ID NO: 73603 - RNA, 64 nt, hsa
ccccauccugacugaggucacccugaugaaugcccgcagugagcuauacuuacgcuuccucaag

SEQ ID NO: 73604 - RNA, 62 nt, hsa
cacucagggcugccacuaaccuguagaacaccccugugcaaauuuuaaaaaggaacccuuuu

SEQ ID NO: 73605 - RNA, 62 nt, hsa
gugacugaacgagggauaauucaaacugacaaccugugcagucccguggaggguaggggagu

SEQ ID NO: 73606 - RNA, 62 nt, hsa
ucagacugcccagcucagagugcccgucagggccugugcauccgcacgcggagccgucuguu

SEQ ID NO: 73607 - RNA, 62 nt, hsa
cugggcgcucccugagucagagucucagaagaccugugcaggcuggcgugagaggagcggca

SEQ ID NO: 73608 - RNA, 62 nt, hsa
gggaugccgcgcuccagcaacaccaggucaggccugugcagaccccugcccugccgcugcag

SEQ ID NO: 73609 - RNA, 62 nt, hsa
gccaaauuucccucucucgugagaugggggauccugugcaggcugaugaggcacccaugaga

SEQ ID NO: 73610 - RNA, 62 nt, hsa
ggcuccaguaaggauuggaggcacuuuccagcccugugcaguguugcuaccagcaagaauga

SEQ ID NO: 73611 - RNA, 62 nt, hsa
aguacugugagguaggcaccgugacucggcugccugugcagaagguggagguggcaggcgga

SEQ ID NO: 73612 - RNA, 62 nt, hsa
cccucccucucuucuucccuccuuccccgcucccugugcagaagggcugacaucaaaccaaa

SEQ ID NO: 73613 - RNA, 62 nt, hsa
aaggaacccuccaguccugcucucuggccacaccugugcaggcagcugagaggcagcgugca

SEQ ID NO: 73614 - RNA, 62 nt, hsa
ugcaagggggacacaugaaaggcaucagucccccugugcauaguacgaccuuuacugucgua

SEQ ID NO: 73615 - RNA, 62 nt, hsa
acugaauaaagcacgugcaaggacucccggagccugugcagccuugguggcaaauaucucau

SEQ ID NO: 73616 - RNA, 62 nt, hsa
gagacuguuugaaucuugucucacuaguuuuuccugugcaaaaauaaaauggacagaauugc

SEQ ID NO: 73617 - RNA, 62 nt, hsa
gauaaauauguguugguacagaauggggguauccugugcauuguaggaucuuuagcaguacc

SEQ ID NO: 73618 - RNA, 62 nt, hsa
cccuccagcaaggcagcaccugcucugaugcaccugugcaccccuggcccucccagccaccu

SEQ ID NO: 73619 - RNA, 62 nt, hsa
gcuggcccugcuaggcuggagaagcccugucaccugugcacaucuugcugguggaggcaugg

SEQ ID NO: 73620 - RNA, 62 nt, hsa
aacugccagccccucucuuucaccuguuccauccugugcagcugacacacagcuaaggagcc

SEQ ID NO: 73621 - RNA, 62 nt, hsa
ugccaaagacucgugggggccaucacaccugcccugugcagcggagccggaccaggcucuug

SEQ ID NO: 73622 - RNA, 62 nt, hsa
gccagcaagcuggggccuguccgccacggugcccugugcaccuuugggcugcccuggccccc

SEQ ID NO: 73623 - RNA, 55 nt, hsa
cuguggacauggagaucuagaugggccugugcagcuucgggggguccugcugggg

SEQ ID NO: 73624 - RNA, 62 nt, hsa
ggcaggccuuccucgauccucagccaaaggaaccugugcaagacacuggcucagcaguuccc

SEQ ID NO: 73625 - RNA, 62 nt, hsa
gguuaaagggaggugacagggugaagagggauccugugcaggggccaccugggagauagcag

SEQ ID NO: 73626 - RNA, 62 nt, hsa
caucgcccggcggucagugggcuucagaugggccugugcauccuggccaagcgucacccuca

SEQ ID NO: 73627 - RNA, 62 nt, hsa
gucuggguggggcgcggaccccucacugugcgccugugcagggggugcuggugcacguggca

SEQ ID NO: 73628 - RNA, 62 nt, hsa
cucaaugugccaggcucuuccucccaugacacccugugcaccagcugcacuggcuucccccu

SEQ ID NO: 73629 - RNA, 62 nt, hsa
ggcuggagcggagcguccgugagcgcuuccucccugugcacugauccuggcccccucuuauu

SEQ ID NO: 73630 - RNA, 62 nt, hsa
gccaccuggaggacuugccuguuccgacuccaccugugcagccggggccaccccaggagaaa

SEQ ID NO: 73631 - RNA, 62 nt, hsa
ucacguauuuaugcauguggcaagcguuacuuccugugcacguagccagcccugggucuguc

SEQ ID NO: 73632 - RNA, 62 nt, hsa
ucggugggcuucuccugcaugggaguuguguuccugugcaagggggagcuuugcuccaggac

SEQ ID NO: 73633 - RNA, 62 nt, hsa
cucuguagcucaaggggggcagcccccagaguccugugcauucugccaaggcuccauagcuu

SEQ ID NO: 73634 - RNA, 62 nt, hsa
ggaucagcagaggcuuaagaugggauacauggccugugcagugaggggaccuggguccuuug

SEQ ID NO: 73635 - RNA, 62 nt, hsa
aauuacccagagauauauuuauuaacagccaaccugugcaaccugcuggagcuuuauuuuua

SEQ ID NO: 73636 - RNA, 64 nt, hsa
uaguucagucuaguguugguagcaugacagaaaguggggaaaaugccgcaguuuguugccuuga

SEQ ID NO: 73637 - RNA, 64 nt, hsa
ugauaagcuuuucuuuuaaacuuagguuuuaaguuggggaaagacuuaauuaacuaauauagua

SEQ ID NO: 73638 - RNA, 64 nt, hsa
uccuguggugugcaaagcauuaugauaggcaccguggggaaacuggaaaugaauuugacaugaa

SEQ ID NO: 73639 - RNA, 64 nt, hsa
uuacuuacuuuuauagcauuacugugccuagucguggggaaagagauggggcuguauagauuau

SEQ ID NO: 73640 - RNA, 64 nt, hsa
aauggaucccugagcucugagccaagggugaggauggggaaacucuaagcucccaccuaauaag

SEQ ID NO: 73641 - RNA, 64 nt, hsa
uggauugaauauacauugagcccaaagucaaguuuggggaaaaggcagacuaaggccuccuuuc

SEQ ID NO: 73642 - RNA, 64 nt, hsa
ggggaaaggagauggagcagcucuugggauccuuuggggaaaaggaggccauucugggccccuu

SEQ ID NO: 73643 - RNA, 64 nt, hsa
ucugcccuccacugggcccaguggcucagggaccuggggaaaggagauggagcagcucuuggga

SEQ ID NO: 73644 - RNA, 64 nt, hsa
gccccacucaauggccuagaagcugccuguacuuuggggaaacagauggagcucuugggcccag

SEQ ID NO: 73645 - RNA, 64 nt, hsa
ccuccauacccagcccuauacgcagacccacagguggggaaacugaggcaggaacaggguucug

SEQ ID NO: 73646 - RNA, 64 nt, hsa
gagguccugcccaagcacaggccagaugcaagaauggggaaaagucugguccugaucuccaagu

SEQ ID NO: 73647 - RNA, 64 nt, hsa
gugccuaccucccucaagccugggaaggugggucuggggaaagugggccgagugaucugggggu

SEQ ID NO: 73648 - RNA, 64 nt, hsa
uuauaaugauaguauaauuaucccuuuuuaauauuggggaaagaaaaaugaaaauucauuaguu

SEQ ID NO: 73649 - RNA, 64 nt, hsa
cuguccugagccauguaauaugccugcaucguguuggggaaauguuugggaaauauaagccagc

SEQ ID NO: 73650 - RNA, 64 nt, hsa
guaugcauaccugccagcucguaugccucuggcauggggaaauuaagggaacagugucuguuug

SEQ ID NO: 73651 - RNA, 64 nt, hsa
cgcauuggcgcaauauuuaugggagugggagggauggggaaaauaaacuuaacucuacaaaagc

SEQ ID NO: 73652 - RNA, 64 nt, hsa
ucagaaauccuacuucagaaguguaauaaauggauggggaaaucguuugauggggaaaagucuc

SEQ ID NO: 73653 - RNA, 64 nt, hsa
agaaguguaauaaauggauggggaaaucguuugauggggaaaagucucuuguaaguaaaaguag

SEQ ID NO: 73654 - RNA, 64 nt, hsa
aaggaaaaaagcaaaauuggccugaauauucucuuggggaaagagggcaccaaagaaaagggua

SEQ ID NO: 73655 - RNA, 64 nt, hsa
uaaugaagcucugcauagaggaacuagucagaaguggggaaaacacugucuaauuuuuaucagu

SEQ ID NO: 73656 - RNA, 64 nt, hsa
caaaaauaaaaaaaaucaaguauuggcaaagauguggggaaaauucucauaagcuacugaugag

SEQ ID NO: 73657 - RNA, 64 nt, hsa
ggcuuguucuuguggcuucugaugauuucugacuuggggaaaaauggggaagaguugaaauacg

SEQ ID NO: 73658 - RNA, 64 nt, hsa
cuccccgaggcacccuccucucccugcacacagauggggaaaccgagggcugguagggaugagc

SEQ ID NO: 73659 - RNA, 64 nt, hsa
ggaggccucaugcgucugcuccuaggaccucccuuggggaaagaggugcuucuggggaagugcu

SEQ ID NO: 73660 - RNA, 64 nt, hsa
cuucaggccuagggguuauccaaccaagcauucuuggggaaagagaaaucacugacauucuaua

SEQ ID NO: 73661 - RNA, 64 nt, hsa
caggggcagauuucauaacaacaucucaaaaauuuggggaaacacaacguugaaaacuuccuaa

SEQ ID NO: 73662 - RNA, 64 nt, hsa
uuauuuuucucugaccuuuccauccuugaaaaaauggggaaaaaagaagaaaaaagacaaaauc

SEQ ID NO: 73663 - RNA, 64 nt, hsa
cugcugguuuggggcacaaggaagccuuaggguauggggaaaggcuguuauuaccuagaguuua

SEQ ID NO: 73664 - RNA, 63 nt, hsa
uccuuuuuuuuuuuuuuuaacucggaaacacaacuggggaaauauauucuuucccagugauua

SEQ ID NO: 73665 - RNA, 64 nt, hsa
augccauaagaaaaugcaauaucuggguacuguauggggaaaaaaauguccaaguuuguguaaa

SEQ ID NO: 73666 - RNA, 64 nt, hsa
caaacuuuggacgagacucucaucugaacuaacuuggggaaacaauuucuagguugaagcuggu

SEQ ID NO: 73667 - RNA, 64 nt, hsa
cgagagcugguaacuagguagacugcugcucuaauggggaaagggggcuuugcaaagccgagga

SEQ ID NO: 73668 - RNA, 64 nt, hsa
gcgugucugcauggugucgcaucuguuguaccuuuggggaaaauuuguauguaaauguacagaa

SEQ ID NO: 73669 - RNA, 64 nt, hsa
gcugccucagccaagcugagccucucaacugguguggggaaauccugucuuuccaaaaguccaa

SEQ ID NO: 73670 - RNA, 64 nt, hsa
auugcacuccagccugggcgacagagucuccaucuggggaaaaaaauuaaauaaauaaacuccc

SEQ ID NO: 73671 - RNA, 64 nt, hsa
ugaggucagaaguucaagaccagccuggccaacauggggaaacccugucuuuacuaaaaauaua

SEQ ID NO: 73672 - RNA, 64 nt, hsa
cauggcaugagagagggcagagaaacuaaguugcuggggaaaguuagaggaacugaaaguuugg

SEQ ID NO: 73673 - RNA, 64 nt, hsa
uaaagaauaaugcuccucuuucaggguaauaaaguggggaaaaggaacgucuucucaaugcaag

SEQ ID NO: 73674 - RNA, 64 nt, hsa
gggaaaguuaguugagaaucagagcauauguuauuggggaaaggauauguuuauugacacauaa

SEQ ID NO: 73675 - RNA, 64 nt, hsa
cuaccaauuccuauucccaaaaugaacauauuacuggggaaaguuaguugagaaucagagcaua

SEQ ID NO: 73676 - RNA, 64 nt, hsa
ucuguucagaugugaucuauaaaaaaucauaauuuggggaaaguuuaagcaaaucuggcuuugu

SEQ ID NO: 73677 - RNA, 64 nt, hsa
uuuguguuuuuaaguugguuuuacaauucuuuccuggggaaauuauuucuggaggggaaaaaga

SEQ ID NO: 73678 - RNA, 64 nt, hsa
cuggagaggcugcucccuuacagaccugguaguuuggggaaaggaggaggagagcccuucaggu

SEQ ID NO: 73679 - RNA, 64 nt, hsa
gcagguacccucuaugccaauagcugggccugccuggggaaagguggaaggagaaacagcugca

SEQ ID NO: 73680 - RNA, 64 nt, hsa
ucccacacaagcucgguggugacucuucggccccuggggaaaaacaaaaagauauugcugagau

SEQ ID NO: 73681 - RNA, 64 nt, hsa
cgaggccagugagggacggcguggcugugcuuccuggggaaaugaacccccuccccacagacac

SEQ ID NO: 73682 - RNA, 64 nt, hsa
aguucauugcagacaccaccauauugcuaucuaauggggaaauguagcuaugggccauaaccaa

SEQ ID NO: 73683 - RNA, 64 nt, hsa
cacacucuccugggccccaaggagucccacggaauggggaaagcgggaacccuggaguucuugg

SEQ ID NO: 73684 - RNA, 64 nt, hsa
caucagcccagggccgcguggugaaaucuggcaguggggaaagagcaaccccagcccgucccuu

SEQ ID NO: 73685 - RNA, 64 nt, hsa
uagugggguugaaguaugacauaauauuucccauuggggaaaggagaauuucucuuagagggug

SEQ ID NO: 73686 - RNA, 64 nt, hsa
agcucugcuuuccagcgcuugguggaaucugggcuggggaaagacggcaccgggaaacucugcu

SEQ ID NO: 73687 - RNA, 64 nt, hsa
uuuccaagccuggaaggguauucagcagcugugguggggaaacauuucuccugaaagacugaac

SEQ ID NO: 73688 - RNA, 64 nt, hsa
caggucuggggccaggagugggacccaccauuuguggggaaaguagcauuccuccaccucaggc

SEQ ID NO: 73689 - RNA, 64 nt, hsa
aaaagaacaggagcagcauaggcuguuugagcuuuggggaaaugaacuuugcuuuuuauauuua

SEQ ID NO: 73690 - RNA, 64 nt, hsa
auggcgguuuuguggaauagaaaaggcggaaagguggggaaaagauugagaaauuggaugguug

SEQ ID NO: 73691 - RNA, 64 nt, hsa
auuucuacucugucuccucaacucuguugauauuuggggaaaauucuguuuuucauagauucuu

SEQ ID NO: 73692 - RNA, 64 nt, hsa
gaggaacaaguuuccgugucuucugccuuccucuuggggaaaggugccuuguugugaugaauua

SEQ ID NO: 73693 - RNA, 64 nt, hsa
gagcaaggagaccauggcuacucuuugaaauggauggggaaaauuagcuuaaaaauuuaaucac

SEQ ID NO: 73694 - RNA, 64 nt, hsa
gacauugccuugguuuguuacaugacuaucgugauggggaaacuggcuggaaauaguaaucaca

SEQ ID NO: 73695 - RNA, 64 nt, hsa
ugguggagaacagagagaugagaagcagagggcuuggggaaagccuguuccucucugacucagc

SEQ ID NO: 73696 - RNA, 64 nt, hsa
guuuaacuccuggguuggcuguuggguagacagguggggaaaaggcccgugagucauuguaagc

SEQ ID NO: 73697 - RNA, 64 nt, hsa
cguggguccugguugggaguggggagggucagguuggggaaagaugggguagaguguagauggc

SEQ ID NO: 73698 - RNA, 64 nt, hsa
uagauguaucggcaagcaguguaaacggaggacuuggggaaaaaggaccacauaguccaucgaa

SEQ ID NO: 73699 - RNA, 64 nt, hsa
aaccccaaaagaaaguuacagguauugcacuggguggggaaaggauagugugucuuuaacucuu

SEQ ID NO: 73700 - RNA, 64 nt, hsa
uaguaaggaagugaaaacuuagcagucagugacauggggaaauaguuauagaaaaugucacuga

SEQ ID NO: 73701 - RNA, 64 nt, hsa
cauuaucauaaaauuuucauauaugccuagauaauggggaaaaaaagucuugugauugacuuuc

SEQ ID NO: 73702 - RNA, 64 nt, hsa
gccaacugcgugccaggcccaguacggaggacgcuggggaaauggugaaggaaacagaaaaaag

SEQ ID NO: 73703 - RNA, 64 nt, hsa
aaaggucccugcccuucuggagaugacaacugaguggggaaaacagaccgugaacacaaaacau

SEQ ID NO: 73704 - RNA, 64 nt, hsa
ugcugucaauuuuuuuuuaacccaaguauuuugguggggaaaagcaaguaucuauugcuuagca

SEQ ID NO: 73705 - RNA, 64 nt, hsa
guagcuguuggugauugcauggugucucggugcauggggaaaggcaaggucuucugagcucauc

SEQ ID NO: 73706 - RNA, 64 nt, hsa
gucaguguguguuuuucauuugauuuauuuaucuuggggaaagugaaaaauguaaucugcaagu

SEQ ID NO: 73707 - RNA, 64 nt, hsa
ugcuuuggugguuuuaauauuauugugccagggauggggaaaugggggggguugugugggaaga

SEQ ID NO: 73708 - RNA, 64 nt, hsa
uuugccccuaacacgaggaacucguuugaagggggcagcguagcaugucugauuugccaccugg

SEQ ID NO: 73709 - RNA, 64 nt, hsa
auuuuuguuuuuauuuuuguacgaugaguuuucugcagcguacagaauuguugcugucagauuc

SEQ ID NO: 73710 - RNA, 64 nt, hsa
uacccuaaggucauuaccacaggccaggggcugggcagcguacucaucaucaacccuaaaaagc

SEQ ID NO: 73711 - RNA, 64 nt, hsa
caaaggguuugaaaugggaagguuugaguuccaggcagcguaugaacucuggagaggggcugcc

SEQ ID NO: 73712 - RNA, 64 nt, hsa
gcuuucugugugaugcagauguguccugguuucggcagcguagccagcugcugcuugaggccau

SEQ ID NO: 73713 - RNA, 64 nt, hsa
acagaacuuggcuaauggaauucacagagguguugcagcguaucacuguuaugauccuguguuu

SEQ ID NO: 73714 - RNA, 64 nt, hsa
cgaggaccagucugaucgcccaggacuaagaguggcagcguaugagaaguugggaccauagagc

SEQ ID NO: 73715 - RNA, 64 nt, hsa
uggggaagacagugcagccacccagccuuuaccagcagcguacggcagacgaaggcagucgagg

SEQ ID NO: 73716 - RNA, 64 nt, hsa
ggaaaggagugagguauuucccgucuaacagaaagcagcguaucaacuccuauuguucugcacu

SEQ ID NO: 73717 - RNA, 64 nt, hsa
cacacaaaccugaacaaagcaaauuuuuuuaaaagcagcguauguaagcaccgacacccacuca

SEQ ID NO: 73718 - RNA, 64 nt, hsa
ccucgauuugggcagaugguggagucaagggugggcagcguacuucuaacucauuguuucccuc

SEQ ID NO: 73719 - RNA, 64 nt, hsa
caagucagauggcugcauuuuugagcauuaauuugcagcguauuucacuuuuucuguuauuuuc

SEQ ID NO: 73720 - RNA, 64 nt, hsa
ccaagagcagcuccgcgccugcuggaucguggaugcagcguaaacaucuuccuucagacgaggc

SEQ ID NO: 73721 - RNA, 64 nt, hsa
ucuaucggggaggguccuuggcgguaaccagagggcagcguagugucaacaccagagaccagga

SEQ ID NO: 73722 - RNA, 64 nt, hsa
auaauuuguaauugugacuuguucuccccggcuggcagcguaguggggcugccaggccccagcu

SEQ ID NO: 73723 - RNA, 64 nt, hsa
agagccuucagaaacugugaguggaaaugaaugcgcagcguaugacuguuggugauaaguguau

SEQ ID NO: 73724 - RNA, 64 nt, hsa
aacacacagaaagcucccacagugggaccuugaugcagcguagcugguauuaacaaccgugggg

SEQ ID NO: 73725 - RNA, 64 nt, hsa
uauagaaucauuuuaaucacuuucagauguuagagcagcguauuuuacaggcauuuauauccau

SEQ ID NO: 73726 - RNA, 64 nt, hsa
uggagugugcgugugcaggcagugugggugcauggcagcguaacuguggaguggaugggcucug

SEQ ID NO: 73727 - RNA, 64 nt, hsa
agggcugucaaagucaccauucuuuuugaugagggcagcguaauuacauugccuuuugucagga

SEQ ID NO: 73728 - RNA, 64 nt, hsa
uuagcuguaaagggaagcgaggugaagucguccugcagcguauuagaguaaaagucuaccccuc

SEQ ID NO: 73729 - RNA, 64 nt, hsa
uuuggagccaaaaaauugauucuggggggugggggcagcguagaagugguauauccaaguauau

SEQ ID NO: 73730 - RNA, 64 nt, hsa
gucuuuagaagcuggguggacucuuagugguccugcagcguauccuaaaagacuaccuuugaaa

SEQ ID NO: 73731 - RNA, 64 nt, hsa
aauuuccucaacacuaacuucacugggauaaucagcagcguaacuacccuaaaagcauaucacu

SEQ ID NO: 73732 - RNA, 64 nt, hsa
gacucagaugucucuggcguguggguaggugacggcagcguagccucuccggcagaagggaacu

SEQ ID NO: 73733 - RNA, 64 nt, hsa
ccaagucugcugaugagagacagcgcaugcuggugcagcguaaggacgaacuccuccagcaagc

SEQ ID NO: 73734 - RNA, 64 nt, hsa
cuuugauuagggcuuuuuguuacuguuugacagugcagcguaaguaugcacagaugaagaugga

SEQ ID NO: 73735 - RNA, 64 nt, hsa
caaaucccguacuccuugccaccggcuuccuagagcagcguagacagcugguaaacugaagagc

SEQ ID NO: 73736 - RNA, 64 nt, hsa
ccaaaggcgcagaagccggcuggccguggugggggcagcguaggcguagcaucccucuccucuc

SEQ ID NO: 73737 - RNA, 64 nt, hsa
ccgaguugaggauguugaacaacaugggaaggucgcagcguacuaagugaagaagucagaggac

SEQ ID NO: 73738 - RNA, 64 nt, hsa
ugagaauucaggcaaacguccacaaaggucacaggcagcguacauacgguucuguuauacccca

SEQ ID NO: 73739 - RNA, 64 nt, hsa
ccaugcuuuagagauccaucuuucuccacucaccgcagcguacuuggcacuucaguuucaaaca

SEQ ID NO: 73740 - RNA, 64 nt, hsa; identical to SEQ ID NO: 43695

SEQ ID NO: 73741 - RNA, 64 nt, hsa; identical to SEQ ID NO: 43696

SEQ ID NO: 73742 - RNA, 64 nt, hsa; identical to SEQ ID NO: 43697

SEQ ID NO: 73743 - RNA, 64 nt, hsa; identical to SEQ ID NO: 43698

SEQ ID NO: 73744 - RNA, 64 nt, hsa; identical to SEQ ID NO: 43699

SEQ ID NO: 73745 - RNA, 64 nt, hsa; identical to SEQ ID NO: 43700

SEQ ID NO: 73746 - RNA, 64 nt, hsa; identical to SEQ ID NO: 43701

SEQ ID NO: 73747 - RNA, 64 nt, hsa; identical to SEQ ID NO: 43702

SEQ ID NO: 73748 - RNA, 64 nt, hsa; identical to SEQ ID NO: 43703

SEQ ID NO: 73749 - RNA, 64 nt, hsa; identical to SEQ ID NO: 43704

SEQ ID NO: 73750 - RNA, 64 nt, hsa; identical to SEQ ID NO: 43705

SEQ ID NO: 73751 - RNA, 64 nt, hsa; identical to SEQ ID NO: 43706

SEQ ID NO: 73752 - RNA, 64 nt, hsa; identical to SEQ ID NO: 43707

SEQ ID NO: 73753 - RNA, 64 nt, hsa; identical to SEQ ID NO: 43708

SEQ ID NO: 73754 - RNA, 64 nt, hsa; identical to SEQ ID NO: 43709

SEQ ID NO: 73755 - RNA, 64 nt, hsa; identical to SEQ ID NO: 43710

SEQ ID NO: 73756 - RNA, 64 nt, hsa; identical to SEQ ID NO: 43711

SEQ ID NO: 73757 - RNA, 64 nt, hsa; identical to SEQ ID NO: 43712

SEQ ID NO: 73758 - RNA, 64 nt, hsa; identical to SEQ ID NO: 43713

SEQ ID NO: 73759 - RNA, 64 nt, hsa; identical to SEQ ID NO: 43714

SEQ ID NO: 73760 - RNA, 64 nt, hsa; identical to SEQ ID NO: 43715

SEQ ID NO: 73761 - RNA, 64 nt, hsa; identical to SEQ ID NO: 43716

SEQ ID NO: 73762 - RNA, 64 nt, hsa
aguuuaauggaucgugaauuuuuuucauguaacuccuauucauaucccauagaucuaguauugu

SEQ ID NO: 73763 - RNA, 64 nt, hsa
cugugaagucuaggcucagacaggcaucaacaaaccuauucaccccaccaucauccugaucuaa

SEQ ID NO: 73764 - RNA, 64 nt, hsa
gcucuucaaaguuuuaacuagcauuauaaaauggccuauucauuauauguauauuuuuuuauaa

SEQ ID NO: 73765 - RNA, 64 nt, hsa
aggcaguggguuuuuccuagaggagagauuaguaccuauucauuaacacaaggauacauaagag

SEQ ID NO: 73766 - RNA, 64 nt, hsa
cugggcauggggugguggugggagcuuaccgccaccuauucaagcucucagcuacuccugaaac

SEQ ID NO: 73767 - RNA, 64 nt, hsa
acuuacaggagagcugauaauuuguuagcuggaaccuauucacuuccgagauucagacauagcc

SEQ ID NO: 73768 - RNA, 64 nt, hsa
auuacucuugagaaguagaacaaggcacuucaguccuauucaacauaguacuggaaguccucgc

SEQ ID NO: 73769 - RNA, 64 nt, hsa
acauccaagcugagagccaaaucaagaaugcaauccuauucacaauugccacaaaaagaauaaa

SEQ ID NO: 73770 - RNA, 64 nt, hsa
gaguagaauauaaacacauaauugcuuauguaugccuauucagaauaaauggguaacacugauu

SEQ ID NO: 73771 - RNA, 64 nt, hsa
uacauuuugaauuuugaaccaugugacuguauuaccuauucaaaauaaacaauaaaugggccca

SEQ ID NO: 73772 - RNA, 64 nt, hsa
uacauagucuuuuuuaaauggaaggagaaaaugucagccacauuacugucuguguagugccagg

SEQ ID NO: 73773 - RNA, 64 nt, hsa
ccagaggcuaguggucacagacagcugggaauggcagccacagaggguccccucugggagaaac

SEQ ID NO: 73774 - RNA, 64 nt, hsa
cagccuggugccacagucacgugggggaagaccucagccacagcuguaagcagcucucugccag

SEQ ID NO: 73775 - RNA, 64 nt, hsa
aagaccucagccacagcuguaagcagcucucugccagccacauggccggggaccgaaaaacucc

SEQ ID NO: 73776 - RNA, 64 nt, hsa
ccacuuggaguaugaacaaugggcacgggguuuucagccacaguucccucgaggccaguguuca

SEQ ID NO: 73777 - RNA, 64 nt, hsa
cuauguaaagaugaaggcagagaucggaguuuugcagccacaagcuaagaaacaccaaggauug

SEQ ID NO: 73778 - RNA, 64 nt, hsa
gacuuacgugguaaaaaaugaagucuccugcccacagccacauuagugaaccuagaagcagaga

SEQ ID NO: 73779 - RNA, 64 nt, hsa
agacucuccacucccccugccgcccacacugcagcagccacauccauacacacacgcucgcaca

SEQ ID NO: 73780 - RNA, 64 nt, hsa
gugacucaguuucccucccuucucccuccauccgcagccacaggggaacucgucucuuacauac

SEQ ID NO: 73781 - RNA, 64 nt, hsa
gugaggggaggguugagggaggcucuggaaagcccagccacaccugagucccuggcaguagccu

SEQ ID NO: 73782 - RNA, 64 nt, hsa
acuggugguagaacuccaguucuguggcaaggggcagccacaccauuucucucucauugacuca

SEQ ID NO: 73783 - RNA, 64 nt, hsa
acacugccacugucccuuggcacgcacacagccacagccacacgugugaccugcugggccgugg

SEQ ID NO: 73784 - RNA, 64 nt, hsa
aauggcacacugccacugucccuuggcacgcacacagccacagccacacgugugaccugcuggg

SEQ ID NO: 73785 - RNA, 64 nt, hsa
uguuuacauuggccuuugguuuuuuuuuuucuuucagccacaacuauaugcugauauaacucag

SEQ ID NO: 73786 - RNA, 64 nt, hsa
guuggauagcugccacuaggguugcuucgaucuucagccacaugcuguccuugaagcagcuauu

SEQ ID NO: 73787 - RNA, 64 nt, hsa
gagaaaggacagagccagcggcuccaacuccuuucagccacaugccccaggcucucgcugcccu

SEQ ID NO: 73788 - RNA, 64 nt, hsa
ccagccacaggccaaauccuuggagucccaggggcagccacaccacugccauuacccagugccg

SEQ ID NO: 73789 - RNA, 64 nt, hsa
auccuuguuaccuaucucguguguguuauuuccccagccacaggccaaauccuuggagucccag

SEQ ID NO: 73790 - RNA, 64 nt, hsa
cucugcauccccugcacccgcuaccacaccagcucagccacagcagagccaaucacagacccac

SEQ ID NO: 73791 - RNA, 64 nt, hsa
cacgaccauugaaaauaucucugugucuguccaccagccacagcccaaacacaucaaacuugcu

SEQ ID NO: 73792 - RNA, 64 nt, hsa
agccgaccauccucgcaguugcaugugacagccacagccacacgcauggacguuucauccaaca

SEQ ID NO: 73793 - RNA, 64 nt, hsa
uuugggagccgaccauccucgcaguugcaugugacagccacagccacacgcauggacguuucau

SEQ ID NO: 73794 - RNA, 64 nt, hsa
ccccccaguaugggaaccagcaccucccaccaaccagccacacccggugggggcacagcacaga

SEQ ID NO: 73795 - RNA, 64 nt, hsa
ccccccggugugggaaccagcaccucccaccaaccagccacacccagugggggcacagcacaga

SEQ ID NO: 73796 - RNA, 64 nt, hsa
uguugcaggacacuccgggggagaauguggaacccagccacacugccaccgccacacuagugcu

SEQ ID NO: 73797 - RNA, 64 nt, hsa
uggcaccagaugccagggaagggacagaggaaaacagccacaaacaagccaggggggcuccccg

SEQ ID NO: 73798 - RNA, 64 nt, hsa
aaagaccccccgccagcuucccacaccucauacgcagccacaucugcccuauucuccaugcuuu

SEQ ID NO: 73799 - RNA, 64 nt, hsa
gcccagaacaacaguuggcaggacaggugugacacagccacagcagaggcaaggggugccagga

SEQ ID NO: 73800 - RNA, 64 nt, hsa
ggccagcaaugugguuccugugcacugagcccaccagccacagugcccauguccccucuggaag

SEQ ID NO: 73801 - RNA, 64 nt, hsa
uaucaaauuacugaagaucucaucaugcaugugucagccacagcgaaucccaugucuugguuau

SEQ ID NO: 73802 - RNA, 64 nt, hsa
acaaccaaaauuauuaagcucugugcgaggcugucagccacacuagguaucagggaucccgaga

SEQ ID NO: 73803 - RNA, 64 nt, hsa
uccucuucccccagggcuucccaagcucuuuccacagccacaucagucagggcauggcuccaau

SEQ ID NO: 73804 - RNA, 64 nt, hsa
aauaugugagcauuggccaucaaccccaucaaaccagccacagccguggaacaggcaaggaugg

SEQ ID NO: 73805 - RNA, 64 nt, hsa
ccagccauacuugacuguccccaaacucucccugcagccacauguuucccaugaccugugggcu

SEQ ID NO: 73806 - RNA, 64 nt, hsa
cagugugcacgccguccggccaugcccacagccacagccacagcugaggaguggccgggcaggc

SEQ ID NO: 73807 - RNA, 64 nt, hsa
acggcccagugugcacgccguccggccaugcccacagccacagccacagcugaggaguggccgg

SEQ ID NO: 73808 - RNA, 64 nt, hsa
ugauuuucccuacacuucucccuggcccaggcuccagccacaggcaccucuccugcccccgccc

SEQ ID NO: 73809 - RNA, 64 nt, hsa
cagccagagucaaugccuucaugggaagggcucccagccacacccagaguggcccaaagcuguu

SEQ ID NO: 73810 - RNA, 64 nt, hsa
cacacacacgcuuguucacacucagaacccaggacagccacagccaccgcuuaggggaagccac

SEQ ID NO: 73811 - RNA, 64 nt, hsa
aagaacugcucagggacauuaaaggucaaaaguccagccacacucauucauccuuuccccaggc

SEQ ID NO: 73812 - RNA, 64 nt, hsa
ggaaaaagucagcgggucaagcuagccuguggcccagccacaacuagcugacaaagcuuccugg

SEQ ID NO: 73813 - RNA, 64 nt, hsa
guuauucauccaucccuuucagaccuaacagccacagccacacggaaagagacuuugccucacu

SEQ ID NO: 73814 - RNA, 64 nt, hsa
ugcuuaguuauucauccaucccuuucagaccuaacagccacagccacacggaaagagacuuugc

SEQ ID NO: 73815 - RNA, 64 nt, hsa
gcacagagaaagccagcugucgucauuugagagccagccacagccucuggggagccagucauuu

SEQ ID NO: 73816 - RNA, 64 nt, hsa
caggaagauguccuuccuggggaagaagaagcaccagccacaggggcagguguccucccaggaa

SEQ ID NO: 73817 - RNA, 64 nt, hsa
cacgaucaaguuacacagcuuuauuggcccccagcagccacaguucccccaagggggcuuuggg

SEQ ID NO: 73818 - RNA, 64 nt, hsa
ucccagaccccacauccccucagaacgcugcgcccagccacacccacgaucaaguuacacagcu

SEQ ID NO: 73819 - RNA, 64 nt, hsa
agauccaggagggagccacccccaaggacccugccagccacagaccuccaauaaagacagcaug

SEQ ID NO: 73820 - RNA, 64 nt, hsa
cugauccaggguuccaccaccaggagggcagacccagccacauaccacaaccacccccaagccu

SEQ ID NO: 73821 - RNA, 64 nt, hsa
gugaauguaagagccuuggaaauuaacaaaauaacagccacauaaccuugcggcaagucugaug

SEQ ID NO: 73822 - RNA, 64 nt, hsa
gaaggaaagauuucuccucucaagugccagggagcagccacacgucugucuguguuuagagagg

SEQ ID NO: 73823 - RNA, 64 nt, hsa
ggugcacagguagccccgacccucucaggcauuccagccacagaacaucaaagugagcgaguac

SEQ ID NO: 73824 - RNA, 64 nt, hsa
ggaagcaccuccgguuggaggcacccaggcuugccagccacagagcgccccaaagucaccguca

SEQ ID NO: 73825 - RNA, 64 nt, hsa
ggaguggccuuggcucccuggagagcccacgucucagccacaguucuccacucgccucggacuu

SEQ ID NO: 73826 - RNA, 64 nt, hsa
uccucagaggaggaggaggaggaggcagcuccggcagccacagaaggcugcagcccagcccgcc

SEQ ID NO: 73827 - RNA, 64 nt, hsa
ugccaccugagggagccgccugcaagcggcccugcagccacaaagcaacccgcccucugcaaaa

SEQ ID NO: 73828 - RNA, 64 nt, hsa
aggagcugguggugggagaaugacggcagggacgcagccacaguucagacccuguccccucagc

SEQ ID NO: 73829 - RNA, 64 nt, hsa
aaugcagacacaaacugguuucauauggugagagcagccacagcagcagcuugaccugguauuc

SEQ ID NO: 73830 - RNA, 64 nt, hsa
cuauaucauucccaguuauuaguuaacacaaauucagccacauucugaguauuguuuguucacc

SEQ ID NO: 73831 - RNA, 62 nt, hsa
ugaaaucguuagcaccuuaggagaggggaccuucggccgaguuguacaauguguugaccauc

SEQ ID NO: 73832 - RNA, 64 nt, hsa
caacaggcuggccaacaaggcggugcagcggggcucggccgacaacgucacugugaugguggug

SEQ ID NO: 73833 - RNA, 64 nt, hsa
aagaguagaugguugcccugcaucuugggcuccaucggccgaaacuuucccaagccagggugug

SEQ ID NO: 73834 - RNA, 64 nt, hsa
ggcuccaacuuccuuccuuccuucggggccagucucggccgaagucuggucacgcucagacaga

SEQ ID NO: 73835 - RNA, 64 nt, hsa
cuuggggucccacugcucgaaauggccccugucuucggccgagcugguuuccugcccagccugg

SEQ ID NO: 73836 - RNA, 64 nt, hsa
gaaacaucccaggcccugagcagcgugucuuuccucggccgagucaggcuuccuggugagccuc

SEQ ID NO: 73837 - RNA, 64 nt, hsa
cagaaaugaggaggcuguuuuccucugauucuccucggccgaccaccuguccaaugcugcuggu

SEQ ID NO: 73838 - RNA, 64 nt, hsa
cccugcaucagcaaggccagccccagaaggagccucggccgagcgugcaacccggagccgccuu

SEQ ID NO: 73839 - RNA, 64 nt, hsa
gcccaggagaaugaggagccucccugcaguguugucggccgaggccugagcucgcccugcccag

SEQ ID NO: 73840 - RNA, 64 nt, hsa
ccuggacugggcuagccugcacugccugggaaagucggccgagggcccaaagcugcugaggggu

SEQ ID NO: 73841 - RNA, 64 nt, hsa
gugucccagccacgcagggccauccacugugacgucggccgaccaggcuggacacccucugccg

SEQ ID NO: 73842 - RNA, 64 nt, hsa
ggcuccgggcuguguccuaaaugcaaagcacaccucggccgaggccugcgcccugacaugcuaa

SEQ ID NO: 73843 - RNA, 64 nt, hsa
aucagcaguggcccaggaaggaggucaagcaucuucggccgauauuuaaacaugggcagcuucc

SEQ ID NO: 73844 - RNA, 64 nt, hsa
ucaauucuuacacauaaauguuugccagaguguuucggccgacguauuuacagcucugacaaau

SEQ ID NO: 73845 - RNA, 64 nt, hsa
ugggcacuuuuuaacauugcugauguaguaugcuuaagagaaaugaccuaaauaaggaucaauu

SEQ ID NO: 73846 - RNA, 64 nt, hsa
ugucuuaucacucuuauuugacauuucguagguguaagagaaauggaaaugaaugguuucaaca

SEQ ID NO: 73847 - RNA, 64 nt, hsa
gugaaucguaagagaaccucagcauugugcacgauaagagaaugugucaguauuucaggguucu

SEQ ID NO: 73848 - RNA, 64 nt, hsa
uguacauuuuuaauugcaguuuaaaagugaaucguaagagaaccucagcauugugcacgauaag

SEQ ID NO: 73849 - RNA, 64 nt, hsa
augucccaggcacuguacuaaccuacagagaugcuaagagaaaaaaaagacuuguuucugaucu

SEQ ID NO: 73850 - RNA, 64 nt, hsa
gaaacucagggcuucuaguuucucuuagaaaagcuaagagaagauaaggucugaauaauagcag

SEQ ID NO: 73851 - RNA, 64 nt, hsa
guuguuuagucaaaagaccagacaaguuacaaacuaagagaaacaauauuucacaacacaguaa

SEQ ID NO: 73852 - RNA, 64 nt, hsa
gucauuauagacagcaguguguuuuuuagaaagauaagagaaucaccccuaugcugcugagaug

SEQ ID NO: 73853 - RNA, 64 nt, hsa
acacuucuguucucuuagaacuuagaaguguuucuaagagaacagaaguaauaagagaaacagu

SEQ ID NO: 73854 - RNA, 64 nt, hsa
gaacuuagaaguguuucuaagagaacagaaguaauaagagaaacaguuacguguggaauucaac

SEQ ID NO: 73855 - RNA, 64 nt, hsa
caaauagauugcuuagaaugguucucaagaauuauaagagaaaugaacucacaguacaaaaauu

SEQ ID NO: 73856 - RNA, 64 nt, hsa
gggaacccugcccagacuaauacuguugguggcauaagagaaucaagccauucucaagagauaa

SEQ ID NO: 73857 - RNA, 64 nt, hsa
aguucuuuaccucauucucaaaccuugauaaacauaagagaauucauaccggagagaaacugua

SEQ ID NO: 73858 - RNA, 64 nt, hsa
cagucuuuaccacauccucaaacuuuguuaaacauaagagaauuuauaccagagagaaacccua

SEQ ID NO: 73859 - RNA, 64 nt, hsa
aaagcuugcaaccacacucaaucuauucuaaauauaagagaaaugauauuggugagaagccaca

SEQ ID NO: 73860 - RNA, 62 nt, hsa
cauuuuuuuccuccugguaguaaaugucagaguaagagaaacaaacuguuuagaauuaucau

SEQ ID NO: 73861 - RNA, 64 nt, hsa
uaguaauuaaaaugugccuuuugaagauguuuucuaagagaaaggaaauacguugcagugaugu

SEQ ID NO: 73862 - RNA, 64 nt, hsa
gaauauacucucaaagaauucacucucuuuuuauuaagagaacuaaauuguuucuaaauguaga

SEQ ID NO: 73863 - RNA, 64 nt, hsa
aguugucuugugaaugacuuuuaagaaguguacuuaagagaaaaauccuaccuuauuugaauaa

SEQ ID NO: 73864 - RNA, 64 nt, hsa
guacaacaugacaagcugugaguuuguguguuuguaagagaaaaauguguggguacuugcuaau

SEQ ID NO: 73865 - RNA, 64 nt, hsa
acuucagaaugcauccuuugagauuauguccacuuaagagaaaucaucaguuaagaaaucuacu

SEQ ID NO: 73866 - RNA, 64 nt, hsa
aacuccguugucauuaacaacugaggucuaaaguuaagagaacacagaggauuuuuagggcagu

SEQ ID NO: 73867 - RNA, 64 nt, hsa
augcuuccucaacgaaggggaacaaauaccuggauaagagaauccuuuuagcaauauggagcuu

SEQ ID NO: 73868 - RNA, 64 nt, hsa
aaacaaaacguaacacaguuaagagaaauaaucguaagagaacagugacggacaacuugagaaa

SEQ ID NO: 73869 - RNA, 64 nt, hsa
ggccgcagagggaaaaaacaaaacguaacacaguuaagagaaauaaucguaagagaacagugac

SEQ ID NO: 73870 - RNA, 64 nt, hsa
auaggccaucaauaucacaauagauuucucaagguaagagaaaauaagcucaugagaugacauu

SEQ ID NO: 73871 - RNA, 64 nt, hsa
guuccacauuguauuuuugucuucaaauauuuucuaagagaaugaauuaucccccaaaaugcau

SEQ ID NO: 73872 - RNA, 64 nt, hsa
aaagauaaaauuugauacagguuuggugucauuauaagagaaaucauuauuaaaugaagcaagu

SEQ ID NO: 73873 - RNA, 64 nt, hsa
agaaaucauuauuaaaugaagcaaguuaacacucuaagagaauuauuuugagauagaagugaag

SEQ ID NO: 73874 - RNA, 64 nt, hsa
caaggggcagagcauggagggaagaggauuuuuauaagagaaauuucugcacuuugaaacuguc

SEQ ID NO: 73875 - RNA, 64 nt, hsa
auaagagaaauuucugcacuuugaaacuguccucuaagagaauaagcauuuccuguucuuccag

SEQ ID NO: 73876 - RNA, 64 nt, hsa
agagcagacaguuaagagaaaugagcuugaccuuuaagagaaaugagcugcacuccaugagugc

SEQ ID NO: 73877 - RNA, 64 nt, hsa
caaaacugauuacaacugcuacagagcagacaguuaagagaaaugagcuugaccuuuaagagaa

SEQ ID NO: 73878 - RNA, 64 nt, hsa
uaaccccugagaaaugaacauugguaggagcauuuaagagaaaacuugcuuauuugcuaaugcc

SEQ ID NO: 73879 - RNA, 64 nt, hsa
uuguuacuuucaaugugaggaaugaaugauaaauuaagagaaaaaaauaucaggaaggucaaua

SEQ ID NO: 73880 - RNA, 64 nt, hsa
uuucuugaagugguguaaaaacuuagagauuuuauaagagaaccaggggcucccuucaccucuc

SEQ ID NO: 73881 - RNA, 64 nt, hsa
caggagagaagagauguccaaccagugagaucuuuaagagaaaaguuuguauuuuaaaugucaa

SEQ ID NO: 73882 - RNA, 64 nt, hsa
agagccuccagcagggcaggccuaggacuucuccuaagagaagggcacuuccccaccagugauc

SEQ ID NO: 73883 - RNA, 64 nt, hsa
gauuuuccucauaucuuauuuaccuaggagcauguaagagaaagaagggagagaaaagguugca

SEQ ID NO: 73884 - RNA, 64 nt, hsa
guuagcguuaaauggaaguaaauauauguauaccuaagagaaugucaaaauaaacaccaaacca

SEQ ID NO: 73885 - RNA, 64 nt, hsa
ugugaaauugaagugaaacuaucucuguaggacuuaagagaauagcuaaaaggugugacuugcc

SEQ ID NO: 73886 - RNA, 64 nt, hsa
agcuuaaaauaauuuuauuuacaagcaaguuauguaagagaauguuuuauacuauagccacaau

SEQ ID NO: 73887 - RNA, 64 nt, hsa
uugaaaacaugacaagggcccguaguuguuuggauaagagaacuccagcauagagccuuauagc

SEQ ID NO: 73888 - RNA, 64 nt, hsa
cucugaacaacacuaacaugagaacacaagaacuuaagagaaaaagaaaccuacucaagaaaag

SEQ ID NO: 73889 - RNA, 64 nt, hsa
ucugagaaaagaacauaagaacucaaggagaacauaagagaaaaggaaaccuguuacagaaaag

SEQ ID NO: 73890 - RNA, 64 nt, hsa
agcaaaauuucuguauauucccuguggaauguaccuaugugaguuucagaaauucucaaaauac

SEQ ID NO: 73891 - RNA, 64 nt, hsa
agugaaagacuugaauuuaguuuuuuaccuauaccuaugugaaacucuauuauggaacccaaug

SEQ ID NO: 73892 - RNA, 64 nt, hsa
ggauuuaaaauaccugcacaaggauagagagaaacuaugugacucauucugugaaaagacuucu

SEQ ID NO: 73893 - RNA, 64 nt, hsa
aacuagcaugaaauauuguuucaggcccuggguucuaugugacacuacauuaggaauuggauug

SEQ ID NO: 73894 - RNA, 64 nt, hsa
ugaucuuuucauuuaggugaggaagcaaaagcaucuaugugagaccauuuagcacacugcuugu

SEQ ID NO: 73895 - RNA, 64 nt, hsa
cucuuugagugaagcugggagaaccaaaaagaggcuaugugagcacaaagguagcuuuucccaa

SEQ ID NO: 73896 - RNA, 64 nt, hsa
uaguuuuacuugguguuuauguugcaaucugguugugauuuauauuuuaaagcuuggugcuaaa

SEQ ID NO: 73897 - RNA, 64 nt, hsa
ugccuaaaauaugauguuuaaaagcauacucuaugugauuuauuuauuucuaccuuucugaguc

SEQ ID NO: 73898 - RNA, 64 nt, hsa
cgcacaaaagccaaacgcauccgacucucuaaaugugauuuauuucuugcuuugagauuggaga

SEQ ID NO: 73899 - RNA, 64 nt, hsa
aaacuauuguuuguguuucuguguuucauauucagugauuuaauacaguaucauggcugaggug

SEQ ID NO: 73900 - RNA, 64 nt, hsa
aauagcaaucuuuaauaaaccuuuuuauuacauugugauuuagcaguuaugcuaaaauauguac

SEQ ID NO: 73901 - RNA, 64 nt, hsa
augauccagucacugacuugauugagggauaagugugauuuagaaauggaauggccuuggaugu

SEQ ID NO: 73902 - RNA, 64 nt, hsa
uuuuuuuacauuuacaacguaucaauaaacaguagugauuuaauagucaauaggcuuuaacauc

SEQ ID NO: 73903 - RNA, 64 nt, hsa
cauuuaaugucacaaaguuuuguuuuuuuaaaaagugauuuaaacuuaagauccgacauuuuuu

SEQ ID NO: 73904 - RNA, 64 nt, hsa
augcuuguauacuaguuuuucuuucugauugucagugauuuauaagcuauaaaugaccaagguc

SEQ ID NO: 73905 - RNA, 64 nt, hsa
ugaaaacauaaauuuucaggaugugaaaugaacagugauuuauaaaauggaaaucaaauuguac

SEQ ID NO: 73906 - RNA, 64 nt, hsa
aaaugcacuugaaauacacuggauaauuacuuuugugauuuagauuuuaauuuguugcugguuu

SEQ ID NO: 73907 - RNA, 64 nt, hsa
ucugccuaacuaucaaaggauuauagcaauccuggugauuuaggugcaucugucugugaguaaa

SEQ ID NO: 73908 - RNA, 64 nt, hsa
uugauggucaauuucccuucagcagaaggaaaaggugauuuagaucaguagcucuuuugaaggu

SEQ ID NO: 73909 - RNA, 64 nt, hsa
gcuuauagaacccauggguccaguuuaguaacgagugauuuaggcaaucaaugauagguuuaua

SEQ ID NO: 73910 - RNA, 64 nt, hsa
guuuaugauuccacuuaacaaaaggccugcagaagugauuuauuauuuggguauuuggagauaa

SEQ ID NO: 73911 - RNA, 64 nt, hsa
cuuauuucuuacuguaugaaagcuuaacagcaaugugauuuaagguuuuguuuuaaaugggaga

SEQ ID NO: 73912 - RNA, 64 nt, hsa
ugauuuaagguuuuguuuuaaaugggagauguaagugauuuaauucauggguacuuuuagaacc

SEQ ID NO: 73913 - RNA, 64 nt, hsa
gaaacugucugucuaauggucacagagcacuguagcacuuaacagauugccauggacaccaguu

SEQ ID NO: 73914 - RNA, 64 nt, hsa
uuucuuuagugggggaggguaagaaaagcaguuugcacuuaaaaagaaaaaaaaaaaacgggug

SEQ ID NO: 73915 - RNA, 64 nt, hsa
gauaaucaguauaauaauuugccuuguguggucagcacuuaacuguuuacaaagcccuuucacg

SEQ ID NO: 73916 - RNA, 64 nt, hsa
ccaccuguggccccuaaacccagagugacugagagcacuuaacauucagcuugucucaucccca

SEQ ID NO: 73917 - RNA, 64 nt, hsa
uuuuuucuuuccucccuuaccccaaauucauugagcacuuaaaggagcagagaugcagccagug

SEQ ID NO: 73918 - RNA, 64 nt, hsa
augacuaggaguguuaggggcagaaguuuugaaugcacuuaaccggaggagggcgcaggguggg

SEQ ID NO: 73919 - RNA, 64 nt, hsa
uguuuuaaauuaauuuuuuagcagauagcaguuagcacuuaaucuguaaauugaauaauuuauc

SEQ ID NO: 73920 - RNA, 64 nt, hsa
uaaucaauuaguaauggcggaaacugucgcugaagcacuuaagaaauaaagguacuuuacagca

SEQ ID NO: 73921 - RNA, 64 nt, hsa
auauuuaaaaauuguuucuugacaagcugacuuggcacuuaagugcacuuuuuuaugaagaaaa

SEQ ID NO: 73922 - RNA, 64 nt, hsa
gugcaggugacagcaggacuugcuaaagcacuuugcacuuaauggcuguugagggccacuuuuu

SEQ ID NO: 73923 - RNA, 64 nt, hsa
cauaugcaaucacucguuuaugcugucuagucaugcacuuaaagcaauuuucaaauguacucaa

SEQ ID NO: 73924 - RNA, 64 nt, hsa
cgcgugcaguucauuucuaguucuugauagaacugcacuuaauuuucaguaguagucuugacuu

SEQ ID NO: 73925 - RNA, 64 nt, hsa
auuucuuaauuauuauaaaaauauuaagacaauagcacuuaaauuccucaacaguguuuucaga

SEQ ID NO: 73926 - RNA, 64 nt, hsa
guuuuucauuuuaaaaaguccauaccuuauauaugcacuuaauuuguuggggcuuuacauacuu

SEQ ID NO: 73927 - RNA, 64 nt, hsa
ugcaagugacaaucagaggugacuaucuauauuugcacuuaaaaucaaaguaguucaacaugca

SEQ ID NO: 73928 - RNA, 64 nt, hsa
uuugacuccccuuauucccucuccaagaguaguugcacuuaacuuuuuuuuuuuuuuuuuagug

SEQ ID NO: 73929 - RNA, 64 nt, hsa
ugcagguaguguuuaguuaucuacugcauuaugagcacuuaaaguacugcuagcuguagaacuc

SEQ ID NO: 73930 - RNA, 64 nt, hsa
aacuuucuauuuuuagccuauauuuggaaagaaagcacuuaacauuuuaggaauucuuuuuaaa

SEQ ID NO: 73931 - RNA, 64 nt, hsa
uuuuuguuuuuuuucaucuuaauauguaccaguggcacuuaaccaaaagauacagugauauagc

SEQ ID NO: 73932 - RNA, 64 nt, hsa
ggguuucaguacaaaugcugcugucuauuucugugcacuuaacaauggaacccaaacagaagag

SEQ ID NO: 73933 - RNA, 64 nt, hsa
guuuuguuuucuuuguuuuuucccccuucuccugaaucagcagggauggaaggaggguagggaa

SEQ ID NO: 73934 - RNA, 64 nt, hsa
ggauacuaaaugacagccuuguuucuccccuuugaaucagcagacaccauggauuauauucuuu

SEQ ID NO: 73935 - RNA, 64 nt, hsa
agaaaugaccauuucccuuguauuuuuauaauuaaaucagcaaaauauuguaauaaagaaaucu

SEQ ID NO: 73936 - RNA, 64 nt, hsa
uaaauuucaacaaagguuccagaggugacauucgaaucagcaaugaaauuuucauaguuaaauu

SEQ ID NO: 73937 - RNA, 64 nt, hsa
ggggguuaucuuuuuuuuuuuccccuccuauuuuaaucagcaaaauccauaccaaaacaacgac

SEQ ID NO: 73938 - RNA, 64 nt, hsa
gugcucagauuuguguguucaaucaaugggcuuaaaucagcaaaauauuaugccuaaaguaaau

SEQ ID NO: 73939 - RNA, 64 nt, hsa
ccauggugggagaguuuacaucacaaccacuacaaaucagcacuugcuuucuucuucuuaaaga

SEQ ID NO: 73940 - RNA, 64 nt, hsa
cacuaauuucugcugcagcaucacgaucagggcaaaucagcacagccccccagccaucaguggu

SEQ ID NO: 73941 - RNA, 64 nt, hsa
uucuguaccuggagagagaguuuaggcaaauaacaaucagcaaggaaaccuucaccagugagaa

SEQ ID NO: 73942 - RNA, 64 nt, hsa
aacaaaaaaccauacacacacacacacacacacaaaucagcaucauaagggaauguagccuucc

SEQ ID NO: 73943 - RNA, 64 nt, hsa
ugaaaaugggggcaggugagaaguccauuuugagaaucagcauaguaaauuacauuucuaaucc

SEQ ID NO: 73944 - RNA, 64 nt, hsa
cuuaauauuuucuuuugucaccccagaggugaaaaaucagcaguugaagccugacaggccucag

SEQ ID NO: 73945 - RNA, 64 nt, hsa
aaaaugcacccaucagcacucuguaaaacgcaccaaucagcacucuguaaaaugcaccaaucag

SEQ ID NO: 73946 - RNA, 64 nt, hsa
aaaacgcaccaaucagcacucuguaaaaugcaccaaucagcaggauucuaaaaguagacaauca

SEQ ID NO: 73947 - RNA, 64 nt, hsa
acucuguaucuagcucaagguuuguaaacacaccaaucagcacccugugucuagcucaguguuu

SEQ ID NO: 73948 - RNA, 64 nt, hsa
ccuuugugucuagcucagggaucguaaacgcaccaaucagcacccugucaaaacagaccacuug

SEQ ID NO: 73949 - RNA, 64 nt, hsa
aaaacagaccacuugacucucuguaaaauggaccaaucagcaggauguggguggggcgagacaa

SEQ ID NO: 73950 - RNA, 64 nt, hsa
gcuauaauaaagauuucccugagacgggagucaaaaucagcaucccucagauaacugcuuuaug

SEQ ID NO: 73951 - RNA, 64 nt, hsa
augacuuuggagaguuucaaagugaaaagcccaaaaucagcaaauuugacuucuuaguagccac

SEQ ID NO: 73952 - RNA, 64 nt, hsa
uugauuuuuguacgaaaaaaagcuuuguuauagaaaucagcauacuauuuuuuuaaaucuggag

SEQ ID NO: 73953 - RNA, 64 nt, hsa
auacgguaaaugaggacucagcacagccaaccauaaucagcaugucugggauagacuggucuag

SEQ ID NO: 73954 - RNA, 64 nt, hsa
aagauggaccaaucagcgcucuguaaaauggaccaaucagcaggacaugggcggggacaauaag

SEQ ID NO: 73955 - RNA, 64 nt, hsa
uuuucugucuuacaagaggauuguaaaauggaccaaucagcacucuguaagauggaccaaucag

SEQ ID NO: 73956 - RNA, 64 nt, hsa
ugauuaauuaauacuauuugaguuauuaaauguuaaucaaaaugaguauaucauuuccugucuu

SEQ ID NO: 73957 - RNA, 64 nt, hsa
uuacaaaugaauauuucauguuuauauaagcuguaaucaaaaaggacuaguaguaguaguaagg

SEQ ID NO: 73958 - RNA, 64 nt, hsa
auuucaacaauggacuaugccuugguuuuucacuaaucaaaaucaaaauuacucuuuaacauga

SEQ ID NO: 73959 - RNA, 64 nt, hsa
acaauggacuaugccuugguuuuucacuaaucaaaaucaaaauuacucuuuaacaugauaaaug

SEQ ID NO: 73960 - RNA, 64 nt, hsa
gaacuucuuguccuagaucagccccaaucuguuuaaucaaaauggaagguucaguaauuucaug

SEQ ID NO: 73961 - RNA, 64 nt, hsa
uaauuacuguuuuuuauuuccacugccuuuauaaaaucaaaauuuucuccuuuugauaaaaacu

SEQ ID NO: 73962 - RNA, 64 nt, hsa
auucguuuucauuuagaagccccucuguacagauaaucaaaauucaaaguugaaagaaucaaaa

SEQ ID NO: 73963 - RNA, 64 nt, hsa
cucuguacagauaaucaaaauucaaaguugaaagaaucaaaagcagccacaguuauguaggucu

SEQ ID NO: 73964 - RNA, 64 nt, hsa
ucacucaggaaccagcggaucugcaaagaccuacaaucaaaagcaaauccccauuuuccuuuua

SEQ ID NO: 73965 - RNA, 64 nt, hsa
uaaggugugagguaacaauucaaucucuucuucaaaucaaaaugagaauucucuggaauaacag

SEQ ID NO: 73966 - RNA, 64 nt, hsa
gaauaaucuauggguuagaaaagcaucccugaauaaucaaaaauuggcaguauuggcauuguuc

SEQ ID NO: 73967 - RNA, 64 nt, hsa
ucuggauagauaaucugguaauaaaugauagguaaaucaaaaauuacuuuuauuuaggaguuug

SEQ ID NO: 73968 - RNA, 64 nt, hsa
auaugaugcugagucuguggaaugauacuucugaaaucaaaauuccucauaaggcaugaaguug

SEQ ID NO: 73969 - RNA, 64 nt, hsa
uugaaaauuaaaagugcccucuuaaaaauacaaaaaucaaaaagaggaaaauaaguuaaauuaa

SEQ ID NO: 73970 - RNA, 64 nt, hsa
uuuauuuuaacccuugaaucugcuuuauguacauaaucaaaauaucuauaucuauaucuauauc

SEQ ID NO: 73971 - RNA, 64 nt, hsa
cggaaugugcacguuuccaggggcgaguauugucaaucaaaagguuugcaaugauuuccuuccu

SEQ ID NO: 73972 - RNA, 64 nt, hsa
cauauagccauugaucauaaacugacuaucauaaaaucaaaacaagugaaauaacaaaauggac

SEQ ID NO: 73973 - RNA, 64 nt, hsa
auggaacgcuaaugaaacacagcuuacaaucgcaaaucaaaacucacaagugcucaucuguugu

SEQ ID NO: 73974 - RNA, 64 nt, hsa
uuuugauaguuuuauggcuuuuuacuguuagacuaaucaaaaauaacuuuaaaaggaacaaaga

SEQ ID NO: 73975 - RNA, 64 nt, hsa
acuauucaaguuguguacuuuaaacaaauauaaaaaucaaaaggcugccucuauuacaauccuc

SEQ ID NO: 73976 - RNA, 64 nt, hsa
uagcacuaugcuugggggccauuuuaaacagugaaaucaaaaaaagaacagaaaugcaaaaacc

SEQ ID NO: 73977 - RNA, 64 nt, hsa
gggaaguuucacccucucccuaucugaagaaaaaaaucaaaaacaaauguccccggaucuuucg

SEQ ID NO: 73978 - RNA, 64 nt, hsa
uguggccuuggaguuugcuaaauccaaauaugaaaaucaaaagcuuuaguauuccucaucuucu

SEQ ID NO: 73979 - RNA, 64 nt, hsa
uaauaaacuaacuuuaugugcaccuguguaggagaaucaaaauccuguaugcuuucuuugccuu

SEQ ID NO: 73980 - RNA, 64 nt, hsa
uguauuugauuacuuagagauaggaauuuuuaaaaaucaaaacaaaaaauaccacagcuuagug

SEQ ID NO: 73981 - RNA, 64 nt, hsa
uuuuuucaucuuuugcaaaaaguauuuguuacauaaucaaaaggugaaccagaggaaauauuga

SEQ ID NO: 73982 - RNA, 64 nt, hsa
ucuugaaaucucucucucucucucuauuuggaugaaucaaaauguaauuuguugaguuuugccu

SEQ ID NO: 73983 - RNA, 64 nt, hsa
auauauauauauauuaaacuuagaugauaaucaaaaucaaaaagucaacguaaaaacugguuuc

SEQ ID NO: 73984 - RNA, 64 nt, hsa
acacacauauauauauauauuaaacuuagaugauaaucaaaaucaaaaagucaacguaaaaacu

SEQ ID NO: 73985 - RNA, 64 nt, hsa
uugaugucaucaaagaucaccagggcauaauuauaaucaaaauuaguuuuauugaugcuugcug

SEQ ID NO: 73986 - RNA, 64 nt, hsa
gaacucucggccgggcgcgguggcucacaccuguaaucaaaacacuuugggaggcugagucggg

SEQ ID NO: 73987 - RNA, 64 nt, hsa
cagugaaacuuaugacuuggauauaugguugaagaaucaaaacaaaagcaaaaaaaaaaagcaa

SEQ ID NO: 73988 - RNA, 64 nt, hsa
uaaaaagaaguuaacauucauaucucuguuuugaaaucaaaaaucauauuucaaaauucuuucc

SEQ ID NO: 73989 - RNA, 64 nt, hsa
guuacaaaggugaaaagccaaauuuuaggaacagaaucaaaagaauaaaaaucugugaagagau

SEQ ID NO: 73990 - RNA, 64 nt, hsa
gccuuuuuuuuuaagcuuggcaaacaucccagcuaaucaaaauagucauauuccugagaaguag

SEQ ID NO: 73991 - RNA, 64 nt, hsa
ccagccuuuggaggaauagagauggucaauuaacaaucaaaaagaggagauuaaccucuuguuu

SEQ ID NO: 73992 - RNA, 64 nt, hsa
accuuacaugagaagaugagcaagaugaacuugcaaucaaaaacuuaaauauauauaaauaaag

SEQ ID NO: 73993 - RNA, 64 nt, hsa
uuggauuuacuagacgaaaaccauaccucucuucaaucaaaaugaaaacaaagcaaaugaauac

SEQ ID NO: 73994 - RNA, 64 nt, hsa
auauuguagucauuuuaaaguacacaaagggcacaaucaaaaugagaugcacucauuuaaaucu

SEQ ID NO: 73995 - RNA, 64 nt, hsa
ucccacuuaacacuuugauuagcaugaacuugccaaucaaaaaaugacaaucaauuugagaaaa

SEQ ID NO: 73996 - RNA, 64 nt, hsa
cuggacaacauagugagauccuaucucuauaaaaaaucaaaaauuagccaggcaugguggugca

SEQ ID NO: 73997 - RNA, 64 nt, hsa
ucgguuccucugauuucaaggccauauuuuaaaaaaucaaaaggcacugugaacuauuuugaag

SEQ ID NO: 73998 - RNA, 64 nt, hsa
caucaaguaaucauggccagcgauuauugaucaaaaucaaaagguaaugcacauccucauucac

SEQ ID NO: 73999 - RNA, 64 nt, hsa
aacuauaucaucaccaagagauguuuauuagggcaaucaaaagauuuauuauuuuaaaaaaauc

SEQ ID NO: 74000 - RNA, 64 nt, hsa
ugaaacuagacccccaucucuuagcauauacaaaaaucaaaauuaauuaaaaaguuaaaucuaa

SEQ ID NO: 74001 - RNA, 64 nt, hsa
cuucuguauaccuucacccauuucaugaaaauaaaaucaaaagggaaaucaaaaauaaagaaaa

SEQ ID NO: 74002 - RNA, 64 nt, hsa
uucacccauuucaugaaaauaaaaucaaaagggaaaucaaaaauaaagaaaacgcuaaagaaaa

SEQ ID NO: 74003 - RNA, 64 nt, hsa
accaggacccacuggggcauauaaaaaagucaaaaaucaaaaucaaacaacaaguucugaguua

SEQ ID NO: 74004 - RNA, 64 nt, hsa
agcuuuccuucuuuucaacagugauaccuacgaaaaucaaaauaaaugcaagcugagguuuugu

SEQ ID NO: 74005 - RNA, 64 nt, hsa
ucccaaauuuaauguggaagacaaaguguuggaaaaucaaaagaggcucacucaaaccagcaca

SEQ ID NO: 74006 - RNA, 64 nt, hsa
aaaacaaaaacaaaacaaaacauaaaauauaaacaaucaaaauccaaacaaacaaacaaacacu

SEQ ID NO: 74007 - RNA, 64 nt, hsa
acccagccucaaaaaaaaaaaaaaaaaagugaugaaucaaaauuagaaauuaagaguuuuaaga

SEQ ID NO: 74008 - RNA, 64 nt, hsa
ugagccaaggccacauagcuaccuacagugacagaaucaaaauucaaacucagguuuaucuagu

SEQ ID NO: 74009 - RNA, 64 nt, hsa
gugagaugcaacaagcccugcuuuugcauaaugcaaucaaaaauauguguuuuuaagauuaguu

SEQ ID NO: 74010 - RNA, 64 nt, hsa
guaaaguuacacuuuuauuuccuguauguuguacaaucaaaacacacuacuaccucuuaagucc

SEQ ID NO: 74011 - RNA, 64 nt, hsa
agguguggaacuuuuauuuuguuuuaaaaauaugaaucaaaauuccuguguugugugccaaggu

SEQ ID NO: 74012 - RNA, 64 nt, hsa
ggggacguagccuaacauuuuaccaacuuacguaaaucaaaaaagucauuauuguugcaggagu

SEQ ID NO: 74013 - RNA, 64 nt, hsa
ucagugacuaagaggcugcaauaaggugccaugaaaucaaaaucaaagggcuagaacucuccaa

SEQ ID NO: 74014 - RNA, 64 nt, hsa
aaaugauauaaaaacuauagucauaagaagagacaaucaaaaauaaucagccauaaaauauuaa

SEQ ID NO: 74015 - RNA, 64 nt, hsa
uauuuaaaaaaacaaaaaacaaaaaaaaucaaaaaaucaaaaaaauaauaaacuucauuuuaac

SEQ ID NO: 74016 - RNA, 64 nt, hsa
aacaguuuuauuuaaaaaaacaaaaaacaaaaaaaaucaaaaaaucaaaaaaauaauaaacuuc

SEQ ID NO: 74017 - RNA, 64 nt, hsa
uguauuuacaggagaaagaggugauuauggagggaaucaaaaauacugcuuucaguuaguagcu

SEQ ID NO: 74018 - RNA, 64 nt, hsa
uuaagugcgcauaucuuuucuguauacagcuuaaaaucaaaaauguauguuaagagaauuuuuu

SEQ ID NO: 74019 - RNA, 64 nt, hsa
aagccagcaauuggcugggguccaggaaacaaagcaaaagcacaauaugugaaugugcugauug

SEQ ID NO: 74020 - RNA, 64 nt, hsa
ggaaauuuauguuggcgauagccaagaccacaagcaaaagcacauacuggaaaugaugaguuag

SEQ ID NO: 74021 - RNA, 64 nt, hsa
agaaguucuaccaccuuauuagaacugcuauaaacaaaagcaucugaaauaauugugcacaucu

SEQ ID NO: 74022 - RNA, 64 nt, hsa
caacuccuagacaaaguuugccaaccauaagugucaaaagcacaggccaguauuaagcagaagu

SEQ ID NO: 74023 - RNA, 64 nt, hsa
ucuuacauuguggcaagaaaaaaugaggaagaagcaaaagcagaaaccccugauaaacugauca

SEQ ID NO: 74024 - RNA, 64 nt, hsa
aggcaagucccuuccaccuaugagccuguaaaaucaaaagcaagcuaguuacuuccuagauacc

SEQ ID NO: 74025 - RNA, 64 nt, hsa
uagcccuuugauuccagagagggagcuuugcuggcaaaagcaguuuuugcacuagaaauuuuug

SEQ ID NO: 74026 - RNA, 64 nt, hsa
uuccuguggacaaugcccagucucuguucagauccaaaagcacaaaauguuguauauagaguca

SEQ ID NO: 74027 - RNA, 64 nt, hsa
acuaucaucauauggacucuauguaacacaaauucaaaagcaaacuaaaagcuauaugcagagu

SEQ ID NO: 74028 - RNA, 64 nt, hsa
auaaaauaaaaaauauuugucuccaccuuuuccccaaaagcaacagcaagacauauuuuguuag

SEQ ID NO: 74029 - RNA, 64 nt, hsa
cuuaaggaauagaagcaaauuaaacgguaacauccaaaagcaaccacaaaccuaguacgacuuc

SEQ ID NO: 74030 - RNA, 64 nt, hsa
guuuaagauuguaauuaaaaugauaguugauuuucaaaagcauuaauuuuuuuucauuguuuuu

SEQ ID NO: 74031 - RNA, 64 nt, hsa
gaccccaccccggaccaguuacauucguuccuggcaaaagcaaauggaaauggucuccugucuc

SEQ ID NO: 74032 - RNA, 64 nt, hsa
cuuugcacccucucccacaacaaauaccaagcaucaaaagcacuuucauuugaaaauuauuaug

SEQ ID NO: 74033 - RNA, 64 nt, hsa
gaaaugacuucuuuucuccuucugucccuuuucucaaaagcaucuuucccccaaauguaugucu

SEQ ID NO: 74034 - RNA, 64 nt, hsa
ucuagaggaagggaacuuagaagaagcugaaauacaaaagcagaggauugaacaacugcagaga

SEQ ID NO: 74035 - RNA, 64 nt, hsa
uuaugauaagcacaugagagugucuuacauuuuccaaaagcaggcuuuaauugcauaguugagu

SEQ ID NO: 74036 - RNA, 64 nt, hsa
guuaaccccauguccucagcauuucuuuucuggccaaaagcaguaaauuugcuagcaguaaaag

SEQ ID NO: 74037 - RNA, 64 nt, hsa
uuauuuguauugaagaaaacaaauuuaccaaaagcaaaagcauaaaccccucccucuuuucagu

SEQ ID NO: 74038 - RNA, 64 nt, hsa
aucugauuauuuguauugaagaaaacaaauuuaccaaaagcaaaagcauaaaccccucccucuu

SEQ ID NO: 74039 - RNA, 64 nt, hsa
aguuggggcaggcuggcuggcccgucauguuccucaaaagcacccuugacgucaagucuccuuc

SEQ ID NO: 74040 - RNA, 64 nt, hsa
aacaugcgaccgugaccaggaacacccgacuccucaaaagcaaaugagaucccgccucuucuuc

SEQ ID NO: 74041 - RNA, 64 nt, hsa
gaaauuuguuguuuguuuaaacccaagugcugcacaaaagcagauacuugaggaaaacacuauu

SEQ ID NO: 74042 - RNA, 64 nt, hsa
cacaaaagcagauacuugaggaaaacacuauuuccaaaagcacauguauugacaacaguuuuau

SEQ ID NO: 74043 - RNA, 64 nt, hsa
accucucacaugcagcucagagcucccaagagcucaaaagcagaaauggccaggccuucugaaa

SEQ ID NO: 74044 - RNA, 64 nt, hsa
cacaaccagugccauggaaaaccaaggauauuagcaaaagcagaaguugcuagugaccuuggga

SEQ ID NO: 74045 - RNA, 64 nt, hsa
cuuuagaaguuaaaccacccgauaggccuucgagcaaaagcaaagauccaccgagagaagaaga

SEQ ID NO: 74046 - RNA, 64 nt, hsa
cauucgucauccaaguccaggucuagaucacacucaaaagcaaagcauucucuucccagugccu

SEQ ID NO: 74047 - RNA, 64 nt, hsa
acugacaggcacuauaauuucuguaacacacuaacaaaagcaugaaaaauaggaaccacaccaa

SEQ ID NO: 74048 - RNA, 64 nt, hsa
uugaguugauaguuuuacaaauucuuaauagguucaaaagcaaucuggucugaauaacacugga

SEQ ID NO: 74049 - RNA, 64 nt, hsa
uauuaugaaacuuuccuuugucauuauuagucuucaaaagcaugauuuuuaauaguuguugagu

SEQ ID NO: 74050 - RNA, 64 nt, hsa
uuacaucuuaagugaccuacaggguauauguuggcaaaagcagacuguguauaugucuuauaaa

SEQ ID NO: 74051 - RNA, 64 nt, hsa
aaaaaagagauucuaguacaaaguuacuguuuaacaaaagcaacauaaacucugggaaagauuu

SEQ ID NO: 74052 - RNA, 64 nt, hsa
acaaaagcaaaguaaucuuacaacuaugugcauacaaaagcaauacuauuuugugacuaaauau

SEQ ID NO: 74053 - RNA, 64 nt, hsa
agaguuuuaugaaagaugguauaguuuuuauugacaaaagcaaaguaaucuuacaacuaugugc

SEQ ID NO: 74054 - RNA, 64 nt, hsa
gggcuacaguaaccaaaacugcaugauacugguacaaaagcauggugcugguacaaaagcagac

SEQ ID NO: 74055 - RNA, 64 nt, hsa
ugcaugauacugguacaaaagcauggugcugguacaaaagcagacacauagaucaauggaacag

SEQ ID NO: 74056 - RNA, 64 nt, hsa
uucagugaucagaauagauauccuuuuacacgcacaaaagcaauagauucauucaguggacaag

SEQ ID NO: 74057 - RNA, 64 nt, hsa
gauuuacauaguaaguuucacacuaccuuauuaccaaaagcaaacaccucuuacuuuaaacuac

SEQ ID NO: 74058 - RNA, 64 nt, hsa
ucugucacaucuacucaacucugcuguugacaugcaaaagcagcaauagacaauaugcguguaa

SEQ ID NO: 74059 - RNA, 64 nt, hsa
ugaguguggcuguaauccaagaaaacuuuauuuacaaaagcagguggagggcuggguuuggccu

SEQ ID NO: 74060 - RNA, 64 nt, hsa
ugcaauagaaugaugucugcucuagggaaaccuucaaaagcaauaaaaaugcuguguugaaaug

SEQ ID NO: 74061 - RNA, 64 nt, hsa
caaaauguaacugcuaaucaagggugaugcacagcaaaagcaauggaccccaucccucuaaagc

SEQ ID NO: 74062 - RNA, 64 nt, hsa
cacucacacuaggcaaugccauuucaaugcauuacuaaaugacauuuguaguuccuagcuccuc

SEQ ID NO: 74063 - RNA, 64 nt, hsa
ggugguuguuuuuggucucuguugucacuaaagacuaaaugaggguuugcaguugggaaagagg

SEQ ID NO: 74064 - RNA, 64 nt, hsa
aaauacuuucauuuauguuugcuagaaacauuuucuaaaugauagugauuagcugguuagccau

SEQ ID NO: 74065 - RNA, 64 nt, hsa
guuuuagaauccuuugaaucuaaguauuuguuuccuaaaugaaacauuuguacaacauuugaug

SEQ ID NO: 74066 - RNA, 64 nt, hsa
aaaaaucaaacauucauauccacaaaauuuucugcuaaaugacuccacacucagccuucucuac

SEQ ID NO: 74067 - RNA, 64 nt, hsa
guaacugaagcuccagaguuaagguuucagauuucuaaaugaaacuaucuuuuucaauuacauc

SEQ ID NO: 74068 - RNA, 64 nt, hsa
ccuuaagugagaauuucuaaaugauuuucacauucuaaaugacuuuggguuuugaacucuccau

SEQ ID NO: 74069 - RNA, 64 nt, hsa
ccccuaauucugugggugccuuaagugagaauuucuaaaugauuuucacauucuaaaugacuuu

SEQ ID NO: 74070 - RNA, 64 nt, hsa
augucauauguuaaaaauaaagagauguagaaaucuaaaugaauuaucacuguguauacagaca

SEQ ID NO: 74071 - RNA, 64 nt, hsa
cauggucaucuggugaugaagagaaaaguuuaaucuaaaugauaugugcauuuccucauuuaaa

SEQ ID NO: 74072 - RNA, 64 nt, hsa
uugccucuugggaaauuagcagauagucuuugcucuaaaugauaucugaguaaauagacuugag

SEQ ID NO: 74073 - RNA, 64 nt, hsa
auacauuuuaaguauuuuuaaauagaugaaaauucuaaaugauuuucccucaaaucuaucuaga

SEQ ID NO: 74074 - RNA, 64 nt, hsa
aacauuuucugaauucccauuuucuuguucgcggcuaaaugacaguuucugucauuacuuagau

SEQ ID NO: 74075 - RNA, 64 nt, hsa
aaagguucuggcacuucaaugccaggcaggucuccuaaaugaacagaaugaucugugugagccg

SEQ ID NO: 74076 - RNA, 64 nt, hsa
aguguauuuuaaaguaauaaugauuaaagaauaacuaaaugacucugauuuuguuuuaucaauc

SEQ ID NO: 74077 - RNA, 64 nt, hsa
aaugcauucuguacuacauccugccuuuugaaaccuaaaugaguuuucguugaugaaauguugc

SEQ ID NO: 74078 - RNA, 64 nt, hsa
cucugagagaagcuauaauuuaaucugugaggaacuaaaugacaggagauuggugcuaauacgg

SEQ ID NO: 74079 - RNA, 64 nt, hsa
uguuaguacaugauuuuaaagguuagaaccccuucuaaaugaauggucuguggaagauuuuagu

SEQ ID NO: 74080 - RNA, 64 nt, hsa
aaaaacacuuccaaaaagauacacagaagaggaacuaaaugacugcgaagcuggaauacugcua

SEQ ID NO: 74081 - RNA, 64 nt, hsa
cacugcuuaaaguacauuaugcuuuuuaauggaacuaaaugaucaaaaaaagaauggacuguaa

SEQ ID NO: 74082 - RNA, 64 nt, hsa
uagaaaguauguuuguguugguuuuuuaagaagucuaaaugaaguuauuaauaccugaagcuuu

SEQ ID NO: 74083 - RNA, 64 nt, hsa
aaaaaauugacuaccuggaggaaugauuaggaaucuaaaugaagccagcccucgguaucugcag

SEQ ID NO: 74084 - RNA, 64 nt, hsa
uauccaaguauagugcagauucuauguaaaacuacuaaaugacacuggaauauguuuaguagau

SEQ ID NO: 74085 - RNA, 64 nt, hsa
cuauauuuaucugagugaguccaaggugcaacuccuaaaugaauuguguugcagagaacuccca

SEQ ID NO: 74086 - RNA, 64 nt, hsa
gcaagggaaacuggggagauggggauggaggaggaaggcugauauccucuggggagcacaucac

SEQ ID NO: 74087 - RNA, 64 nt, hsa
cuggggagcacaucaccugaaggugccaaggaggaaggcugagaggggggccaccccauuucug

SEQ ID NO: 74088 - RNA, 64 nt, hsa
ccggccucggaaccagcuuuucucucuuacgaugaaggcugaugccgagagcgggcugugggcg

SEQ ID NO: 74089 - RNA, 64 nt, hsa
guggucacugcgguugccgccccuaauugugccaaaggcugacccggcccgggcugcguacacc

SEQ ID NO: 74090 - RNA, 64 nt, hsa
cagauacuuuuaccugagugaugcuucccuuccuaaggcugaccaagaccuguugauccuuuua

SEQ ID NO: 74091 - RNA, 64 nt, hsa
auccuuuuagauuaaaaauaaaaugucgcauguaaaggcugaagucgcguuuuaucagaaugcc

SEQ ID NO: 74092 - RNA, 64 nt, hsa
augguggugaacaccuguaaucccagcuacuuggaaggcugaggcauaggaguugcuugaaccu

SEQ ID NO: 74093 - RNA, 64 nt, hsa
agagcgggaguuaguauaggaauguccaucucauaaggcugagagcuauuuuuuccuguggcug

SEQ ID NO: 74094 - RNA, 64 nt, hsa
acuucuccacccgccaggcagcugccacaggccuaaggcugagugaggugugauugggcccucc

SEQ ID NO: 74095 - RNA, 64 nt, hsa
auucgcccguuacaucuuccaaacugggacggucaaggcugaaggcuccucuggguuugagggu

SEQ ID NO: 74096 - RNA, 64 nt, hsa
cugguggcgggcgccuguagucccagcuacuuggaaggcugaggcaggagaauggcgugaaccc

SEQ ID NO: 74097 - RNA, 64 nt, hsa
accuuggccacccaaagugguagaauuacagaggaaggcugaggcaggaggauugcuuaaacgc

SEQ ID NO: 74098 - RNA, 64 nt, hsa
ggaagcaggguggccuccagagccuugccauaaaaaggcugaaggcagccgggcgcaguggcuc

SEQ ID NO: 74099 - RNA, 64 nt, hsa
cagacuccgucucaaaaaaaaaaaaaaaacaaaaaaggcugaaggcagcuguagcuccacacag

SEQ ID NO: 74100 - RNA, 64 nt, hsa
augguauaaaguuugcucauuaagaaaaaaagacaaggcugauuuugaagagaguugcuuuuga

SEQ ID NO: 74101 - RNA, 64 nt, hsa
acuuuuucucggagcauauauguagcuuuuaggaaaggcugaugaugguauaaaguuugcucau

SEQ ID NO: 74102 - RNA, 64 nt, hsa
ucgcuggggaagggggcuccaugcugguguggccaaggcugagagcucucucuucucuguuaca

SEQ ID NO: 74103 - RNA, 64 nt, hsa
acacuacuugagaaaaugcaggagagcuucccccaaggcugaugcauucccggugcagaacagg

SEQ ID NO: 74104 - RNA, 64 nt, hsa
aauuugccuguuuggggcagcuuuuaguaucgaugccacucaucugcagcagaagagaaagaag

SEQ ID NO: 74105 - RNA, 64 nt, hsa
uuucauggaccaacugaucaauugccaguacuaagccacucauuguuauggcuuccuuuuugaa

SEQ ID NO: 74106 - RNA, 64 nt, hsa
accuauuuaugugggccuucaguggaugggcagugccacucaggucucugggguuucccucucu

SEQ ID NO: 74107 - RNA, 64 nt, hsa
aucaugagggaaggaaaaugcagcacucuaaauggccacucaggcguuccuauucacucggaaa

SEQ ID NO: 74108 - RNA, 64 nt, hsa
agggcuggggacuuguccuucucuuccaacguaggccacucagcaacuggcauggagggcccag

SEQ ID NO: 74109 - RNA, 64 nt, hsa
uguggggacagcccucgcccugccaagcacugcggccacucagcagcuauguucccgccgcagu

SEQ ID NO: 74110 - RNA, 64 nt, hsa; identical to SEQ ID NO: 53255

SEQ ID NO: 74111 - RNA, 64 nt, hsa; identical to SEQ ID NO: 53256

SEQ ID NO: 74112 - RNA, 64 nt, hsa; identical to SEQ ID NO: 53257

SEQ ID NO: 74113 - RNA, 64 nt, hsa; identical to SEQ ID NO: 53258

SEQ ID NO: 74114 - RNA, 64 nt, hsa; identical to SEQ ID NO: 53259

SEQ ID NO: 74115 - RNA, 64 nt, hsa; identical to SEQ ID NO: 53260

SEQ ID NO: 74116 - RNA, 64 nt, hsa; identical to SEQ ID NO: 53261

SEQ ID NO: 74117 - RNA, 64 nt, hsa; identical to SEQ ID NO: 53262

SEQ ID NO: 74118 - RNA, 64 nt, hsa; identical to SEQ ID NO: 53263

SEQ ID NO: 74119 - RNA, 64 nt, hsa; identical to SEQ ID NO: 53264

SEQ ID NO: 74120 - RNA, 64 nt, hsa; identical to SEQ ID NO: 53265

SEQ ID NO: 74121 - RNA, 64 nt, hsa; identical to SEQ ID NO: 53266

SEQ ID NO: 74122 - RNA, 64 nt, hsa; identical to SEQ ID NO: 53267

SEQ ID NO: 74123 - RNA, 64 nt, hsa; identical to SEQ ID NO: 53268

SEQ ID NO: 74124 - RNA, 64 nt, hsa; identical to SEQ ID NO: 53253

SEQ ID NO: 74125 - RNA, 64 nt, hsa; identical to SEQ ID NO: 53254

SEQ ID NO: 74126 - RNA, 64 nt, hsa
gcugaacaggagaaagacaaacagaaagaauagagaacaggaacgagguggagagcaagacuga

SEQ ID NO: 74127 - RNA, 64 nt, hsa
guggugcccguggaaagagggagaaagagaagcugaacaggagaaagacaaacagaaagaauag

SEQ ID NO: 74128 - RNA, 64 nt, hsa
uucuguucaaccuguuuugaccucccaggcaucugaacaggaugacaucaucuuauuauaucuu

SEQ ID NO: 74129 - RNA, 64 nt, hsa
gguaacuaacaauuuugaaauacucauauaaaaugaacaggaaaguguuagugauugggugauu

SEQ ID NO: 74130 - RNA, 64 nt, hsa
auugcaagguacaauuuucuccaauaaaucaggagaacaggaguuugaugaugcaaaguugauc

SEQ ID NO: 74131 - RNA, 63 nt, hsa
uuggagaauacuuaaauaaaacaugugcaugcuugaacaggacaaaauguugacuguugcccu

SEQ ID NO: 74132 - RNA, 64 nt, hsa
caguuaauauaaaacaucuuuggaggaugggagagaacaggagggaagaugggaaacaaaauag

SEQ ID NO: 74133 - RNA, 64 nt, hsa
uccuuuccagaaaaauccucagaucauguaucuagaacaggaguuagaaagccugaaagcugug

SEQ ID NO: 74134 - RNA, 64 nt, hsa
agggaucuucuauuuaaguggcuucugagagggugaacaggauuguuacuuuuaagccuaccuc

SEQ ID NO: 74135 - RNA, 64 nt, hsa
cccucucucugcagacaugcugggaacucgcauggaacaggagggcagcagggcacuaaccucc

SEQ ID NO: 74136 - RNA, 64 nt, hsa
uuuaucuuuugagaacuuuugguaagggaaaagggaacaggaaaagaaaccccaaacucaggcc

SEQ ID NO: 74137 - RNA, 64 nt, hsa
agagcccuguaucaacccagaaacaccuagaucagaacaggaauccacauugccagugacauga

SEQ ID NO: 74138 - RNA, 64 nt, hsa
auauuuguguagugagguccuaaucaagaaacuugaacaggauaaugugucuaaaaauauugcu

SEQ ID NO: 74139 - RNA, 64 nt, hsa
uggguaguuuuaugucaaaauauuggcuuuucaagaacaggacucauaucuugauauuuaagag

SEQ ID NO: 74140 - RNA, 64 nt, hsa
ccccuaaugagggugugagaagugccuucuccuuccccaggauggacucuucucggcucaggcu

SEQ ID NO: 74141 - RNA, 64 nt, hsa
uuugccuuucugggagcagaaacagccauugcggccccaggaggggaacugagucacgcugggg

SEQ ID NO: 74142 - RNA, 64 nt, hsa
cuggaacaggggucccuggaguucacaggcuuauccccaggaagccucacuccuggggaaagac

SEQ ID NO: 74143 - RNA, 64 nt, hsa
aucccaagcagaauuagcaacaggaaaagcagagccccaggagagacacucuacuauauauacu

SEQ ID NO: 74144 - RNA, 64 nt, hsa
gagucccuggaaaagaaagaauaaguggauucucccccaggagaauccuuuuugcaaagauagg

SEQ ID NO: 74145 - RNA, 64 nt, hsa
cagcugaggucaguuucaggagggugaagcugauccccaggaauggaucagcugccaugggcac

SEQ ID NO: 74146 - RNA, 64 nt, hsa
agccaugguagaguuggguagaguugagcagcugccccaggauccaaauguggugucugaaaug

SEQ ID NO: 74147 - RNA, 64 nt, hsa
ccuccuuuguugcugcuucccugaaugaguauuaccccaggaugaggucugccaucagcuuagu

SEQ ID NO: 74148 - RNA, 64 nt, hsa
uacuuugcugcccuugccaucuuuuaggaugggcccccaggagacugaggucuuccugggcccu

SEQ ID NO: 74149 - RNA, 64 nt, hsa
uaggaaccgagggcacacgggacucuagccucauccccaggacccccuuggcucagaguguggu

SEQ ID NO: 74150 - RNA, 64 nt, hsa
gccaagggaggugccaacacugggcuugccacagccccaggagaggaauuuggggccuaggaac

SEQ ID NO: 74151 - RNA, 64 nt, hsa
accuagggaccacguuagcugccuuccuugagcuccccaggagucgguuuccacaucugugagg

SEQ ID NO: 74152 - RNA, 64 nt, hsa
gaggagugacuccaagaagaguuccggcagcuuuccccaggaaagggugaggggugacacucgg

SEQ ID NO: 74153 - RNA, 64 nt, hsa
gucaacccaaaggagcugccgcacugacccagccccccaggaaacagugagacaagaaucaagu

SEQ ID NO: 74154 - RNA, 64 nt, hsa
ggcagcagcaguaggacuauaaaccacagcugucccccaggaucccacuccuuuccugucugug

SEQ ID NO: 74155 - RNA, 64 nt, hsa
cacagggcccaggaggcauuccacacaggcacugccccaggacaacacaacaaggacagucaca

SEQ ID NO: 74156 - RNA, 64 nt, hsa
cuucaugguggguggaguggggguggcugggcucccccaggacagaggggacccugagguuggc

SEQ ID NO: 74157 - RNA, 64 nt, hsa
uccccugggaggggaggcaggaggaggccgagggccccaggaugucugccuggucccuucucac

SEQ ID NO: 74158 - RNA, 64 nt, hsa
aggguagcaguaaugaauaggaacagacagaaaaccccaggaggggcuuucaggaaacucuccc

SEQ ID NO: 74159 - RNA, 64 nt, hsa
caugggcucugguucugccaggagccugugacacccccaggaaggggguggaacugaggaagag

SEQ ID NO: 74160 - RNA, 64 nt, hsa
gagagagccuuggcgccucuguuugccaccacuuccccaggaaggagggacagcauuucucugg

SEQ ID NO: 74161 - RNA, 64 nt, hsa
uuucaaaaaguguggccucagcucuggaggccacccccaggaaggaguuugagguucauuguca

SEQ ID NO: 74162 - RNA, 64 nt, hsa
uggaucugcugagucaccccaggcaccagacuuaccccaggagcaugggccacuguccaugggg

SEQ ID NO: 74163 - RNA, 64 nt, hsa
cagugaugucauuuuauuccccucccaaaacaugccccaggaacaagcaccccuugccucugug

SEQ ID NO: 74164 - RNA, 64 nt, hsa
ccguccuguccaugcgcuuccagggccccacgguccccaggaggacgcuuccuggccaaagccc

SEQ ID NO: 74165 - RNA, 64 nt, hsa
ccucagaaucccacugcaauggacccaggcagcgccccaggaagccaugcugggcccccgccag

SEQ ID NO: 74166 - RNA, 64 nt, hsa
gaugcaugcagggcccccacaggagcguguacuaccccaggacgcaugcagggcccccaugcag

SEQ ID NO: 74167 - RNA, 64 nt, hsa
gacgcaugcagggcccccacaggagcguguacuaccccaggaugcaugcagggcccccacagga

SEQ ID NO: 74168 - RNA, 64 nt, hsa
gacgcaugcagggcccccacaggagcguguacuaccccaggacgcaugcagggcccccacagga

SEQ ID NO: 74169 - RNA, 64 nt, hsa
gacgcaugcagggcccccacuggagcguguacuaccccaggacgcaugcagggcccccacagga

SEQ ID NO: 74170 - RNA, 64 nt, hsa
aacgcaugcagggcccccacaggagcguguacuaccccaggacgcaugcagggcccccacugga

SEQ ID NO: 74171 - RNA, 64 nt, hsa
cuggcucaagguguagagggagcagagacgaagaccccaggaagucauccugcaaugggagaga

SEQ ID NO: 74172 - RNA, 64 nt, hsa
cauagaacaggaccucugcuuuugcacaccuuuuccccaggagcagaagagaguggggccugcc

SEQ ID NO: 74173 - RNA, 64 nt, hsa
cugccccuacgggcgcugcagccucccuuccaugccccaggaucacucucugcuggcaggauuc

SEQ ID NO: 74174 - RNA, 64 nt, hsa
aaccgugaauguagggcccccagccucaccucugccccaggaccaacaacacccugguuuggag

SEQ ID NO: 74175 - RNA, 64 nt, hsa
agggggucaccuaggggacugccucugugccucuccccaggaagcauccagggcagaggaagcc

SEQ ID NO: 74176 - RNA, 64 nt, hsa
caccuuggggcuucucaugggaaaugugcccccgccccaggacccucucccuuguggacaggca

SEQ ID NO: 74177 - RNA, 64 nt, hsa
cugggccucagcuucccuucccacauuccuccggccccaggagcaaccccuugggcuaggucug

SEQ ID NO: 74178 - RNA, 64 nt, hsa
uucuccaugacacgaggccaguccccaggagcagccccaggagcacaaccugagauuucuaagc

SEQ ID NO: 74179 - RNA, 64 nt, hsa
acacacaugcuuuucuccaugacacgaggccaguccccaggagcagccccaggagcacaaccug

SEQ ID NO: 74180 - RNA, 64 nt, hsa
uccagggaccuagagaaugggagggagaacggggccccaggagacccggccgccaccccacccg

SEQ ID NO: 74181 - RNA, 64 nt, hsa
ccuugcugaguccccugccaagcgcucggagcccccccaggacacucugcacccccucaccccg

SEQ ID NO: 74182 - RNA, 64 nt, hsa
aggagagagaggggaaggagguaugaaucccaguccccaggaaccuagcucuuuaaacucuggg

SEQ ID NO: 74183 - RNA, 64 nt, hsa
cuuuaaacucuggggagucggauucaggaaacacccccaggaggccaagccugaaaacagaggg

SEQ ID NO: 74184 - RNA, 64 nt, hsa
acgugggcgcuggguccagaccucggcugccacgccccaggaccugcagcccucaugggggcug

SEQ ID NO: 74185 - RNA, 64 nt, hsa
gagggaaggggauuuggagggaggcugucgucgcccccaggaaagacgggccugggggaggcgg

SEQ ID NO: 74186 - RNA, 64 nt, hsa
gccucaggugccacagccugguucggccuggcggccccaggaggcagcagcaaccuugggcuuc

SEQ ID NO: 74187 - RNA, 64 nt, hsa
gaggcccaggggagcccuguucacgcugguuucuccccaggacccaugagcuuccuggcuggcc

SEQ ID NO: 74188 - RNA, 64 nt, hsa
ccuggcagagggagaggacaggaggaggagccuuccccaggaggaacgaggagagguggccacg

SEQ ID NO: 74189 - RNA, 64 nt, hsa
aggagaaugagcuggagcgccagcaccacgauggccccaggacguuguuuaagaucugagaucc

SEQ ID NO: 74190 - RNA, 64 nt, hsa
gccagggcagcccuuaucagcuugugacaaccuuccccaggacagaagucauacaaggccucug

SEQ ID NO: 74191 - RNA, 64 nt, hsa
guggauccgggaccgaggguggucucuuggacaaccccaggaacuuggaccaaggcagagccaa

SEQ ID NO: 74192 - RNA, 64 nt, hsa
guccccuauucauuaacagugugugcaaaugcaaccccaggacacauuauuguucugauagaug

SEQ ID NO: 74193 - RNA, 64 nt, hsa
uuuuccauuccaggaacaaaggagaagccacuuuccccaggacgcaagacucuccccuccacug

SEQ ID NO: 74194 - RNA, 64 nt, hsa
cuuaaauccaaguuguuucuccagcugucaccucccccaggagaucaggauuccacugacgucc

SEQ ID NO: 74195 - RNA, 64 nt, hsa
cauccaugugauuaagauccaggccgcugaaguuccccaggaaaugaucuuccacuugagcaac

SEQ ID NO: 74196 - RNA, 64 nt, hsa
auccucauaggcagagaagcccuucugacauuucccccaggaggcaggggguggucugagucuc

SEQ ID NO: 74197 - RNA, 64 nt, hsa
cggggaccacaucuggcccccggcccgcgccaucccccaggauccuccggccugggcucccccu

SEQ ID NO: 74198 - RNA, 64 nt, hsa
uggaucaggguuguucugggaguccugucagcuuccccaggagcucucugcugagcagcccagc

SEQ ID NO: 74199 - RNA, 64 nt, hsa
cccaggagcucucugcugagcagcccagcacaacccccaggaaacacaaaugggguccagguca

SEQ ID NO: 74200 - RNA, 64 nt, hsa
gcuuugaccuuuauucaagagaccagauggguugccccaggauccggcugccagcccugaggcc

SEQ ID NO: 74201 - RNA, 64 nt, hsa
ccuggccugccguugcccugagcugcagccucggccccaggauccugcucacagucaccgcagg

SEQ ID NO: 74202 - RNA, 64 nt, hsa
gucacaacaaccucgucaucauccccacuuuaaaccccaggagacugaaacucaaacaacccug

SEQ ID NO: 74203 - RNA, 64 nt, hsa
cugagcucugaccuuucucuuggccccuuguacaccccaggagagaaguucucaaucccagcag

SEQ ID NO: 74204 - RNA, 64 nt, hsa
cauugagccugcaggcuuugagugggaguguugcccccaggagccuuaucucagccaauuaccu

SEQ ID NO: 74205 - RNA, 64 nt, hsa
agcaaagcaauacgacucagcccagcacucucugccccaggacucauggcucugcugugccuuc

SEQ ID NO: 74206 - RNA, 64 nt, hsa
cuacccccuacucuggggcuugggggucaacuccccccaggacuuaccuuccaaaacaaacuuu

SEQ ID NO: 74207 - RNA, 64 nt, hsa
gucagucccuguucuugagccucuuuucuccucuccccaggaugcagaaaguggugaacccagg

SEQ ID NO: 74208 - RNA, 64 nt, hsa
agagccucacaggagggagggggccccacaggcuccccaggaggcucgugucuuuggcccagag

SEQ ID NO: 74209 - RNA, 64 nt, hsa
cacagccucacaggagcaguuugugggcugguuuccccaggaauccagacccuaacccgugaga

SEQ ID NO: 74210 - RNA, 64 nt, hsa
gcacacggggccgcugggcaggugccccucacacccccaggaugucagugcucaccucgagcaa

SEQ ID NO: 74211 - RNA, 64 nt, hsa
agaguccugcagagccucugggcugggcuggugcccccaggagauggagggccugguggaugcc

SEQ ID NO: 74212 - RNA, 64 nt, hsa
cccgaccuccacccccucagacuccaucccccacccccaggagccuggcugucucuagcgaggg

SEQ ID NO: 74213 - RNA, 64 nt, hsa
uaggccucaaaacugacuuggucccacuuggaggccccaggauugguccugagguacagagcca

SEQ ID NO: 74214 - RNA, 64 nt, hsa
gcagaucaugcggcugcuucaugagaugcagaacccccaggagcgcccaggcuugggcagcaac

SEQ ID NO: 74215 - RNA, 64 nt, hsa
cccugcugaugagccugcuccaugggacccagccccccaggagauuggggcugccaacaagcag

SEQ ID NO: 74216 - RNA, 64 nt, hsa
gaaaaucuaguuaaaauaauccaauggacagaagccccaggaagggguauuuccaacacuuggc

SEQ ID NO: 74217 - RNA, 58 nt, hsa
agggcuucaagaucuucugaggcccccuccccaggaagccuaggcucgguggcuggac

SEQ ID NO: 74218 - RNA, 64 nt, hsa
augaccagaugcccugcuccaucacaaccuccuuccccaggaaaacccacuuuccaaaagccca

SEQ ID NO: 74219 - RNA, 64 nt, hsa
ggcuggccuuccuucucuucugagcccuccccugccccaggaacccuggccucaccaaaacagc

SEQ ID NO: 74220 - RNA, 64 nt, hsa
cgugagccacagggcuagaagcacaggcccgucaccccaggaggaaaagcccagggucuggggc

SEQ ID NO: 74221 - RNA, 64 nt, hsa
ugcucauccaccuucacaccacuugugagcugacccccaggaacagcuuggcuguuccaccaga

SEQ ID NO: 74222 - RNA, 56 nt, hsa
gucaggagugggggaaaugaggugcaccccaggaaggccccguagaccuccgaaga

SEQ ID NO: 74223 - RNA, 64 nt, hsa
aagaugucaaaggugugcagcuuccaaacggcauccccaggaucacugggcaaugcuggaaaga

SEQ ID NO: 74224 - RNA, 64 nt, hsa
cagcccaaagauuuuccugucccuggagugccagccccaggaagcuccagggcugaguggucag

SEQ ID NO: 74225 - RNA, 64 nt, hsa
gggggcugggaccccuucccaucccaaccuugagccccaggagauaccgcgcccacacccaauc

SEQ ID NO: 74226 - RNA, 64 nt, hsa
gggcagggcccagugggauugagggggcugggucccccaggacacgggcccagaagagccccac

SEQ ID NO: 74227 - RNA, 64 nt, hsa
caaacacccaaacagaaaaauacaaauacacguaccccaggaaggggucccucaagucucugcu

SEQ ID NO: 74228 - RNA, 64 nt, hsa
cccccucccagggcagccccugcccagcacaaaaccccaggacccuggcucugcacgccugggg

SEQ ID NO: 74229 - RNA, 53 nt, hsa
cccuucuccaggaagaguaacagccccaggagguauugaaggacaggagagau

SEQ ID NO: 74230 - RNA, 64 nt, hsa
gucgagagaccuguucuuucacagaugugagaagccccaggaugauugaccaugguguucagga

SEQ ID NO: 74231 - RNA, 64 nt, hsa
uuuagagacuuggccaugaauauccuuuguccugccccaggauuuagaucuuggcuacugucau

SEQ ID NO: 74232 - RNA, 64 nt, hsa
cuuugggauuacagcuugaguucugucaccccauccccaggaaacuguagcuucuuaacuggug

SEQ ID NO: 74233 - RNA, 64 nt, hsa
ucucgugauucuguuuguuacccauguucacuucccccaggagaggccuugguacccccucucc

SEQ ID NO: 74234 - RNA, 64 nt, hsa
ccaccccccaccuccaugccucagccuuugccuaccccaggaaugagcuuggccuccaacaucc

SEQ ID NO: 74235 - RNA, 64 nt, hsa
aggucggccugugugcccagcucagcuagcucugccccaggacggcccugcccucgaccuuccc

SEQ ID NO: 74236 - RNA, 64 nt, hsa
augaucuguuuugugcgucucuucucucccuuuuccccaggaaugaaccgaggccgucgccccu

SEQ ID NO: 74237 - RNA, 64 nt, hsa
caccccaggcugccaccccuccccacccguucacccccaggaugcuguugcuguaggacgccug

SEQ ID NO: 74238 - RNA, 64 nt, hsa
uguugcuguaggacgccugcugcccuggagcccuccccaggaugugagccaguccccucgcugg

SEQ ID NO: 74239 - RNA, 64 nt, hsa
gcucugguuucagagcagugccgggauugccuuuccccaggaucugugucggccauccaggaag

SEQ ID NO: 74240 - RNA, 64 nt, hsa
acugggcacacgccaucccagagggcucaggaugccccaggaaggaaagaagggcaacagacua

SEQ ID NO: 74241 - RNA, 64 nt, hsa
cugccaucuuggucaugagcuacugucugucccuccccaggacccgcggugggugcugcauguu

SEQ ID NO: 74242 - RNA, 64 nt, hsa
uggcuuggguggcagagcccacuuguuucagggaccccaggaggugcccccuggcucccaggac

SEQ ID NO: 74243 - RNA, 64 nt, hsa
ucaccaggagagccaaagacaggguugugccuuaccccaggagccaccccuguaccccccuugc

SEQ ID NO: 74244 - RNA, 64 nt, hsa
accaugguacugucuccacagcccucaguccccaccccaggagaggcgccugccaccuccuccu

SEQ ID NO: 74245 - RNA, 64 nt, hsa
gccagagcucggcagagucacccacccugcccuuccccaggaccccugagaggggcuuauuggu

SEQ ID NO: 74246 - RNA, 64 nt, hsa
cccggucauguggcgccuguuucgacgccgggacccccaggagaccaggucuggcucgcggcgg

SEQ ID NO: 74247 - RNA, 64 nt, hsa
cccccucauccugccuccaguucccggccacgccccccaggaccccugccccuccggggacacc

SEQ ID NO: 74248 - RNA, 64 nt, hsa
ugggcaccccaggaaccgccauugcccauaagacccccaggaagcuaggcacuuucuuuccaug

SEQ ID NO: 74249 - RNA, 64 nt, hsa
caaucugagccaugagaacgaggggaucugggcaccccaggaaccgccauugcccauaagaccc

SEQ ID NO: 74250 - RNA, 64 nt, hsa
auuucagauauauuuuaguaacacauucccagcuccccaggaaagccagucucaucuaauuucu

SEQ ID NO: 74251 - RNA, 64 nt, hsa
cuuuccauaggacauuucacacaguccuuagaacccccaggagagagcuacugacuuguuauca

SEQ ID NO: 74252 - RNA, 64 nt, hsa
cgcuggaggaagcugcucacuucucccuggaaguccccaggacagaccgaugccccugacagcc

SEQ ID NO: 74253 - RNA, 64 nt, hsa
cgagaccggcuggaucgcggccggccccggggggccccaggaggcaggggagcccagcugucgg

SEQ ID NO: 74254 - RNA, 64 nt, hsa
cuucauccggcuuagcuuggggcuggcugcauucccccaggaugggcuucgagaaagacaaacu

SEQ ID NO: 74255 - RNA, 64 nt, hsa
ccauagacggugcggggggccuggcugggccagaccccaggaaggugggguagacuggggggau

SEQ ID NO: 74256 - RNA, 64 nt, hsa
gcacccacacugaaagaugaggggcugcaccuucccccaggaaugacccucuaucccaggaccu

SEQ ID NO: 74257 - RNA, 64 nt, hsa
acccacccgccccauccaggcuccagcagcaaagccccaggagaacaggcuggacagaggagaa

SEQ ID NO: 74258 - RNA, 64 nt, hsa
cuuuaugcaacacccaaacaucuuggcauccccaccccaggaagugcggggaggagguuaugau

SEQ ID NO: 74259 - RNA, 64 nt, hsa
ucccagcuccagccuggagggaaggggacaaagaccccaggaggccaaagggcugcagucaccc

SEQ ID NO: 74260 - RNA, 64 nt, hsa
cuugggagcuuuaaagagcaggauagcucuuccuccccaggacuuggucuuuuuucugggucuu

SEQ ID NO: 74261 - RNA, 64 nt, hsa
ccagugcucacacaaucagaccaaggaacaagacccccaggaaggaaacagauuuaagcaagac

SEQ ID NO: 74262 - RNA, 64 nt, hsa
gugaugcggccacaagcccagggacaccuggagcccccaggagcugggagaggcaggaaggauc

SEQ ID NO: 74263 - RNA, 64 nt, hsa
gugaugcugccccaagcccagggaugccuggaguccccaggagcugggagaggcaggaaggacc

SEQ ID NO: 74264 - RNA, 64 nt, hsa
cguuuggagaccaagcagcagaugcagguguggaccccaggaaccuacaggggugucagccgcu

SEQ ID NO: 74265 - RNA, 64 nt, hsa
aagugagcguguagcguccugaggaauaaaauguuccgaugauguggaagcuccucugaugccu

SEQ ID NO: 74266 - RNA, 64 nt, hsa
cuuucacacaggguuugcauuuaucagucuguuuuccgaugauguguacaugaaagaguacacc

SEQ ID NO: 74267 - RNA, 64 nt, hsa
caauuacaacagugagaaaccauauuuccuucuauccgaugaguaaaaaguuucuaaaguguug

SEQ ID NO: 74268 - RNA, 64 nt, hsa
ucuucucuauuguaagguuuccauuuaguuugcuuccgaugauuaaaucuaagucauuugagaa

SEQ ID NO: 74269 - RNA, 64 nt, hsa
aaaaaaaaaaaaaacacuuaaacuuuguuaggacuccgaugaguuugggacuucaggaaaaauc

SEQ ID NO: 74270 - RNA, 64 nt, hsa
gaaacucacuggagagcugaagggagcugccauguccgaugaaugccaacagacaggccacucu

SEQ ID NO: 74271 - RNA, 64 nt, hsa
ccagcugugggcagucaguagcagaggacgauccuccgaugaaagcagccauuucuccuuuccu

SEQ ID NO: 74272 - RNA, 64 nt, hsa
guguguauuucuuaugcagucuuucccagggaacuccgaugaaguguuccaacaaaaugagcga

SEQ ID NO: 74273 - RNA, 64 nt, hsa
acccggagaaggccgcugccccagccccguuccuuccgaugacagugcucuaggcugccccggg

SEQ ID NO: 74274 - RNA, 64 nt, hsa
acuguguaaucccugagcagcacaaaacuuuuauuccgaugaccaguuacacaauuccuguuuu

SEQ ID NO: 74275 - RNA, 64 nt, hsa; identical to SEQ ID NO: 74272

SEQ ID NO: 74276 - RNA, 64 nt, hsa
agccugugcuuggaaagaugguuaguugauaccguccgaugauucuucaguaaagauagauucc

SEQ ID NO: 74277 - RNA, 64 nt, hsa
auguauauccugugguuuccccugccccucuguuuccgaugagguguacggaugagugaccugc

SEQ ID NO: 74278 - RNA, 64 nt, hsa
caaggaaaauuaggguacucaaccuaaguucgguuccgaugaauucuuauccccugccccuucc

SEQ ID NO: 74279 - RNA, 64 nt, hsa
ugacacuggguuagcucagcauggauuucccuuauccgaugauuuuucuacauuuacuuggcca

SEQ ID NO: 74280 - RNA, 64 nt, hsa
gcuugguugcauucuuggacagacagcucuggcauccgaugaagugaucuuaguugucugcuca

SEQ ID NO: 74281 - RNA, 64 nt, hsa
auucaccccaccccauuuucuuguuucugguccauccgaugagacggaugcucugaugcucuga

SEQ ID NO: 74282 - RNA, 64 nt, hsa
cugacccuagaaugccaaggaacugagaaugggcuccgaugaaaaccuuccuuuucagauuccc

SEQ ID NO: 74283 - RNA, 64 nt, hsa
ggagcaggagagagcugcugucagugagaaugacuccgaugagcugcucaucgaccuggagcgg

SEQ ID NO: 74284 - RNA, 64 nt, hsa
ucugaaugggacugagucccaggaaacagugcuuuccgaugagacucagcccaccauuucuccu

SEQ ID NO: 74285 - RNA, 64 nt, hsa
acguuugcuuuacccaccgccaccaagaaagcaguccgaugagauuuuuuuuuggaggggggag

SEQ ID NO: 74286 - RNA, 64 nt, hsa
gccugggccccgaagccaagcccuuuccagcuccuccgaugaaggcagccccugcccuggcaug

SEQ ID NO: 74287 - RNA, 64 nt, hsa
cgcuugccuguuuccgcuugacccuuccuccagcuccgaugagaagaguauaaagcaucuuccu

SEQ ID NO: 74288 - RNA, 64 nt, hsa
uuaaaauuaucucguuaaagaucuccaaauuuguuccgaugacaagugaaauuuaaaugugaga

SEQ ID NO: 74289 - RNA, 64 nt, hsa
gucuauugaaacugcaaagaucccggagcuggucuccgaugaaaaugccauuucuucguugcca

SEQ ID NO: 74290 - RNA, 64 nt, hsa
ucguucuccacccaccagucagggacagcagccucccugucacucagcugagaaggccagcccu

SEQ ID NO: 74291 - RNA, 64 nt, hsa
ugcagaucugugcucaucggagacugccccacggcccugucagagccgccacuccuauccccag

SEQ ID NO: 74292 - RNA, 64 nt, hsa
gccccauacccgucacuacagccucaccucccaccccugucacuacggccucaccucccacccc

SEQ ID NO: 74293 - RNA, 64 nt, hsa
cucccaccccugucacuacggccucaccucccaccccugucacuacagccucaccuccuacagc

SEQ ID NO: 74294 - RNA, 64 nt, hsa
uaguaaagcuggaaggccaggugcagugucucaccccugucaucccagcacuuugagaggccaa

SEQ ID NO: 74295 - RNA, 64 nt, hsa
gaucccggccugaagcgcaaguccccuccugaggcccugucaggguccuuacccccagccacca

SEQ ID NO: 74296 - RNA, 64 nt, hsa
caaauuuuaacuuuuaauuuuuauuuuggcaaaacugucaaaugagaaaaaugauuuuaaaaac

SEQ ID NO: 74297 - RNA, 64 nt, hsa
auuuaaccuggauagccacauuaaugaauuggugcugucaaaauauaguaauuuuuaaauuugu

SEQ ID NO: 74298 - RNA, 64 nt, hsa
ccuucagucuaauaaccuugaagugguuuuugaacugucaaacuuugaccuguagaugcuguag

SEQ ID NO: 74299 - RNA, 64 nt, hsa
ugauugcuacauacacuucucugaggaucaccugcugucaaauugccaucuacaguauuacagc

SEQ ID NO: 74300 - RNA, 64 nt, hsa
ccuuucuuuuggucacagagaaaggguacuuucucugucaaaucucaacuuagacuugacuucc

SEQ ID NO: 74301 - RNA, 64 nt, hsa
acucucuuccaucucuuuccccaaggcuccgugacugucaaacugggaguaggagaggggacaa

SEQ ID NO: 74302 - RNA, 64 nt, hsa
cggccuuuacuuccgccucccucagagcagcagccugucaaaacaccagauuacaacaaauuua

SEQ ID NO: 74303 - RNA, 64 nt, hsa
gguagaagagguuaguuuuauagacaggaaggggcugucaaaggcagaaagaaaugaagaacaa

SEQ ID NO: 74304 - RNA, 64 nt, hsa
accccauguaccuuuauugagcuuaauuauaauacugucaaauugccacgaucucacuaaagga

SEQ ID NO: 74305 - RNA, 64 nt, hsa
aaauuuggguaccauuuuaucacuguucaaagcacugucaaauuccuuucauccuuuaauaguu

SEQ ID NO: 74306 - RNA, 64 nt, hsa
aaaaauauguuaccugcaguguaaguacagcacacugucaaauucuuuuccuuaaggugcacag

SEQ ID NO: 74307 - RNA, 64 nt, hsa
uuguggaaggcaguuuuaacuuucugaagaauaucugucaaaauuuaagaaaacaaauguauaa

SEQ ID NO: 74308 - RNA, 64 nt, hsa
cucgaucagcuguucauccauuucguguuuuuuccugucaaacauuaauccagcaaauauauga

SEQ ID NO: 74309 - RNA, 64 nt, hsa
auuaaaauauuuucacggaauuaaaaguagcuugcugucaaagaaacaccugagaugaauuggu

SEQ ID NO: 74310 - RNA, 64 nt, hsa
acucuuauacccagaaaagaacauauuucagaaucugucaaacuuuuguguaucccacagauuc

SEQ ID NO: 74311 - RNA, 64 nt, hsa
gcagcuauuugagggacuaagggauggagauauucugucaaaugaaucucuucaguauaccagu

SEQ ID NO: 74312 - RNA, 64 nt, hsa
gaaguaauugcagaagcaguuggggugaagaaaacugucaaauaugaagcugcuggggaagcug

SEQ ID NO: 74313 - RNA, 64 nt, hsa
aaaauucuucaaaaaacacagcccacuuauccaucugucaaaaguucacaaugccauacaggcu

SEQ ID NO: 74314 - RNA, 64 nt, hsa
auaaaaugugucaauugucucugugauuuagaaacacuauuaauaacaucagagcaagguucua

SEQ ID NO: 74315 - RNA, 64 nt, hsa
cuuaagcauuauagaauuucucuuaccagcaugacacuauuauauucaggaaacauggcacugc

SEQ ID NO: 74316 - RNA, 64 nt, hsa
ucuugaguuuguuuucuaaaggagaccagaaauccacuauuacaaauguauuugaaaacauguu

SEQ ID NO: 74317 - RNA, 64 nt, hsa
gucaaguuuuccauaaauucuacuucucauguggcacuauuauauaauaccuuugagaucuuug

SEQ ID NO: 74318 - RNA, 64 nt, hsa
aaaagucacuauuauccuaccacuuugcgggacacacuauuaauauuuaagcauagauucuucc

SEQ ID NO: 74319 - RNA, 64 nt, hsa
ugagaaaauagagauaaguaaaaagaauaaaagucacuauuauccuaccacuuugcgggacaca

SEQ ID NO: 74320 - RNA, 64 nt, hsa
aaucuaaguccuuauuuucugauggcucuuguuccacuauuaacauuguuuuuaauuuuuaaaa

SEQ ID NO: 74321 - RNA, 64 nt, hsa
uuaacaugucuaggagugggagccugacagacaccacuauuaaaaaaaaaaaaaauccccaaaa

SEQ ID NO: 74322 - RNA, 64 nt, hsa
ccuucuagcucuaauccuggcaacaguucuccgucacuauuauuuugccuuuucuggacuguca

SEQ ID NO: 74323 - RNA, 64 nt, hsa
uuaggauaacaagaagagaaaauaaagguaaaaacacuauuaccuguuucuagucacuuuagaa

SEQ ID NO: 74324 - RNA, 64 nt, hsa
auccuuuaaaacaacuuuucaauuaauauuaucacacuauuaucagauuguaauuagaugcaaa

SEQ ID NO: 74325 - RNA, 64 nt, hsa
aaaacaaaacaaaaaacuauguauuugcacagcacacuauuaaaauauuaaguguaauuauuuu

SEQ ID NO: 74326 - RNA, 64 nt, hsa
aaucucaacacuuugggaggccaaggugggaagaucacuugaucccaggaauucuagaucagcu

SEQ ID NO: 74327 - RNA, 64 nt, hsa
ggucccagcuacucaggaggcugaggcaggaggaucacuugagcacaggaguuugaggcugcag

SEQ ID NO: 74328 - RNA, 64 nt, hsa
aaucucagcacuuugggaggccaaggugggcggaucacuugaggucuggaguuugagaccagcc

SEQ ID NO: 74329 - RNA, 64 nt, hsa
ggucccagcuacuugggaggcugaggugggaaaaucacuugaaccugggagggugagguugcag

SEQ ID NO: 74330 - RNA, 64 nt, hsa
uguucagaagagaauaaaccaguguuuuuaccuuucacuugaaaaagaaguauaaaaacaacug

SEQ ID NO: 74331 - RNA, 64 nt, hsa
aaucccaacaccuugggaggccaaggugggcggaucacuugaggucaggaguucaagaccaucu

SEQ ID NO: 74332 - RNA, 64 nt, hsa
aacuccagcuacucgggagacugaaggacaagaaucacuugaaccugggaagccgagggacgag

SEQ ID NO: 74333 - RNA, 64 nt, hsa
aaccccagcacuuugggaggccgaggcggguggaucacuugaggucaggaguucaagaccagcc

SEQ ID NO: 74334 - RNA, 64 nt, hsa
aaucccagcugcuugggaggcugaggcaggagaaucacuugaacacaggaggcagagguugcag

SEQ ID NO: 74335 - RNA, 64 nt, hsa
ggucccaguuacuugggaggcugacguggguggcucacuugagcacaggaguuugaggcugcag

SEQ ID NO: 74336 - RNA, 64 nt, hsa
aaucucggcacuuugggagacugaggugggagcaucacuugagaccaggaguuugggaccaggc

SEQ ID NO: 74337 - RNA, 64 nt, hsa
ggucccaucugcuugggaggcugagguugcaggaucacuugagcccaggaggucaaggcugcag

SEQ ID NO: 74338 - RNA, 64 nt, hsa
aaucccagcacuuuggaaggcugaggcagaaggaucacuugagcccaggaauuugagguuguag

SEQ ID NO: 74339 - RNA, 64 nt, hsa
gccucuucuauuguucugauuagucuacuuaaauucacuugaugcucuuuuuauuuuacaagag

SEQ ID NO: 74340 - RNA, 64 nt, hsa
aaucccaacacuuugggaggccgaggugggaggaucacuugagcacaggaguuugagaccagcc

SEQ ID NO: 74341 - RNA, 64 nt, hsa
aaucccagcauuuugggaguccgaggugggcagaucacuugagcucaggaggucaagaucagcc

SEQ ID NO: 74342 - RNA, 64 nt, hsa
uagucccacuacuuguggggcuaaggcaggaggaucacuugagccccggaggucgaggcuacag

SEQ ID NO: 74343 - RNA, 64 nt, hsa
aauccuagcacuuugggaggcugaggaggaaggaucacuugagcccagaaguucgagacuagcc

SEQ ID NO: 74344 - RNA, 64 nt, hsa
agucccagcauuccgggaggcugaggugggaggaucacuugagcccagggagguuggggcugca

SEQ ID NO: 74345 - RNA, 64 nt, hsa
aaucccaacacuuuaggagaccaaggcgggcagaucacuugaggucagaaguuugagaccagcc

SEQ ID NO: 74346 - RNA, 64 nt, hsa
agucccaacuacuagggaggcugaggcaggagaaucacuugaacccaggagguggagguugcag

SEQ ID NO: 74347 - RNA, 64 nt, hsa
agucccagcucuaccccuucuuggccccuacaagucacuugacccaucuuaggcugagggugug

SEQ ID NO: 74348 - RNA, 64 nt, hsa
aaucccagcacuuugggaggccaaaguggguggaucacuugaggaguucaagaccagccugguc

SEQ ID NO: 74349 - RNA, 64 nt, hsa
gccuuuuuaaaauuuuauguauuaauauaugcauucacuugaaaaacuaaaaaaaaacaauaau

SEQ ID NO: 74350 - RNA, 64 nt, hsa
aaucccagcgcuuugggaggcuaaggcaggcagaucacuugagaccagcuugggcaacauggca

SEQ ID NO: 74351 - RNA, 64 nt, hsa
ggcucaugccuguaaucccagcacauugggaagaucacuugaggcaaggaguuugagaccagac

SEQ ID NO: 74352 - RNA, 64 nt, hsa
uccaaggguuuccaaacuugucugcaaauuaggaucacuugagaauccuuuaaaaauuccaaag

SEQ ID NO: 74353 - RNA, 64 nt, hsa
aaucccagcacuuugggaagccaaggugggcugaucacuugaucccaggaguuugagaccagcc

SEQ ID NO: 74354 - RNA, 64 nt, hsa
uguagucucaacuauuggggaggcuaagguaggaucacuugaucccaggaggcggagguugcag

SEQ ID NO: 74355 - RNA, 64 nt, hsa
aaucccagcacuuugugaggccaaggugggcggaucacuugaggccaggaauuugaaaccagcc

SEQ ID NO: 74356 - RNA, 64 nt, hsa
uguaaucccagcacuuugggagguugcggguggaucacuugaggucaggaguucgagaccagcc

SEQ ID NO: 74357 - RNA, 64 nt, hsa
aaucucagcuacuugggaggcugaggcacaagaaucacuugaacuugggagguggagguugcag

SEQ ID NO: 74358 - RNA, 64 nt, hsa
aaucccagcacuuugggaggccaaggcaggcagaucacuugaggucaggcguuugagaccagcc

SEQ ID NO: 74359 - RNA, 64 nt, hsa
uaaucccagcacuuugggggccaaggaggguggaucacuugagaucaggaguucaagaccagcc

SEQ ID NO: 74360 - RNA, 64 nt, hsa
aucccagcuacccaggaaggcugaggcggcagaaucacuugaacccggaggcggagguugcggu

SEQ ID NO: 74361 - RNA, 64 nt, hsa
gacauaagauuuaguccuaauaaggacucuguauucacuugauuauucugacccuuccuaaggg

SEQ ID NO: 74362 - RNA, 64 nt, hsa
agucacagguacuugggaggcugaggugggaggaucacuugagcccaggagauagaggcugcag

SEQ ID NO: 74363 - RNA, 64 nt, hsa
agaccucuuacuuugggaggccaaggugggugggucacuugaacccaggaguuugacaucaacc

SEQ ID NO: 74364 - RNA, 64 nt, hsa
aaucccagcuacuugggaggcugaggcaggagaaucacuugaacccgggagaugaagguugcag

SEQ ID NO: 74365 - RNA, 64 nt, hsa
aaucccagcccuuugggaggcugagguggguguaucacuugaggucaggaguucaagaccaauc

SEQ ID NO: 74366 - RNA, 64 nt, hsa
gccugcggucccagcugcucugauaagaggaggcucacuugagcccaggagguugaggcugcag

SEQ ID NO: 74367 - RNA, 64 nt, hsa
aaucccagcgcuuugggaggcugaggcagguggaucacuugagcucaggaguucaagaccagcu

SEQ ID NO: 74368 - RNA, 64 nt, hsa
aaucccagcacuuugggaggcugaggcgggugaaucacuugauugaggucaggaguucgagacc

SEQ ID NO: 74369 - RNA, 64 nt, hsa
auuuauuuacauacuuauaaagaaaacuguauguucacuugaacucugaaaauguacauguaug

SEQ ID NO: 74370 - RNA, 64 nt, hsa
aaucccagcacuuugcaaggccgaggaggguggaucacuugaggucaggaguucgagaccagcc

SEQ ID NO: 74371 - RNA, 64 nt, hsa
gcuaggaugcuguuuaccccaucucucucuuauaucacuugaaugauauauuguaagugagagg

SEQ ID NO: 74372 - RNA, 64 nt, hsa
aucuucaguaccucauuggaucacuuuucuuucaucacuugaguauucuagcagucauucuccu

SEQ ID NO: 74373 - RNA, 64 nt, hsa
aaucccagcuacgcaggaggccaaggcaggagaaucacuugaaccugggagguggugguugcag

SEQ ID NO: 74374 - RNA, 64 nt, hsa
caugguggugggcuacucuggaggcccuugaggaucacuugagcccaggagauugaggcugcag

SEQ ID NO: 74375 - RNA, 64 nt, hsa
aguuccagcuacucgggaagcugaggcaguaagaucacuugagcccaggaggccgaugcugcag

SEQ ID NO: 74376 - RNA, 64 nt, hsa
aaucucagcacuuugggaggcugagguggaaggaucacuugaagccagaguuugagaccagccu

SEQ ID NO: 74377 - RNA, 64 nt, hsa
aguaccugcuauugguaaggcugagguggaagguucacuugagccugggagguggagguuguag

SEQ ID NO: 74378 - RNA, 64 nt, hsa
aaucccagcacuuugggaggccgaggggggcagaucacuugagcccaggaguucgagagcagcc

SEQ ID NO: 74379 - RNA, 64 nt, hsa
cccacuguuauuaaagcaaaaaguauaauguucuucacuugaacuaaucaaauacaauagauua

SEQ ID NO: 74380 - RNA, 64 nt, hsa
augacagagguuaaaauuuugucugcacuugaguucacuugaguuuacauuugaaaugugcaug

SEQ ID NO: 74381 - RNA, 64 nt, hsa
aaucccagcacuuugggaggccaaggccagcggaucacuugaggucaggaguucgagaccagcc

SEQ ID NO: 74382 - RNA, 64 nt, hsa
aaucccagcuacucgggaggcugaggcaggagaaucacuugaacccgggaggcggcgguugcag

SEQ ID NO: 74383 - RNA, 64 nt, hsa
aauccgagcacuuugggaggcugaggcaggcggaucacuugaggucagcaguuugagacgagcc

SEQ ID NO: 74384 - RNA, 64 nt, hsa
caggcgugguggcgggaggcugaggcaaggagaaucacuugaauacaagaggcagagguugcag

SEQ ID NO: 74385 - RNA, 64 nt, hsa
augcauggcuauaaucccagccgaggugggaggaucacuugaguccagguucaagacuagccug

SEQ ID NO: 74386 - RNA, 64 nt, hsa
agucccagcuacuugggaggcugaguugggaggaucacuugagccugggagguugaggcugcag

SEQ ID NO: 74387 - RNA, 64 nt, hsa
aaucccagcacuuugggaggcugaggcaggcggaucacuugaggucaggagcucgagaccagcc

SEQ ID NO: 74388 - RNA, 64 nt, hsa
aaucccagcauuuugggaggccaaggcgggcggaucacuugaggucaggagcucaagaccagcc

SEQ ID NO: 74389 - RNA, 64 nt, hsa
aaucccaacacuuuaggaguccaaggcgggcggaucacuugaggucaggaguucaagaccagcu

SEQ ID NO: 74390 - RNA, 64 nt, hsa
aaucccagcacuuugggaggcugaggcgggcagaucacuugaggccaggaguucaagaccagcc

SEQ ID NO: 74391 - RNA, 64 nt, hsa
cccaguuacuugggaggaucacuugaauguaggaucacuugagucuaggaguucggggcugcag

SEQ ID NO: 74392 - RNA, 64 nt, hsa
uggcccaagucugagucccaguuacuugggaggaucacuugaauguaggaucacuugagucuag

SEQ ID NO: 74393 - RNA, 64 nt, hsa
ggucccagcuacaggggaggcugagacgcaaggaucacuugagcccagaagcucaaggcugcag

SEQ ID NO: 74394 - RNA, 64 nt, hsa
aauccuagcacuuugggaggcugagaugggaggaucacuugaggccaagaguuugagaccaacc

SEQ ID NO: 74395 - RNA, 64 nt, hsa
gucuuugggucuuugggaggccagggugggaggaucacuugagcucaggaguuugagaccagcc

SEQ ID NO: 74396 - RNA, 64 nt, hsa
ccagcuacucgggaggcugagugaggcaggaggaucacuugagaccaggagguuguggcuguag

SEQ ID NO: 74397 - RNA, 64 nt, hsa
ggguccagcuacucaggaggccaaggugggaggaucacuugagcccaggaguuuuagacuagcc

SEQ ID NO: 74398 - RNA, 64 nt, hsa
ggucucagcuauucaggaggcugaggcaggagaaucacuugagaccaggaaguugaggcugcaa

SEQ ID NO: 74399 - RNA, 64 nt, hsa
aaucccagcacuuucgguggccgggguggguggaucacuugaggccaggaguucaagaccaccc

SEQ ID NO: 74400 - RNA, 64 nt, hsa
aaucccagcuacucaggaggcagaggcaggagaaucacuugaacccgggagguggaggcugcag

SEQ ID NO: 74401 - RNA, 64 nt, hsa
aaucccagcacuuugggagggcgaggcuagcagaucacuugagguuaggaguucgauaccagcc

SEQ ID NO: 74402 - RNA, 64 nt, hsa
aaucccagcuacugagggggcugaggcaugagaaucacuugaaccugggagacagagguugcaa

SEQ ID NO: 74403 - RNA, 64 nt, hsa
agucccagcugcuugggaggcugaggugggagaaucacuugagcccaggaguucgaggcugcag

SEQ ID NO: 74404 - RNA, 64 nt, hsa
uaaucccagcauuuugggaggcugagugagaggaucacuugagcucaggaguucgagaccagcc

SEQ ID NO: 74405 - RNA, 64 nt, hsa
uucuuuccuuggcccgcucccuuuuucuucugccucacuugaaucccccguaaacaccagacga

SEQ ID NO: 74406 - RNA, 64 nt, hsa
aaucccagcuacuugggagacugaggcaagagaaucacuugaacccgggagguggagguggcag

SEQ ID NO: 74407 - RNA, 64 nt, hsa
aguccccgcuacgcagguggcugaagcagaagaaucacuugaaccugagagguggagguugcag

SEQ ID NO: 74408 - RNA, 64 nt, hsa
aaucccagcuacucaggaggcugaggcaggagaaucacuugaacccaggaggcagagguugcag

SEQ ID NO: 74409 - RNA, 64 nt, hsa
agucccagcuacuagggaggcugagccaggaggaucacuugagcccgggagguugaggcugcag

SEQ ID NO: 74410 - RNA, 64 nt, hsa
uaucccagcuacucaggaagcugagacacgagaaucacuugaaccugggaggcagagguugcag

SEQ ID NO: 74411 - RNA, 64 nt, hsa
gcucacgccuguaaucccagcacugagaggccgaucacuugaggucaggaguucaagaccagcc

SEQ ID NO: 74412 - RNA, 64 nt, hsa
aaucccagcauuuugggaggccaagguggguggaucacuugaggccaggaguucaagaccagcc

SEQ ID NO: 74413 - RNA, 64 nt, hsa
guaaacacaguggcuggggaaacccuuccuagucucacuugauuccucaugacggaaaucacac

SEQ ID NO: 74414 - RNA, 64 nt, hsa
uuccuauguggaaaugauuccagccaugguccccucacuugagcaugugaauauucucacggag

SEQ ID NO: 74415 - RNA, 64 nt, hsa
aaucccagcacuuuaagaggccaaggcggauggaucacuugagcccaggaguucaacaccagcc

SEQ ID NO: 74416 - RNA, 64 nt, hsa
agucccagccacucaagaggcacaggcgggaggaucacuugagccugggagguugugguugcag

SEQ ID NO: 74417 - RNA, 64 nt, hsa
aaugcucgcacuuugugaggccaggguggguggaucacuugaggucaggaguucaagacuagcc

SEQ ID NO: 74418 - RNA, 64 nt, hsa
aaucccagcuacucgggaggcugaggcaagagaaucacuugaacccaggaggcggagguugcag

SEQ ID NO: 74419 - RNA, 64 nt, hsa
aaucccagcaguuugcgaggccgaggcagguggaucacuugagcccaggaguuugaaaccagcc

SEQ ID NO: 74420 - RNA, 64 nt, hsa
aguccuagcuacucaggaggcugaggugggaggaucacuugagcuugggaggcggugguugcag

SEQ ID NO: 74421 - RNA, 64 nt, hsa
aaucccagcuacuugggaggcugaggcaagugaaucacuugaacccaggaagcagagguugcag

SEQ ID NO: 74422 - RNA, 64 nt, hsa
aaucccagcauuuugagaggcugagguggguggaucacuugaggucaggaguuugagaccaccc

SEQ ID NO: 74423 - RNA, 64 nt, hsa
aaccccagcacuuugggaggcugagaugggcagaucacuugaggucaggaguucgagaccagcc

SEQ ID NO: 74424 - RNA, 64 nt, hsa
aaucccagcacuuugggaagccaaggagggaggaucacuugaacucaggaauucgagaccagcc

SEQ ID NO: 74425 - RNA, 64 nt, hsa
aaucccagcuacuugggaggcuaaggcaggagaaucacuugaauccaggaggcggaguuugugg

SEQ ID NO: 74426 - RNA, 64 nt, hsa
cacacaccuguagucccaggcugaggugggaggaucacuugaacccaagaggcagaguuugcag

SEQ ID NO: 74427 - RNA, 64 nt, hsa
aaucccagcacuuugggaggacaagguggguggaucacuugaggccaggaguuugagaccaacc

SEQ ID NO: 74428 - RNA, 64 nt, hsa
aaucccaguacuuuaggacauggaagggggaggaucacuugagaccaggaguugugaggucaac

SEQ ID NO: 74429 - RNA, 64 nt, hsa
caaucaucacaguaauuauugauuuguacaaaaaucacuugacgucauaaccuuaaagugacac

SEQ ID NO: 74430 - RNA, 64 nt, hsa
uccaucaccugugguuccagcugaggugggaggaucacuugagccuaugaggucgaggcuacag

SEQ ID NO: 74431 - RNA, 64 nt, hsa
aaucucagaacuuugggaggcugaggcagguggaucacuugagcucaggagcuugagaccagcc

SEQ ID NO: 74432 - RNA, 64 nt, hsa
agucccagcuacucgggaggcugaagcagaaggaucacuugagucugagaauucgguguuguuu

SEQ ID NO: 74433 - RNA, 64 nt, hsa
uaaucccagcuacagggaggcugaggcaggagaaucacuugaaccugggaggcagagguuucag

SEQ ID NO: 74434 - RNA, 64 nt, hsa
guguccuccgcacagccggucagaacugugugacucacuugaggcaggaccgagagugacaucc

SEQ ID NO: 74435 - RNA, 64 nt, hsa
aaucccagcacuuugggaggcugaggaggguggaucacuugaggccaggaauucgagaccagcc

SEQ ID NO: 74436 - RNA, 51 nt, hsa
cacuagagaagagucugugagucacuugaggaggcgagucuagcagauucu

SEQ ID NO: 74437 - RNA, 64 nt, hsa
aaucccagcuauucggaaggcugaggcaggagaaucacuugaacccaggaggcggagguugcgg

SEQ ID NO: 74438 - RNA, 64 nt, hsa
cgcguugcccgucccugcguggugcugucccaugucacuugaacugauagaggggccugugcaa

SEQ ID NO: 74439 - RNA, 64 nt, hsa
aaucccagcuacucgggaggcugaggcacgagaaucacuugaacccaggaggcggagguugcag

SEQ ID NO: 74440 - RNA, 64 nt, hsa
aaucuuagcuacucaggaggcuaaggcaggagaaucacuugaaccugggacacggagguugcag

SEQ ID NO: 74441 - RNA, 64 nt, hsa
gggucuuaggaaggaggugacagcacuugcauggucacuugagcccacacacacgcucaacccc

SEQ ID NO: 74442 - RNA, 64 nt, hsa
aaucccagcacuuugggaggcugagacaggcagaucacuugaggucaggaguucgaagucagcc

SEQ ID NO: 74443 - RNA, 64 nt, hsa
aaucccaguacuuugggaggccgaggcgggcagaucacuugaggucaggaguucaagaccagcc

SEQ ID NO: 74444 - RNA, 64 nt, hsa
aacccuagcacuuugggaggcugaggcgggcagaucacuugagguuaggaguuugagaacuggc

SEQ ID NO: 74445 - RNA, 64 nt, hsa
uaauccuacacuuugggaggccaaggugggcggaucacuugagcucaggaguuuaagaccagcc

SEQ ID NO: 74446 - RNA, 64 nt, hsa
aaucccaguuacucgggaggcugaggcaggagaaucacuugaacccgggaggcagagguugcgg

SEQ ID NO: 74447 - RNA, 64 nt, hsa
aaucccagcacuuugggaggccgaaguggguggaucacuugaggccaggaguuugagaccagcc

SEQ ID NO: 74448 - RNA, 64 nt, hsa
guacaccaucaacaggaauguaucauuuugucaucaauggcagcauuccagaggaucaugaaga

SEQ ID NO: 74449 - RNA, 64 nt, hsa
auggaguuucacucuuguugcccaggcuggagugcaauggcacaaucucggcucacugcaaccu

SEQ ID NO: 74450 - RNA, 64 nt, hsa
gcuuugacaucgaguacaaaaauaaucaaagaagcaauggcaaaggguaauguauagagugcuu

SEQ ID NO: 74451 - RNA, 64 nt, hsa
uuacaccugcagggagaaacucuggaaaccuugacaauggcaacagugugucucuucagcgcac

SEQ ID NO: 74452 - RNA, 64 nt, hsa
gaccaaugacagagccugaaaaugcccugucagccaauggcagcucuucucggacuccccuggg

SEQ ID NO: 74453 - RNA, 64 nt, hsa
acagccaacggcuaugacaaaaccacucccuggccaauggcaucacucuucaggcuggggugug

SEQ ID NO: 74454 - RNA, 64 nt, hsa
gacagggucuugcucugucacccaggcuggggcgcaauggcacgaucuuggcucacugcaaccu

SEQ ID NO: 74455 - RNA, 64 nt, hsa
gaaaucccuuggccuccagagauuaaacauggugcaauggcaccucuguccaaccuccuuucug

SEQ ID NO: 74456 - RNA, 64 nt, hsa
cacagagucuugcucuguugcccaggcuggagugcaauggcaugaucucggcucaccgcaaccu

SEQ ID NO: 74457 - RNA, 64 nt, hsa
agucccuucuuccaagugguuuuuccaaaucgcacaauggcaaagccaaacagaggaagaaaca

SEQ ID NO: 74458 - RNA, 64 nt, hsa
cggaguuucgcucuuguugcccaggcugggagggcaauggcaccgucuuggcucacugcaaccu

SEQ ID NO: 74459 - RNA, 64 nt, hsa
uaauagauaccaaauuagggaaguuuggcaauuucaauggcauauuuuuagucaagguacacag

SEQ ID NO: 74460 - RNA, 64 nt, hsa
uuuucuuaaauccaaguuggccguuuuauuaguauguuucaaauguguauuaccaaugugggug

SEQ ID NO: 74461 - RNA, 64 nt, hsa
cacaauuuuuggaauaugucauaauuuuuuucccuguuucaaauguguucagaggaaauagaau

SEQ ID NO: 74462 - RNA, 64 nt, hsa
uuugauaaauauccucucaguguuuuaucuuccauguuucaacaacuauugaaauaugaaaugc

SEQ ID NO: 74463 - RNA, 64 nt, hsa
ucuuuaggcagccuucugaggagaaaagcaacccuguuucaaauccacugccaauucagcuccu

SEQ ID NO: 74464 - RNA, 64 nt, hsa
aucccauucaggcuacaagugacgacaaagauucuguuucaaauauagccacagaaauaaagga

SEQ ID NO: 74465 - RNA, 64 nt, hsa
aucccauucaggcuacaagugacgagaaagauucuguuucaaauauagccacagaaauaaagaa

SEQ ID NO: 74466 - RNA, 64 nt, hsa
agucaguucugugaucugggucucuaaucugugcuguuucaaaguucucuguggcaaagcagca

SEQ ID NO: 74467 - RNA, 64 nt, hsa
agaacugaacugagguucauggauuuuccaggacuguuucaaacaugcccauuacuaacggcaa

SEQ ID NO: 74468 - RNA, 64 nt, hsa
acaacaggccagugcagacuuugcuuccuccuuuuguuucaaaggaccuuaucuacccauuaac

SEQ ID NO: 74469 - RNA, 64 nt, hsa
guuagagacaccucagucgggccacaacugucucuguuucaacuuuaagcccacacacucugua

SEQ ID NO: 74470 - RNA, 64 nt, hsa
gcccucauuaacaagaauaacauuuaaaggagauuguuucaaaauauuuuugcaaauugagaua

SEQ ID NO: 74471 - RNA, 64 nt, hsa
uuauaauuaaauguaaaauugaaaauucauuugcuguuucaaagugugauaucuuucacaauag

SEQ ID NO: 74472 - RNA, 64 nt, hsa
ccuaacagcauauugcucuuauaacugguagagcuguuucaaaggaaguugguuucugguccaa

SEQ ID NO: 74473 - RNA, 64 nt, hsa
uuauagaguauugaugucauuuauguuucugagguguuucaacacaauuuuggaucagcugccu

SEQ ID NO: 74474 - RNA, 64 nt, hsa
cuccgucaacauguccucauacugaagacaaacuuguuucaaugauagucuucauuuuuaaaaa

SEQ ID NO: 74475 - RNA, 64 nt, hsa
gagagugggcuugcaagaacacaaucuaaaaguguguuucaauugaguaucucucuaguagaau

SEQ ID NO: 74476 - RNA, 64 nt, hsa
aaugaaugcagagggagcuuggucaaacugcuuuuguuucaacugcaggcaggggagcaaaagg

SEQ ID NO: 74477 - RNA, 64 nt, hsa
uuccuacucauagccaaccaauaaauucaguaucuguuucaaauauuuuagaaguguaguuugu

SEQ ID NO: 74478 - RNA, 64 nt, hsa
guauuauuugccuucauaauagaacccaagagucuguuucaauuuaugaauucaguauuugcac

SEQ ID NO: 74479 - RNA, 64 nt, hsa
aacaaaauuuaguauucaagcugagugagaauacuguuucaaugagcaugucccuaagauaaac

SEQ ID NO: 74480 - RNA, 64 nt, hsa
ccaugguuuagauugcaaguguacuuuauaccauuguuucaacuucaaccuuuauuuuuguaua

SEQ ID NO: 74481 - RNA, 64 nt, hsa
agaaguuacuagcacugacacacugauuuugaaauguuucaaaaugaguagauaugauuagauc

SEQ ID NO: 74482 - RNA, 64 nt, hsa
cuggcuaauagggagacccuucgcaggcacccacuguuucaacuugacccucccacccccugcu

SEQ ID NO: 74483 - RNA, 64 nt, hsa
cucaccuucccucuuuuuuaaagucacauuuccauguuucaacauuaguuugcauucaccuuua

SEQ ID NO: 74484 - RNA, 64 nt, hsa
acccagccugcuucuuguccagcauugauccuucuguuucaacaacuccuccacugggcagagc

SEQ ID NO: 74485 - RNA, 64 nt, hsa
aaguggcuuuuggggccccagguugagcucuggauguuucaagccaaggcucggcuauucccgc

SEQ ID NO: 74486 - RNA, 64 nt, hsa
ccauugggcccucgucugccucuccaggauuguauguuucaagccuuguccuguguuccuuugu

SEQ ID NO: 74487 - RNA, 64 nt, hsa
augaguggcggcauguugguagugccggacuuccuguuucaaguuuucuggggccucgcuaauu

SEQ ID NO: 74488 - RNA, 64 nt, hsa
ccuauuaccuuucugaggcuggcuuuccagcaauuguuucaaaggaaaauagauccccuuaaag

SEQ ID NO: 74489 - RNA, 64 nt, hsa
uauaauugaauggauauuccuauggaaaauuuuuuguuucaaaauacaggaaaaacauuccuau

SEQ ID NO: 74490 - RNA, 64 nt, hsa
aggaaaaaaaaaucucacaaguucuuuuggaacuuguuucaagccaaaaacucucaagaaagca

SEQ ID NO: 74491 - RNA, 64 nt, hsa
ugcuagcauguacuguaugggaggaugauccagauguuucaaagagaauuucucuuaguuuagu

SEQ ID NO: 74492 - RNA, 64 nt, hsa
uaucuuugauuauucuuuuaauuuuuauuugagcuguuucaauagcauaaugaaauaaaauuuu

SEQ ID NO: 74493 - RNA, 64 nt, hsa
gucauuccacuugugaaagaaaacacaaugugcauguuucaaugauacugugcggaaacacacc

SEQ ID NO: 74494 - RNA, 64 nt, hsa
uucaguucauagcguagacugcuaaauacuguaauguuucaaaacauccaacuguuuguuauaa

SEQ ID NO: 74495 - RNA, 64 nt, hsa
aaaucuaaaaauaguuaagcacugugucaaagaguguuucaaaagaauuguuuguuuucucauu

SEQ ID NO: 74496 - RNA, 64 nt, hsa
uauucucauugugagaauuuuaauacuaauggaauguuucaaagguuuuauucaaaccacaaau

SEQ ID NO: 74497 - RNA, 64 nt, hsa
acuucugacuauauuaacaauauacaaugaaauuuguuucaagugaacuacaacuugucuuccu

SEQ ID NO: 74498 - RNA, 64 nt, hsa
uuaaagauuuuuaaaaguuuaucuuuucacuuaguguuucaaacauauuaggcaaaauuuaacu

SEQ ID NO: 74499 - RNA, 64 nt, hsa
ugaacaaacaaugaaaacucuuugcugcugcccauguuucaaauacuuagagcagugaagacua

SEQ ID NO: 74500 - RNA, 61 nt, hsa
agaaagaguacuucaucuagaucagccuuuuuguuucaaugagguguccaacuggcccuau

SEQ ID NO: 74501 - RNA, 64 nt, hsa
cuuuuuuaaacuaagaucuguuaaaaaagaaaucuguuucaacagaugaccguguacaauaccg

SEQ ID NO: 74502 - RNA, 64 nt, hsa
caaaccacugugaacauuuuuuauuugagaauuuuguuucaaagggauugcuuuuuccucucau

SEQ ID NO: 74503 - RNA, 64 nt, hsa
agggaccuaggugcaagugcaaaggaaauuucccuguuucaaaaucuauuuaacugcaauugag

SEQ ID NO: 74504 - RNA, 64 nt, hsa
gguguccuuaagauaaugaguuaugagaucuuguuguuucaaaguauguggcacucgcccccca

SEQ ID NO: 74505 - RNA, 64 nt, hsa
uccucucacuuggccuugcagcuaaauggagaaauguuucaauuucuuugaauacuugcacauu

SEQ ID NO: 74506 - RNA, 64 nt, hsa
aauaacugccuaggauacugaugguugugaagacuguuucaaaugauuggaucuuugaaagcuu

SEQ ID NO: 74507 - RNA, 64 nt, hsa
uguguguguaugagagagagaguguguguuuguguguuucaaggucagaacagguuuuuuuguu

SEQ ID NO: 74508 - RNA, 64 nt, hsa
uaaacugaauaguucaggagacuuuacaaaccuuuguuucaacuuucuuaucuggaaauaauau

SEQ ID NO: 74509 - RNA, 64 nt, hsa
augacauaaccaauuuguaaugauuuuggaacuguguuucaaauggacuguuacagacugaaag

SEQ ID NO: 74510 - RNA, 64 nt, hsa
ugguuugaccuuuagagaguugcuuuacguggccuguuucaacacagacccacccagagcccuc

SEQ ID NO: 74511 - RNA, 64 nt, hsa
aaaaaccuggaugucacuggccacugaggagcuuuguuucaaccaagucaugugcauuuccacg

SEQ ID NO: 74512 - RNA, 64 nt, hsa
aaugugguugaagaaagugggccaggugguugaagaaagccaugugggagcucagcaaauccca

SEQ ID NO: 74513 - RNA, 64 nt, hsa
aggcuggugggcuuucaaauugguacuuccagaggaaagccaagcugcuucuguugugagcgaa

SEQ ID NO: 74514 - RNA, 64 nt, hsa
acacgaaagccacagaguugaaagccacagaguugaaagccacagaguuaagugaccucaggua

SEQ ID NO: 74515 - RNA, 64 nt, hsa
cuauaccgccaucuuacacgaaagccacagaguugaaagccacagaguugaaagccacagaguu

SEQ ID NO: 74516 - RNA, 64 nt, hsa
uugguguccauggcccuauaccgccaucuuacacgaaagccacagaguugaaagccacagaguu

SEQ ID NO: 74517 - RNA, 64 nt, hsa
uucacauuuuauuuggagauauuuaaaugaaauagaaagccauauaacauagcuauaauuacua

SEQ ID NO: 74518 - RNA, 64 nt, hsa
ccaagacguuugaggccaguaggaaguugagaaagaaagccacaaggauucagcaauuuaagca

SEQ ID NO: 74519 - RNA, 64 nt, hsa
acuaagucagaggucuggucccucauguuuaggugaaagccagagaaugacagcuguagucaua

SEQ ID NO: 74520 - RNA, 64 nt, hsa
augauucaucuucaguaauuuuuagaagcaagaagaaagccauuguguccucuacaauuaacaa

SEQ ID NO: 74521 - RNA, 64 nt, hsa
caagggaggaagccaggggcgaggcaggccgcgggaaagccagggccccugccugcagguuaga

SEQ ID NO: 74522 - RNA, 64 nt, hsa
ugugggggaugaagcccaggcagggaauggccuugaaagccauuggagcuccaauucgugaccc

SEQ ID NO: 74523 - RNA, 64 nt, hsa
aagagcaaaagaauggcagaaaaguuuagccccugaaagccauggagauucucauaacuugaga

SEQ ID NO: 74524 - RNA, 64 nt, hsa
aaaggccuccuggcugucugaggcuagguggguugaaagccaaggagucacugagaccaaggcu

SEQ ID NO: 74525 - RNA, 64 nt, hsa
gaggacgaauagaguuuaauuacucauugcgucggaaagccaagccauuucugucuccagaguu

SEQ ID NO: 74526 - RNA, 64 nt, hsa
cucuucgggagacauguugagauuugaccguaaugaaagccacauuuuccugaauuaugauggu

SEQ ID NO: 74527 - RNA, 64 nt, hsa
uacccuuuggaaacccuggggugaccaagguuuggaaagccaccugagaccacuucauagcaag

SEQ ID NO: 74528 - RNA, 64 nt, hsa
gucuccacggagcccucgggaccugcugcaccaggaaagccacuccaccaguagugcugguugc

SEQ ID NO: 74529 - RNA, 64 nt, hsa
auaaagcuugggguuuuuuuuuuuccuuuguuaagaaagccaaccaaucacaaugauauaguca

SEQ ID NO: 74530 - RNA, 64 nt, hsa
uauagaauuucaggguuaggguuuaaagaaaggagaaagccauuggaaaaaugaugggcuccau

SEQ ID NO: 74531 - RNA, 64 nt, hsa
aucuuuuuauuucugauaguuuuauauuauaauagaaagccagccacugcuuagcuaucauagu

SEQ ID NO: 74532 - RNA, 64 nt, hsa
gagaaucaaagauggauuaaacucagugguugaugaaagccaaaaccuguuuguacuguucuau

SEQ ID NO: 74533 - RNA, 64 nt, hsa
aggacuuucugccaacuuuucuuguaugccuugggaaagccaguugcccugaacccagcagaca

SEQ ID NO: 74534 - RNA, 54 nt, hsa
aggaauggguguguuuguaggagagaaagccaggagguaagagccagcugauau

SEQ ID NO: 74535 - RNA, 64 nt, hsa
caggugacuuccaaagaaugagucagguggcacugaaagccauggguucugaagaggcgaauuu

SEQ ID NO: 74536 - RNA, 64 nt, hsa
ucugaaggccauuacaguggccuggauaugugcugaaagccaaacuuuuaaauuuuuugguuuu

SEQ ID NO: 74537 - RNA, 64 nt, hsa
cagcccggcuggccgccgccgcuccuccccccaggaaagccaagguggaggcugagguggcugc

SEQ ID NO: 74538 - RNA, 64 nt, hsa
gcuagggguccugaaccaggcuacuucgaaccaggaaagccagauuccagccugagugcuggcc

SEQ ID NO: 74539 - RNA, 64 nt, hsa
uccaagaugaacuugaagauuacauaaaagugcagaaagccagaggacuagagccaaaaacuug

SEQ ID NO: 74540 - RNA, 64 nt, hsa
gaccuaccaacgaccauaccauauuucaccaguggaaagccaguuaccucaguggcuaccaacc

SEQ ID NO: 74541 - RNA, 64 nt, hsa
uccaagaugaacuugaagauuacaucaaaguacagaaagccagaggacuagauccaaagacuug

SEQ ID NO: 74542 - RNA, 64 nt, hsa
accaaaaugagugugcagauuacaucaaugugcagaaagccagaggacuagaggccaagacuug

SEQ ID NO: 74543 - RNA, 64 nt, hsa
agaagaaauagaacagcugaagucucaaaucauugucuggaauuuuccucaccuuggcuagcuc

SEQ ID NO: 74544 - RNA, 64 nt, hsa
ccauucccaccccuuugcuuugccauuugcaagagucuggaauugucaggucucagcuucgaaa

SEQ ID NO: 74545 - RNA, 64 nt, hsa
aagccuuuuaauacuaaguaugaaacaaccuauggucuggaaauuuguaucgcaaagcuauaug

SEQ ID NO: 74546 - RNA, 64 nt, hsa
uaauuugguauugcacaggugauuagucaaggaagucuggaaaagcuuuggucccacagccuug

SEQ ID NO: 74547 - RNA, 64 nt, hsa
acuaaccgagugcugaauagcaaugggcuucagugucuggaauggcuuucugcaacucuuuuug

SEQ ID NO: 74548 - RNA, 64 nt, hsa
aaccugcucaucguucagcuuccaaaauucugaagucuggaaguuuuuccuucaagaaaagaaa

SEQ ID NO: 74549 - RNA, 64 nt, hsa
agggguucucuguguucugccccuguaauucuaggucuggaaccuuuauuuguucuagggcagc

SEQ ID NO: 74550 - RNA, 64 nt, hsa
gucugugaccuggucuucccaucccugcauuccugucuggaaccagugaaugcauuagaaccuu

SEQ ID NO: 74551 - RNA, 64 nt, hsa
agggacucuugacagccaccgcuuucacacccuggucuggaauaaggaaacaucggagggagaa

SEQ ID NO: 74552 - RNA, 64 nt, hsa
gccgagauugcagccucugcccggccgccaccccgucuggaaagugaggagcgccucugcccgg

SEQ ID NO: 74553 - RNA, 64 nt, hsa
uucccccaggaugggcuucgagaaagacaaacuugucuggaaaccagaguugcugauuccaccc

SEQ ID NO: 74554 - RNA, 64 nt, hsa
cacaagcgccagggccagggcuuagcagggccuggucuggaagucgacaauguuacaaguggaa

SEQ ID NO: 74555 - RNA, 64 nt, hsa
acaggcagggaaauguuaggaggucagccuccagcaggccuagucucaggcucuaaaguacuga

SEQ ID NO: 74556 - RNA, 64 nt, hsa
cuugucaucauggacuccaacaggguuagagggacaggccuaaucaacugaaacuccucggaga

SEQ ID NO: 74557 - RNA, 64 nt, hsa
agcacaguggggacaucucccgucucaacagccccaggccuaugggggcucuggaaggaugggc

SEQ ID NO: 74558 - RNA, 64 nt, hsa
cagccugccucucccgcccacgcccugcugucuccaggccuauagacguuucucuccaaggccc

SEQ ID NO: 74559 - RNA, 64 nt, hsa
cucucugucacaaugccucaaaagacauggaacccaggccuacaaccgucccaacugcuaauuc

SEQ ID NO: 74560 - RNA, 64 nt, hsa
ugucagcccaccugaggcugggaggaagcaggaccaggccuaggaucuccccagcagaugcaaa

SEQ ID NO: 74561 - RNA, 64 nt, hsa; identical to SEQ ID NO: 74543

SEQ ID NO: 74562 - RNA, 64 nt, hsa; identical to SEQ ID NO: 74544

SEQ ID NO: 74563 - RNA, 64 nt, hsa; identical to SEQ ID NO: 74545

SEQ ID NO: 74564 - RNA, 64 nt, hsa; identical to SEQ ID NO: 74546

SEQ ID NO: 74565 - RNA, 64 nt, hsa; identical to SEQ ID NO: 74547

SEQ ID NO: 74566 - RNA, 64 nt, hsa; identical to SEQ ID NO: 74548

SEQ ID NO: 74567 - RNA, 64 nt, hsa; identical to SEQ ID NO: 74549

SEQ ID NO: 74568 - RNA, 64 nt, hsa; identical to SEQ ID NO: 74550

SEQ ID NO: 74569 - RNA, 64 nt, hsa; identical to SEQ ID NO: 74551

SEQ ID NO: 74570 - RNA, 64 nt, hsa; identical to SEQ ID NO: 74552

SEQ ID NO: 74571 - RNA, 64 nt, hsa; identical to SEQ ID NO: 74553

SEQ ID NO: 74572 - RNA, 64 nt, hsa; identical to SEQ ID NO: 74554

SEQ ID NO: 74573 - RNA, 64 nt, hsa; identical to SEQ ID NO: 74555

SEQ ID NO: 74574 - RNA, 64 nt, hsa; identical to SEQ ID NO: 74556

SEQ ID NO: 74575 - RNA, 64 nt, hsa; identical to SEQ ID NO: 74557

SEQ ID NO: 74576 - RNA, 64 nt, hsa; identical to SEQ ID NO: 74558

SEQ ID NO: 74577 - RNA, 64 nt, hsa; identical to SEQ ID NO: 74559

SEQ ID NO: 74578 - RNA, 64 nt, hsa; identical to SEQ ID NO: 74560

SEQ ID NO: 74579 - RNA, 64 nt, hsa
agcagauauggaccccucugcacaggccucccgaaguccugaagcugggcggcagugagguguc

SEQ ID NO: 74580 - RNA, 64 nt, hsa
cccucccauccucucacccacuggaccccguaggaguccugaccccagaugcccaagucuuggg

SEQ ID NO: 74581 - RNA, 58 nt, hsa
gcaaagaaguauucagaaaagagaugucccaguucaucguccagugccugaacccuua

SEQ ID NO: 74582 - RNA, 58 nt, hsa
ugcugucuugccagugccggcccccggcccaguucagggacagaauuauaguguuugg

SEQ ID NO: 74583 - RNA, 58 nt, hsa
agggcaugcuguaauuucacacaauuuuccaguucaaaaauggagaauacuucgccua

SEQ ID NO: 74584 - RNA, 58 nt, hsa
aucuuggcucacugcgaccuccaccuccccaguucaagcgauucuccugccucagccu

SEQ ID NO: 74585 - RNA, 58 nt, hsa
gugcuguuucuaucacuauuguaauuugccaguucauuuuucaugcugaaaguaauau

SEQ ID NO: 74586 - RNA, 58 nt, hsa
uauuuccuauaauaggaugcugccuaacccaguucaucucuauguccuguucacugaa

SEQ ID NO: 74587 - RNA, 58 nt, hsa
agagccugugauaguuacuguggagcagccaguucauggggucccccuuggggcccca

SEQ ID NO: 74588 - RNA, 58 nt, hsa
auuaacccaagugaaccaaccaaagucaccaguucagaagugcuaagcuaauaggagu

SEQ ID NO: 74589 - RNA, 58 nt, hsa
agcauggcaugcagcacacacggcugcuccaguucauggccucccaggggugcugggg

SEQ ID NO: 74590 - RNA, 58 nt, hsa
aacugcacccugguccucuccccaguccccaguucacccuccaucccucaccuuccuc

SEQ ID NO: 74591 - RNA, 58 nt, hsa
augggaaggaccuugguugggacucuuuccaguucacuuggggcagagggaauuuaau

SEQ ID NO: 74592 - RNA, 58 nt, hsa
gugcugggcaggacaaagcaucagcuguccaguucaggccucuccucuuucccuggug

SEQ ID NO: 74593 - RNA, 64 nt, hsa
aaccaugcagcaggugcuugaguuucaccuuucuccaguccagcagaauuacauuuugaugacc

SEQ ID NO: 74594 - RNA, 64 nt, hsa
cuuuuuuuaaaaaagaauuugauugacaauauauccaguccaauauaaguaugaaggauucucu

SEQ ID NO: 74595 - RNA, 64 nt, hsa
uuuagaugccuucuuuucccucccuaauuuguagccaguccaaccuuucauuccuuggaggauu

SEQ ID NO: 74596 - RNA, 64 nt, hsa
caccgaagcguugaccugaacauauuagugcaauccaguccagauuggaccuuugauccuaugu

SEQ ID NO: 74597 - RNA, 64 nt, hsa
uagaaauauuaguguuacggaagugccuaauaucccaguccaaauuuuuuuuuuuuuuuuuuuu

SEQ ID NO: 74598 - RNA, 64 nt, hsa
cugggauuacaggugugagccaccacgccuggccccaguccaaaauauuuaaagauuguuuccu

SEQ ID NO: 74599 - RNA, 64 nt, hsa
cugguugucucuucugcaaagaaugcauucucccccaguccacccagaacacacagccuccauc

SEQ ID NO: 74600 - RNA, 64 nt, hsa
ucucuggcacugucaaaagcagccaacccaccccccaguccacauggucaccacugcugcuacc

SEQ ID NO: 74601 - RNA, 64 nt, hsa
cacagcuggggcgggcccuguggcugggcggcagccaguccagcucuugcuuccucuggcccgu

SEQ ID NO: 74602 - RNA, 64 nt, hsa
ccugcagcaccccggcuuucccgggucuccagccccaguccagaguugggcaccacaccggcca

SEQ ID NO: 74603 - RNA, 64 nt, hsa
gucccugacuuggggcacuuccacccugacccagccaguccagcucugccuugccggcucucca

SEQ ID NO: 74604 - RNA, 64 nt, hsa
augggggcugcuggcagaccccgagggugccuggccaguccacuccacucugggcugggcugug

SEQ ID NO: 74605 - RNA, 64 nt, hsa
acccggaacuugggccaaucagccucaccuugucccaguccacuccuaacacuagcaucagucc

SEQ ID NO: 74606 - RNA, 64 nt, hsa
ucaaggccaaaguccugagcccccuccgcuggucccaguccagcucuuaucaacuccccaaagg

SEQ ID NO: 74607 - RNA, 64 nt, hsa; identical to SEQ ID NO: 72674

SEQ ID NO: 74608 - RNA, 64 nt, hsa; identical to SEQ ID NO: 72675

SEQ ID NO: 74609 - RNA, 64 nt, hsa; identical to SEQ ID NO: 72676

SEQ ID NO: 74610 - RNA, 64 nt, hsa; identical to SEQ ID NO: 72677

SEQ ID NO: 74611 - RNA, 64 nt, hsa; identical to SEQ ID NO: 72678

SEQ ID NO: 74612 - RNA, 64 nt, hsa; identical to SEQ ID NO: 72679

SEQ ID NO: 74613 - RNA, 64 nt, hsa; identical to SEQ ID NO: 72680

SEQ ID NO: 74614 - RNA, 64 nt, hsa; identical to SEQ ID NO: 72681

SEQ ID NO: 74615 - RNA, 64 nt, hsa; identical to SEQ ID NO: 72682

SEQ ID NO: 74616 - RNA, 64 nt, hsa; identical to SEQ ID NO: 72683

SEQ ID NO: 74617 - RNA, 64 nt, hsa; identical to SEQ ID NO: 72684

SEQ ID NO: 74618 - RNA, 64 nt, hsa; identical to SEQ ID NO: 72685

SEQ ID NO: 74619 - RNA, 64 nt, hsa; identical to SEQ ID NO: 72686

SEQ ID NO: 74620 - RNA, 64 nt, hsa; identical to SEQ ID NO: 72687

SEQ ID NO: 74621 - RNA, 64 nt, hsa; identical to SEQ ID NO: 72688

SEQ ID NO: 74622 - RNA, 64 nt, hsa; identical to SEQ ID NO: 72689

SEQ ID NO: 74623 - RNA, 64 nt, hsa; identical to SEQ ID NO: 72690

SEQ ID NO: 74624 - RNA, 64 nt, hsa; identical to SEQ ID NO: 72691

SEQ ID NO: 74625 - RNA, 64 nt, hsa; identical to SEQ ID NO: 72692

SEQ ID NO: 74626 - RNA, 64 nt, hsa; identical to SEQ ID NO: 72693

SEQ ID NO: 74627 - RNA, 64 nt, hsa; identical to SEQ ID NO: 72694

SEQ ID NO: 74628 - RNA, 64 nt, hsa; identical to SEQ ID NO: 72695

SEQ ID NO: 74629 - RNA, 64 nt, hsa; identical to SEQ ID NO: 72696

SEQ ID NO: 74630 - RNA, 64 nt, hsa; identical to SEQ ID NO: 72697

SEQ ID NO: 74631 - RNA, 64 nt, hsa; identical to SEQ ID NO: 72698

SEQ ID NO: 74632 - RNA, 64 nt, hsa; identical to SEQ ID NO: 72699

SEQ ID NO: 74633 - RNA, 64 nt, hsa; identical to SEQ ID NO: 72700

SEQ ID NO: 74634 - RNA, 64 nt, hsa; identical to SEQ ID NO: 72701

SEQ ID NO: 74635 - RNA, 64 nt, hsa; identical to SEQ ID NO: 72702

SEQ ID NO: 74636 - RNA, 64 nt, hsa; identical to SEQ ID NO: 72703

SEQ ID NO: 74637 - RNA, 64 nt, hsa; identical to SEQ ID NO: 72704

SEQ ID NO: 74638 - RNA, 64 nt, hsa; identical to SEQ ID NO: 72705

SEQ ID NO: 74639 - RNA, 64 nt, hsa; identical to SEQ ID NO: 72706

SEQ ID NO: 74640 - RNA, 64 nt, hsa; identical to SEQ ID NO: 72707

SEQ ID NO: 74641 - RNA, 64 nt, hsa; identical to SEQ ID NO: 72708

SEQ ID NO: 74642 - RNA, 64 nt, hsa; identical to SEQ ID NO: 72709

SEQ ID NO: 74643 - RNA, 64 nt, hsa; identical to SEQ ID NO: 72710

SEQ ID NO: 74644 - RNA, 64 nt, hsa; identical to SEQ ID NO: 72711

SEQ ID NO: 74645 - RNA, 64 nt, hsa; identical to SEQ ID NO: 72712

SEQ ID NO: 74646 - RNA, 64 nt, hsa; identical to SEQ ID NO: 72713

SEQ ID NO: 74647 - RNA, 64 nt, hsa; identical to SEQ ID NO: 72714

SEQ ID NO: 74648 - RNA, 64 nt, hsa; identical to SEQ ID NO: 72715

SEQ ID NO: 74649 - RNA, 64 nt, hsa; identical to SEQ ID NO: 72716

SEQ ID NO: 74650 - RNA, 64 nt, hsa; identical to SEQ ID NO: 72717

SEQ ID NO: 74651 - RNA, 64 nt, hsa; identical to SEQ ID NO: 72718

SEQ ID NO: 74652 - RNA, 64 nt, hsa; identical to SEQ ID NO: 72719

SEQ ID NO: 74653 - RNA, 64 nt, hsa
acagaugguauuuugggcagaaagcucuuagacaauggacuauccaaagcacuauuuaaauucu

SEQ ID NO: 74654 - RNA, 64 nt, hsa
agaugauucuguacccuaguauaucuuuuugggcauggacuaauuuguaucuguuuaacucaua

SEQ ID NO: 74655 - RNA, 64 nt, hsa
ugagugaugcuggauaagguauuguauuucaacaauggacuaugccuugguuuuucacuaauca

SEQ ID NO: 74656 - RNA, 64 nt, hsa
cccagucucagauauucuguuacagaaacacaaaauggacuaagacaccacccuuuuccaaaau

SEQ ID NO: 74657 - RNA, 64 nt, hsa
auaaaaauauauaagagggacuuuaugggauaguauggacuauggaaaaacaaauuugcacaau

SEQ ID NO: 74658 - RNA, 64 nt, hsa
ggaaugagagguggggaggggagauuguugagagauggacuaggaaguggaagcaggcuggaaa

SEQ ID NO: 74659 - RNA, 64 nt, hsa
caauuuuuucuggcaacuguaaauggaaaaauauauggacuaaacguagcccugugcuguauca

SEQ ID NO: 74660 - RNA, 64 nt, hsa
cagcugguuccagcccuggccaagguucuccuauauggacuaggagaaauauuuccuauugaga

SEQ ID NO: 74661 - RNA, 64 nt, hsa
ccuguuucauaugaaggucguuucugagaauuaaauggacuaauguaugcaaaaagccuggcaa

SEQ ID NO: 74662 - RNA, 64 nt, hsa
caugcugcaaucacuguccugggcuuauggugcuauggacuagggguccuuugugaaagagcaa

SEQ ID NO: 74663 - RNA, 64 nt, hsa
ucuugcucugaguuaugugacaugccucagccccauggacuaagcaggggucugguauaaaaac

SEQ ID NO: 74664 - RNA, 64 nt, hsa
ggacccuccugucagugugcaaagcuguaaucucauggacuagaggagagggggccaaggggau

SEQ ID NO: 74665 - RNA, 64 nt, hsa
gauucugcuuugaauauagcuacagaaauaaaggauggacuacagugugggacagguaauuuug

SEQ ID NO: 74666 - RNA, 64 nt, hsa
ugccaaucacgaguacaguacaagcagccagcauauggacuacaaagacacauucgacaugcug

SEQ ID NO: 74667 - RNA, 64 nt, hsa
cucuguggaucacagaguguaacaauggaccuaaauggacuauaguauauuggauguuaaaucc

SEQ ID NO: 74668 - RNA, 64 nt, hsa
cucuugaguuugucgcucaugugugcaacaggguauggacuaucugucugguggccccguuucu

SEQ ID NO: 74669 - RNA, 64 nt, hsa
gucaccaguugcuuuuucagucaauuuggccgggauggacuaaugaggcucuaacacugcucag

SEQ ID NO: 74670 - RNA, 64 nt, hsa
gcauuuuggcuccggggcauccuggauuuagaacauggacuacacacaauacagugguauaaac

SEQ ID NO: 74671 - RNA, 64 nt, hsa
uacuuugaaauuaucacccauauaaaagagggacauggacuauaacguugauuucuuauugcug

SEQ ID NO: 74672 - RNA, 64 nt, hsa
aaucugaacugcuaauguggcugcuuuguagggaauggacuaauaucaguguguuagaucuuaa

SEQ ID NO: 74673 - RNA, 64 nt, hsa
aaaguggaauuagaaagcuggagugcuucuucagauggacuaaauuuaugucgugugugugugu

SEQ ID NO: 74674 - RNA, 64 nt, hsa
caugugccauucuauacugucauuccaaauucucauggacuauugccuguugugaaaauguuug

SEQ ID NO: 74675 - RNA, 64 nt, hsa
uuucuuguuaggaguuuauccugccagcccauaaauggacuauuuauuguaaguguagaaaauc

SEQ ID NO: 74676 - RNA, 64 nt, hsa
ugaauagauaaaccaaaucugguauauccauacaauggacuauauuauucagccauaaaaagaa

SEQ ID NO: 74677 - RNA, 64 nt, hsa
aacgggacauaguaugugacaaucugcaucgaucauggacuacuaaaugccuuuacauagaagg

SEQ ID NO: 74678 - RNA, 64 nt, hsa
auggacgaaugcugcuucaugcgacuccaugucaauggacuauuuuauucaacucggguauuua

SEQ ID NO: 74679 - RNA, 64 nt, hsa
uguguguguaauuauggccaaaaggacauaggagauggacuaagaugucuuggaccaccuuugu

SEQ ID NO: 74680 - RNA, 64 nt, hsa
gaagaucaucaauggcugcgguagccuaguaggaauggacuauauaauaauauagcaggugcuc

SEQ ID NO: 74681 - RNA, 64 nt, hsa
ugaauucuaacauuaaaucacagcccaaaauuugauggacuaauuauuauuuuaaaauauauga

SEQ ID NO: 74682 - RNA, 64 nt, hsa
ccauaaaauaagcuuuauaaaaaccaauuuccugauggacuauuaaauucaucuuagaauaaau

SEQ ID NO: 74683 - RNA, 64 nt, hsa
ugaagauagcuuaguguaaacacaagccuaggacauggacuagguaaagacaaaguccuugcau

SEQ ID NO: 74684 - RNA, 64 nt, hsa
guauaaaaauugcaguaucuuuaaaaucaguaaaauggacuagcauauuauuuaucuuguucuu

SEQ ID NO: 74685 - RNA, 64 nt, hsa
uaacuccauauuucugugaggucacugaggccuuauggacuaacucugugaggauaggaguuau

SEQ ID NO: 74686 - RNA, 64 nt, hsa
caaagaaacauguuaaaaaaaaaaauuauaagacauggacuaguccucauuagcauguuugcau

SEQ ID NO: 74687 - RNA, 64 nt, hsa
uguguuuuucacauguauuauagaaugcuuuugcauggacuauccucuuguuuuuauuaaaaac

SEQ ID NO: 74688 - RNA, 64 nt, hsa
ugcauggcuuugagaagugccucagcacccugaaauggacuaaggccagcuuucauuaagaauc

SEQ ID NO: 74689 - RNA, 64 nt, hsa
gcagucaucucacuaguuauguucaaaaaaguacauggacuauaucgcacaacaggugcuaguu

SEQ ID NO: 74690 - RNA, 64 nt, hsa
aaaauguauuugaacauugguucuguaaaagauaauggacuaaaaaaguagagaggaguuguag

SEQ ID NO: 74691 - RNA, 64 nt, hsa
auucucaauuucacuucaaauuagagaauccauaauggacuagaauauaaauuacaaacacaua

SEQ ID NO: 74692 - RNA, 64 nt, hsa
aagcauuccccaaagauaacaugcuuuggguggaauggacuacuccaagggaaucuguaaagaa

SEQ ID NO: 74693 - RNA, 64 nt, hsa
aagccuucagggcugcucggagucaccuguuggaauggacuaaaaggacccuugugugggaaca

SEQ ID NO: 74694 - RNA, 64 nt, hsa
uaauagcuugcgaaauauuagcaauuuucccauuauggacuauucucucuaaagcaagagagac

SEQ ID NO: 74695 - RNA, 64 nt, hsa
uaacgggauuuuaaaaauauauacauuuuacaacauggacuagaaaaggaccauuagaucaggg

SEQ ID NO: 74696 - RNA, 64 nt, hsa
uacagaccuaguuacugggaauucauuacuugccauggacuaccuuugcuaagaaaagucugaa

SEQ ID NO: 74697 - RNA, 60 nt, hsa
acuuucaaacagaaguuuaaaaaaaucaaaauggacuaagguagagacaaaacuuuauug

SEQ ID NO: 74698 - RNA, 64 nt, hsa
ggaggaaggugggaagcagaugacugaggaagggauggacuaagcuaauccccuuuugguggug

SEQ ID NO: 74699 - RNA, 64 nt, hsa
gaauuuggccuugguugggcucugccaaagacuaauggacuaaaaugugaaacagccucuugcc

SEQ ID NO: 74700 - RNA, 64 nt, hsa
gccagcucugacccagguccgcccagggacccacauggacuaaaggcaaugccaggagcccuga

SEQ ID NO: 74701 - RNA, 64 nt, hsa
uaaacaggauuauuauuaguguuuuaugcauguaauggacuaugcacacuuuuaauuuugucag

SEQ ID NO: 74702 - RNA, 64 nt, hsa
uguauuuuauuuuaaaauguacaacuaaauuguuauggacuacaggguuauuuuuauggucaua

SEQ ID NO: 74703 - RNA, 64 nt, hsa
gcagacucuuccuccacacagcagacacggaccuauggacuauggauggaugcggacgauggaa

SEQ ID NO: 74704 - RNA, 64 nt, hsa
agcauaaggcauuaaaugacaauaaaaauuccaaauggacuauuuguuccacauuguauuuuug

SEQ ID NO: 74705 - RNA, 64 nt, hsa
uuaauuuaaaugacuucuugcaccaucuugccuaauggacuagauuggacuguaucaacauuga

SEQ ID NO: 74706 - RNA, 64 nt, hsa
aaugucuacugaagcuuaaccgaagaacuaauaaauggacuacaguagcucacguuacagggaa

SEQ ID NO: 74707 - RNA, 64 nt, hsa
acuuuacgguaaucauuaacucuaccccgaaaugauggacuacaaguuauaauguguguuaccu

SEQ ID NO: 74708 - RNA, 64 nt, hsa
caccagccgaaccaaugucaaaauuaauaaagaaauggacuaauggcacagggcucuaucucuc

SEQ ID NO: 74709 - RNA, 64 nt, hsa
augggugcuaauugauaauggaaauaauuuaguaauggacuauacaggauguuaauaaugaagc

SEQ ID NO: 74710 - RNA, 64 nt, hsa
uaugugaaaccuaaaggaagugguucuguugcaaauggacuauaaacagggacauuauauucuu

SEQ ID NO: 74711 - RNA, 64 nt, hsa
ccagucaugggcaguccuuuacagcagcaugagaauggacuaauacacuccucaaauguuuuga

SEQ ID NO: 74712 - RNA, 64 nt, hsa
auuuucuuccuuugaagcuuuaggcagagccauaauggacuaaaacauuuugacuaaguuuuua

SEQ ID NO: 74713 - RNA, 64 nt, hsa
ccggcauauccuggccguaacgauuuuuauaguuauggacuacuugaaaccacuacugagggua

SEQ ID NO: 74714 - RNA, 64 nt, hsa
uucuuuacccauggaauguaauauuuuugcaaagauggacuacuucacaaaugguuauaaaguc

SEQ ID NO: 74715 - RNA, 64 nt, hsa
agaaaccaagaaauuaacaacugaaagcauuuuaauggacuauuuauuaaagugcaaacaaacu

SEQ ID NO: 74716 - RNA, 64 nt, hsa
cauucuaaagcuagaggaaguaugugauauacacauggacuaaggcucaggugacacuauggcu

SEQ ID NO: 74717 - RNA, 64 nt, hsa
cauuguacuuugauaagucuguacauugacguguauggacuaaauccaggguaaaaucaauguu

SEQ ID NO: 74718 - RNA, 64 nt, hsa
cagugauucaaaaucagguauagaguccagaaacauggacuacacauaagguucucuauuuaag

SEQ ID NO: 74719 - RNA, 64 nt, hsa
ucuuuuguagugacauuaaauuuggcuauaaaagauggacuacaugugauacuccuauggacgu

SEQ ID NO: 74720 - RNA, 64 nt, hsa
ggaaugaugcuuccauuggcuuuuucuuguuaccauggacuaggaagaaaacaugguuuccaaa

SEQ ID NO: 74721 - RNA, 64 nt, hsa
gggaagaggaaggaagguggguggggcugguaguauggacuaaggugcugcaggaccuggggcc

SEQ ID NO: 74722 - RNA, 64 nt, hsa
auuuuuucacccuuagaaaagggacuguuuuucuauggacuaaguagaaguuacagagucaugu

SEQ ID NO: 74723 - RNA, 64 nt, hsa
gucugcagugcuguguaaaaugcccuaccuuugcauggacuauucuuucuaaucaagaggcgug

SEQ ID NO: 74724 - RNA, 64 nt, hsa
gauccgggauucaggagcucucaguuucuuagggauggacuauggcccagucccccaucuaagu

SEQ ID NO: 74725 - RNA, 64 nt, hsa
accacaacugacacaggaaaccaacacccaaagcauggacuaaccccaacgcacaggaaaaggu

SEQ ID NO: 74726 - RNA, 64 nt, hsa
cacaugaagaaauuaguccuaacaacacuaugagauggacuauaacuugcccaaauuuuuuuuu

SEQ ID NO: 74727 - RNA, 64 nt, hsa
acgccguccuggcugcgcaggaggggccgcuggcauggacuaagaaauccugacaccaagaagg

SEQ ID NO: 74728 - RNA, 64 nt, hsa
guguuagaaaaccuuaauuuuuuuucccuuuuguauggacuacaaauaaaacuuggggcaauuu

SEQ ID NO: 74729 - RNA, 64 nt, hsa
cacuucuuucuaaauguaucggagaaaaaaucaaauggacuacaagcacguguuugcugugcuu

SEQ ID NO: 74730 - RNA, 64 nt, hsa
cacacuuacauguauguauuuugauagauauuacauggacuaaauuuugucaauuucauguaau

SEQ ID NO: 74731 - RNA, 64 nt, hsa
ucuaaacaaaaccuguuugaaucuugguucugauauggacuaggagagagacugggucaaguaa

SEQ ID NO: 74732 - RNA, 64 nt, hsa
guuaagaguuuuccuucaggcuuuacuuaggagaauggacuaagcugaagguguacuucaccag

SEQ ID NO: 74733 - RNA, 64 nt, hsa
cacgacuagaaccuuaggcauuggggaguuuuagauggacuaauuuuauuaaaggauuguuuuu

SEQ ID NO: 74734 - RNA, 64 nt, hsa
ucuagguucuccagugacagaaagauccugaagcauggacuaacaugcucucuggagcuuagua

SEQ ID NO: 74735 - RNA, 64 nt, hsa
uacugacaaggacaccaaccuagggugcaaacagauggacuaugguucaaggacacuggaauug

SEQ ID NO: 74736 - RNA, 64 nt, hsa
uugucuacugugguccugugcacguuggccucagauggacuacaggagauuacaacguacaagg

SEQ ID NO: 74737 - RNA, 64 nt, hsa
ccagccuaggcccuuaaucuugcuguuauuuuccauggacuaaaggucuggucaucugagcuca

SEQ ID NO: 74738 - RNA, 64 nt, hsa
ccaagucuguaccucaaaugaauucuuuaaggagauggacuaauugacuugcaaagaccuaccu

SEQ ID NO: 74739 - RNA, 64 nt, hsa
uuuaaaucccacaaauugacacuuucuaucuucaauggacuaagauuuuuuuggucaguaaucu

SEQ ID NO: 74740 - RNA, 64 nt, hsa
uggcccuuuaagaguuagcuuuuuaccugcacaaauggacuaaaaaaucuggcacaaaacauug

SEQ ID NO: 74741 - RNA, 64 nt, hsa
uuagaccuuugcuuaugcaaaucagaaaaacagaauggacuaggacucagugugaguaacuuca

SEQ ID NO: 74742 - RNA, 64 nt, hsa
gcugccaccccucuucugcuccuuagacaccugaauggacuaagaugaaaugcacuguauugcu

SEQ ID NO: 74743 - RNA, 64 nt, hsa
aaaugagaacuuuauauauauuacuuaaaauuaaauggacuauuccuugugcauugccuaauuu

SEQ ID NO: 74744 - RNA, 64 nt, hsa
uguucaaaacagggaaagacugaugaaaaguaaaauggacuacuuuuguaacuuaccuguuugu

SEQ ID NO: 74745 - RNA, 64 nt, hsa
uauagauaauugauauaaaagaaucgccaugcccauggacuaagaacgaugcuggcuuucaagc

SEQ ID NO: 74746 - RNA, 64 nt, hsa
acuucauauuuuuccaucauuagacaaauacaaaauggacuaaauaauuuuaagagauagugga

SEQ ID NO: 74747 - RNA, 64 nt, hsa
ugggcaaagccccugggaacgaggccuauccacuauggacuaugguaacuugguaggauuuuua

SEQ ID NO: 74748 - RNA, 64 nt, hsa
ucuuuuuuuuaaguggggaggaaggggaagcuagauggacuaggagagacuugauuuuggugcu

SEQ ID NO: 74749 - RNA, 64 nt, hsa
ugaauauacagagccuugauccagaagccagaggauggacuaagugggagaaauuagaaaacaa

SEQ ID NO: 74750 - RNA, 64 nt, hsa
cuggugauggcaaaugacuggcuuucucuuguggauggacuauaggaagcacuuucugaauuau

SEQ ID NO: 74751 - RNA, 64 nt, hsa
acuucgcugaguuccacuguggauuacaguuuguauggacuacuacuguaaauuauagcuuguu

SEQ ID NO: 74752 - RNA, 64 nt, hsa
acacuguccugggaggcguucagaggguuccaugauggacuagguuuggaaccacuggguuaaa

SEQ ID NO: 74753 - RNA, 64 nt, hsa
uuccagcaaacguacgggaaugugcuuucaauugauggacuacucuauuuuuugcaaauuugua

SEQ ID NO: 74754 - RNA, 64 nt, hsa
agggagggaacucuugacacugagccacuaaaauauggacuaauuuuuuggacaaaucuucaaa

SEQ ID NO: 74755 - RNA, 64 nt, hsa
cuuaccagcagagcaccuuagacagucccugccaauggacuaacuugucuuuggacccugaggc

SEQ ID NO: 74756 - RNA, 64 nt, hsa
uccuuaccucccugguccccguuugucaaagaggauggacuaaaugaucucugaaaguguugaa

SEQ ID NO: 74757 - RNA, 64 nt, hsa
aaggacauuugaugcugguaguauggauuaugagauggacuagccccugccccagcccagcucu

SEQ ID NO: 74758 - RNA, 64 nt, hsa
uguccugaccaucgcacaccggcuuaacacuaucauggacuacaccaggugggacacggaaacc

SEQ ID NO: 74759 - RNA, 64 nt, hsa
gaaauaaugggaaagguugaauuaauuccugggcauggacuaccagaugaccacaaguugcguu

SEQ ID NO: 74760 - RNA, 64 nt, hsa
gagggggaaaaaucacuaacaugaaaggcaaaaaauggacuaugauuccuguggggaaacaauu

SEQ ID NO: 74761 - RNA, 64 nt, hsa
ugaugaccuugaauuuggggaguggggagaguggauggacuagacugugcugugugcuggaaaa

SEQ ID NO: 74762 - RNA, 64 nt, hsa
gaucacaaagcucaaggaauuuaauauucuuguaauggacuagauaauucaaacugauuagccc

SEQ ID NO: 74763 - RNA, 64 nt, hsa
ucguuauuuugcugggucagcuuaucuuuaauauauggacuauuccuauaaaccaaagucucug

SEQ ID NO: 74764 - RNA, 64 nt, hsa
uccuuaggggacggcuuugggggucccacgagacauggacuaggaguuuaagcaggacagugug

SEQ ID NO: 74765 - RNA, 64 nt, hsa
ccacuucugacauuccauuaugugcuauucaaagauggacuauugaacuauagaaaagacagac

SEQ ID NO: 74766 - RNA, 64 nt, hsa
uugcugcuuuacccacgcaucucuugcuuucaagauggacuacaaaaguuccuuauccuuuuga

SEQ ID NO: 74767 - RNA, 64 nt, hsa
caguaauaacuaguuggccaacugacugugguccauggacuacacagugaguagagguucuuua

SEQ ID NO: 74768 - RNA, 64 nt, hsa
uuggcacagaggacucuucugauaacuugaaaaaauggacuaccuuuuucagggaucuuuugga

SEQ ID NO: 74769 - RNA, 64 nt, hsa
uaucuuugaaccgggaagcaggcccuuaccagacauggacuaugccagugccuugauauuggac

SEQ ID NO: 74770 - RNA, 64 nt, hsa
gggcuuaccaguggcccagguaauuuuuuguuucauggacuauggacucuuucaaagggaucug

SEQ ID NO: 74771 - RNA, 64 nt, hsa
aagccauuuuggagacagugagggaaguguggacauggacuaaauauuaaaugauauuuacaua

SEQ ID NO: 74772 - RNA, 64 nt, hsa
agaaagcaauuacuacugcuaaaugugggaaauaauggacuagaccuguacuaauauaugguag

SEQ ID NO: 74773 - RNA, 64 nt, hsa
caaguccccgucugccuggcagguuguuagaaaaauggacuauccauuagagcaacuuucuggg

SEQ ID NO: 74774 - RNA, 64 nt, hsa
uccaauucuuuuaaaauuaauguuuuuguuguaaauggacuauauaaauaccuucguauauaug

SEQ ID NO: 74775 - RNA, 64 nt, hsa
gaagaucagaaggggcuucacgcuucuccuggacauggacuagcuugagccaaggcaguggcac

SEQ ID NO: 74776 - RNA, 64 nt, hsa
aggggauggguuugucuugucuucuuuuuaauuuauggacuagucucauuacuccggaauuaug

SEQ ID NO: 74777 - RNA, 64 nt, hsa
uucuaagcuuaaauauugcauagcuucgagcuguauggacuauauuaugaaagaauauguaaag

SEQ ID NO: 74778 - RNA, 64 nt, hsa
guguuuaagauacuugauuugaaguccuuuucauauggacuaauuguaguaucaauuuccuccu

SEQ ID NO: 74779 - RNA, 64 nt, hsa
uucauucagguuuuuuaaaggauauuuaacuuuuauggacuagaaggaaucacgagggcuacug

SEQ ID NO: 74780 - RNA, 64 nt, hsa
cauuuccucagucucccuuugugguucgaaggauauggacuauugcaauacauuucuuccuuca

SEQ ID NO: 74781 - RNA, 64 nt, hsa
gaagcuucagaaaccgugggaccaguguagaagaauggacuaucuguccaaacuaagaauaaaa

SEQ ID NO: 74782 - RNA, 64 nt, hsa
cugugcuacccaccccuuccauggacugaauaagauggacuaacaggccuguguuuuuguguuu

SEQ ID NO: 74783 - RNA, 64 nt, hsa
aguuugugaguguuuauugguuuucuuaagagaaauggacuauuuugcucucauguguaauguu

SEQ ID NO: 74784 - RNA, 64 nt, hsa
auugguguccugugggagggcgagcugagaacacauggacuagcugagugguagcgguaguugg

SEQ ID NO: 74785 - RNA, 64 nt, hsa
guuguuuugauuuguuuuuggcuaaguagaggacauggacuaguuguagcaaacagaacaugcu

SEQ ID NO: 74786 - RNA, 64 nt, hsa
gcgugugugcuaguuaauagguuuaguagcuuuuauggacuaaaaaugauugauuguaucuuga

SEQ ID NO: 74787 - RNA, 64 nt, hsa
cguguauccagauggacugacaggccgagagcggauggacuacaugaaacgcaagagccgcgag

SEQ ID NO: 74788 - RNA, 64 nt, hsa
aggaagcacaucuguagugcacucccagcaggccauggacuagucacuaaccccacacucaaag

SEQ ID NO: 74789 - RNA, 64 nt, hsa
cacccacagaaagagagcacugaccccgauggcgauggacuacugaagcccuaacucagccaac

SEQ ID NO: 74790 - RNA, 64 nt, hsa
cacuuaauuagaaacgugauaaauauauggacaaauggacuauacauacuauaagaggacugua

SEQ ID NO: 74791 - RNA, 64 nt, hsa
ugcugcacagcagaaauuacaccauccacaggaaauggacuauuuuugcaguccaacaucagcc

SEQ ID NO: 74792 - RNA, 64 nt, hsa
cuccaucccccauggaggaggcaucgcacuuuaccaagcugaugcauuccuacagaagugggcc

SEQ ID NO: 74793 - RNA, 64 nt, hsa
caucgccugcuuucucuccaguggcuggagacuucaagcugacuucauuguuuccaccuuggga

SEQ ID NO: 74794 - RNA, 64 nt, hsa
uaucuuuaauucgcuauccaaaauuaaauuauugcaagcugauucacauauaaagaugcaggua

SEQ ID NO: 74795 - RNA, 64 nt, hsa
ucgccugguuaaagaugcucugcgucaauuaagucaagcugaagcuacugacuucugcaaagua

SEQ ID NO: 74796 - RNA, 64 nt, hsa
aauucagaaccccaacuacuguguuaugcaaaagcaagcugauuaaaugacacucauauaauua

SEQ ID NO: 74797 - RNA, 64 nt, hsa
uauaaagaauugugguuuauauauuuaaaagugucaagcugaguauuaaaauguaugcauguug

SEQ ID NO: 74798 - RNA, 64 nt, hsa
uggggugguugugccagccugccuuuggcagcugcaagcugagguggcagcucugaccaccucu

SEQ ID NO: 74799 - RNA, 64 nt, hsa
uagaggcaagccaggccagggagcugggagcgagcaagcugaggccacguccacaaggagcuuu

SEQ ID NO: 74800 - RNA, 64 nt, hsa
gcacacgggacugguauucuggcuguacuaaugacaagcugagucaagacccuggagggucaua

SEQ ID NO: 74801 - RNA, 64 nt, hsa
ugucauccuucuucaauaaaugcugaaugacauucaagcugauuuucuagaccacugagaaaau

SEQ ID NO: 74802 - RNA, 64 nt, hsa
aaaucaucacuucagcuccugauuggucccaggccaagcugaauagcccuuaggaauaaucacu

SEQ ID NO: 74803 - RNA, 64 nt, hsa
gaauaaucacuucaacuccugauuggucccgggccaagcugaauagcccuuaugaaucaucacu

SEQ ID NO: 74804 - RNA, 64 nt, hsa
gguuccugauuggucccgggccaaggucccagaccaagcugaaucacgcuuucuccaagacagc

SEQ ID NO: 74805 - RNA, 64 nt, hsa
agggcuggggcugggaugggagggugaagaugcccaagcugaagaugccuuccuuugggcuggc

SEQ ID NO: 74806 - RNA, 64 nt, hsa
cuaaggcagaggcugagggggcugggcgagcuaccaagcugaagguauccaaauuugccaucuc

SEQ ID NO: 74807 - RNA, 64 nt, hsa
agccccggcccgcugcuccugaaguuguagagagcaagcugaagcugcccaccaucaagaugcc

SEQ ID NO: 74808 - RNA, 64 nt, hsa
gauagaaucauccauucccaucgccgcacccccuaccccccaaacacacacacacacacacaca

SEQ ID NO: 74809 - RNA, 64 nt, hsa
cucgucuugacuguuuucccuacuugcugacuuaaccccccauagugugggggaccugcagaga

SEQ ID NO: 74810 - RNA, 64 nt, hsa
gcuuccuuuuuaucauaacgcggccucuaauuccaccccccaagugaaacgguuugagagacgc

SEQ ID NO: 74811 - RNA, 64 nt, hsa
acuauccccuuccucauccauguaagguuaacccaccccccagcaagggacuggacgcccucau

SEQ ID NO: 74812 - RNA, 64 nt, hsa
gccugaggcuguggccuccaaagggucugggcgcaccccccaggucgcaggugucugaggccag

SEQ ID NO: 74813 - RNA, 64 nt, hsa
ccccucuccugccagacagcccacgaccgggucgaccccccaggggacgcccaugccaggcccg

SEQ ID NO: 74814 - RNA, 64 nt, hsa
gcuuaggacuuggcccuguuaugagcugacccccaccccccaccccccaccccccccccccgcc

SEQ ID NO: 74815 - RNA, 64 nt, hsa
acuuggcccuguuaugagcugacccccaccccccaccccccaccccccccccccgccaacuccu

SEQ ID NO: 74816 - RNA, 64 nt, hsa
cucaucugugguccaggccggcaucguccuggccaccccccagaucuggugccugcuggccggc

SEQ ID NO: 74817 - RNA, 64 nt, hsa
ugucguccaccccaggacgagccaucagggacagaccccccacccccaaggcugcagccacacc

SEQ ID NO: 74818 - RNA, 64 nt, hsa
ugcucgggguuuuuuauuuauaaaaccucuccccaccccccaccccccaacuuccuggguuuuc

SEQ ID NO: 74819 - RNA, 64 nt, hsa
gguuuuuuauuuauaaaaccucuccccaccccccaccccccaacuuccuggguuuucucauugu

SEQ ID NO: 74820 - RNA, 64 nt, hsa
ggccacgagccaccacugccucccgcugcugcccaccccccacaaaaaggaaaaaaugaaugag

SEQ ID NO: 74821 - RNA, 64 nt, hsa
gaagcccuucuugcuuuugagagaggcugugaccaccccccauccuucucccuacacucccagc

SEQ ID NO: 74822 - RNA, 64 nt, hsa
ggggccuccccugcuaucccuccucccauccuguaccccccauuucuggggccucaucacugug

SEQ ID NO: 74823 - RNA, 64 nt, hsa
cuaggggggagggggguggcacagcagcuuggguaccccccaaccuccaggagcuaguggaggg

SEQ ID NO: 74824 - RNA, 64 nt, hsa
uucaccuuugaccuugccucaccuuucaccccccaccccccacagcgucagcuccuaccucuga

SEQ ID NO: 74825 - RNA, 64 nt, hsa
gcugcaguucaccuuugaccuugccucaccuuucaccccccaccccccacagcgucagcuccua

SEQ ID NO: 74826 - RNA, 64 nt, hsa
gcugcacuucaccgcugaccuugccucaccuuuaaccccccaccugagccccagcuccuaccuc

SEQ ID NO: 74827 - RNA, 64 nt, hsa
uugcuuuuauacauuuuucugcagcuguaggcauaccccccaagucugcuuuuagcuucccuau

SEQ ID NO: 74828 - RNA, 64 nt, hsa
auugauuuaggggcuuuggagaacuuugaaugcuaccccccaaguaaccauuguuggcaaccug

SEQ ID NO: 74829 - RNA, 64 nt, hsa
gaguaucagggauuguggggacaggagugagacaaccccccagguacagcacuggcuuuucuuu

SEQ ID NO: 74830 - RNA, 64 nt, hsa
gucagggacugaagggggaccccaaaacuggcucaccccccagaacacccuccucccagggagg

SEQ ID NO: 74831 - RNA, 64 nt, hsa
uccagccccuccucccucagacccaggaguccagaccccccagccccuccucccucagacccag

SEQ ID NO: 74832 - RNA, 64 nt, hsa
cccagccccuccucccucagacccaggaguccagaccccccagccccuccucccucagacccag

SEQ ID NO: 74833 - RNA, 64 nt, hsa
gggagggguagugcuccacagcuuuuccuuccccaccccccagccuuagaugccucgcucuuuu

SEQ ID NO: 74834 - RNA, 64 nt, hsa
uacuccugcugucuaccucuccucacaccccagcaccccccauuuuuucaaaccuugguaucug

SEQ ID NO: 74835 - RNA, 64 nt, hsa
uuuucaacuuccugcuggaaacuagagguggggcaccccccaccccccagccucgcacuguguc

SEQ ID NO: 74836 - RNA, 64 nt, hsa
cuuccugcuggaaacuagagguggggcaccccccaccccccagccucgcacuguguccuugggg

SEQ ID NO: 74837 - RNA, 64 nt, hsa
aauccacuaagaaggccugucuacacugcaggggaaccucaagaacuuuucauugcacuucuaa

SEQ ID NO: 74838 - RNA, 64 nt, hsa
uugauaucacugacucuugaaaucacuaacagugaaccucaaauuugguuaugauguuaacaga

SEQ ID NO: 74839 - RNA, 64 nt, hsa
cuucaaaaggaagagccuuuuaaaaacauuugccaaccucaagaauaaauacugaaagucuuga

SEQ ID NO: 74840 - RNA, 64 nt, hsa
uguuuuuuuaacgucagccagauauuuagaaaauaaccucaaaaguguuuauauggucagugag

SEQ ID NO: 74841 - RNA, 64 nt, hsa
uucccacuggaaaguaaacaaaaccaucccucccaaccucaaagcuaggccacacucuauuuca

SEQ ID NO: 74842 - RNA, 64 nt, hsa
uucugaaauacacuaagagcagccacaaaacuguaaccucaaggaaaccauaaagcuuggagug

SEQ ID NO: 74843 - RNA, 64 nt, hsa
uccaguacacagucugauaaggacuuaacguccuaaccucaauuguauuaaauagcauugggga

SEQ ID NO: 74844 - RNA, 64 nt, hsa
cucacuggagacucagaaggggaagcauugggaaaccauguauguuucauuucugguuuaacca

SEQ ID NO: 74845 - RNA, 64 nt, hsa
auaacuacuucugaacuccugagaucuaguggauaccauguauccuggaagauaggacacuuuc

SEQ ID NO: 74846 - RNA, 64 nt, hsa
gauauuucucaacacuuaaauucauaaaauuaagaccauguaaggguauguuuuuagagaaaug

SEQ ID NO: 74847 - RNA, 64 nt, hsa
ucuuugcucauucacucaguaauacugagcacuuaccauguaccagaauuuuacuaggcacaac

SEQ ID NO: 74848 - RNA, 64 nt, hsa
uuagaaagaacauuuuaaaacaaucaguuaauuuaccauguaaaauugcuguaaaugauaaugu

SEQ ID NO: 74849 - RNA, 64 nt, hsa
guuauugcuugucagguggacuguuuuggauuuaaccauguaauccaugggaccaauugagagu

SEQ ID NO: 74850 - RNA, 64 nt, hsa
cuuugguuaccagagaaauuuucuuagucauuagaccauguaacaguaauauaucauauguaaa

SEQ ID NO: 74851 - RNA, 64 nt, hsa
uauuaguugauugcuguaacuuuuucauuuucaaaccauguacaauucuuguauagaccaacuu

SEQ ID NO: 74852 - RNA, 64 nt, hsa
ugcaaaguaaggaggacuaagggaaaaugaugguaccauguaacagaaugagagcuaauuccaa

SEQ ID NO: 74853 - RNA, 64 nt, hsa
gucauauaugaauuuaaaccuaguaccauccaaaaccauguaauggauuuuaagaaucuguuag

SEQ ID NO: 74854 - RNA, 64 nt, hsa
uaaagauguauuuuguauaacuuaaauaauaaugcuaaaguauacuaggguuuuuuuuucuuga

SEQ ID NO: 74855 - RNA, 64 nt, hsa
auauauggucuaauaguuuuuuaaagcuuuuggacuaaaguauuccacaaaucuuaccucuuua

SEQ ID NO: 74856 - RNA, 64 nt, hsa
auuaguauguuaagauucugaauauuaugguggccuaaaguaggcuucuugguacaccagauua

SEQ ID NO: 74857 - RNA, 64 nt, hsa
augucaauaaaguuuauuuaggucauagaauauccuaaaguaucacauaguuaaauuuuucagu

SEQ ID NO: 74858 - RNA, 64 nt, hsa
uuuuuggugauaucugccugggaaaucucucuuccuaaaguauuuguauaugggaguccuuguu

SEQ ID NO: 74859 - RNA, 64 nt, hsa
ggccauuuacuuaaggugaaauuuuaagauggagcuaaaguaagaucacugguuuuuagaacca

SEQ ID NO: 74860 - RNA, 64 nt, hsa
uuucuauuuaugcaacucaucuucacagauuguucuaaaguaaaauagaugguguaugcuguau

SEQ ID NO: 74861 - RNA, 64 nt, hsa
ggagacucuuguacuugauccccucccaccaauucuaaaguagcuuucuccagaucagacuuua

SEQ ID NO: 74862 - RNA, 63 nt, hsa
acuuaucaaaaaggcaggaaaguagguaugaucucuaaaguaaaaaaaaaaaaaaaaaaaaaa

SEQ ID NO: 74863 - RNA, 64 nt, hsa
agcugcacucaccaaggaccacaaugcccccggccuaaaguacugccauucagaaaagcagguu

SEQ ID NO: 74864 - RNA, 64 nt, hsa
uucuuugaaaaaaugcauugacucuuuaagacaucuaaaguaucacauuauccauaauuuauug

SEQ ID NO: 74865 - RNA, 64 nt, hsa
aucaaaccagauaauucucuaauucuucuuuaaucuaaaguagauagcuucccacuggaaagua

SEQ ID NO: 74866 - RNA, 64 nt, hsa
gcuuuauuggauucacuuuguguguguuagugcucuaaaguagcaguauuauuauuaaacuguc

SEQ ID NO: 74867 - RNA, 64 nt, hsa
auuauuaaacuguccccagaguaacccuguaggccuaaaguacucaguuuuaagacaaacacua

SEQ ID NO: 74868 - RNA, 64 nt, hsa
uaaauguaaacauguagacugcauucgaggugaccuaaaguagagaggucaugaacuuugagaa

SEQ ID NO: 74869 - RNA, 64 nt, hsa
ucuaauuucaauuauagugucaugcagaguauuucuaaaguaauugguuaucaugggaaaguau

SEQ ID NO: 74870 - RNA, 64 nt, hsa
cauuuuacagagaaagaaauuauggcccagggggcuaaaguaaacaacucaagggcacauagaa

SEQ ID NO: 74871 - RNA, 64 nt, hsa; identical to SEQ ID NO: 58517

SEQ ID NO: 74872 - RNA, 64 nt, hsa; identical to SEQ ID NO: 58518

SEQ ID NO: 74873 - RNA, 64 nt, hsa; identical to SEQ ID NO: 58519

SEQ ID NO: 74874 - RNA, 64 nt, hsa; identical to SEQ ID NO: 58520

SEQ ID NO: 74875 - RNA, 64 nt, hsa; identical to SEQ ID NO: 58521

SEQ ID NO: 74876 - RNA, 64 nt, hsa; identical to SEQ ID NO: 58522

SEQ ID NO: 74877 - RNA, 64 nt, hsa; identical to SEQ ID NO: 58523

SEQ ID NO: 74878 - RNA, 64 nt, hsa; identical to SEQ ID NO: 58524

SEQ ID NO: 74879 - RNA, 64 nt, hsa; identical to SEQ ID NO: 58525

SEQ ID NO: 74880 - RNA, 64 nt, hsa; identical to SEQ ID NO: 58526

SEQ ID NO: 74881 - RNA, 64 nt, hsa; identical to SEQ ID NO: 58527

SEQ ID NO: 74882 - RNA, 64 nt, hsa; identical to SEQ ID NO: 58528

SEQ ID NO: 74883 - RNA, 64 nt, hsa; identical to SEQ ID NO: 58529

SEQ ID NO: 74884 - RNA, 64 nt, hsa; identical to SEQ ID NO: 58530

SEQ ID NO: 74885 - RNA, 64 nt, hsa; identical to SEQ ID NO: 58531

SEQ ID NO: 74886 - RNA, 64 nt, hsa; identical to SEQ ID NO: 58532

SEQ ID NO: 74887 - RNA, 64 nt, hsa
auucuaggggcaugaggguauuuuuuagguucuaagguuuuaucuuguugcaagagugggaccu

SEQ ID NO: 74888 - RNA, 64 nt, hsa
uuccccugguuugucucauucuucuugguugaguagguuuuaacugggguagcacuccugcuag

SEQ ID NO: 74889 - RNA, 64 nt, hsa
gcuuacuuacguacuucaaugccaccgguaacuuagguuuuaccaccaaaugcuguuaacguua

SEQ ID NO: 74890 - RNA, 64 nt, hsa
agcacuacuggauucaacugccaaaauuuuuuaaagguuuuaggacuuacuauaccuuguacug

SEQ ID NO: 74891 - RNA, 64 nt, hsa
cuucauuauaacauuuaugugcuuaagauuucuaagguuuuaaaaaguuaccuuuaauacaauc

SEQ ID NO: 74892 - RNA, 64 nt, hsa
guaaaugauauuauugauacucuuucuaaauaagagguuuuaaaauauauaaaaacuuuaugau

SEQ ID NO: 74893 - RNA, 64 nt, hsa
uaguagagacgggguuucaccacguuggccgggcagguuuuaaacucuugaccucauguuccac

SEQ ID NO: 74894 - RNA, 64 nt, hsa
cagguaguuaauccauuucuaaugaauaauuuuaagguuuuaauccuuuccaaguguacaauaa

SEQ ID NO: 74895 - RNA, 64 nt, hsa
gcugguuggaugugcaggaacuucagcaagcaguagguuuuacuaagcagauggucgggcacug

SEQ ID NO: 74896 - RNA, 64 nt, hsa
uaguaaccauggauaagaugcuuuagaucagacuagguuuuaaucauuaacuuccacaaagaag

SEQ ID NO: 74897 - RNA, 64 nt, hsa
uacaaaauaguucugaaaguggugagauacaaaaagguuuuagaaucacugcccuguugagaga

SEQ ID NO: 74898 - RNA, 64 nt, hsa
uucccauuuuaagaugggggaaaauuaagguuugagguuuuagaaauuagcaaguagugcauac

SEQ ID NO: 74899 - RNA, 64 nt, hsa
uuuuaauuguguaucaagugaaaaagaaacacugagguuuuaagcugcuguauauagcuuguga

SEQ ID NO: 74900 - RNA, 64 nt, hsa
uuuucuauaacaaaacaaguagcucuaggaaaagagguuuuauuuuguaaacgaucauuuguga

SEQ ID NO: 74901 - RNA, 64 nt, hsa
ccaggaccuugagugucauuaguuacuuuauugaagguuuuagacccauagcagcuuugucucu

SEQ ID NO: 74902 - RNA, 64 nt, hsa
aaaagaacaaugacaaacacccacuuauuuuucaagguuuuaaaacagucuacauugagcauuu

SEQ ID NO: 74903 - RNA, 64 nt, hsa
aauagaugcagagguuuuacagcaguuuauuuuaagguuuuauuuauacauaauuacuuugaac

SEQ ID NO: 74904 - RNA, 64 nt, hsa
uuuugaaguuauuuguguugcuaaauagaugcagagguuuuacagcaguuuauuuuaagguuuu

SEQ ID NO: 74905 - RNA, 64 nt, hsa
aacugucacaucuauugaaaauggauauagauacagguuuuaaguauuuuaaguauauauuacu

SEQ ID NO: 74906 - RNA, 64 nt, hsa
uuuaaacaguaaccaaaucuaaauuuaauuauucagguuuuacaaaaguugauacaccuucuua

SEQ ID NO: 74907 - RNA, 64 nt, hsa
cacagauggguccuccaugcuggcaaugcguuacagguuuuaugauaauagaacuaugacaguc

SEQ ID NO: 74908 - RNA, 64 nt, hsa
ggcuggaagaugaagccaugauagcuacagagaaagguuuuagacuccaguuuaccuuucucuu

SEQ ID NO: 74909 - RNA, 64 nt, hsa
ggucugaaacauuacuuggcagccaagaauuuggagguuuuaaaauggugcuaauucuguccuc

SEQ ID NO: 74910 - RNA, 64 nt, hsa
agacuuuaugaacaguuauucuaucaacuuuuaaagguuuuaaaccugcccagaaauuaccuug

SEQ ID NO: 74911 - RNA, 64 nt, hsa
agaaggcuagguucagcaaaauaaguguaucagcagguuuuaucaugaucaguaaaaauguucc

SEQ ID NO: 74912 - RNA, 64 nt, hsa
gugucagccacagcgaaucccaugucuugguuauagguuuuauguuuuguuuugugggucauag

SEQ ID NO: 74913 - RNA, 64 nt, hsa
auugugagaguagcaaguccagggagagcuaaagagguuuuaucuguauuuccuaauuucaaau

SEQ ID NO: 74914 - RNA, 64 nt, hsa
auuauuacuguuuaagugauuauuugcuuaacacagguuuuauuuugucuuuuugcugguagau

SEQ ID NO: 74915 - RNA, 64 nt, hsa
gggaugauaaauuacacuuuuaaguucuugcuggagguuuuaaauagauuuagacaaauguuaa

SEQ ID NO: 74916 - RNA, 64 nt, hsa
aacuaaagaucauaauguugucuuguaauauauuuauuuacaaaacacuucauuauuuauaaag

SEQ ID NO: 74917 - RNA, 64 nt, hsa
cgcaacagaaucucuguggcccacaaggcuaaaauauuuacauucucacccauuacagaaaaag

SEQ ID NO: 74918 - RNA, 64 nt, hsa
auuuaacccagaaccagaguaaagucaccucuacuauuuacacaucauaggcucaagauuguac

SEQ ID NO: 74919 - RNA, 64 nt, hsa
ugcauuuguguaguacuuuauaguuuacaaagcauauuuacaccaauuauuuuauguaauccuc

SEQ ID NO: 74920 - RNA, 64 nt, hsa
acaaguuaccuaccacauuucacuuuaguguaccuauuuacagaaagauuaaacugccaccugc

SEQ ID NO: 74921 - RNA, 64 nt, hsa
uggucuuuucauggcauaugagcaaauaauaaacuauuuacacuacuauucuguaauauguugu

SEQ ID NO: 74922 - RNA, 64 nt, hsa
uuucccacugauaguugauuuuugaggcaucuaauauuuacauauuugccuucugaacuuuguu

SEQ ID NO: 74923 - RNA, 64 nt, hsa
uugccuucugaacuuuguuuugaccuguauccuuuauuuacauuggguuuuucuuucguaguuu

SEQ ID NO: 74924 - RNA, 64 nt, hsa
gggccaaaggcacauuauguauauaauuaguuuauauuuacacacuagcauauaggaaauauuu

SEQ ID NO: 74925 - RNA, 64 nt, hsa
uuauuaaaaauugauagaauuuuagcuccugagauauuuacaacugggagaaaugucuauuuag

SEQ ID NO: 74926 - RNA, 64 nt, hsa
uuuauuucuugccauauuuauaacacagcaagaguauuuacaggaaugaaguagcugacacaua

SEQ ID NO: 74927 - RNA, 64 nt, hsa
uguuguuguuuuaacauguuuaaccaacagaaguuauuuacagaaauucauauauccaggcaac

SEQ ID NO: 74928 - RNA, 64 nt, hsa
cuuuggcugcuagaacucaucuguaguccuuuauuauuuacacugaauuccaauuucauuucug

SEQ ID NO: 74929 - RNA, 64 nt, hsa
agcuacuuuagaaauagaaaaugugaagagugacuauuuacauguauacuccuuuggcugcuag

SEQ ID NO: 74930 - RNA, 64 nt, hsa
aaaaaagaaagaacaugggugguacauugaggaguauuuacauuuuauaaaaugacuuaaaaau

SEQ ID NO: 74931 - RNA, 64 nt, hsa
ugggcuucccagccgcucacgguuuuacagauacuauuuacaggcggaaacuccucggcugcuu

SEQ ID NO: 74932 - RNA, 64 nt, hsa
gaagaaaacauuuuguuuuuauuaaauggagcauuauuuacaaaaagccauuguugagaauuag

SEQ ID NO: 74933 - RNA, 64 nt, hsa
ugauggcuccugcagcacuuuuuccuucugaaaauauuuacauuuugcuaaccuaguuuguuac

SEQ ID NO: 74934 - RNA, 64 nt, hsa
uccacccuuuuaaaaauuauuauuugaaguaauuuauuuacaggaaauguuaaugagauguauu

SEQ ID NO: 74935 - RNA, 64 nt, hsa
uuucaaucaaacauuuccuauauaacaauuauuauauuuacaauuugguuucugcaauauuuuu

SEQ ID NO: 74936 - RNA, 64 nt, hsa
uuaggaugcaauuacgaguguaaacugugugccuuauuuacacuuuauugucucccgcuucuca

SEQ ID NO: 74937 - RNA, 64 nt, hsa
guacaguggaauaucuuagauacuuuuuggaaaguauuuacauaaguuauaucacaauuaaaau

SEQ ID NO: 74938 - RNA, 64 nt, hsa
aucuuaccuugcaguuauugacuuuauauucaauuauuuacaucaaauaaugaaauaacugaaa

SEQ ID NO: 74939 - RNA, 64 nt, hsa
aauacaaauuuaaaaaccaauacaguauaacaacuauuuacauagugcuuacauuguauuaggu

SEQ ID NO: 74940 - RNA, 64 nt, hsa
ugcuuuagaaaaaaaauucaaauuuauaguaguauauuuacauuuuuguuguuguuguuguucu

SEQ ID NO: 74941 - RNA, 64 nt, hsa
ugggauuacaggcaugagccacugcaccuggcuauauuuacauuuaauagaaacauaucuagca

SEQ ID NO: 74942 - RNA, 64 nt, hsa
uggccccucaagcaccguuaauuuacauuccaguuauuuacaugauaauucaugacauucugaa

SEQ ID NO: 74943 - RNA, 64 nt, hsa
gcugccacauagacuuuguucucauuaauaucacuauuuacaacucauguggacucagaaaaac

SEQ ID NO: 74944 - RNA, 64 nt, hsa
ccagauuacuguacuguaggcuaaaauaacacaguauuuacauguuaucuucuuaauuuuaggu

SEQ ID NO: 74945 - RNA, 64 nt, hsa
cucauaagcauauguauacugguuuauggaacuuuauuuacacuccucuaucaugcaaaaaaau

SEQ ID NO: 74946 - RNA, 64 nt, hsa
uugugcuuacaauauuuuugaccuggaguggaucuauuuacauagucauuuaggauccaugcag

SEQ ID NO: 74947 - RNA, 64 nt, hsa
aaauuacuauagcaaaguaguacuucuucuguaauauuuacaauguauuaagcccacaguauau

SEQ ID NO: 74948 - RNA, 64 nt, hsa
auuaguaagaucucuuucuaaagacaggagagauuauuuacaagaagaacucaccaggguuuag

SEQ ID NO: 74949 - RNA, 64 nt, hsa
aacuuagcaaacuuuugaaucuuucuuuuauugcuauuuacacauacauacacacauacaaaac

SEQ ID NO: 74950 - RNA, 64 nt, hsa
ucuuuauacuauuuuacaguaaccacaaucuaaauauuuacauauacccaaaauuaacuuaugc

SEQ ID NO: 74951 - RNA, 64 nt, hsa
aagauucuuauagcuacauuugguuuauucaucauauuuacaguauauauauuguucuuuucag

SEQ ID NO: 74952 - RNA, 64 nt, hsa
uuugaacauuuuucuaaugauuuggagagaaaacuauuuacaaaaauuccacauaucagugaua

SEQ ID NO: 74953 - RNA, 64 nt, hsa
acaaaaacaugaaggacuccaacuagaagacagauauuuacauuuaaauagauuagugggaaaa

SEQ ID NO: 74954 - RNA, 64 nt, hsa
cauccacucugacugauuuccucugaaguaaacauauuuacaauccaaagcaauucuacugaca

SEQ ID NO: 74955 - RNA, 64 nt, hsa
cuguaaauaagagcuuuuguacuagcccaguauuuauuuacauugcuuuguaauauaaaucugu

SEQ ID NO: 74956 - RNA, 64 nt, hsa
aauuagaagauaaugagagaauuaaugggguuuauauuuacauuaucucucaacuauguagccc

SEQ ID NO: 74957 - RNA, 64 nt, hsa
gugauaaacauaacuugccaacagucucuaugcuuauuuacaucuucuacuguucaaacuaaga

SEQ ID NO: 74958 - RNA, 64 nt, hsa
auauuguccaaaaggaaugcuguucuuaaagcauuauuuacaguaggaacuggggaguaaaucu

SEQ ID NO: 74959 - RNA, 64 nt, hsa
uagaaagauuuuuugcuaagaaaaaaauuaaacauauuuacauauuuuucauuuuauuucguau

SEQ ID NO: 74960 - RNA, 64 nt, hsa
aagaagaauugggucuuuuuauuauuauuauuauuauuuacagucauauuacugaacucagugu

SEQ ID NO: 74961 - RNA, 64 nt, hsa
acuuaacuaguuaucagauccuuugaaaagagaauauuuacaauauaugacuaauuuggggaaa

SEQ ID NO: 74962 - RNA, 64 nt, hsa
aauauauucaaauuauguauaaauauauauuauauauuuacaaggaguuauuuuuuguauugau

SEQ ID NO: 74963 - RNA, 64 nt, hsa
acuauuuacaaguuuuaaaaauugcuaucauguauauuuacacaucugauaaauauuaaaucau

SEQ ID NO: 74964 - RNA, 64 nt, hsa
uauuuacaguguguuguaauuuuguaaggccaacuauuuacaaguuuuaaaaauugcuaucaug

SEQ ID NO: 74965 - RNA, 64 nt, hsa
aaucauguaguuuguauaaaaugugggaaggauuuauuuacaguguguuguaauuuuguaaggc

SEQ ID NO: 74966 - RNA, 64 nt, hsa
gagggagggaggaggaauacuagcccuuuuuauauauuuacacaagcaaaacuuuuaaauauuu

SEQ ID NO: 74967 - RNA, 64 nt, hsa
cggugugguaguaguugaaaauuauugccgucauuauuuacauacuuaagacauauuagcaagu

SEQ ID NO: 74968 - RNA, 64 nt, hsa
aaugcauaaaaguauaauugaaaucugugguauuuauuuacaaacaugucuacaaaaauagauu

SEQ ID NO: 74969 - RNA, 64 nt, hsa
guagaacucuguuacacauauuuuugacccauauuauuuacaaugucuugauaauucuaccuuu

SEQ ID NO: 74970 - RNA, 64 nt, hsa
ugaaaaaaaucugccaaauagcaucuuuaggauauauuuacauuuucacucaucuaaaaaguau

SEQ ID NO: 74971 - RNA, 64 nt, hsa
aaguuauauauaguuuggcaaugcucuucuucaauauuuacaauaauaggaugaucuacaagaa

SEQ ID NO: 74972 - RNA, 64 nt, hsa
cauaauuuguuuagugcuacauuugauaauuuauuauuuacagcuuagaauauugauuucuuga

SEQ ID NO: 74973 - RNA, 64 nt, hsa
uguacuuucaauuauguagcuuuguaacuaugaauauuuacauauuuugccuuuuagugauauu

SEQ ID NO: 74974 - RNA, 64 nt, hsa
cuauccuguacauuucacaaaaaggcauaugcaauauuuacauuuuuaauuuaguuuacagaau

SEQ ID NO: 74975 - RNA, 64 nt, hsa
uguagguacuucacauugcaaacgccuuuuauucuauuuacaagcucagaugucucugcucucc

SEQ ID NO: 74976 - RNA, 64 nt, hsa
ucuuuaagauugagcuaaauuaucuaccauugccuauuuacaggauaaguacauucaggacaau

SEQ ID NO: 74977 - RNA, 64 nt, hsa
uuuuuacugauuuuauuguguuguugguaacuaguauuuacagcuaaccuaucuauucauauuu

SEQ ID NO: 74978 - RNA, 64 nt, hsa
cgcuuugauauauuccuggagggccaagcccaucuauuuacaaaaggugaacagcaaaaucaag

SEQ ID NO: 74979 - RNA, 64 nt, hsa
uauaaaccaugugaccucauuuauuugucuuauauauuuacagccauacuagaauuuuuauuuc

SEQ ID NO: 74980 - RNA, 64 nt, hsa
uguuuuaaaaguugcacuaucuuaauguugaaaauauuuacaagggaacuguuuuacgugaagu

SEQ ID NO: 74981 - RNA, 64 nt, hsa
uaauuuuaaauauuguuaguuuuaauauuccugauauuuacaaauauucauucuuauauacaau

SEQ ID NO: 74982 - RNA, 64 nt, hsa
gaaaagaaaguguuuuauuuucaaaucugguccauauuuacauucuaguucagagccaagccuu

SEQ ID NO: 74983 - RNA, 64 nt, hsa
ucuaaacaaaauugcaauuucuuagguaaccuuauauuuacaauaaaugaagauuacccucaaa

SEQ ID NO: 74984 - RNA, 64 nt, hsa
aaucaauugucuauauggaauuuaggauaaagaauauuuacaauaaagaauauuuacaauaaag

SEQ ID NO: 74985 - RNA, 64 nt, hsa
ggaauuuaggauaaagaauauuuacaauaaagaauauuuacaauaaagaguuuauuauuauuug

SEQ ID NO: 74986 - RNA, 64 nt, hsa
agaauuaauuggcuauauggaauuuaggauagaauauuuacaauaaagaguauuuacaauaaag

SEQ ID NO: 74987 - RNA, 64 nt, hsa
auggaauuuaggauagaauauuuacaauaaagaguauuuacaauaaagaguuuguuauuauuug

SEQ ID NO: 74988 - RNA, 64 nt, hsa
agaccaugcagucaaugcauugcuuaaggucucuuauuuacaaaaaaaaaccuuaaacauaguc

SEQ ID NO: 74989 - RNA, 64 nt, hsa
ugcuccucucugcggccagggccagguggguucauauuuacagauaugcccagccaguccuggu

SEQ ID NO: 74990 - RNA, 64 nt, hsa
cacuuuuaguaaggaaauuacuagcuuguguugcuauuuacauaugaauuacugauuauuuuga

SEQ ID NO: 74991 - RNA, 64 nt, hsa
auuguacacacuuugcugaauauuuugucaguuguauuuacaaagaaagguacuuucuuaagag

SEQ ID NO: 74992 - RNA, 64 nt, hsa
caugagguuuaauuuauuuuugugauaggagggauauuuacauauuuuaguggaccacauuuua

SEQ ID NO: 74993 - RNA, 64 nt, hsa
aagaagcaaaacugcuggugucccaaggagcaaguauuuacauugagaauaaagaagaaaagac

SEQ ID NO: 74994 - RNA, 64 nt, hsa
auacugaauuuucagucauaaaagcuuuacuauuuauuuacauauuuauucauguucaugguac

SEQ ID NO: 74995 - RNA, 64 nt, hsa
aaaucuuguauaugcaucuuuguugcuuauuacauauuuacacacacaaccacaaauuuuaaac

SEQ ID NO: 74996 - RNA, 64 nt, hsa
caacacauagaucauaugucugaggcacaaguuggcuguucaucuuugaaaccaggggaugcac

SEQ ID NO: 74997 - RNA, 64 nt, hsa
agaaaauuaccuuuugauuuguaacacuacuucugcuguucaaucaagagucuugguagauaag

SEQ ID NO: 74998 - RNA, 64 nt, hsa
uccuacggaguuacguacuauuguuuaguucacagcuguucagggugacagugagcagauccag

SEQ ID NO: 74999 - RNA, 64 nt, hsa
gacauaaauacguacuugcaaagauuccagaugagcuguucaugugggccccuugcugacuaua

SEQ ID NO: 75000 - RNA, 64 nt, hsa
cagccaagaaaaauugcacagauaguguauauaagcuguucauucuguacagugaauuuuccga

SEQ ID NO: 75001 - RNA, 64 nt, hsa
uauguaacaucuccugaggguguuuaguugcauggcuguucagaaagguauuaagggcuuaggc

SEQ ID NO: 75002 - RNA, 64 nt, hsa
gagugagaagacaguuuauuuaaaacuugagcaggcuguucagcauuguuucugcuucugaaau

SEQ ID NO: 75003 - RNA, 64 nt, hsa
ucacugugaggauucuauacugauuugaaguggagcuguucagaacugaaccuuguaggaaauu

SEQ ID NO: 75004 - RNA, 64 nt, hsa
cucaagaccucaaaauugaguuacuguauacaaagcuguucauagaaaaacaaauguuaccaag

SEQ ID NO: 75005 - RNA, 64 nt, hsa
uccaaccucagccugccaaguagcugucaccauagcuguucaucaccaugccuagcucauuuaa

SEQ ID NO: 75006 - RNA, 64 nt, hsa
aaaaucuaguuuaauacugcauuauuuauuuuccuaaggcuaaagaggagcaguccuaugcuuu

SEQ ID NO: 75007 - RNA, 64 nt, hsa
ggggagaucuacaauuugaauauguguuacuuaauaaggcuaggcuggccaucaguugcuuauu

SEQ ID NO: 75008 - RNA, 64 nt, hsa
aacaauggcugguucuagcccugagugacagucuuaaggcuagauccuucccauaguaucaucu

SEQ ID NO: 75009 - RNA, 64 nt, hsa
uguggcaaacagggccgagggcuggugaagcuguuaaggcuaaaugucgcaugcaugaggcggg

SEQ ID NO: 75010 - RNA, 64 nt, hsa
gcacugaggaguauuuccccucauucuaccucucuaaggcuaugcaacccuccccacgucuucc

SEQ ID NO: 75011 - RNA, 64 nt, hsa
acgucaauggugagcugauggacacaagaucaaauaaggcuaugcuuauuuugugcugccagaa

SEQ ID NO: 75012 - RNA, 64 nt, hsa
cuuuucucuuugccuuuuuuugugauccugccauuaaggcuaugugcagucugcccuccugcuc

SEQ ID NO: 75013 - RNA, 64 nt, hsa
ccaaauacuuuuuguuuuuaacacagcuauccaguaaggcuaucaugaugugugcuaaaauuuu

SEQ ID NO: 75014 - RNA, 64 nt, hsa
acuccaugguggaaguuaaagggcauuuccaaguuaaggcuaagacuugcuuuucuaacuaaga

SEQ ID NO: 75015 - RNA, 64 nt, hsa
uaugagaaaggucagcaaacagaugcaagaccuauaaggcuagucauugagcuauauugguuuu

SEQ ID NO: 75016 - RNA, 64 nt, hsa
aucuuauuuuauaauacuuuuggaauuucauuaauaaggcuaaaauuugaggaauauaacuaau

SEQ ID NO: 75017 - RNA, 64 nt, hsa
ggguuuuuuggggggggaguuggcggggaggaaauaaggcuaacagagguugaccuaaaauuag

SEQ ID NO: 75018 - RNA, 64 nt, hsa
uuuauuuaucuaaaaguaaguguuuuccggcugauaaggcuaacccuacccaggaaaggauuga

SEQ ID NO: 75019 - RNA, 64 nt, hsa
augaucugcauuuugccagaaacucauuuauaauuaaggcuaucauuuauuaaugauuuuuuuc

SEQ ID NO: 75020 - RNA, 64 nt, hsa
agcaacuuagaguaaaaauucgaaaacugaaaaauaaggcuaguguacuacaaaagagacuauc

SEQ ID NO: 75021 - RNA, 64 nt, hsa
uugucuuucaagugaaaccagcuuccuucaucucuaaggcuaaggauagggaaaggguggaugc

SEQ ID NO: 75022 - RNA, 64 nt, hsa
auccuuuugaacacuaaugaugccaggaagagaguaaggcuagaggaggagacucauuuuaacc

SEQ ID NO: 75023 - RNA, 64 nt, hsa
gcaaucuggucuauagacuuuuaacucaagaagcuaaggcuagacuuguuaccuucguugaaug

SEQ ID NO: 75024 - RNA, 64 nt, hsa
aaaacuuguauucauaauguguauaauuuccugguaaggcuaacuccugaucguuucuguagaa

SEQ ID NO: 75025 - RNA, 64 nt, hsa
gaggacacugaggccccacaaggccucaucuccuuaaggcuagugccugaggucacuguauagg

SEQ ID NO: 75026 - RNA, 64 nt, hsa
gaauaaaaacgucuauaauuacaaggaguuuuguuaaggcuaauacaaugacagacugagcaaa

SEQ ID NO: 75027 - RNA, 64 nt, hsa
caccucagacuuuucauucacaacagacagcuuuuaaggcuaacguccagcuguauuuacuucu

SEQ ID NO: 75028 - RNA, 64 nt, hsa
guggaccacagagggcccaaucccucuuggccgcuaaggcuaagguaggagccagagagcugua

SEQ ID NO: 75029 - RNA, 64 nt, hsa
uuucauuuuaaauaauacuuacagagauauaagauaaggcuacuugacaaccagugguacuauu

SEQ ID NO: 75030 - RNA, 64 nt, hsa
agcuguucuccccaccccaggugccuuuggagguuaaggcuagguuaggcccugcacuccaccu

SEQ ID NO: 75031 - RNA, 64 nt, hsa
uacaaaaaauacuuuccguacauuagugguugccuaaggcuagaauugggggugaugaaugggg

SEQ ID NO: 75032 - RNA, 64 nt, hsa
cagaggugcaagccagaggcaauguaauaugcuguaaggcuagugcagaugggagcuuuuuaga

SEQ ID NO: 75033 - RNA, 64 nt, hsa
aauaacaauguuaauauuuuugauuuacauuuuguaaggcuauaauuguaucuuuuaagaaaac

SEQ ID NO: 75034 - RNA, 64 nt, hsa
uaucuucuagaucucuuuuuaucauauaugacauuaaggcuacagaaguuuugugcauuaaucu

SEQ ID NO: 75035 - RNA, 64 nt, hsa
ucacccugagauauuuagaacauuacacaccuucuaaggcuauguuaagacugccuccuucuca

SEQ ID NO: 75036 - RNA, 64 nt, hsa
gugagagaaagugugagcaaacuaacuugacuuuuaaggcuaaaacuuaacauucauagagggg

SEQ ID NO: 75037 - RNA, 64 nt, hsa
gcugugcucaccuuuuccugcuuugugccuugauuaaggcuacugacccuaaauuucugaagca

SEQ ID NO: 75038 - RNA, 64 nt, hsa
auuuuaauuuuagacuacuugaaaaggccccuaauaaggcuagaggucuaagucccccaccccu

SEQ ID NO: 75039 - RNA, 64 nt, hsa
agccguaggaggcucuucaguugggccccaaggauaaggcuacugauuugauacuaaaugaauc

SEQ ID NO: 75040 - RNA, 64 nt, hsa
aacuggacuauccaauagguugccaccagccacauaaggcuauuuaaauuaauucaaauuaaau

SEQ ID NO: 75041 - RNA, 64 nt, hsa
uaacguuagaauagugguuaacagagcuaagaaauaaggcuaaccaucgaaaagaacaugggcc

SEQ ID NO: 75042 - RNA, 54 nt, hsa
ucaaagaucauaacucuugacuuauaaggcuagcuacuuaauaaucacucuugu

SEQ ID NO: 75043 - RNA, 64 nt, hsa
guuguacaacagaacacuuguacaaaauagauuuuaaggcuaacuucuuuucacuguugugcuc

SEQ ID NO: 75044 - RNA, 64 nt, hsa
auuuuuucuucccaggaucaaacugaaaacauguuaaggcuauaguuuagccaguaagauuuaa

SEQ ID NO: 75045 - RNA, 64 nt, hsa
aauacauucucaucuuauaacuacaucuuauaaauaaggcuaauaacccuuagaacaccaccug

SEQ ID NO: 75046 - RNA, 64 nt, hsa
aauccucugggauuggccgacugugagcugcagauaaggcuaucagccaccaaagagcaaugaa

SEQ ID NO: 75047 - RNA, 64 nt, hsa
uuugcaauaucuucuggcuguuaauaaaaauauguaaggcuauauauuuuucuuuaaauaaagc

SEQ ID NO: 75048 - RNA, 64 nt, hsa
cuccacaggacggacauuuuagaguuuaaauuauuaaggcuaucauucuuuuaguaaugucaua

SEQ ID NO: 75049 - RNA, 64 nt, hsa
uauggagaugauacgguguuaaaaaaaaucaugguaaggcuacaauacucaaguaacaagguuu

SEQ ID NO: 75050 - RNA, 64 nt, hsa
cugaacuugcagcugccuauagcauucuccuccauaaggcuagaggagagcuggauauaagcag

SEQ ID NO: 75051 - RNA, 64 nt, hsa
agcucucugccaucgauguauucuaauagauuuguaaggcuauuaauuugaagcaacuccuugc

SEQ ID NO: 75052 - RNA, 64 nt, hsa
acuuauugucacacuguguauguuuucagcauuuuaaggcuagagauuguaaugggcuccuacu

SEQ ID NO: 75053 - RNA, 64 nt, hsa
cccuuggcuguaguugccuuuccuagcuccacucuaaggcuaagcaucuucaaagacguuuucc

SEQ ID NO: 75054 - RNA, 64 nt, hsa
aauauuaaugcaguauugcaacaggggugcaauuuaaggcuaugugauagaggguuauuuacuc

SEQ ID NO: 75055 - RNA, 64 nt, hsa
cuuaguucuugcuacacaggauggugacuggaacuaaggcuacacagagggucgcacuuggacu

SEQ ID NO: 75056 - RNA, 64 nt, hsa
gugcagcagaguggcugaugcugcaaguuaugucuaaggcuaggaacuaucaggugucuauaau

SEQ ID NO: 75057 - RNA, 64 nt, hsa
uauucauaccacacugaaaugaacaacugaagaauaaggcuaagaaccaauaaaauauuucucu

SEQ ID NO: 75058 - RNA, 64 nt, hsa
auaaugacuaaacauacuauguacacaauuacuguaaggcuaauucacgugccauacuccaccu

SEQ ID NO: 75059 - RNA, 64 nt, hsa
uagaaaguuauauuuauauucaauauuuacuucuuaaggcuagcggaauauccuuccugguucu

SEQ ID NO: 75060 - RNA, 64 nt, hsa
ugcucuucauagacacaucuugcagcauuuuucuuaaggcuaugcuucaguuuuucuuuguaag

SEQ ID NO: 75061 - RNA, 64 nt, hsa
cauguggguacugugucaucacaaaaucucucaguaaggcuauaugugauccucauuuugccuc

SEQ ID NO: 75062 - RNA, 64 nt, hsa
aguuugcaugacuuucuggaggcauggaguuagguaaggcuacaugagaaauugagcuuuucca

SEQ ID NO: 75063 - RNA, 64 nt, hsa
ugaagaguuacauaagcauuugaaugcucuaauauaaggcuaaugauuuucuguuaguguuuga

SEQ ID NO: 75064 - RNA, 64 nt, hsa
caacuucucucuguauaggccucugaaauaucaauaaggcuaaauauuacuuuacacaguaaga

SEQ ID NO: 75065 - RNA, 64 nt, hsa
gaaguuuaagaugccuugacuuuuuaaaugcucuuaaggcuauucgauguaauucuuacuccua

SEQ ID NO: 75066 - RNA, 64 nt, hsa
ggaggucauuuaucugagucucuccagaaguuuuuaaggcuacauuuuggaaucauuaaacuug

SEQ ID NO: 75067 - RNA, 64 nt, hsa
augacugcaauaacaaugauucauucauuaauguuaaggcuaauacauuuaagaucuuguuuaa

SEQ ID NO: 75068 - RNA, 64 nt, hsa
gagggaguugacugcaggcaguuuuuaggccagauaaggcuagaucuuccugcaaugcacuugc

SEQ ID NO: 75069 - RNA, 64 nt, hsa
aaggguggagggcagggaauggggccugagguauuaaggcuaagaggugggggacagggcccau

SEQ ID NO: 75070 - RNA, 64 nt, hsa
agugccuugcagucuuugcccacuauacauaggcuaaggcuaagcucuuuguacuacugcaaac

SEQ ID NO: 75071 - RNA, 64 nt, hsa
uuucuguauuuuucuuuucuggaacagugggaauuaaggcuacugcaugcaucacuucugcauu

SEQ ID NO: 75072 - RNA, 64 nt, hsa
agcaaaucauaaacaguaguuuucaacauacuucuaaggcuaaauucauuuccagaaguagcaa

SEQ ID NO: 75073 - RNA, 64 nt, hsa
uaucaacuauucuaaauacagguaaugguauauuuaaggcuaccauaacauccuauuuagaggg

SEQ ID NO: 75074 - RNA, 64 nt, hsa
gggcguuguguuuuacacaaaaccauuuuugaauuaaggcuaugauauuaagauagaaauuugg

SEQ ID NO: 75075 - RNA, 64 nt, hsa
uugaaaguaugaaauguguugcuucugaguuauauaaggcuacuucaugacaagacugcuuugu

SEQ ID NO: 75076 - RNA, 64 nt, hsa
gugugccguggacgaguggccacuuuacuacuccuaaggcuaagauguugagagcucagaccac

SEQ ID NO: 75077 - RNA, 64 nt, hsa
gggcuggcuuaggagcaaguggcucauuuucccauaaggcuaaaaauaacuggugcgcucccuu

SEQ ID NO: 75078 - RNA, 64 nt, hsa
cuuuccaauggccgggggcauuugguccccaaauuaaggcuauuggacaucugcacaggacagu

SEQ ID NO: 75079 - RNA, 64 nt, hsa
agguuuuuaaacacuaaaauauauaauuuauaguuaaggcuaaaaaguauauuuauugcagagg

SEQ ID NO: 75080 - RNA, 64 nt, hsa
guuaguuauacauauuagaagcauauuugccuaguaaggcuaguagaaccacauuucccaaagu

SEQ ID NO: 75081 - RNA, 64 nt, hsa
gauauugcuaugucaaagcaaagggcacuucuuuuaaggcuacuuucagaacuuuguauuuucg

SEQ ID NO: 75082 - RNA, 64 nt, hsa
cuuuuguugaauguauuugacuuaguucuuauuuuaaggcuaaaaaaacuuugucauauuuaag

SEQ ID NO: 75083 - RNA, 64 nt, hsa
augcagaaaaggacuugugguuuuguuuuuaugcuaaggcuaguguacuagauguacuuuuucu

SEQ ID NO: 75084 - RNA, 64 nt, hsa
ccgucucuugagcaugguuuuuagaggcuacgaauaaggcuaugaauaaggguuaucuuuaagu

SEQ ID NO: 75085 - RNA, 64 nt, hsa
uauaagaauguauagacaagcugacauauuucccuaaggcuaacaacacccugcugaagcucuu

SEQ ID NO: 75086 - RNA, 64 nt, hsa
uauagaaacaucauucgauauugcuacuugaguguaaggcuaauauugauauuuaugacaauaa

SEQ ID NO: 75087 - RNA, 64 nt, hsa
cagugucacaaguacagaagagagaaauauuguuuaaggcuagcacauggaaaaacaacuuaga

SEQ ID NO: 75088 - RNA, 64 nt, hsa
uauaugcuuugcagagaacucauaaaggagcauauaaggcuaaauguaaaacacaagacuguca

SEQ ID NO: 75089 - RNA, 64 nt, hsa
auacucuuccuaugaagagggaaugcguaugaauuaaggcuacuacugucacagaagaucauag

SEQ ID NO: 75090 - RNA, 64 nt, hsa
acaggagaggaggugauguacacuuagagguaacuaaggcuaguuugaaaaccgugaauuaaga

SEQ ID NO: 75091 - RNA, 64 nt, hsa
ugugcuucaaaagggcaaaugugcuuuagugcccuaaggcuaaauuuuggucauuugacaucag

SEQ ID NO: 75092 - RNA, 64 nt, hsa
ggauuuaggaaguuuugaucucacaaauuuacuguaaggcuaaucaaugaauguuuguacucag

SEQ ID NO: 75093 - RNA, 64 nt, hsa
cagcucugugugauucaaguucuggcagagcuuguaaggcuagagcccaggucugccgacaccc

SEQ ID NO: 75094 - RNA, 64 nt, hsa
uuccuacuuuauauaagggcaacuuccugggagcuaaggcuacuaaaagguagaagccacagua

SEQ ID NO: 75095 - RNA, 64 nt, hsa
aaauugaggauuaccaauuaaacuuuaacugaacuaaggcuaccaaauacauucccuguuaucu

SEQ ID NO: 75096 - RNA, 64 nt, hsa
gcugcucuguuagacuggugcugaaacaaaagguuaaggcuagguugaagucuagaaugaaaga

SEQ ID NO: 75097 - RNA, 64 nt, hsa
uagaauuggguuaggugagaaagaaaguuaagguuaaggcuagaguugucuuuaaggguuaggg

SEQ ID NO: 75098 - RNA, 64 nt, hsa
ccauucagaagaaauaaauuagguaacuugauaauaaggcuaagugggagaguaccuguucaau

SEQ ID NO: 75099 - RNA, 62 nt, hsa
uuuguacaguguucaagugaauaaaaaccaugccuaaggcuagcucugaugugguucuuugg

SEQ ID NO: 75100 - RNA, 64 nt, hsa
cugagaguucugaguccaaaggguguacguugcauaaggcuagagaccgcuuuuccuccuuucc

SEQ ID NO: 75101 - RNA, 64 nt, hsa
gacuacauuucuagaguuagagaaaccugcuuuuuaaggcuauuguccuuuguuccuucaugua

SEQ ID NO: 75102 - RNA, 64 nt, hsa
ugcuuaauaaaucuucuguaaggauuuuagaugauaaggcuacaauucagaaucuucugaacca

SEQ ID NO: 75103 - RNA, 64 nt, hsa
uacaugcaucuguaauacaguuucuacgucuauuuaaggcuaggagccgaaugugccccauugu

SEQ ID NO: 75104 - RNA, 64 nt, hsa
gggguaggggugggccaccaaguauacugaauucuaaggcuagcuguuccugacauauaguagg

SEQ ID NO: 75105 - RNA, 64 nt, hsa
cuccaaggcucugcaccaugccacacacuugcuguaaggcuagaagugaagaccuuauuaauag

SEQ ID NO: 75106 - RNA, 64 nt, hsa
aauuaaauaauucaaacaucaaauaacuucaauuuaaggcuauggacuuugagauaauucugag

SEQ ID NO: 75107 - RNA, 64 nt, hsa
ugcuuucaauuuauugucuugcuucauuaaaauguaaggcuaaggagagcauggaauuugucag

SEQ ID NO: 75108 - RNA, 64 nt, hsa
ggacagagcugaauaggaaagacuugcuauugccuaaggcuaugugugacacccuccugaggac

SEQ ID NO: 75109 - RNA, 64 nt, hsa
uccaguuuuguugagaauuguuuucuuacauuacuaaggcuaauaaugagauguaacucaugaa

SEQ ID NO: 75110 - RNA, 64 nt, hsa
gaugccucauuccucaguuuccucacguguacuauaaggcuaguaccugcuuuguugggguaug

SEQ ID NO: 75111 - RNA, 64 nt, hsa
aaacaugcauagcuauuuuuaucacucuaaucaguaaggcuacuaucuagacucgaaugcuuuc

SEQ ID NO: 75112 - RNA, 64 nt, hsa
aauaauacucauaaugucucauuuuagugacuccuaaggcuaguccuuuuauaaacaacuuuuu

SEQ ID NO: 75113 - RNA, 64 nt, hsa
cccugaaucuucuacugaacaucuugcuauguacuaaggcuaccuguacaacgacucugccucu

SEQ ID NO: 75114 - RNA, 64 nt, hsa
ccaugauuguaugaaguuuuaaaaaaaacuacagcagccaaagaaacuauauauauauauauau

SEQ ID NO: 75115 - RNA, 64 nt, hsa
ugucugggaauaucauagaguaacaagugcuggucagccaaagaaacauucacugcuggugaac

SEQ ID NO: 75116 - RNA, 64 nt, hsa
aaaugcugggauuacaggcaugagccacuguacccagccaaaauuguuuucuuuuuuaagugaa

SEQ ID NO: 75117 - RNA, 64 nt, hsa
uggagcuuacagucuguucuggggaacagagauucagccaaagucaagaaacacuggaugccag

SEQ ID NO: 75118 - RNA, 64 nt, hsa
uucugguguuauucugucuccucuucuuugucaucagccaaaacgugguuuuuaaagagaguca

SEQ ID NO: 75119 - RNA, 64 nt, hsa
auccuaguguuccuauagugaaauaaguaggguucagccaaagcuuucuuuguuuuguaccuua

SEQ ID NO: 75120 - RNA, 64 nt, hsa
cuucacagauggcuucucacagaugcccuccugccagccaaaccggacuuguucuuccugccuc

SEQ ID NO: 75121 - RNA, 64 nt, hsa
gagaauuaguguguuauguggauaauguuauauacagccaaaguggauguuucuauuuggcaag

SEQ ID NO: 75122 - RNA, 64 nt, hsa
gaacgggcagccacaggacugagcccucucacuccagccaaagaaaugggccugccugccucca

SEQ ID NO: 75123 - RNA, 64 nt, hsa
cagaagaagugggagcagcuucuugggcugagugcagccaaaggggagccagaaaugggcaguu

SEQ ID NO: 75124 - RNA, 64 nt, hsa
gcucacucagauuguccguuugcuaugccgaaugcagccaaaauuccuuuuuacaauuugugau

SEQ ID NO: 75125 - RNA, 64 nt, hsa
uuuagcggaaacuacuaaauuauuuugggugguucagccaaaccucaaaacaguuaaucucccu

SEQ ID NO: 75126 - RNA, 64 nt, hsa
ccuccuguagcaguagggcccccagccagcgcuccagccaaagcggcggccccaggguuaauug

SEQ ID NO: 75127 - RNA, 64 nt, hsa
uugcggcuggcaggcaggauguuuugaaauggugcagccaaaggccccgucuagcuuggcuggc

SEQ ID NO: 75128 - RNA, 64 nt, hsa
gguggggcacccccaaauuugacucugggagacucagccaaauccuaucugguaauaaaauuuc

SEQ ID NO: 75129 - RNA, 64 nt, hsa
uguucuuuuuacauaaaggaauuuguaggaaaugcagccaaaggugcagucggaaaagaugcag

SEQ ID NO: 75130 - RNA, 64 nt, hsa
ggccuucauggagggugguaacagcaccucaguccagccaaaauguuuagaaacacucagucuc

SEQ ID NO: 75131 - RNA, 64 nt, hsa
ggugggcucuguuuaggagggcagugagaccacccagccaaauugcuucucaacccuagacaaa

SEQ ID NO: 75132 - RNA, 64 nt, hsa
gagggaucccugcacccaggaggccuccugacaccagccaaaauccugacagcagggucugccc

SEQ ID NO: 75133 - RNA, 64 nt, hsa
uuugacucuccuuucugggaugacaucucagaaucagccaaagacuucauccggcaccuucugg

SEQ ID NO: 75134 - RNA, 64 nt, hsa
gaguggggcugaaggccaggcugagugccugggucagccaaaccccuggcacccccagggugac

SEQ ID NO: 75135 - RNA, 64 nt, hsa; identical to SEQ ID NO: 73323

SEQ ID NO: 75136 - RNA, 64 nt, hsa; identical to SEQ ID NO: 73324

SEQ ID NO: 75137 - RNA, 64 nt, hsa; identical to SEQ ID NO: 73325

SEQ ID NO: 75138 - RNA, 64 nt, hsa; identical to SEQ ID NO: 73326

SEQ ID NO: 75139 - RNA, 64 nt, hsa; identical to SEQ ID NO: 73327

SEQ ID NO: 75140 - RNA, 64 nt, hsa; identical to SEQ ID NO: 73328

SEQ ID NO: 75141 - RNA, 64 nt, hsa; identical to SEQ ID NO: 73329

SEQ ID NO: 75142 - RNA, 64 nt, hsa; identical to SEQ ID NO: 73330

SEQ ID NO: 75143 - RNA, 64 nt, hsa; identical to SEQ ID NO: 73331

SEQ ID NO: 75144 - RNA, 64 nt, hsa; identical to SEQ ID NO: 73332

SEQ ID NO: 75145 - RNA, 64 nt, hsa; identical to SEQ ID NO: 73333

SEQ ID NO: 75146 - RNA, 64 nt, hsa; identical to SEQ ID NO: 73334

SEQ ID NO: 75147 - RNA, 64 nt, hsa; identical to SEQ ID NO: 73335

SEQ ID NO: 75148 - RNA, 64 nt, hsa; identical to SEQ ID NO: 73336

SEQ ID NO: 75149 - RNA, 64 nt, hsa; identical to SEQ ID NO: 73337

SEQ ID NO: 75150 - RNA, 64 nt, hsa; identical to SEQ ID NO: 73338

SEQ ID NO: 75151 - RNA, 64 nt, hsa; identical to SEQ ID NO: 73339

SEQ ID NO: 75152 - RNA, 64 nt, hsa; identical to SEQ ID NO: 73340

SEQ ID NO: 75153 - RNA, 64 nt, hsa; identical to SEQ ID NO: 73341

SEQ ID NO: 75154 - RNA, 64 nt, hsa; identical to SEQ ID NO: 73342

SEQ ID NO: 75155 - RNA, 64 nt, hsa; identical to SEQ ID NO: 73343

SEQ ID NO: 75156 - RNA, 64 nt, hsa; identical to SEQ ID NO: 73344

SEQ ID NO: 75157 - RNA, 64 nt, hsa
accugcgaaagcugucaacuuuugugguuguagcaaguauuaauaaauauuuauaaauccucua

SEQ ID NO: 75158 - RNA, 64 nt, hsa
gucuagcuaccuauccaauacuaaauaccccuuaaaguauuaaaugcacuaucugcuguaaaag

SEQ ID NO: 75159 - RNA, 64 nt, hsa
uacauauaagcaguaguacuuuuucucuauuauaaaguauuaauuuugaguuccauuuuauaau

SEQ ID NO: 75160 - RNA, 64 nt, hsa
guaguaaaaacaucaaagaugcagcaagcuuauuaaguauuauuuucuaaaagaaauaggaggc

SEQ ID NO: 75161 - RNA, 64 nt, hsa
guaguucuuugagauaguugcuuaugcauauaguaaguauuacauucuuagaguagagcagagu

SEQ ID NO: 75162 - RNA, 64 nt, hsa
cucauuaacacuuacauuuccauaaagaaaacucaaguauuaauaaaagagacuuuacuggcuu

SEQ ID NO: 75163 - RNA, 64 nt, hsa
gcucuuaauguauuccuuuuuaguaggaauccggaaguauuagauugaauggaaaagcacuugc

SEQ ID NO: 75164 - RNA, 64 nt, hsa
cuuggccuuccuggugugcaguacugcuguagaaaaguauuaauagcuucauuucauauaaaca

SEQ ID NO: 75165 - RNA, 64 nt, hsa
guaccaugaaauauccagaacauacuuauauguaaaguauuauuuauuugaaucuacaaaaaac

SEQ ID NO: 75166 - RNA, 64 nt, hsa
gugccuugguuucuccuuuauuucuaaguggaaaaaguauuagccaccaucuuaccucacagug

SEQ ID NO: 75167 - RNA, 64 nt, hsa
agaacaagacauacuucaauguauuauacagauaaaguauuacauguguuugauuuuaaaaggg

SEQ ID NO: 75168 - RNA, 64 nt, hsa
uuuauacuguacuuauuggaaugaaauuucuuuaaaguauuacuauuaacugacuucagaagua

SEQ ID NO: 75169 - RNA, 64 nt, hsa
uuaacucuuagaaguguuguaaaagaugcagaguaaguauuaugccccaguucagaaauuuggc

SEQ ID NO: 75170 - RNA, 64 nt, hsa
aauacuuucugacagucaccugagccuuaaauguaaguauuacaugacaugcauucuguuucuu

SEQ ID NO: 75171 - RNA, 64 nt, hsa
aagaacuuguccagaagaaaaaccuguuaaauucaaguauuaaaauuuuuagaucaaaaaggca

SEQ ID NO: 75172 - RNA, 64 nt, hsa
uaaaaguauucccaguaugugugcagcaugaagaaaguauuagugcuucucaguguucucagug

SEQ ID NO: 75173 - RNA, 64 nt, hsa
gguauuauacuguauaacccuacaaaauacauagaaguauuauuugccuucauaauagaaccca

SEQ ID NO: 75174 - RNA, 64 nt, hsa
uucauguuguuauguaaucaauauuuuucaauagaaguauuagagguuuuuuuuauugauauaa

SEQ ID NO: 75175 - RNA, 64 nt, hsa
gagagaaaaauuaaagcuaaaauuagcugcaaagaaguauuaauaaucaccucugcaaaaauuc

SEQ ID NO: 75176 - RNA, 64 nt, hsa
gaccaucuaccugccuuauacuacacuuaggaaaaaguauuacauaugguuuauuuugaaacuu

SEQ ID NO: 75177 - RNA, 64 nt, hsa
aaaaaguauuacauaugguuuauuuugaaacuucaaguauuauugccuuaaugucucuuaaccc

SEQ ID NO: 75178 - RNA, 64 nt, hsa
gcaguuaaaauguucuaucuuauguauuucuuuuaaguauuaccauuauggugcuacugagcgu

SEQ ID NO: 75179 - RNA, 64 nt, hsa
uagauaaacaugaaugugauuaauaaugcugaaaaaguauuagccuaccaaagacacacucagg

SEQ ID NO: 75180 - RNA, 64 nt, hsa
cauaaaacuacaaaauaaagucccauuagguuauaaguauuacaaaaaauccaccuuucucuaa

SEQ ID NO: 75181 - RNA, 64 nt, hsa
uaaaguggcuguuaaaaagggaguugauuugaggaaguauuacuuagcauucaugcauauuggg

SEQ ID NO: 75182 - RNA, 64 nt, hsa
aauuguccuuaugaaacaagaaaaagaaaaugaaaaguauuauuaagcuucuguguuugucuaa

SEQ ID NO: 75183 - RNA, 64 nt, hsa
cuaaaauuuuauuuuuaaaaaggaaaauuguuuaaaguauuauauguaaacauauggguauuuu

SEQ ID NO: 75184 - RNA, 64 nt, hsa
gggaauauuuuuuccuuaaaacagaaaaaaauuaaaguauuauuaauaauauaugucuguauau

SEQ ID NO: 75185 - RNA, 64 nt, hsa
cuuggagaaguuuaaugagaaaauuuuagaagaaaaguauuacaaacaauauuuugacucuauu

SEQ ID NO: 75186 - RNA, 64 nt, hsa
uucaaagauguuuuauuuuuagaauaguuauaaaaaguauuagucuuaacauaaugugucuugu

SEQ ID NO: 75187 - RNA, 64 nt, hsa
guuaauuuuacuaagaauaaaacauccaaauuuuaaguauuaugaaauacuaaaacuacauguu

SEQ ID NO: 75188 - RNA, 64 nt, hsa
uuuuucauaauucaaacaaaaguuauuacacuaaaaguauuauaguaacguauuguccuuccgu

SEQ ID NO: 75189 - RNA, 64 nt, hsa
uuuguccuuguucuaggaguuacuggguaguuguaaguauuauuuuuauuaaauauaauguaaa

SEQ ID NO: 75190 - RNA, 64 nt, hsa
guggagaaccauuaaaaauuugagaagaaacaacaaguauuaugucaacuuacuucaaaggcgu

SEQ ID NO: 75191 - RNA, 64 nt, hsa
ggccuacgauccuucugauuuaaguacagcuggaaaguauuaucuaauuaaguucaugauagug

SEQ ID NO: 75192 - RNA, 64 nt, hsa
gacugacucuguuauguaacucuucauuuauguuaaguauuaauaggucaaaaccaaaaugacc

SEQ ID NO: 75193 - RNA, 64 nt, hsa
cuuggaacuuccaugauuauccacuuaaagaucaaaguauuauaugcugugugcuuuuuaggug

SEQ ID NO: 75194 - RNA, 64 nt, hsa
ugggauuuauaaaccagcugugauuaacaauguaaaguauuaauuauugaacuuugaaccagau

SEQ ID NO: 75195 - RNA, 64 nt, hsa
acuuuuucuugugugauucuuaacauuauagcacaaguauuaucucaguggauuauccggaaua

SEQ ID NO: 75196 - RNA, 64 nt, hsa
gcuuguacaacaugguuuggggugaaggggaggaaaguauuaaaaaaucuauaucgcuaguaaa

SEQ ID NO: 75197 - RNA, 64 nt, hsa
uacaucuaugguaguuuuugaggugccuauuauaaaguauuacggaaguuugcuguuuuuaaag

SEQ ID NO: 75198 - RNA, 64 nt, hsa
gcuccuuucuggaccucaguccuucaccuagucaccuagucacaggguggauugccucuaagga

SEQ ID NO: 75199 - RNA, 64 nt, hsa
uuaagauagcuccuuucuggaccucaguccuucaccuagucaccuagucacaggguggauugcc

SEQ ID NO: 75200 - RNA, 64 nt, hsa
uuggccuuacagggcucuaguuaugguuacuuucccuagucaaugcucugaaaaugugucacau

SEQ ID NO: 75201 - RNA, 64 nt, hsa
aacacuugccuuacaaggcucuaauuaugauuucccuagucagugcucugaagaugugucacau

SEQ ID NO: 75202 - RNA, 64 nt, hsa
ucuaaagguuuuaucacuuaguuguucauauuaugaaccuaaaaauaauggcauaaaguuuggg

SEQ ID NO: 75203 - RNA, 64 nt, hsa
aaguagacaagaauaaagugguuugagaugaaaagaaccuaacauuauuuacaguagauguggu

SEQ ID NO: 75204 - RNA, 64 nt, hsa
uuucaugcaaauucuauauuuuacauucuuggaaagucuauaugaaaaacaaaaauaacaucuu

SEQ ID NO: 75205 - RNA, 64 nt, hsa
ggcuguuuguuuuacagugucugauaaucuuguuagucuauacccaccaccucccuucauaacc

SEQ ID NO: 75206 - RNA, 64 nt, hsa
uuaaaacggucucaaaaaguacugauauaaggucagucuauauucuggaaauguuuauauuaaa

SEQ ID NO: 75207 - RNA, 64 nt, hsa
ugcauuuucuaguucugaaaguggaaaaugaaacagucuauaauaaacuuagaugauauauagu

SEQ ID NO: 75208 - RNA, 64 nt, hsa
gcauguaucacaagauaagaaaugaaaaaucaaucuuucuuaccacccuguucucuuucccuuu

SEQ ID NO: 75209 - RNA, 64 nt, hsa
uaguuaugacugauaguggcuuuuuucaaaauggcuuucuuacguaccacacuuuuuuuuaucu

SEQ ID NO: 75210 - RNA, 64 nt, hsa
uccugaugccaagauuuuuuggagaacaucugcacuuucuuauauauauauauaauauuaaaaa

SEQ ID NO: 75211 - RNA, 64 nt, hsa
gggaaacaaguugacauuugucauuuguggcuuucuuucuuaucaucauggcacagauucugua

SEQ ID NO: 75212 - RNA, 64 nt, hsa
ggcaaaugauuuuauaaacaauggacaauauauacuuucuuaagaucuaagguacuuucuuaag

SEQ ID NO: 75213 - RNA, 64 nt, hsa
auggacaauauauacuuucuuaagaucuaagguacuuucuuaagaucuaagaauuugcugaaag

SEQ ID NO: 75214 - RNA, 64 nt, hsa
ucuuacccagugucagauaauuaauuacuaauuacuuucuuaaaaacaugaacuaugccagaau

SEQ ID NO: 75215 - RNA, 64 nt, hsa
aaggagggcacccagcaccccggcgucucuggcccuuucuuauucuuuggcuccucauccaccg

SEQ ID NO: 75216 - RNA, 64 nt, hsa
aacauguauuuguauuaaacuuuuuaaauaauugcuuucuuaucaaaccaauugauuuuauaau

SEQ ID NO: 75217 - RNA, 64 nt, hsa
gcauagcuaugugaaaaagaaacccucaaaaauacuuucuuaauuucacauuguuuuuucugac

SEQ ID NO: 75218 - RNA, 64 nt, hsa
aaaagauucaggcagcuuaaaaccuuagugcuuucuuucuuaacauacccacauuucaauucuu

SEQ ID NO: 75219 - RNA, 64 nt, hsa
acuguaugagaaaauauuaauacagauuaaaagccuuucuuacaucuugaaaauuuucuaauau

SEQ ID NO: 75220 - RNA, 64 nt, hsa
uuucuuuagaguuggaauuuuuauuuguuuuuaucuuucuuagugguugcuuuagaguuggagu

SEQ ID NO: 75221 - RNA, 64 nt, hsa
cuagcauaucaguuauacuuuuuuuuuuuuaaaccuuucuuagugguuucuuuagaguuggaau

SEQ ID NO: 75222 - RNA, 64 nt, hsa
aaaauugaacaaaacaggguaccagcacggaagacuuucuuaaaacgcaaccugaauugaauga

SEQ ID NO: 75223 - RNA, 60 nt, hsa
uuguuguacccccgauguaaagaagaacugcuuucuuauagcacaaaacuacuuacucug

SEQ ID NO: 75224 - RNA, 64 nt, hsa
uccuaaccccagaggcucccugcucucauuuuagcuuucuuaggguaagucccacgagccagcc

SEQ ID NO: 75225 - RNA, 64 nt, hsa
uucauuauagaaaaaaccuguggcaaaaacguuucuuucuuauuuuuuuucuuuuccuaaaaca

SEQ ID NO: 75226 - RNA, 64 nt, hsa
uuaagaauucuguacuuccaauuuauaaugaauacuuucuuagauuuuagguaggaggggagca

SEQ ID NO: 75227 - RNA, 64 nt, hsa
uaauucuuaagucuuuugucugauuuuuaaaguacuuucuuauaaauuuggaucauguuaugau

SEQ ID NO: 75228 - RNA, 64 nt, hsa
caagacaaaauaaaacucaccaucuccugaagaccuuucuuaccuuuuuuuaaaaacaaaaaau

SEQ ID NO: 75229 - RNA, 64 nt, hsa
gauaaauagggacagggacaguuaaauugggagccuuucuuacaaccuugaugggauuuuuccc

SEQ ID NO: 75230 - RNA, 64 nt, hsa
uuaaaaucagaguaaguauguucuuacauaaggccuuucuuaggaauuauguguauauaaaucu

SEQ ID NO: 75231 - RNA, 64 nt, hsa
guugguugguaaugugccugccucagccaguucacuuucuuagguaauucacugcagguuaaga

SEQ ID NO: 75232 - RNA, 64 nt, hsa
ccaucucaaaaguuugggauuuuccuccucuuaacuuucuuaauauuuggacaugcaguugucg

SEQ ID NO: 75233 - RNA, 64 nt, hsa
ugauacugaagacugccaaauacauaggaauuuucuuucuuaaaaaacaguaaugaagacuaua

SEQ ID NO: 75234 - RNA, 64 nt, hsa
uguccuuacuuuaacuugaucuaauuauugcuuccuuucuuauuacuuuccuaauuuuucuaua

SEQ ID NO: 75235 - RNA, 64 nt, hsa
cuuuccucucuaugaugugauaauacaguaaaagcuuucuuacccagcauagugggagagugga

SEQ ID NO: 75236 - RNA, 64 nt, hsa
uagagagugacgacauggaaaaugaauuuaaccacuuucuuauuggguugucuugcuuucuuac

SEQ ID NO: 75237 - RNA, 64 nt, hsa
augaauuuaaccacuuucuuauuggguugucuugcuuucuuacaugaacuuguuuuuuuaauca

SEQ ID NO: 75238 - RNA, 64 nt, hsa
caaagcaacccaaaggcuuuucccuggaaaagcucuuucuuaccuaaagauaaaaccaauucac

SEQ ID NO: 75239 - RNA, 64 nt, hsa
aucucuauauucuuucaaguaaccaagcuguugacuuucuuacuacuugcaguagccugucccc

SEQ ID NO: 75240 - RNA, 64 nt, hsa
aaauuggagccaauccucucaaacccugccacugcuuucuuaacuacgugcgucaauauuguaa

SEQ ID NO: 75241 - RNA, 64 nt, hsa
cugccuauggaguagccguucuuuuauuccuuuacuuucuuaacaaauuugcuuucacuuaaaa

SEQ ID NO: 75242 - RNA, 64 nt, hsa
uucccucauauuuucuugagaucaaacuuuacuucuuucuuauuuacuaagaauuugccuguuu

SEQ ID NO: 75243 - RNA, 64 nt, hsa
agaacccaaggccacaaaucauaggcaugaagcacuuucuuaagacugaccuaacgcuggauua

SEQ ID NO: 75244 - RNA, 64 nt, hsa
uguuuggaauaauauauauuuuuuaugcuuuugucuuucuuaccugauugauauuacauucacc

SEQ ID NO: 75245 - RNA, 64 nt, hsa
uuaaaaguuuauuuuuacagaauauauuuaguaccuuucuuaaggaguaacugaauugaaucaa

SEQ ID NO: 75246 - RNA, 64 nt, hsa
auuuaacuauuuuuauguuuauacuagguagggucuuucuuauguuucuguguuuuugguaugc

SEQ ID NO: 75247 - RNA, 64 nt, hsa
auugggugguuuguaaccccuucagccuagccucucugcccauuuauuuccaaccccaacagac

SEQ ID NO: 75248 - RNA, 64 nt, hsa
ccugacugacgccuuuugaugcucacgggaaauuucugcccaggaucucagccccaggcugguu

SEQ ID NO: 75249 - RNA, 64 nt, hsa
cuccccaggugccccccggggauucagggcugaaucugcccaguucccacacucaggccagccc

SEQ ID NO: 75250 - RNA, 64 nt, hsa
ucccaggguccagccugagcccccaccaggggucucugcccagcacaggaagcugacccuggcc

SEQ ID NO: 75251 - RNA, 64 nt, hsa
ccaccucccaaacuccugccugcccuccagacugucugcccauacaccugucuccuucuuccug

SEQ ID NO: 75252 - RNA, 64 nt, hsa
guccccuuccugucugcccauauccuguuuucugucugcccaccuucccuucuucccaccugcc

SEQ ID NO: 75253 - RNA, 64 nt, hsa
ugucuuccugacccccgcuucuguccccuuccugucugcccauauccuguuuucugucugccca

SEQ ID NO: 75254 - RNA, 64 nt, hsa
uggccuucccuucucaggcuauucccaccauuagucugcccaccuuucuaggcugggcuuggcc

SEQ ID NO: 75255 - RNA, 64 nt, hsa
ugucugccccacuccuucacacaagcccagcuccucugcccaaggggugcggcgcccccuuggg

SEQ ID NO: 75256 - RNA, 64 nt, hsa
uccaguccuguggcugugugacuuugaacacguuucugcccaucuccaggucuuaguuucuuug

SEQ ID NO: 75257 - RNA, 64 nt, hsa
auucagacucuccugguuguguaacugaagauguucugcccaccagcaccagaggucacucucc

SEQ ID NO: 75258 - RNA, 64 nt, hsa
ccagcaacuugggcuaccuuaggggaagcagcacucugcccaggguucuugcuauaaauagguc

SEQ ID NO: 75259 - RNA, 64 nt, hsa
uggucaggcuggucucgaacuccugaccucguaaucugcccaccucggccucccaaaguucugg

SEQ ID NO: 75260 - RNA, 64 nt, hsa
ugguggcugcuugccaggguccccuggggccccuucugcccagucccugugacgucacacugca

SEQ ID NO: 75261 - RNA, 64 nt, hsa
ggacuguuggaggagaguuagcccaaguauaggcucugcccagaugccaucacaucccugauac

SEQ ID NO: 75262 - RNA, 64 nt, hsa
aagcagagucaggagaccccaaggcaugugagcaucugcccagcaaccuguggagacaacccac

SEQ ID NO: 75263 - RNA, 64 nt, hsa
cggccgcgaccccauuugggaggugaggagcaacucugcccagccgccccgucugagaagugag

SEQ ID NO: 75264 - RNA, 64 nt, hsa
uggcaaccgccccgucugauaaguaaggagccccucugcccagcagccgccccgucugagaagu

SEQ ID NO: 75265 - RNA, 64 nt, hsa
cagcagccgccccgucugagaagugaggagccccucugcccagcagccacccugucugggaagu

SEQ ID NO: 75266 - RNA, 64 nt, hsa
ggccagccgccccguccgggaggugaggggcgccucugcccagcugccccuacugggaagugag

SEQ ID NO: 75267 - RNA, 64 nt, hsa
auagaccucucaauuucuggaaaacugccuuuuaucugcccagaauucuaagcuggugccccac

SEQ ID NO: 75268 - RNA, 64 nt, hsa
cucuaaggugggaucacuaagggauggggcagucucugcccaaacauaaagagaacucugggga

SEQ ID NO: 75269 - RNA, 64 nt, hsa
cccccuaaccugccucuggccccaguucguuuccucugcccacuaaucccugcgcaggacuucc

SEQ ID NO: 75270 - RNA, 64 nt, hsa
aucucuauggacaguuccguauagacucaacucaucugcccaaccaaguauguuccuccugaau

SEQ ID NO: 75271 - RNA, 64 nt, hsa
uagcaaggcuuccuuguggguaccacaggacaacucugcccauagcaaagaugcuucaguccag

SEQ ID NO: 75272 - RNA, 64 nt, hsa
caaucuaggccuugaagaaacaaaggcuggaauaucugcccaugcuuugggcaugagaugcuca

SEQ ID NO: 75273 - RNA, 64 nt, hsa
caagagccaugccuucucucaugugugagccccuucugcccacagcugccgcgguggccccuag

SEQ ID NO: 75274 - RNA, 64 nt, hsa
gaggguggcuucuuugaggagaagggcgccaucuucugcccaccaugcuaugacgugcgcuaug

SEQ ID NO: 75275 - RNA, 64 nt, hsa
ugagggcaggaggccccugcggaggcagcguggaucugcccacacauaggcuacuggaauaguu

SEQ ID NO: 75276 - RNA, 64 nt, hsa
uugcucuagggcaacccagggcagaggggccaggucugcccagcguuuaccacugcugucaagc

SEQ ID NO: 75277 - RNA, 64 nt, hsa
gaggcuguucccuguccugccucagugccuccccucugcccagccccuguggccucuuggagag

SEQ ID NO: 75278 - RNA, 64 nt, hsa
caguuuaacaccuuaaucuuaagccauguccucaucugcccacccuccccaacccacauaccuc

SEQ ID NO: 75279 - RNA, 64 nt, hsa
cagagggaagaugaauacacuugaccccaacauuucugcccaucccugaugaccaagaccucuu

SEQ ID NO: 75280 - RNA, 64 nt, hsa
aagcgccucaccuuagcauucaaggcuugucuagucugcccaaaauuacuuauccucaccuagc

SEQ ID NO: 75281 - RNA, 64 nt, hsa
ugcucucccuccuuuccucucccuugagcuugguucugcccagcacucgugcuuguucacauaa

SEQ ID NO: 75282 - RNA, 64 nt, hsa
gcaccuuacaaacagcagucugcucccaugacccucugcccacuuccauuggucuccaggcccc

SEQ ID NO: 75283 - RNA, 64 nt, hsa
gccaggcuggucucaaauuccugaccccaggugaucugcccaccuuggccuuaaaaagugcugg

SEQ ID NO: 75284 - RNA, 64 nt, hsa
cuuaucaccccugcugggugacaagaauaaaggcucugcccaggcugaaaguuccuacccuuuu

SEQ ID NO: 75285 - RNA, 64 nt, hsa
uacacugggcagaguuggcagggugcugguucacucugcccagcccugaaugugugccuuaaag

SEQ ID NO: 75286 - RNA, 64 nt, hsa
cccugggaggugagggccugaucaaggcaccuccucugcccacucggggcccagcugugauuuu

SEQ ID NO: 75287 - RNA, 64 nt, hsa
gucaggguggucucaaacuccugaccugaggcgaucugcccaccucggccucccaaagugcugg

SEQ ID NO: 75288 - RNA, 64 nt, hsa
uugguuuaauaguuaaaagcugcuguagauuuauucugcccacaacuuggggguccuuucugga

SEQ ID NO: 75289 - RNA, 64 nt, hsa
gcguugagcguacgauggaggccuaccucucguuucugcccagcccucuguggccaggagcccu

SEQ ID NO: 75290 - RNA, 64 nt, hsa
augccacagugguacucugugucuggcaggcuacucugcccaccccagcaucagcacagcucuc

SEQ ID NO: 75291 - RNA, 64 nt, hsa
ucuuccugcccagcccccaacccagucucuggccucugcccaacgagccuggcugggcuugcaa

SEQ ID NO: 75292 - RNA, 64 nt, hsa
gugcucuccagggaggggucagacguccuugugaucugcccagggugucacggaaggagauuuu

SEQ ID NO: 75293 - RNA, 64 nt, hsa
uagggccacgcaggcaggggcgucaagggguuucucugcccaaggaagacagaacauggagaac

SEQ ID NO: 75294 - RNA, 64 nt, hsa
cuuaagccaugacuagccugguggcguguuaguuucugcccaguucuacccccucaugugcuuc

SEQ ID NO: 75295 - RNA, 64 nt, hsa
agugucugugccuuggugaccauugauugcugcuucugcccaggccgcugcaaagguuaggacu

SEQ ID NO: 75296 - RNA, 64 nt, hsa
guguagguggguuguggggucagcagagcugccaucugcccacgucuggaaaacaacacacggu

SEQ ID NO: 75297 - RNA, 64 nt, hsa
guggcucugaggcagucugcgcuguggcccugccucugcccagcgagaggccgugggcucugga

SEQ ID NO: 75298 - RNA, 64 nt, hsa
aggcgccuuccucuguccuuccugcucuuucuucucugcccaggccgcugcagcugcacagccu

SEQ ID NO: 75299 - RNA, 64 nt, hsa
gcuguagacgucccccauaggucgccccagggccucugcccacccgagccccaccacucucaga

SEQ ID NO: 75300 - RNA, 64 nt, hsa
aaaagcuccagcaggcgcugccuucacccacggaucugcccaggcugaaggcacacgcucaaug

SEQ ID NO: 75301 - RNA, 64 nt, hsa
cagccccuucccuugcucggggaaagcccccaauucugcccacacccauuuauuuccuuccuuc

SEQ ID NO: 75302 - RNA, 64 nt, hsa
ccuuccuuccuucuuuuuuguuuuugcccccaauucugcccauacccauuucuuucuuuccuuc

SEQ ID NO: 75303 - RNA, 64 nt, hsa
cagaccacacacaucuggaacgcugugggcaucuucugcccaugggcuccauuuggcaccugcu

SEQ ID NO: 75304 - RNA, 64 nt, hsa
uucuggucaguuucacacagaagucacgagggccucugcccaggaccuucuauucacauuucaa

SEQ ID NO: 75305 - RNA, 64 nt, hsa
ugugugguucaucuuuuuuuuaggccccugccugucugcccaucugccccucacccacccgagg

SEQ ID NO: 75306 - RNA, 64 nt, hsa
cugucugcccaucugccccucacccacccgaggcucugcccaccgccuggaccugcccaccccu

SEQ ID NO: 75307 - RNA, 64 nt, hsa
uggguugcagacacauugcaggucagcuucuuccucugcccaguccugcccucacuccccagug

SEQ ID NO: 75308 - RNA, 64 nt, hsa
cagggagaaucugcauguggggacacuguggagcucugcccagaugaccuuuucagggguaaca

SEQ ID NO: 75309 - RNA, 64 nt, hsa
ccucgucaccacggucaggaggagguucagacauucugcccagaggggcuggggaaagggaugg

SEQ ID NO: 75310 - RNA, 64 nt, hsa
gaacugaaggcugacaaguucugaggauuacagcucugcccaggcccuuucuacuuucccugcc

SEQ ID NO: 75311 - RNA, 64 nt, hsa
ccccucgaagugggccgggccggccccaccugccucugcccagauuugcccuccuccugcucug

SEQ ID NO: 75312 - RNA, 64 nt, hsa
caccugccucugcccagauuugcccuccuccugcucugcccaggagguggcguccagcagucca

SEQ ID NO: 75313 - RNA, 64 nt, hsa
accaccaccaacaacaucaacacagaucuucacaucugcccauucugugguuagucaauggcuu

SEQ ID NO: 75314 - RNA, 64 nt, hsa
gacuauggcuugaguaggaugaaagacaaacacaucugcccaaugauccagcugcccuuccuua

SEQ ID NO: 75315 - RNA, 64 nt, hsa
cagcugacuuauguagauuuaagcugcuaauaugcuacuuaaccaucuauuaaugcaccauuaa

SEQ ID NO: 75316 - RNA, 64 nt, hsa
ggacaaaaaaaaaaaaagccgauauaguagcuagcuacuuaagcauccauggguauugcuccau

SEQ ID NO: 75317 - RNA, 64 nt, hsa
auuuguucauuccagaaacauacugagaugucagcuacuuaaaaauggucacaaaaagcuacug

SEQ ID NO: 75318 - RNA, 64 nt, hsa
aacugagcugcugccuauagugucuuuuggaaaacuacuuaaagggugauuuucuguuacuuuu

SEQ ID NO: 75319 - RNA, 64 nt, hsa
augaauuguuaauauggcaguaauuaauuaguaucuacuuaaauuuaguggucagaaauguauu

SEQ ID NO: 75320 - RNA, 64 nt, hsa
gcuaaaaaaucacaauuuuuuuacugcuuuaauucuacuuaauuuugguagauauugaauggcu

SEQ ID NO: 75321 - RNA, 64 nt, hsa
uuaagaaaaugccuuuuacucagggaaucuccugcuacuuaauguggaaagacacgcccauguc

SEQ ID NO: 75322 - RNA, 64 nt, hsa
acccccaggacugcugcuggagccuggacacguccuacuuaagaaaaugccuuuuacucaggga

SEQ ID NO: 75323 - RNA, 64 nt, hsa
cuccaaaugcuucuuccaguucauuuuucagccaucaguucaagagccaaugccuuuuuaaaau

SEQ ID NO: 75324 - RNA, 64 nt, hsa
gauguauuuucaaauagaguucaggaucugcaauucaguucaacacaaguuuguugagcuuuaa

SEQ ID NO: 75325 - RNA, 64 nt, hsa
acaacagucuauugcauugauuuauaaauaguugucaguucacauagcaauuuaaucaaguaau

SEQ ID NO: 75326 - RNA, 64 nt, hsa
cagccaagcaacugacaaaucaaaaacccacuugucaguucaguaaaauaauuuggucaaacaa

SEQ ID NO: 75327 - RNA, 64 nt, hsa
aguuggugaguuugucaagcaacuaucgacuugaucaguucagccaagcaacugacaaaucaaa

SEQ ID NO: 75328 - RNA, 64 nt, hsa
uguaagauacacuuuaagccagacaccuaauucuucaguucacugcccaugugauacugauugc

SEQ ID NO: 75329 - RNA, 64 nt, hsa
guuaagauaaacuguaauccagacaccuaauucuucaguucacuacucaugugauacugauucc

SEQ ID NO: 75330 - RNA, 64 nt, hsa
gagcuaugaaggcucccugggaguguggcccacaucaguucaacauccucugguuuuucuaaag

SEQ ID NO: 75331 - RNA, 64 nt, hsa
uagcccagcucugaacuuucucgauaaaaugccaucaguucaccuuuaaagacacacauuccuu

SEQ ID NO: 75332 - RNA, 64 nt, hsa
gcagcuuaggaugcuauuuugagauguaugauauucaguucauucaccugauuacuuugguugc

SEQ ID NO: 75333 - RNA, 64 nt, hsa
cugggugagaauugggacucuguugcuggucuucucaguucauuuccugagguggauuuacuga

SEQ ID NO: 75334 - RNA, 64 nt, hsa
auggucucaguguuaauacugagaaaaaguccugucaguucagaaaaaaugugaagucuacuuu

SEQ ID NO: 75335 - RNA, 64 nt, hsa
aacaaaaaucaccaauauccaagacaugaagauaucaguucaacaaauacuguaguuaagagac

SEQ ID NO: 75336 - RNA, 64 nt, hsa
aauuuguaucaauacuauguuuugguuguaauauucaguucacucacccaauguacaaccaaug

SEQ ID NO: 75337 - RNA, 64 nt, hsa
aagagauaaacgaccaaacucaguucgaccaaacucaguucaaaccauuucagccaaacuguag

SEQ ID NO: 75338 - RNA, 64 nt, hsa
agguugucuguuuuuuuuuuuuuaaauaauugcaucaguucauugaccucaucauuaauaagug

SEQ ID NO: 75339 - RNA, 64 nt, hsa
uuuggaccaauauccucagauuggugcagcuuuuucaguucagauaucacaccccaaguggaua

SEQ ID NO: 75340 - RNA, 64 nt, hsa
ugugggcuacucagugcagaaccugcuguaacccucaguucaaaaaauggacuggcaaugugau

SEQ ID NO: 75341 - RNA, 64 nt, hsa
ccaagaaagaaaauguuaucgauacuaaacaccaucaguucagagggaggaugugugugugugc

SEQ ID NO: 75342 - RNA, 64 nt, hsa
agcuggugugguugcagugaccuuguagaggaaaucaguucauuacuuugacaucauucaguga

SEQ ID NO: 75343 - RNA, 64 nt, hsa
auccaguggguaaaugagagucgacuggauucugucaguucaaaaaaggaaagaaacaaaacuu

SEQ ID NO: 75344 - RNA, 64 nt, hsa
ugugccccaaguuggaugagcaaaccacuuuggaucaguucacagcauuaacuacaagugaacu

SEQ ID NO: 75345 - RNA, 64 nt, hsa; identical to SEQ ID NO: 23154

SEQ ID NO: 75346 - RNA, 64 nt, hsa; identical to SEQ ID NO: 23155

SEQ ID NO: 75347 - RNA, 64 nt, hsa; identical to SEQ ID NO: 23156

SEQ ID NO: 75348 - RNA, 64 nt, hsa; identical to SEQ ID NO: 23157

SEQ ID NO: 75349 - RNA, 64 nt, hsa
gagagggucugcccugccucacuccccucuucagucccaguagacucugcucccuagcccugag

SEQ ID NO: 75350 - RNA, 64 nt, hsa
ccucaaauuuauuuaccagucagcuucuugcuguucccaguagaaucgcuagcucuucuccaga

SEQ ID NO: 75351 - RNA, 64 nt, hsa
caaaauaagcagcuugcuucugaaaugcugucuuucccaguagcuacucaccugccucuggugg

SEQ ID NO: 75352 - RNA, 64 nt, hsa
aaguuacaggcuagcacaauaccuaacucauguuucccaguacaccuguagauauuacuguacu

SEQ ID NO: 75353 - RNA, 64 nt, hsa
gcuucauuaaacccagaaagaauguucagaaagccuauuccaucaacugugaaagcuggggaau

SEQ ID NO: 75354 - RNA, 64 nt, hsa
aagcagcaacuauucacaaaauaucaccaaaaaccuauuccacuuacauccaaggcacugucac

SEQ ID NO: 75355 - RNA, 64 nt, hsa
accuagagcuggagugaggaguagaggucuccggcuauuccagaaagaaaagugagccacaugc

SEQ ID NO: 75356 - RNA, 64 nt, hsa
auuccccaagaacaaguuacccucuggggugaggcuauuccagcgagcugggacauuuccccau

SEQ ID NO: 75357 - RNA, 64 nt, hsa
gaaauuggccgaguucaaccauucacugcaaugccuauuccaaacuuuaaaucuaucuauugca

SEQ ID NO: 75358 - RNA, 64 nt, hsa
agcgcacggcggcaaguuuucaagcacugaguuucuauuccaagaucauagacuuacuaaagag

SEQ ID NO: 75359 - RNA, 64 nt, hsa
cagaauauacauuuuuuucagcaccacaccacaccuauuccaaaauugaccacauaguuggaag

SEQ ID NO: 75360 - RNA, 64 nt, hsa
guacaaggaggagcugguacuauuccuucugaaacuauuccaaucaaugggaaaagagggaauc

SEQ ID NO: 75361 - RNA, 64 nt, hsa
ugugucuuuccauagucagggucaggcccugcaucuauuccaaggggcacucaguacacauucc

SEQ ID NO: 75362 - RNA, 64 nt, hsa
ugguggaagggaaaggugguguguccccuguucccuauuccaucucccugggacuuccugcuca

SEQ ID NO: 75363 - RNA, 64 nt, hsa
ucuccauuguauuuaaaccaaaaugaacugauacuuguuggaauguaugugaacuaauugcaau

SEQ ID NO: 75364 - RNA, 64 nt, hsa
gugucuccuuuuugccaagcacauucugauuuucuuguuggaacacaggucuaguuucuaaagg

SEQ ID NO: 75365 - RNA, 64 nt, hsa
aauguuugccuugaaugggggugaaagccuuucuuuguuggaucaaauacuacuacacuauuac

SEQ ID NO: 75366 - RNA, 53 nt, hsa
guguucuccgcgagaagugaccauuguuggagcaccauccagagcuagugacc

SEQ ID NO: 75367 - RNA, 64 nt, hsa
accaaauauaaucccaaguauccucucuccuuccuuguuggagaugucuuaccucucagcuccc

SEQ ID NO: 75368 - RNA, 64 nt, hsa
guguauuacugcaacuugaaucacucuuuuacuguuguuggauauaaacuuauccuguaccaau

SEQ ID NO: 75369 - RNA, 64 nt, hsa
uaguuagaugucuuauuauuaaaguuaccuauuauuguuggaaauaaacuaauuuguauggguu

SEQ ID NO: 75370 - RNA, 64 nt, hsa
ccuaagccuuagaagaagagaugcugucuuggucuuguuggaggagcuugcuuuaguuagaugu

SEQ ID NO: 75371 - RNA, 64 nt, hsa
uuugagauuuauuuuaucucacagguuuguguaauuguuggaaaauuuuuaaacuucuaaguga

SEQ ID NO: 75372 - RNA, 64 nt, hsa
cuuguuucucauuguaaagcuucaugucuuuuguuuguuggaaaauuuuuacuuauagaaacuu

SEQ ID NO: 75373 - RNA, 64 nt, hsa
acguagucuuuuguauuuucccugccgaagugaauuguuggagaauguaaaccgccuccacgug

SEQ ID NO: 75374 - RNA, 64 nt, hsa
uuuguucggugccagccgaccaagauugacuaguuuguuggacuuaaacgacgauuugcugcug

SEQ ID NO: 75375 - RNA, 64 nt, hsa
aaggaacuuaauuuuagagccaaauuuuucuaucuuguuggauuuuuuacaguguuuaagauag

SEQ ID NO: 75376 - RNA, 64 nt, hsa
aaagccacacaggaguaggugccacugaccucuauuguuggagacuuuguuccacuuuuuguuu

SEQ ID NO: 75377 - RNA, 64 nt, hsa
uuuaagaccaagacuauuaaaaugauuuuuaaaguuguuggagacgccaauagcaauaucuagg

SEQ ID NO: 75378 - RNA, 64 nt, hsa
uuuuaucaacagcaaacuucagccguuucacuuuuuguuggagaaaaauaguagauuuuaauuu

SEQ ID NO: 75379 - RNA, 64 nt, hsa
gagguugcugagauuguuggaacaagacgagagguuguuggagcaagaggagagguugcuggag

SEQ ID NO: 75380 - RNA, 64 nt, hsa
cgccugaacgaagagcaggaagagguugcugagauuguuggaacaagacgagagguuguuggag

SEQ ID NO: 75381 - RNA, 64 nt, hsa
caccugaaccaagagcaggaagagguugcucagguuguuggagcaagaggagaaguugcuggag

SEQ ID NO: 75382 - RNA, 65 nt, hsa
ucaucuucaguugaaugcccucacuccaagacuggaugcuggaucucauagaaaauucacagcca

SEQ ID NO: 75383 - RNA, 65 nt, hsa
acucacauaacuugauuauucacuccucugaaaagaugcuggauaggcuaccaaaguucccaagu

SEQ ID NO: 75384 - RNA, 65 nt, hsa
aggugcuugaugaugaccaggagugugcucugggaaugcuggaggucccccugugccagauccuc

SEQ ID NO: 75385 - RNA, 65 nt, hsa
uuuauggcucuagcugcguacugacuauaaaauagaugcuggacucugguugguaaggucccuuc

SEQ ID NO: 75386 - RNA, 65 nt, hsa
guuuuaguccacuauauauugcuguauuugcuuaaaugcuggaaaguaacuguuaaaaugugaaa

SEQ ID NO: 75387 - RNA, 65 nt, hsa
gaggcugcgucaggcucuuaaagucauguguuugcaugcuggaugcuauacuguccagccaggac

SEQ ID NO: 75388 - RNA, 65 nt, hsa
gucuccagagcagacuucugacaggaaagguuuagaugcuggagaguugaagagguguaagaaga

SEQ ID NO: 75389 - RNA, 65 nt, hsa
guguuuagcauucccuugucaaagugcuugacugcaugcuggaaacuuuguauuuuugaagcggc

SEQ ID NO: 75390 - RNA, 65 nt, hsa
acagcccucaccggugaauaaacauaagaaaaaucaugcuggagggaagcccuacacauguggca

SEQ ID NO: 75391 - RNA, 65 nt, hsa
uuuaauugguccucaaugcuuaauaaauauaauucaugcuggagagaaacuucacaugugaaccg

SEQ ID NO: 75392 - RNA, 65 nt, hsa
augguccucaacccuuaaugaacguaagugaauucaugcuggagcaaaaugcuucacaugcgaag

SEQ ID NO: 75393 - RNA, 65 nt, hsa
cuguaccugccagcaggagcaugauggggacuuccaugcuggaauugcucccugauuaaaaugag

SEQ ID NO: 75394 - RNA, 65 nt, hsa
ucucugcacacgcuagcucuccuucgccuucugccaugcuggaaguagccugaggcccucaccag

SEQ ID NO: 75395 - RNA, 65 nt, hsa
cuuauucuuccaaacaguaucgcuaguaaaauagcaugcuggacuucagaccucagggauccuuu

SEQ ID NO: 75396 - RNA, 65 nt, hsa
guggcagcuaaacauuaaauucgcaugaaccacagaugcuggagaucaccagaccggggagagaa

SEQ ID NO: 75397 - RNA, 65 nt, hsa
uuaggguuccugugauuaauuuugugaugacuaaaaugcuggaaagcgagugaguugcccauuaa

SEQ ID NO: 75398 - RNA, 65 nt, hsa
aaauugaauuagcauaauugggccauggaacacauaugcuggaaaucuuugaaccauuucaaguc

SEQ ID NO: 75399 - RNA, 65 nt, hsa
ggcgucacaccuguugaggagugggguggcuuugaaugcuggaaauggcuucauagugaagugcc

SEQ ID NO: 75400 - RNA, 65 nt, hsa
cuucugcccuucucgguguccaggcuccuugggugaugcuggaguugucauggccgcaguucagu

SEQ ID NO: 75401 - RNA, 65 nt, hsa
aacucccaagaaaccaggcaggcagaagcuccugaaugcuggacuagacaaacuacaugcuggcu

SEQ ID NO: 75402 - RNA, 65 nt, hsa
caaacaaguagugaucaguuuauacuuugauauuuaugcuggaaauggauagaaguucaaucaga

SEQ ID NO: 75403 - RNA, 65 nt, hsa
ggacucacauuggggcgaaugaaccaaguuucgccaugcuggaugaugaaauggauucccauccc

SEQ ID NO: 75404 - RNA, 65 nt, hsa
gccucucacccuggaaaggaguugagggacaucagaugcuggaacccucacugaaaguccagaau

SEQ ID NO: 75405 - RNA, 65 nt, hsa
uccaccccuuggugcuggcaguguuuggggacauuaugcuggaaagagcuccuagcaucagagga

SEQ ID NO: 75406 - RNA, 65 nt, hsa
guaugucaccaauauaugauuuaaaccgagcacugaugcuggacuucaugauuuuuacccucccu

SEQ ID NO: 75407 - RNA, 65 nt, hsa
auauaugagggagaacgccucacccagauuuuaucaugcuggaaagaguguauguaugugaagau

SEQ ID NO: 75408 - RNA, 65 nt, hsa
gauagagaacacaguggcuauuaaugaagaggcccaugcuggagacuggaaggguucccuugucc

SEQ ID NO: 75409 - RNA, 65 nt, hsa
cuggucucucagcaaacacuccugagugguugaagaugcuggacauuggauucuagcacuggguu

SEQ ID NO: 75410 - RNA, 65 nt, hsa
uauuacaauuaaaaauagugauguagcuguaacauaugcuggaauuggauauuuaauuuauguuu

SEQ ID NO: 75411 - RNA, 65 nt, hsa
uccuagcucugggggcaaaggggcuuaguaaaggaaugcuggauguguagaggguuuagucccga

SEQ ID NO: 75412 - RNA, 65 nt, hsa
agaggaggcugugaaugcugagaccagaguuuaucaugcuggacaagccuggaaggaggcaauaa

SEQ ID NO: 75413 - RNA, 65 nt, hsa
cccagaggcacagccggggccugccuagcacucacaugcuggacaggucugggagaggcagagug

SEQ ID NO: 75414 - RNA, 65 nt, hsa
uacacaagacuuuccccauacucugucucccuauaaugcuggagcggcuacuaaaaaggauaaaa

SEQ ID NO: 75415 - RNA, 65 nt, hsa
ugccgccccuccccgauguggugcgcucaauaaaaaugcuggaauucacagggggcuuugcugag

SEQ ID NO: 75416 - RNA, 65 nt, hsa
accacuaucucuugggagcccccaaaagcugggaaaugcuggaggaaccaggccuuucccgcuuu

SEQ ID NO: 75417 - RNA, 65 nt, hsa
ccaguacuuuacccuuaauacacauaagauaauuaaugcuggagagaaacccuacaaaugugaag

SEQ ID NO: 75418 - RNA, 65 nt, hsa
ccaauccucaacccuuacuacacauuagauaauucaugcuggagagaaacccuacaaaugugaaa

SEQ ID NO: 75419 - RNA, 65 nt, hsa
uucacauucacaccucaauagacaucagagaauccaugcuggacagaaaucuuacaaaugucauc

SEQ ID NO: 75420 - RNA, 65 nt, hsa
auaucguucauauauugcuauucaucaucgaacucaugcuggagagaaaccuuauaaaugucaug

SEQ ID NO: 75421 - RNA, 65 nt, hsa
uucacauucacaccucauuagacaucagagaauccaugcuggacagaaaucuuacaaaugucauc

SEQ ID NO: 75422 - RNA, 65 nt, hsa
acaucguucaugccuugcauuucacuggugaacucaugcuggagagaaaccuuauaaaugucaug

SEQ ID NO: 75423 - RNA, 65 nt, hsa
gaccagguugucacuugcuuguccuauaaagagccaugcuggaauuugacccaccuugggauuuu

SEQ ID NO: 75424 - RNA, 65 nt, hsa
aauguggaaggcauuccaucaacaucagagaacucaugcuggagaaagacauuccaaauauaacu

SEQ ID NO: 75425 - RNA, 65 nt, hsa
augucauuuuaaacauugguaggccuugguacaugaugcuggauuaccucucuuaaaaugacacc

SEQ ID NO: 75426 - RNA, 65 nt, hsa
gagagucuggucauguggaggugggguuuauugggaugcuggagaagagcugccaggaaguguuu

SEQ ID NO: 75427 - RNA, 63 nt, hsa
guaacucaguguuugcuugcgacuuauuuauaaauauuguaaguuugugucgaugaguguaag

SEQ ID NO: 75428 - RNA, 63 nt, hsa
ugagcgagaaaaauguggauguacuguuuguauauauuguauauauuaaaacagagauaugug

SEQ ID NO: 75429 - RNA, 63 nt, hsa
gggaauucaaauuuuucuaaacucaugguaaguauauuguaaaauacauauguacuaagaauu

SEQ ID NO: 75430 - RNA, 63 nt, hsa
ugaguacccgcuugguuuuuuuuugguaauuaaauauuguaugauuuaucugguucaaggaag

SEQ ID NO: 75431 - RNA, 63 nt, hsa
agauuuuggcacuauauuuaauuggaagguaaaauauuguacaugugauccagaguaaaugag

SEQ ID NO: 75432 - RNA, 63 nt, hsa
aacaacacuuugucagugcuuuugaaccuuucaauauuguagcaugcuugaggaguuuuuccc

SEQ ID NO: 75433 - RNA, 63 nt, hsa
cuugaaugugcaccugagggugcuuuguguaauauauuguacacuacagcaucuuauauuuuu

SEQ ID NO: 75434 - RNA, 61 nt, hsa
uaaaaagcaguuugauguagagauauuuuaaauauuguacacuuugccuuuuugaguaaca

SEQ ID NO: 75435 - RNA, 63 nt, hsa
uauucaagauguuacaaaauuuacauuuagaaaauauuguaguauuugaauacugucaacuug

SEQ ID NO: 75436 - RNA, 63 nt, hsa
uuaaauuaauuuuaauaaauuauauaauuauacauauuguaaaauaaagaccgguauuuuauu

SEQ ID NO: 75437 - RNA, 63 nt, hsa
ugcugaccacaaaguuucuggauguuuuauuaaauauuguacguguuuacaguugggaauuua

SEQ ID NO: 75438 - RNA, 63 nt, hsa
augauugcuuucagauaacaagauaccaaucuuauauuguauuuugacugcucuaaaaugauu

SEQ ID NO: 75439 - RNA, 63 nt, hsa
auugggaaaacaugagacuggucauauugaugaauauuguaacaugugaauugugauccauuu

SEQ ID NO: 75440 - RNA, 63 nt, hsa
uuuuaacauuguaaaauuuugagucagauuuuaauauuguaaaaucuugggucaaauaauuca

SEQ ID NO: 75441 - RNA, 63 nt, hsa
uuaaauauguaaauguuuuucaaaguugagguaauauuguauagaauuuuauagccuacauuu

SEQ ID NO: 75442 - RNA, 63 nt, hsa
agcucuggcugccugucagcucccuuggauacuauauuguaugauuucuuccuuucccacuaa

SEQ ID NO: 75443 - RNA, 63 nt, hsa
uuauugacugggagccugacugauguauuauauauauuguauacuguauucuuaaaguaagcu

SEQ ID NO: 75444 - RNA, 63 nt, hsa
auuugggcuuuauuuuuuucuguguacuguacuauauuguaaaagggauuuuagcagagacuu

SEQ ID NO: 75445 - RNA, 63 nt, hsa
ccagauggaagccuucuuuuucuccuuuaccucauauuguaauaaagcucugauuucugacuc

SEQ ID NO: 75446 - RNA, 63 nt, hsa
ccuaucuguaugucugccuaauuaaaaaaauauauauuguauuaugcuaccugcauuuguuua

SEQ ID NO: 75447 - RNA, 63 nt, hsa
aauacauugugcuauauguaaauguguaaauaaauauuguaauuuucucacaaagucugugaa

SEQ ID NO: 75448 - RNA, 63 nt, hsa
uuuuguguaauuuucucuuaacugauugcucugauauuguaaacacaauagauguagcucuau

SEQ ID NO: 75449 - RNA, 63 nt, hsa
cuuuuaccaugaauucuugaguuuacaucaauaauauuguauauuaaggggaucagaaguagg

SEQ ID NO: 75450 - RNA, 63 nt, hsa
gcgaacagcacuauagcaaaagaagaucguuccauauuguacgccccauuaaauuacaguguu

SEQ ID NO: 75451 - RNA, 63 nt, hsa
aguauagagacagacagcugaauggcuuucugcauauuguauaguauaccuagacauagaaac

SEQ ID NO: 75452 - RNA, 63 nt, hsa
cauaaauauuucuggcuuuugaguaguguauuuauauuguauaucauacuuucaacuguagac

SEQ ID NO: 75453 - RNA, 63 nt, hsa
gguauauucuuuaaaauaguguugauaacuggaauauuguauguaugcuuggagaugcuuugu

SEQ ID NO: 75454 - RNA, 63 nt, hsa
aaacguagcccugugcuguaucauggccauaguauauuguaaccuuugucuaaucauuggauu

SEQ ID NO: 75455 - RNA, 63 nt, hsa
ugaggagaaaacaauuccuuagaagucuuaaauauauuguacucuuuagaucucccaugugua

SEQ ID NO: 75456 - RNA, 63 nt, hsa
auauauauacacacauauacacaugccuucuauauauuguaacuuaaagaaaauacuuauaaa

SEQ ID NO: 75457 - RNA, 63 nt, hsa
uuuaugaauuuucuuuggggaucacuauagggaauauuguauagaaaauaucuucaagaaaag

SEQ ID NO: 75458 - RNA, 63 nt, hsa
cucaccuuuuauggucguagcauauaguguuguauauuguaaauuguaauuucaaccagaagu

SEQ ID NO: 75459 - RNA, 63 nt, hsa
auuguucauucagagggugauguguacauaucuauauuguauauaugugaugaaaaugcauug

SEQ ID NO: 75460 - RNA, 63 nt, hsa
uuuuguacuggcauuaacaaaaaaagagauaaaauauuguaccauuaaacuuuaauaaaacuu

SEQ ID NO: 75461 - RNA, 63 nt, hsa
uugucagcagauaucaguaacuuauugccgcuuauauuguacaauguuaaacuucaauuccug

SEQ ID NO: 75462 - RNA, 63 nt, hsa
agcugugccagcacauguucaucuuuacaauuuauauuguaaaugauuuguaucguaugauua

SEQ ID NO: 75463 - RNA, 63 nt, hsa
uguagauucuaacauuuauguaucuuuauuuucauauuguacaguaauuuuacuuuaaauuau

SEQ ID NO: 75464 - RNA, 63 nt, hsa
guucagaauuacuuuugcucuucucacgaucccauauuguauuaucacuugucuucuagaggu

SEQ ID NO: 75465 - RNA, 63 nt, hsa
auaccagaaagcucuacauuugcagauguucaaauauuguaaaacuuuggugcauuguuauuu

SEQ ID NO: 75466 - RNA, 63 nt, hsa
ucauuccaaauaagaacuagucuguuaaugaucauauuguauguagagaaaaauuuucauuga

SEQ ID NO: 75467 - RNA, 63 nt, hsa
auaaucgacuuuuuaaaugugaucaggacuauaauauuguacaguuauuauagggcuuuuggg

SEQ ID NO: 75468 - RNA, 63 nt, hsa
ugauaugaaaugagauucuauuuuugucaaaguauauuguaauaauaaugacucaaacggccc

SEQ ID NO: 75469 - RNA, 63 nt, hsa
gagugagguauauuaggagacuaguucuacacaauauuguaaugcuggguuccaucaacaccc

SEQ ID NO: 75470 - RNA, 63 nt, hsa
guauugucuguugggcugggaaaugucucuuucauauuguaaguccaggaugaacuaggagaa

SEQ ID NO: 75471 - RNA, 63 nt, hsa
gugaaugccaucuucuuccuucucuuuuuuauaauauuguacauauggauuuuuuuauuguuu

SEQ ID NO: 75472 - RNA, 63 nt, hsa
agauauaguaucucugugcggggauaugauauaauauuguauuuccuuacuguuuuaucuauu

SEQ ID NO: 75473 - RNA, 63 nt, hsa
gcaaauguccauuuguguaaauguauuuauuuuauauuguauauauuguuaaaugcaaaaagg

SEQ ID NO: 75474 - RNA, 63 nt, hsa
auacuguguaucuaucauuagcuauaugggacuauauuguagauugugguuucucaguagaga

SEQ ID NO: 75475 - RNA, 63 nt, hsa
cauaacacaaaccaguggucaaauguaaacacuauauuguagauuuacuguagguuuucaacc

SEQ ID NO: 75476 - RNA, 63 nt, hsa
uuaggaucugcaaacaaugaagaauuauguaauauauuguacaaauguaagcaaaggcucuga

SEQ ID NO: 75477 - RNA, 63 nt, hsa
cucuauauuaacgcugguuuuauaagugaccguauauuguaaagagcuguuaaaaaguauuau

SEQ ID NO: 75478 - RNA, 63 nt, hsa
uauaccaauaaaaagcauuuaaaaauuuaggggauauuguaacccaguauaauuuucugacag

SEQ ID NO: 75479 - RNA, 63 nt, hsa
auugaauuuaaaacuucuaaaaauaacaggcaaauauuguagcuauauuacagugggauuuua

SEQ ID NO: 75480 - RNA, 63 nt, hsa
caccugauuacuuugguugcagcacaacuguauauauuguauaaccgaaauugauuauuuuca

SEQ ID NO: 75481 - RNA, 63 nt, hsa
uuacauauauaucaagugugcuuagaaaaauguauauuguaaagcaggugagcuucauuugau

SEQ ID NO: 75482 - RNA, 63 nt, hsa
uagggaguagagacucauaucauggccuuuuaaauauuguaauaaaggcaaauagauauuugc

SEQ ID NO: 75483 - RNA, 63 nt, hsa
agcccuucucguuucuuuuuuaaacuaaucaccauauuguaaauuucaggguuuuuuuuuuuu

SEQ ID NO: 75484 - RNA, 63 nt, hsa
ggcaguaaauggaaaacaauacguaugucauggauauuguagguuuccuuaugcuguuuuuac

SEQ ID NO: 75485 - RNA, 63 nt, hsa
acuauauaagacauuaagagaacaaagagugaaauauuguaaaugcuauuauacuguuaucca

SEQ ID NO: 75486 - RNA, 63 nt, hsa
agauccccuaaacuugcauacccaguuuuuuggauauuguaauaaaaaaaaguauuaugacaa

SEQ ID NO: 75487 - RNA, 63 nt, hsa
uaacuuaaauaauuuaagccaauaaauaauauuauauuguauuuaacccauuauuccucaccu

SEQ ID NO: 75488 - RNA, 63 nt, hsa
ugaggcucaaugaaaccugacaaagagacuguaauauuguaguugcuccagaaugucaagggc

SEQ ID NO: 75489 - RNA, 63 nt, hsa
auuauauguaacuuuguugcucuguauggcauaauauuguauccauaaacaugguaauuuuga

SEQ ID NO: 75490 - RNA, 63 nt, hsa
auacagaauuucauggugauaucagaaauguaaauauuguacaguauugucauguacaagcgu

SEQ ID NO: 75491 - RNA, 63 nt, hsa
cuucucuuuaauucccaccuaagccucuggguaauauuguaaauauuguuuuaaaaugcauca

SEQ ID NO: 75492 - RNA, 63 nt, hsa
aguuuuauggcaugauuuauauauggcauauuuauauuguauauucuggaaaaaaaauauaua

SEQ ID NO: 75493 - RNA, 63 nt, hsa
guuauuuuauaaauaugugcauauugucauaaaauauuguaugauuaauugauuuaaauaaug

SEQ ID NO: 75494 - RNA, 63 nt, hsa
uuggaacuuccuuucagcucaagagguucagcuauauuguauuugugcaguguaaucacuacu

SEQ ID NO: 75495 - RNA, 63 nt, hsa
accucugauuuuucacucaaguuugggcugauuauauuguaaugauguuagauaauacucaac

SEQ ID NO: 75496 - RNA, 63 nt, hsa
auuuauuagccauaugcagaauuucuaaugaugauauuguacagcuucuaauucacuuuucag

SEQ ID NO: 75497 - RNA, 63 nt, hsa
uaagucauuuuauauggaaaggcuuacaaaucaauauuguaagcauucauuauuuaagaaugu

SEQ ID NO: 75498 - RNA, 63 nt, hsa
uuuuguaaaucucccauuuuuguaagaaaauauauauuguauuuauacauuuuuacuuuggau

SEQ ID NO: 75499 - RNA, 63 nt, hsa
aauuaaacugggcaauagccuaagaaggggggaauauuguaacacaaauuuaaacccacuacg

SEQ ID NO: 75500 - RNA, 63 nt, hsa
agaaggaaaaggcagggagcgagggagaagacuauauuguacacaccuuauauuuacguauga

SEQ ID NO: 75501 - RNA, 63 nt, hsa
cuuguuuaggccacuaucauagauauauuucaaauauuguacuacucaguguuaaguauugaa

SEQ ID NO: 75502 - RNA, 63 nt, hsa
uaaugaauaauaaguacaaugaaaaauacaauuauauuguaaaauuauaacugggcaagcaug

SEQ ID NO: 75503 - RNA, 63 nt, hsa
acugcccuaaaaugucucuggcaauguacagaaauauuguauauacuuacauauguaauuguu

SEQ ID NO: 75504 - RNA, 63 nt, hsa
aaugcuagacaaauaguuugcaagcagauuucuauauuguauuacaguuuugaaaacagauuu

SEQ ID NO: 75505 - RNA, 63 nt, hsa
gauaaugguuuuaaaauauguuccugauuguacauauuguaaaauaaacauguuuuuuaacau

SEQ ID NO: 75506 - RNA, 63 nt, hsa
gguaauaaaccuuaggaacuagcauauaauucuauauuguauuucucacaacaauggcuaccu

SEQ ID NO: 75507 - RNA, 63 nt, hsa
uguauuuguucuagucauuuuuauucaggcuauauauuguagcuuaauuuuuauuugcaauua

SEQ ID NO: 75508 - RNA, 63 nt, hsa
auguaacaaaacaacugaagauauguuuaauaaauauuguacuuauuggaaguaauaucaaac

SEQ ID NO: 75509 - RNA, 63 nt, hsa
cuucauacucugcauauaauuuguggcugcagaauauuguaauuuguugcacacuauguaaca

SEQ ID NO: 75510 - RNA, 63 nt, hsa
agugugugugucuacacaggauaaacccaauacauauuguacugcucagugauuaaauggguu

SEQ ID NO: 75511 - RNA, 63 nt, hsa
uguuguucaaaagauaauuggaaaaaauugaauauauuguaggauuugaauauacagccuacu

SEQ ID NO: 75512 - RNA, 63 nt, hsa
agcccagccacugucucacagauuguuuuuuguauauuguagcaaaauccugaaacaaugggg

SEQ ID NO: 75513 - RNA, 63 nt, hsa
uuuaacacauuuucuugaguaacaguucuguuaauauuguacaagaugguacuugaauucuuu

SEQ ID NO: 75514 - RNA, 63 nt, hsa
auuuuauacacccucaggcaguguuuuggaauaauauuguaccuuuucaaauuguuaucaauu

SEQ ID NO: 75515 - RNA, 63 nt, hsa
agcuaaacuacugguuagaaaguauucaguguaauauuguauuaauuuguuaaauucuaaacu

SEQ ID NO: 75516 - RNA, 63 nt, hsa
guuacacauuuuucagauauaaaagacugaccaauauuguacaguuuuuauugcuuguuggau

SEQ ID NO: 75517 - RNA, 63 nt, hsa
acaaaauagcuggcgagugcuuucuguauuuaaauauuguaaaaagaaaauaaguuauaacug

SEQ ID NO: 75518 - RNA, 58 nt, hsa
uggagacacaccaaaaguaaaauuguugauauuguauuauuuauauuuucagugaucu

SEQ ID NO: 75519 - RNA, 63 nt, hsa
gcacugaaguugucugaagguaauacuauaaauauauuguauauuuguaaauuuuggaaagau

SEQ ID NO: 75520 - RNA, 63 nt, hsa
gaaaaagguuauacguaccacggauucucuuuaauauuguacaguuaaacuguauuucugaug

SEQ ID NO: 75521 - RNA, 63 nt, hsa
uacaaauguuuaaaauauggcuuuucuaauuggauauuguauuuuuuuuaagucuucuugaag

SEQ ID NO: 75522 - RNA, 63 nt, hsa
gcuuugcacagcuugcacuuacagugauuguacauauuguacaucuuuguacagagacaucuu

SEQ ID NO: 75523 - RNA, 63 nt, hsa
uuuuuaugggaauucuuuuauauaguguucugcauauuguaauucauagggcuuuuguuuauu

SEQ ID NO: 75524 - RNA, 63 nt, hsa
auucaagccaauguuuuuugcaucaacuuuucuauauuguauguauguauauaaauacauaga

SEQ ID NO: 75525 - RNA, 63 nt, hsa
caccuuuguauuuuuauuaucagauggggcaacauauuguaugaagcauauguagcacuucac

SEQ ID NO: 75526 - RNA, 63 nt, hsa
augguaaaauaauagaaaugaucgacucuaucaauauuguauaaaaagacugaaacaaugcau

SEQ ID NO: 75527 - RNA, 63 nt, hsa
caucauucgaaucauccuuaaacacuugaauuuauauuguaugguaguauacuugguaagaua

SEQ ID NO: 75528 - RNA, 63 nt, hsa
uuccauaagcuugcugaauaguguaccgguaauauauuguauuuccaccguacucugugaauc

SEQ ID NO: 75529 - RNA, 63 nt, hsa
auuaugauuuguagcuucauauaugacauguuuauauuguaaaugcacuuuuccauggaauaa

SEQ ID NO: 75530 - RNA, 63 nt, hsa
auugcgguaucaacaaugugaauaaggauuaacauauuguaaauguucuuuuuuccauguaaa

SEQ ID NO: 75531 - RNA, 63 nt, hsa
acauuagcugcaauuuuuuuugcauuugacacaauauuguaauaauccaugauuuugaaugua

SEQ ID NO: 75532 - RNA, 63 nt, hsa
agguugcauggacuguacgaccggcaugacuuuauauuguauacagauuuugcacgccaaacu

SEQ ID NO: 75533 - RNA, 63 nt, hsa
acuuuuuuuuaguauuugcccggggggaaaaagauauuguauuaucauauaugcuuuuuugca

SEQ ID NO: 75534 - RNA, 63 nt, hsa
agcugauaaaaauuuuacauuuguaaaauuaauauauuguacugguacaaaauaguuuuaaau

SEQ ID NO: 75535 - RNA, 63 nt, hsa
uauauuuaguuguaaaccaagugaucaaacuacauauuguaaagcccauuuuuaaaauacauu

SEQ ID NO: 75536 - RNA, 63 nt, hsa
caauagccccaugaaaagaagcaucacccaaggauauuguaaaaaggauguaacaaggagaua

SEQ ID NO: 75537 - RNA, 63 nt, hsa
gggguggcacuggagagccauggcagucgugagauauuguauguguaugcacaugaucaugug

SEQ ID NO: 75538 - RNA, 63 nt, hsa
auuuucuauaauuauagagaucuuacuauuaggauauuguagcuucauuuaccaauaaauuau

SEQ ID NO: 75539 - RNA, 63 nt, hsa
ugcaacuucagggagaaauaagauuguguuugaauauuguagguagaugcauuuguaauuaag

SEQ ID NO: 75540 - RNA, 63 nt, hsa
aacuguauauaauuguuauuuuuguccuuaaaaauauuguacauacuugguuguuaacauggu

SEQ ID NO: 75541 - RNA, 63 nt, hsa
cacuguuauauuuaacuauauauaaauacgcauauauuguaauuuuaaugucugcuuagcacc

SEQ ID NO: 75542 - RNA, 63 nt, hsa
uccaccucagccacauauguguuuguguuuaggauauuguaaaucuuugcuaaguaguguuuu

SEQ ID NO: 75543 - RNA, 63 nt, hsa
aucuuagauagauauauuuuuuuuuauuuuuaaauauuguacuauuuauggugguggggcuuu

SEQ ID NO: 75544 - RNA, 63 nt, hsa
aaaaugaagaauauguagauaauggacugggauauauuguauuucucauguuaaagccucuuc

SEQ ID NO: 75545 - RNA, 63 nt, hsa
auguguuucauucuaguaagaaaaccucaaaggauauuguaggauauaaaucuuacuugaaaa

SEQ ID NO: 75546 - RNA, 63 nt, hsa
acagaugaguaaguggagguguuauguaaaggcauauuguacucgaaaucugaagaccugcag

SEQ ID NO: 75547 - RNA, 63 nt, hsa
aaucauuucauaugauuuucugccacauuaaacauauuguaugccucacaguuuacaggauuc

SEQ ID NO: 75548 - RNA, 63 nt, hsa
gaguugcuucugagguacauuuugaaugacagcauauuguaagaaaaaaaaaggugaauaaaa

SEQ ID NO: 75549 - RNA, 63 nt, hsa
gcuugguuagaguaaaggacgaggucauuagccauauuguauauaucgucaagcaacacacac

SEQ ID NO: 75550 - RNA, 63 nt, hsa
cuaguuaaauuugaauuccuuggaauuuaucguauauuguauucacugagauuaugaagggac

SEQ ID NO: 75551 - RNA, 63 nt, hsa
aacuaaucugaugaaauggaaaauuauucugcaauauuguaauucauaguuugacuuuucaua

SEQ ID NO: 75552 - RNA, 63 nt, hsa
auuaccacaaguuauguucagauuuucaagaggauauuguauuuccuuuuucccugggcuggu

SEQ ID NO: 75553 - RNA, 63 nt, hsa
ugguacaacuaaauuaaaacucuugguggucacauauuguauauaaacaaaacaauaugcuuu

SEQ ID NO: 75554 - RNA, 63 nt, hsa
uuauuaacuaauguaauguccuccucuaagaccauauuguaagagucuuguuaaaaugaugga

SEQ ID NO: 75555 - RNA, 63 nt, hsa
uaaugugugcguaucaugucacuauauauaagaauauuguaugucaugcuguuuaugugugac

SEQ ID NO: 75556 - RNA, 63 nt, hsa
cacagagcuauaaaaugcuggauugaaaauuuuauauuguaauguagagauaaaagcaguagg

SEQ ID NO: 75557 - RNA, 63 nt, hsa
cuaaaaauugaaauaaauauauauuuuuaacauauauuguacuugaauuaucucauguuggca

SEQ ID NO: 75558 - RNA, 63 nt, hsa
ucucugggaaaaaaauaugcugccuuggugcuaauauuguauguauuuaaaugaucauccgac

SEQ ID NO: 75559 - RNA, 63 nt, hsa
gaucuuuacauagcuuaguguucugauggcaaaauauuguauaugauaauaauuauguccuau

SEQ ID NO: 75560 - RNA, 63 nt, hsa
uguuaucaggaguauuuugagggagauaugauuauauuguauuuucucagauaagaaaaaugu

SEQ ID NO: 75561 - RNA, 63 nt, hsa
cagugcuugucaaauuugcugacaggucacaucauauuguaauucuauucuuugcagcucaag

SEQ ID NO: 75562 - RNA, 63 nt, hsa
gauccucaaaaggaaauauucaguuagcaguggauauuguacaagauguaacauggcuuagag

SEQ ID NO: 75563 - RNA, 63 nt, hsa
agcuuucuuagucauuuugaucaugaggguuaaauauuguaauauggauacuugaaggacuuu

SEQ ID NO: 75564 - RNA, 63 nt, hsa
aaugauguuuuauguuauuaugugugaaguaauauauuguacaaguaauaaauguauuguuga

SEQ ID NO: 75565 - RNA, 63 nt, hsa
caauaaucagagaaguguaaaauaaaacagauuauauuguacuugacccuuuaugucuuuaaa

SEQ ID NO: 75566 - RNA, 63 nt, hsa
acuuaaacaacuauuuuuugguuugguuguaauauauuguacuuuauuaagauugccaaaaac

SEQ ID NO: 75567 - RNA, 63 nt, hsa
gagugaaaauauaagcauauuuccauuaacaguauauuguacugaucagcagcucucauuuua

SEQ ID NO: 75568 - RNA, 63 nt, hsa
uaaaggcaaauuaagauauaggaccaaaacagaauauuguagauggcaguuaugaauguauau

SEQ ID NO: 75569 - RNA, 63 nt, hsa
uuuuaaggcucuguuagaaauuacacacacaguauauuguaaauucuuaucucuguauacugu

SEQ ID NO: 75570 - RNA, 63 nt, hsa
uaaugaaugcuucauaguggaaauauuugaaauauauuguaaaauacagaacagacuuauuuu

SEQ ID NO: 75571 - RNA, 63 nt, hsa
uuucuauuucagggaagaagugcuauaucuccuauauuguauuuuuguagaaaauuuguauuu

SEQ ID NO: 75572 - RNA, 63 nt, hsa
ucuaacauaguuuuuauggaccaaggaacuuguauauuguauaagcuuuaguaaaagguacau

SEQ ID NO: 75573 - RNA, 63 nt, hsa
gcauuuuauggaaagaaaguugggucugagauuauauuguaauuuuauacuuucuauagacag

SEQ ID NO: 75574 - RNA, 63 nt, hsa
uugggucauuuagaagccugacaacucauuuucauauuguaaucuauguuuauaauacuacua

SEQ ID NO: 75575 - RNA, 51 nt, hsa
acgacaugguggagcaauaguauauuguauguuguaaaguguucugucauu

SEQ ID NO: 75576 - RNA, 63 nt, hsa
ugagggcaaagaaaguccuuagauaaagagagaauauuguaugggccaucaaccauuuacuuu

SEQ ID NO: 75577 - RNA, 63 nt, hsa
aggaaaaugaagcacagaauuacucagucuuccauauuguauuugacuucauaucaaucuagu

SEQ ID NO: 75578 - RNA, 63 nt, hsa
gacaaaaacaaguaaauauauauggucauauacauauuguauauauauucauauacaaacaug

SEQ ID NO: 75579 - RNA, 63 nt, hsa
gcuguuggauuugauacauuaaaucuuaauguaauauuguaagacuuuugagaauauacuuga

SEQ ID NO: 75580 - RNA, 63 nt, hsa
uuugggauuaacuagcauuauuuugccaccuuuauauuguauuuauaaaaaaaaaaguacuau

SEQ ID NO: 75581 - RNA, 63 nt, hsa
uggguugcuuguuuuuuaggugacaaaaauaaaauauuguauuuuaauucauggguuuuuuug

SEQ ID NO: 75582 - RNA, 63 nt, hsa
augaacuuuuuucuaggacuuugguuacuauacauauuguauauuuuaagaauucuuuauaca

SEQ ID NO: 75583 - RNA, 63 nt, hsa
uuauaaaugucauuugacuaugucaaucuguauauauuguaccuuaauaugaaaaacaaauuu

SEQ ID NO: 75584 - RNA, 63 nt, hsa
uaugaaaauauuuuguuuuaaaaugaacuaugaauauuguacaguuaauuuccucacugagga

SEQ ID NO: 75585 - RNA, 63 nt, hsa
uacguagagcauucgaaguuuuauccauguuauauauuguacuccuguggcaugaaaaauagc

SEQ ID NO: 75586 - RNA, 63 nt, hsa
guuuucuuuuaugacagaggguggugaaggcagauauuguaaacuacaaccaggaaccuaugu

SEQ ID NO: 75587 - RNA, 63 nt, hsa
aauaugccgaaccuaacuacagaugacuuuuuaauauuguaaaauauuuucugcuuuuugacu

SEQ ID NO: 75588 - RNA, 63 nt, hsa
aacuucauuccuagccaugaaaguagcacgaucauauuguacuguauuguuauuguaaaauga

SEQ ID NO: 75589 - RNA, 63 nt, hsa
auaaaaugaauugcuccccagauuauuuuuuuaauauuguaugcaaucuuuauguguaacucc

SEQ ID NO: 75590 - RNA, 63 nt, hsa
uuuugggugggacauauuucaaacuucugccuuauauuguacggugcagcuagagaauuauag

SEQ ID NO: 75591 - RNA, 63 nt, hsa
aaguaguaauaaagaauaaaauacuuuacuaaaauauuguauggcuauuuucauguuugaagc

SEQ ID NO: 75592 - RNA, 63 nt, hsa
uaaagccauaguuuucuuggauuuucuuccaagauauuguauucccaagaagaaauugauuua

SEQ ID NO: 75593 - RNA, 63 nt, hsa
uaguauuacaugaacaauauuuguaugcuguauauauuguaaauauauauaauauauaaaguu

SEQ ID NO: 75594 - RNA, 63 nt, hsa
gggauuuggcuaugccuucacuacaacauuagaauauuguaacucacaugccuucuaaacgug

SEQ ID NO: 75595 - RNA, 63 nt, hsa
uuagacuuguauuccuauuuaucuauauuagaaauauuguaugagcaaauuugcagcuguugu

SEQ ID NO: 75596 - RNA, 63 nt, hsa
uguaaacauuucaacucuguaugaaaauguuaaauauuguaagaaaguuauccucucauuuuu

SEQ ID NO: 75597 - RNA, 63 nt, hsa
uuguaaaucugacuucuuugcaaguaacuauguauauuguaaauagauauaaaaggccuuuuu

SEQ ID NO: 75598 - RNA, 63 nt, hsa
cacaguccaaaauacaaauuggacagaagaucuauauuguaccagaacuauuuauuucacccc

SEQ ID NO: 75599 - RNA, 63 nt, hsa
uuucccuuguauuuuuauaauuaaaucagcaaaauauuguaauaaagaaaucuuuccugugaa

SEQ ID NO: 75600 - RNA, 63 nt, hsa
uguuaugauaaucuuucuccacuguucuaauauauauuguauuuuuauuugauagcuugggau

SEQ ID NO: 75601 - RNA, 63 nt, hsa
cugccugauuuuuuucaugugucuguguuuguaauauuguauaguaucuugugcuaggugagg

SEQ ID NO: 75602 - RNA, 63 nt, hsa
cuuugugaacaagguagaauauaaauacauaauauauuguauauauauuauaguucucuaaua

SEQ ID NO: 75603 - RNA, 63 nt, hsa
guauuuagauuccuccccccauuauucacaaucauauuguauuucggaaccccaaugcagagc

SEQ ID NO: 75604 - RNA, 63 nt, hsa
caugcugugcucuuugaagagauuucaacaagaauauuguauguuaaagcaucagagauggua

SEQ ID NO: 75605 - RNA, 63 nt, hsa
guaauguuauugaagaacuaaugaacagguaacauauuguagaaaauuagucuuucauuguuu

SEQ ID NO: 75606 - RNA, 63 nt, hsa
cucuuuacuucaaacagcaaaaaaguggggggcauauuguaguccugucauuuaaguuaugua

SEQ ID NO: 75607 - RNA, 63 nt, hsa
ucauuaauguuuuuuuguucugaaagugauauuauauuguacauguaaaauuaauuuaaauau

SEQ ID NO: 75608 - RNA, 63 nt, hsa
cuauaggaauuagauucuucuauaaaagucaccauauuguauccuauagaaaaguuaaggucu

SEQ ID NO: 75609 - RNA, 63 nt, hsa
uucuguucuauauuuucuucaccuacucuccaaauauuguaaugcaaaaagucucaguaauga

SEQ ID NO: 75610 - RNA, 63 nt, hsa
acguguucagugugaauaguguuuaaguugaaaauauuguaaaaaaauuauauuuuuucaaaa

SEQ ID NO: 75611 - RNA, 63 nt, hsa
uuuugauugcaucauuaguuaauuauuuucuucauauuguagauuuucugcagucacccauac

SEQ ID NO: 75612 - RNA, 63 nt, hsa
caauguuuauuucccccaauuuguguguauguaauauuguacggauuuacucuugauuuuucu

SEQ ID NO: 75613 - RNA, 63 nt, hsa
ucauccuccaucucaaaaugaacuuggaauuaaauauuguaagauauguauaaugcuggccau

SEQ ID NO: 75614 - RNA, 63 nt, hsa
aaccagaacaucuuuuggcauuccacuaaguauauauuguaaauuuaaugaacaaucaagguu

SEQ ID NO: 75615 - RNA, 63 nt, hsa
acuuuuuucuuuaaagcuagucauuucaaaagcauauuguauuuuuuugaaugacuacaguau

SEQ ID NO: 75616 - RNA, 63 nt, hsa
cacugcuguuuuuaugauucaggcuuauaacaaauauuguauccuuuauuucugauaagacau

SEQ ID NO: 75617 - RNA, 63 nt, hsa
acugugauugauagcauuguaagaaucgggacaauauuguauucaacuguuuuauuuuuuaua

SEQ ID NO: 75618 - RNA, 63 nt, hsa
guguaugaaucagucacaaugaauuuuacuugaauauuguauguugcauuccacuucauuuga

SEQ ID NO: 75619 - RNA, 63 nt, hsa
aaauaauggaucaauuaauuuuuuuugaagcucauauuguaucuuuuuaaaaaccauguugug

SEQ ID NO: 75620 - RNA, 63 nt, hsa
cauugcuaaucugaacuauuauuuuuauacuauauauuguaguacaauaauauagaacuguug

SEQ ID NO: 75621 - RNA, 63 nt, hsa
ucaccucagauaaaauugguaucguguaugauaauauuguaucauuuauauuugccuuauguu

SEQ ID NO: 75622 - RNA, 63 nt, hsa
auugucccccagugggcauagucagugucguuuauauuguagcaguuacagcucuguaguuua

SEQ ID NO: 75623 - RNA, 63 nt, hsa
gucucugcaagauuuuguucuuugaauuucuugauauuguaauugauuauugauaacugucau

SEQ ID NO: 75624 - RNA, 63 nt, hsa
aauuugagccuucaaacuuguaguuauccuauuauauuguaaacuaauacauugucuagcauu

SEQ ID NO: 75625 - RNA, 63 nt, hsa
uucuuuuucuuuuaguucuauucuacauucuuaauauuguauauuaccugaauaauucaauuu

SEQ ID NO: 75626 - RNA, 63 nt, hsa
aggaacauaacacuugcauucuaauuuuugcauauauuguaaaugugucugguauuuacagca

SEQ ID NO: 75627 - RNA, 63 nt, hsa
aaagugaugaguucugaacaagacaagacugucauauuguagagacuuugguaugugauacca

SEQ ID NO: 75628 - RNA, 63 nt, hsa
uugauguuuaguuugcuuuagucauuuaaaaagauauuguaccaggaugugcuauuaagagca

SEQ ID NO: 75629 - RNA, 63 nt, hsa
ugaccaaguacacauaaaauacugauuauaaaaauauuguaauaaaccacuuccucauuugau

SEQ ID NO: 75630 - RNA, 63 nt, hsa
gagaggaagguaaagaagaagagaauauuaaguauauuguaaaauaaacaaaaaauagaacuu

SEQ ID NO: 75631 - RNA, 63 nt, hsa
aaacauuaaauuauuuuguacaguuaaguguaaauauuguauguuuuguaucaauagcauaau

SEQ ID NO: 75632 - RNA, 63 nt, hsa
cagagaacuuucuuuucucugcaagaauguuacauauuguauagauaaaugagugacauuuca

SEQ ID NO: 75633 - RNA, 63 nt, hsa
uugcauuaaaaaugcauauacuuuaauaaauguauauuguauuguauacugcaugauuuuauu

SEQ ID NO: 75634 - RNA, 63 nt, hsa
guacagauguguaugggaaaccccaaccccuauauauuguaaauagaugggcugggcuaaaca

SEQ ID NO: 75635 - RNA, 63 nt, hsa
aagaaugagccaccgugccuggccuauuuuauuauauuguaauauauuuuauuauauuagcca

SEQ ID NO: 75636 - RNA, 63 nt, hsa
cuuuuauacaaaguaucuauaugagauucuucuauauuguacagaguggggcaaaacacgccc

SEQ ID NO: 75637 - RNA, 63 nt, hsa
uggggagaaauaaauuuuguuucagaauuuuguauauuguaggaauccuuugagaaugugauu

SEQ ID NO: 75638 - RNA, 63 nt, hsa
ugucaauuuuuauauguucuguguuuaguuuacauauuguaauucauuuuuaagagaguacag

SEQ ID NO: 75639 - RNA, 63 nt, hsa
guccuuuuucacuugcaccuuuuuuauaagaauauauuguaauacuaaaaaauauuaaauuca

SEQ ID NO: 75640 - RNA, 63 nt, hsa
uucuuuuaaugaccaaccuuagguaaaacaaaaauauuguaauccuagaaauuauccuccagc

SEQ ID NO: 75641 - RNA, 63 nt, hsa
uuuucucaaaugcaucaauucucuaaaauuccuauauuguaacuugccuuuuuuuaaaaaagu

SEQ ID NO: 75642 - RNA, 63 nt, hsa
agaaaaaagcaccuuugaaauuccaaacaaauuauauuguacuuguaucuuuuuaccuauuuu

SEQ ID NO: 75643 - RNA, 63 nt, hsa
cuguaaaaauagcaaccacuuauggcacuguauauauuguagacuuguuuucucuguuuuaug

SEQ ID NO: 75644 - RNA, 63 nt, hsa
uauuugcuuuuauaauugccuccuuguuuugguauauuguaaaauaauuuaaauaauguauuu

SEQ ID NO: 75645 - RNA, 63 nt, hsa
ucauacauuuaaacugucuuguucagcauaccaauauuguauguuacaaaucaucauuucuaa

SEQ ID NO: 75646 - RNA, 63 nt, hsa
uaaaaucugucaucccaugcagacaggaaaacaauauuguauaacagaccacuuccugaguag

SEQ ID NO: 75647 - RNA, 63 nt, hsa
gcccugggcccaacaguuuguacuucaugaaacauauuguacauuuuacauaguuuaauuuaa

SEQ ID NO: 75648 - RNA, 63 nt, hsa
aauccucuuguagggaucacaucuuucuuuaugauauuguauuucucuaccucuaacaguaaa

SEQ ID NO: 75649 - RNA, 63 nt, hsa
ggcgugagccaccgcgcccggcggcgaaacacgauauuguacuaacaucuuaauuuuguuaua

SEQ ID NO: 75650 - RNA, 63 nt, hsa
cagaaacaguagaaccuguguaaccucaaggagauauuguaugaaucucacuagccgcagcuu

SEQ ID NO: 75651 - RNA, 63 nt, hsa
accacauaguacuuauucagucaguguuagaggauauuguaguauuaucaaaaguauugguua

SEQ ID NO: 75652 - RNA, 63 nt, hsa
uauacauauguauauauauuuaaauacacauauauauuguacagaauaaaaauguuuuauuga

SEQ ID NO: 75653 - RNA, 63 nt, hsa
aggaacaaauaaagacaaacaacauuaagggccauauuguaagauuuccauguuaaugaucua

SEQ ID NO: 75654 - RNA, 63 nt, hsa
aacucaagcccucaaggcccaacuucucugucuauauuguaauauagaauuucgaagagacau

SEQ ID NO: 75655 - RNA, 63 nt, hsa
aaaucuaacauuauuacuuuuccucuuagaagaauauuguauuguuagauguuuguugagcug

SEQ ID NO: 75656 - RNA, 63 nt, hsa
guuuuccuuuauuucuacaucuaaaauaagaacauauuguacacuauuauauaauacagaauu

SEQ ID NO: 75657 - RNA, 63 nt, hsa
augacauauaauuuauauaugaaagcuuacgcuauauuguaugaauuauuugcaucuuucagu

SEQ ID NO: 75658 - RNA, 63 nt, hsa
aaugauuuuuuuagcauuuuaauauuuuaauauauauuguaaaauuuagacugaugauacuaa

SEQ ID NO: 75659 - RNA, 63 nt, hsa
aaaaccuguguucuuuacacacuacacguauaaauauuguaacuguucaucuuuguuguuuua

SEQ ID NO: 75660 - RNA, 63 nt, hsa
gucaacucuuaaauggagacuugagaugcuuaaauauuguacuacugugcuuaucuuguaaag

SEQ ID NO: 75661 - RNA, 63 nt, hsa
uuuccaauacaauauaaguugaaacaauguacaauauuguauauucuuuguugcaaguggcag

SEQ ID NO: 75662 - RNA, 63 nt, hsa
uuugccuguaacaagccagauuuuuuaaaauuuauauuguaaauauugugugugugugugugu

SEQ ID NO: 75663 - RNA, 63 nt, hsa
gaauucauuuauuuaauagaauauucaaaggcuauauuguaauucuaaugagaauuauauuua

SEQ ID NO: 75664 - RNA, 63 nt, hsa
aaguuauaagugucugucuuaucuuuacuacacauauuguaacaaauucaauauccuagucuu

SEQ ID NO: 75665 - RNA, 63 nt, hsa
uauacaguuauaaaauuaaaaguuugaaaagcaauauuguauauuuuuaucuauauaaaauaa

SEQ ID NO: 75666 - RNA, 63 nt, hsa
ggcuaacuuauacauauuuuuaaagaaauauuuauauuguauuuauauaauguauaaaugguu

SEQ ID NO: 75667 - RNA, 63 nt, hsa
ucaccuuuaaacgccuuuuuuuaaaauuauaaaauauuguaaagcagggucucaacuuuuaaa

SEQ ID NO: 75668 - RNA, 63 nt, hsa
ugucaauuuguauaucaugaaacacuucucaucauauuguauguaaguaauugcauuucugcu

SEQ ID NO: 75669 - RNA, 63 nt, hsa
gugagcauauauauuuuaaaauacuuucuuuggauauuguaauucuuaacugguuguaaauua

SEQ ID NO: 75670 - RNA, 63 nt, hsa
gcuuguaaaacugcauucuugggcaaaauauuuauauuguauauaaaugguuggcagcuuauu

SEQ ID NO: 75671 - RNA, 63 nt, hsa
uucuaaaauugaaagacaagaaauuuagugccaauauuguacagacagaaauuccauguauga

SEQ ID NO: 75672 - RNA, 63 nt, hsa
aaauuugguuucaaguguacaugugugaaaacaauauuguauacuaccauagugagccaugau

SEQ ID NO: 75673 - RNA, 63 nt, hsa
aagaacuguaaggcaaucgggcagugaaacuugauauuguauuaacuuaauaggaacccugug

SEQ ID NO: 75674 - RNA, 63 nt, hsa
uauuuacuucuaaucuuaaaucagaauaaauuaauauuguauugcugcugugcguggaaaaag

SEQ ID NO: 75675 - RNA, 63 nt, hsa
ugaucacuuuuuugcacuccuucuuuguuuucaauauuguauucagccuauuguaggaggggg

SEQ ID NO: 75676 - RNA, 63 nt, hsa
ucuaguuauuaaaaguugcuuguuucagcagugauauuguauaaagaacaucuuguaagauac

SEQ ID NO: 75677 - RNA, 63 nt, hsa
uuaagacauuuucaugcuuccagguaaaaacagauauuguaccauguaccuaauccaaauauc

SEQ ID NO: 75678 - RNA, 63 nt, hsa
aacugccugugaauauaucuucucucaauuggaauauuguagauaacuucugcuuuaaaaaag

SEQ ID NO: 75679 - RNA, 63 nt, hsa
agaaaccagaauuuuagacagcaagcuaaauaaauauuguaaaauugcacuauauuagguuaa

SEQ ID NO: 75680 - RNA, 63 nt, hsa
uagauugcuuccuucaugucacuuucuuuuuagauauuguacagccaguuucucagaauaaaa

SEQ ID NO: 75681 - RNA, 63 nt, hsa
uugaaauaccuauucaagaagauaguuguaaagauauuguaucuccuuuaauauacuccuuaa

SEQ ID NO: 75682 - RNA, 63 nt, hsa
uuaauauaugugccgaacaagaaaccgaaagcuauauuguacuguguauuuuuacuuuagucc

SEQ ID NO: 75683 - RNA, 63 nt, hsa
aaugcuacgugauagacaauuucagcuagccacauauuguauguaugagauucauaaagacuu

SEQ ID NO: 75684 - RNA, 63 nt, hsa
uauuucaguugagcugcuguuuucuuccaugcaauauuguauacucaauuguguauagaagaa

SEQ ID NO: 75685 - RNA, 63 nt, hsa
uuucacagcccucgacuuugcacuuaaaaagggauauuguaaaugaaaggcugcagugccagu

SEQ ID NO: 75686 - RNA, 63 nt, hsa
augcuaaacagaugucuucuugcaauauuuuaaauauuguauuugagaaaauaaacaucugag

SEQ ID NO: 75687 - RNA, 63 nt, hsa
aucgaguguugaauauaucauguaauuuauugaauauuguacauuauguugaaauugcaacca

SEQ ID NO: 75688 - RNA, 63 nt, hsa
uucaaauuuuaagcaaucauauuuucaauuuauauauuguauuucuuaauauuaugaccaaga

SEQ ID NO: 75689 - RNA, 63 nt, hsa
gaaaucucaaaacuguacugucuuuauuuuuguauauuguauuuauauauaaaaagaaacguc

SEQ ID NO: 75690 - RNA, 63 nt, hsa
uagaaaaguuuuauugguagaugaguaaauaaaauauuguaaaaaaacuuauugucuauaaag

SEQ ID NO: 75691 - RNA, 63 nt, hsa
cccuccucagucuuugggggauucaaaugcaugauauuguauguaccugggaaauuugccgau

SEQ ID NO: 75692 - RNA, 63 nt, hsa
agagagaaaccauuaaaaguuucacugucagauauauuguaggugcuaauacuggauuucguc

SEQ ID NO: 75693 - RNA, 63 nt, hsa
cauuccuguuaagcugccaaaaauuaaagugcaauauuguauauuuuuaagaacaaauuuaaa

SEQ ID NO: 75694 - RNA, 63 nt, hsa
uuucuauuuucugaccucuaagccuaaauuaagauauuguauauguaaugaugacauaguuga

SEQ ID NO: 75695 - RNA, 63 nt, hsa
uuuccauucagacaauauaucauaacuuaauaaauauuguauuuuagauauauucucuaauaa

SEQ ID NO: 75696 - RNA, 63 nt, hsa
uuuuuuuuucauuaacugagcaagacuuucaggauauuguagaugcacagaugguagguuguc

SEQ ID NO: 75697 - RNA, 63 nt, hsa
uaguucuauuagaaauaaguaguaaauuuugauauauuguacauacacacgugugugugugug

SEQ ID NO: 75698 - RNA, 63 nt, hsa
uauuuggguuuaaaaugacuaaaugcuuuaaacauauuguagcuuaagauauauguguuaaga

SEQ ID NO: 75699 - RNA, 63 nt, hsa
auucuucaccaacauuucauuugcuccuuugucauauuguaaugccaauauaauauaguuaau

SEQ ID NO: 75700 - RNA, 63 nt, hsa
ucauaauucacacaaacaucagucuuuguuuuaauauuguacuguuaaaaaaaucuaugcagc

SEQ ID NO: 75701 - RNA, 63 nt, hsa
cauuaaccauuuagaggucauuuaaauaacaaaauauuguauuguaaaagaacuguacaauuu

SEQ ID NO: 75702 - RNA, 63 nt, hsa
ccuaucaaaacagcaggaaauuuuuaaacuuuuauauuguacacuauuuuugcauaaaauaag

SEQ ID NO: 75703 - RNA, 63 nt, hsa
uuaagccuacuagagccauuguaugugacagcuauauuguauuacaaaguaaaaauauaugag

SEQ ID NO: 75704 - RNA, 63 nt, hsa
uggucaaaacggauuagggcauuugagaaaugcauauuguauuacuagaagaugaauacaaac

SEQ ID NO: 75705 - RNA, 63 nt, hsa
cuuuguuuagaaaaaaaacugaagaugaaauauauauuguaaagaagggauauuaagaaucuu

SEQ ID NO: 75706 - RNA, 63 nt, hsa
uuugagagccuugaguauuugucauucugcagaauauuguaauugcaugcauaccgauauugg

SEQ ID NO: 75707 - RNA, 63 nt, hsa
caaaucuguggugcaaccacuaucuccagugaaauauuguauaacaccauuuggaacuacuga

SEQ ID NO: 75708 - RNA, 63 nt, hsa
acacaccuuggguaguucugcuuguguuuuugcauauuguaaaagcagugucacagcuaaaaa

SEQ ID NO: 75709 - RNA, 63 nt, hsa
uuucucauaggaaguuuggucagagugaauugaauauuguaagucagccacugggacccgagg

SEQ ID NO: 75710 - RNA, 63 nt, hsa
ugagugugguugugaaugauuucuuuugaagauauauuguaguagauguuacaauuuugucgc

SEQ ID NO: 75711 - RNA, 63 nt, hsa
uugugcucuaaaauucuauuauacuacaauaauauauuguaaagauccuauagcucuuuuuuu

SEQ ID NO: 75712 - RNA, 63 nt, hsa
aauuuugguaccaguuaaaaauacaaauguacuauauuguagucauuuuaaaguacacaaagg

SEQ ID NO: 75713 - RNA, 63 nt, hsa
cuuuguuguaaaagcuaaaauaaacagcaugcuauauuguaauuguauuucuugcugaccaaa

SEQ ID NO: 75714 - RNA, 63 nt, hsa
guccuuauuuguauaaacauuuguaugcacguuauauuguaauagcuuugccuguauuuauug

SEQ ID NO: 75715 - RNA, 63 nt, hsa
uaccccaucucucucuuauaucacuugaaugauauauuguaagugagagguaaaggaaaaugu

SEQ ID NO: 75716 - RNA, 63 nt, hsa
aauguacuccugggaacuggguaggacauauccauauuguaguucccaaggugucugguugag

SEQ ID NO: 75717 - RNA, 63 nt, hsa
agauaagguagguagauaucaguugaaugccuuauauuguauacauuccuuucaaauaaagac

SEQ ID NO: 75718 - RNA, 63 nt, hsa
uaacaaaacauguucagcuuuccauuugguuaaauauuguauuuuguuauuuauuaaauuauu

SEQ ID NO: 75719 - RNA, 63 nt, hsa
uugcacauaaucaugcuauucagcauugaugcuauauuguauuauguaaauaauaaaagccau

SEQ ID NO: 75720 - RNA, 63 nt, hsa
uauccagcaccacuugcagagggcugcuuuaucauauuguacuuggguguaggacucuagugu

SEQ ID NO: 75721 - RNA, 63 nt, hsa
gaaauccaggguauucagauucugggguuuuucauauuguauuauuauuauucuuaggaauag

SEQ ID NO: 75722 - RNA, 63 nt, hsa
ucuuaaauuucagcauauguugcugcugcuuaaauauuguauaauuuacuuguauaauucuau

SEQ ID NO: 75723 - RNA, 63 nt, hsa
uuugaauuuugauuuucuauuuuuauuuuuuaaauauuguauuugugcacaauguacauuaaa

SEQ ID NO: 75724 - RNA, 63 nt, hsa
acagcuuaauaguuuaugcgugauuuucucaaaauauuguaaaacuuuugacaaugcucauua

SEQ ID NO: 75725 - RNA, 63 nt, hsa
gccuugugugccagacuaagggguuuguaguauauauuguaggcagaagagauccaucaacag

SEQ ID NO: 75726 - RNA, 63 nt, hsa
cauauauuuguaucagaacuguauuuuuauguuauauuguauaguuugcucuccugccccucu

SEQ ID NO: 75727 - RNA, 63 nt, hsa
cuacagugggcaaaacuauccaacacaaaaucuauauuguaauaaaguuguaaagaauuuuga

SEQ ID NO: 75728 - RNA, 63 nt, hsa
acacucaggugcucacaaauagagcagauugucauauuguaacaugcgugugccagacaccgg

SEQ ID NO: 75729 - RNA, 63 nt, hsa
auaaaggacaggcuggugcuaacauaaaauccaauauuguaauccuagcacuuugggaggcca

SEQ ID NO: 75730 - RNA, 63 nt, hsa
augaguuguagacacugaucugcuagugcuguaauauuguaaauacuggacucaggaacuuuu

SEQ ID NO: 75731 - RNA, 63 nt, hsa
ugccuuuugagggguucccaucaucccucccugauauuguauugaaaauauuaugcacacugu

SEQ ID NO: 75732 - RNA, 63 nt, hsa
ggcugcugggguggcccugcuuccccaguguacauauuguaucuguguaacauuuuguauauu

SEQ ID NO: 75733 - RNA, 63 nt, hsa
gaaagcccagugacaugggccagcagccacagcauauuguaaacugaagaugaccagcucgug

SEQ ID NO: 75734 - RNA, 63 nt, hsa
gaaaaaaaaaaugcugaacauugcauauaacuuauauuguaagaaauacuguacaaugacuuu

SEQ ID NO: 75735 - RNA, 63 nt, hsa
cgucuuaauuuuccauuggcuaugauggaauuaauauuguauuuuaaaaaugcauauugauca

SEQ ID NO: 75736 - RNA, 63 nt, hsa
acaguauucaguuuucucaccucuugcuauuguauauuguagauuuuuuucauucauguguua

SEQ ID NO: 75737 - RNA, 63 nt, hsa
auauaacaaaaaugaauuuuguuugauagauuuauauuguaaccuuuuucuaguucuugaaua

SEQ ID NO: 75738 - RNA, 63 nt, hsa
uuacccugcagcuacauuguugaguuagugaugauauuguauaugcucauggucuuaacugga

SEQ ID NO: 75739 - RNA, 63 nt, hsa
aaugugguuaucaaucacauacuuuuuuggauuauauuguagcaaaaaguugauuagcuuacc

SEQ ID NO: 75740 - RNA, 63 nt, hsa
cuguaaaaacuguacaaagcuaauguauuuuucauauuguaaaguuucaauuguagaaacaac

SEQ ID NO: 75741 - RNA, 63 nt, hsa
uuuuuacagugaagacuguuuucagcucuuuuuauauuguacauagucuuuuauguaauuuac

SEQ ID NO: 75742 - RNA, 63 nt, hsa
gcggggaggaaagcaaaauccaacuaaugguauauauuguaggguacagaauagagcgugugc

SEQ ID NO: 75743 - RNA, 63 nt, hsa
aaccuguguuugcauauuuuuuuggagugcagaauauuguaauuaaugucauaagugauuugg

SEQ ID NO: 75744 - RNA, 57 nt, hsa
uuaugcauucucucaaguaacuaucaaauauuguaaaugcaauugcugcuaguucag

SEQ ID NO: 75745 - RNA, 63 nt, hsa
caacugaggaccacuguccuacagagucaggaaauauuguagggagaaaaaaauaacaacaac

SEQ ID NO: 75746 - RNA, 63 nt, hsa
aaaauuuggcaaauaaugcauauaaugaaaucaauauuguaaggccugcuuuuguaaugaaaa

SEQ ID NO: 75747 - RNA, 63 nt, hsa
auuaaagugauaaaaccccauaucuguuuugguauauuguacacaaaccuacaaaaauaaacu

SEQ ID NO: 75748 - RNA, 63 nt, hsa
cucagaaucuggccuuccuuuauagcacuggucauauuguauugugcauaucugguuauuugc

SEQ ID NO: 75749 - RNA, 63 nt, hsa
guucaaugaaaggaaguuaaaaguaccuuuuacauauuguaaaaguggauacaguugauuugu

SEQ ID NO: 75750 - RNA, 63 nt, hsa
guaucuuaaaggacauaaaauuuaaaaacuuaaauauuguaauaugacagauaaccuaauaau

SEQ ID NO: 75751 - RNA, 63 nt, hsa
ucuauaacugacagauguuuauauuaaaauaaaauauuguauuaaaaauuuaaaauagguauu

SEQ ID NO: 75752 - RNA, 63 nt, hsa
aaaaauaaggaaccaugacauuguagauauuuaauauuguacaguauagaaaccuccauuuuu

SEQ ID NO: 75753 - RNA, 63 nt, hsa
auuaucgcauuaucuuggcauaauggccagaaaauauuguauugcuuggcagaaaagaaaaua

SEQ ID NO: 75754 - RNA, 63 nt, hsa
aagucagguacaaauguacacaucaaaaugcccauauuguaucuaucuguagucguuuaaugu

SEQ ID NO: 75755 - RNA, 63 nt, hsa
acgugggugcuuguguuugaccuuuucagccauauauuguacagccuuauagaaucuaagcug

SEQ ID NO: 75756 - RNA, 63 nt, hsa
gaaaggaaaugcaaacuguaaauguauaaauguauauuguauuguauguacauuuuauauuca

SEQ ID NO: 75757 - RNA, 63 nt, hsa
aacagacaauauuaguuuaggucgggaacugagauauuguaaucaaauaguuaacaucaggaa

SEQ ID NO: 75758 - RNA, 63 nt, hsa
aagggacuuuauuuuguaacauaucaauuauaaauauuguauuuaucuuugaaauuuuguaca

SEQ ID NO: 75759 - RNA, 63 nt, hsa
aacuucaaauauagagauauuuuuguacguuauauauuguauuaagggcauuuuaaaagcaau

SEQ ID NO: 75760 - RNA, 63 nt, hsa
cuuuguuuuuuaucacuuaauguuauaucuuggauauuguauuacccuggguauuaaaaagaa

SEQ ID NO: 75761 - RNA, 63 nt, hsa
ccaggaacuuuuugcuuuuaugaaaauagauucauauuguauuucccagugugucuuuuaugu

SEQ ID NO: 75762 - RNA, 63 nt, hsa
uauauauaauaugaaaagauuaacuucauagagauauuguaaguagguaauuuuauuauuuaa

SEQ ID NO: 75763 - RNA, 63 nt, hsa
uuuucacuggaauuacaaagcagaauuaaaauuauauuguagaaggaaacaccaagaaaagaa

SEQ ID NO: 75764 - RNA, 63 nt, hsa
cuuugaacuuacucaggaaagccagcccccauaauauuguauuaccaaacaguaucgcuuugu

SEQ ID NO: 75765 - RNA, 63 nt, hsa
gggcuggacuucuaccugcccucaaggguguguauauuguauaggggcaacuguaugaaaaau

SEQ ID NO: 75766 - RNA, 63 nt, hsa
aaccuuauuuuuuauuauugccaauccccuaagauauuguauuuuacaaaucucccucuuccc

SEQ ID NO: 75767 - RNA, 63 nt, hsa
ucuauaaauauaucuguauauaaagguuucuguauauuguauagagcuguguauaaacuggau

SEQ ID NO: 75768 - RNA, 63 nt, hsa
auugacaaauaccaagaauuuuugcguauguuuauauuguauuguucuaaauaauggguagcc

SEQ ID NO: 75769 - RNA, 63 nt, hsa
uacaucacagccuucucaaacagcucaagcaauauauuguauauugccauaucgucuggugaa

SEQ ID NO: 75770 - RNA, 63 nt, hsa
uuugaaaauguuuaugccacagaauuugcuaauauauuguaaucacauuccuuaggaggacuu

SEQ ID NO: 75771 - RNA, 63 nt, hsa
ugagccagcacucagcugugucagauuugauuaauauuguauuaaucucauggaugguucuca

SEQ ID NO: 75772 - RNA, 63 nt, hsa
aggaaagcaguuagcuaaguguuuaauucaugaauauuguauacugcauccccuaccacaauu

SEQ ID NO: 75773 - RNA, 63 nt, hsa
uuaaaugugaugauguaugccaaggugcuuuguauauuguaaagugcuauauaauuauaagau

SEQ ID NO: 75774 - RNA, 63 nt, hsa
caggaaggauuaccaugaacuuauuuuaaauccauauuguaccagaaugacuaugucuguguu

SEQ ID NO: 75775 - RNA, 63 nt, hsa
aggagcuguuuuuguuugaaguacugcaaaauuauauuguaacuuccccucaccccaguugca

SEQ ID NO: 75776 - RNA, 63 nt, hsa
cuagaaaaaaaaaagcaguuuccaggcccauccauauuguaauuuuucuuuaucugcagauau

SEQ ID NO: 75777 - RNA, 63 nt, hsa
aaaugguaagguacucaggaaucuggagacaagauauuguaaggaaugaacaagguugccaca

SEQ ID NO: 75778 - RNA, 63 nt, hsa
uguuaaucuuugugcuauaugguaugaaauacaauauuguacucaguguuuugaauuauuaaa

SEQ ID NO: 75779 - RNA, 63 nt, hsa
guacaaagaaauaggcauuauuuuauugcuguaauauuguaugauacuuuaacuguacaauaa

SEQ ID NO: 75780 - RNA, 63 nt, hsa
ucacccacguuccuuguaaauccaaauguuucuauauuguagcuuugcuuaaaauggggucgg

SEQ ID NO: 75781 - RNA, 63 nt, hsa
ggagacaguuucagaugauuauuuaauuuguaaauauuguacaaauuuuaauagcuuaaauug

SEQ ID NO: 75782 - RNA, 63 nt, hsa
uuuauuuaugauuaucaauuuuacauaacauuaauauuguaucagaccuccuuaugaaaauga

SEQ ID NO: 75783 - RNA, 63 nt, hsa
cacuugccauggccugaauguuggcuuaacugaauauuguaugaaaagacaugccuccauaug

SEQ ID NO: 75784 - RNA, 63 nt, hsa
caggaggaagacuagugguggauuccaugacauauauuguaauucuuuucauaggaaauguca

SEQ ID NO: 75785 - RNA, 63 nt, hsa
gagaagugacacagaguaaauggcugaucuucuauauuguaguauauuuuguccuucccucuu

SEQ ID NO: 75786 - RNA, 63 nt, hsa
caaucugcaaaacuguauagcuuugacaauuccauauuguaaauacuguguaaaucuuguuga

SEQ ID NO: 75787 - RNA, 63 nt, hsa
ccugagcccauaccuaaugaauuugugucuuaaauauuguacauuguguuugaggcuugucaa

SEQ ID NO: 75788 - RNA, 63 nt, hsa
gugaauaguuuguuaauauugcuguaaaguauuauauuguaugauuugaagacagacuauaug

SEQ ID NO: 75789 - RNA, 63 nt, hsa
agacucauuauuguuuacuggacaucaggugcuauauuguauagcauucacauuccacaggug

SEQ ID NO: 75790 - RNA, 63 nt, hsa
cagcucacagcaaaauagagcaauuauaacaauauauuguaauaaaaauuaugugaauguggu

SEQ ID NO: 75791 - RNA, 63 nt, hsa
uggagaguuuuuuauauacuguagccugauuucauauuguauuuuaaacugugugaaauuaaa

SEQ ID NO: 75792 - RNA, 63 nt, hsa
ugaacauguguauuguauauauucuguauaguuauauuguacugaaauuagcuuguuugauau

SEQ ID NO: 75793 - RNA, 63 nt, hsa
acuaucaauucauccccauaugaaucucuaaccauauuguaucucucccacuguauucauuua

SEQ ID NO: 75794 - RNA, 63 nt, hsa
uuuccaccagugauuuguauuaagacagcacuuauauuguacaauacuucagacuguuuuuuu

SEQ ID NO: 75795 - RNA, 63 nt, hsa
gaaagguacuauauuugcuagacucuagacaagauauuguacauaaaagaauuuuuuugucuu

SEQ ID NO: 75796 - RNA, 63 nt, hsa
uuuuggaaggggaggaaaauggcaaguguauuuauauuguaaccacaugcaaauaaaaagaau

SEQ ID NO: 75797 - RNA, 63 nt, hsa
cucaaucagccauaaucccugcuuucagaguuuauauuguaccugccuaauccacccggcgug

SEQ ID NO: 75798 - RNA, 63 nt, hsa
cggaauugaagucuuccccaaaaauauauguauauauuguaugucuucauccuugguagcggc

SEQ ID NO: 75799 - RNA, 63 nt, hsa
gcuaaagacauggaccuucagcaguguaagaagauauuguacaguauauuuuaaaucuaugaa

SEQ ID NO: 75800 - RNA, 63 nt, hsa
auguauauauuaugguagaaauaauauugaaggauauuguacuucacuagugcugccagagga

SEQ ID NO: 75801 - RNA, 63 nt, hsa
ucccacugucagauuauauuaucuaacaauugaauauuguaaauauacuugucuuaccucuca

SEQ ID NO: 75802 - RNA, 63 nt, hsa
uccuuuaaaagggggauuuccuuucugaaauacauauuguauuagcuucccagggcuuccaua

SEQ ID NO: 75803 - RNA, 63 nt, hsa
auaaagccuugguuaucaacagguggaauguagauauuguaaagcuuuuugugaauuaaaagu

SEQ ID NO: 75804 - RNA, 63 nt, hsa
auucaguaccauccacauuggaauauacauggaauauuguaaaaccuacaugagcagaugaaa

SEQ ID NO: 75805 - RNA, 63 nt, hsa
ucaguauuugauguggucguguaaauauguacaauauuguaaauacauaaaaaauauacaaau

SEQ ID NO: 75806 - RNA, 63 nt, hsa
gguuuuuccccaucuccuguagagcgaauuuacauauuguauuggguaaguguucacuacuuu

SEQ ID NO: 75807 - RNA, 63 nt, hsa
cugugcuggggaacaaagcuuuugcaguaccuuauauuguaguuaaaauuuuauuuaacauau

SEQ ID NO: 75808 - RNA, 63 nt, hsa
ugacuaaacgauuauaugaugagaagcaacaacauauuguauauuguucaaaugaucuucuag

SEQ ID NO: 75809 - RNA, 63 nt, hsa
cucaguggauagcacucaauuuauuccguagugauauuguaacaauacugccauucccuucua

SEQ ID NO: 75810 - RNA, 63 nt, hsa
uuaacuauuucuuuucucuuuaauccuuuaguuauauuguauuaaauaaaaauauaauacugc

SEQ ID NO: 75811 - RNA, 63 nt, hsa
ucauuuuuuuauauagacuucagcccuuuguaaauauuguaacuggggaguauagaguagaaa

SEQ ID NO: 75812 - RNA, 63 nt, hsa
aagcacuuuuuuccuuccgucaugcuucauacuauauuguauuguacuaaccccucaugcugg

SEQ ID NO: 75813 - RNA, 63 nt, hsa
aaaagaacucagauucuugaagccaccguuuucauauuguaauguuagguguucucagagggg

SEQ ID NO: 75814 - RNA, 63 nt, hsa
ugagccacugcgcccaaccuggaguguuuuuacauauuguaaaauuuuauuuccuaaccucaa

SEQ ID NO: 75815 - RNA, 63 nt, hsa
gcgaauuuugugugauuuccugcccuuugcguuauauuguauaauaccaacguaaggaaauaa

SEQ ID NO: 75816 - RNA, 63 nt, hsa
guugcuguaauaauuauuuuaagaaacuuuuaaauauuguaagaggauaucuaguuucucuau

SEQ ID NO: 75817 - RNA, 63 nt, hsa
auuaacauguuuguggaagaauauagcagacguauauuguaucauuugagugaauguucccaa

SEQ ID NO: 75818 - RNA, 63 nt, hsa
uguguaaugccuuccugaaauagucuaaaaugaauauuguacccagugacuucagugguaucc

SEQ ID NO: 75819 - RNA, 63 nt, hsa
ccaaaggaauccucaaacuucccuccaagggagauauuguaaggggaaaacaaaguguuuauu

SEQ ID NO: 75820 - RNA, 63 nt, hsa
ugaacuuuuugcauuggcuugaagcaauauaauauauuguaaacaaaacacagcucuuaccua

SEQ ID NO: 75821 - RNA, 63 nt, hsa
ucugccuauucauugauauaugauauucuguaaauauuguacaauuugaucuuuuuuaugguu

SEQ ID NO: 75822 - RNA, 63 nt, hsa
auuuuaaauauaacacucaaaaaaauguaaaucauauuguaguauucaauaguuaauaaaaac

SEQ ID NO: 75823 - RNA, 63 nt, hsa
guugccuccugagugauaaugaaguguuccuggauauuguauuguaauuuaaugugcuuacca

SEQ ID NO: 75824 - RNA, 63 nt, hsa
uacuaaauuuuugccuacaauuuaccuuguuaaauauuguagauaaauugcuaauacuaauag

SEQ ID NO: 75825 - RNA, 63 nt, hsa
ugcaaccuugucucuugcaguuuaagguaauggauauuguagcccauuugaauuuucuucacu

SEQ ID NO: 75826 - RNA, 63 nt, hsa
cugcuguucuuucuaacugacagacauguauuaauauuguacuuugaagguuauaaauaugug

SEQ ID NO: 75827 - RNA, 63 nt, hsa
cauuaaugaacaucaucauuaauuucaccuauuauauuguacccacauauauugaugucucca

SEQ ID NO: 75828 - RNA, 63 nt, hsa
aauaugauacaauuauaacguuagcuaagaagcauauuguaagucuuuagaauaguuuaauug

SEQ ID NO: 75829 - RNA, 63 nt, hsa
gaaggaauuuaaggagagguauuacuuauuuucauauuguauuuuaacuguuucucugaucaa

SEQ ID NO: 75830 - RNA, 63 nt, hsa
uguuuauuaguuuugcauaauuucagcuucuauauauuguauguauauauuuuuuaaaaaucu

SEQ ID NO: 75831 - RNA, 63 nt, hsa
gagaaagggcagcccauugcccagaauuaacacauauuguagagacuuguaugcaaagguugg

SEQ ID NO: 75832 - RNA, 63 nt, hsa
gcagcugucuuuuuauauguuuuuugacaaaucauauuguauucuuuuguacaaaaaagaacu

SEQ ID NO: 75833 - RNA, 63 nt, hsa
cuauuacacuggagcuguuuuauagauaagucaauauuguaucaggcaagauaaaccaauguc

SEQ ID NO: 75834 - RNA, 63 nt, hsa
aacauuuccuacguauuuuauuuuacauagaucauauuguauauaguuaguaucuuuauuaau

SEQ ID NO: 75835 - RNA, 63 nt, hsa
aguuuugccaguucaagaauuuaauggaaucagauauuguaagcauucuuguguaauacuuca

SEQ ID NO: 75836 - RNA, 63 nt, hsa
cuugcagcauauuagaacagacgauccaugcuaauauuguauuuucucuuaaaacauagcuuu

SEQ ID NO: 75837 - RNA, 63 nt, hsa
aguguuucuguucaaauagagaccugaauucaaauauuguaguuuagguucaaacagaguaug

SEQ ID NO: 75838 - RNA, 63 nt, hsa
ugcagaggaguuuucaagaggcuaucuggugugauauuguaauaggcugaaugcaaaagcaga

SEQ ID NO: 75839 - RNA, 63 nt, hsa
gugauaaaaauaggugagagaucauaugaucuaauauuguauugauggaaguauagguaguau

SEQ ID NO: 75840 - RNA, 63 nt, hsa
uuuugacagugaacauggucuaaaaaagggaagauauuguagaagauuucacacacacacgcg

SEQ ID NO: 75841 - RNA, 63 nt, hsa
uucuuauaaguucguugugucuagagauuguuaauauuguaauuuaauguagacuuacuuuga

SEQ ID NO: 75842 - RNA, 63 nt, hsa
uuauuuucucugguuuguacuguuauuaaaagcauauuguauuauagagcuauucagauauuu

SEQ ID NO: 75843 - RNA, 63 nt, hsa
uguuagcauucuacccagagauaauaucaauucauauuguaguguagauuuuuuuaaaguuca

SEQ ID NO: 75844 - RNA, 63 nt, hsa
ccaaugaaggacaacuaauuuauaacuuguucuauauuguaaauagcuguuuacagguuuuua

SEQ ID NO: 75845 - RNA, 63 nt, hsa
uguaagacucugauuucccuuuggacuucauguauauuguacaguuacaguaaaauucaaccu

SEQ ID NO: 75846 - RNA, 63 nt, hsa
uuuaucuauugaauaggugucaauauggcaugcauauuguaacuuucauuagaaauaaguugc

SEQ ID NO: 75847 - RNA, 63 nt, hsa
uuugucuaggcaacuagugguuauacucugcaaauauuguaaugaauuuuuacuuuuuugauu

SEQ ID NO: 75848 - RNA, 63 nt, hsa
aagacaaagacauuucaaauaacugcagaaaaaauauuguaguuugaauauuuaagcaauaaa

SEQ ID NO: 75849 - RNA, 63 nt, hsa
guaaacuuagcccacaguggcaaauaaugaguaauauuguaauauguuccaguugcaccucag

SEQ ID NO: 75850 - RNA, 63 nt, hsa
uuuucuuuaaagcccucuccuuuagaauuuaaaauauuguaccauugaagaguuuggaugugu

SEQ ID NO: 75851 - RNA, 63 nt, hsa
ucauuuuuuuauuaacagcaacuaaaauuuuauauauuguaaccaguguuaaaagucuuaaaa

SEQ ID NO: 75852 - RNA, 63 nt, hsa
gagccaucgcccagcccagaagcuaauuuuuuaauauuguauauggucuuauuuauacuugaa

SEQ ID NO: 75853 - RNA, 63 nt, hsa
uuuguaaacccugucuugucaaauaaguguauaauauuguauuauuaauuuauuuuuacuuuc

SEQ ID NO: 75854 - RNA, 63 nt, hsa
ugcauauguuaacuagcuugauuuaacuauuccauauuguauccacaauuuaugauaucacuu

SEQ ID NO: 75855 - RNA, 63 nt, hsa
uguuauucacaaaauacucauucucauuuauguauauuguauguuuaacccccagugggauuu

SEQ ID NO: 75856 - RNA, 63 nt, hsa
uuuauaaaugcaugucugauuguacuuguaacaauauuguaaugaacggcugugcaguaggcc

SEQ ID NO: 75857 - RNA, 63 nt, hsa
aauuuguuuuaugauuuaaagcaucugguuugcauauuguauuguaauacugauacaguuugg

SEQ ID NO: 75858 - RNA, 63 nt, hsa
uagguauuuauagcaugaagaaaaucagacuauauauuguagacuauguauuauucuaacaug

SEQ ID NO: 75859 - RNA, 63 nt, hsa
caccuucuuguguauauuacuuggcaugagaugauauuguacuuguauaggauucuagcaauu

SEQ ID NO: 75860 - RNA, 63 nt, hsa
caauuuuuuuaauuuuguauuuuccaagugugcauauuguacacuuuuuuggggauaugcuua

SEQ ID NO: 75861 - RNA, 63 nt, hsa
uuuuuaguguggcuuuaguauggcuuccuuuuaauauuguacauacauuguaucuuuguuuua

SEQ ID NO: 75862 - RNA, 63 nt, hsa
uccaaugcaaucaacucuguauuauauguauaaauauuguaauucugcaauuggggaaaauag

SEQ ID NO: 75863 - RNA, 63 nt, hsa
auguauauugucucguguuuuuauuuuuacaccauauuguauuacacuuuuaguauucaccag

SEQ ID NO: 75864 - RNA, 63 nt, hsa
cacuccaaucuccaccuuccugccaaccuugagauauuguaugcauauauacauauuuccuuu

SEQ ID NO: 75865 - RNA, 63 nt, hsa
auuuaauuauuuccagauaaauuucuuuauuuuauauuguacaugaaaaguuuuaaagauaug

SEQ ID NO: 75866 - RNA, 63 nt, hsa
aguuaguguucucucauuuaaugcacacugaugauauuguagggaugggugggguggggaucu

SEQ ID NO: 75867 - RNA, 63 nt, hsa
ggaauguacccauguacauaugugaacuuuuucauauuguauuaucaagguauagacuuuuuu

SEQ ID NO: 75868 - RNA, 63 nt, hsa
aacuugacagaugaaggacuuuaguugaacuucauauuguaagaacuguuaauaaaaguuguc

SEQ ID NO: 75869 - RNA, 63 nt, hsa
uuuuaaaacaguacauuccugaauaaaacaacaauauuguaucuuaaucaaggcugucugaug

SEQ ID NO: 75870 - RNA, 63 nt, hsa
uauaaguucuuaagaauguccguccuuugucauauauuguaacuuuuuuuagccuuauuuguc

SEQ ID NO: 75871 - RNA, 63 nt, hsa
cauuguagcuguucaugugucugcuucuauugcauauuguaaaauuauuaacuacuucccaaa

SEQ ID NO: 75872 - RNA, 63 nt, hsa
aauuguuuuguuaauggaaaguuuaaguaaauuauauuguaauaaaaagguagauaaaccauu

SEQ ID NO: 75873 - RNA, 63 nt, hsa
cuguguuguuacagucuuagagguugcaguacuauauuguaagcuuugguguuuguuuaauua

SEQ ID NO: 75874 - RNA, 63 nt, hsa
gccuuuuuaagcuguuucauauugaaagguggaauauuguaaaaauuuugucaaagauguacu

SEQ ID NO: 75875 - RNA, 63 nt, hsa
aacaugauuugaugcuauaaaguaggcauuuuaauauuguaaacauauacuuuggcuguauug

SEQ ID NO: 75876 - RNA, 63 nt, hsa
gaaucuccuaguaaaagucauuuuuuuaaaguaauauuguaugcuuacaaaagcuguaaaaau

SEQ ID NO: 75877 - RNA, 63 nt, hsa
cugaagaauuuucaaggcgggugggauaagauuauauuguauuuuagauuacaguaguccccc

SEQ ID NO: 75878 - RNA, 63 nt, hsa
uaagauguauuuguauguguaaacauucaauguauauuguauagucaguguauaaaauaacac

SEQ ID NO: 75879 - RNA, 63 nt, hsa
guauggguccauauguacguguguauauaauauauauuguaugugauaauaugaucguauucu

SEQ ID NO: 75880 - RNA, 63 nt, hsa
aaaaaauuuucaucuaaaguaauauuucacuuuauauuguaaagaagguagguauauuggugg

SEQ ID NO: 75881 - RNA, 63 nt, hsa
cuucaguuuugaggccauguguaaaguuuaaccauauuguaaaauaucuauuccguauuagaa

SEQ ID NO: 75882 - RNA, 63 nt, hsa
acuugguaggaaaaaaaguaggacauuauugccauauuguaugucuuaauauuuaacuuauuc

SEQ ID NO: 75883 - RNA, 63 nt, hsa
gaaugccugccuuuccugguuauuuuuuguaccauauuguaaauuauauuauuuauucuuuac

SEQ ID NO: 75884 - RNA, 63 nt, hsa
ugugugguuuaagcagugguacuguuguauaucauauuguaaaguaucauacugccaagaaaa

SEQ ID NO: 75885 - RNA, 63 nt, hsa
aagaucuauaucugguauaacuauucuuguuuuauauuguauuauacuggaacagcucguguc

SEQ ID NO: 75886 - RNA, 63 nt, hsa
uguguacgguauuuuuuauuugacuaaaucaauauauuguacagccuaaguuaauaaauguua

SEQ ID NO: 75887 - RNA, 63 nt, hsa
acuggagacagugaugaaucagcuacaaagguaauauuguauuaaaaucauguuuaagauagc

SEQ ID NO: 75888 - RNA, 63 nt, hsa
accaucucaagggaaaauggaggcuccagcagcauauuguaccgcuaccccuuugaaaggcug

SEQ ID NO: 75889 - RNA, 63 nt, hsa
cgccagcacuuaagauuauauguuuacuaauguauauuguauuuuuugguaaggaccaaaaaa

SEQ ID NO: 75890 - RNA, 63 nt, hsa
uguuguagugaaauuauacagauagaguuccauauauuguauuuguuucaaugguaaauccuu

SEQ ID NO: 75891 - RNA, 63 nt, hsa
uuucgcaaaaaaccuagcuggaauaauaaugccauauuguauuuugcacacugcuuuauuuuc

SEQ ID NO: 75892 - RNA, 63 nt, hsa
uacaaccuguaucugcuggguguucuuguuaucauauuguaaaacagcuuuaaaaauauuuau

SEQ ID NO: 75893 - RNA, 63 nt, hsa
ucaccaaaaccaccccagugccugagauugaaaauauuguaacuuucaguuagaaaucagcca

SEQ ID NO: 75894 - RNA, 63 nt, hsa
aaauaaagaccacacgguuaaagaaaucuuuccauauuguacuuuaugguguuggagugaagc

SEQ ID NO: 75895 - RNA, 63 nt, hsa
cuuaaaacccaauugagugauuugcaaacccagauauuguacauuuagaaauguuuuguuaaa

SEQ ID NO: 75896 - RNA, 63 nt, hsa
aaagauaacauuguuauucuuaagccuuauauaauauuguaacuugcauguauccauaccugg

SEQ ID NO: 75897 - RNA, 63 nt, hsa
acacauuuuuaaaccuggcaaaagaugaagagaauauuguaaauauaaaaguuuaacuguugg

SEQ ID NO: 75898 - RNA, 63 nt, hsa
cuuugggacuuugucaucuuccagaaaggaaacauauuguauauuuggcccagugugauugau

SEQ ID NO: 75899 - RNA, 63 nt, hsa
guauaauuucguuguaaaaucuguaaguuguaaauauuguacauaguuaaaucuguauucugu

SEQ ID NO: 75900 - RNA, 63 nt, hsa
cugcccggcccaagcucuacuuguguacaguguauauuguauaauagacaauugugucuacua

SEQ ID NO: 75901 - RNA, 63 nt, hsa
aacuauauauuauauguauauuuauuuuaaauaauauuguauauuuuauguuuguaaauuguu

SEQ ID NO: 75902 - RNA, 63 nt, hsa
auuuaaaguuuuuuucauuuuacgugagcaucuauauuguacagggcugggggggcccuuggc

SEQ ID NO: 75903 - RNA, 63 nt, hsa
ggucuucuagggcacaaaacucacucuagguuuauauuguauguagcuuauauuuuuuacuaa

SEQ ID NO: 75904 - RNA, 63 nt, hsa
auuuuguccuuuuacuuuuuuaaaaaauguuacauauuguaugcacugugcugaugcaagaau

SEQ ID NO: 75905 - RNA, 63 nt, hsa
ucuaagugaaauaacucaggaauggagaaccaaauauuguacauccucacuuauaagugggag

SEQ ID NO: 75906 - RNA, 63 nt, hsa
agcuguggguaaaauaugcaaacgaaaagaaauauauuguacaaauucuauauaauaagguac

SEQ ID NO: 75907 - RNA, 63 nt, hsa
accugaacugaacaccauugaaggcuuaaacccauauuguaaaacagguagaauuaucuaauu

SEQ ID NO: 75908 - RNA, 63 nt, hsa
gauuagaauguuuaguccuacuuaguaagaaaaauauuguauuuuuaaucauucauagugcug

SEQ ID NO: 75909 - RNA, 63 nt, hsa
ucauuucaccuguaaacuguaucacuuugacugauauuguaauuuucaaauguauaauauguu

SEQ ID NO: 75910 - RNA, 63 nt, hsa
auugguucuuuaucuuuauuguguucacaaaauauauuguauuaaacuuuucauuuagaaauc

SEQ ID NO: 75911 - RNA, 63 nt, hsa
cuacucagaauauaaugacuccucaucaguaucauauuguauauaaauaaugaaaugcauuaa

SEQ ID NO: 75912 - RNA, 63 nt, hsa
gaaaaucauauauccuaucuucucaaaggagaaauauuguacaauaauaugaaggcuuauauu

SEQ ID NO: 75913 - RNA, 63 nt, hsa
uaaaccaaagucucugacaagugcaccuaauuuauauuguauuuuaacuacaguguaaguuuc

SEQ ID NO: 75914 - RNA, 63 nt, hsa
uaaauggaaaacaaaaacccuacuauuucaaauauauuguacuuuuuuauuucuguaagccaa

SEQ ID NO: 75915 - RNA, 63 nt, hsa
auacacuaugugcauuuauaauagcuauuuuauauauuguaguaucaacauuuuuaaauuaaa

SEQ ID NO: 75916 - RNA, 63 nt, hsa
agauucacggacccagagcuuuuccauguguuuauauuguaaauauuuuugauuucaucaaau

SEQ ID NO: 75917 - RNA, 63 nt, hsa
guugaaacucuuauuagaaacuuucaguuggugauauuguauucuagaagauauaaaugagag

SEQ ID NO: 75918 - RNA, 63 nt, hsa
aucucagaaguaguuugcugcuaauauauacauauauuguauaaaaagguauauuuugguuuu

SEQ ID NO: 75919 - RNA, 63 nt, hsa
gcuuaaauauagucuugaagggcuuguuuugaaauauuguauauauuuuuucaaauguauaca

SEQ ID NO: 75920 - RNA, 63 nt, hsa
cagggcaggcugccguugcuaaaugauuuaauaauauuguaauucuguauuucuuugggggga

SEQ ID NO: 75921 - RNA, 63 nt, hsa
ccuugguuucagaagagaguaguuuuauuauaaauauuguauggacuuuguauauuaagagag

SEQ ID NO: 75922 - RNA, 63 nt, hsa
augagauuuuuuaagggcuuuaugugaacuaugauauuguaauuuuucuaagcauauucaaaa

SEQ ID NO: 75923 - RNA, 63 nt, hsa
gcuuacuagacgaacaaucuuucauuucuggauauauuguagcuaacccaacacauuuuuaaa

SEQ ID NO: 75924 - RNA, 63 nt, hsa
cuuugucagacauucuggagguuuccaaaaauaauauuguaaaguucaauuucaacauguaug

SEQ ID NO: 75925 - RNA, 63 nt, hsa
aguaaccacuuuaaugcaauaacuguuaucauaauauuguauuucgugguaguccuuuccugu

SEQ ID NO: 75926 - RNA, 63 nt, hsa
gaauuuuuuccuugugcuucuaguagacuuuaaauauuguaucccuuugucaaaccuuguuuc

SEQ ID NO: 75927 - RNA, 63 nt, hsa
uacacaucucacuucagaguuccauuagguuuuauauuguacuuuuccuccauuacuuauuaa

SEQ ID NO: 75928 - RNA, 63 nt, hsa
gaaauuauuuuccugagccuuuuguuuuacgguauauuguaaacuuuuauguuaaagaaaaaa

SEQ ID NO: 75929 - RNA, 63 nt, hsa
acuguauucuuauguuguuugaaaaugcuauuuauauuguaaagaagcgggcgggugccccug

SEQ ID NO: 75930 - RNA, 63 nt, hsa
cuguguaaaaauauuuuuuuuuaaucugcugccauauuguagcucaauacaaugugaauuugu

SEQ ID NO: 75931 - RNA, 63 nt, hsa
ccuuaauuuguacugucugcggcauuuuuuauaauauuguauauagugacugacaaauauugu

SEQ ID NO: 75932 - RNA, 63 nt, hsa
auuuuuuauaauauuguauauagugacugacaaauauuguauuacuguacauagagagacagg

SEQ ID NO: 75933 - RNA, 63 nt, hsa
uaaaacuugaaguagugacaccuaccugcggucauauuguagagagaugcucaguguuaaaac

SEQ ID NO: 75934 - RNA, 63 nt, hsa
auuucauuauuauuacccauacuguugccacucauauuguaagucaguuuuuucauugcuggu

SEQ ID NO: 75935 - RNA, 63 nt, hsa
ugcuuuacaggaguuugucauguauugacuuuaauauuguauuuugguaauaaauuuuuuguu

SEQ ID NO: 75936 - RNA, 63 nt, hsa
acaauggcuguagacuuguauauggcuccuuuaauauuguaaagaugcugauguacaauuguc

SEQ ID NO: 75937 - RNA, 63 nt, hsa
gcccccuuucugcccugggggcccaggauguagauauuguacaaagguuucuaaaucccuucu

SEQ ID NO: 75938 - RNA, 63 nt, hsa
gcuccagacuugggaaacuauucaugaauauuuauauuguaugguaauauaguuauugcacaa

SEQ ID NO: 75939 - RNA, 63 nt, hsa
auuucuucuuuauuuuucuguaggauggagaugauauuguagcuguuuguacauaauguaauc

SEQ ID NO: 75940 - RNA, 63 nt, hsa
ugagccaugugauaguuuuaccucauauuaaauauauuguacagaaguaaaaauaaucaugua

SEQ ID NO: 75941 - RNA, 63 nt, hsa
aauuauggauggaggaagagggagaggaaaaaaauauuguauuuuugaaucauuguugcagga

SEQ ID NO: 75942 - RNA, 63 nt, hsa
acaccuucacaggaaagcauuuauacuugagaaauauuguacaaauauaaagacugugaaaaa

SEQ ID NO: 75943 - RNA, 63 nt, hsa
cacuuauuuauaagcccucuugguugcuauuccauauuguaggaugccuuucuauuucaauug

SEQ ID NO: 75944 - RNA, 63 nt, hsa
gaauauuauuuucacauugaaacauagauguauauauuguauagauuucagacucucuuauga

SEQ ID NO: 75945 - RNA, 63 nt, hsa
guaagaugagcaauugcaacauaauauucucuaauauuguauacuguaaauuuauucagcugc

SEQ ID NO: 75946 - RNA, 63 nt, hsa
uuuaaaaaauuagagugaagaaaaaugaugaacauauuguaaugaugcuucugugaauuugaa

SEQ ID NO: 75947 - RNA, 63 nt, hsa
uugugacuuccucuaaucacgaacuaaaauuuaauauuguauauaauaccggaguauuuuaug

SEQ ID NO: 75948 - RNA, 63 nt, hsa
acccugccacugcuuucuuaacuacgugcgucaauauuguaaauccucuguuguaguuuaaac

SEQ ID NO: 75949 - RNA, 63 nt, hsa
auugcagaguacagagaacugaaccagcuccugauauuguaguuagcagucuuccuggcuucu

SEQ ID NO: 75950 - RNA, 63 nt, hsa
ugaauagauuuuuuuguaaauaugaccuuuaagauauuguauuauguaaaauauguauauacc

SEQ ID NO: 75951 - RNA, 63 nt, hsa
gacaagggaaaccaugaguaaugccacaauggcauauuguaaaugucauuuuaaacauuggua

SEQ ID NO: 75952 - RNA, 63 nt, hsa
uucaugaacuugauccuauuaauuuauaugcugauauuguacuuuagacauacgcuugucucc

SEQ ID NO: 75953 - RNA, 63 nt, hsa
agcuguuuguaagcacgauuuuuuuaacagguuauauuguacaggaucaauauuuugcuuuuu

SEQ ID NO: 75954 - RNA, 63 nt, hsa
uagaauauuucagaaauauacauuuaugucuuuauauuguaauaaauauguacauaucuaggu

SEQ ID NO: 75955 - RNA, 63 nt, hsa
uauuuauggcuaccuauguguuuguaagcagguauauuguauauuaguguauuaguaauacua

SEQ ID NO: 75956 - RNA, 63 nt, hsa
uaguacuauuccuguuguaaaguuagauuuugcauauuguaucuaucaaaauauguuuggguu

SEQ ID NO: 75957 - RNA, 63 nt, hsa
cuuucauaaguuguuaucuagucaauguaauguauauuguauugaaauuuacagugugcaaaa

SEQ ID NO: 75958 - RNA, 63 nt, hsa
cagauuguaagaucuaguccggacuugcuguguauauuguaacguuaaaugaaaaaagaaccc

SEQ ID NO: 75959 - RNA, 63 nt, hsa
aaucccuuaacaguuguauuuaacagaaauuguauauuguaauuuaaaauaauuauauaacug

SEQ ID NO: 75960 - RNA, 63 nt, hsa
ccaauacagucacacaucagcucaaaauuugcaauauuguaguucauauauuaccguuauguc

SEQ ID NO: 75961 - RNA, 63 nt, hsa
uaaguugaccuucucuuagauuauguucaaugaauauuguaaauguucaaguauuguuaauga

SEQ ID NO: 75962 - RNA, 63 nt, hsa
uaauauuaucuuaucuauugggugguaugugaaauauuguacauagaccugaugaguuguggg

SEQ ID NO: 75963 - RNA, 63 nt, hsa
gcuuuguuuuuucaguuugcuguuucuguagccauauuguauucugugucaaauaaaguccag

SEQ ID NO: 75964 - RNA, 63 nt, hsa
ugucccccuggauagaacgugcauuuaaagaauauauuguacuuacugugacagcagauaaua

SEQ ID NO: 75965 - RNA, 63 nt, hsa
aaauauguaaagugcagucuucuguauuccugcauauuguauauaccuguauauguuuuccug

SEQ ID NO: 75966 - RNA, 63 nt, hsa
uaacuagaucuaauauauaucaucagaaaauauauauuguauguuuacucuuauuuucagaaa

SEQ ID NO: 75967 - RNA, 63 nt, hsa
aaugaucagaaccauuuuacuuuaaaauuaauaauauuguauuagagaauauauuaaaugguu

SEQ ID NO: 75968 - RNA, 63 nt, hsa
uuugucaccguaucauaugugcauuuaccauguauauuguacacauucacucccuugauguca

SEQ ID NO: 75969 - RNA, 63 nt, hsa
uaggauagauagaaugguuauuuuaugcaagaaauauuguaccgcaagggugguuuggaugaa

SEQ ID NO: 75970 - RNA, 63 nt, hsa
auuuucucucuuguuuuugguuuuucaccauugauauuguauuuagaagguuucaggugggug

SEQ ID NO: 75971 - RNA, 63 nt, hsa
aguucucauguauugggggguggggguggguacauauuguauuugguauuuguguuccaguua

SEQ ID NO: 75972 - RNA, 63 nt, hsa
acagcauucaugauguuaccuucacuuuucaaaauauuguagaaggauuuuucucaugcucuu

SEQ ID NO: 75973 - RNA, 63 nt, hsa
ccuuucagcugccaguuuugaauaaugaauaucauauuguaucaucaaugcugauauuuaacu

SEQ ID NO: 75974 - RNA, 63 nt, hsa
ugugaaacgaaaaaagcaauuuucaaaugguauauauuguaucccauuuuuguaaaaaaaaug

SEQ ID NO: 75975 - RNA, 63 nt, hsa
guuauuuguguguguguguccgaucucacaaguauauuguaaacccuucggugggugggggcc

SEQ ID NO: 75976 - RNA, 63 nt, hsa
guguaaagcacagauuucaacagagugcuuggcauauuguagggugcucaauggugguuuuua

SEQ ID NO: 75977 - RNA, 63 nt, hsa
cuuaaaacgucaaucaacaaaacuuuguuuuaaauauuguaauuguggagaaaaguaaacuua

SEQ ID NO: 75978 - RNA, 63 nt, hsa
uuuucuauaauuuaaauauaugcuaagucuuauauauuguagauaauacaguucggugagcua

SEQ ID NO: 75979 - RNA, 63 nt, hsa
uguaugccaagaaaauucuuuuuauuggugccuauauuguaacaauuauuuuuaaugcauugu

SEQ ID NO: 75980 - RNA, 63 nt, hsa
auuguaacuaaaaaagcugacauugacccagacauauuguacucuuucuaaaaauaauaauaa

SEQ ID NO: 75981 - RNA, 63 nt, hsa
cauuagguuuaauuacaaaauuugaucacgaucauauuguagucucucaaagugcucuagaaa

SEQ ID NO: 75982 - RNA, 63 nt, hsa
uccuggacauucauuccagagaaaugaaaaccuauauuguacuuguacucaaauauucauagg

SEQ ID NO: 75983 - RNA, 63 nt, hsa
cuauauaaaguuacuuuuccccuuuacuuaauuauauuguagugugcagauaacaaaacugcu

SEQ ID NO: 75984 - RNA, 63 nt, hsa
aaaacguguuaucaauauagaguguugcaguguauauuguaacaaccuaaaacgcagagaagu

SEQ ID NO: 75985 - RNA, 63 nt, hsa
ugaauuuacagugaugagaaauuugugaaaaauauauuguauuucuuuugauguuucaaaagg

SEQ ID NO: 75986 - RNA, 63 nt, hsa
agcacuuucaagugagcuguugcguacuguaucauauuguagcuauuagggaagagaagaaug

SEQ ID NO: 75987 - RNA, 63 nt, hsa
gaagauaccuguguccaaaauuuuugaagauauauauuguauguguuuauucuucauauggua

SEQ ID NO: 75988 - RNA, 63 nt, hsa
caaggcagaagcuuggaggaggguuguaaaagcauauuguacccccucauuuguuuaucugau

SEQ ID NO: 75989 - RNA, 63 nt, hsa
uuuggguguaaagcguuuuugcuuaguauugugauauuguauauguuuugucccaguuguaua

SEQ ID NO: 75990 - RNA, 63 nt, hsa
uuaugaccuauuuagcaaugccuuugaaaagggauauuguauccaugguaaauuaauuguaua

SEQ ID NO: 75991 - RNA, 63 nt, hsa
cuuucuggcaugccuguacuauuauuaauguuuauauuguaccuugauuuggaaaaguauugg

SEQ ID NO: 75992 - RNA, 64 nt, hsa
acaaccacaggugucucauugcugccauuucuccugaggacauaaucacuuggucaccuuggac

SEQ ID NO: 75993 - RNA, 64 nt, hsa
caggucauggguauguggagaaugguuuggagguugaggacaaccacaggugucucauugcugc

SEQ ID NO: 75994 - RNA, 64 nt, hsa
cuggcccaaaggccugucugggcccaucuggggcugaggacacacagauacauaaugacaccug

SEQ ID NO: 75995 - RNA, 64 nt, hsa
agauacauaaugacaccugcagaaauguauucucugaggacacuuagaauaugaggaagagggu

SEQ ID NO: 75996 - RNA, 64 nt, hsa
ccccaucaguuuuccucccucucagaccugucuuugaggacaaacagauuugucagcugucagg

SEQ ID NO: 75997 - RNA, 64 nt, hsa
gagacuaugugguccaucgccuucauuguguaaaugaggacacagacuggcuuggucgcaguga

SEQ ID NO: 75998 - RNA, 64 nt, hsa
cccggggcagggugggcagggcuuuuguggguuaugaggacacagaagucccugaggcccccag

SEQ ID NO: 75999 - RNA, 64 nt, hsa
agcccccaagcaagucccuucucuagggugucccugaggacagcacagaggcgggacucagaga

SEQ ID NO: 76000 - RNA, 64 nt, hsa
auuuaaaccugagagauagguauuguuucccagaugaggacaaugaggcaaagaaauaucaagu

SEQ ID NO: 76001 - RNA, 64 nt, hsa
uaggcccuagcggcagaaaggaaaaccugaagacugaggacaaaguggaggagggccgaggugg

SEQ ID NO: 76002 - RNA, 64 nt, hsa
agagggcauaaaggagcacucaauugcagagauuugaggacauuauuuuuauuuugagcuuuaa

SEQ ID NO: 76003 - RNA, 64 nt, hsa
cacuaucauugucuucucuggacugugaagucacugaggacaaggaaacuaaauuuaaugucug

SEQ ID NO: 76004 - RNA, 64 nt, hsa
aaaugcuuauuguauugagaaccaagaugggaccugaggacacaaagaugagcucaacagucuc

SEQ ID NO: 76005 - RNA, 64 nt, hsa
uugggguauuccaugugacuuguauagguauauuugaggacagcaucuugcuagagaaaaggug

SEQ ID NO: 76006 - RNA, 64 nt, hsa
acaauggagacuuuuucaguuuuauaaagggaacugaggacagcuaauccaacuacuuggugcg

SEQ ID NO: 76007 - RNA, 64 nt, hsa
aaaaaaaaacaauggaaggcagacagcaagucccugaggacacaucacacaguguccuguagcu

SEQ ID NO: 76008 - RNA, 64 nt, hsa
aggaaaaaacaaaaacuccaaacccuucaguggaugaggacaaggucgcagaaaggcauucugu

SEQ ID NO: 76009 - RNA, 64 nt, hsa
ucaguacacaggucaggagcucacgccagggccuugaggacaggcugacccuccuccccggggu

SEQ ID NO: 76010 - RNA, 64 nt, hsa
gggcaggggaggggaagaccuggggaaggaagaaugaggacagucccgucguaagaccugucac

SEQ ID NO: 76011 - RNA, 64 nt, hsa
gauagguacagauucucuuauuuuuugcuuccucugaggacaucuuuuucucaccuucauucuc

SEQ ID NO: 76012 - RNA, 64 nt, hsa
cuaaaagcagaaaagcuaacaaaagcuucucagcugaggacacucaaggcauacaugaugacag

SEQ ID NO: 76013 - RNA, 64 nt, hsa
gcucccugggagaagcacugggucaggugaggucugaggacagcaggccuucccuaggggaagg

SEQ ID NO: 76014 - RNA, 64 nt, hsa
ugaccacugaagggugucagcagagcacacggcaugaggacagagggaggggcacggggaguga

SEQ ID NO: 76015 - RNA, 56 nt, hsa
augugguugucuccguuuaauagcacagacuugaaggaguuuaaaaggaggcugga

SEQ ID NO: 76016 - RNA, 64 nt, hsa
auuaauuuaauuacuacuagguaauaauaaugggagacuugagugauaauaggggauuuuaaaa

SEQ ID NO: 76017 - RNA, 64 nt, hsa
uaaaaaaaaaaaaaaaaaaaaaggaaaauaaaggagacuugaaauuuuugaacuaaauaguggu

SEQ ID NO: 76018 - RNA, 64 nt, hsa
gagccacugugcguggccagaacuuuauaauaagagacuugaagcugggugugacggugcacac

SEQ ID NO: 76019 - RNA, 64 nt, hsa
uaaggguuacugaucacuuaccuucuucucuuucagacuugaaucuguagacauuucuuuauug

SEQ ID NO: 76020 - RNA, 64 nt, hsa
ccaugaugcuuuccuagugccugguuacucugcgagacuugagucuaccuuuggacugccuucc

SEQ ID NO: 76021 - RNA, 64 nt, hsa
acuucgggaaggugucuggacauucagaacaccaagacuugaaggugccuugcucaauggaaga

SEQ ID NO: 76022 - RNA, 64 nt, hsa
uguuugcuaccugaacacuuauugcuuugaaacuagacuugaggaaaccaggguuuaucuuuug

SEQ ID NO: 76023 - RNA, 64 nt, hsa
aucuuuauaaagaaagauuaguguuuaagagcguagacuugagcuagacuacccagguugaaac

SEQ ID NO: 76024 - RNA, 64 nt, hsa
aggaaaaaaccuagaaaugaugguuagaaucaggagacuugagaacuacgaggaacauggcagc

SEQ ID NO: 76025 - RNA, 64 nt, hsa
cauguggaaugagaaucuugaguugcccacagacagacuugaccuuugugccagaacuguccag

SEQ ID NO: 76026 - RNA, 64 nt, hsa
accugucuguuguagaaaacaccggucccuggggagacuugaaaggccccugucccagccugga

SEQ ID NO: 76027 - RNA, 64 nt, hsa
cucacuggugaaacccaggauguagauagagggccacacccacccuguccagaguagagggcac

SEQ ID NO: 76028 - RNA, 64 nt, hsa
guggguuucccagcuaacggacaagcuccccugccacacccagugcccacgcaugcucacauac

SEQ ID NO: 76029 - RNA, 64 nt, hsa
acacacagugcuuuaagaaagggccaggugauaucacacccaaauuucacaagcacugaccccc

SEQ ID NO: 76030 - RNA, 64 nt, hsa
uguccccaaaugcaaacacaggcacacacaugcacacacccauaaacacacacacagugcuuua

SEQ ID NO: 76031 - RNA, 64 nt, hsa
uuauucaaaaauaaauaauacacucacauguuuccacacccaaaagauauauagagugaaaagu

SEQ ID NO: 76032 - RNA, 64 nt, hsa
cuccugaguagcugggauuauaggcaugcaccaccacacccagcuauuuuuuguauuuuuacug

SEQ ID NO: 76033 - RNA, 64 nt, hsa
cacccaaauagcuggaacuacaggcauauaccgccacacccagcuaauuuuauuuuuugaaaag

SEQ ID NO: 76034 - RNA, 64 nt, hsa
cugggauacugggccuugguaaagcagaggagggcacacccacaguccucuuauucucuguuuu

SEQ ID NO: 76035 - RNA, 64 nt, hsa
gucacguaagagaacaucuuccagcugccuuuuucacacccacuccagcccucugccccaguuu

SEQ ID NO: 76036 - RNA, 64 nt, hsa
cucauuuccacccaaccccaggauuuccacagcacacacccacaggccuggaccugggaugaag

SEQ ID NO: 76037 - RNA, 64 nt, hsa
gagcccaggggaaggccaggcuggaccccggcuccacacccacauccagccugcaggccucucu

SEQ ID NO: 76038 - RNA, 64 nt, hsa
uucuuuuaccugugccaccagcucuggagacauccacacccauucccagguguccuuccaggcc

SEQ ID NO: 76039 - RNA, 64 nt, hsa
gcauccugaagcaguaggaccauuagugugcgugcacacccacguggcacacuguguggugacc

SEQ ID NO: 76040 - RNA, 64 nt, hsa
ugacaacgugaccacaccacacaugccuccaacacacacccacagucuaaacaucucuccuucu

SEQ ID NO: 76041 - RNA, 64 nt, hsa
cucagugagcccuucucccauuccagaucaucagcacacccacacccaccauaggucucucucc

SEQ ID NO: 76042 - RNA, 64 nt, hsa
gagcccuucucccauuccagaucaucagcacacccacacccaccauaggucucucuccuccggu

SEQ ID NO: 76043 - RNA, 64 nt, hsa
ugaggcuccacuucuguugaauaugagcggcugucacacccaugagcaaguuuccuugauggaa

SEQ ID NO: 76044 - RNA, 64 nt, hsa
ccuguuuacucguaccaaaaaugaagacaagccccacacccaccucagcccuugcuuggccaug

SEQ ID NO: 76045 - RNA, 64 nt, hsa
uugcucauccacuucccuacacaucuauggguaucacacccaagacuacccaccaagcucauac

SEQ ID NO: 76046 - RNA, 64 nt, hsa
acccaagacuacccaccaagcucauacagggaaccacacccaacacuuagacaugcgaacaagc

SEQ ID NO: 76047 - RNA, 64 nt, hsa
ugguggcccacaccuaucuucucaccuuggaggccacacccaacuuuccaaagacccugagaca

SEQ ID NO: 76048 - RNA, 64 nt, hsa
ggccuggcagcucagcuuccccaacacgcaggagcacacccagcccccacauccugugccucca

SEQ ID NO: 76049 - RNA, 64 nt, hsa
caggcaggggggcagguacacacacacccacaggcacacccaccaguacacacgcgugcgcaua

SEQ ID NO: 76050 - RNA, 64 nt, hsa
gggagcaucuggcaggcaggggggcagguacacacacacccacaggcacacccaccaguacaca

SEQ ID NO: 76051 - RNA, 64 nt, hsa
gaagcgaggcggaugcccuggaagcacccagcaucacacccaggcuugugcggggccaggcugg

SEQ ID NO: 76052 - RNA, 64 nt, hsa
guguguucagggacugagccuggggacgcccacccacacccacugcuuccucucggcgcacccc

SEQ ID NO: 76053 - RNA, 64 nt, hsa
aucauauuugcaacucuucucucucuuucuuccccacacccaagaggaggauuggugguagggg

SEQ ID NO: 76054 - RNA, 64 nt, hsa
accuugcacugcacaaccuuccuucugcuucucccacacccaguauuugcagaagggcaaagcu

SEQ ID NO: 76055 - RNA, 64 nt, hsa
cccaggaguagcugggacuacaggugcccaccaccacacccagcuaauuuuuuuguauuuuuag

SEQ ID NO: 76056 - RNA, 64 nt, hsa
ccugaguagccggggagcuacaagcaugcaccaccacacccagcuaauuuuuuuuuuuuuuuug

SEQ ID NO: 76057 - RNA, 64 nt, hsa
aagaaauccccaagaucaucugggucucccucuccacacccagaacugaggcuuggauaucuuc

SEQ ID NO: 76058 - RNA, 64 nt, hsa
ucccuccaggcuugggcagggagacucgcagaugcacacccacaaguauucaguucucaaacuc

SEQ ID NO: 76059 - RNA, 52 nt, hsa
ugauacagaagaucagcuaagacacacccagcccagauucaacaggaaaccg

SEQ ID NO: 76060 - RNA, 64 nt, hsa
ucuucagaggagcuggaacugucuaccccagggacacacccauuucguugcuacccaaguggau

SEQ ID NO: 76061 - RNA, 64 nt, hsa
uucagcauguuggucagagacacggucacugauucacacccagucccugccacagaccgucuca

SEQ ID NO: 76062 - RNA, 64 nt, hsa
ucucagacacgcacagugggccugcugcaugauucacacccagucccugccacagaccgucuca

SEQ ID NO: 76063 - RNA, 64 nt, hsa; identical to SEQ ID NO: 76062

SEQ ID NO: 76064 - RNA, 64 nt, hsa
cuccccauggggcagaguggucuccuuacgugcucacacccagucagcuugggucccuaucucu

SEQ ID NO: 76065 - RNA, 64 nt, hsa
gagcaaaccgauggucagggagagggcuagagcucacacccagcucggaauagaucuucccuga

SEQ ID NO: 76066 - RNA, 64 nt, hsa
cucacccaucccaccccuccauuggcucccaagucacacccacucccuuccccauagauaggcc

SEQ ID NO: 76067 - RNA, 64 nt, hsa
cagaccccuagggauuuaaagggacaccccuacacacacccaggcccaugccaaggccucccuc

SEQ ID NO: 76068 - RNA, 64 nt, hsa
gagaugggcggccccgccccagcgcagugccggccacacccaugcacugaagcuccucccugcc

SEQ ID NO: 76069 - RNA, 64 nt, hsa
aaguggggacaucaggguagcugaaggaaauccacacacccagagcaucucggaguucagacuc

SEQ ID NO: 76070 - RNA, 64 nt, hsa
cggggccuccccucccugcuaggaggcaacucgucacacccaagcugcuggccuccagucccau

SEQ ID NO: 76071 - RNA, 64 nt, hsa
uacaugcccugcuuccacguggcugccacgcugacacacccacauucaccaaacccacccgcgc

SEQ ID NO: 76072 - RNA, 64 nt, hsa
cugggcgagacccagcaguggacagcaugguccucacacccagcucccugcacacccaggccag

SEQ ID NO: 76073 - RNA, 64 nt, hsa
aguggacagcaugguccucacacccagcucccugcacacccaggccagccaccccucccgcucg

SEQ ID NO: 76074 - RNA, 64 nt, hsa
aggcaggacagccaugagguggggcugcagccggcacacccagugguggagggccggcgcugcc

SEQ ID NO: 76075 - RNA, 64 nt, hsa
aaggucccugcguggggaggugucacaccaggggcacacccagggccaccuggguguaggagag

SEQ ID NO: 76076 - RNA, 64 nt, hsa
cagagucaaugccuucaugggaagggcucccagccacacccagaguggcccaaagcuguugaag

SEQ ID NO: 76077 - RNA, 64 nt, hsa
ugcccucggagugccacacaugcccagaccuucucacacccacacaaauaggcucugccgugca

SEQ ID NO: 76078 - RNA, 64 nt, hsa
cucccaaguagcugggacuacaggcacacgccaccacacccaacuaauuuuuguauuuuuagua

SEQ ID NO: 76079 - RNA, 64 nt, hsa
cucccaaagugcugggauuacaggcaugagccaccacacccagcgagacgggguuucauuaugu

SEQ ID NO: 76080 - RNA, 64 nt, hsa
cccucccacaggcaagaaccagaggcccaggcugcacacccauuucagccaucaagaacccaca

SEQ ID NO: 76081 - RNA, 64 nt, hsa
uggcgggaacgcgagaagggcaccagcagcauuccacacccagcucuuccucaccuuccugucu

SEQ ID NO: 76082 - RNA, 64 nt, hsa
uggcagccgguuguaagccuugcacgggacagaccacacccaccgcaaccucauccccucagca

SEQ ID NO: 76083 - RNA, 64 nt, hsa
cauccacucucaaccccguccccuucgcacugaccacacccaccccguucggccccgccccccg

SEQ ID NO: 76084 - RNA, 64 nt, hsa
cuucccuugcucggggaaagcccccaauucugcccacacccauuuauuuccuuccuuccuuccu

SEQ ID NO: 76085 - RNA, 64 nt, hsa
ugggauuacaggcaugagccaccgugcccggcuucacacccauuucuuuaaaaaggaucccgua

SEQ ID NO: 76086 - RNA, 64 nt, hsa
gguuccugucccuccgggagaccuagagaagcugcacacccaggagcuuuccaugacccgggag

SEQ ID NO: 76087 - RNA, 64 nt, hsa
uccucugauccuguccggugccucccccaacccccacacccaugcagaacucccaggucacaug

SEQ ID NO: 76088 - RNA, 64 nt, hsa
ugugggccaggugcauucacucagaguggggccacacacccaucuacccaguuuccacaagaug

SEQ ID NO: 76089 - RNA, 64 nt, hsa
caucuacccaguuuccacaagauguggcuccugccacacccacagggcagccuccuccaaaucc

SEQ ID NO: 76090 - RNA, 64 nt, hsa
ugccucccaaguaacugggacuauagcaugccaccacacccagcugauuaucauauuuuuuuuu

SEQ ID NO: 76091 - RNA, 64 nt, hsa; identical to SEQ ID NO: 76090

SEQ ID NO: 76092 - RNA, 64 nt, hsa
cugacaguucccagugagagaaaugcugaaaguacacugggaucacugggacacugucuuauga

SEQ ID NO: 76093 - RNA, 64 nt, hsa
cccagugagagaaaugcugaaaguacacugggaucacugggacacugucuuaugaagguuugcu

SEQ ID NO: 76094 - RNA, 64 nt, hsa
cggaugggccacggauggagcuugccaugggaagcacugggaaguaaugggguguggggugcca

SEQ ID NO: 76095 - RNA, 64 nt, hsa
cuuuugguucuuuuauaaagacuugucuagacuccacugggaagaguccuuugcuuuggggccc

SEQ ID NO: 76096 - RNA, 64 nt, hsa
uugcagggacaguccccaccuucucuauagccggcacugggagcagccgccagcagggaaaucu

SEQ ID NO: 76097 - RNA, 64 nt, hsa
acuucugaaacacucuuguugcgaucgcuaaccucacugggacagagaaccgcagucuuucgag

SEQ ID NO: 76098 - RNA, 64 nt, hsa
gcaggaugggauugaugggcaggagggauccccgcacugggagacaggcccagguaugaaugag

SEQ ID NO: 76099 - RNA, 64 nt, hsa
accucccacagcccuccacuggucuggccagaugcacugggaacagagccacggguccuggguc

SEQ ID NO: 76100 - RNA, 64 nt, hsa
uuuauagguguagcuugauuucaguucaaauccccacugggauuguuuuguuggggcaggcagg

SEQ ID NO: 76101 - RNA, 64 nt, hsa
agagagguuagguaacuugcucaaggucacacagcacugggacuggaagccagcucuguagaac

SEQ ID NO: 76102 - RNA, 64 nt, hsa
aucuauuuuauuaccuugaauauuuaauauuuuucacugggagguuugaagcuuacaaaaugag

SEQ ID NO: 76103 - RNA, 64 nt, hsa
cgaggggcugugcugcaggccuccccucgaaagacacugggaggucagcauguuccacaggugu

SEQ ID NO: 76104 - RNA, 53 nt, hsa
cagggcccccucccagcugagagcacugggacgcccaccgccccuuucccucc

SEQ ID NO: 76105 - RNA, 64 nt, hsa
uaacaauaccaauagcuaggacccggcugcugugcacugggacuggggauuccacauguuugcc

SEQ ID NO: 76106 - RNA, 64 nt, hsa
gcacuggucugacccaggacuuuggagccacccacacugggaagacuaggcuaggcagucgguc

SEQ ID NO: 76107 - RNA, 64 nt, hsa
ccucaagugauccucccaccucagccugccaaagcacugggauuacaggcaugagccaccaugc

SEQ ID NO: 76108 - RNA, 64 nt, hsa
agaguggggaugacaugcacucagcucuuggcuccacugggaugggaggagaggacaagggaaa

SEQ ID NO: 76109 - RNA, 64 nt, hsa
agacagggcugauaagcuaacaccagacagacaacacugggaaacagaggcuauuguccccuaa

SEQ ID NO: 76110 - RNA, 64 nt, hsa
cugugucaaguauaagguuuuucagcaggaguuacacugggagccugagguccucaccuuccuc

SEQ ID NO: 76111 - RNA, 64 nt, hsa
ucaugcuguccaggacuucuggcccuguguucaccacugggaaaacguacuucagacuggauag

SEQ ID NO: 76112 - RNA, 64 nt, hsa
augcauggggcucugggggaaugcugggaaaaugggcaagcagagugcacagcccucguucugc

SEQ ID NO: 76113 - RNA, 64 nt, hsa
acuacuggacuuucaacuggcuuuccuuaggucaggcaagcagacagcuccccacugaagaggu

SEQ ID NO: 76114 - RNA, 64 nt, hsa
guaccuacuauaauacaguagcuaacauguauugagcacagauuuuuuuugguaaaacugugaa

SEQ ID NO: 76115 - RNA, 64 nt, hsa
ugcaagcuuuaccaaguaauuggcaugacaucugagcacagaaauuaaggcaaaaaaccaaagc

SEQ ID NO: 76116 - RNA, 64 nt, hsa
ucugaaagcccgccucuguccuaaaauacaaacaagcacagacauuaaaccuggauacuauaug

SEQ ID NO: 76117 - RNA, 64 nt, hsa
guaauuaggugaaaacagcccagguccucccgggagcacagaggggcuaggggcugguccuucu

SEQ ID NO: 76118 - RNA, 64 nt, hsa
cuggaaaagugucccagcuuagggauaagugucuagcacagaauggggcacacaguaggugcuu

SEQ ID NO: 76119 - RNA, 64 nt, hsa
ggauggcuggauugagcaaugagcagagccaagcagcacagaguccccuggggcuagaggugga

SEQ ID NO: 76120 - RNA, 64 nt, hsa
accgggucugacaugccagugccuuccugggcugagcacagauuagagacucucccccuuguca

SEQ ID NO: 76121 - RNA, 64 nt, hsa
gaaaccccuuagagagaagcauauauggccacaaagcacagaggcuuagguuugccacaugcag

SEQ ID NO: 76122 - RNA, 64 nt, hsa
aagagcgagcccagcagcacagagaagcucugauagcacagaucagcaccaacguugaacagcu

SEQ ID NO: 76123 - RNA, 64 nt, hsa
uuuaugggcagggcccuagaagagcgagcccagcagcacagagaagcucugauagcacagauca

SEQ ID NO: 76124 - RNA, 64 nt, hsa
acagcuuccccaucgccuucuggcugcugcagucagcacagagagcggcuuccccaucgccuuc

SEQ ID NO: 76125 - RNA, 64 nt, hsa
acggcuuccccaucgccuucuggccgcugcagucagcacagagagcggcuuccccauugccuuc

SEQ ID NO: 76126 - RNA, 64 nt, hsa
ccgucagccugugaacugccaggcagcugcaguuagcacagaggauggcuuccccauugccuuc

SEQ ID NO: 76127 - RNA, 64 nt, hsa
auucaggaagauaguaucucagaaugaccagagcagcacagaaacaagcuacucugacauuaug

SEQ ID NO: 76128 - RNA, 64 nt, hsa
ugaagaacugcagccaagaccuuaauuccaggaaagcacagaggacaaaguuaauucaaaaaga

SEQ ID NO: 76129 - RNA, 64 nt, hsa
gggcacagcaccccuccccggcaucugccagcucagcacagaagacaccgaaugugcaucugga

SEQ ID NO: 76130 - RNA, 64 nt, hsa
gguuugagugaacccucuuucaaagacaauaaauagcacagaauuguccgugcuucugugaggc

SEQ ID NO: 76131 - RNA, 64 nt, hsa
uguuguuuucauuucuguuauaaguaaaacuaaaagcacagaauggugggaaaggggcuauaau

SEQ ID NO: 76132 - RNA, 64 nt, hsa
auaaacagucucuuuuuuacaaagccuguguuagagcacagauuuaccuaggcuugaagauuug

SEQ ID NO: 76133 - RNA, 64 nt, hsa
ugggcuuccuggagcagaagcagcaacuuguccuagcacagauggccagccccuuagacagagg

SEQ ID NO: 76134 - RNA, 64 nt, hsa
cuuuuauaucccauuuauagaugggggaaagcaaagcacagagagucuggauaacuuccacagg

SEQ ID NO: 76135 - RNA, 64 nt, hsa
ccucccaccaaccaaccacacccggugggggcacagcacagaccccagagccaggaaccucuca

SEQ ID NO: 76136 - RNA, 64 nt, hsa
ccucccaccaaccagccacacccggugggggcacagcacagaccccagaggcaggaaccucuca

SEQ ID NO: 76137 - RNA, 64 nt, hsa
ccucccaccaaccagccacacccagugggggcacagcacagaccccagagccaggaaccucuca

SEQ ID NO: 76138 - RNA, 64 nt, hsa
ccucccaccaaccagccacucccgguggggacacagcacagaccccaaagccaggaaccucuca

SEQ ID NO: 76139 - RNA, 64 nt, hsa
cuccaucuguuugguggggguagagcugauccagagcacagaucuguuucgugcauuggaagac

SEQ ID NO: 76140 - RNA, 64 nt, hsa
ugcccgccucuaguucccaaggcguccgcgcgccagcacagaaacagaggagagucccagagca

SEQ ID NO: 76141 - RNA, 64 nt, hsa
ccugccucuccaucucucaccaaggcugcgucaaagcacagaggcuccccggacucggaggggg

SEQ ID NO: 76142 - RNA, 64 nt, hsa
ugaggagaaugauagagagugaagcagaaacaggagcacagaccucugcuguagcuuuaaugca

SEQ ID NO: 76143 - RNA, 64 nt, hsa
gacugucaagcauccccuguccccaaguuccaaaagcacagacucaaagggaaaccccccaguc

SEQ ID NO: 76144 - RNA, 64 nt, hsa
ccccgagguguguguaggaggcggaggcccgcagagcacagagcaggagaagggcuugggcccu

SEQ ID NO: 76145 - RNA, 64 nt, hsa
ggaugauuugggcauuacgaucaccucuuaccacagcacagaacauacauucuucaacagcauu

SEQ ID NO: 76146 - RNA, 64 nt, hsa
ccagagcccuacacuccacgaccugggggcucacagcacagaaccuagaagcaccugcugacac

SEQ ID NO: 76147 - RNA, 64 nt, hsa
ccgaggugggaaauggugucccugucccucccaaagcacagagcacagaaaugaggccguuuac

SEQ ID NO: 76148 - RNA, 64 nt, hsa
gggaaauggugucccugucccucccaaagcacagagcacagaaaugaggccguuuacauggcga

SEQ ID NO: 76149 - RNA, 64 nt, hsa
ccucccccaucagggcccaccgaaagcucaggggagcacagaagcccauggaagcccagggaga

SEQ ID NO: 76150 - RNA, 64 nt, hsa
cugggugggguggguguugagacccccucagaccagcacagagaccuguccuugugcagucugc

SEQ ID NO: 76151 - RNA, 64 nt, hsa
uaccugcaugcccagccuuaccccucauucucacagcacagaugagguugagaccaugcaguca

SEQ ID NO: 76152 - RNA, 64 nt, hsa
auugggaaagacucuuaauuaagaggcucaggcaagcacagaggcagcccgugggucucugucu

SEQ ID NO: 76153 - RNA, 64 nt, hsa
agugugaggacccuuuucccccgcuugcugugaaagcacagauucauugacuacaguacacugu

SEQ ID NO: 76154 - RNA, 64 nt, hsa
ccaugcauuuuuuuuuuuacaguucucaaggaagagcacagaacaauuucucauuucauauuug

SEQ ID NO: 76155 - RNA, 59 nt, hsa
ugcggaggaucuacuugugagcuaucugccccaggcaggccucgccuccagcagcccca

SEQ ID NO: 76156 - RNA, 64 nt, hsa
acgcaggacucuggagccagaguagaggcuguggcccaggcacuaccugcuggcucccaccuau

SEQ ID NO: 76157 - RNA, 64 nt, hsa
aaauguagcccauuaccacauguagccuuggagacccaggcaaggacaaguacacguguacuca

SEQ ID NO: 76158 - RNA, 64 nt, hsa
cagagaauccucaccaguucucaccaaccuuccccccaggcaagggcagcugccagcauggugc

SEQ ID NO: 76159 - RNA, 64 nt, hsa
ucccuggggacagaggccuugugucaccugccugcccaggcagcuguuugcagcugaagaaaca

SEQ ID NO: 76160 - RNA, 64 nt, hsa
ccguccuccuccaggccgccgccccuucugaggacccaggcaccaaggugcugcuggucuccug

SEQ ID NO: 76161 - RNA, 64 nt, hsa
ggaggaggcccaggccacaguaccaccccaccugcccaggcagccccucgucaccuacuccccg

SEQ ID NO: 76162 - RNA, 64 nt, hsa
agaaccagcugcaacagcugcgugcacaggagcccccaggcagucagcagccccugcagagccu

SEQ ID NO: 76163 - RNA, 64 nt, hsa
ggcugucuggcauggcucauuugggugggguuuccccaggcauaccuuaguucccugauccucu

SEQ ID NO: 76164 - RNA, 64 nt, hsa
gggaacuggugcuugcugggaaacuuggaaccuucccaggcagggaugacuccuggacagugaa

SEQ ID NO: 76165 - RNA, 64 nt, hsa
ggcugcugcaggaggccaggcccaggccagagaccccaggcagccugagcucuuggaugugguc

SEQ ID NO: 76166 - RNA, 64 nt, hsa
auucuguggcucagcacacaggacugacccacagcccaggcagcggguguguggagauggcgcc

SEQ ID NO: 76167 - RNA, 64 nt, hsa
cugcccaggcccacaagccccuccccugggcucucccaggcagggagaauggggagagggaccu

SEQ ID NO: 76168 - RNA, 64 nt, hsa
agaggaugguugucccuggggagggcccucuggccccaggcaaccuuagccccucagaacaggg

SEQ ID NO: 76169 - RNA, 64 nt, hsa
cuuuugaagagcaaagggaaaucaagaggagacccccaggcagaggggcguucucccaaagauu

SEQ ID NO: 76170 - RNA, 58 nt, hsa
ucacugagagggucccaugacggcggggcccaggcagccuccgggcgugugaagaaca

SEQ ID NO: 76171 - RNA, 64 nt, hsa
caguuaacugagaauuggagaggacaggcuaggucccaggcacagcgagggcccugggcuuggg

SEQ ID NO: 76172 - RNA, 64 nt, hsa
ggugcuggagcuaggucuccaggugggccugguucccaggcagcaggugggaacccugggccug

SEQ ID NO: 76173 - RNA, 64 nt, hsa
cuuauggcaucaggggcaaaaagucacagcuuaucccaggcacccuggcagguucucagagccu

SEQ ID NO: 76174 - RNA, 64 nt, hsa
uccucccuguuuauaugcguacagccugguaacccccaggcaugcaaauauacaaucuguaaca

SEQ ID NO: 76175 - RNA, 64 nt, hsa
uuugcacagcaugaggcaaaaauguccagccacccccaggcaucuguuagcagagucugucucu

SEQ ID NO: 76176 - RNA, 52 nt, hsa
uauucaagaaggugcagugaggcccaggcagacaaccuugucccaaggaauc

SEQ ID NO: 76177 - RNA, 64 nt, hsa
gcgccugggagucccggaaggaggagagcgcacacccaggcagcccucugcggaaacuuuccuu

SEQ ID NO: 76178 - RNA, 64 nt, hsa
cauuuguaaccaaggggugcgaaacccuggcagucccaggcagcaccaggccagggguugauuu

SEQ ID NO: 76179 - RNA, 64 nt, hsa
accgacaggcagcccaagggccuggacaccccuccccaggcaggugcugccccaggaggacugu

SEQ ID NO: 76180 - RNA, 64 nt, hsa
gggccuggggccccaagccggggcgucugagcuccccaggcaugaccaaaccucaguggagggg

SEQ ID NO: 76181 - RNA, 64 nt, hsa
cugguguucgccccggacaagcgguuaagcgcgacccaggcacugcagcaccccuacgugcaga

SEQ ID NO: 76182 - RNA, 64 nt, hsa
ccccacagaguccccccgugcagccaagaacguucccaggcagaacuccgcuccccugcuccaa

SEQ ID NO: 76183 - RNA, 64 nt, hsa
ucacugggagcccuugguguucugagcagcagggcccaggcagcacaugagcagugcccagggg

SEQ ID NO: 76184 - RNA, 64 nt, hsa
auucagaacagacccugugccuggccccagugugcccaggcaauuccccaggcccucacuggga

SEQ ID NO: 76185 - RNA, 64 nt, hsa
gagccagggcuaggcccuggugguguguggagcacccaggcagacccaguccugguugggauca

SEQ ID NO: 76186 - RNA, 64 nt, hsa
auccugugcugugcacaccugcucucuccucucucccaggcaggcagcugcaggcgcucuccuc

SEQ ID NO: 76187 - RNA, 64 nt, hsa
gcuuugcugcuuaugagcacagaggaauucaguccccaggcagcccugccucugacuccaagag

SEQ ID NO: 76188 - RNA, 64 nt, hsa
acaccacauugccucaacaaccggccccagagugcccaggcacuccugagguagcuucuggaaa

SEQ ID NO: 76189 - RNA, 64 nt, hsa
ccuccucuucacucagugcuucugcuugcccugccccaggcagcccacccacgcccagugcggg

SEQ ID NO: 76190 - RNA, 64 nt, hsa
uaugcguacugguuguugagcugggaaaccguggcccaggcaguggucacuacagccugauugg

SEQ ID NO: 76191 - RNA, 64 nt, hsa
ucaaaggcccaccagcccggcgcucaugcugagccccaggcacgcagggccggccaccucucuc

SEQ ID NO: 76192 - RNA, 64 nt, hsa
uggccugcaugaacuaccagaugaguaagggaaccccaggcaggcggcccugccacagccccca

SEQ ID NO: 76193 - RNA, 64 nt, hsa
aauagagaagaaaucccuuugcuagauagggucccccaggcaguccccaguggcgggacacagg

SEQ ID NO: 76194 - RNA, 64 nt, hsa
gacucccggccugggcccccaggauucuaggacccccaggcagccccuuggacuggucccgggu

SEQ ID NO: 76195 - RNA, 64 nt, hsa
uggaaacagguucuugcauguggauguguguuuccccaggcagacggccccucucuucccagca

SEQ ID NO: 76196 - RNA, 64 nt, hsa
aaagacucccaaaaugugccaagaauuucccagucccaggcagggcaggggaaacuaagggcaa

SEQ ID NO: 76197 - RNA, 64 nt, hsa
ggcugcugcugggcucagugaaguugcugcuucucccaggcaaggcuguggaccauggaguggc

SEQ ID NO: 76198 - RNA, 64 nt, hsa
agccuguccugccuguggccaugacccugccucucccaggcaggggcccgcgauguggaacugc

SEQ ID NO: 76199 - RNA, 64 nt, hsa
ucuucuguuuugccccauggucaagucccuguuccccaggcagguuucagcugauuggcagcag

SEQ ID NO: 76200 - RNA, 64 nt, hsa
agcugugaccaucccaggaggccugugcacacaucccaggcaugucccagacacaucccacacg

SEQ ID NO: 76201 - RNA, 64 nt, hsa
ccugugcuugcagccaggucaggcccagcugcagcccaggcaggagcagucgccuuucccaccc

SEQ ID NO: 76202 - RNA, 64 nt, hsa
agucuccaggccugguccacggacuggcagggaccccaggcacaagagcugccaccccucugcc

SEQ ID NO: 76203 - RNA, 64 nt, hsa
cagcagggaacggaggcugcugcagagacgcagccccaggcagccggggcuccuaggcuggugc

SEQ ID NO: 76204 - RNA, 64 nt, hsa
ggacaaaagccuguuccagagacccugggaggaccccaggcagggagagcccgccugccuccac

SEQ ID NO: 76205 - RNA, 64 nt, hsa
gccugguguggggucugagacggccggagaaccucccaggcagggcucuguguuuugucuguua

SEQ ID NO: 76206 - RNA, 64 nt, hsa
ccaacguaggccacucagcaacuggcauggagggcccaggcaacggagacguuuucuccauggc

SEQ ID NO: 76207 - RNA, 64 nt, hsa
guguaaugauggcaguagaaucugaaucucggaucccaggcaggguucacauuuccaaaccuuu

SEQ ID NO: 76208 - RNA, 64 nt, hsa
uugacccguguguaacuuccucugguaguuagaccccaggcagcuccgaauuugugaaccugcu

SEQ ID NO: 76209 - RNA, 64 nt, hsa
cccuccagagaaggacacaaacguguuucguaagcccaggcaccaaugggaauggaccaaagag

SEQ ID NO: 76210 - RNA, 64 nt, hsa
ucccccaggcaucgugugccauguugcacuucugcccaggcagcaggguggguggguaccaugg

SEQ ID NO: 76211 - RNA, 64 nt, hsa
gacacugaccaugagucccuggggggagugaucccccaggcaucgugugccauguugcacuucu

SEQ ID NO: 76212 - RNA, 64 nt, hsa
ucgucucaagcccccccuuggaggcugaaaucaccccaggcacugugagggcuucuccaggggg

SEQ ID NO: 76213 - RNA, 64 nt, hsa
gauggguggcucagccucgaaucccaggccccagcccaggcaggugcugcugccuguugugguu

SEQ ID NO: 76214 - RNA, 64 nt, hsa
caccuccugaaccuauccagacaccuucuccugacccaggcaccaccugcuuucggggcgaugg

SEQ ID NO: 76215 - RNA, 64 nt, hsa
ccaccugcuuucggggcgauggccguagccuccucccaggcaccugucugcaucccucuggcca

SEQ ID NO: 76216 - RNA, 64 nt, hsa
gguggggggaggaguggauuccuccccacccugucccaggcagcgccacuguccgcugucuccc

SEQ ID NO: 76217 - RNA, 64 nt, hsa
cucagaaucugauaccaaagagacagggcccgggcccaggcagagagcgaccagcaggcuccuc

SEQ ID NO: 76218 - RNA, 64 nt, hsa
gcccgguggggaagggucuccaggcuuuauuccucccaggcacugcagaggcaccggugaggaa

SEQ ID NO: 76219 - RNA, 64 nt, hsa
gugccagagguucagggagaacagcugcguugcucccaggcacugcagaggcccgguggggaag

SEQ ID NO: 76220 - RNA, 64 nt, hsa
uuucucuagaaaugcagaaauuaggaaggugaugggucuguaucccccugcccccuucuuuccc

SEQ ID NO: 76221 - RNA, 64 nt, hsa
agcuggaauucugagcuuuguguuuggacugucuggucuguagcuaaaggaaaaaguuaggagg

SEQ ID NO: 76222 - RNA, 64 nt, hsa
cuuacgcccuuuccuaggugaauucucccacaguggucuguaucucaacauuuucuuuuuaaag

SEQ ID NO: 76223 - RNA, 64 nt, hsa
aaaauauauauauauaguuucuuuuuauugaucaggucuguaaauguguacuaaaaaaaucaga

SEQ ID NO: 76224 - RNA, 64 nt, hsa
uggaaaagaaagacacuugagaauuuaguguuggggucuguacagaugaugcuacccaauuugg

SEQ ID NO: 76225 - RNA, 64 nt, hsa
gucuugacuugucauauucccccaugcaauccuaggucuguauugcucaauuuuaggaagccuu

SEQ ID NO: 76226 - RNA, 64 nt, hsa
uugguauucuaaccaaaguugacagacugugcgucugucuuaauggaugucuuaggaguugguu

SEQ ID NO: 76227 - RNA, 64 nt, hsa
cacaaccuccgccuccuggguucaagggauucuccugucuuagccuccugaguagcugugauua

SEQ ID NO: 76228 - RNA, 64 nt, hsa
acaugucucaauucccaugugcugugacuguagacugucuuaccauagacugucuuacccaucc

SEQ ID NO: 76229 - RNA, 64 nt, hsa
caugugcugugacuguagacugucuuaccauagacugucuuacccauccccuggauaugcucuu

SEQ ID NO: 76230 - RNA, 64 nt, hsa
aacaaagcaguugcucaguagaaagucuagauuucugucuuauaggugauuucugucuuauagg

SEQ ID NO: 76231 - RNA, 64 nt, hsa
uagaaagucuagauuucugucuuauaggugauuucugucuuauaggugauuauaaucaagugua

SEQ ID NO: 76232 - RNA, 64 nt, hsa
aaagggaacaccuggcauucugugguguuucgugcugucuuaaauaauggugcauuuauuaugu

SEQ ID NO: 76233 - RNA, 64 nt, hsa
ggaaaaauaauaauaacucuuguuucuuuccucccugucuuagacuuugaauguugacccucac

SEQ ID NO: 76234 - RNA, 64 nt, hsa
acuuuuccaagcuuuuacauuaacgagcaggccucugucuuaaaagggacucaguauauuaauu

SEQ ID NO: 76235 - RNA, 64 nt, hsa
gccacugcacucuauccuggguaacagcgagacucugucuuaaaaauaauaacaauaauaauaa

SEQ ID NO: 76236 - RNA, 64 nt, hsa
aguuuaagcaaugguugaaauuuguagguacuaucugucuuauuuuguguguguuuagaggugu

SEQ ID NO: 76237 - RNA, 64 nt, hsa
gcacaagaaaaagcauuggcaugagccaaagagucugucuuaauguuacuuuugaaaaucugcu

SEQ ID NO: 76238 - RNA, 64 nt, hsa
acaagcuccaagacuaaacaaacagacagguccucugucuuaaaaagguuacuucuugguucuc

SEQ ID NO: 76239 - RNA, 64 nt, hsa
ggaaacagcuaaauuacaacuuuuacauauggcucugucuuauuguuucuucauacugugucug

SEQ ID NO: 76240 - RNA, 64 nt, hsa
uucacuuaggaagccacgugccaauaccuggcugcugucuuaacucguagucugggcacaggau

SEQ ID NO: 76241 - RNA, 64 nt, hsa
ugacacaaggaaaccuucauggaucuucccuugccugucuuagucacagagagaaauaagagga

SEQ ID NO: 76242 - RNA, 64 nt, hsa
ggaagggcagaccccgccaaugauuucucuucaccugucuuaagauuaaauaaaaaagaguguc

SEQ ID NO: 76243 - RNA, 64 nt, hsa
agaugaaacuuacacuacuucuccaagccuuuugcugucuuaagaauaagaccugagauuaaca

SEQ ID NO: 76244 - RNA, 64 nt, hsa
gcacugccucaguuaaagguuuaauuuuuguuuaaaccuagacgugcaacaaaaguuuuaccac

SEQ ID NO: 76245 - RNA, 64 nt, hsa
gcugaaggccaaagccgccuacugguuuguaguuaaccuagagaagguugaaaaauuaauccua

SEQ ID NO: 76246 - RNA, 64 nt, hsa
agaaccaagaagggcuagaaccuggaggggcuagaaccuagagaagcuaaaaccugagcuagaa

SEQ ID NO: 76247 - RNA, 64 nt, hsa
cuagaaccuggagggcuagaaccuggagagcuagaaccuagaagggcuagaaccuggagggcug

SEQ ID NO: 76248 - RNA, 64 nt, hsa
cuagaaccuggagggcuagaaccuggagggcuagaaccuagaagggcuagaaccuggagggcug

SEQ ID NO: 76249 - RNA, 64 nt, hsa
cuagaaccuggagggcuagaaccuggagggcuagaaccuagaagggcuagaaccuggagggcua

SEQ ID NO: 76250 - RNA, 64 nt, hsa
cuagaaccuggagggcuagaaccuggcagguuagaaccuagaagggcuagaaccuggagagcca

SEQ ID NO: 76251 - RNA, 64 nt, hsa
caucaucucauuuaauccucccuuccucccuauuaaccuagagauuguuuuuguuuuuuauucu

SEQ ID NO: 76252 - RNA, 64 nt, hsa
ucccuccccgcccucacccgccccacucccuccuaaccuagagauuguuacagaagcugaaauu

SEQ ID NO: 76253 - RNA, 64 nt, hsa
aacuggaugggcugcagugaggugggggcgggugggcagggaaugggagaggggaagucuuggc

SEQ ID NO: 76254 - RNA, 64 nt, hsa
gcgggugggcagggaaugggagaggggaagucuuggcagggaaaucccuuuuggccacacaguu

SEQ ID NO: 76255 - RNA, 64 nt, hsa
ucuugaggucccuggagccccaggugggcugaggggcagggagccggcugugcccaguaugccu

SEQ ID NO: 76256 - RNA, 64 nt, hsa
ucguccccacccccagccugggggucugggcuggggcagggauugcucaguggaagcaggacug

SEQ ID NO: 76257 - RNA, 64 nt, hsa
cacagcccacacgugagcucccuccucacccccaggcagggaagccccuccugccagucccugu

SEQ ID NO: 76258 - RNA, 64 nt, hsa
agugcuggacucucccgggccacaauagggacagggcagggacagggacagcccaggucacacg

SEQ ID NO: 76259 - RNA, 64 nt, hsa
agucaagggcagggaggggaggaaugacacaaauggcagggagcugcugggggacugaccccuc

SEQ ID NO: 76260 - RNA, 64 nt, hsa
agaugagaugacugccauguacacugcagucaagggcagggaggggaggaaugacacaaauggc

SEQ ID NO: 76261 - RNA, 64 nt, hsa
gccugcugcugggcgugaugucgcuggaggugcuggcagggacucugauuuggugguccgcgcu

SEQ ID NO: 76262 - RNA, 64 nt, hsa
ccuggcucugaacuaguagaugauggugccagagggcagggagcucgccuggggagagggcugu

SEQ ID NO: 76263 - RNA, 64 nt, hsa
cuucccgcguagccaggugggcccaagggugccuggcagggagcacuaccccuggaccccuccu

SEQ ID NO: 76264 - RNA, 64 nt, hsa
aggcagccagaaaaggaggaggcacgggugagcuggcagggacacacugccuuuggggcuccug

SEQ ID NO: 76265 - RNA, 64 nt, hsa
aggaaguagccagggugaagagagacucggugcgggcagggagaaugccugggggucccucacc

SEQ ID NO: 76266 - RNA, 64 nt, hsa
gagcuagggacuaacuguugcucuuggugggcuuggcagggacuaggcugaagaugugucuucu

SEQ ID NO: 76267 - RNA, 64 nt, hsa
auguaagugggcccacccggugggacccccguggggcagggagcugggcccgacauggcuccgg

SEQ ID NO: 76268 - RNA, 64 nt, hsa
uucauacaaauucuucuaauugcugugugucccaggcagggagacgguuuccagggaggggccg

SEQ ID NO: 76269 - RNA, 64 nt, hsa
ccagccaggccauucuuagucccuggguuggggaggcagggagcuagggcagggaccaaaugaa

SEQ ID NO: 76270 - RNA, 64 nt, hsa
ucuuagucccuggguuggggaggcagggagcuagggcagggaccaaaugaacagaaagucucag

SEQ ID NO: 76271 - RNA, 64 nt, hsa
auaauggaauggcuggagucugcuguugucagaaggcagggagggugaugaaggacugacccac

SEQ ID NO: 76272 - RNA, 64 nt, hsa
cuucacagacaucccugaaaggaagccccuuuggggcagggaggugaggacuucaucucaacau

SEQ ID NO: 76273 - RNA, 64 nt, hsa
guggaagagugggaggaagcagagggagggacugggcagggacugccggccccggagucuccca

SEQ ID NO: 76274 - RNA, 64 nt, hsa
cagaccagacuuuucagauugcuuccuggaacugggcagggacucacugugcuuuucugagcuu

SEQ ID NO: 76275 - RNA, 64 nt, hsa
gcaggcacauggaggagcuugggggaugacuagaggcagggaggggacuauuuaugaaggcaaa

SEQ ID NO: 76276 - RNA, 64 nt, hsa
agaaguaggcaugagggaucacagggccccagaaggcagggaaaggcucugaaagccagcugcc

SEQ ID NO: 76277 - RNA, 64 nt, hsa
uaauaccuacacucuccaauuguaagagaaagggggcagggaagcaauauagcuuccauucuaa

SEQ ID NO: 76278 - RNA, 64 nt, hsa
gaauugcuauguucaggauguucuagggggugggggcagggacucuuuucguaauaagcacuug

SEQ ID NO: 76279 - RNA, 64 nt, hsa
ucuuggggucugggaggcccaggcuaagccauguggcagggaccgucuugcccugcuggccaca

SEQ ID NO: 76280 - RNA, 64 nt, hsa
accccugcccugggacuggcagggcaggggcaggggcagggacaguggccaggcggcccgagga

SEQ ID NO: 76281 - RNA, 64 nt, hsa
aaguuucucagcugggcucugaccuggggucuggggcagggaacgaacaugguggcuuugggcu

SEQ ID NO: 76282 - RNA, 64 nt, hsa
gcuggacacuggccauuuucacuagaguuugccuggcagggaccgaucucugcccccuccucuc

SEQ ID NO: 76283 - RNA, 64 nt, hsa
uucccaacugucgcccccuucaggcuaagucucaggcagggacagacccagaaagaacacaguc

SEQ ID NO: 76284 - RNA, 64 nt, hsa
gggccuguaauucagccugccugccuugccuuggggcagggagagagggaaccugcucacggcc

SEQ ID NO: 76285 - RNA, 64 nt, hsa
gggacagucaugggaaugugggggaugaagcccaggcagggaauggccuugaaagccauuggag

SEQ ID NO: 76286 - RNA, 64 nt, hsa
auuccauguggaugucaccaaaccccaguguggaggcagggacagucaugggaaugugggggau

SEQ ID NO: 76287 - RNA, 64 nt, hsa
aagcccuugaagguuuggggagagggggguaucaggcagggagggggcagaggcaaaucaccgg

SEQ ID NO: 76288 - RNA, 64 nt, hsa
ccaggaacaggacagggagaccuugugauggcggggcagggagccuguucguagggaagaugag

SEQ ID NO: 76289 - RNA, 64 nt, hsa
guccgcacauuucuuaguauucccuccaggcuugggcagggagacucgcagaugcacacccaca

SEQ ID NO: 76290 - RNA, 64 nt, hsa
ggcaccguaaguuugauuagugaugucugccacgggcagggauggaaggagcagugugaugucu

SEQ ID NO: 76291 - RNA, 64 nt, hsa
ucaucucaaccauccccuccguggcaucaccuuaggcagggaaguguaagaaacacacugaggc

SEQ ID NO: 76292 - RNA, 64 nt, hsa
caccuuaggcagggaaguguaagaaacacacugaggcagggaaguccccaggccccaggaagcc

SEQ ID NO: 76293 - RNA, 64 nt, hsa
cuggggaggcagcaagcaugcuggugggaagggaggcagggacuggcagcugccacccccuuca

SEQ ID NO: 76294 - RNA, 64 nt, hsa
cccgcuggaggguuggugcuguggagccuacaccggcagggacagccuggggcugacagggcuc

SEQ ID NO: 76295 - RNA, 64 nt, hsa
ucccgggcuccugggcccuguucuuaggaucaguggcagggagaaacggguaucucuuuucucu

SEQ ID NO: 76296 - RNA, 64 nt, hsa
ccccacucugagguuuccccaagagaaccagauuggcagggagaagcauuguggggcaauuguu

SEQ ID NO: 76297 - RNA, 64 nt, hsa
agggcagggagcggcaggauggaaggagacacggggcagggagaacucucuucugcuaaaucga

SEQ ID NO: 76298 - RNA, 64 nt, hsa
caggaagaaaaggcuugcccaaaaggcuggagagggcagggagcggcaggauggaaggagacac

SEQ ID NO: 76299 - RNA, 64 nt, hsa
ucugagggagaugggcuugggggcuguaggaggaggcagggauuccagggugucaggaaggcag

SEQ ID NO: 76300 - RNA, 64 nt, hsa
ucugaggcagaugggcuugggggcucuaggaggaggcagggacuccagggugucaggaaggcag

SEQ ID NO: 76301 - RNA, 64 nt, hsa
gcugagucugggccacuugcuuaauugcauuucuggcagggaaggagaggagggauggagaagc

SEQ ID NO: 76302 - RNA, 64 nt, hsa
accuugcuuagcgcccaagguagaugagagacagggcagggaaucugcguggugcugggaugug

SEQ ID NO: 76303 - RNA, 64 nt, hsa
gggcaguggcauuguuucugcuguggugggaacuggcagggagagggucaccuccacucugguu

SEQ ID NO: 76304 - RNA, 64 nt, hsa
uccuuuggugcacucaccguccaccguuccccaaggcagggagagggaguggcccgucccuggg

SEQ ID NO: 76305 - RNA, 64 nt, hsa
aaucaucugcggcuuaaacucaucucgcuugaagggcagggagaaacccaugaaucucaggcac

SEQ ID NO: 76306 - RNA, 64 nt, hsa
auuccugcaggagcugcagccacccaaagugggaggcagggaggggagcaucugucugccacug

SEQ ID NO: 76307 - RNA, 64 nt, hsa
uccuggaacaaagcgacaucgccagcagcaggcuggcagggagugguugaggucugggggccag

SEQ ID NO: 76308 - RNA, 64 nt, hsa
agacuaaucagugggcacaccaagggcccugaggggcagggagaugccaccaugcuucucuguc

SEQ ID NO: 76309 - RNA, 64 nt, hsa
cgugcucucagcagacagaacugcuggugugaaaggcagggauugucagcccaccugaggcugg

SEQ ID NO: 76310 - RNA, 64 nt, hsa
cugagaccucgggagugaggacgcagggguaugaggcagggagagggugugccgcucguacucc

SEQ ID NO: 76311 - RNA, 64 nt, hsa
aggccugcccaugcaggagaccaucuggacaccgggcagggaagggguugggccucaggcaggg

SEQ ID NO: 76312 - RNA, 64 nt, hsa
ucuggacaccgggcagggaagggguugggccucaggcagggagggggguggagacgaggagaug

SEQ ID NO: 76313 - RNA, 64 nt, hsa
gcuucucugucucaugcucccaggcugcacagcaggcagggagggaggcaaggcaggggagugg

SEQ ID NO: 76314 - RNA, 64 nt, hsa
ccacaagccuggcauuucagccagggcuggagaaggcagggacgccugggugagaggcaaaggg

SEQ ID NO: 76315 - RNA, 64 nt, hsa
uuguuuuaaaauauuaugauuuggcuacagaccaggcagggaaagagacccgguaauuggaggg

SEQ ID NO: 76316 - RNA, 64 nt, hsa
ggcaggccuucggggccccuuucgccugcuuccgggcagggacgaggccugguguccucgcucc

SEQ ID NO: 76317 - RNA, 64 nt, hsa
uuaguagagcuaguaggcccuggucgucacucugggcagggaugccgucagccuugagggucgc

SEQ ID NO: 76318 - RNA, 64 nt, hsa
ggucgccacccaccuguguguugcccucuguccuggcagggaaacauacaccccuugucucacc

SEQ ID NO: 76319 - RNA, 64 nt, hsa
uucuugauaucaaggaaaguggggcacugagaaaggcagggacuugcccaagggcauauaguga

SEQ ID NO: 76320 - RNA, 64 nt, hsa
cagggacuugcccaagggcauauagugagacaguggcagggaacccaaugcucugucucuggac

SEQ ID NO: 76321 - RNA, 64 nt, hsa
gcuagaaacccagagauggaggcugucuugcuauggcagggaggugacagccugcuggcacugu

SEQ ID NO: 76322 - RNA, 64 nt, hsa
agggcaccugaggagacuuuggggacagggcaggggcagggagggaaacugaggaaaucuucca

SEQ ID NO: 76323 - RNA, 64 nt, hsa
ccucccaacagcucaaaauuaggccuugggcaggggcagggagagcugcugagccuaaagacug

SEQ ID NO: 76324 - RNA, 64 nt, hsa
ucccaaugcagcgccuugucagccaaggugggcaggcagggacuguggcagcuuauguccaaag

SEQ ID NO: 76325 - RNA, 64 nt, hsa
ucccgagggcagcgcagggauccggggaagcugcggcagggagcgggcgccggcuucguggcuc

SEQ ID NO: 76326 - RNA, 64 nt, hsa
ggcugggggagcuagacaaaauucacacgggaggggcagggaugagacaauauugugcccuggg

SEQ ID NO: 76327 - RNA, 64 nt, hsa
ggggucuucugagacuccaccaggagccggagagggcagggagccaaauccagcuaggagguua

SEQ ID NO: 76328 - RNA, 64 nt, hsa
ggggagggggucaguuucugggaaggguggggggggcagggaaggggaacacagauuucuuugg

SEQ ID NO: 76329 - RNA, 64 nt, hsa
cuucuccccccaccacuaacaccucagacgcuugggcagggauggggguguuggaugccuggau

SEQ ID NO: 76330 - RNA, 64 nt, hsa
agcuuucuccggccucagggcagaaaaagggaauggcagggaguaagaggcgcugggcucggag

SEQ ID NO: 76331 - RNA, 64 nt, hsa
aggacucaucugucagagugcacaugaaaaaucaggcagggaaucgaaacgacagugcuggagg

SEQ ID NO: 76332 - RNA, 64 nt, hsa
aaguggugggugcauuggccuaggcugagcguggggcagggaauuaugggggcugugccccagg

SEQ ID NO: 76333 - RNA, 64 nt, hsa
ccuacuuaagggaauaggccaggcuccauccggaggcagggaccaugccaggaggagccccugu

SEQ ID NO: 76334 - RNA, 64 nt, hsa
uggguguuugugacaggcccugccugccacccuaggcagggaaagcugucaagacuccugccag

SEQ ID NO: 76335 - RNA, 64 nt, hsa
uccaggcaugaucuuccccaucaggcugggcucuggcagggaccugcccaggauggagaugaga

SEQ ID NO: 76336 - RNA, 64 nt, hsa
gcgggccaggucuggcgccaggggcaggcagcuaggcagggagggggcugggaaagaacuugga

SEQ ID NO: 76337 - RNA, 64 nt, hsa
ccgacugggcugcuggggcagggcccagggagguggcagggaagggugccuggcugggcuuugg

SEQ ID NO: 76338 - RNA, 64 nt, hsa
caguucagggaaaaaggagaggaggaaacagugaggcagggagaaaggcuuuccaaauaagagu

SEQ ID NO: 76339 - RNA, 64 nt, hsa
gggaggcagcugagggucucaagggugacuggguggcagggaugagugcggugggugagaaucc

SEQ ID NO: 76340 - RNA, 64 nt, hsa
cagugcuaucugaugacggggaaacaaaauuauucucugagagggaaaggacauuugagggaaa

SEQ ID NO: 76341 - RNA, 64 nt, hsa
gaacagcucaccuugucagacagccucagggcaucucugagacacaggggcagaaaaugacauu

SEQ ID NO: 76342 - RNA, 64 nt, hsa
agggauggcuugaaaggaaggagacugaaaaacacucugagagcauacacuguccaaggccauu

SEQ ID NO: 76343 - RNA, 64 nt, hsa
cacuccccaacagcuuuguugauguagcuuguaucucugagaauuuauuguauuaaaauuaaua

SEQ ID NO: 76344 - RNA, 64 nt, hsa
uuuuacaaauacaagugaugugcagcuucuccggcucugagaagaacaccugagagcgcuuucc

SEQ ID NO: 76345 - RNA, 64 nt, hsa
uagauuccuucucucaucaacgggaaaguacuuccucugagagugcgagugcaccaugcucacu

SEQ ID NO: 76346 - RNA, 64 nt, hsa
ugagcccucauccugcaggcagagccccucagugcucugagaaaccugcccugaacucaccgcc

SEQ ID NO: 76347 - RNA, 64 nt, hsa
cagaggaagccuaucuguggggcuggguacauuucucugagacucacggaauguaaguguugag

SEQ ID NO: 76348 - RNA, 64 nt, hsa
cucgugauuguauagggcucuucuccuguaugaacucugagaucagugagcucugaucuccaag

SEQ ID NO: 76349 - RNA, 64 nt, hsa
ugcagguuuuaaguaauuaacuuaaaagcuucuccucugagaaacauuucuguugcgcuacuga

SEQ ID NO: 76350 - RNA, 64 nt, hsa
gagaagcugugcgugccccgggguggguaucuagcucugagaugaacucaguuauaggagaaaa

SEQ ID NO: 76351 - RNA, 64 nt, hsa
cuaauccuuuuugccccaggcaaggucccuguaucucugagacaccccgauuggcuggagaauu

SEQ ID NO: 76352 - RNA, 64 nt, hsa
gcagagcaacugaggagcucugcgagagugugcccucugagacagcccuguccgccccgcccag

SEQ ID NO: 76353 - RNA, 64 nt, hsa
gcaccauaguaggggaaugucuaaagacccacugcucugagauguggucagagagguuucugug

SEQ ID NO: 76354 - RNA, 64 nt, hsa
aacuacagcugguggaacagcaagccuaagucuucucugagaggaguuucgugagcugaagaac

SEQ ID NO: 76355 - RNA, 64 nt, hsa
aauucaccauaauuauggugcaaggucagugugucucugagaucuaugucuguugguggcaaug

SEQ ID NO: 76356 - RNA, 64 nt, hsa
ccaaggcagcagacuguuaaucagacaaacagaucucugagaaggugcaucagcugcuuugaag

SEQ ID NO: 76357 - RNA, 64 nt, hsa
gggcagaugaacacggaggcucucuguugucugucucugagaucuuugugucugggaaugccua

SEQ ID NO: 76358 - RNA, 64 nt, hsa
guucugcuggggccaugaaggcagaagguuuagccucugagaagcccucuucuucccccacccc

SEQ ID NO: 76359 - RNA, 64 nt, hsa
ccucucugucugcaccagggaguaguacccccagcucugagaaagaggcggcauccccuaggcc

SEQ ID NO: 76360 - RNA, 64 nt, hsa
cagcccugucugucuccaccccauccccucuugucucugagaaccauucucccaccccaaguuc

SEQ ID NO: 76361 - RNA, 64 nt, hsa
ucuccccuggugucuguacuguguacacacaucccucugagaagcacaaggagacgacacgcgc

SEQ ID NO: 76362 - RNA, 64 nt, hsa
guaacagugcagauuccacguucuuguuccgauacucugagaagugccugauguugauguacuu

SEQ ID NO: 76363 - RNA, 64 nt, hsa
uguguugaaauccugucaugaauccuugguagcucucugagaacagugaaguccagggaaaggc

SEQ ID NO: 76364 - RNA, 64 nt, hsa
cagaacccagagacaauacaaaaccccucacuuccucugagagggccaaaugcugugagucuga

SEQ ID NO: 76365 - RNA, 64 nt, hsa
aaccuccuguacauguguucauguucccagccagcucugagacccaggaaccaaauauuccauu

SEQ ID NO: 76366 - RNA, 64 nt, hsa
uuggcucucuuccccuacuuccacuuauucuugacucugagaacuuuuggaacccaauggaauc

SEQ ID NO: 76367 - RNA, 64 nt, hsa
uccuuguuuugaugucaccuugguaggcugggcccucugagagguuggaagcucuaggcauugu

SEQ ID NO: 76368 - RNA, 64 nt, hsa
ccugcccggggagcugcagagcagcagcaccuuucucugagaagagguccuugguugggucaag

SEQ ID NO: 76369 - RNA, 64 nt, hsa
ggccacccugcugcacuaggacuugguaagaugacucugagaaaaugcgagacucugauggaau

SEQ ID NO: 76370 - RNA, 64 nt, hsa
cgggcaccgcccuuucuuccuugucccugccucacucugagagccuugggggucuccaccagug

SEQ ID NO: 76371 - RNA, 64 nt, hsa
cucagcuuagcccagcaugaagagaugggcucugcucugagaguagggcgggcuugaaggcccu

SEQ ID NO: 76372 - RNA, 64 nt, hsa
uauacagucacccuucucucacccguccucccugcucugagacacaccccuguggcgagcaccg

SEQ ID NO: 76373 - RNA, 64 nt, hsa
aggucagugauuggcugugucacagugcccuuuucucugagaagagccagcaguccacaguguu

SEQ ID NO: 76374 - RNA, 64 nt, hsa
uugggaggggcgcucugagauuaaagaguuuuaccucugagauaaaugugaaguguguugugag

SEQ ID NO: 76375 - RNA, 64 nt, hsa
ugagggguugggggaucggcaguugggaggggcgcucugagauuaaagaguuuuaccucugaga

SEQ ID NO: 76376 - RNA, 64 nt, hsa
caggcgaagcugguaccucuggcuacagcuugcucucugagaccuggggcuucacucggaucac

SEQ ID NO: 76377 - RNA, 64 nt, hsa
ccucgcuuccucaaaaagaucacagagggaggagcucugagaacagucuccuucaacaguucgg

SEQ ID NO: 76378 - RNA, 64 nt, hsa
uggguucaauuccuucaauuuuuaaaaaacuggucucugagaguuuuuuaaaucauugagagcc

SEQ ID NO: 76379 - RNA, 64 nt, hsa
caagcacacuuugguuccuucuccgggcggcucucucugagacccaaggcugcagucccucagu

SEQ ID NO: 76380 - RNA, 64 nt, hsa
agaaagacaagugacaggggcaauggaucucaggcucugagauaaguauaucagaugacacugg

SEQ ID NO: 76381 - RNA, 64 nt, hsa
agaaaagaaggaagcaguugccuuccggagggggcucugagagaaucuagccuccccucugucc

SEQ ID NO: 76382 - RNA, 64 nt, hsa
auuuauuuggaaauauucuaugaccacuuuacagaugaggaaacaggccucaagcguggagggg

SEQ ID NO: 76383 - RNA, 64 nt, hsa
acaagucuugcugugcuuuauuugugaaacuuuaaugaggaaaaaacaaauaauaaauguucuc

SEQ ID NO: 76384 - RNA, 64 nt, hsa
uucccuaagaaacaauggaagagaaggagcuuggaugaggaaacuguucagcaagaggaagggc

SEQ ID NO: 76385 - RNA, 64 nt, hsa
uacuauuugacugacugacugaaugaaugaaugaaugaggaagaaaacuguggguaaucaaacu

SEQ ID NO: 76386 - RNA, 64 nt, hsa
gggccuugaaggauggaugaaauuuggauagagaaugaggaagacagagggccuccaagugaga

SEQ ID NO: 76387 - RNA, 64 nt, hsa
accagccagcuuacacaggcauuaacucuccucaaugaggaagaaucauucacaacugagcaag

SEQ ID NO: 76388 - RNA, 64 nt, hsa
uguuauuauaauuauaauuauuauuauuauugacaugaggaaaccuagcacuggcagagggcac

SEQ ID NO: 76389 - RNA, 64 nt, hsa
gaaguccuuguuggcagagggauguggggcgggaaugaggaaaggggagggcaugauccuggca

SEQ ID NO: 76390 - RNA, 64 nt, hsa
gcaaaagacacuucuuacauuguggcaagaaaaaaugaggaagaagcaaaagcagaaaccccug

SEQ ID NO: 76391 - RNA, 64 nt, hsa
gugaaaggcacuucuuacauggcagcaagagaaaaugaggaagaagcaaaaguggaaaccccug

SEQ ID NO: 76392 - RNA, 64 nt, hsa
gaagguugagaccaaugauuuccuguuaugagucaugaggaaacugaaucaccuagaaguggaa

SEQ ID NO: 76393 - RNA, 64 nt, hsa
acagggucuacaauggggagaacuuguuuuauagaugaggaaaccaaggcucagaggggcaaag

SEQ ID NO: 76394 - RNA, 64 nt, hsa
aaugccuucaacugaaaaaaacauauccaaaauaaugaggaaauguguuggcucacuacguaga

SEQ ID NO: 76395 - RNA, 64 nt, hsa
auuuauuuacacucuugauucuacaauguagaaaaugaggaaaugccacaaauuguauggugau

SEQ ID NO: 76396 - RNA, 64 nt, hsa
aaaaucaguagacauuucuggacauaaaacacagaugaggaaagggcuucaauuagaaguuacg

SEQ ID NO: 76397 - RNA, 64 nt, hsa
uuacacaguguaaaugaaaccauccuagaggauuaugaggaauccuuucuaugugauuuucaau

SEQ ID NO: 76398 - RNA, 64 nt, hsa
caggcaaaauugguaccaaagggaaacauuaaccaugaggaagagcauuuuucuaaggagaaca

SEQ ID NO: 76399 - RNA, 64 nt, hsa
ugacugcuuaauuggcaugagguuuccuuuugagaugaggaaaauguucugaaaauauggugau

SEQ ID NO: 76400 - RNA, 64 nt, hsa
aaaaagcucaaggacuuuaugaagaucucauuauaugaggaaaaucauagguuaccauuuuaua

SEQ ID NO: 76401 - RNA, 64 nt, hsa
ucagugaaaauaauuuuauuucagucaaacauuuaugaggaaaugagaucacaucuuugucacu

SEQ ID NO: 76402 - RNA, 64 nt, hsa
ugugugguuguggcaugugugagcagaagggaggaugaggaaaaagagaagaaaccccgguacu

SEQ ID NO: 76403 - RNA, 64 nt, hsa
uccccaugucccuggcacacuagcauuccgggggaugaggaauccccagcccuugaggcagagg

SEQ ID NO: 76404 - RNA, 64 nt, hsa
auuuaauugggggaacaaaaggccucagguaaggaugaggaacucugaaaucagauggaaaaga

SEQ ID NO: 76405 - RNA, 64 nt, hsa
gaagccagugccuguguacucacugaaauugaagaugaggaaaguagcuguacacucacugaau

SEQ ID NO: 76406 - RNA, 64 nt, hsa
gccaaggagaguccuugcacccgugagcgucaggaugaggaaaugacaggaggaagacgugggu

SEQ ID NO: 76407 - RNA, 64 nt, hsa
auuuccccauuucuguuugcugccugaaagcaggaugaggaaggccaaggagaguccuugcacc

SEQ ID NO: 76408 - RNA, 64 nt, hsa
uucacuaccuauccaggaguggaacugguagaggaugaggaaagcauguauucagcuuuaguag

SEQ ID NO: 76409 - RNA, 64 nt, hsa
uaauaggcacuuaaguggcuuccaauuuuuggccaugaggaagagaacccacgaacauuccugg

SEQ ID NO: 76410 - RNA, 64 nt, hsa
cacucugaacaggcacagcccucccaucuucccaaugaggaaacggauucaggaagagccacuc

SEQ ID NO: 76411 - RNA, 64 nt, hsa
ugagggugaguucugcugccuuguccauuuagcgaugaggaaagugaagcucagagcacaaacc

SEQ ID NO: 76412 - RNA, 64 nt, hsa
cgauacggcaaccaccacggaccuguggggaccaaugaggaaagagagaggcaggucugggcca

SEQ ID NO: 76413 - RNA, 64 nt, hsa
aggcccccuuguccuuccuggguccugguccuucaugaggaacuagcccaucccugguggggcu

SEQ ID NO: 76414 - RNA, 64 nt, hsa
aaaaaaaaaaaaaaaguuuaaucugaaucuaaccaugaggaaauaaucagacaaauccacauua

SEQ ID NO: 76415 - RNA, 64 nt, hsa
aacucuguuggguguacucugcuaaguucuggggaugaggaaauuaauaaagguacagucuugc

SEQ ID NO: 76416 - RNA, 64 nt, hsa
aagauaauucauacuggaaggaaacccuacaaauaugaggaaugucucaaagcuuuuuacugau

SEQ ID NO: 76417 - RNA, 64 nt, hsa
ucuauguaaauaccagaauuuauaguagaaauauaugaggaagcgacacuucgaauauucuacu

SEQ ID NO: 76418 - RNA, 64 nt, hsa
cuaaaggaggguuugugauugucaccauuuacugaugaggaaacuaaggcuccuaggggagaaa

SEQ ID NO: 76419 - RNA, 64 nt, hsa
acuuguuaucaucuccauuugaucaucuccuccaaugaggaaacccacgcaccuuccuuaguaa

SEQ ID NO: 76420 - RNA, 64 nt, hsa
cuccaggucugccauucgcuauugagaacuagaaaugaggaaggacaguuacgcuaacuccaaa

SEQ ID NO: 76421 - RNA, 64 nt, hsa
ggcaccucagucucaacauuuucuuuucggauucaugaggaaagagaaauccugggguuggacc

SEQ ID NO: 76422 - RNA, 64 nt, hsa
gccaucgagcgugccgcuuucuucguggcccuggaugaggaauccuacuccuaugaccccgaag

SEQ ID NO: 76423 - RNA, 64 nt, hsa
caguaccuagagucugugcgccccuuguuggaugaugaggaauauuaccgcauggaguugcugg

SEQ ID NO: 76424 - RNA, 62 nt, hsa
ucaacaaggaaaacuucuaacuugucucuuccaugaggaaauaaauguggguugugcugcca

SEQ ID NO: 76425 - RNA, 64 nt, hsa
agccacaaauguuuagaacucuucaacuucgguaaugaggaagaaggagaaagagcugggggaa

SEQ ID NO: 76426 - RNA, 61 nt, hsa
cagcccuacccaccugcccuguuugaacuuccuguuugacaauguuugcuguugauuuuuu

SEQ ID NO: 76427 - RNA, 61 nt, hsa
aggagaggauggucagcccuacccaccugcccuguuugaacuuccuguuugacaauguuug

SEQ ID NO: 76428 - RNA, 61 nt, hsa
ccaugaccgaggagccaacugggacuucuggcuguuugacauccucauguucccguugguc

SEQ ID NO: 76429 - RNA, 61 nt, hsa
uuugccauugugugcucucagauuucuuccacuguuugacacccuccuuagagggcugcuc

SEQ ID NO: 76430 - RNA, 61 nt, hsa
cagagaauauacuuuuccucaaguaauauaccuguuugaagcuuuaagagagauguuuuug

SEQ ID NO: 76431 - RNA, 61 nt, hsa
guuacugcucgccuguuaaauuucaaauguccuguuugauacuacuguagaacacuauuuu

SEQ ID NO: 76432 - RNA, 61 nt, hsa
gucuaccuugugagcaggcuuuuggaagaaccuguuugaugcaaaaaagaaaaugaaaaac

SEQ ID NO: 76433 - RNA, 61 nt, hsa
ccuuauuaugggagcccgucggucuuagaagcuguuugacauguauaauaaauggcauuga

SEQ ID NO: 76434 - RNA, 61 nt, hsa
cucaaaccuuguuacagcaucaucacauuaccuguuugauguaaaaaauaaaaaauagaaa

SEQ ID NO: 76435 - RNA, 61 nt, hsa
aacuaucuuauuauaaaaggcuguacuucuacuguuugaaaaaauuauuucuaggguuuaa

SEQ ID NO: 76436 - RNA, 61 nt, hsa
ucuagaacauguagacacuugagaaauguuucuguuugaagaaaauagagggagaaacaga

SEQ ID NO: 76437 - RNA, 61 nt, hsa
ugaaggugugguaucaaacuucagguugaaacuguuugaagcauuauaaacauucauuuca

SEQ ID NO: 76438 - RNA, 61 nt, hsa
cccaaguacuggauuuuaaaucuguauguaucuguuugauuuuuuuuucuaauauuucagu

SEQ ID NO: 76439 - RNA, 61 nt, hsa
uaucuuaguaccuauggauuuucuuuauuugcuguuugaauggauugaccuugguuaugug

SEQ ID NO: 76440 - RNA, 61 nt, hsa
gcacacccuucuugguuggaacugaaagcuucuguuugaagagacaugaguucuggaagga

SEQ ID NO: 76441 - RNA, 61 nt, hsa
aagccauaugaugacacacagugucuuucuccuguuugaaaagaaauugugucauauuggu

SEQ ID NO: 76442 - RNA, 61 nt, hsa
gucucagacuaaguaaugcaucagaauucaucuguuugaagccugaaauaauuuaggacuc

SEQ ID NO: 76443 - RNA, 61 nt, hsa
uuaugauuugaaaguuggaaguuuguaccaucuguuugaguauaugcacauuuaaaaaaua

SEQ ID NO: 76444 - RNA, 61 nt, hsa
cauaauguaucuuaugaaagcauuacccaaccuguuugaguugagaaugcauuuguccacc

SEQ ID NO: 76445 - RNA, 61 nt, hsa
uugggaugauaagaaacaaaaauaaucccaacuguuugaaaguucgaaagaggggcauucu

SEQ ID NO: 76446 - RNA, 61 nt, hsa
uuugugagggcaaaggggaggaaaugggguucuguuugaaaaaaaugaggggaucuuagau

SEQ ID NO: 76447 - RNA, 61 nt, hsa
cucaugugcuucuucugaauacugaaugugacuguuugaaagcugguagaauucaucccuc

SEQ ID NO: 76448 - RNA, 61 nt, hsa
accccuccuccugcgaagugaucugcaguggcuguuugaccagaccacaaaguucacaucu

SEQ ID NO: 76449 - RNA, 61 nt, hsa
aagagccuugucugaccuuaaugcaagcagucuguuugaaccccuguaggcugcauucagg

SEQ ID NO: 76450 - RNA, 61 nt, hsa
ggaaaaaucuguguguauuguauagcucuagcuguuugacuaucuguaaugaaaaugcugc

SEQ ID NO: 76451 - RNA, 61 nt, hsa
gacaucuacauuucagugcuuuuucccuaagcuguuugaaaguuacgcuuuucuguuguuc

SEQ ID NO: 76452 - RNA, 61 nt, hsa
caggguagacacguggagugcuggugcugagcuguuugagaagcucuguguggguguuucu

SEQ ID NO: 76453 - RNA, 61 nt, hsa
acuccaaugaguguguuugugaguuuuuauccuguuugaauuuugaugucguccaggcguc

SEQ ID NO: 76454 - RNA, 61 nt, hsa
cugcauuuucccccuuuaaagcugcggucuccuguuugauaaaagaauauuggccaguauu

SEQ ID NO: 76455 - RNA, 61 nt, hsa
gaagcuuagauaauaauggcuguuucguaaacuguuugagaccuauuaaugaaaaugacua

SEQ ID NO: 76456 - RNA, 64 nt, hsa
cauaauucaaacaauuacaccaugguauaaagugggcauuuaauauguaaagauucaaaguuug

SEQ ID NO: 76457 - RNA, 64 nt, hsa
uuuucauuuuagucuuuucuaagagucaaccacaggcauuuaagucagccaaagaauauuguua

SEQ ID NO: 76458 - RNA, 64 nt, hsa
aacccauuuguaugacuucaacaacgucaaggagggcauuuagaauuuagaaucugagcacauc

SEQ ID NO: 76459 - RNA, 64 nt, hsa
aucccacucaaugccaaaucuuucaguccucaaaggcauuuaaguccaauagucaugcuuuaaa

SEQ ID NO: 76460 - RNA, 64 nt, hsa
auaauucaggccuguuugguagacaaaaucaaaaggcauuuaacagcagcaguacuuggaagcu

SEQ ID NO: 76461 - RNA, 64 nt, hsa
aggaaaacaaaauuauguggugugaaacagccaaggcauuuauucuucagaggcaggauaauau

SEQ ID NO: 76462 - RNA, 64 nt, hsa
ugcagaagucuccaauauggaguacaugcacuugggcauuuaauauauaccacuggugugugug

SEQ ID NO: 76463 - RNA, 64 nt, hsa
uugguaauugugugaaauauaagcuuuuuaacagggcauuuaaguggcuagcaaaucaguaauu

SEQ ID NO: 76464 - RNA, 64 nt, hsa
uuauuuccaauggauauuucuguauuacuagggaggcauuuacaguccucuaauguugauuaau

SEQ ID NO: 76465 - RNA, 64 nt, hsa
ccccaagcuugaauuuucauucugccauugacuuggcauuuaccuuggguaagccauaagcgaa

SEQ ID NO: 76466 - RNA, 64 nt, hsa
ucuuaacaaacacaggaggacuuaauggcagcuuggcauuuaaugucaaaauccaagccguggc

SEQ ID NO: 76467 - RNA, 64 nt, hsa
gcagcuuggcauuuaaugucaaaauccaagccguggcauuuaaugucaaaaugacuucagacca

SEQ ID NO: 76468 - RNA, 64 nt, hsa
auugauaaaauggugauguguauuaauguuaguucaaccauauauuuauacugucuggggaugu

SEQ ID NO: 76469 - RNA, 64 nt, hsa
uaaauagaggcuagcuaccuaggcuugucuauagcaaccauaauguugauguaaguaaugcggu

SEQ ID NO: 76470 - RNA, 64 nt, hsa
cauuuuuauggcuuuuuacaguuucucauucugucaaccauauugaagugaaguggcauagucu

SEQ ID NO: 76471 - RNA, 64 nt, hsa
ucccuauucgaaaauuagugcuggaauaucuggccaaccauaugcagaagaaugaaacugaacc

SEQ ID NO: 76472 - RNA, 64 nt, hsa
caaguuaauuccucucucugugccucgguucccucaaccauauaauggagacaacagcauuacc

SEQ ID NO: 76473 - RNA, 64 nt, hsa
aggagcaagacugagacucugauucagcgagaaacaaccauaggggcagaucccuucaucuguc

SEQ ID NO: 76474 - RNA, 64 nt, hsa
ggcauagggccagcucuaugugguagguggaucaaauggccacucagaugaccugaguugugga

SEQ ID NO: 76475 - RNA, 64 nt, hsa
ccuuuugauuuugcagaaaaagccaccacgugagaauggccauaagcagauaaguagcaguuca

SEQ ID NO: 76476 - RNA, 64 nt, hsa
cagaauuuaagcaagaaauauuuuaauauagugaaauggccacuacuuuaaguauacaaucuuu

SEQ ID NO: 76477 - RNA, 64 nt, hsa
ucuuuccccagcaguuucuguccuagcaaguaagaauggccaacucaacuuucauaauuuaaaa

SEQ ID NO: 76478 - RNA, 64 nt, hsa
uaggggauacaagauuucuuacaugcauguauuaaauggccauuuuaaaauuagcuaguuucau

SEQ ID NO: 76479 - RNA, 64 nt, hsa
acagguuguuuuuuguuuguuuguuuguuuuuuuaauggccauuuuauuuuauuuguauuuaua

SEQ ID NO: 76480 - RNA, 64 nt, hsa
uaccuggagccuuaucuucugaaggguuuuaaagaauggccaauuagcugagaagaauuaucua

SEQ ID NO: 76481 - RNA, 64 nt, hsa
ggguguauuucauuccaggcccucagucuuuggcaauggccacccugguguuggcauauuggcc

SEQ ID NO: 76482 - RNA, 64 nt, hsa
gcuuccuuugacuucaggaaugaucaguuuucauaauggccacugggccugcuuagauugcagu

SEQ ID NO: 76483 - RNA, 64 nt, hsa
accuggauuaacaguauuguuggacaguccuaaaaauggccagauuguggaacagcuguugaau

SEQ ID NO: 76484 - RNA, 64 nt, hsa
gccguggccaugggaagauguuccacgcugccuccuccucgaguuuuccucggaaacacucuug

SEQ ID NO: 76485 - RNA, 64 nt, hsa
ggcuagcucaugcugcucuugucagccucugguucuccucgaguccuuggggacguggcagaug

SEQ ID NO: 76486 - RNA, 64 nt, hsa
agcacaugccguacucuuauauguaccauugguugauaauuauaaugauucauuuggacuugaa

SEQ ID NO: 76487 - RNA, 64 nt, hsa
aguagaaaugaguuguauggugaaucuguguagugauaauuauauaauuuauuuauuuugaaug

SEQ ID NO: 76488 - RNA, 64 nt, hsa
aaaaauacauaaucaugcucagauauguaucuaggauaauuauaauuaauaauaaucauaguaa

SEQ ID NO: 76489 - RNA, 64 nt, hsa
cugaagcuucuacuaggaucccaguuuugccgcagauaauuaauggacaacuguagugcaguga

SEQ ID NO: 76490 - RNA, 64 nt, hsa
ugccaaaauccuggggcuuugcugcauucccuaagauaauuacaggaaaaagaaaauguaaaag

SEQ ID NO: 76491 - RNA, 64 nt, hsa
ugccacauggaccaggaugaagagggaucaaagagauaauuagccaaaaacccaguagccuaga

SEQ ID NO: 76492 - RNA, 64 nt, hsa
cauuuuuagauuaaacugugauggaugagcuaucauaauucaaguauacauuucuuuuuucuau

SEQ ID NO: 76493 - RNA, 64 nt, hsa
cucugauuaucagaaguuuuacuaaaacuuugaaauaauucacuuucaucugcuuucuagauuu

SEQ ID NO: 76494 - RNA, 64 nt, hsa
guuuggauuacaugcacgugugagauuauuugcaauaauucauagguuccaaggguguugauga

SEQ ID NO: 76495 - RNA, 64 nt, hsa
ugaugaauagucauacauuuuuuuggacuuuguuauaauucauugugguaagaaugauugaaau

SEQ ID NO: 76496 - RNA, 64 nt, hsa
aaagcauuuaauugguccucaaugcuuaauaaauauaauucaugcuggagagaaacuucacaug

SEQ ID NO: 76497 - RNA, 64 nt, hsa
cuucaauagguucucaacccuuacugugcacaagauaauucauucuggggaaaaaaaugcuaca

SEQ ID NO: 76498 - RNA, 64 nt, hsa
cuuuaaaucuuccucagucuuuucuaaucauaagauaauucacacugaagagaaacugcaaacg

SEQ ID NO: 76499 - RNA, 64 nt, hsa
ucauuuaauaauucaaaccaacacuuuuaaaaaaauaauucagaugagacugagccauaucugc

SEQ ID NO: 76500 - RNA, 64 nt, hsa
cauugggcuuccuuguacuuaguuuuuucauuuaauaauucaaaccaacacuuuuaaaaaaaua

SEQ ID NO: 76501 - RNA, 64 nt, hsa
cuuuaaccaguuuucaacccuuauuacacauaagauaauucauagcggagagaaaccccacaaa

SEQ ID NO: 76502 - RNA, 64 nt, hsa
cuuuaacugguccucaacucuuauuacacauaagauaauucacaguggagaaaaacccuacaaa

SEQ ID NO: 76503 - RNA, 64 nt, hsa
cuuuaacaagucuucaacccuuucugcacauaauauaauucauacuggagagaaaccccacaaa

SEQ ID NO: 76504 - RNA, 64 nt, hsa
agcgucugauaaauccuguaguccaagcucaggcauaauucagcauaagaaaauucacaccaga

SEQ ID NO: 76505 - RNA, 64 nt, hsa
cuucagucauagcucagccauugcucagcaucagauaauucacaccagagagaaacccucugaa

SEQ ID NO: 76506 - RNA, 64 nt, hsa
auuggaauguuauuauaaacucuuagauauuuauauaauucaaaagaaugcauguuucacauug

SEQ ID NO: 76507 - RNA, 64 nt, hsa
auuuucaaagaauggagguugcugcacucagaaaauaauucagaucauguuuaugcauuauuaa

SEQ ID NO: 76508 - RNA, 64 nt, hsa
ucuuuuaaaguguuacuuuuuguaaacgacaagaauaauucaauuuuaaagacucaaggugguc

SEQ ID NO: 76509 - RNA, 64 nt, hsa
uuuggaaauaauuuguaauaaaaaucauggcaacauaauucacuuuccaucuuuuaaaaauaua

SEQ ID NO: 76510 - RNA, 64 nt, hsa
gaaauaauuguauuucucugaauucagugaagaaauaauucaugauucaacugcaucuccaaac

SEQ ID NO: 76511 - RNA, 64 nt, hsa
cucuuuugaagaucuaugguugacuaauuaaacaauaauucaaguagagugucccagaaaaaaa

SEQ ID NO: 76512 - RNA, 64 nt, hsa
cucaagugaguucuuaguauuuuauaucagcaaaauaauucaauuuugcagguugcaaacaaau

SEQ ID NO: 76513 - RNA, 64 nt, hsa
uagaaucuuguauuuuuuaauugagcuaaucaaaauaauucagccaagucuauuugaaauagaa

SEQ ID NO: 76514 - RNA, 64 nt, hsa
agaagauucuuuaacaaauugaggagauugauucauaauucacaugucaauuuuuuauaguaau

SEQ ID NO: 76515 - RNA, 64 nt, hsa
uuauaugaaagucaagaucuaaguaccuuuucauauaauucaaacugauugcuugugauauguu

SEQ ID NO: 76516 - RNA, 64 nt, hsa
augugaucuuucuauaaccaugccauucacuuaaauaauucaugaagggaaugguuuaauuuaa

SEQ ID NO: 76517 - RNA, 64 nt, hsa
ucuauucacauugaaauaaagaauuaucuagaugauaauucagauaauucaguuuguucauaga

SEQ ID NO: 76518 - RNA, 64 nt, hsa
auugaaauaaagaauuaucuagaugauaauucagauaauucaguuuguucauagaauuacuuuc

SEQ ID NO: 76519 - RNA, 64 nt, hsa
aucguauaaaaaucugcucauauuagaacacaguauaauucagcaguaaacacuagaaucaaau

SEQ ID NO: 76520 - RNA, 64 nt, hsa
caaguuauucauuuuauucaaguuauauguauguauaauucaacaauuuuagauuaugguguaa

SEQ ID NO: 76521 - RNA, 64 nt, hsa
uuucuauugauucucauaccuuacuaaauauaagauaauucauauuggagagaaauucuacaga

SEQ ID NO: 76522 - RNA, 64 nt, hsa
uuuuaaccacuucucaacccugccuacacguaagauaauucauacuggaaggaaacccuacaaa

SEQ ID NO: 76523 - RNA, 64 nt, hsa
uuuuuacugauucuuauaccuuacuaaacauaaaauaauucauaaaggagauaaauuauacaaa

SEQ ID NO: 76524 - RNA, 64 nt, hsa
uuuuaacaaauccucauccauuaguaaacauaagauaauucauacuggagagaaaaccuacaaa

SEQ ID NO: 76525 - RNA, 64 nt, hsa
uuuuaaccaauccucaacccuuacuacacauuagauaauucaugcuggagagaaacccuacaaa

SEQ ID NO: 76526 - RNA, 64 nt, hsa
gcuuuuaaccaguccucaaacuuuauugaacaaaauaauucauacaggagagaaacccuacaaa

SEQ ID NO: 76527 - RNA, 64 nt, hsa
cuuuaacuggcucuuaauccuuaugaaacaaaagauaauucauacuagagagaaacccuacaaa

SEQ ID NO: 76528 - RNA, 64 nt, hsa
uuuaguguauuuucaacuuuuauuaaaacacaagauaauucauacuggagagaaauccuacaaa

SEQ ID NO: 76529 - RNA, 64 nt, hsa
ugacaucagauaauucagucuagcaauaugauagauaauucagucugucauacugaaaaugaca

SEQ ID NO: 76530 - RNA, 64 nt, hsa
cccuuaacuaaacgcuuacuucucuugacaucagauaauucagucuagcaauaugauagauaau

SEQ ID NO: 76531 - RNA, 64 nt, hsa
gcauaucaauuguaggucauguauuuuacuauauguugcauaguauuuugcauucuguaaauac

SEQ ID NO: 76532 - RNA, 64 nt, hsa
uaugguauauugugucaaucuuggaaggaaagcuguugcauaucaauuguaggucauguauuuu

SEQ ID NO: 76533 - RNA, 64 nt, hsa; identical to SEQ ID NO: 38319

SEQ ID NO: 76534 - RNA, 64 nt, hsa; identical to SEQ ID NO: 38320

SEQ ID NO: 76535 - RNA, 64 nt, hsa; identical to SEQ ID NO: 38321

SEQ ID NO: 76536 - RNA, 64 nt, hsa; identical to SEQ ID NO: 38322

SEQ ID NO: 76537 - RNA, 64 nt, hsa; identical to SEQ ID NO: 38323

SEQ ID NO: 76538 - RNA, 64 nt, hsa; identical to SEQ ID NO: 38324

SEQ ID NO: 76539 - RNA, 64 nt, hsa; identical to SEQ ID NO: 76531

SEQ ID NO: 76540 - RNA, 64 nt, hsa; identical to SEQ ID NO: 76532

SEQ ID NO: 76541 - RNA, 64 nt, hsa; identical to SEQ ID NO: 38319

SEQ ID NO: 76542 - RNA, 64 nt, hsa; identical to SEQ ID NO: 38320

SEQ ID NO: 76543 - RNA, 64 nt, hsa; identical to SEQ ID NO: 38321

SEQ ID NO: 76544 - RNA, 64 nt, hsa; identical to SEQ ID NO: 38322

SEQ ID NO: 76545 - RNA, 64 nt, hsa; identical to SEQ ID NO: 38323

SEQ ID NO: 76546 - RNA, 64 nt, hsa; identical to SEQ ID NO: 38324

SEQ ID NO: 76547 - RNA, 64 nt, hsa; identical to SEQ ID NO: 61495

SEQ ID NO: 76548 - RNA, 64 nt, hsa; identical to SEQ ID NO: 61496

SEQ ID NO: 76549 - RNA, 64 nt, hsa; identical to SEQ ID NO: 61497

SEQ ID NO: 76550 - RNA, 64 nt, hsa; identical to SEQ ID NO: 61498

SEQ ID NO: 76551 - RNA, 64 nt, hsa; identical to SEQ ID NO: 61499

SEQ ID NO: 76552 - RNA, 64 nt, hsa; identical to SEQ ID NO: 61500

SEQ ID NO: 76553 - RNA, 64 nt, hsa; identical to SEQ ID NO: 61501

SEQ ID NO: 76554 - RNA, 64 nt, hsa; identical to SEQ ID NO: 61502

SEQ ID NO: 76555 - RNA, 64 nt, hsa; identical to SEQ ID NO: 61503

SEQ ID NO: 76556 - RNA, 64 nt, hsa; identical to SEQ ID NO: 61504

SEQ ID NO: 76557 - RNA, 64 nt, hsa; identical to SEQ ID NO: 61505

SEQ ID NO: 76558 - RNA, 64 nt, hsa; identical to SEQ ID NO: 61506

SEQ ID NO: 76559 - RNA, 64 nt, hsa; identical to SEQ ID NO: 61507

SEQ ID NO: 76560 - RNA, 64 nt, hsa; identical to SEQ ID NO: 61508

SEQ ID NO: 76561 - RNA, 64 nt, hsa; identical to SEQ ID NO: 61509

SEQ ID NO: 76562 - RNA, 64 nt, hsa; identical to SEQ ID NO: 61510

SEQ ID NO: 76563 - RNA, 64 nt, hsa; identical to SEQ ID NO: 61511

SEQ ID NO: 76564 - RNA, 64 nt, hsa; identical to SEQ ID NO: 61512

SEQ ID NO: 76565 - RNA, 64 nt, hsa; identical to SEQ ID NO: 61513

SEQ ID NO: 76566 - RNA, 64 nt, hsa; identical to SEQ ID NO: 61514

SEQ ID NO: 76567 - RNA, 64 nt, hsa; identical to SEQ ID NO: 61515

SEQ ID NO: 76568 - RNA, 64 nt, hsa; identical to SEQ ID NO: 61516

SEQ ID NO: 76569 - RNA, 64 nt, hsa; identical to SEQ ID NO: 61517

SEQ ID NO: 76570 - RNA, 64 nt, hsa
uuucuuaaucugguaucaccucguguguucuuuggggcccuagaaacccuggcuuuugggagug

SEQ ID NO: 76571 - RNA, 64 nt, hsa
ucaaagacagccccuauccuccauucuugagucagggcccuaggugaccuauucuaacucaagg

SEQ ID NO: 76572 - RNA, 64 nt, hsa
cuccuccgagcaccucaugcaugucccagccccugggcccuagcccuuuccugcccugcagucu

SEQ ID NO: 76573 - RNA, 64 nt, hsa
acucauccauuucuauaggaugcacaaugcaugugggcccuaauauugaggccuuaucccugca

SEQ ID NO: 76574 - RNA, 64 nt, hsa
ugggcuccagcugccaagccacccaagggagucugggcccuaggccuagccccaucccucccca

SEQ ID NO: 76575 - RNA, 64 nt, hsa
agaggagcagucaggacuuccggacaacuuagcugggcccuacuugggcccaaguuucagaaua

SEQ ID NO: 76576 - RNA, 64 nt, hsa
aaacccacugguucuuagcucuguggguaggaaggggcccuagaaagggccuaguuacuauccu

SEQ ID NO: 76577 - RNA, 64 nt, hsa
ugucaguucuaacaguaguggaacaggagaaucugggcccuaggagcccuguaacucccaggag

SEQ ID NO: 76578 - RNA, 64 nt, hsa
acgcuggaccacagggucccccucaagcaucucggggcccuauucucucugagcaccuggaggg

SEQ ID NO: 76579 - RNA, 64 nt, hsa
cucaggcuugugccagggccugacuugggccugggggcccuagaacacuccuccuccugagccu

SEQ ID NO: 76580 - RNA, 64 nt, hsa
gcuccaggauuacucccuccuccaaaaaaggaaucaaauccacgaguggaaaagccuuuguaaa

SEQ ID NO: 76581 - RNA, 64 nt, hsa
ucccucauucccgcugaccucacuggcccacuggcaaauccaaccagcaaccagaaauguucua

SEQ ID NO: 76582 - RNA, 64 nt, hsa
agaacauuagccacgagccauaggcauuucaggccaaauccaugaaagggggaccagucauuua

SEQ ID NO: 76583 - RNA, 64 nt, hsa
uaaaugccucaauacguucugggagaaaacuuagcaaauccaucagcagggaucuguccccucu

SEQ ID NO: 76584 - RNA, 64 nt, hsa
aggcaggccuagcaguucccuuaccugaaguuuucaaauccauacugcaguucccucucguaau

SEQ ID NO: 76585 - RNA, 64 nt, hsa
uucauaaaccguguuuuucaaaauaaguuuaugucaaauccagcuucccagaaacacuaauaau

SEQ ID NO: 76586 - RNA, 64 nt, hsa
aucucccacuuaauggaaaggcaaagggguaccccaaauccagaggugccuacauuucaggcag

SEQ ID NO: 76587 - RNA, 64 nt, hsa
uuuacuuuuauaugacauucuuauacugcugucucaaauccaaaaacauuucagagcucuuguc

SEQ ID NO: 76588 - RNA, 64 nt, hsa
aacagaacuacuaacguuucaaguuuaccaagugcaaauccaagaagacccagaacggcgucac

SEQ ID NO: 76589 - RNA, 64 nt, hsa
cugaacuuucucucauaggacgucgcuuggauuucaaauccacggucaccugcugcccuuugcc

SEQ ID NO: 76590 - RNA, 64 nt, hsa
cccaagucugcuccuccaguugagacacaagucacaaauccaggcuucugaaacuucggaccaa

SEQ ID NO: 76591 - RNA, 64 nt, hsa
gaaccuccguguguucacgucucaugaagcucuccaaauccaguccucuuggguuuuuauggaa

SEQ ID NO: 76592 - RNA, 64 nt, hsa
cgggacugcgcgugaggccccggcccuccaaauccaaauccagacgcaggcccugaaaugaggg

SEQ ID NO: 76593 - RNA, 64 nt, hsa
ggaccucgggacugcgcgugaggccccggcccuccaaauccaaauccagacgcaggcccugaaa

SEQ ID NO: 76594 - RNA, 63 nt, hsa
ccucccuuuuuccuuguccccacacuccuacaccuaacucaccuaacucauacugugcuggag

SEQ ID NO: 76595 - RNA, 63 nt, hsa
uuccuuguccccacacuccuacaccuaacucaccuaacucauacugugcuggagccacuaacu

SEQ ID NO: 76596 - RNA, 64 nt, hsa
ccuucuuuagguaaccgagcauuuauuuaaccaacuauaccacugcauugggacgucugcacuu

SEQ ID NO: 76597 - RNA, 64 nt, hsa
auucuaagaaagccacugcuuucucaucaucacucuauaccaauacuuauuucuggccaaauga

SEQ ID NO: 76598 - RNA, 64 nt, hsa
cguugcagguguacugggcugucagggaucuuuucuauaccagaacugcggucacuauuuugua

SEQ ID NO: 76599 - RNA, 64 nt, hsa
caccccaugccucagcuucaugucugucccauuccuauaccauccccacccuguuguauguauu

SEQ ID NO: 76600 - RNA, 64 nt, hsa
uccuggugucaucacagccaagguuuuuagguugcuauaccaauggcuuauuaaaugaaaaugg

SEQ ID NO: 76601 - RNA, 64 nt, hsa
augcaucacaucacuuuugaaauguaauucuggucuauaccauggaagucauaaauggacauua

SEQ ID NO: 76602 - RNA, 64 nt, hsa
uuccagugagggcugcaggcuuccuagaggugugcuauaccaugcgucugucguugugcuuuuu

SEQ ID NO: 76603 - RNA, 64 nt, hsa
gugugucugucucucuggcguuccaccuccaagccuauaccagcuguguacagcgccaucucuc

SEQ ID NO: 76604 - RNA, 64 nt, hsa
auaaaagucuuccucuugccccagaaguaauucucuauaccaagauaugcuaggaguaggauga

SEQ ID NO: 76605 - RNA, 64 nt, hsa
cagcucucugguuuacuggaacauagucuuccaucuauaccacuaggguuuugucuuauguuua

SEQ ID NO: 76606 - RNA, 64 nt, hsa
uuuuagugacguauuuuuguauauauaggccaaccuauaccacauccaaaauuauguaucuauu

SEQ ID NO: 76607 - RNA, 64 nt, hsa
ucucaggugucuguauagauggccuaauaguucucuauaccaacuguaguucuuuuucuguucu

SEQ ID NO: 76608 - RNA, 64 nt, hsa
guguuuugaggauuuuaaaacugaauuuuaucugcuauaccaguuauuugagaaaguaugauuu

SEQ ID NO: 76609 - RNA, 64 nt, hsa
ugaauaaccaauaaacaguaaccuccaucaaaugcuauaccaauggaccaguguuaguagcugc

SEQ ID NO: 76610 - RNA, 64 nt, hsa
uuuuaggaaaccauuucauucuguuucuacuaaccuauaccaucugagaauucuaggaagaaua

SEQ ID NO: 76611 - RNA, 64 nt, hsa
agguuacugugauaggcauuuauucauauucuuucuauaccacugucauuaauauauuaaaaag

SEQ ID NO: 76612 - RNA, 64 nt, hsa
ccucugagucauuguuauaaaaaaucaguuaucacuauaccaugcuauaggagacugggcaaaa

SEQ ID NO: 76613 - RNA, 64 nt, hsa
aaaaaaaaaaaaccaguuagcugcuauauaaacacuauaccaagcacuaggcuuagaggaaaag

SEQ ID NO: 76614 - RNA, 64 nt, hsa
uuauugugauaaaguaugaauauuuuuagaaagucuauaccauguucuuucguuaaagauuugc

SEQ ID NO: 76615 - RNA, 64 nt, hsa
auuuuuuuuuaaaucaaaagggagagaacaaaagcuauaccaaaagggccauguuucaagaaaa

SEQ ID NO: 76616 - RNA, 64 nt, hsa
uccccggcacggcaaguacauggccugcugccugcuauaccauggagauguggugcccaaggau

SEQ ID NO: 76617 - RNA, 64 nt, hsa
uguaacacaaugaauuccagcuuucucauuuguucuauaccagaaugggaaauuuccccaaauc

SEQ ID NO: 76618 - RNA, 64 nt, hsa
cugccugaagaaauucugccuuugacaauaaauccuauaccagcuuuuuguuuguuuauguuac

SEQ ID NO: 76619 - RNA, 64 nt, hsa
uuuucagacuauuuuaauuccugccccguuauuacuauaccaggucguacauuuccuguugauc

SEQ ID NO: 76620 - RNA, 64 nt, hsa
uacuauuauaaauaaagugaaacaauaucucuuacuauaccauuucuaaauuuagaguucguaa

SEQ ID NO: 76621 - RNA, 50 nt, hsa
aagaagacucugaaguauagcuauaccagcuauuuagggaauaauuagaa

SEQ ID NO: 76622 - RNA, 64 nt, hsa
cuauuauguaacauccagaagguuugcaccccuccuauaccauaugucugcuucuguccaggac

SEQ ID NO: 76623 - RNA, 64 nt, hsa
auguuucuuuuaauugauuuaaaggacuugucuucuauaccacccuuguccucaucucagguaa

SEQ ID NO: 76624 - RNA, 64 nt, hsa
ugugacaaacagcuagagcaucagagcccuuuugcuauaccacagucuuucguuuccagccuuu

SEQ ID NO: 76625 - RNA, 64 nt, hsa
cuuuuguuagugcuuuaugggaagaauagggagucuauaccagugcugugggaaaaaugguaac

SEQ ID NO: 76626 - RNA, 64 nt, hsa
uguauugcuuuuuuuuuuuuuuuuuuuccuucuacuauaccauuuuaaguucugaccucaggcc

SEQ ID NO: 76627 - RNA, 64 nt, hsa
ugggcuacgugaauagcgcccucaacccugugaucuauaccaccuucaauaucgaguuccggaa

SEQ ID NO: 76628 - RNA, 64 nt, hsa
aaauaauaugaaguagguuggucucucugcuucucuauaccaggacuucuuagcucaguaucau

SEQ ID NO: 76629 - RNA, 64 nt, hsa
aucaugcuacacuuaacuucuccuagaagcuaaucuauaccauaauauuuucauauucacaaga

SEQ ID NO: 76630 - RNA, 64 nt, hsa
gauaacugaaugaagcauuugaguauaacagacacuauaccaaaauaccaagcaacuguuuuga

SEQ ID NO: 76631 - RNA, 64 nt, hsa
cagaagaucuccagucaccccauagagacucucucuauaccagcaugccgacacuggcuggugu

SEQ ID NO: 76632 - RNA, 64 nt, hsa
aagcauucuuggggaaagagaaaucacugacauucuauaccaaugguucccaaaauuuuuuccc

SEQ ID NO: 76633 - RNA, 64 nt, hsa
uuaucacagaauuuuuuuuccugcuggccuauugcuauaccaaugauguugaguggcauuuucu

SEQ ID NO: 76634 - RNA, 64 nt, hsa
aaugaauaaauacaugcauaauauuuucaaaguucuauaccaguaccuauuuuuacucuuacaa

SEQ ID NO: 76635 - RNA, 64 nt, hsa
uuacagcuugguaggaggaauaauuucugguguucuauaccacuguaggacgacuauaguuaag

SEQ ID NO: 76636 - RNA, 64 nt, hsa
cuuaaauggaaggcauagucagcgaggguaaauccuauaccacuuuaggaaguauuaaaaauau

SEQ ID NO: 76637 - RNA, 64 nt, hsa
ugcugccaaccauguguaggguauguauauguuccuauaccauaauaaaauuuuaauuacauuu

SEQ ID NO: 76638 - RNA, 64 nt, hsa
guuguugcuauuggauuccaaacugcuaugcccucuauaccaguggcugacaaggcauauaggg

SEQ ID NO: 76639 - RNA, 64 nt, hsa
aucuccagaauuuguucucagucccaaacugaaacuauaccauucaaacaacagcgcuccccau

SEQ ID NO: 76640 - RNA, 64 nt, hsa
caaugcauuauuuuuuuccuccuuuccuuccaaacuauaccacuguauuuaccacuucuaagag

SEQ ID NO: 76641 - RNA, 64 nt, hsa
ucuguuugcuuauuccacauuaauuuacuuuucucuauaccaaaucacccauggaauaguuauu

SEQ ID NO: 76642 - RNA, 64 nt, hsa
uagcagaacacaagagagcaagaaaaugucacaucuauaccaaauuaaggauguugaguuaugu

SEQ ID NO: 76643 - RNA, 64 nt, hsa
ggucauggccccucucugggcccagcccauuuaucuauaccaugagguaacugaaguaaggaga

SEQ ID NO: 76644 - RNA, 64 nt, hsa
ucagccuucagcagaguuggcuuauugccugccucuauaccaauaagucagucaccuugcuccu

SEQ ID NO: 76645 - RNA, 64 nt, hsa
ugacuccuucuuccaccccucuucuugcuaucuccuauaccaauaaauacgaagggcuguggaa

SEQ ID NO: 76646 - RNA, 64 nt, hsa
cagcacagugugucauuugcagauuugugguuaccuauaccacgcuagguguuuugacauguuu

SEQ ID NO: 76647 - RNA, 64 nt, hsa
aggaaaguacaaccagaauugaaaaccaacugaucuauaccaguucuuucaauuaauagucaag

SEQ ID NO: 76648 - RNA, 64 nt, hsa
auuguucaaaauuggagauguacacauacauacccuauaccaagagggccgaaacucuucaccu

SEQ ID NO: 76649 - RNA, 64 nt, hsa
uaaguuuuuuuuccacagguauuuuuccugagcucuauaccaugcauuuagcugccuagugaga

SEQ ID NO: 76650 - RNA, 64 nt, hsa
uggugaauaauaauuaacuauugugaacaguacacuauaccauacuuccuuagcuuauaaauaa

SEQ ID NO: 76651 - RNA, 64 nt, hsa
caauccaaacguucaccuguuuccuuuccucaagcuauaccaguguaauaccaguuacccugug

SEQ ID NO: 76652 - RNA, 64 nt, hsa
auuaguguuaaacucuuaaucgacuccugcaaaucuauaccagugagaaaucuuacaaauguau

SEQ ID NO: 76653 - RNA, 64 nt, hsa
cuaguaauagagcuuacauauauuuguauaacugcuauaccacugaacugaauuuauuuuacaa

SEQ ID NO: 76654 - RNA, 64 nt, hsa
ccaacagcuaaagcccccaguaucucuucagucucuauaccaauaaagugacccuguucucacu

SEQ ID NO: 76655 - RNA, 64 nt, hsa
ccaacagcuaaagccccuggucccucugcagucucuauaccaauaaagugacccugcucucacu

SEQ ID NO: 76656 - RNA, 64 nt, hsa
uugggauuaagagcuuucuagccagaaucuggaccuauaccaugggaaaauuuaggggugcugg

SEQ ID NO: 76657 - RNA, 64 nt, hsa
uuuauaacuaauccacguuugcuuucagaugacacuauaccacuuugcagguagggugguauau

SEQ ID NO: 76658 - RNA, 64 nt, hsa
uuuaccguggcaaccgucaagcuauucucugucccuauaccaggugucaucaaauuuuuuucug

SEQ ID NO: 76659 - RNA, 64 nt, hsa
acaaacuuauggguaauaaaggcuagucagaacccuauaccauaaaguguaguuaccauacaga

SEQ ID NO: 76660 - RNA, 64 nt, hsa
uucccaagguuacuggauagaagccaaccacagucuauaccauagcaauguuuuuccuuuaauc

SEQ ID NO: 76661 - RNA, 64 nt, hsa
uauuuaacuugaaauucaucaugggagucugcugcuauaccaggcacaagauaaaacuccaaaa

SEQ ID NO: 76662 - RNA, 64 nt, hsa
ccaacagcuaaagcccccggucccucugcagucucuauaccaauaaaguggcccugcucucacu

SEQ ID NO: 76663 - RNA, 64 nt, hsa
ucagaacauuacaugccuucaaaaugggauuguacuauaccaguaagugccacuucugugucuu

SEQ ID NO: 76664 - RNA, 64 nt, hsa
uaugcaaaaaguauuucucugucaguuccccacucuauaccaaggauauuauuaaaacuagaaa

SEQ ID NO: 76665 - RNA, 64 nt, hsa
caaaaaaguuaacuuaugugacuuggcaguuauucuauaccauuuccuguccauuaaaauuuuu

SEQ ID NO: 76666 - RNA, 64 nt, hsa
ggggacuagacaguuagagacucugucacccuagcuauaccagcagaaaaccuguucaggcagg

SEQ ID NO: 76667 - RNA, 64 nt, hsa
ggcccacagguggcagugggcagaggggaccccgcuauaccaccucgcugcuguuccacugucu

SEQ ID NO: 76668 - RNA, 64 nt, hsa
uuuuugacuaaguuuaaacucaugaauuguuaugcuauaccaaucugcaguaaaaaaaauuuuu

SEQ ID NO: 76669 - RNA, 64 nt, hsa
cuaaagagagugacaaaugcuuccuuaaugucuucuauaccagaauguaaauauuuuuguguuu

SEQ ID NO: 76670 - RNA, 64 nt, hsa
aacucuuucaaaaccuuuugaaauuaaccucucacuauaccaguauaauugaguuuucaguggg

SEQ ID NO: 76671 - RNA, 64 nt, hsa
uucuacuuaucugagaagcaaaucccuguggagacuauaccacuauuuuuucugagauuaaugu

SEQ ID NO: 76672 - RNA, 64 nt, hsa
ucuauuagagaaagaagcccuaaagcagaaagcucuauaccaagaaguccaaacccagcacgca

SEQ ID NO: 76673 - RNA, 64 nt, hsa
cggcagcgaggcugggcuggccagccaccacugacuauaccaacugggccucugauguucuucc

SEQ ID NO: 76674 - RNA, 64 nt, hsa
ucaagaccagccuggccaacauggugaaacccaucuauaccaaaaauacaaaaauuagccgggu

SEQ ID NO: 76675 - RNA, 64 nt, hsa
aauuccgggcacggcagcgccguggcuccccacgcuauaccaucuaccugggcuucgggcagga

SEQ ID NO: 76676 - RNA, 64 nt, hsa
ggaggugcugugugugagucaaccacuuguaccacuauaccacuggggggccccagucuaagcu

SEQ ID NO: 76677 - RNA, 64 nt, hsa
augccccucccuccccacggcccugccaagcagucuauaccagcaugaguacugccccaccccu

SEQ ID NO: 76678 - RNA, 64 nt, hsa
ugcagaacagcuguggagacucuaaccugaagaucuauaccaaacgucgucugcuuaccacgua

SEQ ID NO: 76679 - RNA, 64 nt, hsa
auggcuuggcuaauaagcaugcaauuccauauaucuauaccaucuuguaacucacuguguuagu

SEQ ID NO: 76680 - RNA, 64 nt, hsa
acgucaccauuacuuaaaagaugauugauuauugcuauaccaaaucagaugaacucuguucauc

SEQ ID NO: 76681 - RNA, 64 nt, hsa
ggaugcuuagugcccucacuucuucucucucucucuauaccaucugagcacccauugcucacca

SEQ ID NO: 76682 - RNA, 64 nt, hsa
acauaaacuuuauaaaccuuuuauaaaaaggaaacuauaccauuacuauaaauggaaaaucauu

SEQ ID NO: 76683 - RNA, 64 nt, hsa
uuucugcagcuaagggcagaggcugugccuagggcuauaccaccacuagcaucuguauuugaga

SEQ ID NO: 76684 - RNA, 64 nt, hsa
aaaaggucaauaaggucaagggaaaaccccgucucuauaccaaccaaaccaauucaccaacaca

SEQ ID NO: 76685 - RNA, 64 nt, hsa
guauaauauuguauuauuaauuuauuuuuacuuucuauaccauuucaaaacacauuacacuaag

SEQ ID NO: 76686 - RNA, 64 nt, hsa
cucugccauagaaauggcagauuaagaagauugacuauaccaaacauuauauuaaaaacacaaa

SEQ ID NO: 76687 - RNA, 64 nt, hsa
gugugucuuccaacuuucauugaaaaugccauaucuauaccauauuuuauucgagucacugaug

SEQ ID NO: 76688 - RNA, 64 nt, hsa
agaaagcaacagguaagauaggcuuucucucucccuauaccaaguaauuuauaccuacacagau

SEQ ID NO: 76689 - RNA, 64 nt, hsa
gcugggauuacaggcgucagccaccgcgccuggccuauaccaguauuuucuaguuuaaaggagg

SEQ ID NO: 76690 - RNA, 64 nt, hsa
uuuauucuagaauugcagaaaugacuacacugugcuauaccagagaauuccaguagaaagaaac

SEQ ID NO: 76691 - RNA, 64 nt, hsa
aggauuuaccuaauuguccaauucuacgugcucucuauaccaaaacaaaaaaaaaaagcuaucc

SEQ ID NO: 76692 - RNA, 64 nt, hsa
uuauuguuacagauaaaacuugagagauaaaaagcuauaccauaauaaaaucuaaaauuaagga

SEQ ID NO: 76693 - RNA, 64 nt, hsa
ucucuccuuuuaggaguaagccaucccacaaguucuauaccauauuuuuagugacaguugaggu

SEQ ID NO: 76694 - RNA, 64 nt, hsa
cacagaacuuaaaaugaacgccuguagagacacucuauaccaggccugagugcaggucuuggcg

SEQ ID NO: 76695 - RNA, 64 nt, hsa
ugcuugcaagcguaauauccaacaguuuaagguacuauaccacaugguaaccuacuguuugcca

SEQ ID NO: 76696 - RNA, 64 nt, hsa
accaguuccuuuaagcagucuuuuuaccugcaggcuauaccaaccaggauccaaaugaagagaa

SEQ ID NO: 76697 - RNA, 64 nt, hsa
acgucccuugugacaacaccaccaagccuggugucuauaccaaagucugccacuacuuggagug

SEQ ID NO: 76698 - RNA, 64 nt, hsa
cagaccccugugggagguccgacaaaccuggcgucuauaccaacaucugccgcuaccuggacug

SEQ ID NO: 76699 - RNA, 64 nt, hsa
gguucucuacugccuccugaauacacaugaaccccuauaccaauuuuaagaaaaaaaugauucu

SEQ ID NO: 76700 - RNA, 64 nt, hsa
gaacacaaauaccaaaacugcauuuugguuuugccuauaccauccugauuuuugaaaagugaau

SEQ ID NO: 76701 - RNA, 64 nt, hsa
gacagagggggaaauaagaggaggagaaagcucucuauaccaaagacugaaaaaaaaaauccug

SEQ ID NO: 76702 - RNA, 64 nt, hsa
cuggugauuucaguucugugaaauauuuugggaucuauaccaauuaaacauuuucauaguucug

SEQ ID NO: 76703 - RNA, 64 nt, hsa
ugggaucaccccagccacaagcccuucgagggcccuauaccauggcccaccuuggagcagagag

SEQ ID NO: 76704 - RNA, 64 nt, hsa
uuccacagagcaugcaagaacuucuacaaaacuucuauaccacacagaagcugaaagagacucu

SEQ ID NO: 76705 - RNA, 64 nt, hsa
gcaggggagccuauaaggagagcgaugcccacuccuauaccacccuuguaacccaguagacuug

SEQ ID NO: 76706 - RNA, 64 nt, hsa
aaucuugggaacugaagccagucauguaaacauacuauaccaaucuagucccuaacaguguuuu

SEQ ID NO: 76707 - RNA, 64 nt, hsa
uucagagaucucucuucccaaauguguaaauauucuauaccagauaaguuuaaauaagaaauuu

SEQ ID NO: 76708 - RNA, 64 nt, hsa
uugaaucucguucuuuguguccuuacuuucugcccuauaccaucaauaggggaagagugguccu

SEQ ID NO: 76709 - RNA, 64 nt, hsa
uacccuaaacugcauaauucugaaguuauauuuccuauaccauuuccguaauucuuauuccaua

SEQ ID NO: 76710 - RNA, 64 nt, hsa
uuucuuccugcaucuugggacacuccuucccugucuauaccacugacucuugcucugguuguug

SEQ ID NO: 76711 - RNA, 64 nt, hsa
agauaacccuggcccuacagccugcuugcuccgccuauaccacagagcacagccuggacauuau

SEQ ID NO: 76712 - RNA, 64 nt, hsa
agccuugcccaguuguucucucuggacucuguuccuauaccacaacagcagcaggggccugaaa

SEQ ID NO: 76713 - RNA, 63 nt, hsa
gaucacgugaggucaagaguucaagaccagccuggccaauauggugaaaccccaucucuacua

SEQ ID NO: 76714 - RNA, 63 nt, hsa
cagaucacgagaucaggaguucaagaccagccuggccaauaugaugaaaccccgucucuacua

SEQ ID NO: 76715 - RNA, 63 nt, hsa
uuggugggguuuuccccccuuuuuuauggaguuggccaauaggauugaguuggggcuccagua

SEQ ID NO: 76716 - RNA, 63 nt, hsa
ucacacuaaguuguaaacauaggagaagcauuuggccaauaaaguuguugaaacucuauagac

SEQ ID NO: 76717 - RNA, 63 nt, hsa
gaucaccugaggucaggaguucgaguccagccuggccaauaugcugaaacccugucucuacua

SEQ ID NO: 76718 - RNA, 58 nt, hsa
uccaguuuuccaggcuguaagaaaaaagggccaauaaccagacugcugagguugccca

SEQ ID NO: 76719 - RNA, 63 nt, hsa
ucagaauauaagacucaaggaguuugacuugguggccaauaccugccuuccaaagagauccua

SEQ ID NO: 76720 - RNA, 63 nt, hsa
gucuguuuuuaaaaccauaggugggacagcuauggccaauaggcuauaaagagacauuuagca

SEQ ID NO: 76721 - RNA, 63 nt, hsa
accacagacaccauauauccuucugcauccuuuggccaauaaaaguugcuggagaaccaaacc

SEQ ID NO: 76722 - RNA, 63 nt, hsa
gccauaagccucccauuuuguuagcgucagcuaggccaauaggaacagaccgggaccuugucu

SEQ ID NO: 76723 - RNA, 63 nt, hsa
agauaccugaagucaggaguucgagacuagccuggccaauaugguaaaaccccgugucuauua

SEQ ID NO: 76724 - RNA, 63 nt, hsa
auggggguagccccaaaaggaggaaucuccuauggccaauaagguaucuugacuuuaucaaag

SEQ ID NO: 76725 - RNA, 63 nt, hsa
aguacugggauuuaggcaugagccaccacaucuggccaauaguuucuuuugaugugcagaagc

SEQ ID NO: 76726 - RNA, 63 nt, hsa
ugcauaaaucaaugguucaagucuucuguuaggggccaauaaaauguaucugcauauguuuuc

SEQ ID NO: 76727 - RNA, 63 nt, hsa
uccgagacggagucuugcucugccacugugcccggccaauacauuauuauuaacuuaaggcug

SEQ ID NO: 76728 - RNA, 63 nt, hsa
acagcacuccaggccagcucaagaagcaaagcaggccaauagaaaugcaauauuuuuaauuua

SEQ ID NO: 76729 - RNA, 63 nt, hsa
uggaucacaaggucaggaguucaagaccagccuggccaauauggugaaaguccgucucuacua

SEQ ID NO: 76730 - RNA, 63 nt, hsa
gaucacuugaggucaggaguucgagaccagccuggccaauacggcaaaaccucaucauuacua

SEQ ID NO: 76731 - RNA, 63 nt, hsa
aaucaugaagagaguuaaugguuaacagacauuggccaauaacaaaacaccccauggacugug

SEQ ID NO: 76732 - RNA, 63 nt, hsa
ucacuuuucacuucuggcuuuuuuguggcccaaggccaauauaggauuaauaucuguguucca

SEQ ID NO: 76733 - RNA, 63 nt, hsa
cccagacaucugggaaccaaauucuacccaaugggccaauauugcagaacaguauggugacug

SEQ ID NO: 76734 - RNA, 63 nt, hsa
cucaaaaaagaaaaacaaaaaacaaaaaacaggggccaauaaauucccuaacauccacagugu

SEQ ID NO: 76735 - RNA, 63 nt, hsa
acuuugggaggcugaggugggcagaucacuugaggccaauaguucgagaucagccugaccaac

SEQ ID NO: 76736 - RNA, 63 nt, hsa
gaucacuugaggucaggaguucgagagcagccuggccaauaugaugaaaccccaucucuacua

SEQ ID NO: 76737 - RNA, 63 nt, hsa
guuaauuugaggguagggguaugagaccaucuuggccaauauagcaagacccugugucuaaaa

SEQ ID NO: 76738 - RNA, 63 nt, hsa
ugcauuauucuugucuccuuuucagaccaugauggccaauauggagauuaaaauaugucauca

SEQ ID NO: 76739 - RNA, 63 nt, hsa
gaucauuugaggccaggaguucaagaccagucuggccaauauggagaaaccuugucucuacua

SEQ ID NO: 76740 - RNA, 63 nt, hsa
ggguuaagggaggguacuguugacaccagcuauggccaauagcugggcuguccugaggggugg

SEQ ID NO: 76741 - RNA, 63 nt, hsa
uaauuuaucucuuguuugaaucugucauucaaaggccaauaauuuaaguugcuaucagcugau

SEQ ID NO: 76742 - RNA, 63 nt, hsa
guuucaagauuuuuuuuuaauguuccagaagauggccaauagagaacauucaagggaaauggg

SEQ ID NO: 76743 - RNA, 63 nt, hsa
auauuuucaucuguuuacuuguagugccauagaggccaauaugcacaauauuaacuaaugcca

SEQ ID NO: 76744 - RNA, 63 nt, hsa
uguugucaucacuugguccaugaaauauuaccuggccaauaucccaccaucaccucaaaccca

SEQ ID NO: 76745 - RNA, 63 nt, hsa
caauuuauuuguggcuuauuuuacccaugagcuggccaauacuuccuggccuagaaaaauauc

SEQ ID NO: 76746 - RNA, 63 nt, hsa
guuugucacuaguuuuucauuauuaaaugcugaggccaauaccaagaaguuuauuuucuauau

SEQ ID NO: 76747 - RNA, 63 nt, hsa
cagaucaugaugucaggaguuugagaccagccuggccaauauggugaaacccugucucuacaa

SEQ ID NO: 76748 - RNA, 63 nt, hsa
auuauuuuaucuuuaagcaugcuacuuuuacuuggccaauauuuucuuauguuaacuuuugcu

SEQ ID NO: 76749 - RNA, 63 nt, hsa
gaaaaccucagucauugcaugcuuuuuaguaugggccaauaaaaucucaacaccugugggaga

SEQ ID NO: 76750 - RNA, 63 nt, hsa
aacuagcuuugcucuuuagaugcaaguggcugaggccaauaggugccuaguaaauguuaacug

SEQ ID NO: 76751 - RNA, 63 nt, hsa
aaggaccagagaauucuuagauuggcccggaaaggccaauaaagaguuagaaugaaaacucau

SEQ ID NO: 76752 - RNA, 63 nt, hsa
caguaagcagcaccuccaagacugucuccuuuuggccaauaucauaagauggacgccauaauc

SEQ ID NO: 76753 - RNA, 63 nt, hsa
uggaucacaaggucaggaguucgagaccagccuggccaauauggugaaaccccgucucuacua

SEQ ID NO: 76754 - RNA, 63 nt, hsa
ucaaaaugaucuuuagugccuuuauuccuuucaggccaauaauccacccaaaaauuagaaugu

SEQ ID NO: 76755 - RNA, 63 nt, hsa
auuugaaccuuucucauggauuuuuguggugugggccaauaugguguuuacauuauauaauuc

SEQ ID NO: 76756 - RNA, 63 nt, hsa
uagcucagauagcuaauuaggaaauuucaaguuggccaauaauagcauucucucugacauuua

SEQ ID NO: 76757 - RNA, 63 nt, hsa
aagcaguaaaaauuguucauuaaucuuccguuaggccaauaaaagaagggccucacaagacaa

SEQ ID NO: 76758 - RNA, 63 nt, hsa
cauuaaaauaaccugaaggaaacuuucguuaugggccaauauuagcucuuauggaaacugauu

SEQ ID NO: 76759 - RNA, 63 nt, hsa
agccugcucccacacugucacuggaugucauggggccaauaaaaucuccugcaauuguguauc

SEQ ID NO: 76760 - RNA, 63 nt, hsa
aggauuuuucugcaggacuuuaaagcuuugaaaggccaauaucccauaggcuaacuuuaaaca

SEQ ID NO: 76761 - RNA, 63 nt, hsa
auucugggaagaaaaaaaaaacauuaaugaagaggccaauaauaugaagggaaucauggauca

SEQ ID NO: 76762 - RNA, 63 nt, hsa
cuggaaaugguuuaccuaaaagcuacagaaccaggccaauauauuuugaaauauugaugcaga

SEQ ID NO: 76763 - RNA, 63 nt, hsa
agauccccucaacugucuacuuguugcagugagggccaauaauuaugaaauugucaggcugcu

SEQ ID NO: 76764 - RNA, 63 nt, hsa
ccucccucaccuguuauaaaaaauucgcugggaggccaauaggcugaaauggcuccugcacuu

SEQ ID NO: 76765 - RNA, 63 nt, hsa
aguuucuauuuaguuauuuaagaagaaugagaaggccaauaguuuuagauuauuuuaucuggu

SEQ ID NO: 76766 - RNA, 63 nt, hsa
agaauaggagugaugggugaagggaccuaagcuggccaauagcccucugccccagacauggga

SEQ ID NO: 76767 - RNA, 63 nt, hsa
uuuuauaaaauuguugacauuucaggcaaauuuggccaauauuaucauugaauuuucuguguu

SEQ ID NO: 76768 - RNA, 63 nt, hsa
cagcuccacauucuuuguugacgugacacuaacggccaauaauaugcuucuuaauuaucaaau

SEQ ID NO: 76769 - RNA, 63 nt, hsa
cuguauaacuccuugccaugcaaacucucaagaggccaauauauuccuggccauguuugaaug

SEQ ID NO: 76770 - RNA, 63 nt, hsa
augacucuagcugggcaccuuggaccuccagcuggccaauagaagagacaggagacaggaagc

SEQ ID NO: 76771 - RNA, 63 nt, hsa
aaucugugcagucaucaacaaaagggagaacauggccaauagucauaugugaagacagagcag

SEQ ID NO: 76772 - RNA, 63 nt, hsa
uaauaaccguauuuuucacagggugacaaauugggccaauaaaucugccaucuuugaacucau

SEQ ID NO: 76773 - RNA, 63 nt, hsa
uaacccaaugccugugaagcagucagcccuuauggccaauaacuuuucaccaaugagccuuag

SEQ ID NO: 76774 - RNA, 63 nt, hsa
aucguucaucuagugagcaauacacauauuauaggccaauauuuuuuuaaaaaauagagcuug

SEQ ID NO: 76775 - RNA, 63 nt, hsa
cauuuagggaguuaucuguuuucaucuugagguggccaauauggggauguggaauuuuuauac

SEQ ID NO: 76776 - RNA, 63 nt, hsa
aaaauagccaauuaacacaaccaaauacaacugggccaauauaaacauguuugaauugucaaa

SEQ ID NO: 76777 - RNA, 63 nt, hsa
uuuuaacuuuuuguuuuuauuucuuuuagaaaaggccaauauaccuaucacacuuuggaagua

SEQ ID NO: 76778 - RNA, 63 nt, hsa
ugaggggaggaggaaugggagagggggcucaggggccaauaaacucugccuugaguccuccua

SEQ ID NO: 76779 - RNA, 63 nt, hsa
caguggaaagagcacgaggauguucucagcucuggccaauacuccauuucauaaaccauguua

SEQ ID NO: 76780 - RNA, 63 nt, hsa
aaucacuugagucuaggaguucaagaccagccuggccaauauggcaaaacccugucucuacua

SEQ ID NO: 76781 - RNA, 63 nt, hsa
cucugagccucugucucugcuucugaacagcggggccaauaaugaugccccgaugccuuccug

SEQ ID NO: 76782 - RNA, 63 nt, hsa
gcagcaacacugauacuugugugcaccugauuuggccaauaggaucaacagugaaaagacaga

SEQ ID NO: 76783 - RNA, 63 nt, hsa
aacaacaagacucuuuuuguacuaccauacucuggccaauaccagagcauaucagcagaguag

SEQ ID NO: 76784 - RNA, 63 nt, hsa
cagaugcacugauauauaugcauuugcuguuuuggccaauauuuugaaaauguaugagcugag

SEQ ID NO: 76785 - RNA, 63 nt, hsa
acccaggaacuguaaauuuaaaccuaaauauuuggccaauaguuuucagacuuaaagcaucau

SEQ ID NO: 76786 - RNA, 63 nt, hsa
gacuuuguaaguucuuauucugggagaacauaaggccaauaaucaugaccucuuccaggcauu

SEQ ID NO: 76787 - RNA, 63 nt, hsa
uuucaauagcauaaugaaauaaaauuuugaauuggccaauaacaugcuuuauaaucuuccagu

SEQ ID NO: 76788 - RNA, 63 nt, hsa
gaccugucucaccauguacauagcuugauaaagggccaauaaauaugauguuauggugaucau

SEQ ID NO: 76789 - RNA, 63 nt, hsa
agcaguuauuugauuugugcucacuuuugauauggccaauaaaaccauaccgacugagcuucu

SEQ ID NO: 76790 - RNA, 63 nt, hsa
cggaucaugaggucaagaguucgagaccagccuggccaauauggugaaaccccgucucuauug

SEQ ID NO: 76791 - RNA, 63 nt, hsa
uggaucacaaugucaggaguuugagacuagccuggccaauauggugaaacccugucucuacua

SEQ ID NO: 76792 - RNA, 63 nt, hsa
uuaaaaaaggaaaaauaugguuuccagagaaaaggccaauaccuaagcauuuuuuccaugaga

SEQ ID NO: 76793 - RNA, 63 nt, hsa
accagucacuuacuccaagaagucguuuccuguggccaauaaugaagaugacgcacucggaag

SEQ ID NO: 76794 - RNA, 63 nt, hsa
aucacgaggucaggaguucgagaccagcagccuggccaauauagugaaacuucgucucuacua

SEQ ID NO: 76795 - RNA, 63 nt, hsa
cagcagaagcaggguacccuuuggggagcaggaggccaauaaaaaguucagaguucauuggau

SEQ ID NO: 76796 - RNA, 63 nt, hsa
cuggacugcuucuuuuggcucuccgacaacuccggccaauaaacacuuucugaauugaguuug

SEQ ID NO: 76797 - RNA, 63 nt, hsa
ucagaacuugccagcuccucaaaacuuuacuagggccaauaaacuuucuuucaaaacaauacg

SEQ ID NO: 76798 - RNA, 63 nt, hsa
gaucacuugaggucaggaguucgagaccagccuggccaauaaggugaaacccugucucuacua

SEQ ID NO: 76799 - RNA, 63 nt, hsa
uuaguacaugggagggcuagccccgggacuuggggccaauacggaaacccuaccccuuccaug

SEQ ID NO: 76800 - RNA, 63 nt, hsa
ugcuuacaguuuuccuauucaaacaauuuguuaggccaauauuuugugacauuuuuguagcga

SEQ ID NO: 76801 - RNA, 63 nt, hsa
auaauuguaaaaagaaugaaauuaugcagaaauggccaauaucucuuaucaaucuguucuuuu

SEQ ID NO: 76802 - RNA, 63 nt, hsa
cggaucacaaggucaggaguucgagaccagccuggccaauauggugaaaccccaucucuacua

SEQ ID NO: 76803 - RNA, 63 nt, hsa
gaucaccugaggucaggaguucgagacaagcguggccaauauggcaaagcccagucucuacua

SEQ ID NO: 76804 - RNA, 63 nt, hsa
aaggaugaaaacaagugucuucacuaagcguauggccaauaaaugggacccaaacguucaauc

SEQ ID NO: 76805 - RNA, 63 nt, hsa
aagauaauucucauuuguguuugucuuuuaaaaggccaauaaaauaucuuucaguaucauugu

SEQ ID NO: 76806 - RNA, 63 nt, hsa
auucauuaugacugcuccaggaagggcuaauggggccaauauauuauugccugucauguggca

SEQ ID NO: 76807 - RNA, 63 nt, hsa
ccaggucagggucccggagccggugcccucacaggccaauagggaagccgagggcuguuuugu

SEQ ID NO: 76808 - RNA, 63 nt, hsa
gcucugguuuuauaauaucuuggguaucucuaaggccaauaaggauaacauuaucuacccaga

SEQ ID NO: 76809 - RNA, 63 nt, hsa
gccaagaccaugggaaaaaaagccaugcucacuggccaauaaagagcuugaugcugccuggcc

SEQ ID NO: 76810 - RNA, 63 nt, hsa
aaaagucaguagggacauugcagaagcuugaaaggccaauaccagaacacaggcugaugcuuc

SEQ ID NO: 76811 - RNA, 63 nt, hsa
auucagacuuucaaaauaaagauguaaaugacuggccaauaauaaccauuuuaggaagguguu

SEQ ID NO: 76812 - RNA, 63 nt, hsa
aaaacauaucaguuugaauacuugaaucaugcaggccaauauuauaaugugaaaagguaucua

SEQ ID NO: 76813 - RNA, 63 nt, hsa
accccacucacuuuguaacuucaucacugacccggccaauaaggacccugugcgucuucuccc

SEQ ID NO: 76814 - RNA, 63 nt, hsa
caaaaaugcagugccaggagugcuaaaccuagaggccaauacugaugaccuggaaggugaucc

SEQ ID NO: 76815 - RNA, 63 nt, hsa
cuucuaacuuguuucuugacgaccaccucauguggccaauaaauggacugggagcguuuuagc

SEQ ID NO: 76816 - RNA, 63 nt, hsa
cuuuuucuauugcuaggagccugccagaacaaaggccaauauauaauguugugacaucauauc

SEQ ID NO: 76817 - RNA, 63 nt, hsa
uaccaugagaagaagugucccguuuuguccaguggccaauagcaagauaugaaccggucggga

SEQ ID NO: 76818 - RNA, 63 nt, hsa
cuguacuaugaugggcuucuguucucugcugagggccaauacccuacuguggggagagauggc

SEQ ID NO: 76819 - RNA, 63 nt, hsa
ugucccugggguggcuaggcaggaguggcguggggccaauacccagaccccuucagccaccag

SEQ ID NO: 76820 - RNA, 63 nt, hsa
ugugcaagaaagggagaccuaagggugaacaguggccaauaaaaacccuagagaacaaacauc

SEQ ID NO: 76821 - RNA, 63 nt, hsa
caucgugggugaggguauccccugugugucccaggccaauaaaaucuaccugccacugccccu

SEQ ID NO: 76822 - RNA, 63 nt, hsa
aucuccgcauuuguguguguguccaacucuguaggccaauaaaccaacaagacaaaugaacug

SEQ ID NO: 76823 - RNA, 63 nt, hsa
ggugaugaaaaugacccacauuuaugaaacagaggccaauacaugcuccugccagagagguuu

SEQ ID NO: 76824 - RNA, 63 nt, hsa
ucugguggucucccccugcucgagcggccccucggccaauaagacaguggacaucaugacgag

SEQ ID NO: 76825 - RNA, 63 nt, hsa
gccagggauuuuuaauuaaauggggugauggguggccaauaccacaauuccugcugaaaaaca

SEQ ID NO: 76826 - RNA, 63 nt, hsa
gugcugggauuacacgcgugagccaccaugcccggccaauacuacacucuuauucugccuuac

SEQ ID NO: 76827 - RNA, 63 nt, hsa
gaccccacaguggggcuggaccagggcccuggaggccaauaaagagcuuucuggguagacccu

SEQ ID NO: 76828 - RNA, 63 nt, hsa
caaagcccccuugggggaacuguggcugcugggggccaauaaagcuguguaacuugaucgugg

SEQ ID NO: 76829 - RNA, 63 nt, hsa
cagaucaugaggucaggaguuugagaccagccuggccaauauggugaaaccacgucucuauua

SEQ ID NO: 76830 - RNA, 63 nt, hsa
gugagcugagaucuucccacugcacuccagccuggccaauaagaccugucuccagcaagaccc

SEQ ID NO: 76831 - RNA, 63 nt, hsa
uggcagaaacucuauaagccagaagagagugggggccaauauucaacauucuuaaagaaaaga

SEQ ID NO: 76832 - RNA, 63 nt, hsa
gaucaccuaaggucaggaguucgagaccagccuggccaauauggugaaaccccaucucuacua

SEQ ID NO: 76833 - RNA, 63 nt, hsa
cugaucacaaggucaagaguucgugaccagccuggccaauauggugaaaccccaugucuacua

SEQ ID NO: 76834 - RNA, 63 nt, hsa
acaggggcaacugguuuggcaaccccacauccaggccaauaaagaugugugagcugggugugu

SEQ ID NO: 76835 - RNA, 63 nt, hsa
acuucagcacgucucaacagaagaccaccaaauggccaauaaguaagugaaaauguauucaau

SEQ ID NO: 76836 - RNA, 63 nt, hsa
cggaucacaaggucaggagaucgagaccauccuggccaauauggugaaacccgucucuacuaa

SEQ ID NO: 76837 - RNA, 63 nt, hsa
gaauagacauuucuccaaagaagauacccagauggccaauaagcacguaacaaugcucgacau

SEQ ID NO: 76838 - RNA, 63 nt, hsa
guaaccuaugucagacacuacaugaugacucaaggccaauaauaaagacauuuccuaccugca

SEQ ID NO: 76839 - RNA, 63 nt, hsa
cugggacuacaggcaugcgcagccacuaugcccggccaauaagcuauauuuauucuuauuuga

SEQ ID NO: 76840 - RNA, 63 nt, hsa
uugcuuguuggaugaauuugcauguuaacuguaggccaauauagauuugccuuuaaaacucug

SEQ ID NO: 76841 - RNA, 63 nt, hsa
aacuuaauuuucauuuuccucauucacaaaaugggccaauaguuugacagcucauuuugaaga

SEQ ID NO: 76842 - RNA, 63 nt, hsa
cagcucuaagaauaauuuuacuuaugauuuaauggccaauauuuugaaggucuucccaacccu

SEQ ID NO: 76843 - RNA, 63 nt, hsa
agggccucuugggauuuacucuguggcucucagggccaauaaagccaugugaugaugaggguc

SEQ ID NO: 76844 - RNA, 63 nt, hsa
uguuucccuucacggaucaauucucacuuaagaggccaauaaacaacccaacaugaaaaggug

SEQ ID NO: 76845 - RNA, 63 nt, hsa
gaucacuugaggucaggaguucaagaccagccuggccaauauggugaaacccagucucuacua

SEQ ID NO: 76846 - RNA, 63 nt, hsa
uacaggaguacagguuuugacacaagaacaguuggccaauacuggugcccaagccuggauuaa

SEQ ID NO: 76847 - RNA, 63 nt, hsa
ucuguugagaauuuucauggagauuaugugguuggccaauaaagauagaugacauuucaaucu

SEQ ID NO: 76848 - RNA, 63 nt, hsa
ccagaccuggccucucuucauuucauuauuauuggccaauauuucuuucagccauuucauuuc

SEQ ID NO: 76849 - RNA, 63 nt, hsa
cuugugacagaugccaggagguagaugugugcuggccaauaaaggccccuaccugauuccccg

SEQ ID NO: 76850 - RNA, 63 nt, hsa
uaugcaaaaauucaucuuucggugauugugggcggccaauacauaccuucuguaacuccuccc

SEQ ID NO: 76851 - RNA, 63 nt, hsa
auaacuuaaaacuuuugugaggaagauuaauguggccaauaaaaccuuuaaauguuaaguguc

SEQ ID NO: 76852 - RNA, 63 nt, hsa
acucucugucguagacacaccgauaggaccaauggccaauagauauuaaaagcaaacccucac

SEQ ID NO: 76853 - RNA, 63 nt, hsa
uuuguuuaugaugcucugcaaacauuucauauuggccaauaaacagaaauauauccaaaaacc

SEQ ID NO: 76854 - RNA, 63 nt, hsa
ugcagauguccuugaagagagugaggcauugagggccaauaggagcaauggggucccuggccu

SEQ ID NO: 76855 - RNA, 64 nt, hsa
aagggagacaaggaaacgggcacagcgaaauccuggugaagagcaaagcagaagaaaugacagc

SEQ ID NO: 76856 - RNA, 64 nt, hsa
aucuuuguugacucaggaguauguugcaagugagggugaagaagauccagaaguugaauuuuua

SEQ ID NO: 76857 - RNA, 64 nt, hsa
ggaaagaacacauaauaaacaagaaaaaaacagaggugaagaaaaauccaagucugaacgggaa

SEQ ID NO: 76858 - RNA, 64 nt, hsa
gcaagcauuucacuggcagccuccacuagaauuuggugaagaggaggaggaggagauugaugac

SEQ ID NO: 76859 - RNA, 64 nt, hsa
acuagguguaaaaggugcuggccaaaugguucagggugaagagggcucuugauucaggggcugg

SEQ ID NO: 76860 - RNA, 64 nt, hsa
gccugguccuugagccccugaguuguggggguagggugaagagcauaucccacaagaggcccca

SEQ ID NO: 76861 - RNA, 64 nt, hsa
agcucagcagaggcugugguacaacaugguccuuggugaagaccugcaccccuggaaccuccca

SEQ ID NO: 76862 - RNA, 64 nt, hsa
ugucugacagagacgggagcucugaguguccacgggugaagaagugaguguccacgggugaaga

SEQ ID NO: 76863 - RNA, 64 nt, hsa
ugaguguccacgggugaagaagugaguguccacgggugaagaagugaguauguuucaccuggac

SEQ ID NO: 76864 - RNA, 64 nt, hsa
cggcgcaggcuugcucuucuuuuacaaugaaaggggugaagagugagggucucacaguuccuua

SEQ ID NO: 76865 - RNA, 64 nt, hsa
auacgccacugauaacuaaaacuagaucagggcuggugaagaagguuagguguuuuagguacau

SEQ ID NO: 76866 - RNA, 64 nt, hsa
uguaaacaguggaaacacugugggaguuucccauggugaagaguggaacgaaggcgauaugaac

SEQ ID NO: 76867 - RNA, 64 nt, hsa
ugaagaguggaacgaaggcgauaugaacugaaggggugaagacuugauuuuggagagggcaaca

SEQ ID NO: 76868 - RNA, 64 nt, hsa
gaaccuuugggccgugcccccauuuuccguacauggugaagaacugcagccgggcuugugugca

SEQ ID NO: 76869 - RNA, 64 nt, hsa
agaguccagguggccuuggagaggaaagaggaacggugaagacaagcugcgagagcugggagcu

SEQ ID NO: 76870 - RNA, 64 nt, hsa
ggugaagacaagcugcgagagcugggagcuggagggugaagaggugaacacuugagugguuaga

SEQ ID NO: 76871 - RNA, 64 nt, hsa
cucaccuagugucacguucccccgacccuggcacacgggccaagguacccacaggaucccaucc

SEQ ID NO: 76872 - RNA, 64 nt, hsa
gcaugacgucacaccgagaugcagcaacgacgucacgggccaugucgacgucacacauauuaau

SEQ ID NO: 76873 - RNA, 64 nt, hsa
gcuccuuggauguggagacagaugucuuuacuagagcugaaaggcccccuugacacauccaggc

SEQ ID NO: 76874 - RNA, 64 nt, hsa
cccacuuucuggaugacagacuugaggcucugagagcugaaaacacuuguccaaggucucacgu

SEQ ID NO: 76875 - RNA, 64 nt, hsa
aaaguaccuaaacauucgugaaaugauuuuuuuuagcugaaaaaugcuggcaagaagaauuuua

SEQ ID NO: 76876 - RNA, 64 nt, hsa
caagaauauaaagauguauuauuuuaagccaaggagcugaaauauaucucaguuuauaaauuca

SEQ ID NO: 76877 - RNA, 64 nt, hsa
uaguagaucucaauguuuuauaauuccuuaaaacagcugaaaauugggacaacauacuuuacgc

SEQ ID NO: 76878 - RNA, 64 nt, hsa
gucuguggcagguugacacagacuguguugccagagcugaaauaauuccacuucauccuaugag

SEQ ID NO: 76879 - RNA, 64 nt, hsa
gugccaguugcuggagagguagugugagcagagcagcugaaaucuugccaucaagcaacccuca

SEQ ID NO: 76880 - RNA, 64 nt, hsa
cacccaugcguaagcuacccaaguuuaauuugguagcugaaauaucuuuuugccucagacagcu

SEQ ID NO: 76881 - RNA, 64 nt, hsa
gccucagguuucuagaggaagggaacuuagaagaagcugaaauacaaaagcagaggauugaaca

SEQ ID NO: 76882 - RNA, 64 nt, hsa
aucugagucccaggagcugcccagaguugcugggagcugaaaaaucacauccuggccuggcaca

SEQ ID NO: 76883 - RNA, 64 nt, hsa
aucauucauucuuagcucuuaauuguucauuuugagcugaaaugcugcauuuuaauuuuaacca

SEQ ID NO: 76884 - RNA, 64 nt, hsa
agguccagagaaccuggcaugcaauggacauggaagcugaaaauuacuuggguauucucugauu

SEQ ID NO: 76885 - RNA, 64 nt, hsa
aaagguggaaggagaaacagcugcaggaggggggagcugaaaggaaucugaugcucaggccugc

SEQ ID NO: 76886 - RNA, 64 nt, hsa
aacuuguauuuucauauaauuuauauuuuuuaaaagcugaaaauuuagaagcaagaugaaaaaa

SEQ ID NO: 76887 - RNA, 64 nt, hsa
guguguguguguguuugcagacaugcaaaacugcagcugaaauaauaccuuagauuucuaggua

SEQ ID NO: 76888 - RNA, 64 nt, hsa
ucacucugacaugacaguauuuuuucugaccaggagcugaaagacccugacauucaugauccaa

SEQ ID NO: 76889 - RNA, 64 nt, hsa
acuaaggaaaauaacugaaaagauuaaaagugagagcugaaaagagaaaugauaaugcuuccaa

SEQ ID NO: 76890 - RNA, 64 nt, hsa
ggauaaaagggugcauuuuaaagguauauauccaagcugaaaagcaugccuauugacagauaaa

SEQ ID NO: 76891 - RNA, 64 nt, hsa
uuaaaccacguaguuaucuuuucacuucagguggagcugaaauucugcuggcuccagaguuuga

SEQ ID NO: 76892 - RNA, 64 nt, hsa
auaacauagcuccgaaagggagagcagagauggcagcugaaacucacucugugcugggcuuugg

SEQ ID NO: 76893 - RNA, 64 nt, hsa
uuacaacuagauauuaguuuuagaggaaggaaauagcugaaaaacuaaauuugcuuuggugaaa

SEQ ID NO: 76894 - RNA, 64 nt, hsa
acauuuagcuccccuucuucaugagcaucuguagagcugaaaguauucuggaacuuuagacaga

SEQ ID NO: 76895 - RNA, 64 nt, hsa
uagagcugaaaguauucuggaacuuuagacagaaagcugaaaggaaucugcagucuccugcugc

SEQ ID NO: 76896 - RNA, 64 nt, hsa
uuccaaaccucaaaaacuauuauggccugagcacagcugaaaucuagcagaguuuaacucuucu

SEQ ID NO: 76897 - RNA, 64 nt, hsa
ucaaugugcaacauacagguaggucuucagcauaagcugaaauauaugcauguaaaaacuuuga

SEQ ID NO: 76898 - RNA, 64 nt, hsa
cuugcaaaaugggacugcaauauuacauuuuucacuuaagcaguuuuuuacaucuacguuguug

SEQ ID NO: 76899 - RNA, 64 nt, hsa
acaauaaauguucauuaaaauaccaaaugauucucuuaagcauuuaccauuauuguaaguagcc

SEQ ID NO: 76900 - RNA, 64 nt, hsa
gaaugucaauaacauuuuaaaggaccaauaaacagccuccuauaaaguaaaccucuucccgugg

SEQ ID NO: 76901 - RNA, 64 nt, hsa
uauuugguagaguaacaccuuuauacgugugcuugccuccuaauuuaaaauacuguauucgcau

SEQ ID NO: 76902 - RNA, 64 nt, hsa
ggaccucauuauuucaagaggaacccaaaguccagccuccuacauagaugcugccccacgaagg

SEQ ID NO: 76903 - RNA, 64 nt, hsa
cgaccuccccagcucaagcaauccucccaccucagccuccuaaguaccugguacuacaggcgcg

SEQ ID NO: 76904 - RNA, 64 nt, hsa
aggugcugcuucuccacaggugcggccuggcccggccuccuaaaggccacacccuccccacgca

SEQ ID NO: 76905 - RNA, 64 nt, hsa
auccgccgccuuccacgcuaggauguaagaggucgccuccuauuguacauuuggggaaagccuu

SEQ ID NO: 76906 - RNA, 64 nt, hsa
caggccuggguggagggaguggcaagucaggcgugccuccuacaagcuuccuaaccucuuaagc

SEQ ID NO: 76907 - RNA, 64 nt, hsa
auaaaagauugugggaaauggucauuugcugagcgccuccuaguugccaggcacuggagggcgc

SEQ ID NO: 76908 - RNA, 64 nt, hsa
cacuuacgacaucacuuccauugugugcauguuuguuauagaggagguuuuaggcuacaauauu

SEQ ID NO: 76909 - RNA, 64 nt, hsa
uaauguacacugucacaucuuuacagucuuguauguuauagaauacaaaauaaguugaugguuu

SEQ ID NO: 76910 - RNA, 64 nt, hsa
gauauuaaaauuuuugaaaucacuacuguuaccuguuauagaaaauaguguuggcuuagucuag

SEQ ID NO: 76911 - RNA, 64 nt, hsa
guguucagauacuuacaccauaauuaaacaguaaguuauagacuugcugaguuuggcauagaua

SEQ ID NO: 76912 - RNA, 64 nt, hsa
aaaccaaugauugcugaaaaucagugaugcauuuguuauagaguauaacucaucguuuacagua

SEQ ID NO: 76913 - RNA, 64 nt, hsa
gcacuuuucacuucuguguguuuuuaaaauuaauguuauagaagacucaugauuucuauuuuug

SEQ ID NO: 76914 - RNA, 64 nt, hsa; identical to SEQ ID NO: 73933

SEQ ID NO: 76915 - RNA, 64 nt, hsa; identical to SEQ ID NO: 73934

SEQ ID NO: 76916 - RNA, 64 nt, hsa; identical to SEQ ID NO: 73935

SEQ ID NO: 76917 - RNA, 64 nt, hsa; identical to SEQ ID NO: 73936

SEQ ID NO: 76918 - RNA, 64 nt, hsa; identical to SEQ ID NO: 73937

SEQ ID NO: 76919 - RNA, 64 nt, hsa; identical to SEQ ID NO: 73938

SEQ ID NO: 76920 - RNA, 64 nt, hsa; identical to SEQ ID NO: 73939

SEQ ID NO: 76921 - RNA, 64 nt, hsa; identical to SEQ ID NO: 73940

SEQ ID NO: 76922 - RNA, 64 nt, hsa; identical to SEQ ID NO: 73941

SEQ ID NO: 76923 - RNA, 64 nt, hsa; identical to SEQ ID NO: 73942

SEQ ID NO: 76924 - RNA, 64 nt, hsa; identical to SEQ ID NO: 73943

SEQ ID NO: 76925 - RNA, 64 nt, hsa; identical to SEQ ID NO: 73944

SEQ ID NO: 76926 - RNA, 64 nt, hsa; identical to SEQ ID NO: 73945

SEQ ID NO: 76927 - RNA, 64 nt, hsa; identical to SEQ ID NO: 73946

SEQ ID NO: 76928 - RNA, 64 nt, hsa; identical to SEQ ID NO: 73947

SEQ ID NO: 76929 - RNA, 64 nt, hsa; identical to SEQ ID NO: 73948

SEQ ID NO: 76930 - RNA, 64 nt, hsa; identical to SEQ ID NO: 73949

SEQ ID NO: 76931 - RNA, 64 nt, hsa; identical to SEQ ID NO: 73950

SEQ ID NO: 76932 - RNA, 64 nt, hsa; identical to SEQ ID NO: 73951

SEQ ID NO: 76933 - RNA, 64 nt, hsa; identical to SEQ ID NO: 73952

SEQ ID NO: 76934 - RNA, 64 nt, hsa; identical to SEQ ID NO: 73953

SEQ ID NO: 76935 - RNA, 64 nt, hsa; identical to SEQ ID NO: 73954

SEQ ID NO: 76936 - RNA, 64 nt, hsa; identical to SEQ ID NO: 73955

SEQ ID NO: 76937 - RNA, 62 nt, hsa
ucuucccuaccuguuucacauccguaagauuuaagauauacauuuuuugagagguagucugu

SEQ ID NO: 76938 - RNA, 62 nt, hsa
gauucuucuuauuucaugguagguugucuuuaaagauauaaaaauuaggaugccuuuaugaa

SEQ ID NO: 76939 - RNA, 62 nt, hsa
uaaaauaaaguauuaauacuuuaaagucaaauaagauauaguguuuacauucuuuagguccu

SEQ ID NO: 76940 - RNA, 62 nt, hsa
uaauuuauuguuucuugguuucaccuuuguauaagauauagccaagacugaagaaaccaaau

SEQ ID NO: 76941 - RNA, 62 nt, hsa
uuaaauuauauaaaauguaucugucuauaaagaagauauaaaauugugacuuuauucuacug

SEQ ID NO: 76942 - RNA, 62 nt, hsa
aaaguaaauaauuguuuuaaaucuauuuuguaaagauauaaaguacaauagaauuucuggag

SEQ ID NO: 76943 - RNA, 62 nt, hsa
cuucugauuuuuaauuuguauccuuuucuauuaagauauauuugucauuuucucuugaauau

SEQ ID NO: 76944 - RNA, 62 nt, hsa
uaaauagcucuguggguuuuaacauuuuuauaaagauauaccaagggccauucaguacauca

SEQ ID NO: 76945 - RNA, 62 nt, hsa
cuaacaaaggaaaauauaagugauugaaucauaagauauaagggggguaaaguauuaaaaau

SEQ ID NO: 76946 - RNA, 62 nt, hsa
auuuuguaauaucauucuaaauagauuaagaaaagauauaauuucuuuacugcaguuaaauc

SEQ ID NO: 76947 - RNA, 62 nt, hsa
aaugacuaaaugcuuuaaacauauuguagcuuaagauauauguguuaagauauauacaugag

SEQ ID NO: 76948 - RNA, 62 nt, hsa
uuaaacauauuguagcuuaagauauauguguuaagauauauacaugagaaacuuuaaaaggu

SEQ ID NO: 76949 - RNA, 62 nt, hsa
acauagauaaagcaugauaaagauuauuauuuaagauauacuuguauuuauaccucagauau

SEQ ID NO: 76950 - RNA, 62 nt, hsa
uuugaguauuuuggauaucaguguuccucaugaagauauacauggauauucaauuuugaugg

SEQ ID NO: 76951 - RNA, 62 nt, hsa
cucucuuaaaauacccauugccccagaccuggaagauauaacauucaguucccaccaucuga

SEQ ID NO: 76952 - RNA, 62 nt, hsa
caaacagaccauaaauaaggaaacgaugaaauaagauauauacaaggugagugugacuuccc

SEQ ID NO: 76953 - RNA, 62 nt, hsa
uacugccuuaugacauagccaaauaauucuguaagauauaccucuuccucauauguuaaaua

SEQ ID NO: 76954 - RNA, 62 nt, hsa
augcugagccuuaaaacccagugugacuguagaagauauaaugcggacaugauuugaauuua

SEQ ID NO: 76955 - RNA, 62 nt, hsa
ucacaguguccauacaaauuaguuccagagggaagauauaccacaaaauuacucaaaaauuu

SEQ ID NO: 76956 - RNA, 62 nt, hsa
cggucuuuucuaaacuuuaacaugagacuuaaaagauauaauaagggaaaagauaagcagau

SEQ ID NO: 76957 - RNA, 62 nt, hsa
gaaaaccuagaaaaaauuaauaaauuccuugaaagauauaaccccccaagauugaaccaaga

SEQ ID NO: 76958 - RNA, 62 nt, hsa
auaggaagaggggaagucaguuucucuugcagaagauauaauucuguauuuagaaaaccugu

SEQ ID NO: 76959 - RNA, 62 nt, hsa
aguucugagccauuuauucugcuacacuuugaaagauauauuaguucugacuuauuguuugg

SEQ ID NO: 76960 - RNA, 62 nt, hsa
cuauaugaagauaccuguguccaaaauuuuugaagauauauauuguauguguuuauucuuca

SEQ ID NO: 76961 - RNA, 64 nt, hsa
aaagugauaguuaacuggauuuguuaggugagggugaggccaagggugacuuccagguuccuga

SEQ ID NO: 76962 - RNA, 64 nt, hsa
auaauaaaaaauaauaaaaauccuuaggauaacuugaggccaggaguuugagaccagugugacc

SEQ ID NO: 76963 - RNA, 64 nt, hsa
ucucuuuuuuguaauuuguuuuugcaaaucauugugaggccacuuuuucuuucuuucuuucuuu

SEQ ID NO: 76964 - RNA, 64 nt, hsa
ucucuuuuuuguaauuuguuguugcaaaucauugugaggccacuuuucuuuccccuuccuuccu

SEQ ID NO: 76965 - RNA, 64 nt, hsa
gcuggaaagacacauauggcgaaagucaaguaucugaggccacuugcaacauugugacaaagaa

SEQ ID NO: 76966 - RNA, 64 nt, hsa
aguuuaagaagacuuagauucauuuauugcuaucugaggccacuagugagauuucagaucucuc

SEQ ID NO: 76967 - RNA, 64 nt, hsa
gaaugacacucucaaauuguuccugggaucgggcugaggccaggccucuccuggaaccaccucu

SEQ ID NO: 76968 - RNA, 64 nt, hsa
gauaucauccaggcccaaggccccucucccugagugaggccagguguuggcagccaacugcucc

SEQ ID NO: 76969 - RNA, 64 nt, hsa
uuagguuaugguagugcucagacaucugcaguguugaggccagucacuguuggaagucauccaa

SEQ ID NO: 76970 - RNA, 64 nt, hsa
agucacuguuggaagucauccaagaagcccauuuugaggccauuuugagccuuacucuuaaguu

SEQ ID NO: 76971 - RNA, 64 nt, hsa
ucuaagaccuuuucuucagaaguugcuuuccuuuugaggccaccaaaguaauuuagggaaacag

SEQ ID NO: 76972 - RNA, 64 nt, hsa
ucacuaccaugauagucuacauucugauaagcugugaggccacugccaagggagggagaaaugg

SEQ ID NO: 76973 - RNA, 64 nt, hsa
ugggagaagggcugaccucugaggggcugaggggugaggccagggcccuccagggggaggggua

SEQ ID NO: 76974 - RNA, 64 nt, hsa
ggcuuacucccugggcagucuugggggccagagcugaggccaguccauauuacaguggcugggc

SEQ ID NO: 76975 - RNA, 64 nt, hsa
acagcacugcuuccaugcuucauacaucaggaaaugaggccagaacuugaguauuuacuaacac

SEQ ID NO: 76976 - RNA, 64 nt, hsa
caacacuuugggaggcugaggaggaaggauagcuugaggccaggaguuugagacuagacugggc

SEQ ID NO: 76977 - RNA, 64 nt, hsa
gcccuucaauagacuugcccuuguuacugcccagugaggccaccaaggaccaagaacaguugag

SEQ ID NO: 76978 - RNA, 64 nt, hsa
uuacuaauuccaucccagaaaagccugugaucccugaggccagaauugacucuuugggccuaaa

SEQ ID NO: 76979 - RNA, 64 nt, hsa
cgugauggcucaccccuguaaucccagcacuuugugaggccaaggugggcggaucacuugaggc

SEQ ID NO: 76980 - RNA, 64 nt, hsa
cagcacuuugugaggccaaggugggcggaucacuugaggccaggaauuugaaaccagccugggc

SEQ ID NO: 76981 - RNA, 64 nt, hsa
ucugaacccuuggggacgagggccugggccgcggugaggccaccagaggcaggaguggcccugg

SEQ ID NO: 76982 - RNA, 64 nt, hsa
gaggggacccguggaugggggggcucuggcguccugaggccaccuggccccaccugcuccucag

SEQ ID NO: 76983 - RNA, 64 nt, hsa
cagcacuuugggaggucgaggugggaggaucgcuugaggccaggaguucgagaccacccugggc

SEQ ID NO: 76984 - RNA, 64 nt, hsa
ggagcacuuggcccuggccaggaaccccuggaacugaggccacgauccccucucaaaggcugug

SEQ ID NO: 76985 - RNA, 64 nt, hsa
gacacugccaucagggcuguuaguggcaccuguaugaggccaagugugcguccaggggaacagc

SEQ ID NO: 76986 - RNA, 64 nt, hsa
uuugcucuagcuguuuguccuuacaagacaacgcugaggccaguugucagacugaauuucuuuu

SEQ ID NO: 76987 - RNA, 64 nt, hsa
agaaaaugaguucucaaggagggaaugcuuugcuugaggccacacagcagguugguagcaaaga

SEQ ID NO: 76988 - RNA, 64 nt, hsa
guugucagcacuggaggagaccccgccaguggggugaggccagccaagucccuguguuacgaau

SEQ ID NO: 76989 - RNA, 64 nt, hsa
cucaggggaaccauggggcuuucuggaguuguggugaggccaccaggcugaagucagcucagac

SEQ ID NO: 76990 - RNA, 64 nt, hsa
aacaaauggaguagcaucccccuggggcacuugcugaggccaagccacucacauccucacuuug

SEQ ID NO: 76991 - RNA, 64 nt, hsa
caaaaaauaaaaaaaauuagcuaggcauaguaccugaggccaggagguccaggccgcaaugaga

SEQ ID NO: 76992 - RNA, 64 nt, hsa
caacccuuuggaagguaaagacgggaggaucacuugaggccaggaguucaagaccagccugggc

SEQ ID NO: 76993 - RNA, 64 nt, hsa
ccugccccucccccacagagccuccagagcuagcugaggccaacgcaggcccauccgucucuuc

SEQ ID NO: 76994 - RNA, 64 nt, hsa
uaauaauacuucaccuaccucauaggggagguugugaggccaccaucaccugaccuggggguca

SEQ ID NO: 76995 - RNA, 64 nt, hsa
caccuaccauuuuccuuuauugugaucacuaaaaugaggccaagguuuaggaggugagaaaaag

SEQ ID NO: 76996 - RNA, 64 nt, hsa
cagcgcuuugggaggcugaggcaggaggauugcuugaggccaggaguuuaaguuacagaacuau

SEQ ID NO: 76997 - RNA, 64 nt, hsa
ugcucccucgcuggcaagccccaccacacaggagugaggccaggggcuaggaguucuaagaaca

SEQ ID NO: 76998 - RNA, 64 nt, hsa
agccagccaagugccaaggucagcuuggcuggucugaggccaccuucuuagccaaaaaccuagg

SEQ ID NO: 76999 - RNA, 64 nt, hsa
gccagggccagucccuccagcuggucccauguaaugaggccagggcuccuuaucagcuuccagg

SEQ ID NO: 77000 - RNA, 64 nt, hsa
cgcuuguacauacgccauggggacccugaggaacugaggccacgucaaucccugugccgcccca

SEQ ID NO: 77001 - RNA, 64 nt, hsa
uuaagagaaagucaccugcccaagaaacaccgagugaggccauagcaacuccccuacaucaaau

SEQ ID NO: 77002 - RNA, 64 nt, hsa
uggaaauuaagaaaaagucgcccgaaacaccaagugaggccauagcaauuccccuacaucaaau

SEQ ID NO: 77003 - RNA, 64 nt, hsa
agaaauuguauugcugcguagaaucugaacacacugaggccaccuagcaagguaguaacuaguc

SEQ ID NO: 77004 - RNA, 64 nt, hsa
aguguuucccauaugccccuggagccccacuuauugaggccagcagaauaggugcagagaugaa

SEQ ID NO: 77005 - RNA, 64 nt, hsa
cagcacuuuggaaggcugaggaaggaggaucgcuugaggccaggaguuugagacuagccuaggc

SEQ ID NO: 77006 - RNA, 64 nt, hsa
uggcuacuucagaggcugagguggaaggaucacuugaggccaggaguuugaggcugcagugagu

SEQ ID NO: 77007 - RNA, 64 nt, hsa
ucucacuccccaaggcucgggugggggcugaggcugaggccaaaggggcuggggaggcaggccu

SEQ ID NO: 77008 - RNA, 64 nt, hsa
aaguugcugaggccaagguagccaaggucagcccugaggccagggugaaaggucccagacuucg

SEQ ID NO: 77009 - RNA, 64 nt, hsa
uuccccgauuuggggcucgagcaaaggaaguugcugaggccaagguagccaaggucagcccuga

SEQ ID NO: 77010 - RNA, 64 nt, hsa
gcugaggugguuguauugcuugaggccagguguuugaggccagccagggcaacacagcaagacc

SEQ ID NO: 77011 - RNA, 64 nt, hsa
cagcacugugggaggcugaggugguuguauugcuugaggccagguguuugaggccagccagggc

SEQ ID NO: 77012 - RNA, 64 nt, hsa
ucucggcucccgcaccccuuuucccuuauggcucugaggccaucggcugucucugcauuucauu

SEQ ID NO: 77013 - RNA, 64 nt, hsa
cacccaccucuccgggggacuugacaaggggcccugaggccaagggaggucacuccucccucca

SEQ ID NO: 77014 - RNA, 64 nt, hsa
guguaccuucagggauggggcucuuacucccuccugaggccagcugcucuaauaucgauggucc

SEQ ID NO: 77015 - RNA, 64 nt, hsa
uucguugauggucuuuucuguacuggaggccuccugaggccaggaacgugcaaauuugcaggug

SEQ ID NO: 77016 - RNA, 64 nt, hsa
aguuucaugaaugcaugcucaguuuauuaaaauccauaaccauguaauucuuguaauauguuga

SEQ ID NO: 77017 - RNA, 64 nt, hsa
uuuuauauagcagcaaaagauaagaauaaaaucacauaaccaaguugaagcuuccuuggcaaag

SEQ ID NO: 77018 - RNA, 64 nt, hsa
cccccugcccuagcucuucucuaacuugguuaaccauaaccauaaccagauucccuugcaaucg

SEQ ID NO: 77019 - RNA, 64 nt, hsa
gcccuagcucuucucuaacuugguuaaccauaaccauaaccagauucccuugcaaucgauuucu

SEQ ID NO: 77020 - RNA, 64 nt, hsa
guagaaauauuuuuaagcuccucugaugcagcagcaaugcaaauuaugacauagugaauauaga

SEQ ID NO: 77021 - RNA, 64 nt, hsa
uuaagccucaacaauccaaaucuacaaacuuuaacaaugcaagucuuacucuaauuuuuaagua

SEQ ID NO: 77022 - RNA, 64 nt, hsa
ugggcagccuuuuuuuuuuuuuuuuuaauugcaacaaugcaaaagccaagaaaguauaaggguc

SEQ ID NO: 77023 - RNA, 64 nt, hsa
auacuguacugauacuauucaaugcaaugcaauucaaugcaaugaaaacaaaauuccauuacag

SEQ ID NO: 77024 - RNA, 64 nt, hsa
aguaaacuggauacuguacugauacuauucaaugcaaugcaauucaaugcaaugaaaacaaaau

SEQ ID NO: 77025 - RNA, 64 nt, hsa
gaagaaguaaacuggauacuguacugauacuauucaaugcaaugcaauucaaugcaaugaaaac

SEQ ID NO: 77026 - RNA, 64 nt, hsa
aaauuguuaugcaugaaaccagugguagaagaaacaaugcaagacauacauuuccacuaugguc

SEQ ID NO: 77027 - RNA, 64 nt, hsa
gucgguuucaggaauuucaaaagaaaucugacgucaaugcaauuauccauuauuuaaaagcuau

SEQ ID NO: 77028 - RNA, 64 nt, hsa
aaaaacugcuguaaacacaggggacacagcuuaacaaugcaacuuuuaauuacuguuuucuuuu

SEQ ID NO: 77029 - RNA, 64 nt, hsa
agucuaguacuuauuacaugcugcuauacacaagcaaugcaagaaaaaaacuuacuggguaggu

SEQ ID NO: 77030 - RNA, 64 nt, hsa
gaagugugcauuuauuagcuauuacucaacuuuacaaugcaaacaucuuauuucucaucuuuaa

SEQ ID NO: 77031 - RNA, 64 nt, hsa
cuaaaauugugccagcgagcaccgugaacgacugcaaugcaagcgggucuugcuggcuaaaaug

SEQ ID NO: 77032 - RNA, 59 nt, hsa
aagaagcuccaaaccuauagaacaaaaugugcaaucacagaagcacaugggauguaauc

SEQ ID NO: 77033 - RNA, 64 nt, hsa
aacccagcauuccugaucuggguaccaauauuucugcaaucaguuuggcaauuuuuggauuagc

SEQ ID NO: 77034 - RNA, 64 nt, hsa
ugcaucuuuuuuguuuaauuguauuuaagcauugugcaaucacuugggaaaaauauuaaauuau

SEQ ID NO: 77035 - RNA, 64 nt, hsa
uugguagcaaaacugagaaaaucagcuucaggucugcaaucaaauucuguucaauuuuagccug

SEQ ID NO: 77036 - RNA, 64 nt, hsa
gggucuugcucuugcccaggcaggaguacaguagugcaaucacagcugacugcagccuugaccu

SEQ ID NO: 77037 - RNA, 64 nt, hsa
aaaugaagaaaagucucucucaacaccucguucaugcaaucagcauuagaauuuguaaggaagg

SEQ ID NO: 77038 - RNA, 64 nt, hsa
acaaaauuucaaaacaaaaacaagagggcauagaugcaaucauugggaaauuuucaugcacgcu

SEQ ID NO: 77039 - RNA, 64 nt, hsa
uuuuuaugaagcacauacaaaagaagacagggaaugcaaucaggaaggaaagacuuuuuaaaaa

SEQ ID NO: 77040 - RNA, 64 nt, hsa
uuucugacguaauguaauucaggaagacagacgcugcaaucacagauuuuaaaaaauuguuugc

SEQ ID NO: 77041 - RNA, 64 nt, hsa
guuuauuuuacguaaaauaaacuguuguuuccaaugcaaucaacucuguauuauauguauaaau

SEQ ID NO: 77042 - RNA, 64 nt, hsa
gucucauucuaucggccaggcuggagugcaguggugcaaucacagcucacugcagccuuguccu

SEQ ID NO: 77043 - RNA, 64 nt, hsa
guuucucaaguguuuuggagaaaaaaaucaacccugcaaucacuuuuuggaauugucuugauuu

SEQ ID NO: 77044 - RNA, 60 nt, hsa
ugacagagcaccuaggauaaagugcagugaugcaaucacagcucaccucagugcggccuu

SEQ ID NO: 77045 - RNA, 64 nt, hsa
uauuuuuuuuuguagagguggggaagugcagugaugcaaucacagcucaccucagugcggccuu

SEQ ID NO: 77046 - RNA, 64 nt, hsa
auucuuuuucuccuacuuuuuacuggggugagaggggcaugaagagaaauacgccuuuuuuuuu

SEQ ID NO: 77047 - RNA, 64 nt, hsa
gaccuauuggggcuggcccugguggaggagcccagggcaugaagcccaaggcagcugaggcagu

SEQ ID NO: 77048 - RNA, 64 nt, hsa
uacccagcacaggcggggcuggaauucuggcggagggcaugagccugggacuccaugucacguu

SEQ ID NO: 77049 - RNA, 64 nt, hsa
gcaucccucuguaugaauaugaaaucagagaccagggcaugauguugcuaggauuagagccucu

SEQ ID NO: 77050 - RNA, 64 nt, hsa; identical to SEQ ID NO: 62936

SEQ ID NO: 77051 - RNA, 64 nt, hsa; identical to SEQ ID NO: 62937

SEQ ID NO: 77052 - RNA, 64 nt, hsa; identical to SEQ ID NO: 62938

SEQ ID NO: 77053 - RNA, 64 nt, hsa; identical to SEQ ID NO: 62939

SEQ ID NO: 77054 - RNA, 64 nt, hsa; identical to SEQ ID NO: 62940

SEQ ID NO: 77055 - RNA, 64 nt, hsa; identical to SEQ ID NO: 62941

SEQ ID NO: 77056 - RNA, 64 nt, hsa; identical to SEQ ID NO: 62942

SEQ ID NO: 77057 - RNA, 64 nt, hsa; identical to SEQ ID NO: 62943

SEQ ID NO: 77058 - RNA, 64 nt, hsa; identical to SEQ ID NO: 62944

SEQ ID NO: 77059 - RNA, 64 nt, hsa; identical to SEQ ID NO: 62945

SEQ ID NO: 77060 - RNA, 64 nt, hsa; identical to SEQ ID NO: 62946

SEQ ID NO: 77061 - RNA, 64 nt, hsa; identical to SEQ ID NO: 62947

SEQ ID NO: 77062 - RNA, 64 nt, hsa; identical to SEQ ID NO: 62948

SEQ ID NO: 77063 - RNA, 64 nt, hsa; identical to SEQ ID NO: 62949

SEQ ID NO: 77064 - RNA, 64 nt, hsa; identical to SEQ ID NO: 62950

SEQ ID NO: 77065 - RNA, 64 nt, hsa; identical to SEQ ID NO: 62951

SEQ ID NO: 77066 - RNA, 64 nt, hsa; identical to SEQ ID NO: 62952

SEQ ID NO: 77067 - RNA, 64 nt, hsa; identical to SEQ ID NO: 62953

SEQ ID NO: 77068 - RNA, 64 nt, hsa; identical to SEQ ID NO: 62954

SEQ ID NO: 77069 - RNA, 64 nt, hsa; identical to SEQ ID NO: 62955

SEQ ID NO: 77070 - RNA, 64 nt, hsa; identical to SEQ ID NO: 62956

SEQ ID NO: 77071 - RNA, 64 nt, hsa; identical to SEQ ID NO: 62957

SEQ ID NO: 77072 - RNA, 64 nt, hsa; identical to SEQ ID NO: 62958

SEQ ID NO: 77073 - RNA, 64 nt, hsa; identical to SEQ ID NO: 62959

SEQ ID NO: 77074 - RNA, 64 nt, hsa; identical to SEQ ID NO: 62960

SEQ ID NO: 77075 - RNA, 64 nt, hsa; identical to SEQ ID NO: 62961

SEQ ID NO: 77076 - RNA, 64 nt, hsa; identical to SEQ ID NO: 62962

SEQ ID NO: 77077 - RNA, 64 nt, hsa; identical to SEQ ID NO: 62963

SEQ ID NO: 77078 - RNA, 64 nt, hsa; identical to SEQ ID NO: 62964

SEQ ID NO: 77079 - RNA, 64 nt, hsa; identical to SEQ ID NO: 62965

SEQ ID NO: 77080 - RNA, 64 nt, hsa; identical to SEQ ID NO: 62966

SEQ ID NO: 77081 - RNA, 64 nt, hsa; identical to SEQ ID NO: 62967

SEQ ID NO: 77082 - RNA, 64 nt, hsa; identical to SEQ ID NO: 62968

SEQ ID NO: 77083 - RNA, 64 nt, hsa; identical to SEQ ID NO: 62969

SEQ ID NO: 77084 - RNA, 64 nt, hsa; identical to SEQ ID NO: 62970

SEQ ID NO: 77085 - RNA, 64 nt, hsa; identical to SEQ ID NO: 62971

SEQ ID NO: 77086 - RNA, 64 nt, hsa; identical to SEQ ID NO: 62972

SEQ ID NO: 77087 - RNA, 64 nt, hsa; identical to SEQ ID NO: 62973

SEQ ID NO: 77088 - RNA, 64 nt, hsa; identical to SEQ ID NO: 62974

SEQ ID NO: 77089 - RNA, 64 nt, hsa; identical to SEQ ID NO: 62975

SEQ ID NO: 77090 - RNA, 64 nt, hsa; identical to SEQ ID NO: 62976

SEQ ID NO: 77091 - RNA, 64 nt, hsa; identical to SEQ ID NO: 62977

SEQ ID NO: 77092 - RNA, 64 nt, hsa; identical to SEQ ID NO: 62978

SEQ ID NO: 77093 - RNA, 64 nt, hsa; identical to SEQ ID NO: 62979

SEQ ID NO: 77094 - RNA, 64 nt, hsa; identical to SEQ ID NO: 62980

SEQ ID NO: 77095 - RNA, 64 nt, hsa; identical to SEQ ID NO: 62981

SEQ ID NO: 77096 - RNA, 64 nt, hsa; identical to SEQ ID NO: 62982

SEQ ID NO: 77097 - RNA, 64 nt, hsa; identical to SEQ ID NO: 62983

SEQ ID NO: 77098 - RNA, 64 nt, hsa; identical to SEQ ID NO: 62984

SEQ ID NO: 77099 - RNA, 64 nt, hsa; identical to SEQ ID NO: 62985

SEQ ID NO: 77100 - RNA, 64 nt, hsa; identical to SEQ ID NO: 62986

SEQ ID NO: 77101 - RNA, 64 nt, hsa; identical to SEQ ID NO: 62987

SEQ ID NO: 77102 - RNA, 64 nt, hsa; identical to SEQ ID NO: 62988

SEQ ID NO: 77103 - RNA, 64 nt, hsa; identical to SEQ ID NO: 62989

SEQ ID NO: 77104 - RNA, 64 nt, hsa; identical to SEQ ID NO: 62990

SEQ ID NO: 77105 - RNA, 64 nt, hsa; identical to SEQ ID NO: 62991

SEQ ID NO: 77106 - RNA, 64 nt, hsa; identical to SEQ ID NO: 62992

SEQ ID NO: 77107 - RNA, 64 nt, hsa; identical to SEQ ID NO: 62993

SEQ ID NO: 77108 - RNA, 64 nt, hsa; identical to SEQ ID NO: 62994

SEQ ID NO: 77109 - RNA, 64 nt, hsa; identical to SEQ ID NO: 62995

SEQ ID NO: 77110 - RNA, 64 nt, hsa; identical to SEQ ID NO: 62996

SEQ ID NO: 77111 - RNA, 64 nt, hsa; identical to SEQ ID NO: 62997

SEQ ID NO: 77112 - RNA, 64 nt, hsa; identical to SEQ ID NO: 62998

SEQ ID NO: 77113 - RNA, 64 nt, hsa; identical to SEQ ID NO: 62999

SEQ ID NO: 77114 - RNA, 64 nt, hsa; identical to SEQ ID NO: 63000

SEQ ID NO: 77115 - RNA, 64 nt, hsa; identical to SEQ ID NO: 63001

SEQ ID NO: 77116 - RNA, 64 nt, hsa; identical to SEQ ID NO: 63002

SEQ ID NO: 77117 - RNA, 64 nt, hsa; identical to SEQ ID NO: 63003

SEQ ID NO: 77118 - RNA, 64 nt, hsa; identical to SEQ ID NO: 63004

SEQ ID NO: 77119 - RNA, 64 nt, hsa; identical to SEQ ID NO: 63005

SEQ ID NO: 77120 - RNA, 64 nt, hsa; identical to SEQ ID NO: 63006

SEQ ID NO: 77121 - RNA, 64 nt, hsa; identical to SEQ ID NO: 63007

SEQ ID NO: 77122 - RNA, 64 nt, hsa; identical to SEQ ID NO: 63008

SEQ ID NO: 77123 - RNA, 64 nt, hsa; identical to SEQ ID NO: 63009

SEQ ID NO: 77124 - RNA, 64 nt, hsa; identical to SEQ ID NO: 63010

SEQ ID NO: 77125 - RNA, 64 nt, hsa; identical to SEQ ID NO: 63011

SEQ ID NO: 77126 - RNA, 64 nt, hsa; identical to SEQ ID NO: 63012

SEQ ID NO: 77127 - RNA, 64 nt, hsa; identical to SEQ ID NO: 63013

SEQ ID NO: 77128 - RNA, 64 nt, hsa; identical to SEQ ID NO: 63014

SEQ ID NO: 77129 - RNA, 64 nt, hsa; identical to SEQ ID NO: 63015

SEQ ID NO: 77130 - RNA, 64 nt, hsa
acagugugugaucaaguguguccaccccuucgggucucagcauggacgugugcauguuaugagc

SEQ ID NO: 77131 - RNA, 64 nt, hsa
caggccuaggaucagggaccagaggauccuaucuucucagcacccagcccaccccuuccuguag

SEQ ID NO: 77132 - RNA, 64 nt, hsa
gcgguccuuucagcucccagucugaugagaccucucucagcaccacugccucaucugccacgcc

SEQ ID NO: 77133 - RNA, 64 nt, hsa
uaccaucaugcggaaaagcagcggcagccccgacucucagcacugguacgucugcucaugacca

SEQ ID NO: 77134 - RNA, 64 nt, hsa
cagcccaugagaaggaaugaggcugguucugcacucucagcaugcaguccgaaagcauguggga

SEQ ID NO: 77135 - RNA, 64 nt, hsa
ggccacuguuagguuuccuuuagaaauaaagagaucucagcagcuuggaagaaaucccagaagc

SEQ ID NO: 77136 - RNA, 64 nt, hsa
gacauuugggagagggaugcccaggaacgccucaucucagcagccugggcucggcauuccgaag

SEQ ID NO: 77137 - RNA, 62 nt, hsa
cauugucucaaaauucuugaagcucagccuguucucagcaguagagaaaucacuaggacuac

SEQ ID NO: 77138 - RNA, 64 nt, hsa
ggcuagugaaggacgccuuuuugacucuucuuggucucagcauguugacugggauuggaaauaa

SEQ ID NO: 77139 - RNA, 64 nt, hsa
uacuuaucuuuucagcaguauauaugugcugaaaucucagcaugaaagcauugcaugaguaaag

SEQ ID NO: 77140 - RNA, 64 nt, hsa
aaaugagaguaauaaaacuuggcuucucucuaccucucagcacuaaugauggucaaaugccuua

SEQ ID NO: 77141 - RNA, 64 nt, hsa
gguguggauuuagguuauacugggggagaacuuuucucagcacagauucuaugccagcuucuuu

SEQ ID NO: 77142 - RNA, 64 nt, hsa
guaugacaacucuacagaaguugugcgcgugcuuucucagcagcauuuuuccuucaaaaucauc

SEQ ID NO: 77143 - RNA, 64 nt, hsa
aaguuuuuuagacccaaagaaaaaaacagcagagucucagcaugaucaguccugauugaauuuc

SEQ ID NO: 77144 - RNA, 64 nt, hsa
aaauccucauaggagcuauaaagcaggcugcugaucucagcaguugauauggugguugugccuc

SEQ ID NO: 77145 - RNA, 64 nt, hsa
cauuuacauguuuucgaacacagaauagcucuuuucucagcaucauuauugcucuuucagcauc

SEQ ID NO: 77146 - RNA, 64 nt, hsa
agcccauagacuacaguucuucagaggccauaugucucagcaaguacugguuauauucuuuuuu

SEQ ID NO: 77147 - RNA, 64 nt, hsa
uguauucuuagaccaaaaaucauaaccugcuguuucucagcaaagccuugcucucuggagcuua

SEQ ID NO: 77148 - RNA, 64 nt, hsa
guuugaccuuuuuaaaacgaaaagagagacaaagucucagcacauuccaaggagugguagaaac

SEQ ID NO: 77149 - RNA, 64 nt, hsa
auaauuggacuagauaccuugguacuguugaccuucucagcaucucccuuuugccuuagauggc

SEQ ID NO: 77150 - RNA, 64 nt, hsa
ucaguagguguuaguaugguugcaaaguucacugucucagcaaaguugaacugggcuaccucuc

SEQ ID NO: 77151 - RNA, 64 nt, hsa
gaggagagccaucuauuuuguuccuaaagccaccucucagcagaaucgucauguuuuucugaug

SEQ ID NO: 77152 - RNA, 64 nt, hsa
ggacuuuuccccugugaagggggcugccaggacaucucagcacucccgccuggagcucucagca

SEQ ID NO: 77153 - RNA, 64 nt, hsa
gcugccaggacaucucagcacucccgccuggagcucucagcaucacugaagguaccacagugua

SEQ ID NO: 77154 - RNA, 64 nt, hsa
gggucugauggcuucuagggaugcucugcgugugucucagcaccgcuaucucagccacuuucag

SEQ ID NO: 77155 - RNA, 64 nt, hsa
gaccccugcccuuuccccgccagagaccucaggcucucagcacauuccacaggcuccugagucc

SEQ ID NO: 77156 - RNA, 64 nt, hsa
aaucuuguuuaucacuuuaaaaaauucaguaauaucucagcagucaggcuucugguugugaaau

SEQ ID NO: 77157 - RNA, 64 nt, hsa
cgugaacauggaacugcuaagagggaaaacugcaucucagcauuuucauuuuuucugaauauua

SEQ ID NO: 77158 - RNA, 64 nt, hsa
ucauguuuuuaaguaaguuggcccaugcaacauaucucagcauucuugcugugcucucugcuga

SEQ ID NO: 77159 - RNA, 64 nt, hsa
gacagauugaacaccugcaaaacugcuagcguaaucucagcacauacgcagcuaggaaguuugu

SEQ ID NO: 77160 - RNA, 64 nt, hsa
gagcaugugagaacauagcaguagggaccaaaagucucagcacacuuaccuccgauuaugccuu

SEQ ID NO: 77161 - RNA, 64 nt, hsa
caaacuggacaguagacaucaugaucccuccaguuagcucuaauuacagaccccaccaguacag

SEQ ID NO: 77162 - RNA, 64 nt, hsa
cuauucaggacuaagucccuuacugcaaauguguuagcucuaacaucucccacaagcuagagga

SEQ ID NO: 77163 - RNA, 64 nt, hsa
cccguucucuaacuuccuuacguuuucguuuauuuagcucuauccccacuaucuacuagaauuu

SEQ ID NO: 77164 - RNA, 64 nt, hsa
agccacgugucuagcggcuaccguuuggacaguauagcucuagagcauggcuugguaaccuguu

SEQ ID NO: 77165 - RNA, 64 nt, hsa; identical to SEQ ID NO: 50680

SEQ ID NO: 77166 - RNA, 64 nt, hsa; identical to SEQ ID NO: 50681

SEQ ID NO: 77167 - RNA, 64 nt, hsa; identical to SEQ ID NO: 50682

SEQ ID NO: 77168 - RNA, 64 nt, hsa; identical to SEQ ID NO: 50683

SEQ ID NO: 77169 - RNA, 64 nt, hsa; identical to SEQ ID NO: 50684

SEQ ID NO: 77170 - RNA, 64 nt, hsa; identical to SEQ ID NO: 50685

SEQ ID NO: 77171 - RNA, 64 nt, hsa; identical to SEQ ID NO: 50686

SEQ ID NO: 77172 - RNA, 64 nt, hsa; identical to SEQ ID NO: 50687

SEQ ID NO: 77173 - RNA, 64 nt, hsa; identical to SEQ ID NO: 50688

SEQ ID NO: 77174 - RNA, 64 nt, hsa; identical to SEQ ID NO: 50689

SEQ ID NO: 77175 - RNA, 64 nt, hsa; identical to SEQ ID NO: 50690

SEQ ID NO: 77176 - RNA, 64 nt, hsa; identical to SEQ ID NO: 50691

SEQ ID NO: 77177 - RNA, 64 nt, hsa; identical to SEQ ID NO: 50692

SEQ ID NO: 77178 - RNA, 64 nt, hsa; identical to SEQ ID NO: 50693

SEQ ID NO: 77179 - RNA, 62 nt, hsa; identical to SEQ ID NO: 50694

SEQ ID NO: 77180 - RNA, 62 nt, hsa; identical to SEQ ID NO: 50695

SEQ ID NO: 77181 - RNA, 62 nt, hsa; identical to SEQ ID NO: 50696

SEQ ID NO: 77182 - RNA, 62 nt, hsa; identical to SEQ ID NO: 50697

SEQ ID NO: 77183 - RNA, 62 nt, hsa; identical to SEQ ID NO: 50698

SEQ ID NO: 77184 - RNA, 62 nt, hsa; identical to SEQ ID NO: 50699

SEQ ID NO: 77185 - RNA, 62 nt, hsa; identical to SEQ ID NO: 50700

SEQ ID NO: 77186 - RNA, 62 nt, hsa; identical to SEQ ID NO: 50701

SEQ ID NO: 77187 - RNA, 62 nt, hsa; identical to SEQ ID NO: 50702

SEQ ID NO: 77188 - RNA, 62 nt, hsa; identical to SEQ ID NO: 50703

SEQ ID NO: 77189 - RNA, 64 nt, hsa; identical to SEQ ID NO: 50680

SEQ ID NO: 77190 - RNA, 64 nt, hsa; identical to SEQ ID NO: 50681

SEQ ID NO: 77191 - RNA, 64 nt, hsa; identical to SEQ ID NO: 50682

SEQ ID NO: 77192 - RNA, 64 nt, hsa; identical to SEQ ID NO: 50683

SEQ ID NO: 77193 - RNA, 64 nt, hsa; identical to SEQ ID NO: 50684

SEQ ID NO: 77194 - RNA, 64 nt, hsa; identical to SEQ ID NO: 50685

SEQ ID NO: 77195 - RNA, 64 nt, hsa; identical to SEQ ID NO: 50686

SEQ ID NO: 77196 - RNA, 64 nt, hsa; identical to SEQ ID NO: 50687

SEQ ID NO: 77197 - RNA, 64 nt, hsa; identical to SEQ ID NO: 50688

SEQ ID NO: 77198 - RNA, 64 nt, hsa; identical to SEQ ID NO: 50689

SEQ ID NO: 77199 - RNA, 64 nt, hsa; identical to SEQ ID NO: 50690

SEQ ID NO: 77200 - RNA, 64 nt, hsa; identical to SEQ ID NO: 50691

SEQ ID NO: 77201 - RNA, 64 nt, hsa; identical to SEQ ID NO: 50692

SEQ ID NO: 77202 - RNA, 64 nt, hsa; identical to SEQ ID NO: 50693

SEQ ID NO: 77203 - RNA, 62 nt, hsa; identical to SEQ ID NO: 50694

SEQ ID NO: 77204 - RNA, 62 nt, hsa; identical to SEQ ID NO: 50695

SEQ ID NO: 77205 - RNA, 62 nt, hsa; identical to SEQ ID NO: 50696

SEQ ID NO: 77206 - RNA, 62 nt, hsa; identical to SEQ ID NO: 50697

SEQ ID NO: 77207 - RNA, 62 nt, hsa; identical to SEQ ID NO: 50698

SEQ ID NO: 77208 - RNA, 62 nt, hsa; identical to SEQ ID NO: 50699

SEQ ID NO: 77209 - RNA, 62 nt, hsa; identical to SEQ ID NO: 50700

SEQ ID NO: 77210 - RNA, 62 nt, hsa; identical to SEQ ID NO: 50701

SEQ ID NO: 77211 - RNA, 62 nt, hsa; identical to SEQ ID NO: 50702

SEQ ID NO: 77212 - RNA, 62 nt, hsa; identical to SEQ ID NO: 50703

SEQ ID NO: 77213 - RNA, 64 nt, hsa; identical to SEQ ID NO: 50680

SEQ ID NO: 77214 - RNA, 64 nt, hsa; identical to SEQ ID NO: 50681

SEQ ID NO: 77215 - RNA, 64 nt, hsa; identical to SEQ ID NO: 50682

SEQ ID NO: 77216 - RNA, 64 nt, hsa; identical to SEQ ID NO: 50683

SEQ ID NO: 77217 - RNA, 64 nt, hsa; identical to SEQ ID NO: 50684

SEQ ID NO: 77218 - RNA, 64 nt, hsa; identical to SEQ ID NO: 50685

SEQ ID NO: 77219 - RNA, 64 nt, hsa; identical to SEQ ID NO: 50686

SEQ ID NO: 77220 - RNA, 64 nt, hsa; identical to SEQ ID NO: 50687

SEQ ID NO: 77221 - RNA, 64 nt, hsa; identical to SEQ ID NO: 50688

SEQ ID NO: 77222 - RNA, 64 nt, hsa; identical to SEQ ID NO: 50689

SEQ ID NO: 77223 - RNA, 64 nt, hsa; identical to SEQ ID NO: 50690

SEQ ID NO: 77224 - RNA, 64 nt, hsa; identical to SEQ ID NO: 50691

SEQ ID NO: 77225 - RNA, 64 nt, hsa; identical to SEQ ID NO: 50692

SEQ ID NO: 77226 - RNA, 64 nt, hsa; identical to SEQ ID NO: 50693

SEQ ID NO: 77227 - RNA, 62 nt, hsa; identical to SEQ ID NO: 50694

SEQ ID NO: 77228 - RNA, 62 nt, hsa; identical to SEQ ID NO: 50695

SEQ ID NO: 77229 - RNA, 62 nt, hsa; identical to SEQ ID NO: 50696

SEQ ID NO: 77230 - RNA, 62 nt, hsa; identical to SEQ ID NO: 50697

SEQ ID NO: 77231 - RNA, 62 nt, hsa; identical to SEQ ID NO: 50698

SEQ ID NO: 77232 - RNA, 62 nt, hsa; identical to SEQ ID NO: 50699

SEQ ID NO: 77233 - RNA, 62 nt, hsa; identical to SEQ ID NO: 50700

SEQ ID NO: 77234 - RNA, 62 nt, hsa; identical to SEQ ID NO: 50701

SEQ ID NO: 77235 - RNA, 62 nt, hsa; identical to SEQ ID NO: 50702

SEQ ID NO: 77236 - RNA, 62 nt, hsa; identical to SEQ ID NO: 50703

SEQ ID NO: 77237 - RNA, 64 nt, hsa; identical to SEQ ID NO: 50680

SEQ ID NO: 77238 - RNA, 64 nt, hsa; identical to SEQ ID NO: 50681

SEQ ID NO: 77239 - RNA, 64 nt, hsa; identical to SEQ ID NO: 50682

SEQ ID NO: 77240 - RNA, 64 nt, hsa; identical to SEQ ID NO: 50683

SEQ ID NO: 77241 - RNA, 64 nt, hsa; identical to SEQ ID NO: 50684

SEQ ID NO: 77242 - RNA, 64 nt, hsa; identical to SEQ ID NO: 50685

SEQ ID NO: 77243 - RNA, 64 nt, hsa; identical to SEQ ID NO: 50686

SEQ ID NO: 77244 - RNA, 64 nt, hsa; identical to SEQ ID NO: 50687

SEQ ID NO: 77245 - RNA, 64 nt, hsa; identical to SEQ ID NO: 50688

SEQ ID NO: 77246 - RNA, 64 nt, hsa; identical to SEQ ID NO: 50689

SEQ ID NO: 77247 - RNA, 64 nt, hsa; identical to SEQ ID NO: 50690

SEQ ID NO: 77248 - RNA, 64 nt, hsa; identical to SEQ ID NO: 50691

SEQ ID NO: 77249 - RNA, 64 nt, hsa; identical to SEQ ID NO: 50692

SEQ ID NO: 77250 - RNA, 64 nt, hsa; identical to SEQ ID NO: 50693

SEQ ID NO: 77251 - RNA, 62 nt, hsa; identical to SEQ ID NO: 50694

SEQ ID NO: 77252 - RNA, 62 nt, hsa; identical to SEQ ID NO: 50695

SEQ ID NO: 77253 - RNA, 62 nt, hsa; identical to SEQ ID NO: 50696

SEQ ID NO: 77254 - RNA, 62 nt, hsa; identical to SEQ ID NO: 50697

SEQ ID NO: 77255 - RNA, 62 nt, hsa; identical to SEQ ID NO: 50698

SEQ ID NO: 77256 - RNA, 62 nt, hsa; identical to SEQ ID NO: 50699

SEQ ID NO: 77257 - RNA, 62 nt, hsa; identical to SEQ ID NO: 50700

SEQ ID NO: 77258 - RNA, 62 nt, hsa; identical to SEQ ID NO: 50701

SEQ ID NO: 77259 - RNA, 62 nt, hsa; identical to SEQ ID NO: 50702

SEQ ID NO: 77260 - RNA, 62 nt, hsa; identical to SEQ ID NO: 50703

SEQ ID NO: 77261 - RNA, 64 nt, hsa
uuagaaauagcuuuaacuuugcuuaaacuacaaacacaagcaaaacuucacggggucauacuac

SEQ ID NO: 77262 - RNA, 64 nt, hsa
ugcuuauguuagaaauaagacaaccccagccaaucacaagcagccuacuaacauauaauuaggu

SEQ ID NO: 77263 - RNA, 64 nt, hsa
uuaaggagaaagugaaucauugguagauauccugcacaagcagcuggacuuuccaguaauagcu

SEQ ID NO: 77264 - RNA, 64 nt, hsa
uggacuucagagauuaagucaccaauagugaucucacaagcacucaccggaacuccuauaaugu

SEQ ID NO: 77265 - RNA, 64 nt, hsa
aaacaaaauccuuuuaucucaguuauuugcccaucacaagcacauuuuuaaaauguugcuuugu

SEQ ID NO: 77266 - RNA, 64 nt, hsa
cagccauccuugugccuucaccucugauguguuucacaagcacguaguucaacccagauaggga

SEQ ID NO: 77267 - RNA, 64 nt, hsa
cuuaugacuuaaaaaaaaaaauucuuuuuggaaacacaagcauuucuuuaaggaugaccggaug

SEQ ID NO: 77268 - RNA, 64 nt, hsa
aaggaugaccggauguugccguauguauuuauggcacaagcagguguugucuaagcaguuucuc

SEQ ID NO: 77269 - RNA, 64 nt, hsa
gaaaaugcaggcauuacaccagcuguuacacaagcacaagcaugcucuguaagagcuuuacauu

SEQ ID NO: 77270 - RNA, 64 nt, hsa
gguacugaaaaugcaggcauuacaccagcuguuacacaagcacaagcaugcucuguaagagcuu

SEQ ID NO: 77271 - RNA, 64 nt, hsa
acucugagcauuuuuaaaaguuuguuuacaauuccacaagcaaaagcucuaauuuaaccagauu

SEQ ID NO: 77272 - RNA, 64 nt, hsa
cucuucagagaucaucagaaaagaggugggaauacacaagcaggugcauguaagcccaaaagcu

SEQ ID NO: 77273 - RNA, 64 nt, hsa
gauuucuggucaaccccacaagcaccacucugggcacaagcagggcacucuguuccccuccccc

SEQ ID NO: 77274 - RNA, 64 nt, hsa
ggcgcuaggggacuuggggauuucuggucaaccccacaagcaccacucugggcacaagcagggc

SEQ ID NO: 77275 - RNA, 64 nt, hsa
gaggaggaagauggugacaugauuugguuagaagcacaagcaaacugaucagccucccagaccu

SEQ ID NO: 77276 - RNA, 64 nt, hsa
acagggagccgagugccccucagagucccccaaacacaagcacaucacaccucccagugagaga

SEQ ID NO: 77277 - RNA, 64 nt, hsa
cacguggucucgccuucccuucuuccugcagguucccgccaagccaugugacagagugcucaca

SEQ ID NO: 77278 - RNA, 64 nt, hsa
uugagugugggagaggagaccaggucacccgauucccgccaagccggaagucccugcagcacca

SEQ ID NO: 77279 - RNA, 64 nt, hsa
agguccgggagggcuggggcuucggggagcccuacccgccaaaccugcuguuggcccgggagag

SEQ ID NO: 77280 - RNA, 64 nt, hsa
aaaaccuuuaauuccaaaagaaauccccccucuccccgccaaaaaaggcguucccaccgcccgg

SEQ ID NO: 77281 - RNA, 64 nt, hsa
agaggguguuugccagucugagugucccgcggugcccgccaacccgcuuccugacugaccugag

SEQ ID NO: 77282 - RNA, 64 nt, hsa
ucgaaaccacagcccuuaccccaaucccacgagccccgccaacgaaccacaggugcugggcuuu

SEQ ID NO: 77283 - RNA, 64 nt, hsa
gcccccaagguggucaugacuggucucauuugcagaagucuaagaauguaccuuuuucuggccg

SEQ ID NO: 77284 - RNA, 64 nt, hsa
agaaacucaaaggaggaagacauaauuagggaaagaagucuauuugaugaauauguguguguaa

SEQ ID NO: 77285 - RNA, 64 nt, hsa
uuuauccugcccauguucacuccauuguaggguugaagucuagcuugugauauuuucuggccug

SEQ ID NO: 77286 - RNA, 57 nt, hsa
augaugaagcuaacacuugaauuuucugaagucuagcuuaacaucuuugguuuuccu

SEQ ID NO: 77287 - RNA, 64 nt, hsa
gaggcuucccacacugccaggggagccucacugugaagucuaggcucagacaggcaucaacaaa

SEQ ID NO: 77288 - RNA, 64 nt, hsa
auaguuucaauucauguaaguucaacagacaccugaagucuagcaugugggaggcugaggaugg

SEQ ID NO: 77289 - RNA, 64 nt, hsa
auuagccacuuauaucuuagacuauacuuuuugggaagucuagagauguauauaaugugcuaaa

SEQ ID NO: 77290 - RNA, 64 nt, hsa
uucuagauugaauuuaaaguaaguauggauuauggaagucuaguaaauauacuuuucccuauuu

SEQ ID NO: 77291 - RNA, 64 nt, hsa
uauauacaacaaaguuucugccaucuagcuuuuugaagucuaugggggucuuacucaaguacua

SEQ ID NO: 77292 - RNA, 64 nt, hsa
gccacugacauuucuuuuuuuaaaaaaaauuugagaagucuacuuccuuuuaacuuuuuugguc

SEQ ID NO: 77293 - RNA, 64 nt, hsa
uguauucuuucauuacagauauccauuuggggaugaagucuacuuugacagcuagcaaggcgac

SEQ ID NO: 77294 - RNA, 64 nt, hsa
auaagaccgaucuccugaccccauugggaacacggaagucuauuccaggccaaccagcccaaaa

SEQ ID NO: 77295 - RNA, 64 nt, hsa
ucccuggaaguguaucacuuucuccggcagcugggaagucuagaaccagccagacuggguuaag

SEQ ID NO: 77296 - RNA, 64 nt, hsa
uguguguucagugacaucauacauucuguaucuagaagucuaaaauuucugccuuucuccuaaa

SEQ ID NO: 77297 - RNA, 64 nt, hsa
aggauucgauggcaaugaauuucugaauacgguggaagucuauaaccuugagucaaaugaaugg

SEQ ID NO: 77298 - RNA, 64 nt, hsa
auuauuuguaaugaacacaagccucucuugaguagaagucuaaaucacauuaugauuauuuuau

SEQ ID NO: 77299 - RNA, 64 nt, hsa
aguguguggcccaugaauugaacaauuuaaccuugaagucuauauccgugauauuaugucgauu

SEQ ID NO: 77300 - RNA, 64 nt, hsa
uauguauugcauuauaucauugcaauaauuauuggaagucuagauaucgagccaucccaggugu

SEQ ID NO: 77301 - RNA, 64 nt, hsa
cacugugauguuuuuacgugaauauguugaaguagaagucuaccauauuauuuuauaaaauguu

SEQ ID NO: 77302 - RNA, 64 nt, hsa
auguauuuugugauguacuaaggauacugguccugaagucuaccaaauauuauagugcauuuua

SEQ ID NO: 77303 - RNA, 64 nt, hsa
uuuuuuuuauuucuacuugaacacuaccucuugugaagucuacuguagauaagacgauugucau

SEQ ID NO: 77304 - RNA, 64 nt, hsa
aucuaguguaaaaaacaacagcaaacaaaaaggugaagucuaaaugaagugcacagccaaaguc

SEQ ID NO: 77305 - RNA, 64 nt, hsa
uuucaauuacuccauguuuuauuuaauauccauugaagucuaugaauucucuguucugguggca

SEQ ID NO: 77306 - RNA, 64 nt, hsa
agugauuuauuuguguuaauaaaacucuuuugaggaagucuaugccaaaauccuuuuuaucaaa

SEQ ID NO: 77307 - RNA, 64 nt, hsa
aguuuuuuaguccuuuaacuuucuggauugcaacgaagucuaguuuagaccucuaagcccuuuu

SEQ ID NO: 77308 - RNA, 64 nt, hsa
gaaccuuauuucucaaaacuuauaguagccucaagaagucuauugauauuggucauguuuauuu

SEQ ID NO: 77309 - RNA, 64 nt, hsa
caggccaggaccacacaguccccagacucagcuggaagucuaccugcuggacagccuccgccaa

SEQ ID NO: 77310 - RNA, 64 nt, hsa
cuaaggucuggccuugccccuuugcucugccccugaagucuaucugcaggauggucuucacagg

SEQ ID NO: 77311 - RNA, 64 nt, hsa
aaaggcaaaaccugaaccaccuucugcacuuaaagaagucuaacaguacaaauacacuaucuau

SEQ ID NO: 77312 - RNA, 64 nt, hsa
uaguguuuuauuuaccugacaaauggaaguuauagaagucuaauaauguuaagcaccaguaauu

SEQ ID NO: 77313 - RNA, 64 nt, hsa
guccuucuuuaucugugauaauuuucuguguucugaagucuacuuugucuaaaaauaacauacg

SEQ ID NO: 77314 - RNA, 64 nt, hsa
auauaaaggaucaaauuaauuuaaauaugauucugaagucuacagaacuuuuaguucugugcug

SEQ ID NO: 77315 - RNA, 64 nt, hsa
agaaaacaugcaguuugggcauuugacugacuuggaagucuaagcuuauuuuaguuauaacuau

SEQ ID NO: 77316 - RNA, 64 nt, hsa
cuagaaugauuccagcuuccucaguacacuucaugaagucuacuugcagguucugaccaagaac

SEQ ID NO: 77317 - RNA, 64 nt, hsa
uaugugaucagguguggccaaugaaauugaagaggaagucuaccugggcuucugggaaagcuuu

SEQ ID NO: 77318 - RNA, 64 nt, hsa
accaaggccagcgcagguuauccaccucugccuggaagucuauacucuacccagggcaucccuc

SEQ ID NO: 77319 - RNA, 64 nt, hsa
aggagaggccacuucccaccaggacccccaacaugaagucuaggccucaggggcucccgcccuu

SEQ ID NO: 77320 - RNA, 64 nt, hsa
aggaauuuucaauauuugauugguauucuguucugaagucuaagauauuuuucagccuauaaag

SEQ ID NO: 77321 - RNA, 64 nt, hsa
uuuuaauuccuaaagauccugacuuuuaucugaggaagucuagguaguuuuccuuuuggaucug

SEQ ID NO: 77322 - RNA, 64 nt, hsa
aacaauaaccaaauaaaaacuugauaggaucuuugaagucuauuuaaauauucauuccauuaca

SEQ ID NO: 77323 - RNA, 64 nt, hsa
caauuuaaauuaggaaauauauaugaaugucguugaagucuauuuugagacugcuaaagcuauu

SEQ ID NO: 77324 - RNA, 64 nt, hsa
cuuagaaccagguggcuggucaccuggauguacagaagucuaacuggugaaggaauaucauuua

SEQ ID NO: 77325 - RNA, 64 nt, hsa
uggagucagauaguuguugggagggggaggacaagaagucuauuguuuggacuguguuugucuc

SEQ ID NO: 77326 - RNA, 64 nt, hsa
aacucugccugagacuuucagugcacuguauauagaagucuaaaacacaccuaagagaaaaaga

SEQ ID NO: 77327 - RNA, 64 nt, hsa
agccaggaauucccauguuacacaggaaaaaauagaagucuacugaauuaauuuuuuaaaagaa

SEQ ID NO: 77328 - RNA, 64 nt, hsa
guagggagauauuuaaguauaaaauacaacaaaggaagucuaaauauucagaaucuuuguuaag

SEQ ID NO: 77329 - RNA, 64 nt, hsa
aguuuuaaaaaaucuauauuuuuagucauaaugagaagucuauuuucaccaauuauggaaacau

SEQ ID NO: 77330 - RNA, 64 nt, hsa
aauggaugaaacuucaaauuaucuuauuuggauagaagucuauauucuagccucauuugcauga

SEQ ID NO: 77331 - RNA, 64 nt, hsa
aacuuaccgugagcgacaaagaugauuuaaaagggaagucuagaguuccuagucucccucacag

SEQ ID NO: 77332 - RNA, 64 nt, hsa
gugccauuccuguccuuaaggcacagucucaucagaagucuaauaccugggcagguuuauaaca

SEQ ID NO: 77333 - RNA, 64 nt, hsa
cuaagagcagaacuccuaccccaaaagaagccuggaagucuaauuaagaguagcauaaggaacc

SEQ ID NO: 77334 - RNA, 64 nt, hsa
uuauccauuucuuuuacucuguguaaagacuugagaagucuaauucacaggcaaaccaauacag

SEQ ID NO: 77335 - RNA, 64 nt, hsa
uugauacgaauguuaugcauuuaguaugcacauugaagucuaaacuguagaagagucuaaaaca

SEQ ID NO: 77336 - RNA, 64 nt, hsa
uaaagcuggugaaguuuggccaguuugggcuucagaagucuaagucuagugaagguacccugac

SEQ ID NO: 77337 - RNA, 64 nt, hsa
aacuuguuucuuuuaauuuuauuugucccugagugaagucuagaaagaaagguaaagagucuag

SEQ ID NO: 77338 - RNA, 64 nt, hsa
cuauuccuguucaguauucuuugucuugaauagagaagucuauguucguaaagucauauaaaag

SEQ ID NO: 77339 - RNA, 64 nt, hsa
auguuuguaaagugcaugagucauguucacacuugaagucuaguagugcacuguaauaauucau

SEQ ID NO: 77340 - RNA, 64 nt, hsa
cugagaaaaaguccugucaguucagaaaaaaugugaagucuacuuuaguauuccuguaauacua

SEQ ID NO: 77341 - RNA, 64 nt, hsa
gacaaauccuucuagaauuugccucuuugggacugaagucuaaggggcugagaccaagaaggga

SEQ ID NO: 77342 - RNA, 64 nt, hsa
ccauggacauggugaccacagccagcuggaaccugaagucuaaacaccauuccugcucuccagc

SEQ ID NO: 77343 - RNA, 64 nt, hsa
ugaaauaggagggaaaccuuuggcuacacaauuggaagucuaagaacccauggaaaaaugccau

SEQ ID NO: 77344 - RNA, 64 nt, hsa
cccacccuauggccuagcuucagguacuucaguugaagucuaaacucagguaacuuggaaugua

SEQ ID NO: 77345 - RNA, 64 nt, hsa
ucuauaugaucuugauauuguuuuauaauaauuugaagucuaaaagacugcauuuuuaaacaag

SEQ ID NO: 77346 - RNA, 64 nt, hsa
cagggugagugagauaaccaaugccaaacuuuuugaagucuaauuuuugaggggugagcucauu

SEQ ID NO: 77347 - RNA, 64 nt, hsa
gagauaaccaaggugauucaggauuugaucaaaagaagucuaguaagaauuaauuacacagaag

SEQ ID NO: 77348 - RNA, 64 nt, hsa
ucaaauaaauuaaauuacauuaaauguuuaagaagaagucuaaauaaguuucauaugcugcccu

SEQ ID NO: 77349 - RNA, 64 nt, hsa
cugacuaguuuuauuuauaaaaucuuaaguuuuggaagucuaaaggagaaaccauuccaguaug

SEQ ID NO: 77350 - RNA, 64 nt, hsa
uugaauuugcuguuucaagcauuuguacauauuagaagucuaaggaguagcaagucagugggag

SEQ ID NO: 77351 - RNA, 64 nt, hsa
ucuccuucaucaucauauaugaaguuuauuuugagaagucuacauugcuuacauuuuaauugag

SEQ ID NO: 77352 - RNA, 64 nt, hsa
uauucuuccaaagaauuguaauccuccccacacugaagucuagggguugcgaaucccuccugag

SEQ ID NO: 77353 - RNA, 64 nt, hsa
caucuucagguuaccauuauuuuuuaaugagcaggaagucuagaaaugauaacuagacuguaug

SEQ ID NO: 77354 - RNA, 64 nt, hsa
ggaaaacagaaaguaagacccucagaaaaccaaugaagucuaagagaaauaaaauuuaguggac

SEQ ID NO: 77355 - RNA, 64 nt, hsa
uggauuacagucaguuaaaaugaaaugcaacacugaagucuauaacaugaaaugauuauuaaau

SEQ ID NO: 77356 - RNA, 64 nt, hsa
caauuccaagaaaauaucacuguaaugagucagugaagucuagaaucauacuuaacauuucauu

SEQ ID NO: 77357 - RNA, 64 nt, hsa
aauuucuuuaagccuuccuuuguagcugauuaaggaagucuagucauaaacuaucaaagagaaa

SEQ ID NO: 77358 - RNA, 64 nt, hsa
ugauucagguacaccauuaagauacaacauucuagaagucuauuaccuuaggaguuaauuaaac

SEQ ID NO: 77359 - RNA, 64 nt, hsa
cacacuguuccagugucuauaaaagaaacacuuugaagucuauaaaaaauaaaauaauuauaaa

SEQ ID NO: 77360 - RNA, 64 nt, hsa
cugcuucccuaaagcagaauuguuauucauuuaagaagucuaauaugauauacauucauccuag

SEQ ID NO: 77361 - RNA, 64 nt, hsa
cauuuagauccugguuucauaacuuccuguacuugaagucuaaaagcagaaaauaaaggaagca

SEQ ID NO: 77362 - RNA, 64 nt, hsa
gcaaacuuaguucuggugauuucuugaugguuuggaagucuauugcugggaagaaauuccauca

SEQ ID NO: 77363 - RNA, 64 nt, hsa
aucacugagcacucauuuagaagugagggagacagaagucuaggcccagggauggcuccaguug

SEQ ID NO: 77364 - RNA, 64 nt, hsa
cugucucagucuuccgcaggcuuaccugcgccaggaagucuaaccaaggaacaagaaucucacu

SEQ ID NO: 77365 - RNA, 64 nt, hsa
acauuuccucuuugagacucugaguucaccuagagaagucuaagcauaacagcuuucuuuccca

SEQ ID NO: 77366 - RNA, 64 nt, hsa
caaggaaauaaaaauucugcaguuuuaaccuuuagaagucuaagcaagauuaacaaauuucaua

SEQ ID NO: 77367 - RNA, 64 nt, hsa
uauccaucaaaaaaugcacucucacaguggaguugaagucuaauacaugauacaugugggccug

SEQ ID NO: 77368 - RNA, 64 nt, hsa
aauggcaguuacagacagguuaacagaagcuacugaagucuacagauaaucaaaaaacuuaaua

SEQ ID NO: 77369 - RNA, 64 nt, hsa
acccuuuucucgccgcaagaagcccauuccuauggaagucuagcaaagcaauacgacucagccc

SEQ ID NO: 77370 - RNA, 64 nt, hsa
uucauaucuagauuuucaaacaaagccccaagaugaagucuaauucugaaaauaucucacaauu

SEQ ID NO: 77371 - RNA, 64 nt, hsa
agagauguuccucuuuaaucaugaaacaccuuaagaagucuauaaugcaauccuuaguccuacc

SEQ ID NO: 77372 - RNA, 64 nt, hsa
guuuggggcuggggguuggagaauaaaagcaggagaagucuaugggauucuagaaauaguaccu

SEQ ID NO: 77373 - RNA, 64 nt, hsa
aguccuguuugcagggaagccccacuugaaggaagaagucuaagagugaaguaggugugacuug

SEQ ID NO: 77374 - RNA, 64 nt, hsa
gguugugguuggauggaggagaugaucuugucuggaagucuagagucuuuguugguuagaggac

SEQ ID NO: 77375 - RNA, 64 nt, hsa
caaacacagaguuugaacuauaauacuaaggccugaagucuagcuuggauauaugcuacaauaa

SEQ ID NO: 77376 - RNA, 64 nt, hsa
auuucuagcuaauuguuaauuauaauuaugcucagaagucuauuuaaugagcucugacuguacu

SEQ ID NO: 77377 - RNA, 64 nt, hsa
gcuuacaacaauuuuccucacagucuggaggccagaagucuaaaaucaaagugucagcagaguu

SEQ ID NO: 77378 - RNA, 64 nt, hsa
uuuccuauuaccuuagauugcaaaccagucuagggaagucuaugagaaaguagcauuuaauuaa

SEQ ID NO: 77379 - RNA, 64 nt, hsa
ugaccugugagaaugaagcuggagcccagcgucagaagucuaguuuuauaggcagcuguccugu

SEQ ID NO: 77380 - RNA, 64 nt, hsa
aauuaagaauggagcuuaaccaugccuccauugggaagucuagacuuugagccagguacaguaa

SEQ ID NO: 77381 - RNA, 64 nt, hsa
ccugggccccaccaccuaggccacuccuccaaaggaagucuaggagcugggaggaaaagaaaag

SEQ ID NO: 77382 - RNA, 64 nt, hsa
ucauucuucacaggcaggaaccucaugcucugaggaagucuaaguccaguuuuccuucuccagc

SEQ ID NO: 77383 - RNA, 64 nt, hsa
cuaaaagauauacagagaagacauaaugaauuucgaagucuaauuuugguuccuaacaugccuc

SEQ ID NO: 77384 - RNA, 64 nt, hsa
uaaaucuagaaaucagcuuuuaaaaauauugucugaagucuaacaaaaguuuucaccucuaaug

SEQ ID NO: 77385 - RNA, 64 nt, hsa
auuagucaaaaauaccauuuuaguaugaagcaaugaagucuauuauuuguugucccauaauuga

SEQ ID NO: 77386 - RNA, 64 nt, hsa
agccucuaacauggccacuucucagcacguccaagaagucuaacuaucaaaaagggcagacuuc

SEQ ID NO: 77387 - RNA, 64 nt, hsa
ggaagucugagaugauaaauauuucaaggucagugaagucuaucaaucauucuccccuuccuca

SEQ ID NO: 77388 - RNA, 64 nt, hsa
cagaacuccauguuuguuucucucuauccccacagaagucuacagguaaggaaaucaaucauga

SEQ ID NO: 77389 - RNA, 64 nt, hsa
uggagacuucuuaucaaaaguaaugcugccaaaggaagucuaaggaauuaguaguguucccauc

SEQ ID NO: 77390 - RNA, 64 nt, hsa
gacuggugcugaaacaaaagguuaaggcuagguugaagucuagaaugaaagaaaucugaaucca

SEQ ID NO: 77391 - RNA, 64 nt, hsa
agacaacauuaugacacuuuaaaacaguagcaaagaagucuauuuauuaacccacaaauguagc

SEQ ID NO: 77392 - RNA, 64 nt, hsa
uuuguggagacagggcuggacuugaaaggaagaagaagucuaaaagaaaacaucauuugcaaag

SEQ ID NO: 77393 - RNA, 64 nt, hsa
ugguggaggccgcuaagcaugguagaggcuagaggaagucuauccacaggcaguuguguuccca

SEQ ID NO: 77394 - RNA, 64 nt, hsa
gccaaagaaaugaacauuccaaggaguuggaagugaagucuaugaugugaaacacuuugccucc

SEQ ID NO: 77395 - RNA, 64 nt, hsa
ugcaauaaaugugaggaaguauuuaauaaaaaaugaagucuaaaugugucagagaauuuaugug

SEQ ID NO: 77396 - RNA, 64 nt, hsa
cacucuagaaaguauguuuguguugguuuuuuaagaagucuaaaugaaguuauuaauaccugaa

SEQ ID NO: 77397 - RNA, 64 nt, hsa
ucuauagaaaaccauuuaccaacugaaaggacacgaagucuagcuccggacaaaagcuguuaga

SEQ ID NO: 77398 - RNA, 64 nt, hsa
aaacacuuggcauacaaaauauuuaagugaaggagaagucuaacgcugaacugacaaugaaggg

SEQ ID NO: 77399 - RNA, 64 nt, hsa
gagaggacuggcugcccuggaggaggaaagggaggaagucuacacagaggagcaccaggacggc

SEQ ID NO: 77400 - RNA, 64 nt, hsa
ugguaaucuguagaaccuucuccuaggaaauggugaagucuauuaggagccacuugugacucca

SEQ ID NO: 77401 - RNA, 64 nt, hsa
auggagacauaaggaaaauuaaauacaaaacugagaagucuaguugcuguugagcuuaaucuuu

SEQ ID NO: 77402 - RNA, 64 nt, hsa
uggauuguaggaaaguuaagcaggcaccauccuggaagucuaccccuagguggucgagagaccu

SEQ ID NO: 77403 - RNA, 64 nt, hsa
gugugugggcgggggggguggggggcaguucagugaagucuagaagaccugcuggacaaauucu

SEQ ID NO: 77404 - RNA, 64 nt, hsa
ccagugugucuggccgcauuccccccaauguggagaagucuaucaagaaggaaauggcucagua

SEQ ID NO: 77405 - RNA, 64 nt, hsa
gccuaccuucucucacagggggacccaauucucugaagucuacgauggagcauuuuuugagaag

SEQ ID NO: 77406 - RNA, 64 nt, hsa
ugacuacugcaccuggacagccuccucuuuucuagaagucuauuuauauugucauuuuauaaca

SEQ ID NO: 77407 - RNA, 64 nt, hsa
aaggccuaacccauuacaccagaagaccaugggugaagucuagauggggaggagaagugaggcc

SEQ ID NO: 77408 - RNA, 64 nt, hsa
aauuuguuuuuugaauggguuuuucuuuuuugaagaagucuaauaaaucuagaaggaauuagag

SEQ ID NO: 77409 - RNA, 64 nt, hsa
uuauguaaaaguguauuuguuagagauaauuucugaagucuauacacaggagaugauauaucug

SEQ ID NO: 77410 - RNA, 64 nt, hsa
guuuaucacacugguuccauuuccuugcaaauaagaagucuauuucccaguaacccuugcaguu

SEQ ID NO: 77411 - RNA, 64 nt, hsa
cagaguagauuaacugaaugaccaaagagcaacagaagucuagugauucuugucuuugagguuc

SEQ ID NO: 77412 - RNA, 64 nt, hsa
uauguaauucuauuaauagaaacagcuguguaaagaagucuaaaauuuucacuauuuccaauga

SEQ ID NO: 77413 - RNA, 64 nt, hsa
aagcugggucaggggccuugaaacuggagaaguggaagucuaugguuggucugaguaaguaacu

SEQ ID NO: 77414 - RNA, 62 nt, hsa
agauuguggcuacuuaauaaauguuuuuuguuaugaagucuacccugagaccacaucugcau

SEQ ID NO: 77415 - RNA, 64 nt, hsa
uuacugacagaaauugacuggacugucauugugugaagucuaggaggaaauguccauuuuaauu

SEQ ID NO: 77416 - RNA, 64 nt, hsa
uuaaaaaaaagauggaguuuucuaacgugaggaugaagucuacacuucagauuaaaaaggguua

SEQ ID NO: 77417 - RNA, 64 nt, hsa
aguuacuguccacccggugguguggccccauagcgaagucuaaaugccuguagagauagagcua

SEQ ID NO: 77418 - RNA, 64 nt, hsa
auguaccauaauuaacuuggcuaguugauuguuugaagucuauggaagaaauaguuuuaugcaa

SEQ ID NO: 77419 - RNA, 64 nt, hsa
cugggcacuuccuuguaaaaucuaguuuuggcaagaagucuauuaggucaguuuagcaagaaca

SEQ ID NO: 77420 - RNA, 64 nt, hsa
ccaccgaggccaguccuaguucuugguccagggagaagucuaggcaggauaaaucauaucuuac

SEQ ID NO: 77421 - RNA, 64 nt, hsa
gccagagacuucaagucuaucugaaaagucuccagaagucuaaccccagauaaauagccaacag

SEQ ID NO: 77422 - RNA, 64 nt, hsa
gucucuacugaauucuucuaauuccuucgcaacagaagucuaaauccugcuuagccuaaacaua

SEQ ID NO: 77423 - RNA, 63 nt, hsa
gaauauuggugagcugcauauauaaauuugacagauagcuauuuacauagccuucuaaguaaa

SEQ ID NO: 77424 - RNA, 63 nt, hsa
aggauuuaaaauacagaaacaguuuauguauaggauagcuauaaguaaauacugaaacacauu

SEQ ID NO: 77425 - RNA, 63 nt, hsa
caaagagaaguaagagagauagcuagauagcuagauagcuagauagucuugugucuuguuuga

SEQ ID NO: 77426 - RNA, 63 nt, hsa
gggggcgccaaagagaaguaagagagauagcuagauagcuagauagcuagauagucuuguguc

SEQ ID NO: 77427 - RNA, 63 nt, hsa
ugacacaugggggcgccaaagagaaguaagagagauagcuagauagcuagauagcuagauagu

SEQ ID NO: 77428 - RNA, 63 nt, hsa
gaucuaauucuguuuccucucacaugauuacuugauagcuaagcaucugauugguuuacugcu

SEQ ID NO: 77429 - RNA, 63 nt, hsa
uucuuguguaaauagaaacuguaaagucaucaggauagcuaguuaagucgguaaccuuaaacu

SEQ ID NO: 77430 - RNA, 64 nt, hsa
agacuuggugggaaguaagcuggagauccaggcugcuggagauccaaugccugcugccuccaga

SEQ ID NO: 77431 - RNA, 64 nt, hsa
caccuccacuguaccaagacuuggugggaaguaagcuggagauccaggcugcuggagauccaau

SEQ ID NO: 77432 - RNA, 64 nt, hsa
caugccugaaaucccacuacuuugggaggcugaggcuggagaauugcuugaggcuagugagcug

SEQ ID NO: 77433 - RNA, 64 nt, hsa
ucaguuuauacucuuaauuuaauuuucuuucugagcuggagaacuggcuuugcacuuugguuac

SEQ ID NO: 77434 - RNA, 64 nt, hsa
uucagggcugggccaugugguugauuuuucuaaagcuggagaaaggaagaauugugccuugcau

SEQ ID NO: 77435 - RNA, 64 nt, hsa
aggccaggauagccaagcccugggugagcgagaggcuggagaacacaggagcucacccagggcu

SEQ ID NO: 77436 - RNA, 64 nt, hsa
uggccacgaugaaacagauuucaacugauaaagagcuggagaacuccauguacuuuggaaucuc

SEQ ID NO: 77437 - RNA, 64 nt, hsa
ggaucaagcucaucgacuuuggucuggccaggaggcuggagaaugcggggucucugaagguccu

SEQ ID NO: 77438 - RNA, 64 nt, hsa
aaugagcucacuggaaauucauucuaauccccaagcuggagaaacagguuaagagauccuguuu

SEQ ID NO: 77439 - RNA, 64 nt, hsa
ccggagcagugucugucugacggcaggauggggagcuggagagcccccccgacccucagcguac

SEQ ID NO: 77440 - RNA, 64 nt, hsa
ggccgcuccagggguggcuggagacgggugggcggcuggagaccaugcagagcgccgugaguuc

SEQ ID NO: 77441 - RNA, 64 nt, hsa
ccucugccgccuccccacggccgcuccagggguggcuggagacgggugggcggcuggagaccau

SEQ ID NO: 77442 - RNA, 64 nt, hsa
gguggggagaugggcauuuggagagucucauguagcuggagacguuaagagcugagcacaccac

SEQ ID NO: 77443 - RNA, 64 nt, hsa
ugcauggagggcuguaaagccacggauuccccucgcuggagaggcuccugucugauagcgguag

SEQ ID NO: 77444 - RNA, 64 nt, hsa
cauauuaauuauuuuccaaaaucuaaaagcuguagcuggagaagcccauggccacgaggaagca

SEQ ID NO: 77445 - RNA, 64 nt, hsa
gaaugggaaaguauuuuugaaagaauucuauuuugcuggagacuauuuaaguacuaucuuuguc

SEQ ID NO: 77446 - RNA, 64 nt, hsa
aaaagaaagcauuguuuuaauugagaggggcagggcuggagaaggagcaaguuguggggagcca

SEQ ID NO: 77447 - RNA, 64 nt, hsa
ggcgccuguagucccagcagcuugggaggcugaggcuggagaauggugugaacccaggaggcgg

SEQ ID NO: 77448 - RNA, 64 nt, hsa
uuguccugaauaaggagauccagagccagcagcggcuggagagccuguccgagacacccgggcc

SEQ ID NO: 77449 - RNA, 64 nt, hsa
auagcaacagcaauuuccgggaggucuuggagaagcuggagagcgaccccgucugccagcgccu

SEQ ID NO: 77450 - RNA, 64 nt, hsa
cgugccuguagucccagcuacucgggaggcugaggcuggagaguugcucaaacccgggaggcgg

SEQ ID NO: 77451 - RNA, 64 nt, hsa
ccaaugugcaccaauaugccuaacuagcuagccagcuggagauaauuuaccagggaauguuuca

SEQ ID NO: 77452 - RNA, 64 nt, hsa
uagccauccccacccacuuguaccagcuaagaaugcuggagacucugccaccaugcucugcgug

SEQ ID NO: 77453 - RNA, 64 nt, hsa
ucaggagcugugccaagcacuuuccucuuuuacagcuggagaucacuggaaaggugucucaguc

SEQ ID NO: 77454 - RNA, 64 nt, hsa
gugccugccgaggcgggacagaguguucgcucgcgcuggagaaggcucugcucagcccugagag

SEQ ID NO: 77455 - RNA, 64 nt, hsa
ugugggcaagaaggagcuggcaaggaccggcgcugcuggagacugacccagcccucuggcugag

SEQ ID NO: 77456 - RNA, 64 nt, hsa
ugugauugaaagccauugaggagcagguguccgggcuggagaagaguccugcuuucucuggagu

SEQ ID NO: 77457 - RNA, 64 nt, hsa
ugcggggcucuuguuggccgcacguggcagugcagcuggagaggaagccuggggcacguccugu

SEQ ID NO: 77458 - RNA, 64 nt, hsa
aaaagauccaggcccuccacuucuccuugaggcagcuggagagcuaucccccgccccucaagca

SEQ ID NO: 77459 - RNA, 64 nt, hsa
gucugggguauuuccccugcugaggagugacagggcuggagacugugucugcuuucugccuccu

SEQ ID NO: 77460 - RNA, 64 nt, hsa
gcugggcucuccagagcugggcuuggcucuuccagcuggagaaggacugagccccaguaacccc

SEQ ID NO: 77461 - RNA, 64 nt, hsa
agaaccugauguaccugaagcagauccuguauuugcuggagaaauucguggcugugcuaggggg

SEQ ID NO: 77462 - RNA, 64 nt, hsa
cugccuggcgccgugcccuuccuuuguccugcccgcuggagacaguguuugucgugggcguggu

SEQ ID NO: 77463 - RNA, 64 nt, hsa
cugauaccuauaaguucacccccaccccacagcugcuggagagaaaucccaagaggcagcccuu

SEQ ID NO: 77464 - RNA, 64 nt, hsa
gaacaggaccugugagcagcugcauuggccuggagcuggagaguaaggcuguaggaucuuugga

SEQ ID NO: 77465 - RNA, 64 nt, hsa
cgcuggacccagccaccuuguaugagguggaagagcuggagacggccacugagcgcuaccugca

SEQ ID NO: 77466 - RNA, 64 nt, hsa
ugagcgcuaccugcacguacgcccccagccuuuggcuggagaggaucccccugcuuaccaggcc

SEQ ID NO: 77467 - RNA, 64 nt, hsa
augagaggcuguggcagcaggagacucugcaggagcuggagaggcugcgggagcuggagaggau

SEQ ID NO: 77468 - RNA, 64 nt, hsa
aggagacucugcaggagcuggagaggcugcgggagcuggagaggaugcuggagcugggguggga

SEQ ID NO: 77469 - RNA, 64 nt, hsa
agcuacaagcagaggcugaacaccugcggaaggagcuggagaaucugacaggacagcuuuaagc

SEQ ID NO: 77470 - RNA, 64 nt, hsa
agcuacaagcagaggcugaacaccugcggaaggagcuggagaaucuggcaggacagcuuuaagc

SEQ ID NO: 77471 - RNA, 64 nt, hsa
caaggcaggaaagucugaguugggagugacaguggcuggagagaagcagaucugugcaacgugc

SEQ ID NO: 77472 - RNA, 64 nt, hsa
aaguuuuguuugauucugagacucucuugggaacgcuggagagcuugugcacagccucuggaag

SEQ ID NO: 77473 - RNA, 64 nt, hsa
gaaccuggucugauuccuuccaacgugcacuucagcuggagaaagaaaccaagaagggaagcgg

SEQ ID NO: 77474 - RNA, 64 nt, hsa
ucagucuuguuccagugacaguuggaaggccucugcuggagagacaccagcucucagggcagag

SEQ ID NO: 77475 - RNA, 64 nt, hsa
aggagaacugaacccggaccugcucacugcccuggcuggagaggagcacaacagaugccacguc

SEQ ID NO: 77476 - RNA, 64 nt, hsa
agaggcucaccacaagccuggcauuucagccagggcuggagaaggcagggacgccugggugaga

SEQ ID NO: 77477 - RNA, 64 nt, hsa
guacuuuacccuuaauacacauaagauaauuaaugcuggagagaaacccuacaaaugugaagaa

SEQ ID NO: 77478 - RNA, 64 nt, hsa
auccucaacccuuacuacacauuagauaauucaugcuggagagaaacccuacaaaugugaaaaa

SEQ ID NO: 77479 - RNA, 64 nt, hsa
agacucugucucaaauaauaauaauaauaauaaagcuggagacuuggccacaccugggcuaaag

SEQ ID NO: 77480 - RNA, 64 nt, hsa
cugacgaggacgaggaggaggacuaugagcaguggcuggagaucaaagguaaguugugggagcu

SEQ ID NO: 77481 - RNA, 64 nt, hsa
ugugggagagggaugaugaagagagagagggccugcuggagagcauagggucuggaacaccagg

SEQ ID NO: 77482 - RNA, 64 nt, hsa
ugauauaaugcgggugagaguaaugaggcuuggggcuggagaggacaagauggguaaacccuca

SEQ ID NO: 77483 - RNA, 64 nt, hsa
gugugcagagguuugugucuccagggaacccacggcuggagagaaauagggagaugcaggaagu

SEQ ID NO: 77484 - RNA, 64 nt, hsa
cucacugccaggccagcggcuuccgcugagacucgcuggagaggcggcucccguguccguccac

SEQ ID NO: 77485 - RNA, 64 nt, hsa
cugaucgccuaggagagggccucguaguggcacagcuggagauaguuucaaagucuaaaccacc

SEQ ID NO: 77486 - RNA, 64 nt, hsa
ucuuaaaaugacaaaaaguguccauaaagaggcugcuggagagugcguggccauagggagccga

SEQ ID NO: 77487 - RNA, 64 nt, hsa
caguaccccagcucaugggggacucagcaagcaagcguggcaccaucuuggaucugagccgguc

SEQ ID NO: 77488 - RNA, 64 nt, hsa
cuagugcucugaguaggaccguaaccgccuccgugcguggcauauggucccugcaugcuguuca

SEQ ID NO: 77489 - RNA, 64 nt, hsa
uugaugagcugauagaugauauaugagagacuaugcguggcacaauacuuuguuacacucuuca

SEQ ID NO: 77490 - RNA, 64 nt, hsa
ugaaugguuaccucacugcugaaaacccagaggggcguggcacacucgcuuguguggaaaagcc

SEQ ID NO: 77491 - RNA, 64 nt, hsa
gggcaggaugugagagguggggaguacuggcugugcguggcaggacagaagcacuguaaagggc

SEQ ID NO: 77492 - RNA, 64 nt, hsa
cuguaccauggaguccugcagccccuuaaccccugcguggcaacuguguacagcuuaccccugc

SEQ ID NO: 77493 - RNA, 64 nt, hsa
uuguccuucauggguagagucaggaagcccgguggcguggcacaacacacuuuggucauuucuc

SEQ ID NO: 77494 - RNA, 64 nt, hsa
ugaugucuuagaaaggaaggugaauauagucaaagcguggcauugagauaauuggacugaagac

SEQ ID NO: 77495 - RNA, 64 nt, hsa
ccugcguacccacugccaggacccucucagacaagcguggcacagccaugcugaccuuccaucu

SEQ ID NO: 77496 - RNA, 64 nt, hsa
gggagccagagccggugggaagcggggaggggcugcguggcacagcuagugggccucccccugc

SEQ ID NO: 77497 - RNA, 64 nt, hsa
uccccauuuaccaucagcucagccccugggaagggcguggcaggggcucugcaugcccgugaca

SEQ ID NO: 77498 - RNA, 64 nt, hsa
cucguguuguuauauagaccauucauuugccugagcguggcacaguuuuaaaaauaguucucuu

SEQ ID NO: 77499 - RNA, 64 nt, hsa
gcccacaggucucgagacgcacaugcacgccugggcguggcagccucacagggaacacgggaca

SEQ ID NO: 77500 - RNA, 64 nt, hsa
ucucuucccaucaaaucauccagcucaguguggggcguggcagggggguaaaugaagccagcca

SEQ ID NO: 77501 - RNA, 64 nt, hsa
ugacuuuaacccgcccaccuguguccucccauuggcguggcauuucuuuggugucugcucagaa

SEQ ID NO: 77502 - RNA, 64 nt, hsa
cugacaaagcuuggaagagccugcaggugcugcugcguggcauagcccagacacagaagaggcu

SEQ ID NO: 77503 - RNA, 64 nt, hsa
gccuuaugagaacauggugugugucucugacaaugcguggcacaucuaaauugaucauucauaa

SEQ ID NO: 77504 - RNA, 64 nt, hsa
cugacugaaggggcuuggcuuccacucagcaucagcguggcagucaccaccccagugaggaccu

SEQ ID NO: 77505 - RNA, 64 nt, hsa
guauacauuggcuuggaauguucacaacuugcgugcguggcagcggaagacgauucccauauuc

SEQ ID NO: 77506 - RNA, 60 nt, hsa
cucuguaucccaaagcuuaagucucugcaggcguggcacgcacgcacgcacccacccacg

SEQ ID NO: 77507 - RNA, 64 nt, hsa
gcugggagcuugccaggaacccaguggccagggagcguggcacuuaccuuugucccuugcuuca

SEQ ID NO: 77508 - RNA, 64 nt, hsa
agggaggaaacuguauccaugcaugcaugauaaugcguggcagagacugcaacagggauugugu

SEQ ID NO: 77509 - RNA, 64 nt, hsa
cuacgcgggccguacagaggagcucuagagggcugcguggcauccuccuaggggcugagaggug

SEQ ID NO: 77510 - RNA, 64 nt, hsa
gaagagcugcuucugcagggaguuuucuggaauggcguggcacauauugaagcauuucucagug

SEQ ID NO: 77511 - RNA, 64 nt, hsa
ugcuuguucuggaagagauucaggugaaaaguuggcguggcauguuugaggacucugcggauca

SEQ ID NO: 77512 - RNA, 64 nt, hsa
acaggacacggaccuucauggaaguccuugcucugcguggcaucugucagcuuuucaccuuuca

SEQ ID NO: 77513 - RNA, 64 nt, hsa
ugcaugcacaagugugugugugccugcgugcugugcguggcagggugugugugugugugucugg

SEQ ID NO: 77514 - RNA, 64 nt, hsa
guuccucuggaagcugugacuggaauaaacccccgcguggcacugcugaguccucucuggcugg

SEQ ID NO: 77515 - RNA, 64 nt, hsa
cagaaagacaccgcgggcggccccuccgcggaaggcguggcagggaggcagucgcccugcggug

SEQ ID NO: 77516 - RNA, 64 nt, hsa
ccuaggaaugcauuguccucaccuuguuauaccugcguggcaccauggcaggauuccacauuuc

SEQ ID NO: 77517 - RNA, 64 nt, hsa
aaccuucuguuacucccugggagaaaggcgcugagcguggcaugcaggugucuuugcuguguuu

SEQ ID NO: 77518 - RNA, 64 nt, hsa
agcaucuacucagcaaggucacuaagcucugccagcguggcagagcaugucuuggaaccugucu

SEQ ID NO: 77519 - RNA, 64 nt, hsa
cauggugauggaugauauccucuuagccuggugggcguggcaugugcuuuuuaaaacaucaucu

SEQ ID NO: 77520 - RNA, 64 nt, hsa
cuggggcugcuuuuuauuguucccacggcugacagcguggcagcggagacuguggaggcagugg

SEQ ID NO: 77521 - RNA, 64 nt, hsa
cagaaaaggaguggggggcagucaccacugcugggcguggcauccgccuugggccuuucuccga

SEQ ID NO: 77522 - RNA, 64 nt, hsa
ucaaaaauccauuuugccuuacauaugcuaagaagcguggcauucuuucuguucauaaaacaga

SEQ ID NO: 77523 - RNA, 64 nt, hsa
ugcauagaaaaggauucuggugcuuccccuguuugcguggcagcaaggguuccacgugcauuug

SEQ ID NO: 77524 - RNA, 64 nt, hsa
cagcgggugugucagccucucaccggcuccccgagcguggcagccaccagguccacagaacuac

SEQ ID NO: 77525 - RNA, 64 nt, hsa
gcuccgaggcuucuccagagcugggagcuggcuggcguggcaagggcaugcucuggggcagugu

SEQ ID NO: 77526 - RNA, 64 nt, hsa
uuggccuccuggcugcuuucuccccuuccccccagcguggcaggaucucuuccuguuagcaagg

SEQ ID NO: 77527 - RNA, 64 nt, hsa
aaggccuuuuccagcagcugggagcucccggauugcguggcacagcugaggggccucugugaug

SEQ ID NO: 77528 - RNA, 64 nt, hsa
acacaucucgugaaaacucagaaaugacaauaaagcguggcauuugccucuguauuauaaauga

SEQ ID NO: 77529 - RNA, 64 nt, hsa
gguggccaccgccagagcuccuggcgacaucuuggcguggcagccucuugacucugacucuccu

SEQ ID NO: 77530 - RNA, 64 nt, hsa
ggaauuuuaaaaaguuggccuaaaaauguuccaugcguggcagcaaccaugcagagugacugaa

SEQ ID NO: 77531 - RNA, 64 nt, hsa
ugcgccugagcugcaugcgccaccauuuuuggcagcguggcagcuuugcaaggggcuggggccc

SEQ ID NO: 77532 - RNA, 64 nt, hsa
gagcguuggaccuucaugaacaguggccuggcuggcguggcagggccaaggcccacccacugcc

SEQ ID NO: 77533 - RNA, 64 nt, hsa
acacugcguagauuugccgcacuuggaccuccaugcguggcacucacccgcagucuccuggaca

SEQ ID NO: 77534 - RNA, 64 nt, hsa
agaauuuuuauaccaauucugaaaaagaaaauuugcguggcauuuuuaauucauaaauuauuuu

SEQ ID NO: 77535 - RNA, 64 nt, hsa
acucauacuuucccguugacacuugauccacgcagcguggcacugggacguaaguggcgcaguc

SEQ ID NO: 77536 - RNA, 64 nt, hsa
agggacagcugagauugagugucaguauugcuaagcguggcauucacaauacuggcacuauaaa

SEQ ID NO: 77537 - RNA, 64 nt, hsa
ucucggauaguugcuauuuuuguaaaguuuccgugcguggcacucgcuguaugaaaggagagag

SEQ ID NO: 77538 - RNA, 64 nt, hsa
acaaccuuugggaacuaaacaguuuucagagauggcguggcacugcauccuugguucuugcuuu

SEQ ID NO: 77539 - RNA, 64 nt, hsa
agaccacuccucaccccagcucaagccauggcaggcguggcaagcaaaguggggaggagacagu

SEQ ID NO: 77540 - RNA, 64 nt, hsa
cucccugggucccccagaccucucuguguugugugcguggcagccuccaggaauaaacauucuu

SEQ ID NO: 77541 - RNA, 64 nt, hsa
gacguaccugggaguuugaaucaggcccauuugagcguggcagccguguugggugaagguccgg

SEQ ID NO: 77542 - RNA, 64 nt, hsa
ggcgcggguggguuuggugaaugugggugugucagcguggcagccacguggaagcagggcaugu

SEQ ID NO: 77543 - RNA, 64 nt, hsa
ugcuuacugguguuuccgacaguauuaacccagugcguggcaugucuuugaagcaaagccuguc

SEQ ID NO: 77544 - RNA, 64 nt, hsa
cagagcaagccuagauccuugaaagcaaugucaggcguggcaguggggaagccauggaggcugg

SEQ ID NO: 77545 - RNA, 64 nt, hsa
ggcaguggugcuaggaggacagaaggcuauaugggcguggcagaggcugguuaacaagggcuua

SEQ ID NO: 77546 - RNA, 64 nt, hsa
ccaagguuuggcuuucacgcgcuccauugccccggcguggcaggccauuccaagcccuuccggg

SEQ ID NO: 77547 - RNA, 64 nt, hsa
cuacaacuguugcuauguguagagggugcucagagcguggcaugagagcaaggagaccauggcu

SEQ ID NO: 77548 - RNA, 64 nt, hsa
uccuugucaccccgaaccuuguaaucgugugcuggcguggcagcccuggcuaaguuaaucccca

SEQ ID NO: 77549 - RNA, 64 nt, hsa
ucugagugucuggcugaucacaucagagaggucugcguggcaguuuggggcugucacgugacca

SEQ ID NO: 77550 - RNA, 64 nt, hsa
ccagauccaaaccgcaggcaaacgggucgugauggcguggcaacccucacuguguuggaggaug

SEQ ID NO: 77551 - RNA, 64 nt, hsa
cucuguagaggguagcuguggcuucuaggugcccgcguggcauccugugaccgaccccucccca

SEQ ID NO: 77552 - RNA, 56 nt, hsa
agggcagcuguggcuucuaggggcccgcguggcauccugugaccccuccccagugc

SEQ ID NO: 77553 - RNA, 64 nt, hsa
auguuuuucacaaaauguauuguucaggaugugagcguggcaaauuuguccguguucuguuuaa

SEQ ID NO: 77554 - RNA, 64 nt, hsa
ccacacaggagagaauauacagccugcagagagugcguggcaauccuuacucccagccgacugu

SEQ ID NO: 77555 - RNA, 64 nt, hsa
acguuugcguuuggaccugucugugcguucuccugcguggcaguccugauuuccaugcuucugg

SEQ ID NO: 77556 - RNA, 64 nt, hsa
uuuggaugugcgugugugucugcgugugccaugugcguggcacgcauaugagugugugugcgug

SEQ ID NO: 77557 - RNA, 64 nt, hsa
aaauuuaagaucaccuccucagcuagcuuagagugcguggcacgggccccccgcccccgagauc

SEQ ID NO: 77558 - RNA, 64 nt, hsa
ggccucccacuccucccagcccgggagaugcuccgcguggcaccacccuccuugcuggggguag

SEQ ID NO: 77559 - RNA, 64 nt, hsa
uugucucuaguguucagaaguuuggcugugaugugcguggcauggaaguuuuuggguguauucu

SEQ ID NO: 77560 - RNA, 64 nt, hsa
ucccaugucuacuaaaauacaaaaaauuagccaggcguggcagcaugcgccuauagucccagcc

SEQ ID NO: 77561 - RNA, 64 nt, hsa
uggcggggcccacucaggacagcugggggccggggcguggcagggcccucucugugccucuccu

SEQ ID NO: 77562 - RNA, 64 nt, hsa
gcaggguguccugggauagguuuccuaggcaggggcguggcagagcagguaggcgcccugcagc

SEQ ID NO: 77563 - RNA, 64 nt, hsa
uaccaaugccaagauaauucacucuacucagccggcguggcaaauauaaaacuuacagagcgug

SEQ ID NO: 77564 - RNA, 64 nt, hsa
uugggaagggagggagagggggcgcagcucgcaggcguggcaacuugaccuugggggaauauuu

SEQ ID NO: 77565 - RNA, 64 nt, hsa
uugugagcauuguguggaauuuuacaccuggccugcguggcagccucuuccaguugagguguuu

SEQ ID NO: 77566 - RNA, 64 nt, hsa
ucguccuuguccugaggggccccagcuugcucgggcguggcacaguggggaauccaagggucac

SEQ ID NO: 77567 - RNA, 64 nt, hsa
accagccaggccacccagccgugggaggaagggggcguggcaaggggugggcacauuggugucu

SEQ ID NO: 77568 - RNA, 64 nt, hsa
cugggguggcuaucaauauuggauggcgaggacagcguggcacuggcugcgaguguuccugaga

SEQ ID NO: 77569 - RNA, 64 nt, hsa
aacagugucccacugaccuccccaaguguuugcugcguggcagauuuccuguucuuguucgcag

SEQ ID NO: 77570 - RNA, 64 nt, hsa
gacuugaauagacacuucaccaaagagcauacacgcguggcaaacaagcacacgaaaagacguu

SEQ ID NO: 77571 - RNA, 64 nt, hsa
ggagggauuccaaaaagucucagccuccaucaaggcguggcagcucaugccgguaaucucagca

SEQ ID NO: 77572 - RNA, 64 nt, hsa
ggcagcacaguggaagugggagccugguccuuccccugcccauggagagcucuuuaagggaucc

SEQ ID NO: 77573 - RNA, 64 nt, hsa
cccaccagcccccaggugaggcuuccagcugggaccugcccagacaggcugagccugggcgugg

SEQ ID NO: 77574 - RNA, 64 nt, hsa
cccaagcccugcccgccucuccccccacgcucaaccugcccacuuguccaggccuggccucuuu

SEQ ID NO: 77575 - RNA, 64 nt, hsa
uuuggcucacucugccaugagaacaggacaccauccugcccagcccagacgggguugcuccugg

SEQ ID NO: 77576 - RNA, 64 nt, hsa
gcugcggcucuggcccacugagccaccgcgcccuccugcccacgggaggacaagcaauaacucu

SEQ ID NO: 77577 - RNA, 64 nt, hsa
ggggcuuaggaaccuucucccuucuugggucugcccugcccauacugagccugccaaagugccu

SEQ ID NO: 77578 - RNA, 64 nt, hsa
aaccagcaggugugguggcucauggcguaaugggccugcccaaugcuuugggaggccaaggcag

SEQ ID NO: 77579 - RNA, 64 nt, hsa
cuacuugugacugaaggggcacaccacugcccugccugcccacuuagccguccauggcaccagc

SEQ ID NO: 77580 - RNA, 64 nt, hsa
cacaucuaggguuguccugccccuuggcucuaucccugcccagaggugggaacuggaggagugg

SEQ ID NO: 77581 - RNA, 64 nt, hsa
gaguccacacauuauagucaugugccaccaccuuccugcccacaggccgagggacagggugagg

SEQ ID NO: 77582 - RNA, 64 nt, hsa
caaggaugugacauggcuucuccucagggcaaccccugcccaacccucauccccaucuucucag

SEQ ID NO: 77583 - RNA, 64 nt, hsa
acaaccuccugggaccacugccaccugcaagagcccugcccaggagauagaagaccuggacucc

SEQ ID NO: 77584 - RNA, 64 nt, hsa
uugagugaaaggagggugaggcugccgaugccuuccugcccagaaguggaugaugugggaguug

SEQ ID NO: 77585 - RNA, 64 nt, hsa
acacaacuguccaagcucucagccccacagggaaccugcccagagagcuuuaccuuucccaagc

SEQ ID NO: 77586 - RNA, 64 nt, hsa
cagaaccccugcccuggcagccuggaagaccgugccugcccagcccucgucaccacagggacuc

SEQ ID NO: 77587 - RNA, 64 nt, hsa
ccccaccaccccggggucucuggggaacugucaaccugcccacgggacauguacauuuccccuu

SEQ ID NO: 77588 - RNA, 64 nt, hsa
acugccauuccuuucuaaguguguuuuauggcauccugcccacaaagaacucacagucugauua

SEQ ID NO: 77589 - RNA, 64 nt, hsa
gcuucacagguugacuaguaucuguggguaccucccugcccagguuauucacucacaagccacc

SEQ ID NO: 77590 - RNA, 56 nt, hsa
augagaugacugaugugugauguugcccugcccagaaagggcccugcccuagaccc

SEQ ID NO: 77591 - RNA, 64 nt, hsa
ccuucacaacggucagcacuccucucccagccccccugcccacuguucucaauaaaaugugagu

SEQ ID NO: 77592 - RNA, 64 nt, hsa
aacgggguuggggaccgaaaggacagggaugccgccugcccaguguuucugggccucacggugc

SEQ ID NO: 77593 - RNA, 64 nt, hsa
auucauccccccggccaccucucuacccguccagccugcccagacccucucagaggaacggggu

SEQ ID NO: 77594 - RNA, 64 nt, hsa
ugaagcaaggggcaaggcugggccccuagcuuguccugcccauuccuccagguguugaucuuga

SEQ ID NO: 77595 - RNA, 64 nt, hsa
cuggucccuggcaacaggaaccugggcagcuuauccugcccacagguaagccccugggagcauc

SEQ ID NO: 77596 - RNA, 64 nt, hsa
gaucuucccuguguggucccucccuucgugugccccugcccagccucuuggcaccuccuguuua

SEQ ID NO: 77597 - RNA, 64 nt, hsa
uggaggguuucaaacaagacaaaaggcauuccucccugcccaaucccagugcagucaaggccaa

SEQ ID NO: 77598 - RNA, 64 nt, hsa
gccuauggcaccuuucccuucugaaagucugguuccugcccagugacccuuggccuugugagcc

SEQ ID NO: 77599 - RNA, 64 nt, hsa
gcauccagccccacacccucauuuauaccaauuaccugcccaguaacuguggacuuuugcuucc

SEQ ID NO: 77600 - RNA, 64 nt, hsa
ugggccuuuccuaugggcaaggcccagugcucuuccugcccaccagggaccauggagcaguggc

SEQ ID NO: 77601 - RNA, 64 nt, hsa
gacaccagacugcaauaacuggaggcgccuccuuccugcccacccuucgcucacgccccagcgc

SEQ ID NO: 77602 - RNA, 64 nt, hsa
uaggacccugccaggucccgcgcaccaucccugcccugcccacgugguauugcugggcuccugg

SEQ ID NO: 77603 - RNA, 64 nt, hsa
cuguuccugaucagcccguaucaucugaggccugccugcccacccugccacccuccccucccuu

SEQ ID NO: 77604 - RNA, 64 nt, hsa
aagguagaugccaacuggagggccagaccuguguccugcccauguccuccuugguggacguuuc

SEQ ID NO: 77605 - RNA, 64 nt, hsa
acguuucuguuuacucagagcugcuagagaccauccugcccauccgaguucugagauugggacu

SEQ ID NO: 77606 - RNA, 64 nt, hsa
gucucugcuaugauggugguauccgaggccuuucccugcccagucuggugccugccccacauug

SEQ ID NO: 77607 - RNA, 64 nt, hsa
ccauggggauccaagaccugagauaaagcaacagccugcccagaucccucuguucauccuaucc

SEQ ID NO: 77608 - RNA, 64 nt, hsa
gacaccugccauugccuccucuccauugcagacgccugcccaucaaguauuaccugcggcgacu

SEQ ID NO: 77609 - RNA, 64 nt, hsa
ugcuggcucaacuucaccaagaugcauucucauaccugcccacagcuccauuuuggaggcaggc

SEQ ID NO: 77610 - RNA, 64 nt, hsa
ccuucuuccucaccucucagccuccagaucccuuccugcccaucccuucccuacaaugcccacu

SEQ ID NO: 77611 - RNA, 64 nt, hsa
ugaaugugaguggcaaguggcuuaucuggagccaccugcccaagucuuacuaaaaugcagcugu

SEQ ID NO: 77612 - RNA, 64 nt, hsa
uuggugaaagaaagcacauccaaagcauaguuuaccugcccacgaguucuggaaagguggccuu

SEQ ID NO: 77613 - RNA, 64 nt, hsa
acgaacuuuaggaacacaguuggaggucaccucuccugcccagcucccgcacccugcguuuagg

SEQ ID NO: 77614 - RNA, 64 nt, hsa
caaacaguaguacaagcuccccucagccagccugccugcccagcgaggcccccagguucaaggu

SEQ ID NO: 77615 - RNA, 64 nt, hsa
gugccaccugguacagguagguggcgcucacguuccugcccaaaugcagcccaucggggaguca

SEQ ID NO: 77616 - RNA, 64 nt, hsa
gaucuaauaccauccugcccauuguccuuaccguccugcccauacagacuguggcuccuuccuc

SEQ ID NO: 77617 - RNA, 64 nt, hsa
ggaaggagauggcauagagaagaucuaauaccauccugcccauuguccuuaccguccugcccau

SEQ ID NO: 77618 - RNA, 64 nt, hsa
cuuccugcaugggagagcugucccuccuucuccaccugcccaccgggacacucccccugcucuc

SEQ ID NO: 77619 - RNA, 64 nt, hsa
ucuuugccucguccaggucucuaucucccaaagaccugcccaccuccugggcucucccagggaa

SEQ ID NO: 77620 - RNA, 64 nt, hsa
cgcacgcacacaagacgggagucacccugugcuuccugcccaagauacugacccauugaacccc

SEQ ID NO: 77621 - RNA, 64 nt, hsa
gcagccucucuggccauugcagagcugcuggccuccugcccagguggaggguccuggggacggc

SEQ ID NO: 77622 - RNA, 64 nt, hsa
caugagccccaaggcuggggccacagcuccuaccccugcccagcagcccugagcucagcugcag

SEQ ID NO: 77623 - RNA, 64 nt, hsa
ccagcccgaguagagggcaucccggagcccccagccugcccacuacauccagccuguggcuuug

SEQ ID NO: 77624 - RNA, 64 nt, hsa
aacccugagaggccuaauagggcagagauggaggccugcccagacuaggaggcagcggggauag

SEQ ID NO: 77625 - RNA, 64 nt, hsa
uccacccaccuccgcauccacccccguccgccauccugcccaccaccaggucgguucccgaggc

SEQ ID NO: 77626 - RNA, 64 nt, hsa
caaaaagggcuucgggggagugguuacccugcucccugcccagugacaagcccuccuuuccccu

SEQ ID NO: 77627 - RNA, 64 nt, hsa
uccuuuccccugggggcccuccuuuccccugcucccugcccagcuacggggcccuccuuucagc

SEQ ID NO: 77628 - RNA, 64 nt, hsa
cucuuuguccuggugcccaggagcccuccagcccccugcccacagaagggaaggccugcagagg

SEQ ID NO: 77629 - RNA, 64 nt, hsa
cagaagcagugaagguucuucucugugugggugcccugcccacccccuccuuugccuguguccu

SEQ ID NO: 77630 - RNA, 64 nt, hsa
ggggaagugagggaaaaacguuaggugcuaaccaccugcccagaagaguggaucucacagccca

SEQ ID NO: 77631 - RNA, 64 nt, hsa
aggccaggaacccaagccaccccggcuccccucgccugcccaggggccguggugacucacgggc

SEQ ID NO: 77632 - RNA, 64 nt, hsa
ugcuggcugucccuguggacccgccauccaccguccugcccacgccgccucagccugccaccuc

SEQ ID NO: 77633 - RNA, 64 nt, hsa
cugcacuggguucucuccuucuucuuccugcuguccugcccaagaacugagggucuccccggcc

SEQ ID NO: 77634 - RNA, 64 nt, hsa
cccucugcccugccagagacagacccaugcgcugccugcccaccgugccccuuuguccccaugu

SEQ ID NO: 77635 - RNA, 64 nt, hsa
cccucaaugucuaccucugaagccuccuucccugccugcccaccccuccaugcuccacgcaggc

SEQ ID NO: 77636 - RNA, 64 nt, hsa
gcccugagacuauuugcugugggcucuccuccagccugcccagggcccacccagaugccucugg

SEQ ID NO: 77637 - RNA, 64 nt, hsa
cuuuccgggcacaagaaaccagaguccugcccagccugcccauccccuucccagucagggcucc

SEQ ID NO: 77638 - RNA, 64 nt, hsa
aacuguagucuuuccgggcacaagaaaccagaguccugcccagccugcccauccccuucccagu

SEQ ID NO: 77639 - RNA, 64 nt, hsa
guggcagcuguggcauccacuguggcaucuccguccugcccaccuucuuaagaggcgagaugga

SEQ ID NO: 77640 - RNA, 64 nt, hsa
gucucaauuuaaaaugauccauggccacagggcuccugcccaggggcuugucaccuuccccucc

SEQ ID NO: 77641 - RNA, 64 nt, hsa
cuccccauaccgggccucuggcccagaccuaagcccugcccacaaagacuaauggaugccagug

SEQ ID NO: 77642 - RNA, 64 nt, hsa
agggcaaguacagccacuguaaauaacccucgucccugcccaggaacccagacuggacuucagu

SEQ ID NO: 77643 - RNA, 64 nt, hsa
caccuuugccuccugaggcgcagcgcacuccuccccugcccaagccuacugccucccgcugccg

SEQ ID NO: 77644 - RNA, 64 nt, hsa
ggggcggcgcugcucagcuugggcugguccagggccugcccaggcuggggcaccuuugccuccu

SEQ ID NO: 77645 - RNA, 64 nt, hsa
gggccagcugccccauucuuuuaacguuguagggccugcccauggagcggacccuccucuuugg

SEQ ID NO: 77646 - RNA, 64 nt, hsa
cugcuuuuuaggccucacucccaucagaacccugccugcccaccugcaacucccccccaacaau

SEQ ID NO: 77647 - RNA, 64 nt, hsa
agcccugccgggcacaugcccgggggacgccugcccugcccagguggccuccuggcccgcccuc

SEQ ID NO: 77648 - RNA, 64 nt, hsa
cagacggccggccggaccucugagcacauaguguccugcccacccuaccagcuccuccagcccu

SEQ ID NO: 77649 - RNA, 64 nt, hsa
cugcuguugcacgggagaacuuuccucacccgccccugcccagacagggugaggaaagggcucc

SEQ ID NO: 77650 - RNA, 64 nt, hsa
uccuaaucaaguaucugagccagaugcugcgggaccugcccagcugcccgugugccuacccacu

SEQ ID NO: 77651 - RNA, 64 nt, hsa
uucuugggaaguagagauguggcggcuuucccacccugcccacagcaggcccuccugcccagcu

SEQ ID NO: 77652 - RNA, 64 nt, hsa
uggcggcuuucccacccugcccacagcaggcccuccugcccagcugcucuugucagcccucugg

SEQ ID NO: 77653 - RNA, 64 nt, hsa
ccaaugcccagagugaccaagcagcaccagcaggccugcccaggaugcugaaagcagauuucuu

SEQ ID NO: 77654 - RNA, 64 nt, hsa
auccuugccccacuggugagaggaggaccuugugccugcccagagccugcaggacagcacgccu

SEQ ID NO: 77655 - RNA, 64 nt, hsa
cagaugcugcuugcucagaaacaacccgugcaucccugcccauggauucugcaggaccuagaag

SEQ ID NO: 77656 - RNA, 64 nt, hsa
ucucccugccugggggcuaugugcacuccagaccccugcccaggcucaggcccaugagguaugg

SEQ ID NO: 77657 - RNA, 64 nt, hsa
uggggcagaggccaggaggggaccuggugugucaccugcccaccaccuggcucaucccucaggc

SEQ ID NO: 77658 - RNA, 64 nt, hsa
gccucuauccugucuguccccaccccagcuguccccugcccagggagcuggcauaaaagcacga

SEQ ID NO: 77659 - RNA, 64 nt, hsa
ggcagcugcuugagaacagagacugcuaccccauccugcccaugcaggcaggcucuugccagcc

SEQ ID NO: 77660 - RNA, 64 nt, hsa
ccgcagagggcagacgccacccuggacugcucucccugcccagcugggccucucuggccuauuc

SEQ ID NO: 77661 - RNA, 63 nt, hsa
acgccuguccccgggacugagcugccaugccagccugcccacagcagccuccuagaguuagca

SEQ ID NO: 77662 - RNA, 64 nt, hsa
agagaguagugacacucaggauccaaaagcuagcccugcccaccccagccccuggaccugcuua

SEQ ID NO: 77663 - RNA, 64 nt, hsa
cucggagcucgccugcccugcuuggcucugaggaccugcccagcgcucaaagggaacggaagcc

SEQ ID NO: 77664 - RNA, 64 nt, hsa
gccuacuugcccuagcaugaggcucugagagccaccugcccaccaaucuggugaggauaauggu

SEQ ID NO: 77665 - RNA, 64 nt, hsa
cccacccuccauuccggaccccaugggcccagccccugcccaucuaguugguuuggggacccug

SEQ ID NO: 77666 - RNA, 64 nt, hsa
cugacacccugugacugagccuguguccugucugccugcccagccaugcuccaucggcugugag

SEQ ID NO: 77667 - RNA, 64 nt, hsa
augguggcagccgccaggcgagcaggcugcuuucccugcccagucaugcaccucccccucuggg

SEQ ID NO: 77668 - RNA, 64 nt, hsa
ugugcuggcaaucagggccgcaguguguucugcgccugcccagagcugacuccugauuuaaccg

SEQ ID NO: 77669 - RNA, 64 nt, hsa
uaggguggauccuugccaggcgucccugauccucccugcccaagucuuccuucgugagcuggcc

SEQ ID NO: 77670 - RNA, 64 nt, hsa
gggugcacagccucccucccuccagcaagcccucccugcccagaaggaauggguccaggugugg

SEQ ID NO: 77671 - RNA, 64 nt, hsa
cgagaagcccacaagaucugagugaaaaaagucaccugcccaauaaagcuugacaagacacucg

SEQ ID NO: 77672 - RNA, 64 nt, hsa
cucaagcccccagcuggaaguuaagagaaagucaccugcccaagaaacaccgagugaggccaua

SEQ ID NO: 77673 - RNA, 64 nt, hsa
gcaccugcagacgcagggggacugcacaauuccaccugcccaggaccugacccuggcgugugcu

SEQ ID NO: 77674 - RNA, 64 nt, hsa
ggaaggauggcucuggccucgguccucccccaacccugcccaagccagacagacagcaccugca

SEQ ID NO: 77675 - RNA, 64 nt, hsa
uuucuaucagacgugcucccucccauccuccagcccugcccacccucccuccacuccucucaac

SEQ ID NO: 77676 - RNA, 64 nt, hsa
ggaagacccugaccguguacauagcccuggugcuccugcccagccaccccucagaugcguucgc

SEQ ID NO: 77677 - RNA, 64 nt, hsa
ucaccugccccucuguucucuccccucacauccuccugcccagcuccucacauacccacacauu

SEQ ID NO: 77678 - RNA, 64 nt, hsa
ccgcgcguuccuucgcacacugugauuuugcccuccugcccacgcagaccugcagcgggcaaag

SEQ ID NO: 77679 - RNA, 64 nt, hsa
ucgggguuggcuucuucccaggccuugcaugggcccugcccacaagcacacccucaggccgagg

SEQ ID NO: 77680 - RNA, 64 nt, hsa
uuuccagugggguuugaagcagaguucagggaacccugcccaagguccuccuguucagacauuc

SEQ ID NO: 77681 - RNA, 64 nt, hsa
acaggacugggccgggcccagggccucuggcuucccugcccaauccucccuggagaagggacau

SEQ ID NO: 77682 - RNA, 64 nt, hsa
caggaccacuagcuaagcaagccaggagaagaccccugcccaaguggcucuugggacaacgugc

SEQ ID NO: 77683 - RNA, 64 nt, hsa
acuccagguguggaccggccgcagcccccacugaccugcccauguccagagggacuggacagcc

SEQ ID NO: 77684 - RNA, 57 nt, hsa
cagaagccccggagauguagacgccacccugcccacccccgggauccugcccccaag

SEQ ID NO: 77685 - RNA, 64 nt, hsa
cuggucagaguggcgugagcugcccggcgccugcccugcccaagugaccagggaagugugugug

SEQ ID NO: 77686 - RNA, 64 nt, hsa
augaguggccagcgccagggcccaggccauguggccugcccagccucaaugucacuugguggcg

SEQ ID NO: 77687 - RNA, 64 nt, hsa
accuugucuuucugucuguuuaccugucucccugccugcccaucugcaucuuuugcagcccacu

SEQ ID NO: 77688 - RNA, 64 nt, hsa
ggacaccccgaagcccaccugcaaucucccaccuccugcccaucccucucuugagggagcagca

SEQ ID NO: 77689 - RNA, 64 nt, hsa
gagcagaggccugaagcggaagcaccacaucgucccugcccaucucacucucucccuugaugau

SEQ ID NO: 77690 - RNA, 64 nt, hsa
agcugccacaggcauaugguggagagggggguacccugcccaccuuggggugguggcaccagag

SEQ ID NO: 77691 - RNA, 64 nt, hsa
cggcugggaaggucucugaucacacagaagcagcccugcccagccuggucauuugcuguccgcu

SEQ ID NO: 77692 - RNA, 64 nt, hsa
acaagcagggaagugaaaggucccaggcacacacccugcccauugcagguggcucuuacagcuc

SEQ ID NO: 77693 - RNA, 64 nt, hsa
gcaccauaauccagugggggugacugggugcacaccugcccaggugaacacagcggcugccagu

SEQ ID NO: 77694 - RNA, 64 nt, hsa
ucugcauugguuauaauaacaguuaucaguaauuccugcccagaagacuuuuauuuauuuuuuu

SEQ ID NO: 77695 - RNA, 64 nt, hsa
cucaacaucuggagauacaggcccaccccucaguccugcccacagagaggcuuggucggucucc

SEQ ID NO: 77696 - RNA, 64 nt, hsa
cacgaggcccugcugaaguccagacccucccccuccugcccacugugcucuaaacccugcucag

SEQ ID NO: 77697 - RNA, 64 nt, hsa
uggggcugcauucccuggagacucacugcaaguuccugcccaggaggcugagggcaccccaucc

SEQ ID NO: 77698 - RNA, 64 nt, hsa
aguagucguacacggagacuggcagcgccgacguccugcccaccacgcacucccggagagcacg

SEQ ID NO: 77699 - RNA, 64 nt, hsa
accggaagcagcacgugugagcugggccaggagcccugcccaccuccgugcagcugaccugccc

SEQ ID NO: 77700 - RNA, 64 nt, hsa
gcacaugcugauacacacuguuguuaggccugcaccugcccauccagaaagcagcagcugccuu

SEQ ID NO: 77701 - RNA, 64 nt, hsa
ccugcuccggcucacacacgcccugccugcccucccugcccagcuguaaggaccgggggucucc

SEQ ID NO: 77702 - RNA, 64 nt, hsa
gcagauaaacagacccccuucugcuccgcuuccuccugcccagccaggcaacacccucaaccgg

SEQ ID NO: 77703 - RNA, 63 nt, hsa
uuccaaaugcugagcccugauccaaaguugucuccugcccaugagcaccacagucaggccuug

SEQ ID NO: 77704 - RNA, 64 nt, hsa
uugcuuagcccacaauucuccauuucacuugaccccugcccaccucuccaaccuaacuggcuua

SEQ ID NO: 77705 - RNA, 64 nt, hsa
gggacacacccugauagcacaaucuccuuggggcccugcccaccuccaggccucucccaccuca

SEQ ID NO: 77706 - RNA, 64 nt, hsa
ggaaaccgaggccaccgccccccccuccgcugccccugcccaccccgaggcagggcuggggcuu

SEQ ID NO: 77707 - RNA, 64 nt, hsa
ccacaccaguccucccagggaguccucgagucgcccugcccagagcccuggcaccagagacgcc

SEQ ID NO: 77708 - RNA, 64 nt, hsa
agacacaaacaaaccaaccagagggagaagagccccugcccacugcacucuuugguucucugcu

SEQ ID NO: 77709 - RNA, 64 nt, hsa
cacucgcuuguugaagaugaauucuugaauucugccugcccacccccggccagaucccuggagc

SEQ ID NO: 77710 - RNA, 64 nt, hsa
cauuugcugcaggcauggcugucuccugccccugccugcccaucuggccuauaccccagccgug

SEQ ID NO: 77711 - RNA, 64 nt, hsa
gcagccuucugugaccccgcugugguaaguccagccugcccagggcugcugagggcugccucuu

SEQ ID NO: 77712 - RNA, 64 nt, hsa
uuucuggcucaggcuguaaaaguagcugagccauccugcccauuccuggagguccuacagguga

SEQ ID NO: 77713 - RNA, 64 nt, hsa
ucaguauagacguauccaaugggaaaacagcggaccugcccagagcagggaggugucguggaac

SEQ ID NO: 77714 - RNA, 64 nt, hsa
ggugcaucgucucaacaccaccaaguuuguaggaccugcccaaguucuaguaguauucaaaacu

SEQ ID NO: 77715 - RNA, 64 nt, hsa
ugcccuugccugguuccauauggcuccuuccagcccugcccaccaagugcagcucccacuuucc

SEQ ID NO: 77716 - RNA, 64 nt, hsa
gcccugcccaccaagugcagcucccacuuuccauccugcccauacgccccucuucccccgacau

SEQ ID NO: 77717 - RNA, 64 nt, hsa
acgccagagcuucagugagguuuccgagccucucccugcccauccucaccacugaggccacgac

SEQ ID NO: 77718 - RNA, 64 nt, hsa
agguaccgcucuccaaggugugcuagcagugggcccugcccaacuucaggcagaacagggaggc

SEQ ID NO: 77719 - RNA, 64 nt, hsa
gcucggccugggagucgggcggccccggucaggcccugcccagagagcuccugguuccugaacu

SEQ ID NO: 77720 - RNA, 64 nt, hsa
ccucacccacccgaggcucugcccaccgccuggaccugcccaccccugaaagacuggccccugg

SEQ ID NO: 77721 - RNA, 64 nt, hsa
ugagagguuccuggcgcccugagguggcucagcaccugcccaggguaggccuggcaugaggggu

SEQ ID NO: 77722 - RNA, 64 nt, hsa
ggagcagauggccugccuuuggcugagagggcuaccugcccagccccucccccaacaagaucuc

SEQ ID NO: 77723 - RNA, 64 nt, hsa
ccugcccugguauguuuuucuuauagauguuagcccugcccaacagccagggcuacacuacaaa

SEQ ID NO: 77724 - RNA, 64 nt, hsa
ucgcagacagcccagagccugccgcuacccucggccugcccaccaccaagcaagcagcaagcaa

SEQ ID NO: 77725 - RNA, 64 nt, hsa
cuggguuuuguaccagucccugcucucaggccacccugcccaggacccaggcccgccucccccu

SEQ ID NO: 77726 - RNA, 64 nt, hsa
agccgggccaagcgcuggccccucagcggugagcccugcccacucuuaccgagcaaggugggug

SEQ ID NO: 77727 - RNA, 64 nt, hsa
gcaggaggacagagugcccuggggcauccaccuuccugcccaggggacguggcgcugucggugu

SEQ ID NO: 77728 - RNA, 64 nt, hsa
ggaugccccuggcccugccucacugugaccugcuccugcccacgugcagcaccugucaccuuuu

SEQ ID NO: 77729 - RNA, 64 nt, hsa
gucaggcugcucucggacuccugaucucaggugaccugcccaccucggccucccgaagugcugg

SEQ ID NO: 77730 - RNA, 64 nt, hsa
guuugcugggcauaagcuucacaggacgggagaaccugcccaugguggacugucguucuccaca

SEQ ID NO: 77731 - RNA, 64 nt, hsa
uucuucuccgagccccaggcagcggugauucagcccugcccaaccugauucugaugacugcgga

SEQ ID NO: 77732 - RNA, 64 nt, hsa
ggaggggcgccugcugagcacuuccgccccucacccugcccagccccugccaugagcucugggc

SEQ ID NO: 77733 - RNA, 64 nt, hsa
caucuguccccucucuccacacccagccccugcuccugcccaggcugcccugcccagcgccuca

SEQ ID NO: 77734 - RNA, 64 nt, hsa
cuccacacccagccccugcuccugcccaggcugcccugcccagcgccucaucagccucugccuu

SEQ ID NO: 77735 - RNA, 64 nt, hsa
ugaucuuccccaucaggcugggcucuggcagggaccugcccaggauggagaugagagaggguga

SEQ ID NO: 77736 - RNA, 50 nt, hsa
aggacaucuaccuggaguagccugcccaccgcucugucuccuggccgucu

SEQ ID NO: 77737 - RNA, 64 nt, hsa
caccccacgcacgccccgugcuguguuccugggcccugcccauggccucaauaaacucucugcu

SEQ ID NO: 77738 - RNA, 64 nt, hsa
gcugaggugcuacccggagccccauucacccccaccugcccacuugggaaucugaggcagagga

SEQ ID NO: 77739 - RNA, 64 nt, hsa
ucucauccuggccccaccagggccuugggcaaguccugcccaccauaggccucugcuaccugcc

SEQ ID NO: 77740 - RNA, 64 nt, hsa
gcacugcacuggaguugucucuuaccccacccucccugcccaucaacuguaucugauuucacua

SEQ ID NO: 77741 - RNA, 64 nt, hsa
aguggggaggagcgucucaagugaacagugggagccugcccaccuggcacugcacuggaguugu

SEQ ID NO: 77742 - RNA, 64 nt, hsa
uggggacuugaggggggucauauucccuccucagccugcccacgcacuggccuucccuccugcc

SEQ ID NO: 77743 - RNA, 64 nt, hsa
cuuacucucugccuaccugccugagccauguucaccugcccacuuguccccugcugccugccca

SEQ ID NO: 77744 - RNA, 64 nt, hsa
gagccauguucaccugcccacuuguccccugcugccugcccaaacaccccaccauuggccuguc

SEQ ID NO: 77745 - RNA, 64 nt, hsa; identical to SEQ ID NO: 75315

SEQ ID NO: 77746 - RNA, 64 nt, hsa; identical to SEQ ID NO: 75316

SEQ ID NO: 77747 - RNA, 64 nt, hsa; identical to SEQ ID NO: 75317

SEQ ID NO: 77748 - RNA, 64 nt, hsa; identical to SEQ ID NO: 75318

SEQ ID NO: 77749 - RNA, 64 nt, hsa; identical to SEQ ID NO: 75319

SEQ ID NO: 77750 - RNA, 64 nt, hsa; identical to SEQ ID NO: 75320

SEQ ID NO: 77751 - RNA, 64 nt, hsa; identical to SEQ ID NO: 75321

SEQ ID NO: 77752 - RNA, 64 nt, hsa; identical to SEQ ID NO: 75322

SEQ ID NO: 77753 - RNA, 64 nt, hsa
aaccuucacccagcacccaugccccacucugcugaggccagaggaagggaggccugaggggcag

SEQ ID NO: 77754 - RNA, 64 nt, hsa
cccucccccggggucuccaccucaggggagacuuaggccagaggugaacauucauguguaggaa

SEQ ID NO: 77755 - RNA, 64 nt, hsa
uuccagagagagucaugcuggaggagaaggaaguaggccagaaguccagggcugcacuguggug

SEQ ID NO: 77756 - RNA, 64 nt, hsa
cccuucucccacugggcucccccauccugggccaaggccagaacuuuagugcuaggggaagaug

SEQ ID NO: 77757 - RNA, 64 nt, hsa
gaucuggaccaguuucccugcugugcuguggcccaggccagagccugugggcaggcaggcaggg

SEQ ID NO: 77758 - RNA, 64 nt, hsa
ucucucaacaucacauacagcuucagcugccuggaggccagaaggaaagggcagugcaggggag

SEQ ID NO: 77759 - RNA, 64 nt, hsa
gcugacaucuaaaacuaaauaaauagaaaacaccaggccagaacuauagucauacucacacaaa

SEQ ID NO: 77760 - RNA, 64 nt, hsa
cgucaacucaucagcucuuccucaaggcaaccugaggccagacaccaagaaaccaagcguaucu

SEQ ID NO: 77761 - RNA, 64 nt, hsa
uauugcuuagcagggcauuugacuacuuuaucugaggccagaacucucacacacagcuaucaag

SEQ ID NO: 77762 - RNA, 64 nt, hsa
cagauaaaggaacuuuuauuaaagccugagacucaggccagaauuaggagggagcuuuuugaag

SEQ ID NO: 77763 - RNA, 64 nt, hsa
agugguaaacugugguuuccccaagcugcacaggaggccagaaaccacaaguaugaugacuagg

SEQ ID NO: 77764 - RNA, 64 nt, hsa
acccaguagguuuucuguuguggucccgugggagaggccagacuggauuauuccuccuuugcug

SEQ ID NO: 77765 - RNA, 64 nt, hsa
gcugguaaauauuuacauucagccagggaagaggaggccagaggucgggccagcugccccauuc

SEQ ID NO: 77766 - RNA, 64 nt, hsa
gggaugauuguaaaauuugcuccucaaaggaaucaggccagacucaauuuuggagggcaagaca

SEQ ID NO: 77767 - RNA, 64 nt, hsa
aaguuggucaacagaucuggugagggaaguccccaggccagacgcuggacuccugcaaugaggg

SEQ ID NO: 77768 - RNA, 64 nt, hsa
guacacauuuccuaucuuccuccagcuuccagcuaggccagaagggcaugcucuggaacccagc

SEQ ID NO: 77769 - RNA, 64 nt, hsa
cuuugguggccuugccccgcucugcagcacagacaggccagaugcauuuguccuuugccuagcu

SEQ ID NO: 77770 - RNA, 64 nt, hsa
agucacaggugacucagcagugacccugugugccaggccagauccaaacugagagggaaggugu

SEQ ID NO: 77771 - RNA, 64 nt, hsa
cauauggcauagaauugugagagaauguuuugaaaggccagaggguggccuuuuuccccaaaca

SEQ ID NO: 77772 - RNA, 64 nt, hsa
ccccaggguugacaaggggccguccuuuccacacaggccagaagaggucuucaggcgaaccgac

SEQ ID NO: 77773 - RNA, 64 nt, hsa
cggcgaauugaagggcuaagagucccagauagcuaggccagagcuggaagcagacaguaagggg

SEQ ID NO: 77774 - RNA, 64 nt, hsa
agaaaugaggaugucugucccugucugccugggcaggccagauuccuccccagcagccgggucu

SEQ ID NO: 77775 - RNA, 64 nt, hsa
auuuaauugugaaaggagacuuugcagauaaaugaggccagaauggcauguuuuauaauuaacu

SEQ ID NO: 77776 - RNA, 64 nt, hsa
aggcucuggugcagagcacuucaaauauguccucaggccagauacugauugcuaguagagagac

SEQ ID NO: 77777 - RNA, 64 nt, hsa
ccccgcccucccacaccugcuugggaggccagagaggccagacaagccgagagccccuucuguu

SEQ ID NO: 77778 - RNA, 64 nt, hsa
ccacacuugccccgcccucccacaccugcuugggaggccagagaggccagacaagccgagagcc

SEQ ID NO: 77779 - RNA, 64 nt, hsa
gccgcaaauaccucuucuagcccuuagaagucugaggccagacugacugagggggccugaagcu

SEQ ID NO: 77780 - RNA, 64 nt, hsa
auggggaagcaaccccagagcaggcagacaucagaggccagagugccuagcccgacaugaagcu

SEQ ID NO: 77781 - RNA, 64 nt, hsa
uguuuguugcacuaaaaugaggauccagggcagcaggccagagaaagcaaaggugcacuccaga

SEQ ID NO: 77782 - RNA, 64 nt, hsa
uggagugggaagggagcauugcagccuaagaagaaggccagagagggaaaaggcaggugcuuuu

SEQ ID NO: 77783 - RNA, 64 nt, hsa
uggagggaagaccugaaagagaggacugguucugaggccagaaaggugugaggagagaggagga

SEQ ID NO: 77784 - RNA, 64 nt, hsa
ugagccaagacuacgccacugcacuccagccuggaggccagagugagacuccgucucaaaacaa

SEQ ID NO: 77785 - RNA, 64 nt, hsa
ggcaugugccuguaaucccagcuucuggaggcugaggccagagaaucgcuugaaccugggaggu

SEQ ID NO: 77786 - RNA, 62 nt, hsa
uacugaaaccaaaauauauuugcuucaucugccccuacuaaccaucccccugccugcugccu

SEQ ID NO: 77787 - RNA, 62 nt, hsa
ugcccugcgugcugguuccuucagaccccuaacccuacuaaccagcaggcucaucucaccuc

SEQ ID NO: 77788 - RNA, 64 nt, hsa; identical to SEQ ID NO: 77753

SEQ ID NO: 77789 - RNA, 64 nt, hsa; identical to SEQ ID NO: 77754

SEQ ID NO: 77790 - RNA, 64 nt, hsa; identical to SEQ ID NO: 77755

SEQ ID NO: 77791 - RNA, 64 nt, hsa; identical to SEQ ID NO: 77756

SEQ ID NO: 77792 - RNA, 64 nt, hsa; identical to SEQ ID NO: 77757

SEQ ID NO: 77793 - RNA, 64 nt, hsa; identical to SEQ ID NO: 77758

SEQ ID NO: 77794 - RNA, 64 nt, hsa; identical to SEQ ID NO: 77759

SEQ ID NO: 77795 - RNA, 64 nt, hsa; identical to SEQ ID NO: 77760

SEQ ID NO: 77796 - RNA, 64 nt, hsa; identical to SEQ ID NO: 77761

SEQ ID NO: 77797 - RNA, 64 nt, hsa; identical to SEQ ID NO: 77762

SEQ ID NO: 77798 - RNA, 64 nt, hsa; identical to SEQ ID NO: 77763

SEQ ID NO: 77799 - RNA, 64 nt, hsa; identical to SEQ ID NO: 77764

SEQ ID NO: 77800 - RNA, 64 nt, hsa; identical to SEQ ID NO: 77765

SEQ ID NO: 77801 - RNA, 64 nt, hsa; identical to SEQ ID NO: 77766

SEQ ID NO: 77802 - RNA, 64 nt, hsa; identical to SEQ ID NO: 77767

SEQ ID NO: 77803 - RNA, 64 nt, hsa; identical to SEQ ID NO: 77768

SEQ ID NO: 77804 - RNA, 64 nt, hsa; identical to SEQ ID NO: 77769

SEQ ID NO: 77805 - RNA, 64 nt, hsa; identical to SEQ ID NO: 77770

SEQ ID NO: 77806 - RNA, 64 nt, hsa; identical to SEQ ID NO: 77771

SEQ ID NO: 77807 - RNA, 64 nt, hsa; identical to SEQ ID NO: 77772

SEQ ID NO: 77808 - RNA, 64 nt, hsa; identical to SEQ ID NO: 77773

SEQ ID NO: 77809 - RNA, 64 nt, hsa; identical to SEQ ID NO: 77774

SEQ ID NO: 77810 - RNA, 64 nt, hsa; identical to SEQ ID NO: 77775

SEQ ID NO: 77811 - RNA, 64 nt, hsa; identical to SEQ ID NO: 77776

SEQ ID NO: 77812 - RNA, 64 nt, hsa; identical to SEQ ID NO: 77777

SEQ ID NO: 77813 - RNA, 64 nt, hsa; identical to SEQ ID NO: 77778

SEQ ID NO: 77814 - RNA, 64 nt, hsa; identical to SEQ ID NO: 77779

SEQ ID NO: 77815 - RNA, 64 nt, hsa; identical to SEQ ID NO: 77780

SEQ ID NO: 77816 - RNA, 64 nt, hsa; identical to SEQ ID NO: 77781

SEQ ID NO: 77817 - RNA, 64 nt, hsa; identical to SEQ ID NO: 77782

SEQ ID NO: 77818 - RNA, 64 nt, hsa; identical to SEQ ID NO: 77783

SEQ ID NO: 77819 - RNA, 64 nt, hsa; identical to SEQ ID NO: 77784

SEQ ID NO: 77820 - RNA, 64 nt, hsa; identical to SEQ ID NO: 77785

SEQ ID NO: 77821 - RNA, 62 nt, hsa; identical to SEQ ID NO: 77786

SEQ ID NO: 77822 - RNA, 62 nt, hsa; identical to SEQ ID NO: 77787

SEQ ID NO: 77823 - RNA, 64 nt, hsa; identical to SEQ ID NO: 77753

SEQ ID NO: 77824 - RNA, 64 nt, hsa; identical to SEQ ID NO: 77754

SEQ ID NO: 77825 - RNA, 64 nt, hsa; identical to SEQ ID NO: 77755

SEQ ID NO: 77826 - RNA, 64 nt, hsa; identical to SEQ ID NO: 77756

SEQ ID NO: 77827 - RNA, 64 nt, hsa; identical to SEQ ID NO: 77757

SEQ ID NO: 77828 - RNA, 64 nt, hsa; identical to SEQ ID NO: 77758

SEQ ID NO: 77829 - RNA, 64 nt, hsa; identical to SEQ ID NO: 77759

SEQ ID NO: 77830 - RNA, 64 nt, hsa; identical to SEQ ID NO: 77760

SEQ ID NO: 77831 - RNA, 64 nt, hsa; identical to SEQ ID NO: 77761

SEQ ID NO: 77832 - RNA, 64 nt, hsa; identical to SEQ ID NO: 77762

SEQ ID NO: 77833 - RNA, 64 nt, hsa; identical to SEQ ID NO: 77763

SEQ ID NO: 77834 - RNA, 64 nt, hsa; identical to SEQ ID NO: 77764

SEQ ID NO: 77835 - RNA, 64 nt, hsa; identical to SEQ ID NO: 77765

SEQ ID NO: 77836 - RNA, 64 nt, hsa; identical to SEQ ID NO: 77766

SEQ ID NO: 77837 - RNA, 64 nt, hsa; identical to SEQ ID NO: 77767

SEQ ID NO: 77838 - RNA, 64 nt, hsa; identical to SEQ ID NO: 77768

SEQ ID NO: 77839 - RNA, 64 nt, hsa; identical to SEQ ID NO: 77769

SEQ ID NO: 77840 - RNA, 64 nt, hsa; identical to SEQ ID NO: 77770

SEQ ID NO: 77841 - RNA, 64 nt, hsa; identical to SEQ ID NO: 77771

SEQ ID NO: 77842 - RNA, 64 nt, hsa; identical to SEQ ID NO: 77772

SEQ ID NO: 77843 - RNA, 64 nt, hsa; identical to SEQ ID NO: 77773

SEQ ID NO: 77844 - RNA, 64 nt, hsa; identical to SEQ ID NO: 77774

SEQ ID NO: 77845 - RNA, 64 nt, hsa; identical to SEQ ID NO: 77775

SEQ ID NO: 77846 - RNA, 64 nt, hsa; identical to SEQ ID NO: 77776

SEQ ID NO: 77847 - RNA, 64 nt, hsa; identical to SEQ ID NO: 77777

SEQ ID NO: 77848 - RNA, 64 nt, hsa; identical to SEQ ID NO: 77778

SEQ ID NO: 77849 - RNA, 64 nt, hsa; identical to SEQ ID NO: 77779

SEQ ID NO: 77850 - RNA, 64 nt, hsa; identical to SEQ ID NO: 77780

SEQ ID NO: 77851 - RNA, 64 nt, hsa; identical to SEQ ID NO: 77781

SEQ ID NO: 77852 - RNA, 64 nt, hsa; identical to SEQ ID NO: 77782

SEQ ID NO: 77853 - RNA, 64 nt, hsa; identical to SEQ ID NO: 77783

SEQ ID NO: 77854 - RNA, 64 nt, hsa; identical to SEQ ID NO: 77784

SEQ ID NO: 77855 - RNA, 64 nt, hsa; identical to SEQ ID NO: 77785

SEQ ID NO: 77856 - RNA, 62 nt, hsa; identical to SEQ ID NO: 77786

SEQ ID NO: 77857 - RNA, 62 nt, hsa; identical to SEQ ID NO: 77787

SEQ ID NO: 77858 - RNA, 64 nt, hsa
cagaacuuuccagcucccccucaucaugccuccuccuuccuaccugccuccccucugcuggugc

SEQ ID NO: 77859 - RNA, 64 nt, hsa
cucucucaucuuacuuuuucuucucagauuucucccuuccuagaacauucucucuguuuagcac

SEQ ID NO: 77860 - RNA, 64 nt, hsa
uguuguugcuguuggucauuuggccugccuuuucccuuccuauuucacuuugccucccaucaca

SEQ ID NO: 77861 - RNA, 64 nt, hsa
aaauaaagucaucuaacuauuaaaaaaaaaacacccuuccuaacccuucuuuucuuaaaauucc

SEQ ID NO: 77862 - RNA, 64 nt, hsa
gucugcucugaugaaacccaauaaucucucaauaccuuccuauuucucaauagucuuuaaaccc

SEQ ID NO: 77863 - RNA, 64 nt, hsa
uaaguccgcucugaugaaacccagucucucaauaccuuccuauuucucaauagucuuuaagccc

SEQ ID NO: 77864 - RNA, 64 nt, hsa
auucuaaaauucagcuuuaaaaauauugaacauaccuuccuaccacuuacgcuucaaguuucau

SEQ ID NO: 77865 - RNA, 64 nt, hsa
aaugugugugcucuauugaugcaagacaagucauccuuccuacugucaugguuuguuauagaga

SEQ ID NO: 77866 - RNA, 64 nt, hsa
uccucccuuuccuuccuaauuucccuucuugcauccuuccuauaacuugaugcaugugguuugg

SEQ ID NO: 77867 - RNA, 62 nt, hsa
ugccccagaaugccaacuaaacuccucccuuuccuuccuaauuucccuucuugcauccuucc

SEQ ID NO: 77868 - RNA, 64 nt, hsa
caucuuugauuuuucuuuagcuucaucaguccuuccuuccuaaucucuaauccccugaagccua

SEQ ID NO: 77869 - RNA, 64 nt, hsa
gguacuuagucuguguccaugugauccaaaauuaccuuccuauugcauuuccuacuccuuugcu

SEQ ID NO: 77870 - RNA, 64 nt, hsa
auuuacucgcuuuguuuaauggauuccaccccugccuuccuaggugaccuuggacaaauucucg

SEQ ID NO: 77871 - RNA, 64 nt, hsa
auauauguccucaaaauccccauaaauauccaucccuuccuagauggcauuaacuuucauuuua

SEQ ID NO: 77872 - RNA, 64 nt, hsa
ugcccucugggcuccuuugguaacagauggagcuccuuccuagcuagggagaccuuaugagaag

SEQ ID NO: 77873 - RNA, 64 nt, hsa
cuuccuacuuuccuucauucucucuuccuucccuccuuccuacuucuuuucuuccuuccucuuc

SEQ ID NO: 77874 - RNA, 64 nt, hsa
ucuugucucuucagaguaaaugguucccuucuuuccuuccuacuuuccuucauucucucuuccu

SEQ ID NO: 77875 - RNA, 64 nt, hsa
uuguagauugagccauacucuggcugccucuuugccuuccuaggggcauuuucuuuaacuucca

SEQ ID NO: 77876 - RNA, 64 nt, hsa
cuggguaccuuguuccaggcagucaguccauuugccuuccuaguacuuagcccccucugacaau

SEQ ID NO: 77877 - RNA, 60 nt, hsa
auagccaccgucuacagauggcuuaguuaagucauccacagcccaagggcggggcuaugc

SEQ ID NO: 77878 - RNA, 60 nt, hsa
caaauuuaauuuugcagauuauuuuagucugucauccagaaaaugugucagcaugcauag

SEQ ID NO: 77879 - RNA, 60 nt, hsa
cucacggagaaggcggcgcccgucaugaacgucauccacagcaucuucagccucgugcuc

SEQ ID NO: 77880 - RNA, 60 nt, hsa
uucaagcacgagaugcagcauuucgugaaggucauccagggcuacaucgccaaccagauc

SEQ ID NO: 77881 - RNA, 64 nt, hsa; identical to SEQ ID NO: 72197

SEQ ID NO: 77882 - RNA, 64 nt, hsa; identical to SEQ ID NO: 72198

SEQ ID NO: 77883 - RNA, 64 nt, hsa; identical to SEQ ID NO: 72199

SEQ ID NO: 77884 - RNA, 64 nt, hsa; identical to SEQ ID NO: 72200

SEQ ID NO: 77885 - RNA, 64 nt, hsa; identical to SEQ ID NO: 72201

SEQ ID NO: 77886 - RNA, 64 nt, hsa; identical to SEQ ID NO: 72202

SEQ ID NO: 77887 - RNA, 64 nt, hsa
ugagauauuuugcucacuaucccuccccacuugcuucccugauaugugcucugagcuucccuga

SEQ ID NO: 77888 - RNA, 64 nt, hsa
cuccccacuugcuucccugauaugugcucugagcuucccugaaccaggaucugccuauuacugc

SEQ ID NO: 77889 - RNA, 64 nt, hsa
uagucuccagcccagcuuuuccccaaccaguggguucccugaguccagagccuaugccccuaga

SEQ ID NO: 77890 - RNA, 64 nt, hsa
ccuggggcggcccaccccugccaagcuugccaacuucccugagguggaugucuuugugcuauua

SEQ ID NO: 77891 - RNA, 64 nt, hsa
guuguuuggcugauggaauaaagggcuuagggacuucccugaggccucuggacccaucugucuu

SEQ ID NO: 77892 - RNA, 64 nt, hsa
aaagccugaaccaugccugccaugucuugucuuauucccugaggcucccuugacucaggacugu

SEQ ID NO: 77893 - RNA, 64 nt, hsa
gcagacugccuucuuucacccuguccugauagacuucccugaucuagauauccuucgucaugac

SEQ ID NO: 77894 - RNA, 64 nt, hsa
cgcaugcccucagccacaagcgggugacugacuguucccugaugauuuggcccaccuccugugu

SEQ ID NO: 77895 - RNA, 64 nt, hsa
aggaagggauucggcuuucaacuuugcuaccaucuucccugaagcaggaaaaugaacauggacu

SEQ ID NO: 77896 - RNA, 64 nt, hsa
ccagcagguguagggccugacaagaacauauuguuucccugaccccuaggccgucacaccacac

SEQ ID NO: 77897 - RNA, 64 nt, hsa
auuugaaucuguuuucuuaguuucaaaugaccauuucccugaugcucugagcuuaugaucacac

SEQ ID NO: 77898 - RNA, 64 nt, hsa
ucauuugggugggguuuccccaggcauaccuuaguucccugauccucugcaaagaguagcucau

SEQ ID NO: 77899 - RNA, 64 nt, hsa
gccccucaccccugugugcuagugucugggaaguuucccugaaaggugggaggcgggugggugg

SEQ ID NO: 77900 - RNA, 64 nt, hsa
gggaagcagcuuccugggagauuagaaauucuacuucccugacuggagcuaaaucccaccagcc

SEQ ID NO: 77901 - RNA, 64 nt, hsa
gcagcaagcaaaaguugucuguggugccauuugauucccugacacugcccccugcuugaauuga

SEQ ID NO: 77902 - RNA, 64 nt, hsa
aaggcagccagaccucuuuuucagaaguuguugguucccugauuuuugucuugagcaggcacca

SEQ ID NO: 77903 - RNA, 64 nt, hsa
cccccagaggaacugcucccaccucuccuucucuuucccugaaaagccuugaaggggguugagg

SEQ ID NO: 77904 - RNA, 64 nt, hsa
uaaaagauaaauauuauauuauauauauauauauuucccugaaggaaccaaagcgaauuuuaaa

SEQ ID NO: 77905 - RNA, 64 nt, hsa
acucaggcccaaagccucgacacagaguggacuguucccugaggugggagauguggaaaagcca

SEQ ID NO: 77906 - RNA, 64 nt, hsa
uguccaucuuuagcgcaugggcugagaacaccucuucccugaggcuucugaagguugcugucug

SEQ ID NO: 77907 - RNA, 64 nt, hsa
aucuacaagcuucaguaacuaaagaaaaaggaacuucccugaguggcuugaauguguuugccca

SEQ ID NO: 77908 - RNA, 64 nt, hsa
gaaaucgaggaggcgagacuagaacugcaccagcuucccugaugucugcagccauggcuuugca

SEQ ID NO: 77909 - RNA, 64 nt, hsa
ccaacuauugccugggaucuugcgaaaagcgagguucccugaucccugggagccucacguauuu

SEQ ID NO: 77910 - RNA, 64 nt, hsa
caucugcugguagcaggcugggacagucccuuccuucccugaaacccugcucuauugcaauucc

SEQ ID NO: 77911 - RNA, 64 nt, hsa
ucucugacuuguccuaggccgauuucucuauggcuucccugagaaaggugaggcccaaaggaga

SEQ ID NO: 77912 - RNA, 64 nt, hsa
acagggcuucugauuacucagaaacaugccccucuucccugaauaaccaagaacauguucuaug

SEQ ID NO: 77913 - RNA, 64 nt, hsa
auaucucaggguaggaaccauguggagccacacauucccugaccacagggaagcaccuggcuca

SEQ ID NO: 77914 - RNA, 64 nt, hsa
cugccuucagccuccucacuccagaaacguguguuucccugaugcgggagguguccucgccugg

SEQ ID NO: 77915 - RNA, 64 nt, hsa
gguuucuccuguuuggugaaagcauuucuuaugguucccugagucaguucgucccacacauccu

SEQ ID NO: 77916 - RNA, 64 nt, hsa
uacuguguugauuucuuuaaugguuugacuuuuuuucccugagggugagggaugggugggaaga

SEQ ID NO: 77917 - RNA, 64 nt, hsa
gguggucuugugaguugugcagggugaagaccgcuucccugagacaggggcaguggugcugaug

SEQ ID NO: 77918 - RNA, 64 nt, hsa
ccuggaagcuguguccuugcaccugcauccguaguucccugaaaacccagagaggaaucagacu

SEQ ID NO: 77919 - RNA, 64 nt, hsa
agaucagugcuugaguuuggggaaugcggccgcauucccugagucaccaggaauguuaaaguca

SEQ ID NO: 77920 - RNA, 64 nt, hsa
cuccucuccucucugguagguuuaauuuuaugcuuucccugauuccagcuuucugcuuccugag

SEQ ID NO: 77921 - RNA, 64 nt, hsa
gguucaugaggacuuugccucuucuccugccucauucccugacuuucucuaguuagaugucagu

SEQ ID NO: 77922 - RNA, 64 nt, hsa
ccucgccuccuucagccuccuccucccucaucuguucccugaugucacauucccugugcaaucu

SEQ ID NO: 77923 - RNA, 64 nt, hsa
ccaccaugugccagguggcaucugccuuacugccuucccugaggagcugggacaugcugggcag

SEQ ID NO: 77924 - RNA, 64 nt, hsa
gcuggauuccgaaaaggccgggaagccagucuccuucccugaagcaagcccaggagaagacucu

SEQ ID NO: 77925 - RNA, 64 nt, hsa
guucacugguucggggcugacuuugagaucuuuguucccugaggugccaggcaggcaacuuuag

SEQ ID NO: 77926 - RNA, 64 nt, hsa
cacacccucaggccgagggugcagacugaugcucuucccugauggagacccugagaucuucccc

SEQ ID NO: 77927 - RNA, 64 nt, hsa
aguuaauccccaccgcuuucagugguagaaagaauucccugagugggccaggcuggugcccucc

SEQ ID NO: 77928 - RNA, 64 nt, hsa
cgagccacuuguaggcacauuagcuccgcucauguucccugagcacagauaaugucuuuuaauc

SEQ ID NO: 77929 - RNA, 64 nt, hsa
aucagggucaauuacagauagcuauaauaaagauuucccugagacgggagucaaaaucagcauc

SEQ ID NO: 77930 - RNA, 64 nt, hsa
gcuuccgucuaucaaaaagcccccuuggcccagguucccugagcugugggauucugcacuggug

SEQ ID NO: 77931 - RNA, 64 nt, hsa
ccugagcugugggauucugcacuggugcuuuggauucccugauauguuccuucaaaucugcuga

SEQ ID NO: 77932 - RNA, 64 nt, hsa
agaagaaacugugaaguauaugagccuuugaaaguucccugaaguuucucaguucaggaacauu

SEQ ID NO: 77933 - RNA, 64 nt, hsa
cccuggacaauugaggaugcccauccccuccccuuucccugaucuuuuacugaggggcugugug

SEQ ID NO: 77934 - RNA, 64 nt, hsa
agucccugcucaggugucaccuucccugagaggcuucccugaccuccugucuaaaaugucaccc

SEQ ID NO: 77935 - RNA, 64 nt, hsa
cucacuuuauucaagucccugcucaggugucaccuucccugagaggcuucccugaccuccuguc

SEQ ID NO: 77936 - RNA, 64 nt, hsa
uguuguugauacagcauaagugaaucaugggcauuucccugagagcagugggagaggcccucug

SEQ ID NO: 77937 - RNA, 64 nt, hsa
ccacacaggcucagcucucuccaccacccagcucuucccugaccuucacgaagggauggcucuc

SEQ ID NO: 77938 - RNA, 64 nt, hsa
gaaaggagccugagugauucucuuuucuucuuguuucccugauuaugaugagcuuccauuguuc

SEQ ID NO: 77939 - RNA, 64 nt, hsa
ggcucccucucccaccugucugcauagaaaggcagaauuagacauagcaugcuuuggaaaagca

SEQ ID NO: 77940 - RNA, 64 nt, hsa
gaaucuggccaacaacuuugguucauccuuuagugaauuagaggauuuggcuacccugaguaua

SEQ ID NO: 77941 - RNA, 64 nt, hsa
uaaagaauaauuuggaguaauaaguaacaagauagaauuagaaaaauguugaauuucugaauga

SEQ ID NO: 77942 - RNA, 64 nt, hsa
ggggaacaggagagaggcaaugaugagugaucaagaauuagagugcccuggaggucacucacaa

SEQ ID NO: 77943 - RNA, 64 nt, hsa
auguuauucaugcuauaaagaguaaacguuugaugaauuagaagagaugcucuuuuccaagcua

SEQ ID NO: 77944 - RNA, 64 nt, hsa
aucuguuacuguuuaauuucaauucuucuggugagaauuagaaaugaaauauuuuuuauucauu

SEQ ID NO: 77945 - RNA, 64 nt, hsa
acugcaagaacuguuuuuacccauggcauggguggaauuagaguggaauaaggauguuaacuug

SEQ ID NO: 77946 - RNA, 64 nt, hsa
gcacaugcacgccgggauuccucugcugccauuugaauuagaagaaaauaauuuauaugcaugc

SEQ ID NO: 77947 - RNA, 64 nt, hsa
aaaacuugaaaaucagcuuuggccaucuaccugagaauuagaaagucugauuuuuggaauuaga

SEQ ID NO: 77948 - RNA, 64 nt, hsa
ccaucuaccugagaauuagaaagucugauuuuuggaauuagaaaucaugauuguaggcugggca

SEQ ID NO: 77949 - RNA, 64 nt, hsa
uaagcuugugcacaauguuuaaaagaaaaacaaugaauuagaagagaucccccgucccccaguc

SEQ ID NO: 77950 - RNA, 64 nt, hsa
caggccauugggccuaagugguaaaugugauuaggaauuagaccucuccccauucugcuagcaa

SEQ ID NO: 77951 - RNA, 64 nt, hsa
uuucuuuuuugaagaagucuaauaaaucuagaaggaauuagaggauuagaaaaaucaccauuuu

SEQ ID NO: 77952 - RNA, 64 nt, hsa
ugaaugugaggucacuaguaauacagcuguugaagaauuagagggaaauaggaaaugauuuucc

SEQ ID NO: 77953 - RNA, 64 nt, hsa
uuggucuaaaauauuuguaauguauauuaaaagguucaaaaauauuuguauaaaucuaaguuau

SEQ ID NO: 77954 - RNA, 64 nt, hsa
acacaugauuuugauuaugcuacaugauauauguuucaaaaagaauuagcauagaaauccuggu

SEQ ID NO: 77955 - RNA, 64 nt, hsa
auccuggucuccuagccaaaaaaaucaaaggauuuucaaaaaaacgaaucuguauguugaggca

SEQ ID NO: 77956 - RNA, 64 nt, hsa
cuaaaccugauacgaaugcaggaguuuuaaauucuucaaaaacucagauuuaacccagaaccag

SEQ ID NO: 77957 - RNA, 64 nt, hsa
agagcucaguagaauccugggcaacuaccuaugguucaaaaaauaaagaaaugccagaauacaa

SEQ ID NO: 77958 - RNA, 64 nt, hsa
caauuauaggaguauuuauguaacuaucuuaugcuucaaaaaacaaaaguauuugugugcaugu

SEQ ID NO: 77959 - RNA, 64 nt, hsa
gugcaucauaguucuacaguuuguuuuuguuuucuucaaaaaagcuguaagagaauuaucugca

SEQ ID NO: 77960 - RNA, 64 nt, hsa
auauuuaauauuauauuacauucauugaaaucuguucaaaaacagauuaagacaaacauuuaug

SEQ ID NO: 77961 - RNA, 64 nt, hsa
auuaaguagaacugcccuugccggaauagugaucuucaaaaaacccuugcuuuuaggggaggga

SEQ ID NO: 77962 - RNA, 64 nt, hsa
guaacaaaauauuuuguagauuacauauugauuuuucaaaaauuaaaaauguauuucaaacuau

SEQ ID NO: 77963 - RNA, 64 nt, hsa
cucagacauauaguuuuuuuuuuuuuuacaaaguuucaaaaacuuaaaaaucaggagauuccuu

SEQ ID NO: 77964 - RNA, 64 nt, hsa
uccagggaccccuauccugauccccaacugaagcuucaaaaagccacuuuuccaaauggcgaca

SEQ ID NO: 77965 - RNA, 64 nt, hsa
gugagagaggaaaaaaaaguauggaggccuuauuuucaaaaaugugaaauauaaggcacguuuu

SEQ ID NO: 77966 - RNA, 64 nt, hsa
ugcuggcuuuuuugaagacuuguguaggaacacauucaaaaagccccuuucugguugugagaga

SEQ ID NO: 77967 - RNA, 64 nt, hsa
aaauguauaccuguaacugcagcaguucaccuauuucaaaaauuuggaauucuguucauuuguu

SEQ ID NO: 77968 - RNA, 64 nt, hsa
cuuuuuauuuuuuaauuauuguuuauauuuucaauucaaaaauguacaaaauaaaguuacauug

SEQ ID NO: 77969 - RNA, 64 nt, hsa
uacaaaguauuuuucccaaagauagcuuuacuauuucaaaaauugucaaauuaaugcaugcucc

SEQ ID NO: 77970 - RNA, 64 nt, hsa
aaaucacaguuuauuuaaauaauuuuaaugacuuuucaaaaacaauuuauugaugcaaaaagca

SEQ ID NO: 77971 - RNA, 61 nt, hsa
acauuuuuauuaguggauagcguuguuggaauucaaaaaacagacaauauugccauagaaa

SEQ ID NO: 77972 - RNA, 64 nt, hsa
agucuugacuaaugguucccgguuuagcugaagauucaaaaaaaaaaaaaaaagcuuuaugcua

SEQ ID NO: 77973 - RNA, 64 nt, hsa
ugcaaaggaauugcuuugcaggaaauauuuaauuuucaaaaacauaaugauuaauguuccaauu

SEQ ID NO: 77974 - RNA, 64 nt, hsa
aagaggcccuaagacugguagaaauuaaaaggauuucaaaaacuuucuauuccuuucuuaaacc

SEQ ID NO: 77975 - RNA, 64 nt, hsa
gaauuaaaaguuauucaagaaaaugaacaugcucuucaaaaagaugcacuuaguauuaaguuga

SEQ ID NO: 77976 - RNA, 64 nt, hsa
auaauucuaaaauaaaauauuggcacaaagagauuucaaaaauaucacugcauccuauagaaga

SEQ ID NO: 77977 - RNA, 64 nt, hsa
ccucugucagcaugaaaguauuccagucuuuaauuucaaaaacuucaaauuagccucaugaaga

SEQ ID NO: 77978 - RNA, 64 nt, hsa
auagcaauaauuuugcacugaaaacuuuuuauaguucaaaaauuaagcauggacuccccaguau

SEQ ID NO: 77979 - RNA, 64 nt, hsa
uacacuccagccuggcgacagagcgagacuugguuucaaaaaaaaaaaaaaaaaaaacuucagu

SEQ ID NO: 77980 - RNA, 64 nt, hsa
auucaguuuucaggaugauacacuaugaagauguuucaaaaaaucugaccaaaacaaacaaaca

SEQ ID NO: 77981 - RNA, 64 nt, hsa
uagagcagccauguggagaacaacauggacuuucuucaaaaauuacaaauagaacuaucauaug

SEQ ID NO: 77982 - RNA, 64 nt, hsa
gagauaucaucucauccuaauuaaggugacuauuuucaaaaagacaaaaaauaugacagccgug

SEQ ID NO: 77983 - RNA, 64 nt, hsa
uuuuaaguuaauugaacuuuuucuuuauuuauuuuucaaaaaaauguuuauaucacauagacau

SEQ ID NO: 77984 - RNA, 64 nt, hsa
aguuuagcaguacaagcuucuauugcuaaaacauuucaaaaaacucagagauauuacucuuuga

SEQ ID NO: 77985 - RNA, 64 nt, hsa
ugcugucuuaccucuugcuaguggguuaaauguuuucaaaaauuauagcaguaguagaaguuuu

SEQ ID NO: 77986 - RNA, 64 nt, hsa
guacuucuuuuagaccaccaguaaauaauccuccuucaaaaaauaaaaauaaaagaaaaaggaa

SEQ ID NO: 77987 - RNA, 64 nt, hsa
aauugaaaacauguaaccacaagaaguugucauuuucaaaaacuucuauauagguggaaaacaa

SEQ ID NO: 77988 - RNA, 64 nt, hsa
uuauuuugcuaaacaguuuacuaacacauuacauuucaaaaacuauuuugguaccuuucaaaua

SEQ ID NO: 77989 - RNA, 64 nt, hsa
ucugcucuugucagaacauugggacaauuggucguucaaaaacauucauccucuuacugcaagu

SEQ ID NO: 77990 - RNA, 64 nt, hsa
gaaagaaaaaaaugguguuugacguugauggaaauucaaaaauauauauggaacugaaacauua

SEQ ID NO: 77991 - RNA, 64 nt, hsa
aguguuaacaaauugcugagaucccacggagucuuucaaaaaucucuguagaguuagucuucuc

SEQ ID NO: 77992 - RNA, 64 nt, hsa
cagcauaaccuuggcuugauuaaggaauucuacuuucaaaaauuaaucugauaauaguaacaag

SEQ ID NO: 77993 - RNA, 64 nt, hsa
ucaacaaaagauugguccuuggugaaauaaacuuuucaaaaaugaauguucuuuucaaaaaaua

SEQ ID NO: 77994 - RNA, 64 nt, hsa
uggugaaauaaacuuuucaaaaaugaauguucuuuucaaaaaauaaaguagaaaaaugcacuua

SEQ ID NO: 77995 - RNA, 64 nt, hsa
ugggcaucauagcaagaccucaucucuacuaaaauucaaaaacaaaauuagccgggcaugaugg

SEQ ID NO: 77996 - RNA, 64 nt, hsa
caacucccucucugugcauuuucuaagugggacauucaaaaaacucucucccaggaccucggau

SEQ ID NO: 77997 - RNA, 64 nt, hsa
acauaacucugcugaauguaaaagaaaauuuuuuuucaaaaaugcuguuaauguauacuacugg

SEQ ID NO: 77998 - RNA, 64 nt, hsa
gauuauggccuuuuuaaguauugcagucuaaaacuucaaaaacuaaaaucauugucaaaauuaa

SEQ ID NO: 77999 - RNA, 64 nt, hsa
auacuaccaacccugaacgucucaggacaaauaauucaaaaaagagaucuacauuuucuggaaa

SEQ ID NO: 78000 - RNA, 64 nt, hsa
aauauuucugcaugcuauugcaagugguaagguuuucaaaaagcuguuuucuaguuauugcuag

SEQ ID NO: 78001 - RNA, 64 nt, hsa
cagaaaugccaaauugaugguuaauuguugcugcuucaaaaauaaguauaaaauuaauauguaa

SEQ ID NO: 78002 - RNA, 64 nt, hsa
guauuaccauuaaagucauuaguauaauauugcuuucaaaaagaaaugguagacaaaacuauaa

SEQ ID NO: 78003 - RNA, 64 nt, hsa
uuaaagaggauccaccccaggguuauuuugaggauucaaaaaggcaugcaacacaccuggagca

SEQ ID NO: 78004 - RNA, 64 nt, hsa
uuuugauucaaagaccaaacuagaacuuuaaaaguucaaaaauaagaaaguauacauuuuugcu

SEQ ID NO: 78005 - RNA, 64 nt, hsa
ccuaugugaguuucagaaauucucaaaauacguguucaaaaauuucugcuuuugcaucuuuggg

SEQ ID NO: 78006 - RNA, 64 nt, hsa
cuagugauauggcaucguugcauuuuacaguaucuucaaaaauacagaauuuauagaauaauuu

SEQ ID NO: 78007 - RNA, 64 nt, hsa
aauguauguguagauauaacuuaaauauggagcuuucaaaaagcacaaauaggcuggacauggu

SEQ ID NO: 78008 - RNA, 64 nt, hsa
gccacugcacuccagccugagugacagagagagauucaaaaaacaaaaaaaaagcaaaaauaua

SEQ ID NO: 78009 - RNA, 64 nt, hsa
uugucacaacugcaaacaauaccugaguggaguauucaaaaacuugcuuagaaagaaaacucua

SEQ ID NO: 78010 - RNA, 64 nt, hsa
auucuaaaugcacaccuccuaagguaaauagucuuucaaaaauaucaggcgugccaacucuugc

SEQ ID NO: 78011 - RNA, 64 nt, hsa
ucauuuaauacuuauuuaaaaagaagaugagagauucaaaaauaucagaaaaguuggccauggu

SEQ ID NO: 78012 - RNA, 64 nt, hsa
caaguuguuaauguuauauuaaaagagaggguccuucaaaaaaauuauuuuuuaaaacacagag

SEQ ID NO: 78013 - RNA, 64 nt, hsa
guugcaauuacuggcucucaagcuauaguuuguuuucaaaaaggaaaaacaaaauaguuuuuua

SEQ ID NO: 78014 - RNA, 64 nt, hsa
aagcugaaccagugucuuuacauuucauuuguacuucaaaaaauaugcuauuguuuagacuuuc

SEQ ID NO: 78015 - RNA, 64 nt, hsa
uaguauauuaagacaugcugauggaaacaguaucuucaaaaaaaucagcagcaauugaaaugcu

SEQ ID NO: 78016 - RNA, 64 nt, hsa
ggccaacauggugaaacccggucucuacuaaaaauucaaaaauuaccuaggcgucauggggcau

SEQ ID NO: 78017 - RNA, 64 nt, hsa
agaaagcacuuuuuuguaauguuuguuuuaaugguucaaaaaaaaucuuucuuauaaagagcau

SEQ ID NO: 78018 - RNA, 64 nt, hsa
uuugagauagaaauuuucaaaaacauaaagcuaguucaaaaaacgaguugcagagcauauaaua

SEQ ID NO: 78019 - RNA, 64 nt, hsa
uauggcucuagaucuuuucuuugagauagaaauuuucaaaaacauaaagcuaguucaaaaaacg

SEQ ID NO: 78020 - RNA, 64 nt, hsa
auacauuauuuuaaucauauauaugacuuuccuuuucaaaaauacuuuaauguacaaguguaaa

SEQ ID NO: 78021 - RNA, 64 nt, hsa
aucaaaucugcuuuucaaaguuuaucaauacccuuucaaaaauauauuuaaaaucuuugaaaga

SEQ ID NO: 78022 - RNA, 64 nt, hsa
ccaccccaccccacccuucacaccuggcugauuuuucaaaaaguuuuuuuguagaaacaggguc

SEQ ID NO: 78023 - RNA, 64 nt, hsa
aguugaauauuugucugaacauuuuauuucaaaguucaaaaaaacagaggcugcaaaauucauu

SEQ ID NO: 78024 - RNA, 64 nt, hsa
uggauuuuauuuuaaugugacuagaugucaccacuucaaaaaaucaauuuguucuuagaaccug

SEQ ID NO: 78025 - RNA, 64 nt, hsa
auguacacagaguaucuggagaauaaaacccaaauucaaaaaaaaaaaugauaauuuauuuuua

SEQ ID NO: 78026 - RNA, 64 nt, hsa
auaagcacauggguaaaaaugagggugauccuuauucaaaaauaacaucugacuacuauaaaaa

SEQ ID NO: 78027 - RNA, 64 nt, hsa
cuuccuuguaauuauacuuaagaucuucaauuucuucaaaaaaugaaggaucaaaauuuuccag

SEQ ID NO: 78028 - RNA, 64 nt, hsa
agggaacuauaaccuuaggauuccugaaaagaauuucaaaaaaaaaauaaagacacuguugcca

SEQ ID NO: 78029 - RNA, 64 nt, hsa
guguuuuacucauuuuaggcuguucagaagaugcuucaaaaauuguccuguuagaauuuccauc

SEQ ID NO: 78030 - RNA, 64 nt, hsa
cagugagcagucaaguuaauggguagccuucaguuucaaaaaaauugacagggaugcaugugag

SEQ ID NO: 78031 - RNA, 64 nt, hsa
uauaaaugaaugacaaagcuuuccccauugugucuucaaaaacgcuauuauaaauuguaauaua

SEQ ID NO: 78032 - RNA, 64 nt, hsa
gccaggcuacacacagaaaauguuuacucaaucauucaaaaaagagaaaaggagagaaaguaac

SEQ ID NO: 78033 - RNA, 64 nt, hsa
agucuuuuacuaccucuggguuagccaaacaaccuucaaaaagcauuguuauuuagguuaaaua

SEQ ID NO: 78034 - RNA, 64 nt, hsa
ugcaaccuagaauucuguuacugucaaaaacguuuucaaaaaugaaggcaaaauaaagacuguu

SEQ ID NO: 78035 - RNA, 64 nt, hsa
aacaggugcuccaggcuuugauuauagauacgacuucaaaaauaugcuaagacgcuugacuuau

SEQ ID NO: 78036 - RNA, 64 nt, hsa
gaauaaagagaagauuugaauuuucaguuucauuuucaaaaacuauuuaccaaaacaaauggag

SEQ ID NO: 78037 - RNA, 64 nt, hsa
gcuacacugauguuuuucuuuacuaaggauacuauucaaaaauuaacauuuucaucucaguaag

SEQ ID NO: 78038 - RNA, 64 nt, hsa
uuauuuuuuauuaaacaaaaugaaaaagauccuuuucaaaaaggugauccugaaaauaaaacua

SEQ ID NO: 78039 - RNA, 64 nt, hsa
ugagcuaucugaaaacuguuauuccuaaguaauguucaaaaaugauaaguaaucuggauaccuu

SEQ ID NO: 78040 - RNA, 64 nt, hsa
uaugaauauguguggcagugaagagaacaggucuuucaaaaagcauuugauuauuuuuuuuaaa

SEQ ID NO: 78041 - RNA, 64 nt, hsa
uauguuuacuauugcucuuacuugaaaacuuuuuuucaaaaaaagcacaaauuaaaguaguaaa

SEQ ID NO: 78042 - RNA, 64 nt, hsa
acugguauauucuuaguaacuuuucuaugaacucuucaaaaauggucacagaaugccuuuuaaa

SEQ ID NO: 78043 - RNA, 64 nt, hsa
acugguuguuuagagugacugaugaagugcaacuuucaaaaacauuuuugaugacaucaccagc

SEQ ID NO: 78044 - RNA, 64 nt, hsa
gacuucacaauuauaauaaauguguggaaaagucuucaaaaaaauuucacaccuugcaaaagga

SEQ ID NO: 78045 - RNA, 64 nt, hsa
uaaagaaaagcuguuaccaaucuuacugaaacuguucaaaaacauggaugcagagggacuccuc

SEQ ID NO: 78046 - RNA, 64 nt, hsa
cucugcccaaaggcuccuagaucugauaaacaacuucaaaaaaguuucaggauacaaaaucugu

SEQ ID NO: 78047 - RNA, 64 nt, hsa
aaguagauuuuucaauguuuuacagaauuacauuuucaaaaaaagguuuuuauaaugaaguugu

SEQ ID NO: 78048 - RNA, 64 nt, hsa
cccccaugaaggcagcugagcuuucagagcuggguucaaaaaaaaaaauuccagugucuguaua

SEQ ID NO: 78049 - RNA, 64 nt, hsa
auaaauuguugaguauuacaucauuuacuugagguucaaaaauaauucauuuuaaauuaaguag

SEQ ID NO: 78050 - RNA, 64 nt, hsa
uucacauuucaaauaauaacaauacuuuuuguuuuucaaaaauaaaaugcaauguuauauaaag

SEQ ID NO: 78051 - RNA, 64 nt, hsa
auguacuguauuuaaaaaaaccuucugugacacauucaaaaauuucaucugagcuggaugcagu

SEQ ID NO: 78052 - RNA, 64 nt, hsa
cagagccuauaauuuuuauuuuucaauuuguuuuuucaaaaaucucuucucggggacaacaucu

SEQ ID NO: 78053 - RNA, 64 nt, hsa
cauuaccagcaucugaauuucaaguucuuaaaauuucaaaaauuaaaauuuuucauuauuagcu

SEQ ID NO: 78054 - RNA, 54 nt, hsa
cuucuccagaaagauacuaaacuguucaaaaagauuuugugaaauugcacagau

SEQ ID NO: 78055 - RNA, 64 nt, hsa
aguuaaaacauauguuucaaaaauauaagaaaaguucaaaaacuaauuaauuugaccuugaguu

SEQ ID NO: 78056 - RNA, 64 nt, hsa
guauuuuucuuguaguguuaguuaaaacauauguuucaaaaauauaagaaaaguucaaaaacua

SEQ ID NO: 78057 - RNA, 64 nt, hsa
ugagagagcacuacuugagagagcaguugaaaguuucaaaaacuuugguucaaucugaagaaag

SEQ ID NO: 78058 - RNA, 64 nt, hsa
aaacaugcagcugccgacgaggcuuugaaaauucuucaaaaaacacagcccacuuauccaucug

SEQ ID NO: 78059 - RNA, 64 nt, hsa
cauuaauguaauuccucuggauaaagauaauauauucaaaaaauauugggaccaaaaaaugcac

SEQ ID NO: 78060 - RNA, 64 nt, hsa
ucauauuuuucaaaugaagaagcaacacauaaguuucaaaaaauauccaggguacuccuggaca

SEQ ID NO: 78061 - RNA, 64 nt, hsa
aguuguauugucaaccccagucaguaaagagaacuucaaaaaauuauccucaaguguagauuuc

SEQ ID NO: 78062 - RNA, 64 nt, hsa
cccaccaagaaaauguaaaagaccacaauuguucuucaaaaacaaacaaaacaaaacaaaacaa

SEQ ID NO: 78063 - RNA, 64 nt, hsa
ucagggaggaccccugcccuccgcugcuccucuguccugcuagccuuccuccaggaagcacacu

SEQ ID NO: 78064 - RNA, 64 nt, hsa
uuggugaccccguggcuuccugucugcuggccucuccugcuacuuaucacuucaccacgaacuc

SEQ ID NO: 78065 - RNA, 64 nt, hsa
agacagaaacuaggguuuagucaucauuugugcuuccugcuagaaacccacagccuugaauaau

SEQ ID NO: 78066 - RNA, 64 nt, hsa
ugugaucugugggacugucugggccuguuacucauccugcuaucaauuucuuauuaauuaaucu

SEQ ID NO: 78067 - RNA, 64 nt, hsa
ugcccccagaucccacugggguccauuugggggguccugcuacacuccaccgauccccaaggaa

SEQ ID NO: 78068 - RNA, 64 nt, hsa
cagaccagaccguuugccuuuucaaguuuccuaguccugcuacaagaugagcuucuuccguggu

SEQ ID NO: 78069 - RNA, 64 nt, hsa
gacucauaguuccucuuguucuuuauuaaauucauccugcuaauuagauuucuagugacuugua

SEQ ID NO: 78070 - RNA, 64 nt, hsa
gacuuacuggacuggcaccgccaggagaaaauucuccugcuaacuuuuuuucuuaagcuuucug

SEQ ID NO: 78071 - RNA, 64 nt, hsa
uaacaugcaagagagagagaagccuuguuacauuuccugcuauuuaacaaacuguccaauuagg

SEQ ID NO: 78072 - RNA, 64 nt, hsa
gcccaagcagcuuguuuugcaaaggcccaaguccuccugcuaggaaaagcuuuugcaugugucc

SEQ ID NO: 78073 - RNA, 64 nt, hsa
cuuagauguauaauccuugagaugccauuugaucagaugccaauuuguauucagagcucauaaa

SEQ ID NO: 78074 - RNA, 64 nt, hsa
gcaauauauagaggucuuagauguauaauccuugagaugccauuugaucagaugccaauuugua

SEQ ID NO: 78075 - RNA, 64 nt, hsa
gaacagaaguaauggauaacagaauggaaauaagagaugccagaacuacuuccauaacuaacuc

SEQ ID NO: 78076 - RNA, 64 nt, hsa
uagagccucuccugcuucuaacaugaaggccuuuagaugccagucugccagaaaucuggaaaca

SEQ ID NO: 78077 - RNA, 64 nt, hsa
gauaccucauuaaacuuggcuuagugaagaagagagaugccaaaggaaugaaccaacccuucac

SEQ ID NO: 78078 - RNA, 64 nt, hsa
ucagccugggagacuccugccaagcccucauuaaagaugccacccugggcugcccuggcaccua

SEQ ID NO: 78079 - RNA, 64 nt, hsa
acacagaguuugggcacacacugcccucccuccgagaugccagaaguuuuuccacagccuugga

SEQ ID NO: 78080 - RNA, 64 nt, hsa
agagggacaggccuaaucaacugaaacuccucggagaugccaucucugucucccugggugccag

SEQ ID NO: 78081 - RNA, 64 nt, hsa
cacuuauuuuuauuuucagaagacaaaagaaccaagaugccaacuggcugcgaaugcucuaucu

SEQ ID NO: 78082 - RNA, 64 nt, hsa
auguuucuuuaauaauuaauuuucaucuucuauaagaugccaugugaagaaguuguggaaaugu

SEQ ID NO: 78083 - RNA, 64 nt, hsa
gcagggcuggacucaguaauuuugaggaaauugaagaugccaucuuccccugugagugacaugu

SEQ ID NO: 78084 - RNA, 64 nt, hsa
ggaaucuguggagacgccagcccugcccaaucagagaugccaaaaauggggacaugacuucugg

SEQ ID NO: 78085 - RNA, 64 nt, hsa
acuguccugguuuuucacaccaaugaaguauuauagaugccaauccaaaaccucagaauuucag

SEQ ID NO: 78086 - RNA, 64 nt, hsa
cccaccucccaagccccaagagguguaccuuuucagaugccauuuuacaggcggaaaugcucca

SEQ ID NO: 78087 - RNA, 64 nt, hsa
ucuuacccucucuuucaauugcagaugccaaaaaagaugccaacagacacuacauuacccuaau

SEQ ID NO: 78088 - RNA, 64 nt, hsa
uuugcuucuuuuucuuacccucucuuucaauugcagaugccaaaaaagaugccaacagacacua

SEQ ID NO: 78089 - RNA, 64 nt, hsa
acuuggagcugaucuuuacugagcucgccguggcagaugccaugcucaggacguucauguggau

SEQ ID NO: 78090 - RNA, 64 nt, hsa
cauaagcuuccugaggccucccuggaagcugagcagaugccagcaccaugcuuccuguacaucc

SEQ ID NO: 78091 - RNA, 64 nt, hsa
gggugcugcgcagcaucccuagucucuacccaguagaugccacuagcccuccucucccagugac

SEQ ID NO: 78092 - RNA, 64 nt, hsa
ggauguugagcagcaucucuggccuguacccaguagaugccacccaguugugacaauuaaaagu

SEQ ID NO: 78093 - RNA, 64 nt, hsa
uuccccgcccagcuugcccaccccauaguuggugagaugccaaguuuggucugaguugugaccc

SEQ ID NO: 78094 - RNA, 64 nt, hsa
gcugcccacacucccagcugcuggaggagaggggagaugccaaggugcccugcaggaccucccu

SEQ ID NO: 78095 - RNA, 64 nt, hsa
agaccccaaggccagggccuuucccgcugcaucaagaugccaaucccuuugugggcuucaccag

SEQ ID NO: 78096 - RNA, 64 nt, hsa
accgagagaaguggcccaaggucacgcaacucugagaugccacauuucauuugaucuuguacac

SEQ ID NO: 78097 - RNA, 64 nt, hsa
uccuaagaggcugcgugcaggugcguguggggggagaugccacacugugucggggccauggugc

SEQ ID NO: 78098 - RNA, 64 nt, hsa
ccagggagcuguagcaagaggguaguccaaaggcagaugccagacaagacacagccaggaaccc

SEQ ID NO: 78099 - RNA, 64 nt, hsa
guuccuuccuuuggguuacuagaauguuggaaaaagaugccaagucugucuugacaacuggaaa

SEQ ID NO: 78100 - RNA, 64 nt, hsa
auggagaguauuucacaaaaauacuuuguaaaugagaugccaguaguguucaaaguuguauuuu

SEQ ID NO: 78101 - RNA, 64 nt, hsa
uauaugugucuuaaugcagucagauuguaaaaaacaaaaacaaagaaacuaagaaucuuacuaa

SEQ ID NO: 78102 - RNA, 62 nt, hsa
acuacaaaagaaaaauauaaaaguaaaacaaacaaaaacaaaccugaaaacugcuuggcauu

SEQ ID NO: 78103 - RNA, 64 nt, hsa
gaguaaaacuggugggucuuuaauaaaacaacaacaaaaacagcaguuugugauauagcagagg

SEQ ID NO: 78104 - RNA, 55 nt, hsa
acgcaccaagccgaaaguaaaaacacaaaaacagauaccccccuacuuaauguaa

SEQ ID NO: 78105 - RNA, 64 nt, hsa
uucccccgcauuugguggauuuuuuauuauuauucaaaaacauaacugaguuuuuuaaaagagg

SEQ ID NO: 78106 - RNA, 64 nt, hsa
ccaacuauuuaguaagcccggauagacuuauugccaaaaacaaaaaauagcuuucaaaagaaau

SEQ ID NO: 78107 - RNA, 64 nt, hsa
aaacacaaaaguaacuuguuuaucucagucuguacaaaaacaguaaggaggcagaaagccaagc

SEQ ID NO: 78108 - RNA, 64 nt, hsa
gccagcuuaaccuggucugaggugagacuaaacacaaaaacaguagauaaaucucucccuaaaa

SEQ ID NO: 78109 - RNA, 64 nt, hsa
acaaaguauuuuuuuaccuguuaugcccuguuugcaaaaacaauuuagaaaaaaacaacaaagc

SEQ ID NO: 78110 - RNA, 64 nt, hsa
agaugccaacuuuuuuccuuugggguaaaagguacaaaaacaaacuaaccacaguugaagagaa

SEQ ID NO: 78111 - RNA, 64 nt, hsa
uuuagcgaacucuagcaaaacuuguuuagcuuagcaaaaacaaacacacaaaaaacugagaacu

SEQ ID NO: 78112 - RNA, 64 nt, hsa
gggcugccagagguucugauauguaagaaaacugcaaaaacaaauauagacaaauauuuugauu

SEQ ID NO: 78113 - RNA, 64 nt, hsa
ugauacuugaaugugauuuaccccuaauuaaguacaaaaacagagucgcuuuugccuuuucaaa

SEQ ID NO: 78114 - RNA, 64 nt, hsa
uguuauaucuaaauuuaaacaguauuuauuuuuucaaaaacagcuacuuaaguuaaugguauag

SEQ ID NO: 78115 - RNA, 64 nt, hsa
uuuaaaugugccuauuucacagcucucuuggucacaaaaacaugcuauuuuuauuggaacuuca

SEQ ID NO: 78116 - RNA, 64 nt, hsa
gagaaagggaauacuaucuaaccaauaacuugaacaaaaacacuaaacuaagcauuuaauagaa

SEQ ID NO: 78117 - RNA, 64 nt, hsa
gagugagacugcaucucaaaaaaaacccaaaaaacaaaaacaaacaacaacaacaaaauuauaa

SEQ ID NO: 78118 - RNA, 64 nt, hsa
guaaaacccugucucuacugaaaaacaacaaaaacaaaaacacaaauuagucgggugugguggc

SEQ ID NO: 78119 - RNA, 64 nt, hsa
aacaugguaaaacccugucucuacugaaaaacaacaaaaacaaaaacacaaauuagucgggugu

SEQ ID NO: 78120 - RNA, 64 nt, hsa
guuucaacacaauuuuggaucagcugccuguuugcaaaaacauaauauauuucuguuaaacagu

SEQ ID NO: 78121 - RNA, 64 nt, hsa
uggugaauggggaggaaaugucacugccgaagaccaaaaacaagcuucuugguauaaaagacuc

SEQ ID NO: 78122 - RNA, 64 nt, hsa
aguuguuauuguuaucccuugaaagcgagggugacaaaaacaacaaaacaccguuauaaacaca

SEQ ID NO: 78123 - RNA, 64 nt, hsa
gauucuauauauugaaaucagaaaaccuaccaaacaaaaacaucagaagcugcugccauaauga

SEQ ID NO: 78124 - RNA, 64 nt, hsa
gaugauuaagacuuacauuuucugcacaggucugcaaaaacaaaaauuauaaacuaguccaucc

SEQ ID NO: 78125 - RNA, 64 nt, hsa
guuuuaccuguaauuaauaagaacugauacaagacaaaaacaguuccuucagauucuacggaau

SEQ ID NO: 78126 - RNA, 64 nt, hsa
uuuuguaucuuugguuuuuguguuuugcugcacacaaaaacaaaagauauaaaaauggaucaua

SEQ ID NO: 78127 - RNA, 64 nt, hsa
cuuaucacauuuaagucauugcuaauuuuauaaacaaaaacaaugguuuuacuuugcaucuccc

SEQ ID NO: 78128 - RNA, 64 nt, hsa
aguuuggguccuacuguuguuauuaaaaacagaacaaaaacaaaacacacacacacacaaaaac

SEQ ID NO: 78129 - RNA, 64 nt, hsa
uaaaaacagaacaaaaacaaaacacacacacacacaaaaacagaaacaaaaaaaaccagcauua

SEQ ID NO: 78130 - RNA, 64 nt, hsa
acaucuacaaacaaccuggcuggaaaacacacagcaaaaacaauaaaaacuauacaagcuuccc

SEQ ID NO: 78131 - RNA, 64 nt, hsa
gauggggagcgaucaguucucucggaagugaauucaaaaacagaucuuguaccaccacuuccgg

SEQ ID NO: 78132 - RNA, 64 nt, hsa
cagccugggcaacagagcgagacuccaucucaaacaaaaacaagaacaaaaacaaacauaaagu

SEQ ID NO: 78133 - RNA, 64 nt, hsa
cagagcgagacuccaucucaaacaaaaacaagaacaaaaacaaacauaaaguuggcacagaaaa

SEQ ID NO: 78134 - RNA, 64 nt, hsa
gauuucaugaagaagacacuaaaaacaauugcaacaaaaacagaaauugacaaauggggccuca

SEQ ID NO: 78135 - RNA, 64 nt, hsa
aaagaugaauaaauaaaauaaaaugacacaaggccaaaaacaaauggguuuaacugaccagagc

SEQ ID NO: 78136 - RNA, 64 nt, hsa
ucuccacaggaauaugguuccauuaggcugggagcaaaaacaauguuuuuuaagauugagaaua

SEQ ID NO: 78137 - RNA, 64 nt, hsa
uaucuccaaaaaaagaaagaaaaaauacaaaaaacaaaaacaaaaaaaaaagaggguaauguac

SEQ ID NO: 78138 - RNA, 64 nt, hsa
uaaugauuuuuauaaaccguuuucugggguguaccaaaaacauuugaauagguuuagaauagcu

SEQ ID NO: 78139 - RNA, 64 nt, hsa
acuguaucucacuuuaaacucuuuggggaaaaaacaaaaacaaaaaaaacuaaguugcuuucuu

SEQ ID NO: 78140 - RNA, 64 nt, hsa
agaguauauauguguauauauauauagauauauucaaaaacauugcaucauuuauaugaacuau

SEQ ID NO: 78141 - RNA, 64 nt, hsa
cuuucgucuucaguugaauuggugaaaacaucaacaaaaacaaaacccacugugucuuaaaaua

SEQ ID NO: 78142 - RNA, 64 nt, hsa
aggaauucaguugggcaaugauaacuuuuaugggcaaaaacauucuauuauagugaacuaauga

SEQ ID NO: 78143 - RNA, 64 nt, hsa
uguuucaaauggcacuaucuucuuuucaguacuacaaaaacagaauaauuuugaaguuuuagaa

SEQ ID NO: 78144 - RNA, 64 nt, hsa
aaaaucucauuauuucaaaaugauagacauauaccaaaaacaagucuauaaugugaguaguuac

SEQ ID NO: 78145 - RNA, 64 nt, hsa
aacauuuuuuauacauuugguuauguugauaaaccaaaaacauuugauuaauaaaauaucuauu

SEQ ID NO: 78146 - RNA, 64 nt, hsa
ugggaaaaauaaaagaaaauguaaaaaacaaaaacaaaaacaaaaaagcaacccaguccccaac

SEQ ID NO: 78147 - RNA, 64 nt, hsa
caaaaaugggaaaaauaaaagaaaauguaaaaaacaaaaacaaaaacaaaaaagcaacccaguc

SEQ ID NO: 78148 - RNA, 64 nt, hsa
uuuugaaauuuucucuuguaaaacauuuagaaaacaaaaacaaaaaaaaugugauuuguuucug

SEQ ID NO: 78149 - RNA, 64 nt, hsa
uacuggcagauuaacauacaaccuauguuuugaacaaaaacaaccagcgauacguaaucaaaau

SEQ ID NO: 78150 - RNA, 64 nt, hsa
gugcauuucggcauuugugccauacugaaagaaucaaaaacaaaucauccaaauuaaauuucaa

SEQ ID NO: 78151 - RNA, 64 nt, hsa
cugcuguauguuaguauuaugagaauaguuacagcaaaaacauaacucagucaaaugauauguu

SEQ ID NO: 78152 - RNA, 64 nt, hsa
auaggcacaggcaaagauuucaugacgaagacgccaaaaacaauugcaacagaagcaaaaauuc

SEQ ID NO: 78153 - RNA, 64 nt, hsa
caccuauaauuuuuuugaucuucgaugaaccugacaaaaacaagcaaugggcaauggauucucu

SEQ ID NO: 78154 - RNA, 64 nt, hsa
aggcuacaguaaccaaaacagcauaguacuggcacaaaaacacacguagacugauggaacagaa

SEQ ID NO: 78155 - RNA, 64 nt, hsa
auuucaaguacccuguauucuggaugcuaaaaaacaaaaacaaacaaaaaaacaaaaacaaaaa

SEQ ID NO: 78156 - RNA, 64 nt, hsa
ucuggaugcuaaaaaacaaaaacaaacaaaaaaacaaaaacaaaaaaacaaaaccagaaucagg

SEQ ID NO: 78157 - RNA, 64 nt, hsa
uguauuguacaucucggucugaacuucauccuggcaaaaacaaaguugcaggcacaacaguuua

SEQ ID NO: 78158 - RNA, 64 nt, hsa
uugauuucugcugcagaaggcagugugauuguaacaaaaacaaugcggcuucccccuuucguac

SEQ ID NO: 78159 - RNA, 64 nt, hsa
ccggcgucuucaaaaacaaauugcacugauaaaacaaaaacaaaaguauguuuuaaaugcuuug

SEQ ID NO: 78160 - RNA, 64 nt, hsa
gcucagguuaaaugaaauaguuuuccggcgucuucaaaaacaaauugcacugauaaaacaaaaa

SEQ ID NO: 78161 - RNA, 64 nt, hsa
guuugaauggaggacgccaguaaaaaaacaaaaacaaaaacaaaacaaaacauaaaauauaaac

SEQ ID NO: 78162 - RNA, 64 nt, hsa
guaaauguuugaauggaggacgccaguaaaaaaacaaaaacaaaaacaaaacaaaacauaaaau

SEQ ID NO: 78163 - RNA, 64 nt, hsa
guuacaauucauaaugcagcaguuucuccaaaaacaaaaacaaaacacacaccacacacacgcg

SEQ ID NO: 78164 - RNA, 64 nt, hsa
aaagugguuacaauucauaaugcagcaguuucuccaaaaacaaaaacaaaacacacaccacaca

SEQ ID NO: 78165 - RNA, 64 nt, hsa
cagagcaaggcucugucucaaaaaaaaacaaaaacaaaaacaaaaaagacugauaucgcaccua

SEQ ID NO: 78166 - RNA, 64 nt, hsa
gggugacagagcaaggcucugucucaaaaaaaaacaaaaacaaaaacaaaaaagacugauaucg

SEQ ID NO: 78167 - RNA, 64 nt, hsa
ugugggaagaucugaaucuggggccguuugaaagcaaaaacaaaccacugucucugcuucugaa

SEQ ID NO: 78168 - RNA, 64 nt, hsa
guaacucuuugcauuuucugucccacaagauaugcaaaaacaaugcaauaauauucauuuaaaa

SEQ ID NO: 78169 - RNA, 64 nt, hsa
ucugaaacgaaaaaagaaauuaauuaaggaauuucaaaaacaccauccagaagcuuugaauuaa

SEQ ID NO: 78170 - RNA, 64 nt, hsa
ggcaauggcaucagagcccaaugccuacaaguugcaaaaacaguaugauaauaaaacagugguc

SEQ ID NO: 78171 - RNA, 64 nt, hsa
caaccgaguucuaguucccugaggucuuuaaaaacaaaaacagaauguuguacgugaagauucu

SEQ ID NO: 78172 - RNA, 64 nt, hsa
cuucacgaugucacuacuuguuuuucugauguuccaaaaacaacguaacuugguuuucaugugu

SEQ ID NO: 78173 - RNA, 64 nt, hsa
ugaagccugguaaaauuaacaccugucugaaaaucaaaaacauggcuucccagcagcucuccug

SEQ ID NO: 78174 - RNA, 64 nt, hsa
cgcauucucuaguaguauauaucgugccugucuucaaaaacauuucccuuuuuauacucauucc

SEQ ID NO: 78175 - RNA, 64 nt, hsa
ucuauuaaaacuguuguuaaaauauuuuuuaaaacaaaaacauuauuugugcccucuuuuauau

SEQ ID NO: 78176 - RNA, 64 nt, hsa
auuugauuagcuuugagucacaauuaaggggaagcaaaaacaucuugaaaagacugcuaggaag

SEQ ID NO: 78177 - RNA, 64 nt, hsa
gccauuucauugccuuaauuuuaagaggaaaauacaaaaacagcugauuuguuuuaguaagaaa

SEQ ID NO: 78178 - RNA, 64 nt, hsa
uccucuuuccuuuccaguuaaaaaaaaacaaaaacaaaaacaaaacccuuugcuguaucacugu

SEQ ID NO: 78179 - RNA, 64 nt, hsa
cuucuuuccucuuuccuuuccaguuaaaaaaaaacaaaaacaaaaacaaaacccuuugcuguau

SEQ ID NO: 78180 - RNA, 64 nt, hsa
ccaacauggugcaaccucgucuuuacuaaaaauacaaaaacaaaaauuagccaggggugguggu

SEQ ID NO: 78181 - RNA, 64 nt, hsa
acuccagccugggagacagagcaagacuccaucucaaaaacaaaaacaaaacaaaacaacaaca

SEQ ID NO: 78182 - RNA, 64 nt, hsa
gccugggagacagagcaagacuccaucucaaaaacaaaaacaaaacaaaacaacaacaaaaaaa

SEQ ID NO: 78183 - RNA, 64 nt, hsa
auuguguuuaacuuuguauuuugauuguugagaacaaaaacaaaaaguaucaauguguaugugg

SEQ ID NO: 78184 - RNA, 64 nt, hsa
ugaucuuccauccaaguggagggaaacuuuaaaacaaaaacacccaguacuguggcucaggaua

SEQ ID NO: 78185 - RNA, 64 nt, hsa
uuugaagaaaaaaaagaaaaagagaaaaaaaucacaaaaacaaacuuuuuuuauucaaaaguaa

SEQ ID NO: 78186 - RNA, 64 nt, hsa
guuagugaauuuggaaauaaaaagaaaaaaaaaacaaaaacaaacaggcugccauaauauauuu

SEQ ID NO: 78187 - RNA, 64 nt, hsa
guuacaaguugauaucguugaaugaaaagcaaaacaaaaacaauucaggaacaacggcuaauuu

SEQ ID NO: 78188 - RNA, 64 nt, hsa
gaauauaaaagcucuuuuccccaugucgcugauucaaaaacauguauuucuuaaaagacuagau

SEQ ID NO: 78189 - RNA, 64 nt, hsa
agacuagauucuauggaucaaacagagguugaugcaaaaacaccacuguuaagguguaaaguga

SEQ ID NO: 78190 - RNA, 64 nt, hsa
aacuugggaaacugaaaguguucccauauagcuucaaaaacaaaaacaaauguguuauccgacg

SEQ ID NO: 78191 - RNA, 64 nt, hsa
ggaaacugaaaguguucccauauagcuucaaaaacaaaaacaaauguguuauccgacggauacu

SEQ ID NO: 78192 - RNA, 64 nt, hsa
guugcacuuuuaguuuuuuuaaaaaaaacaaaaacaaaaacauggcagaugcauauugugucug

SEQ ID NO: 78193 - RNA, 64 nt, hsa
gacuuuguugcacuuuuaguuuuuuuaaaaaaaacaaaaacaaaaacauggcagaugcauauug

SEQ ID NO: 78194 - RNA, 64 nt, hsa
cauuugccuaacaggaaucugaaauauaacuugccaaaaacacacaguugguguggaaugguca

SEQ ID NO: 78195 - RNA, 64 nt, hsa
cugagguuuacgagauuuggcugccuuaagaauacaaaaacagaaaugcagaauuucuggggcu

SEQ ID NO: 78196 - RNA, 64 nt, hsa
aucucuucagaccccuuugccuuuaaaaaaaaaacaaaaacaaaaacaaaaaaacccauaaugc

SEQ ID NO: 78197 - RNA, 64 nt, hsa
ucagaccccuuugccuuuaaaaaaaaaacaaaaacaaaaacaaaaaaacccauaaugcccacag

SEQ ID NO: 78198 - RNA, 64 nt, hsa
caaaugagaugggaugaaauccuaugacaguaagcaaaaacagaaccaugaaaaaugauuggac

SEQ ID NO: 78199 - RNA, 64 nt, hsa
auagauuuuaaggcuuugaaaaugguuaauuucucaaaaacaucaauguccaaacaucuaccuu

SEQ ID NO: 78200 - RNA, 64 nt, hsa
uauagcaagaccccucacuacaaaaauaaaacaucaaaaacaaaaacaauuagcugggcaugau

SEQ ID NO: 78201 - RNA, 64 nt, hsa
aagaccccucacuacaaaaauaaaacaucaaaaacaaaaacaauuagcugggcaugauggcaca

SEQ ID NO: 78202 - RNA, 64 nt, hsa
ggugaccgagggaggcucugucucaaaagcaaagcaaaaacaaaaacaaaaacaccuaaaaaac

SEQ ID NO: 78203 - RNA, 64 nt, hsa
cgagggaggcucugucucaaaagcaaagcaaaaacaaaaacaaaaacaccuaaaaaaccugcag

SEQ ID NO: 78204 - RNA, 64 nt, hsa
aggcucugucucaaaagcaaagcaaaaacaaaaacaaaaacaccuaaaaaaccugcaguuuugu

SEQ ID NO: 78205 - RNA, 64 nt, hsa
aagaaaagcuguuaccaaucuuacugaaacuguucaaaaacauggaugcagagggacuccuccc

SEQ ID NO: 78206 - RNA, 64 nt, hsa
agacuuaaugaugaacaccccaaagcaauugcaacaaaaacaaaaauugacaagugggaccuaa

SEQ ID NO: 78207 - RNA, 64 nt, hsa
augugggaaagccuucaguuaccacuguacugcucaaaaacaugagaggaaucacacugcacag

SEQ ID NO: 78208 - RNA, 64 nt, hsa
auguggaaaagcauuccgauaccaccaaucugcucaaaaacaugaaaaggcucauacuggagag

SEQ ID NO: 78209 - RNA, 64 nt, hsa
gaaaggcggggaagaaggaugaaaccuuuaaaaacaaaaacaaaaacaucaaugaguaggcauu

SEQ ID NO: 78210 - RNA, 64 nt, hsa
cggggaagaaggaugaaaccuuuaaaaacaaaaacaaaaacaucaaugaguaggcauuuuauag

SEQ ID NO: 78211 - RNA, 64 nt, hsa
ggaaguguaagaaauugaagaguucuaaggcuuucaaaaacacucagucaaaaauuuaaaaucu

SEQ ID NO: 78212 - RNA, 64 nt, hsa
aauuuaaaaucuuaaauguguaagucacccccaccaaaaacaaaagagaagaaaaagaauagaa

SEQ ID NO: 78213 - RNA, 64 nt, hsa
accugggugacagagugagauuccaucugaaaaacaaaaacaaaaacagaaaacaaacaaacaa

SEQ ID NO: 78214 - RNA, 64 nt, hsa
gugacagagugagauuccaucugaaaaacaaaaacaaaaacagaaaacaaacaaacaaaaaaca

SEQ ID NO: 78215 - RNA, 64 nt, hsa
uuuguuugcuuugaagaaaaagcaaaaacaagaacaaaaacaccaaaucauuugaaaucacugu

SEQ ID NO: 78216 - RNA, 64 nt, hsa
aagaccaaaucauuuguuugcuuugaagaaaaagcaaaaacaagaacaaaaacaccaaaucauu

SEQ ID NO: 78217 - RNA, 64 nt, hsa
auuaauuuauaauaauacaugucugaaauuugaccaaaaacaucuucuuuaugucaagguuaau

SEQ ID NO: 78218 - RNA, 64 nt, hsa
caccccaaggaagcaauauuuaauaaaacuaggucaaaaacaaaacaaaacagugacacucacu

SEQ ID NO: 78219 - RNA, 64 nt, hsa
uuuccugugagguaugacaguuugcucaaacuucagccaacaggggugucugcuucugcugcac

SEQ ID NO: 78220 - RNA, 64 nt, hsa
ccaagcauccuuuucuaaaaagugacuuaaaauaagccaacagacucucccagaccacacaacu

SEQ ID NO: 78221 - RNA, 64 nt, hsa
ggaauaaacucaaucuuuucuuucccaagcuccuagccaacacuauccuugggagaaagaaauu

SEQ ID NO: 78222 - RNA, 64 nt, hsa
cuguaaaucaagucaucucaagucuagugaagacagccaacagaaacaaaaccuagcauaggga

SEQ ID NO: 78223 - RNA, 64 nt, hsa
ugaugugaauucaaauuuuaccucuguuacuuaaagccaacaauuuuaaggcaguaguuuuacu

SEQ ID NO: 78224 - RNA, 64 nt, hsa
guugauagaaagcacaggagauaccuuaugacacagccaacauuuugugaaacaaugacuggaa

SEQ ID NO: 78225 - RNA, 64 nt, hsa
ggugggagccaacacccuucugauggaaggugggagccaacacccuucugauggaaggcgggau

SEQ ID NO: 78226 - RNA, 64 nt, hsa
ggugggagccaacacccuucugauggaaggugggagccaacacccuucugauggaaggugggag

SEQ ID NO: 78227 - RNA, 64 nt, hsa; identical to SEQ ID NO: 78226

SEQ ID NO: 78228 - RNA, 64 nt, hsa; identical to SEQ ID NO: 78226

SEQ ID NO: 78229 - RNA, 64 nt, hsa
uucccugggccagcaucuucugauggaaggugggagccaacacccuucugauggaaggugggag

SEQ ID NO: 78230 - RNA, 64 nt, hsa
auuuagaagaaagauguuuggcguagcagaguuaaaucucaaauaggcuauuaaaaaagucuac

SEQ ID NO: 78231 - RNA, 64 nt, hsa
agcaggguuucuuuucuucacucaaauuuuggcgaaucucaaaauuagauccuaagauguguuc

SEQ ID NO: 78232 - RNA, 64 nt, hsa
aaaugacaaguuuuacuagcuaaguagagaaauaaaucucaaaugcagcgcuacaauuuucauu

SEQ ID NO: 78233 - RNA, 64 nt, hsa
auggcaaaauguuugcuaccuuaguuuaaaaaacaaucucaaacaaaagacuugcuucaaggug

SEQ ID NO: 78234 - RNA, 64 nt, hsa
ugaagauucugaaaaccuaucuuuauuagaggaaaaucucaaucuucaguuuuggccuucuguc

SEQ ID NO: 78235 - RNA, 64 nt, hsa
uucuacaugcuguaacuaucaggacaugguuagcaaucucaauuucauuuuugauauucaaauu

SEQ ID NO: 78236 - RNA, 64 nt, hsa
acuggugcuuugaaaaucuuuuuuaagggagaaaaaucucaaccaaaguuaugcucauccagac

SEQ ID NO: 78237 - RNA, 64 nt, hsa
auucgcaacucauaauccguagacuacaagaugaaaucucaauaaauuauuuuugaguuuauua

SEQ ID NO: 78238 - RNA, 64 nt, hsa
ucgcuuugucacccaggcuggagugcaauggcacaaucucaacucaccgcaaccuccgccuccc

SEQ ID NO: 78239 - RNA, 64 nt, hsa
uaguauuugugauaagagcacaaaacaauuuucuaaucucaaagagcuuauauucuaguggggu

SEQ ID NO: 78240 - RNA, 64 nt, hsa
cccaacagggaugucacuugauaugagaaucucaaaucucaaugccuuauaagcauuccuuccu

SEQ ID NO: 78241 - RNA, 64 nt, hsa
gccguuucccaacagggaugucacuugauaugagaaucucaaaucucaaugccuuauaagcauu

SEQ ID NO: 78242 - RNA, 64 nt, hsa
uuuagaguuagguaguacagguaagggggaaauuguaaagaauuagcagaauuaggcauaugua

SEQ ID NO: 78243 - RNA, 64 nt, hsa
uccaacugcaguuuacaauuuuuguucuucuccuguaaagaaugucaaugguuaucaccuucaa

SEQ ID NO: 78244 - RNA, 64 nt, hsa
ggacuuggggauuacugagauuaguauguggguaguaaagaauuggagugggaguuagugggga

SEQ ID NO: 78245 - RNA, 64 nt, hsa
augcagugacugugcucgaaaggugaaaucaaugguaaagaagccuaggauuuuaugguaugag

SEQ ID NO: 78246 - RNA, 64 nt, hsa
cuuaaaauagcaugcauucucccagaagcccauaguaaagaaaaugacagaucguggucagcag

SEQ ID NO: 78247 - RNA, 64 nt, hsa
cuuucgaaguaacuguggucuuagguucggcugaguaaagaaaaaggauuuuucuucgaguuag

SEQ ID NO: 78248 - RNA, 64 nt, hsa
cuguaggcuugcaggcuacccgcccugagauuugguaaagaacacugccuuguuccccaucagu

SEQ ID NO: 78249 - RNA, 64 nt, hsa
aagaaaauucauacuugagagaaauccuacaaauguaaagaauguggcaaaccuuuggaugauc

SEQ ID NO: 78250 - RNA, 64 nt, hsa
aagagaauuuauaccagagagaaacccuacacauguaaagaauguggcaaagccuucaauaggu

SEQ ID NO: 78251 - RNA, 64 nt, hsa
guggauauagcugcuggaccauuccaucuuauauguaaagaaaucuggaauuauuauuuuaaaa

SEQ ID NO: 78252 - RNA, 64 nt, hsa
acaugugauuauaauuuuucuuagcauuuucuuuguaaagaacuacaauauaaacuaguuggug

SEQ ID NO: 78253 - RNA, 64 nt, hsa
aacccuuuuaaaaccuagauauaaaugcuuacauguaaagaaaggaagcuaagcaguggguacc

SEQ ID NO: 78254 - RNA, 64 nt, hsa
uuuuuuuuuuuuuuuaaguaacacuaaagaagcuguaaagaacauugaagguggucauuccuuc

SEQ ID NO: 78255 - RNA, 64 nt, hsa
aguaggcauguuuuucuaauaaauuuauauauuuguaaagaaaacaacagaaaucuuuaugcaa

SEQ ID NO: 78256 - RNA, 64 nt, hsa
augcagcccaguuaaauauugauuaucugugaugguaaagaacaacaguggugccagucaucaa

SEQ ID NO: 78257 - RNA, 64 nt, hsa
ccaagcuucuauaaaauuguacgugucaauaacaguaaagaauuuuaauuaauucugucauuua

SEQ ID NO: 78258 - RNA, 64 nt, hsa
gcucuggauccagaaggccuuaugcuccaagcauguaaagaaaagaucgcaggaauguggagag

SEQ ID NO: 78259 - RNA, 64 nt, hsa
caggaacaugagauuuagcagacuaaggagaucuguaaagaaugaaccauaccacaaggcauac

SEQ ID NO: 78260 - RNA, 64 nt, hsa
aaacuaauauggcagguuauaaugauccuuaaguguaaagaaaucagucaauuacaagaguaau

SEQ ID NO: 78261 - RNA, 64 nt, hsa
aaacaguggagguaaaaauauaauuucauacauuguaaagaaaagcacccuuuaaauguguaaa

SEQ ID NO: 78262 - RNA, 64 nt, hsa
aaagcacccuuuaaauguguaaagacaguguuuuguaaagaauuuuguuuaaaaaguuucuauu

SEQ ID NO: 78263 - RNA, 64 nt, hsa
gaaugugagugguaaguauaucucaguuuaaaugguaaagaagaaauguaguuuacauuuguau

SEQ ID NO: 78264 - RNA, 64 nt, hsa
cgcagaagauaagccauguuucuguauuguacauguaaagaaaaauaaaacuguuuaugauacu

SEQ ID NO: 78265 - RNA, 64 nt, hsa
gccuuagagcaaguuaagcacuuccuugguguggguaaagaauaaaggggaaagaaacuacuuu

SEQ ID NO: 78266 - RNA, 64 nt, hsa
gaucagaagccuucagauagagggugguauucugguaaagaagaaagagauaagggacgcuacc

SEQ ID NO: 78267 - RNA, 64 nt, hsa
uugggagguuaauaccaaguauucauuucaugauguaaagaaacugaacagugaaguggcuuga

SEQ ID NO: 78268 - RNA, 64 nt, hsa; identical to SEQ ID NO: 78267

SEQ ID NO: 78269 - RNA, 64 nt, hsa
uguuuaaagaguuggaggaauuggggauugaguuguaaagaaaacuuacagaagaggcaacaau

SEQ ID NO: 78270 - RNA, 64 nt, hsa
uuucauauuuaaagccaaauguaaauagaggucuguaaagaaaaauaauugccauagaaaguau

SEQ ID NO: 78271 - RNA, 64 nt, hsa
gaacgaauucauacuggagagaaacccuaugaauguaaagaauguggaaaacccuucaguuucc

SEQ ID NO: 78272 - RNA, 64 nt, hsa
ggaaggacucacacuggagauaaacccuuuaaguguaaagaauguggaaaagcauuccgauacc

SEQ ID NO: 78273 - RNA, 64 nt, hsa
uacagaaaucauaugguagagagacucugugaaaguaaagaagguagucauggcggagaagguu

SEQ ID NO: 78274 - RNA, 64 nt, hsa
gucuuucaggagguuugcucuuagaacuggugauguaaagaauggaaguagcuguaugagcagu

SEQ ID NO: 78275 - RNA, 64 nt, hsa
uuuuugucuuuguugaaguauuuaauagaguaagguaaagaagauauuaagucccuuucaaaau

SEQ ID NO: 78276 - RNA, 64 nt, hsa; identical to SEQ ID NO: 78274

SEQ ID NO: 78277 - RNA, 64 nt, hsa; identical to SEQ ID NO: 78275

SEQ ID NO: 78278 - RNA, 64 nt, hsa
uuagauaguaauugaagauauguauaaauauuacaaagaauaaaaauauauuacugucucuuua

SEQ ID NO: 78279 - RNA, 64 nt, hsa
ugcaauuaaaccgagagaugucuuguuuuuuuaaaaagaauaguauuuaauagguuucugacuu

SEQ ID NO: 78280 - RNA, 64 nt, hsa
auuucucuguaagggcaacgaacgugcuggcaucaaagaauaucaguuuacauauauaacaagu

SEQ ID NO: 78281 - RNA, 64 nt, hsa
aauguuuucuuguugcuuuaacacuggaagauuuaaagaauaaaaacuccugcauaaacgauuu

SEQ ID NO: 78282 - RNA, 64 nt, hsa
uuaauaauggaaugaacuaaaauaaacaagaacaaaagaauaguauaauuauaucaguaacaag

SEQ ID NO: 78283 - RNA, 64 nt, hsa
uuaaguuuaauuuucucugggggcaugaucucacaaagaauacucaagucuuuuucuucuuaug

SEQ ID NO: 78284 - RNA, 64 nt, hsa
gccauauuuagggaacauuuuuucugaggggccaaaagaauaaaggaccaaauuucuuagcuca

SEQ ID NO: 78285 - RNA, 64 nt, hsa
cuuagcucauaucauugcuuuaaacauagaaguaaaagaauacugcauguuguggguugauuuu

SEQ ID NO: 78286 - RNA, 64 nt, hsa
aaaccagccuuuaaaauaucauguccaggccuggaaagaauacaaauccagugcaaaauuaaac

SEQ ID NO: 78287 - RNA, 64 nt, hsa
augcaaaucucaggguguugccucuaaagaaucuaaagaauagacaugcuuugggcuuacucag

SEQ ID NO: 78288 - RNA, 64 nt, hsa
uauaccagugcucaucugacugaugaaaaagaggaaagaauaaucauuucuagauacugaggcu

SEQ ID NO: 78289 - RNA, 64 nt, hsa
ucuuaauucaacccauaaucauuaaguacuuaacaaagaauauuuuacaagugauaguauuuca

SEQ ID NO: 78290 - RNA, 64 nt, hsa
gaaacucuucuaauaaaugaaguaaaaaaauuaaaaagaauacaaauauuccagccccaaauga

SEQ ID NO: 78291 - RNA, 64 nt, hsa
uuaaguaauagauuuccagcuaaauuggucuaaaaaagaauauuaaguguggacagaccuauuu

SEQ ID NO: 78292 - RNA, 64 nt, hsa
gcuuaaaugaugcuauguaaaaugucaugaguggaaagaauauuuguaguaguaacaagaauuu

SEQ ID NO: 78293 - RNA, 64 nt, hsa
aauuuuucauuuaggaaagauuucuuagguuuugaaagaauacauuaaaauaaaaaacuugccc

SEQ ID NO: 78294 - RNA, 64 nt, hsa
agacuucaguguuaauguucacaauauacuuucgaaagaauaaaauaguucuccuacaugaaga

SEQ ID NO: 78295 - RNA, 64 nt, hsa
uuucgaaagaauaaaauaguucuccuacaugaagaaagaauaugucaggaaauaaggucacuuu

SEQ ID NO: 78296 - RNA, 64 nt, hsa
ucucccaguuuacuuuaaaaauggcuuuaaggauaaagaauaaaugugauagcugugcaugcau

SEQ ID NO: 78297 - RNA, 64 nt, hsa
agaugccacauuucucucugggaaacuaccacucaaagaauaauuguuaaaaauuaagcuuuua

SEQ ID NO: 78298 - RNA, 57 nt, hsa
cugaacauagaaauguguaauuaucagaaagaauaauggcuuucaaugaguuccuau

SEQ ID NO: 78299 - RNA, 64 nt, hsa
uauaccuauguuaaugaaacaacagaaguacaaaaaagaauaucagauacaaaaaucaaucgug

SEQ ID NO: 78300 - RNA, 64 nt, hsa
auugaaaucugcauucaugccaauucagcauaaaaaagaauaggcuacaguucucucacaccaa

SEQ ID NO: 78301 - RNA, 64 nt, hsa
ucauuuaaggauaaauaaaaaauaaaguaguaauaaagaauaaaauacuuuacuaaaauauugu

SEQ ID NO: 78302 - RNA, 64 nt, hsa
gucccagugccaugcuuccuccuuaggcccuaggaaagaauacuuccuagccucuuccuggcuu

SEQ ID NO: 78303 - RNA, 64 nt, hsa
aaauccuuaacguuuguaugggaacauuggcaagaaagaauagugugaaagggaacuguuuuag

SEQ ID NO: 78304 - RNA, 64 nt, hsa
gcuucagaaauauauacugcuuuaaaaaagaauaaaagaauauccuuuuacaaguggcuuuaca

SEQ ID NO: 78305 - RNA, 64 nt, hsa
caaagugugcuucagaaauauauacugcuuuaaaaaagaauaaaagaauauccuuuuacaagug

SEQ ID NO: 78306 - RNA, 64 nt, hsa
uaaaaaugugugcucuuuacuguuuuucauuuuuaaagaauauuauuauggaagcacgauuuau

SEQ ID NO: 78307 - RNA, 64 nt, hsa
aaaggguaagugaagguuuauucuuucagugaaaaaagaauagccaauugagugccuaaugaga

SEQ ID NO: 78308 - RNA, 64 nt, hsa
cauguggagaaaauuauucacacuacuugcauguaaagaauaauuuaacuuuuaacauuaaaau

SEQ ID NO: 78309 - RNA, 64 nt, hsa
guacuuuagagcaacuuaaugaggggaggaaaugaaagaauagaucagaaugauuuuguugaca

SEQ ID NO: 78310 - RNA, 64 nt, hsa
cauuuccuugaguaaaugagcugaaguguaaagcaaagaauagcagaagcagcuugguaggaug

SEQ ID NO: 78311 - RNA, 64 nt, hsa
agccuggaugacagagcgagacuccgccucaaaaaaagaauacaaaugcuccaacauuauuuuu

SEQ ID NO: 78312 - RNA, 64 nt, hsa
gucuuugauuaaucacaaaacuaagaauacauccaaagaauaguguuguaacuaugaaaaagaa

SEQ ID NO: 78313 - RNA, 64 nt, hsa
gaauacauccaaagaauaguguuguaacuaugaaaaagaauacuuugaaagacaaagaacuuag

SEQ ID NO: 78314 - RNA, 64 nt, hsa
ugcauguauuuaccucuucaaccaaaagggcaguaaagaauagggauaauauauuuuaauguaa

SEQ ID NO: 78315 - RNA, 64 nt, hsa
gcccuauagccacauaaauauaaauuucauagaaaaagaauaaaagcggagauauauuuuuuga

SEQ ID NO: 78316 - RNA, 64 nt, hsa
aaaauguauaaauuucuugaguaauuccuggauuaaagaauaugcacuuuuuaaagcuuuuggc

SEQ ID NO: 78317 - RNA, 64 nt, hsa
cauuacagaaacaugagaaaauagagauaaguaaaaagaauaaaagucacuauuauccuaccac

SEQ ID NO: 78318 - RNA, 64 nt, hsa
ggagaucauuuaaaucuuacagauccuuuucuugaaagaauaacagaaaaugugucauucauuu

SEQ ID NO: 78319 - RNA, 64 nt, hsa
acaacuacagcccucauuagccuuucuugugagaaaagaauaauucuaacuggucaguauucag

SEQ ID NO: 78320 - RNA, 64 nt, hsa
accaggcaaagcuaaggaaggauauacuaguugaaaagaauaacccacuccucuucugggcauu

SEQ ID NO: 78321 - RNA, 64 nt, hsa
accuuucccugguaguaguggucucauucacaaaaaagaauaauagauguaacuggagucacuu

SEQ ID NO: 78322 - RNA, 64 nt, hsa
aggcaaaguuuuuucccuacaucucuuuuggccaaaagaauaucugaccaucacagagauccag

SEQ ID NO: 78323 - RNA, 64 nt, hsa
gaauguauuaguguauuuuaaaguaauaaugauuaaagaauaacuaaaugacucugauuuuguu

SEQ ID NO: 78324 - RNA, 64 nt, hsa
gcuugagcugagagacagacacaacaguaucugaaaagaauacauacucuuuccaugcauauau

SEQ ID NO: 78325 - RNA, 64 nt, hsa
gggucaagugcauuggaccuagggaaagagaaagaaagaauaaaagcuggagagagagugaagu

SEQ ID NO: 78326 - RNA, 64 nt, hsa
acaagugcuuuuuaucuugaaauucaaccaacggaaagaauaugcauagaauaaugcauucuau

SEQ ID NO: 78327 - RNA, 64 nt, hsa
uacccauaaccuauguugagccuugcuuaccagcaaagaauauuuuuaauguggauaucuaauu

SEQ ID NO: 78328 - RNA, 64 nt, hsa
cagggaagcugccaaagaaugucgacgucgaaagaaagaauauguaaaaugucuggagagccga

SEQ ID NO: 78329 - RNA, 64 nt, hsa
acaauaaaaguaaaccacaaaaaaauaccucaggaaagaauagaaagaaagucuaucuaaugac

SEQ ID NO: 78330 - RNA, 64 nt, hsa
aaccccagaacuugagccuuguguauagauuuuaaaagaauauauauaucagccgggcgcggug

SEQ ID NO: 78331 - RNA, 64 nt, hsa
cagcuugaagaaccaaaacagaaggaauauguacaaagaauaaauuuucugcucacgaugaguu

SEQ ID NO: 78332 - RNA, 64 nt, hsa
gugaaaacaaauuccguaaaacuguuaguaucaaaaagaauaggaauacaguuuucuuuuccac

SEQ ID NO: 78333 - RNA, 64 nt, hsa
uuuaauucugaguuccuuacacagcauuuuagggaaagaauacaggcaggaugacacuuugugu

SEQ ID NO: 78334 - RNA, 64 nt, hsa
auuuauuuuaaauaaaugaauaaaauaaaauaaaaaagaauauucagucguuggcacauaaacu

SEQ ID NO: 78335 - RNA, 64 nt, hsa
cuucuagcuuggagcuaaaugcugcucaugcugaaaagaauaaugucuauuucuuuguuugggu

SEQ ID NO: 78336 - RNA, 64 nt, hsa
caggauguuuuauuucucacaucauguccaagaaaaagaauaaauuauguucagcuuaauuuua

SEQ ID NO: 78337 - RNA, 64 nt, hsa
cugaaaauugaaaaaauuaaaauguaaaaaaauuaaagaauaaaaauacuucuauuauucuuuu

SEQ ID NO: 78338 - RNA, 64 nt, hsa
uguuuuguuugcauauuuaauuuuaaauuaaaccaaagaauauguuaauucugaaagagauuuu

SEQ ID NO: 78339 - RNA, 64 nt, hsa
aaacauguuucaaagaaaaauaaggucaggagaaaaagaauaaugccuacagauuauccuucag

SEQ ID NO: 78340 - RNA, 64 nt, hsa
guguuguaugucuuuuuugcuuuuuuuuuaaaaaaaagaauaacuuuuuuugccucuuuagauu

SEQ ID NO: 78341 - RNA, 64 nt, hsa
ccuugaggauaacuugucaaaugccccaaagcauaaagaauauaauucugaaucccaaauucca

SEQ ID NO: 78342 - RNA, 64 nt, hsa
caagaauagcauuguaaaagcauuuuguaauaauaaagaauagcuuuaaugauaugcuuguaac

SEQ ID NO: 78343 - RNA, 64 nt, hsa
uuuuuuaagugaaaauauagcuaauaacaugugaaaagaauagaagcuaagguuuagauaaaua

SEQ ID NO: 78344 - RNA, 64 nt, hsa
auuaaaaaggaaagguucuauucauaaucaggguaaagaauaugaaaaccuuagacguaaucca

SEQ ID NO: 78345 - RNA, 64 nt, hsa
auaaauuuuauggcaugucuucuauuuaaaaggaaaagaauaaguauucuugcaucuggccuua

SEQ ID NO: 78346 - RNA, 64 nt, hsa
agaauauuuauuugaaguuuuauuauuuuauaaaaaagaauauuuauuuuaagaggcaucuuac

SEQ ID NO: 78347 - RNA, 64 nt, hsa
uauuuucuaauuuuuucaacauauuguuuaguguaaagaauauuuauuugaaguuuuauuauuu

SEQ ID NO: 78348 - RNA, 64 nt, hsa
uguuuuccuuagcuccuucaugggcaugcuggugaaagaauaaauacauccaauuaaagcucau

SEQ ID NO: 78349 - RNA, 64 nt, hsa
acaauaaacuucauauuuagaaugcaaagucuauaaagaauaauuuuacaugauccucaauauc

SEQ ID NO: 78350 - RNA, 64 nt, hsa
gggaagaccugaaagucauuugaacauuuuaggaaaagaauauuggagagaaaaagguauuaaa

SEQ ID NO: 78351 - RNA, 64 nt, hsa
uaaagugaaaacugaguuguugcugaccuccacaaaagaauauggaaaaaagccuugcuguaca

SEQ ID NO: 78352 - RNA, 64 nt, hsa
agcaguagagaauuuaagcacaagccuauuugugaaagaauauuuugcuuaagugucauucacu

SEQ ID NO: 78353 - RNA, 64 nt, hsa
gggcggggggcggggguacaaagagaaaucucuaaaagaauaugaucuuccauccaaguggagg

SEQ ID NO: 78354 - RNA, 64 nt, hsa
aucaagaaugcaauccuauucacaauugccacaaaaagaauaaaauaccuaggaauacagcuaa

SEQ ID NO: 78355 - RNA, 64 nt, hsa
gaauccuacacccacagaacccggcuuuguccccaaagaauaaaaacaccucucuaaaagcugc

SEQ ID NO: 78356 - RNA, 64 nt, hsa
cuagaaaccuguuauaauugccagcugucuacacaaagaauaugcaggccagaagaaaaguugc

SEQ ID NO: 78357 - RNA, 64 nt, hsa
gaacccauagaugaagaugaagauauucaaacagaaagaauaagaacagccacugcucugacca

SEQ ID NO: 78358 - RNA, 64 nt, hsa
cucauauauacuuuuuccaucuggauucuucacaaaagaauauguugugagcaucuuuccauga

SEQ ID NO: 78359 - RNA, 64 nt, hsa
auggauauccaauuguuucacacaauuuuuuugaaaagaauauccuuggcagggcacgguagcu

SEQ ID NO: 78360 - RNA, 64 nt, hsa
aauagaaguguaugaauugcugcgacaauuuugaaaagaauagaggaaacacccucacuguaug

SEQ ID NO: 78361 - RNA, 64 nt, hsa
uauuaguacauuaguagguaaaugagcagauuuuaaagaauagaauauccagaagcagauucau

SEQ ID NO: 78362 - RNA, 64 nt, hsa
uuuauuccauacugcaaagaaauuuugcaaauguaaagaauaugacaaggucuucaaacacaag

SEQ ID NO: 78363 - RNA, 64 nt, hsa
aaacugggcaaaggccaugaauagaccuuucucaaaagaauacauacauguggcaauaagcaua

SEQ ID NO: 78364 - RNA, 64 nt, hsa
ucuuuauuagaaaauuccaggcuaaugaaugcagaaagaauaauagaaaauuauauuagaaaaa

SEQ ID NO: 78365 - RNA, 64 nt, hsa
cucacaacuaagcauaggaaguuuuauuuaaaggaaagaauauguuaaugaacauauagaagcc

SEQ ID NO: 78366 - RNA, 64 nt, hsa
uguaagaaucaauugucuauauggaauuuaggauaaagaauauuuacaauaaagaauauuuaca

SEQ ID NO: 78367 - RNA, 64 nt, hsa
cuauauggaauuuaggauaaagaauauuuacaauaaagaauauuuacaauaaagaguuuauuau

SEQ ID NO: 78368 - RNA, 64 nt, hsa
guggggaaugggaagaagcaguuuacuuuagacuaaagaauauauuggggggccggguguagug

SEQ ID NO: 78369 - RNA, 64 nt, hsa
acagagcgagacuccaucucaaaaaaaaaaaaaaaaagaauauauugacggaagaauagagagg

SEQ ID NO: 78370 - RNA, 61 nt, hsa
gagcuaucucaucuaagugauuccugaugccaaagaauaugaaaauauuuaaguaaaaaca

SEQ ID NO: 78371 - RNA, 64 nt, hsa
guaagucacccccaccaaaaacaaaagagaagaaaaagaauagaaagaauuauccagugucagc

SEQ ID NO: 78372 - RNA, 64 nt, hsa
cuucacguagaacauugguauucgcuugagaaaaaaagaauaguugaaccuauuucucuuucuu

SEQ ID NO: 78373 - RNA, 64 nt, hsa
aguagauguucuacuuuguucugcuguucucuagaaagaauauuugguuuuccuguauaggaau

SEQ ID NO: 78374 - RNA, 64 nt, hsa
uaaaucuuuuucaccauggaugaaacuauaacuuaaagaauaauacuuagaaggguuaauugga

SEQ ID NO: 78375 - RNA, 64 nt, hsa
accauaaaauugucauaaaauuaauaaauuuaggaaagaauaaagauuuauauauucauucuuu

SEQ ID NO: 78376 - RNA, 64 nt, hsa
uuuaguuuuuuguuugcuuauaugagcuuagcguaaagaauauuuuuaaacuucguguuuuguc

SEQ ID NO: 78377 - RNA, 64 nt, hsa
cacacguuaagcaauccagaggugccuucagggcaaagaauagagagaaagggagccgcugugc

SEQ ID NO: 78378 - RNA, 61 nt, hsa
ggcuuaacuacuucucccuccuuguccagcacuuuucuagcucucccguuccccaucucca

SEQ ID NO: 78379 - RNA, 61 nt, hsa
ccacuguuuuuucucuguugggagggaagcucuuuucuaggagugucucaguucugcuuuu

SEQ ID NO: 78380 - RNA, 61 nt, hsa
auuagaagcuagcugagguagcuugcagcaucuuuucuaguugaaauggugaacugauagg

SEQ ID NO: 78381 - RNA, 61 nt, hsa
acaguucauuuuuuuccgguaggaauaacuccuuuucuacauccacgcuccauagagucuc

SEQ ID NO: 78382 - RNA, 61 nt, hsa
auuucugucucugaaauaaccuuuuacuuggcuuuucuagauagcuuuauuugauuucgag

SEQ ID NO: 78383 - RNA, 61 nt, hsa
auuucgaguggcaaaauguuuuuuauuacggcuuuucuauugcuguaugauacagaacucu

SEQ ID NO: 78384 - RNA, 61 nt, hsa
acuuugucaagcaccucaguuacacauucgccuuuucuaggauugcauuucccaagugcua

SEQ ID NO: 78385 - RNA, 61 nt, hsa
cccauuuuaguuuucuaggacugaaaggauucuuuucuacauuauacauguguguugucau

SEQ ID NO: 78386 - RNA, 61 nt, hsa
uguguucucuaaucaauagugguuuagcuuucuuuucuauuucacucguuucuaggguuuu

SEQ ID NO: 78387 - RNA, 61 nt, hsa
gcuugaauuucuccccagaaaauggguuuuucuuuucuauugcauagucaggcugcaaauu

SEQ ID NO: 78388 - RNA, 61 nt, hsa
aacucacuucggucucugucugucaacuaaacuuuucuaaagguuaccaguuauccaauca

SEQ ID NO: 78389 - RNA, 61 nt, hsa
ucuuggacaacacuauuguuugaagguuuaucuuuucuaaucaugcucuaccgcauuguag

SEQ ID NO: 78390 - RNA, 61 nt, hsa
cagaccuaggggaaaacugcagguggaagugcuuuucuacuaaggccucuuacuuuggggg

SEQ ID NO: 78391 - RNA, 61 nt, hsa
cucuaaucuuucuacauggacaagcuguuuucuuuucuagguuacugauaaccccuacaau

SEQ ID NO: 78392 - RNA, 61 nt, hsa
cucuggcaauaagccuuccaaaauucugugccuuuucuauuaucaccaaacaauauguuaa

SEQ ID NO: 78393 - RNA, 61 nt, hsa
uguuucaacuuuaagcccacacacucuguagcuuuucuaaaacaguacauuccauucaugc

SEQ ID NO: 78394 - RNA, 61 nt, hsa
ggacuagggagggaggcagggaacguuuuuucuuuucuacaucuucacagguucggcuggg

SEQ ID NO: 78395 - RNA, 61 nt, hsa
caaauauuguggguaguagggcugacugcugcuuuucuaaaaaguaguucuuuaguaucaa

SEQ ID NO: 78396 - RNA, 61 nt, hsa
auuauaggugauuucuauuuucuucuguauacuuuucuaugcuuucuagauuaucuacaug

SEQ ID NO: 78397 - RNA, 61 nt, hsa
uaaaaaaaacgcuccuuuguaggguuuuaaacuuuucuaauagauuuagauucacuuuugg

SEQ ID NO: 78398 - RNA, 61 nt, hsa
auucaaaguacuaauaucuacaugguccacacuuuucuauuuuaaaaaauuguguucucuu

SEQ ID NO: 78399 - RNA, 61 nt, hsa
uuguaaaacuaucugaaccauuaaagucgagcuuuucuaaagaaagccaccauagcugugu

SEQ ID NO: 78400 - RNA, 61 nt, hsa
cucugccuguuagacucuuacuuuuuaaaaucuuuucuauuuucccucgcuggggcagugc

SEQ ID NO: 78401 - RNA, 61 nt, hsa
gaacagggcaaacucuccauuuuacuuauggcuuuucuaauuuuuaauuaauuaauuuauu

SEQ ID NO: 78402 - RNA, 61 nt, hsa
uuaaagacguguuuuuaaaauuccacuaucccuuuucuaaagguuaaaggucugaagcagc

SEQ ID NO: 78403 - RNA, 61 nt, hsa
uaaaaugaucucucuuucucucucucucucucuuuucuaagaaacaauuaugugcacuuug

SEQ ID NO: 78404 - RNA, 61 nt, hsa
uagccuacaccuucucuuugguuuaguuuuccuuuucuauaacacucugaauugcuaaucu

SEQ ID NO: 78405 - RNA, 61 nt, hsa
auguaaccuguaaccuuguuguuuaaguuuucuuuucuauuaauacucuguccuguggucc

SEQ ID NO: 78406 - RNA, 61 nt, hsa
guaauugcuuaccugcacacaguuuuuuuuccuuuucuaaauuuguuugugaucauugaca

SEQ ID NO: 78407 - RNA, 61 nt, hsa
aauguuuauugacaggucuuuucaaauaaugcuuuucuaauuaauagccaaagauuucaua

SEQ ID NO: 78408 - RNA, 61 nt, hsa
uaaaagauaaaagagcgauacacaaagcuuucuuuucuaacuuuuccaagcaaaaucuaaa

SEQ ID NO: 78409 - RNA, 61 nt, hsa
uucuaaagaaacccaugcugugaaauagagacuuuucuacugaucaucauaacucuguauc

SEQ ID NO: 78410 - RNA, 61 nt, hsa
ugaaguucacaauaggucauaaggucucuuccuuuucuaaaauugaaagacaagaaauuua

SEQ ID NO: 78411 - RNA, 61 nt, hsa
aucuuuauauacucugaagcauuucuucaaacuuuucuacuuuuauuugucauugauaccu

SEQ ID NO: 78412 - RNA, 61 nt, hsa
ccaaugcuugaauaaguagaccccaagcauccuuuucuaaaaagugacuuaaaauaagcca

SEQ ID NO: 78413 - RNA, 61 nt, hsa
ugauugaguaaaagcagcuuaaauuacuuuucuuuucuacauuaagaaauauauucucaac

SEQ ID NO: 78414 - RNA, 61 nt, hsa
ggauuaauucccagaacccucucccuccuuucuuuucuaagugaguuguugauuuuaggag

SEQ ID NO: 78415 - RNA, 61 nt, hsa
ucucagaccuuagguaacauaccugcagcugcuuuucuaacaaacuguugaucagcaaaaa

SEQ ID NO: 78416 - RNA, 61 nt, hsa
gguagauuuuuauaaaacaagcauggggauucuuuucuaagguaauauuaaugagaaggga

SEQ ID NO: 78417 - RNA, 61 nt, hsa
uucuugugugugaugaaccaguauggauuugcuuuucuaagccuccuguugguuacuaauc

SEQ ID NO: 78418 - RNA, 61 nt, hsa
agagaaccuuucggaucacucguuuacaagccuuuucuaaguauuuggugguuuauguuua

SEQ ID NO: 78419 - RNA, 61 nt, hsa
cuggccgccugaggggacaccagacucagcucuuuucuagcgacugaaaguagaagucugu

SEQ ID NO: 78420 - RNA, 61 nt, hsa
ggguggugcccuggccccgaggucaccccgacuuuucuaaaucuuguuugagugaagucau

SEQ ID NO: 78421 - RNA, 61 nt, hsa
cuucccugucucaacaccugcuuugacccugcuuuucuauuauuacaucagucagcaucuu

SEQ ID NO: 78422 - RNA, 61 nt, hsa
gcccauggcccagucacucaggggcgaguuucuuuucuaacauagcccuuucuuugccaug

SEQ ID NO: 78423 - RNA, 61 nt, hsa
uuugccaugaggccaugaggcccgcuucauccuuuucuauuucccuagaaccuuaauggua

SEQ ID NO: 78424 - RNA, 61 nt, hsa
agaucuuccaaagcacuauuuguuguaauaacuuuucuaaauguagugccuuuaaaggaaa

SEQ ID NO: 78425 - RNA, 61 nt, hsa
aaaaguggguggcaauauucagugcuuaacacuuuucuagcguugguacaucugagaaaug

SEQ ID NO: 78426 - RNA, 61 nt, hsa
auuacucucuucuccuacuucuguacuacugcuuuucuauugugaguuuguuuaguucauu

SEQ ID NO: 78427 - RNA, 61 nt, hsa
ugcucuuaacuacugauguugucuuccugaucuuuucuacaagaagcuuuuaaacuuuuug

SEQ ID NO: 78428 - RNA, 61 nt, hsa
gauacuggagucuuaucauuugaaguguuugcuuuucuacuuuuacaguaaaaccucauua

SEQ ID NO: 78429 - RNA, 61 nt, hsa
acugugccuacauuuaaaaauacuucucucucuuuucuaaaaagcuuuaacuguagugccu

SEQ ID NO: 78430 - RNA, 61 nt, hsa
aaaagucaaaagagaccugucucucuccuuucuuuucuaucuuuaaaccagaaaaccucau

SEQ ID NO: 78431 - RNA, 61 nt, hsa
gaaaugccuuguaccuacaacaaugcuuaggcuuuucuaagccucuugccacuuuuaaaau

SEQ ID NO: 78432 - RNA, 61 nt, hsa
aggccuacaacuuuugccucagacuguuccccuuuucuaaggguauucaaguuuucaccuu

SEQ ID NO: 78433 - RNA, 61 nt, hsa
ggaugcacuaaaguucucacuuuagugagaacuuuucuagcuauuccaauacagaguucuu

SEQ ID NO: 78434 - RNA, 61 nt, hsa
auaaauuauguuuaaauggcuuggugucuuucuuuucuaauuaugcagaauaagcucuuua

SEQ ID NO: 78435 - RNA, 61 nt, hsa
aaaaaagauuaaaugccagcuuuguacaggucuuuucuauuuuuuuuuguuuauuuuguua

SEQ ID NO: 78436 - RNA, 61 nt, hsa
cuuuucuuuguuuucuuuugacuuuuuucuccuuuucuauuugaacuguuuuauuuuccug

SEQ ID NO: 78437 - RNA, 61 nt, hsa
uacauauauaugaaaauuauuaugacacgcacuuuucuaaucauuguacauuucucagagu

SEQ ID NO: 78438 - RNA, 61 nt, hsa
aaucaaugcacaguauaaagaacuuauuguucuuuucuauucuuucaguugaauaagggcc

SEQ ID NO: 78439 - RNA, 61 nt, hsa
uacagaagugucaacagaagcacugaugguucuuuucuacuaucuaacaggguuaauuuca

SEQ ID NO: 78440 - RNA, 61 nt, hsa
uccccuucccucacacccugccucgcccccacuuuucuaguuaacuuuuuccauaucccuc

SEQ ID NO: 78441 - RNA, 61 nt, hsa
uggcacguugcugccagugccccagacaguucuuuucuacccugcgggcccgcacguuuua

SEQ ID NO: 78442 - RNA, 61 nt, hsa
cucauccucaucugugcaaccgcccguccuccuuuucuaguuucugauguuuguaaccaga

SEQ ID NO: 78443 - RNA, 61 nt, hsa
cggcgggcagagcggggcccacucuucuuagcuuuucuacucacuguuagagagagaccua

SEQ ID NO: 78444 - RNA, 61 nt, hsa
agaggggcugcuggcugaauuagguuagagucuuuucuacagacuaagaguguuuaaggau

SEQ ID NO: 78445 - RNA, 61 nt, hsa
uuuaaugaaaagcagcccccaaaaucauuuucuuuucuaacaaagaacagccuguaaaauc

SEQ ID NO: 78446 - RNA, 61 nt, hsa
agaaaaacaaauguuaccaagaaauacuuaccuuuucuauaugcaguguuaucucuugucu

SEQ ID NO: 78447 - RNA, 61 nt, hsa
uaacugaaauccuauauauuucuuguguguucuuuucuauuuguaaaauacuguaauugua

SEQ ID NO: 78448 - RNA, 61 nt, hsa
cuuccccugugcucccuuucucuccucucuccuuuucuagccuguucuuuacauggggcuc

SEQ ID NO: 78449 - RNA, 61 nt, hsa
cugaccaagggugguuaagugacacauagaacuuuucuaagagaagacagacaaguugaca

SEQ ID NO: 78450 - RNA, 61 nt, hsa
aggcugaagccuggagucugcccccacuucccuuuucuauaauccacccuucugcaggccc

SEQ ID NO: 78451 - RNA, 61 nt, hsa
aguugcuucccauuuccucuuucuagccguccuuuucuagugugugcucacucuuccuagg

SEQ ID NO: 78452 - RNA, 61 nt, hsa
uguaaauucaauuuggaguuuauuuaauugacuuuucuaucacguuggggcacaugccaac

SEQ ID NO: 78453 - RNA, 61 nt, hsa
gcaugguguuugggcagcaggcaucauuuuccuuuucuagcuucauaggaauauugugagc

SEQ ID NO: 78454 - RNA, 61 nt, hsa
auuggucgccaucugcacgccaggcggcauccuuuucuaugaaguguugacuuuguaaauc

SEQ ID NO: 78455 - RNA, 61 nt, hsa
ccaggcucaccccucacccuuuuuuugguugcuuuucuaauaaagauggaacaguugucuu

SEQ ID NO: 78456 - RNA, 61 nt, hsa
ccuugcccguuugccuguuccuauucagugucuuuucuauuuuuuccucucucguucaugc

SEQ ID NO: 78457 - RNA, 61 nt, hsa
guggccauguuuucuacccagacaggcccugcuuuucuaggauguggccuuagagcaagaa

SEQ ID NO: 78458 - RNA, 61 nt, hsa
aguugggcgugcucugugguaccagcugugacuuuucuauuucuccuaguuuuagguuguu

SEQ ID NO: 78459 - RNA, 61 nt, hsa
ugacuuacacagagcaaaauugugcuaaaggcuuuucuacucugagaucucaaugcgaaau

SEQ ID NO: 78460 - RNA, 61 nt, hsa
gagaaagacuuuuucacuucuuuguugcuuucuuuucuauugagucugggcuuguuugugu

SEQ ID NO: 78461 - RNA, 61 nt, hsa
uguucuuuugaagcuugugcugagguuuuagcuuuucuauguuuuauaugccgcugcuuug

SEQ ID NO: 78462 - RNA, 64 nt, hsa
uaguuuaccuaaugcccuuaccuaauuagauuaugauaaauagguuugucauuuugcaaguuac

SEQ ID NO: 78463 - RNA, 64 nt, hsa
uaaaugcauucauucuaaaaaauuuuuugaaccagauaaauaaaauuuuuuuuugacaccacag

SEQ ID NO: 78464 - RNA, 64 nt, hsa
aacuauucuugucacuuggcaucaaccucuucaugauaaauaucuacuacugagacacuucaau

SEQ ID NO: 78465 - RNA, 64 nt, hsa
ugccuugucucuugccauauuugcuguuuuuauggauaaauaagauuuaugguuuaguacuugu

SEQ ID NO: 78466 - RNA, 64 nt, hsa
acuuaggaggaaugcagauaaaaguaccuuguaagauaaauauaaauuggaguuaggaauuuca

SEQ ID NO: 78467 - RNA, 64 nt, hsa
augagauuaaucuguauuauauaagaaaagaacugauaaauauuuauaaaaugacaaacuugga

SEQ ID NO: 78468 - RNA, 64 nt, hsa
guguugcuaaugguuaaagaagucuguaucuagugauaaauauaccaguuuuuuuaaaaagaug

SEQ ID NO: 78469 - RNA, 64 nt, hsa
uaaaaggcucaacuguaagccucuuagccaguuggauaaauauuuggggucaccuagccauuga

SEQ ID NO: 78470 - RNA, 64 nt, hsa
caucuccuuaucuauaaaaaggggauauucuuaggauaaauacaugaaaaauuauacuugauag

SEQ ID NO: 78471 - RNA, 64 nt, hsa
gucuggcauugcauaaacuucucuggugugaaaggauaaauaugccuuucuaaaguuguauauc

SEQ ID NO: 78472 - RNA, 64 nt, hsa
aagagcaaaugcaacaaaacaaaucuggacuauggauaaauaauuugagagcugccacccacaa

SEQ ID NO: 78473 - RNA, 64 nt, hsa
ugagaaacauuuaucuguauaaaacauauuuuuggauaaauauauauauauauauuuguaucuc

SEQ ID NO: 78474 - RNA, 64 nt, hsa
ugcacuaacuuuaaagaaauugaaaauucagguggauaaauagucuuacaaaagacaaugugcu

SEQ ID NO: 78475 - RNA, 64 nt, hsa
aucauacucuauuaccaauuuuucagaacucauagauaaauaugaauguagggaagcuguaagc

SEQ ID NO: 78476 - RNA, 64 nt, hsa
augcuuuauggagaguauauuuucauaugaaacugauaaauauauauguggaauauucuuuuua

SEQ ID NO: 78477 - RNA, 64 nt, hsa
uacauuuuauuuucuugcugaugaacuggaauuggauaaauauugcaaguggaugaguuggaaa

SEQ ID NO: 78478 - RNA, 64 nt, hsa
auuggacauuuucaucaaugcagucuaauguguagauaaauauuucaaccauaauaaguggauu

SEQ ID NO: 78479 - RNA, 64 nt, hsa
uauguaacaaacagccauauuuaagacaugccuggauaaauaaaauugguaggaauguuuucuu

SEQ ID NO: 78480 - RNA, 64 nt, hsa
cagucuugaauuuacucacgcugauuguugaacagauaaauacgaaacugccaucaucauuugu

SEQ ID NO: 78481 - RNA, 64 nt, hsa; identical to SEQ ID NO: 78479

SEQ ID NO: 78482 - RNA, 64 nt, hsa; identical to SEQ ID NO: 78480

SEQ ID NO: 78483 - RNA, 64 nt, hsa
uccgggaacguugggagucaccugauucugcaaagauaaauaauaucccugcauuaucaaaaua

SEQ ID NO: 78484 - RNA, 64 nt, hsa
uacgaaaaauuacaguuuacuuaaugaacauaaggauaaauagaaaaacugaaucaucauacau

SEQ ID NO: 78485 - RNA, 64 nt, hsa
aauaaaugucuccuucuguguucuguaauaugaggauaaauaaucuacuuuugauagcaugcuu

SEQ ID NO: 78486 - RNA, 64 nt, hsa
agcucuguccuucaaaccuuuuagcccuauagaugauaaauaucacuggguuauaagaaaaaau

SEQ ID NO: 78487 - RNA, 64 nt, hsa
aacauagacuuaauuccaauaauuagggaaaauugauaaauaucugucaccaaaccacaagaaa

SEQ ID NO: 78488 - RNA, 64 nt, hsa
uucuaagaccuuuuuuggauagucaaauauaagagauaaauaguuuaauuuuuucagaccuuuu

SEQ ID NO: 78489 - RNA, 64 nt, hsa
uuuucagaccuuuuuuggauaguccaauauuagagauaaauaguuuaauuuuuucagauauaau

SEQ ID NO: 78490 - RNA, 64 nt, hsa
gaugccaguaguguucaaaguuguauuuuuaaaagauaaauauuccuuuuuauaccucaguuuu

SEQ ID NO: 78491 - RNA, 64 nt, hsa
uaaaucucuuugccuaacaacuugggauccugaagauaaauauguguuggacaagcauagaaag

SEQ ID NO: 78492 - RNA, 64 nt, hsa
uuuuuuuuccucauuuuucuuaaauccaaguuggccguuuuauuaguauguuucaaauguguau

SEQ ID NO: 78493 - RNA, 64 nt, hsa
ugucuaugguagcugagccaaacacguaggauuuccguuuuaagguucacauggaaaagguuau

SEQ ID NO: 78494 - RNA, 64 nt, hsa
cccauucucagagaaugugugugcagagucccugccguuuuaggacaaucagggcccaucuucu

SEQ ID NO: 78495 - RNA, 64 nt, hsa
cgaaggugcauuuuuguuuagacucccugagguuccguuuuacacaugauccaacguuaacuac

SEQ ID NO: 78496 - RNA, 64 nt, hsa
uuuguccuuuguuuccuaccuuuugaaucagauuccguuuuagucaggaagacuucuugggacc

SEQ ID NO: 78497 - RNA, 64 nt, hsa
ggccaacuagaccacacuuauuggucuaguuuguccguuuuauaugacauugaaaacuugugug

SEQ ID NO: 78498 - RNA, 64 nt, hsa
aaagcauugauauuaguaucuucucagauacagaccguuuuaugauuuuuuaaaaaguaaaagu

SEQ ID NO: 78499 - RNA, 64 nt, hsa
guguacaucuagcuaaaagugugguuuaucuaaaccguuuuaauaagcaagaugacugggaaau

SEQ ID NO: 78500 - RNA, 64 nt, hsa
gagaaauccaauuuguaaaacuugaacaaugauaccguuuuauuuacuuaguagcaucacugug

SEQ ID NO: 78501 - RNA, 64 nt, hsa
ggaggcacccaugccaucucaaccucuuccccgcccguuuuacaaagggggaggcuaaagccca

SEQ ID NO: 78502 - RNA, 64 nt, hsa
gggaggggcgauaaauaccuuugauuguaacgugccguuuuaagagguuuuguguuuguuugcu

SEQ ID NO: 78503 - RNA, 64 nt, hsa
ccauacgccuugccagggcggcaggauugucacaccguuuuaggacucugugccacuuugagag

SEQ ID NO: 78504 - RNA, 64 nt, hsa
augucagauaauuuucaccaguuuuuauuuggagccguuuuauuguguagaccauauuuacaua

SEQ ID NO: 78505 - RNA, 64 nt, hsa
ugcugcuuuuuggugucccgacauaccuacgcccccguuuuauggguuuggcuuaguugaagag

SEQ ID NO: 78506 - RNA, 64 nt, hsa
uuuaacuuuauuuuccuguuguacaauuuaaaaaccguuuuaacauuuugccuuuuuauguuuu

SEQ ID NO: 78507 - RNA, 64 nt, hsa
ucuaaaaaggaacugagguaaaacagaugccugaccguuuuaaaggaucuuuuuuaauguuuua

SEQ ID NO: 78508 - RNA, 64 nt, hsa
ggagcagaaaaucuauugccucaugauguuuuagccguuuuaaugucauagccuagugcauuac

SEQ ID NO: 78509 - RNA, 64 nt, hsa
ugguguuacuaagaugcuccuacacuuugugauaccguuuuaaggacauggugcauuuuuuuuu

SEQ ID NO: 78510 - RNA, 64 nt, hsa
ugaacauuugugacugcccauuccccaucaucauccguuuuaccuuaguuagcauuuuucuuau

SEQ ID NO: 78511 - RNA, 64 nt, hsa
uuacaguggacccucugggugcauugaaaagaauccguuuuauauccagguuucagaggaccug

SEQ ID NO: 78512 - RNA, 64 nt, hsa
gagacuggaauaauuauggccggaaaacaaguacccguuuuaaguaagacaugguuuuccaugu

SEQ ID NO: 78513 - RNA, 64 nt, hsa
ucaguaacuccuagacuuuuucucaucccaugccccguuuuaaauugucaguuuucccucugac

SEQ ID NO: 78514 - RNA, 64 nt, hsa
aacggcuucauuaauuacugugauauacuuucauccguuuuaugaucuguaaaauaaaaacuca

SEQ ID NO: 78515 - RNA, 64 nt, hsa
auaacuuaagcuuugauaguggcacuggagccacccguuuuaauuuauauaaugagaaaugugc

SEQ ID NO: 78516 - RNA, 64 nt, hsa
uaagauacuuauuguccauuuauacccuguaaagccguuuuagaauguaauauuuuagguaauc

SEQ ID NO: 78517 - RNA, 64 nt, hsa
uuugaaaggauauuugucgaaaaaaagagcaaaaccguuuuaaauaaacucccccuggaaaaaa

SEQ ID NO: 78518 - RNA, 64 nt, hsa
ggaaguaggcucuggguccaugccuaacucuguaccguuuuauuccucaaggccuauagccugu

SEQ ID NO: 78519 - RNA, 64 nt, hsa
cggaaccguucgcacccggccugccccagucaggccguuuuagaagagcuuuuacuugggcgcc

SEQ ID NO: 78520 - RNA, 64 nt, hsa
aacuuauuuaaaugacagcaccugagaagaggaaccguuuuacacuggauguuucucauguaga

SEQ ID NO: 78521 - RNA, 64 nt, hsa
uguuagaaaugacguguuuuaaugagaggccuccccguuuuauucuuugaggaguggggaaggg

SEQ ID NO: 78522 - RNA, 64 nt, hsa
uguauuaaacuuucauaugccaaaaggguuugugccguuuuaucugccaucaguguuugaccug

SEQ ID NO: 78523 - RNA, 64 nt, hsa
auaucccuguacucuaauaaaaugccccccccccccguuuuaaucuguuacugugguuuuguuu

SEQ ID NO: 78524 - RNA, 64 nt, hsa
uuaaaacauagacugaucacucagaaauuaaaguccguuuuacugugaauauagcaauauagua

SEQ ID NO: 78525 - RNA, 64 nt, hsa
aucucccuagggccccaccuggaccauuuucccuccguuuuauuuuguuaauuaaauucuuucc

SEQ ID NO: 78526 - RNA, 64 nt, hsa
caaaaaaguacaaaguuggcuuagauaacuuguaccguuuuaaauggagaucauaauuuuaugu

SEQ ID NO: 78527 - RNA, 64 nt, hsa
gccaaaaguaucaauaaacggggagugaagaaacccguuuuauacaauaaaaccaaugaguguc

SEQ ID NO: 78528 - RNA, 64 nt, hsa
ggccuauuccggaaaagaugcuugaugcccagccccguuuuaaggacauuaaaagcuaucaggc

SEQ ID NO: 78529 - RNA, 64 nt, hsa
aaagaaguaucauucaggggugaaaaacaaagagccguuuuaaugauguugaguacauuuggcu

SEQ ID NO: 78530 - RNA, 64 nt, hsa
gaacggugucuuucuuuauaaaugcaaauggcuaccguuuuacaauaaaauuuugcaugugcca

SEQ ID NO: 78531 - RNA, 64 nt, hsa
agcuuaaaacccaauacagucuaguuuccugguuccguuuuagaaaaggaaaacgugaacaaac

SEQ ID NO: 78532 - RNA, 64 nt, hsa
ugacuuguuuuaguauuuugugugccuuagauuuccguuuuaagacauguauauuuuugugagc

SEQ ID NO: 78533 - RNA, 64 nt, hsa
aaauucaauuaggauuaauaaagauggcacuuucccguuuuauuccaguuuuauaaaaagugga

SEQ ID NO: 78534 - RNA, 64 nt, hsa
gccaguguucaaaagauuguguaaaaguucaagcccguuuuagaaagccaacauuuuauguuau

SEQ ID NO: 78535 - RNA, 64 nt, hsa
gaucucacucagccgcagacaaguaaucacuaacccguuuuauucuauuccuaucuguggaugu

SEQ ID NO: 78536 - RNA, 64 nt, hsa
guuucaagaggaacaagggaugagggagaaaaauccguuuuauccaucagagucagugcuauaa

SEQ ID NO: 78537 - RNA, 64 nt, hsa
guuuuuuucugaauaacauuuuuuuccaauuucuccguuuuauaagacauuuccuaauuuaugg

SEQ ID NO: 78538 - RNA, 64 nt, hsa
uuccaucuguucuuguugcaaugccaucuucaaaccguuuuauuuauugaaguguuuguucagu

SEQ ID NO: 78539 - RNA, 64 nt, hsa
acuauuccucaugguggcuuugggagguccagcuccguuuuaaagacucacacaggacugaagc

SEQ ID NO: 78540 - RNA, 64 nt, hsa
aggccgcugggcugggaucaguguuauuuauuugccguuuuaauuuauggauucuccgcaccuc

SEQ ID NO: 78541 - RNA, 64 nt, hsa
cuugacaaauuguguuuuuagugaauuucuuaaaccguuuuauuuagcccuccuucccucuuuc

SEQ ID NO: 78542 - RNA, 64 nt, hsa
auuuuucccuuucaaauaaaacacuagucagguaccguuuuaucccagucguacucuuccaggu

SEQ ID NO: 78543 - RNA, 64 nt, hsa
gucugccccuaugugacagcucuauauuuuauccccguuuuauaaaagaggaaacugaaguucu

SEQ ID NO: 78544 - RNA, 64 nt, hsa
aaaguuagauuuggggguuauucagccaaaauuaccguuuuagaccagaaugaauagacuacac

SEQ ID NO: 78545 - RNA, 64 nt, hsa
caggugauggauggguuugucaagggaaucguuaccguuuuauaccaaagguauuaacaugggc

SEQ ID NO: 78546 - RNA, 64 nt, hsa
ugcuguuugcggugaaaugcuuuuuguccaugugccguuuuaacugauaugcuuguuagaacuc

SEQ ID NO: 78547 - RNA, 64 nt, hsa
guuccaaucuaaaguucuuuuugaguuuuguugcccguuuuaugcuugauguguauaguaauag

SEQ ID NO: 78548 - RNA, 64 nt, hsa
uacccuaaucccaugaugccuggaaccuugauuaccguuuuacaucagcucuuguacuuuucag

SEQ ID NO: 78549 - RNA, 64 nt, hsa
guauuuucaguaucacuggaucccucagucuucaccguuuuauaaacguauaagauuaggauga

SEQ ID NO: 78550 - RNA, 64 nt, hsa
agaacauauauaaagggcauucucuacaaaugugccguuuuaagaauaaaacccccucaaaucu

SEQ ID NO: 78551 - RNA, 64 nt, hsa
aauaaaauaucuuguagccuguguggaaagcugaccguuuuaagaaguggcaugugccuugaaa

SEQ ID NO: 78552 - RNA, 64 nt, hsa
aaauuguauaugaacuuauucuuaaauaauugaaccguuuuauauucaaaugacuuaugaucgu

SEQ ID NO: 78553 - RNA, 64 nt, hsa
aguggugcuguugagauauuuuaaaauauugccuccguuuuaucgaggagagaaauaauaacua

SEQ ID NO: 78554 - RNA, 64 nt, hsa
aguaugaaccgugaccagagaaguaaauauggagccguuuuauugagcaguuuccuccagggau

SEQ ID NO: 78555 - RNA, 64 nt, hsa
cucuucagcagccacccggcccucccuccagcacccguuuuaaucccacagaacaacgggaacg

SEQ ID NO: 78556 - RNA, 64 nt, hsa
ucuaccuggugccugagagcccagggcccuuccuccguuuuaagggggaagcaacauuuggagg

SEQ ID NO: 78557 - RNA, 64 nt, hsa
aaagaaauuaaguucuugaaaauuuagccaaaucccguuuuaugggaaugcucuuuagaauuca

SEQ ID NO: 78558 - RNA, 64 nt, hsa
uuacguuuugugaagagcaaagcacuuggaaucuccguuuuaaagcuucaaguguuaaaaaugc

SEQ ID NO: 78559 - RNA, 63 nt, hsa
acaagauggaggaggaaugaagcugggguggggccguuuuagguagagccuuaaaaaugcuuc

SEQ ID NO: 78560 - RNA, 64 nt, hsa
aauuuuuuguauuuuuaguagagacgggguuucaccguuuuagccgggauggucucgaucuccu

SEQ ID NO: 78561 - RNA, 64 nt, hsa
ugaugaacugagaaacuuuuccauaaaacuugcaccguuuuacauuccuaacauuccacaaaag

SEQ ID NO: 78562 - RNA, 64 nt, hsa
ccuuauuuggcacagagacggaagcacgugugugccguuuuaggaaaagaacaaaaaagacaca

SEQ ID NO: 78563 - RNA, 64 nt, hsa
uacuucccaacaacucuuagagguagguguauucccguuuuacagauaaggaaacugaggccca

SEQ ID NO: 78564 - RNA, 64 nt, hsa
gaaccugaauagcucugcaaaaaacaccaaaggaccguuuuaucguuuucuguuguugcugugg

SEQ ID NO: 78565 - RNA, 64 nt, hsa
ggcuuccgcgcccagcgcucgccacgcucagugcccguuuuaccaauaaacugagcgaccccag

SEQ ID NO: 78566 - RNA, 64 nt, hsa
uucggcgugauguugaucuuuugauguacauacuccguuuuaaacucauuuccacucuaguuga

SEQ ID NO: 78567 - RNA, 64 nt, hsa
guaagggaaugccagucugaggaguuagaaguuaccguuuuauguaagguaauuaugaaagaca

SEQ ID NO: 78568 - RNA, 64 nt, hsa
ugcaauguguaucugaaaagcaaggaauuugcagccguuuuacaaauaucuguggaacauguaa

SEQ ID NO: 78569 - RNA, 64 nt, hsa
uagcauggaauugagcuacuaaaugguuuugguuccguuuuacggagauuuuuccucauauuua

SEQ ID NO: 78570 - RNA, 64 nt, hsa
guccauuuauagaauaaugugggaagaaacaaacccguuuuaugauuuacucauuaucgccuuu

SEQ ID NO: 78571 - RNA, 64 nt, hsa
uucaaauuagaaguggauuucuguuucauuacuuccguuuuaaaaguuuuugccagagaguuuu

SEQ ID NO: 78572 - RNA, 64 nt, hsa
gaggaguuuuaaaguacuguaacuuuaaaauaaauaacuacaaagcuucuuuguccaaacguca

SEQ ID NO: 78573 - RNA, 64 nt, hsa
gguuuuaaauaguuuuucugacccuucugaaaaauaacuacauaagugcuucuuguugcugggu

SEQ ID NO: 78574 - RNA, 64 nt, hsa
ugugagagagcugaguagaguguugguuuuuccauaacuacagggggaaaaaaagucauuaggc

SEQ ID NO: 78575 - RNA, 64 nt, hsa
auugugccuccuguuuucucgaguggggacacuuuaacuacaguuuacaccucgggcgcauaaa

SEQ ID NO: 78576 - RNA, 63 nt, hsa
aagaaccugguguguuucuugggaucaugguacauuuaucacugaauuaagccaucagggaaa

SEQ ID NO: 78577 - RNA, 63 nt, hsa
cccugugcuuggaaaccuuuuuuccuucuugacauuuaucaccucugauggcugaagaaugua

SEQ ID NO: 78578 - RNA, 63 nt, hsa
uguauauuaaugaauuauccaagauucgaugggauuuaucaguguguagauagcucuauaaug

SEQ ID NO: 78579 - RNA, 63 nt, hsa
ucauuucuuauaaaaaacaaaacaacaacaauaauuuaucaaaauuggcauauuuaaagccua

SEQ ID NO: 78580 - RNA, 63 nt, hsa
auucaugguauuuuaagagaucauuuguauauuauuuaucacacuguuguaaugauguuuuga

SEQ ID NO: 78581 - RNA, 63 nt, hsa
agauguuuauuauuagaaaagauugcugagaguauuuaucagguuuuacaaagucauuuuaag

SEQ ID NO: 78582 - RNA, 63 nt, hsa
uuaaagguuuuuuuuuuuauauguauuaaaucaauuuaucacuguuuaaagcuuugaauaucu

SEQ ID NO: 78583 - RNA, 63 nt, hsa
uaaguuaaaugauugagaguuggcuguauuuagauuuaucacuuuuuaauagggugagcuuga

SEQ ID NO: 78584 - RNA, 63 nt, hsa
cccugcuaaauaaugaaaaaacacuuuacuaaaauuuaucaaauuauacuggguucggauugu

SEQ ID NO: 78585 - RNA, 63 nt, hsa
agcaguggugaggagugggagggcccagcaagcauuuaucagaaauagaaucacaauaggagg

SEQ ID NO: 78586 - RNA, 63 nt, hsa
aggccaaugcagcuaauuuugauagcugcauucauuuaucaccagcauauuguguucugagug

SEQ ID NO: 78587 - RNA, 63 nt, hsa
gauauuucauuccuuuguuuacuaaagagacauauuuaucaguugcagauagccuauuuauua

SEQ ID NO: 78588 - RNA, 63 nt, hsa
gccuauucauuauauguauauuuuuuuauaaauauuuaucaagaacaugaaaauauuuuauuu

SEQ ID NO: 78589 - RNA, 63 nt, hsa
ugucuucuuugaucauuugauuuuggauccaagauuuaucaucucucuauuuugcuauuugcc

SEQ ID NO: 78590 - RNA, 63 nt, hsa
uaucaauggauuaagaaguuuaagauuuugcagauuuaucaauuuggguuuuuguacugaagu

SEQ ID NO: 78591 - RNA, 63 nt, hsa
uuuacgguguuugaagaccagcuacuccuuaauauuuaucaauggauuaagaaguuuaagauu

SEQ ID NO: 78592 - RNA, 63 nt, hsa
uaaaaguugucauucuuaggaauuugguuugaaauuuaucaguuauacagaauugucauacug

SEQ ID NO: 78593 - RNA, 63 nt, hsa
acuuuugaggcagccauuagguugaaaguauauauuuaucauauaaaacuugaugcguuuugc

SEQ ID NO: 78594 - RNA, 63 nt, hsa
uuguuaucuguuguuaaguugaaauguauaaucauuuaucacuaaauugcacauugccuuuau

SEQ ID NO: 78595 - RNA, 63 nt, hsa
uaucugccacaguaaauuaaagcauuacacaguauuuaucaguauuuuuuaaacauccugucc

SEQ ID NO: 78596 - RNA, 63 nt, hsa
uugaccugguguucuucaucauucuugcuauggauuuaucaauuuuguuccucuuuuccaaaa

SEQ ID NO: 78597 - RNA, 63 nt, hsa
ccaaacccauguauuagagaagaagggcgugaaauuuaucaccuaagcuuuccauucaggaag

SEQ ID NO: 78598 - RNA, 63 nt, hsa
gauuuuucaaaauaaaagucaaucagcauuguuauuuaucauuaagguauugaacacuggauu

SEQ ID NO: 78599 - RNA, 63 nt, hsa
cugcaaugccaaugauuguaagaaaacaaacaaauuuaucaugaaauucuccuugucauuuua

SEQ ID NO: 78600 - RNA, 63 nt, hsa
aaaaagaaauucacugguucuuuacaaaauagaauuuaucaucaaguuauuacacaaacuuca

SEQ ID NO: 78601 - RNA, 63 nt, hsa
uuucuaaguauauagaaagcuuguauaauucagauuuaucaauuuccugauuuaauguagacu

SEQ ID NO: 78602 - RNA, 63 nt, hsa
cuugucaauuauguugugaaauuguuaguauucauuuaucaaaaaugaccuauguuuagucac

SEQ ID NO: 78603 - RNA, 63 nt, hsa
aggcacaaaacaugagagaaaguguuguacagaauuuaucauggauuauugacugcugagaaa

SEQ ID NO: 78604 - RNA, 63 nt, hsa
aaagcuauccagggcuuaaccuauaugaacucuauuuaucaugucuaaugcaugugauuuaau

SEQ ID NO: 78605 - RNA, 63 nt, hsa
uuguuauaugcugcuuaauaaaguaagcuugaaauuuaucauuuuaucaugaaaacuucuuug

SEQ ID NO: 78606 - RNA, 63 nt, hsa
cauacggaaaguguuugagagcaaguaguugacauuuaucagcaaaucucuugcaagaacagc

SEQ ID NO: 78607 - RNA, 63 nt, hsa
uaucucagauuguguagauaugcuauuuaaauaauuuaucaggaaauacugccuguagaguua

SEQ ID NO: 78608 - RNA, 63 nt, hsa
aaacaugcaauuuaugaaaacauauaaacaauuauuuaucacuuuuaugacccaaaucacaau

SEQ ID NO: 78609 - RNA, 63 nt, hsa
uggaaaacauaugugaugaaauugagcuauaugauuuaucagagaucugauuccaaagagcac

SEQ ID NO: 78610 - RNA, 63 nt, hsa
ccaugaaaguguaaauacuguaaugccuaaucuauuuaucaaaacugacuacuggaccggagc

SEQ ID NO: 78611 - RNA, 63 nt, hsa
cauuucacuaguggccgagacacccucucuggcauuuaucacuguuggccggugugaugagua

SEQ ID NO: 78612 - RNA, 63 nt, hsa
uuagugaaauuugaauuguaaacuugucagugaauuuaucacucugagcgagucucuagaggg

SEQ ID NO: 78613 - RNA, 63 nt, hsa
aaaagaguuuaaacugaacuuuaaggugccuccauuuaucaaggguuaugaaacucagaaaau

SEQ ID NO: 78614 - RNA, 63 nt, hsa
caauuuugguuuuucucauuugaaauguuuuugauuuaucaauauuugugguuuaacuuugug

SEQ ID NO: 78615 - RNA, 63 nt, hsa
gaaucugagaaaguacuuucugguggcaaaugaauuuaucauuuuaguauaguuuucgauaaa

SEQ ID NO: 78616 - RNA, 63 nt, hsa
cauauacacagucuauacaaugaaauaaugaauauuuaucauauugauacaaacugugaccuc

SEQ ID NO: 78617 - RNA, 63 nt, hsa
uaaauucagauccuuucuccacacagcaaugacauuuaucaaucugacucagguguggcuguu

SEQ ID NO: 78618 - RNA, 63 nt, hsa
guucacugcagcuccugucacaagcugggauggauuuaucacauugaguuaugaaauuaccug

SEQ ID NO: 78619 - RNA, 63 nt, hsa
uuccccaucaaugcugauucugagaaaagagcaauuuaucaaaauuaaacacuguaaaagaaa

SEQ ID NO: 78620 - RNA, 64 nt, hsa
uuuggaaauaccuggauauuugcuagaggaaaaaugaaagcaaaacuucguacacagugccuug

SEQ ID NO: 78621 - RNA, 64 nt, hsa
auggucaaaaaauaagucaucagcacuuaagaaaugaaagcaacuuuugaaauuuucuguuaaa

SEQ ID NO: 78622 - RNA, 64 nt, hsa
uuucauucuaaagguaguuaagaugaaauuuauaugaaagcauuuuuaucacaaaauaaaaaag

SEQ ID NO: 78623 - RNA, 64 nt, hsa
gcaagaccuuugugcuuuugaucauucuggcccaugaaagcaacuuuggucuccuuuccccucc

SEQ ID NO: 78624 - RNA, 64 nt, hsa
ucuucaauccuucagucccagccagaagaaucucugaaagcauauugugaauguauacaaugua

SEQ ID NO: 78625 - RNA, 64 nt, hsa
caguggccuuuugggaacccaaguuacguccuggugaaagcagaaaggaggagacaggauggcu

SEQ ID NO: 78626 - RNA, 64 nt, hsa
uugauugccccugggcguucuucccccuuaacugugaaagcagagucuauaaaugaacucuuug

SEQ ID NO: 78627 - RNA, 64 nt, hsa
ccuaaauuuugcuuaaggaaggccuuuaucaugcugaaagcacucagacaugucuguccucaca

SEQ ID NO: 78628 - RNA, 64 nt, hsa
uacuguggaccauguguggugucucuaugcccuuugaaagcaguuuuuauaaaaagaaagcccg

SEQ ID NO: 78629 - RNA, 64 nt, hsa
cccucaguugcagugaauugugagcaaaagaucuugaaagcaaaaagcacuaauuaguuuaaaa

SEQ ID NO: 78630 - RNA, 64 nt, hsa
uuagaaagcaaguguuaccaaaguuguguuaucuugaaagcauuacagguaagggcauguuaug

SEQ ID NO: 78631 - RNA, 64 nt, hsa
acauuuuugauagugacuuuggggucuucuucacugaaagcaccuuagaacuguacuauaagaa

SEQ ID NO: 78632 - RNA, 64 nt, hsa
guuccaaugaauguacagcacuuccauuaacuuuugaaagcaacacagccuuaaacucaaugcu

SEQ ID NO: 78633 - RNA, 64 nt, hsa
agaaaagccuuauauuuuaguuuguuccacauuuugaaagcaaaaaauauauauuugauauacc

SEQ ID NO: 78634 - RNA, 64 nt, hsa
gagaauuuuuuuuuaauggcucaaaaauggaaacugaaagcaagucauggggaaugaauacuuu

SEQ ID NO: 78635 - RNA, 64 nt, hsa
uauucuccuguucagaauaauacuuauuuacgugugaaagcaacauggaugugauucccaacac

SEQ ID NO: 78636 - RNA, 64 nt, hsa
agauugaaaaguuuugagaaaauguuauuuuuacugaaagcaagcaguggccuauaaagaacau

SEQ ID NO: 78637 - RNA, 64 nt, hsa
uuagcuugaauuguauagauuuuuaaaaauucaaugaaagcauguuguuuaauuucuuuuuaaa

SEQ ID NO: 78638 - RNA, 64 nt, hsa
uguuuaauuucuuuuuaaaaucacuguugggcuuugaaagcauugagaauauaauaugaaauua

SEQ ID NO: 78639 - RNA, 64 nt, hsa
uaucagaacaauguaacauuuacaaaugacauauugaaagcaaaggcuguuuuauuuagccaag

SEQ ID NO: 78640 - RNA, 64 nt, hsa
gaugauuaccauuaggaguuacuuuauguauuguugaaagcaaauuuuaaacaugauguuuuag

SEQ ID NO: 78641 - RNA, 64 nt, hsa
aaauuuuguaagauguuuucaccuaaauaaaaauugaaagcaaguggauuacacaggagaacca

SEQ ID NO: 78642 - RNA, 64 nt, hsa
uucucuacagacggauaucuguuuaggaaagauuugaaagcagauuaucaguagguacauggau

SEQ ID NO: 78643 - RNA, 64 nt, hsa
auuacucuacuguucuuucuuuaauaguggcaaaugaaagcauaagcuuaagcauuuuuucaua

SEQ ID NO: 78644 - RNA, 64 nt, hsa
acugacaacuguuuaauugaaucaugaaguaaauugaaagcaggacauaugagaaaacugacca

SEQ ID NO: 78645 - RNA, 64 nt, hsa
auagucugucaaaaucagaacuccugaacaacuuugaaagcaguaauauuaacugguauucaaa

SEQ ID NO: 78646 - RNA, 64 nt, hsa
caauacauuguugauggcauugugccauuugagcugaaagcaggauuuuuuuucauuagucauc

SEQ ID NO: 78647 - RNA, 64 nt, hsa
uuaucauuaggaaacaaaaagaauuuagaaggaaugaaagcagcccguaaggugaauuccuaag

SEQ ID NO: 78648 - RNA, 64 nt, hsa
auaacgaaaugaaggcagaaauaaagauauucucugaaagcaaugagaacaaagacacaacaua

SEQ ID NO: 78649 - RNA, 64 nt, hsa
gauucuuuacuugcaaauucaggggcuuagaaaaugaaagcaaacacaaaaccuugagugugcu

SEQ ID NO: 78650 - RNA, 64 nt, hsa
gauagagcugcacauucuugcagcagaugugugaugaaagcaucuucuaagcccugcgcacccg

SEQ ID NO: 78651 - RNA, 64 nt, hsa
cauuugaaauuguuuucccuuucauuuuacccugugaaagcaucucuccuagagccuugcaaga

SEQ ID NO: 78652 - RNA, 64 nt, hsa
agaagagggcuaagauacguuuucugucuugagcugaaagcacagucuacucuccuucguuuug

SEQ ID NO: 78653 - RNA, 64 nt, hsa
aucggucucuaucucuaucugcuuauuuugguacugaaagcaauaguuccucauucaaaucacc

SEQ ID NO: 78654 - RNA, 64 nt, hsa
gguugagaacagaaggugggcggcaggaucagagugaaagcagaggcgugaggagaggaaagca

SEQ ID NO: 78655 - RNA, 64 nt, hsa
agagauggaaggaugagaggugaaauugaccuuuugaaagcaaagcucuggcucacaggcccca

SEQ ID NO: 78656 - RNA, 64 nt, hsa
ccaguccccucagaggcccccgccagccccaccuugaaagcagcauacaggggaaggcuuggac

SEQ ID NO: 78657 - RNA, 64 nt, hsa
uaaugggcaacuggacaaccaaguuaaccccaauugaaagcaccccuaggaccauugaacaccc

SEQ ID NO: 78658 - RNA, 64 nt, hsa
gugcacugccaauaaguaucucuaauucaauaguugaaagcaaccugcaugcuaaucgugguuu

SEQ ID NO: 78659 - RNA, 64 nt, hsa
ggaauauguuguucuaaaauaugucuuagaauccugaaagcauagauuuugaaauguuuuuuua

SEQ ID NO: 78660 - RNA, 64 nt, hsa
gauuuuguguuuuuacguaaauauuuauauuccuugaaagcaauuuuugccaagguaguucagu

SEQ ID NO: 78661 - RNA, 64 nt, hsa
uucaugucacuucuucggcauuaugguuugcaucugaaagcaguuaaaucuuguuuacugauga

SEQ ID NO: 78662 - RNA, 64 nt, hsa
uuuugcuuuacuuugcauuugauugcugugaagaugaaagcauuagacuuuuauccccuucaug

SEQ ID NO: 78663 - RNA, 64 nt, hsa
cauagggaucagaaacuuuuucauauaaccugucugaaagcacacaaagucuuguuuacuacug

SEQ ID NO: 78664 - RNA, 64 nt, hsa
cauuuucguagugacaguguggagaucuuuuuaaugaaagcaaacuauguggccucugcaaaga

SEQ ID NO: 78665 - RNA, 64 nt, hsa; identical to SEQ ID NO: 48547

SEQ ID NO: 78666 - RNA, 64 nt, hsa; identical to SEQ ID NO: 48548

SEQ ID NO: 78667 - RNA, 64 nt, hsa; identical to SEQ ID NO: 48549

SEQ ID NO: 78668 - RNA, 64 nt, hsa; identical to SEQ ID NO: 48550

SEQ ID NO: 78669 - RNA, 64 nt, hsa; identical to SEQ ID NO: 48551

SEQ ID NO: 78670 - RNA, 64 nt, hsa; identical to SEQ ID NO: 48552

SEQ ID NO: 78671 - RNA, 64 nt, hsa; identical to SEQ ID NO: 48553

SEQ ID NO: 78672 - RNA, 64 nt, hsa; identical to SEQ ID NO: 48554

SEQ ID NO: 78673 - RNA, 64 nt, hsa; identical to SEQ ID NO: 48555

SEQ ID NO: 78674 - RNA, 64 nt, hsa; identical to SEQ ID NO: 48556

SEQ ID NO: 78675 - RNA, 64 nt, hsa; identical to SEQ ID NO: 48557

SEQ ID NO: 78676 - RNA, 64 nt, hsa; identical to SEQ ID NO: 48558

SEQ ID NO: 78677 - RNA, 64 nt, hsa; identical to SEQ ID NO: 48559

SEQ ID NO: 78678 - RNA, 64 nt, hsa; identical to SEQ ID NO: 48560

SEQ ID NO: 78679 - RNA, 64 nt, hsa; identical to SEQ ID NO: 48561

SEQ ID NO: 78680 - RNA, 64 nt, hsa; identical to SEQ ID NO: 48562

SEQ ID NO: 78681 - RNA, 64 nt, hsa; identical to SEQ ID NO: 48563

SEQ ID NO: 78682 - RNA, 64 nt, hsa; identical to SEQ ID NO: 48564

SEQ ID NO: 78683 - RNA, 64 nt, hsa; identical to SEQ ID NO: 48565

SEQ ID NO: 78684 - RNA, 64 nt, hsa; identical to SEQ ID NO: 48566

SEQ ID NO: 78685 - RNA, 64 nt, hsa; identical to SEQ ID NO: 48567

SEQ ID NO: 78686 - RNA, 64 nt, hsa; identical to SEQ ID NO: 48568

SEQ ID NO: 78687 - RNA, 64 nt, hsa; identical to SEQ ID NO: 48569

SEQ ID NO: 78688 - RNA, 64 nt, hsa; identical to SEQ ID NO: 48570

SEQ ID NO: 78689 - RNA, 64 nt, hsa; identical to SEQ ID NO: 48571

SEQ ID NO: 78690 - RNA, 64 nt, hsa; identical to SEQ ID NO: 48572

SEQ ID NO: 78691 - RNA, 64 nt, hsa; identical to SEQ ID NO: 48573

SEQ ID NO: 78692 - RNA, 64 nt, hsa; identical to SEQ ID NO: 48574

SEQ ID NO: 78693 - RNA, 64 nt, hsa; identical to SEQ ID NO: 48575

SEQ ID NO: 78694 - RNA, 64 nt, hsa; identical to SEQ ID NO: 48576

SEQ ID NO: 78695 - RNA, 64 nt, hsa; identical to SEQ ID NO: 48577

SEQ ID NO: 78696 - RNA, 64 nt, hsa; identical to SEQ ID NO: 48578

SEQ ID NO: 78697 - RNA, 64 nt, hsa; identical to SEQ ID NO: 48579

SEQ ID NO: 78698 - RNA, 64 nt, hsa; identical to SEQ ID NO: 48580

SEQ ID NO: 78699 - RNA, 64 nt, hsa; identical to SEQ ID NO: 48581

SEQ ID NO: 78700 - RNA, 64 nt, hsa; identical to SEQ ID NO: 48582

SEQ ID NO: 78701 - RNA, 64 nt, hsa; identical to SEQ ID NO: 48583

SEQ ID NO: 78702 - RNA, 64 nt, hsa; identical to SEQ ID NO: 48584

SEQ ID NO: 78703 - RNA, 64 nt, hsa; identical to SEQ ID NO: 48585

SEQ ID NO: 78704 - RNA, 64 nt, hsa; identical to SEQ ID NO: 48586

SEQ ID NO: 78705 - RNA, 64 nt, hsa; identical to SEQ ID NO: 48587

SEQ ID NO: 78706 - RNA, 64 nt, hsa; identical to SEQ ID NO: 48588

SEQ ID NO: 78707 - RNA, 64 nt, hsa; identical to SEQ ID NO: 48589

SEQ ID NO: 78708 - RNA, 64 nt, hsa; identical to SEQ ID NO: 48590

SEQ ID NO: 78709 - RNA, 64 nt, hsa; identical to SEQ ID NO: 48591

SEQ ID NO: 78710 - RNA, 64 nt, hsa; identical to SEQ ID NO: 48592

SEQ ID NO: 78711 - RNA, 64 nt, hsa; identical to SEQ ID NO: 48593

SEQ ID NO: 78712 - RNA, 64 nt, hsa; identical to SEQ ID NO: 48594

SEQ ID NO: 78713 - RNA, 64 nt, hsa; identical to SEQ ID NO: 48595

SEQ ID NO: 78714 - RNA, 64 nt, hsa; identical to SEQ ID NO: 48596

SEQ ID NO: 78715 - RNA, 64 nt, hsa; identical to SEQ ID NO: 48597

SEQ ID NO: 78716 - RNA, 64 nt, hsa; identical to SEQ ID NO: 48598

SEQ ID NO: 78717 - RNA, 64 nt, hsa; identical to SEQ ID NO: 48599

SEQ ID NO: 78718 - RNA, 64 nt, hsa; identical to SEQ ID NO: 48600

SEQ ID NO: 78719 - RNA, 64 nt, hsa; identical to SEQ ID NO: 48601

SEQ ID NO: 78720 - RNA, 64 nt, hsa; identical to SEQ ID NO: 48602

SEQ ID NO: 78721 - RNA, 64 nt, hsa; identical to SEQ ID NO: 48603

SEQ ID NO: 78722 - RNA, 64 nt, hsa; identical to SEQ ID NO: 48604

SEQ ID NO: 78723 - RNA, 64 nt, hsa; identical to SEQ ID NO: 48605

SEQ ID NO: 78724 - RNA, 64 nt, hsa; identical to SEQ ID NO: 48606

SEQ ID NO: 78725 - RNA, 64 nt, hsa; identical to SEQ ID NO: 48607

SEQ ID NO: 78726 - RNA, 55 nt, hsa; identical to SEQ ID NO: 48608

SEQ ID NO: 78727 - RNA, 64 nt, hsa; identical to SEQ ID NO: 48609

SEQ ID NO: 78728 - RNA, 64 nt, hsa; identical to SEQ ID NO: 48610

SEQ ID NO: 78729 - RNA, 64 nt, hsa; identical to SEQ ID NO: 48611

SEQ ID NO: 78730 - RNA, 64 nt, hsa; identical to SEQ ID NO: 48612

SEQ ID NO: 78731 - RNA, 64 nt, hsa; identical to SEQ ID NO: 48613

SEQ ID NO: 78732 - RNA, 64 nt, hsa; identical to SEQ ID NO: 48614

SEQ ID NO: 78733 - RNA, 64 nt, hsa; identical to SEQ ID NO: 48615

SEQ ID NO: 78734 - RNA, 64 nt, hsa; identical to SEQ ID NO: 48616

SEQ ID NO: 78735 - RNA, 64 nt, hsa; identical to SEQ ID NO: 48617

SEQ ID NO: 78736 - RNA, 64 nt, hsa; identical to SEQ ID NO: 48618

SEQ ID NO: 78737 - RNA, 64 nt, hsa; identical to SEQ ID NO: 48619

SEQ ID NO: 78738 - RNA, 64 nt, hsa; identical to SEQ ID NO: 48620

SEQ ID NO: 78739 - RNA, 64 nt, hsa; identical to SEQ ID NO: 48621

SEQ ID NO: 78740 - RNA, 64 nt, hsa; identical to SEQ ID NO: 48622

SEQ ID NO: 78741 - RNA, 64 nt, hsa; identical to SEQ ID NO: 48623

SEQ ID NO: 78742 - RNA, 64 nt, hsa; identical to SEQ ID NO: 48624

SEQ ID NO: 78743 - RNA, 64 nt, hsa; identical to SEQ ID NO: 48625

SEQ ID NO: 78744 - RNA, 64 nt, hsa; identical to SEQ ID NO: 48626

SEQ ID NO: 78745 - RNA, 64 nt, hsa; identical to SEQ ID NO: 48627

SEQ ID NO: 78746 - RNA, 64 nt, hsa; identical to SEQ ID NO: 48628

SEQ ID NO: 78747 - RNA, 64 nt, hsa; identical to SEQ ID NO: 48629

SEQ ID NO: 78748 - RNA, 64 nt, hsa; identical to SEQ ID NO: 48630

SEQ ID NO: 78749 - RNA, 64 nt, hsa; identical to SEQ ID NO: 48631

SEQ ID NO: 78750 - RNA, 64 nt, hsa; identical to SEQ ID NO: 48632

SEQ ID NO: 78751 - RNA, 64 nt, hsa; identical to SEQ ID NO: 48633

SEQ ID NO: 78752 - RNA, 64 nt, hsa; identical to SEQ ID NO: 48634

SEQ ID NO: 78753 - RNA, 64 nt, hsa; identical to SEQ ID NO: 48635

SEQ ID NO: 78754 - RNA, 64 nt, hsa; identical to SEQ ID NO: 48636

SEQ ID NO: 78755 - RNA, 64 nt, hsa; identical to SEQ ID NO: 48637

SEQ ID NO: 78756 - RNA, 64 nt, hsa; identical to SEQ ID NO: 48638

SEQ ID NO: 78757 - RNA, 64 nt, hsa; identical to SEQ ID NO: 48639

SEQ ID NO: 78758 - RNA, 64 nt, hsa; identical to SEQ ID NO: 48640

SEQ ID NO: 78759 - RNA, 64 nt, hsa; identical to SEQ ID NO: 48641

SEQ ID NO: 78760 - RNA, 64 nt, hsa; identical to SEQ ID NO: 48642

SEQ ID NO: 78761 - RNA, 64 nt, hsa; identical to SEQ ID NO: 48643

SEQ ID NO: 78762 - RNA, 64 nt, hsa; identical to SEQ ID NO: 48644

SEQ ID NO: 78763 - RNA, 64 nt, hsa; identical to SEQ ID NO: 48645

SEQ ID NO: 78764 - RNA, 64 nt, hsa; identical to SEQ ID NO: 48646

SEQ ID NO: 78765 - RNA, 64 nt, hsa; identical to SEQ ID NO: 48647

SEQ ID NO: 78766 - RNA, 64 nt, hsa; identical to SEQ ID NO: 48648

SEQ ID NO: 78767 - RNA, 64 nt, hsa; identical to SEQ ID NO: 48649

SEQ ID NO: 78768 - RNA, 64 nt, hsa; identical to SEQ ID NO: 48650

SEQ ID NO: 78769 - RNA, 64 nt, hsa; identical to SEQ ID NO: 48651

SEQ ID NO: 78770 - RNA, 64 nt, hsa; identical to SEQ ID NO: 48652

SEQ ID NO: 78771 - RNA, 64 nt, hsa; identical to SEQ ID NO: 48653

SEQ ID NO: 78772 - RNA, 64 nt, hsa; identical to SEQ ID NO: 48654

SEQ ID NO: 78773 - RNA, 64 nt, hsa; identical to SEQ ID NO: 48655

SEQ ID NO: 78774 - RNA, 64 nt, hsa; identical to SEQ ID NO: 48656

SEQ ID NO: 78775 - RNA, 64 nt, hsa; identical to SEQ ID NO: 48657

SEQ ID NO: 78776 - RNA, 64 nt, hsa; identical to SEQ ID NO: 48658

SEQ ID NO: 78777 - RNA, 64 nt, hsa; identical to SEQ ID NO: 48659

SEQ ID NO: 78778 - RNA, 64 nt, hsa; identical to SEQ ID NO: 48660

SEQ ID NO: 78779 - RNA, 64 nt, hsa; identical to SEQ ID NO: 48661

SEQ ID NO: 78780 - RNA, 64 nt, hsa; identical to SEQ ID NO: 48662

SEQ ID NO: 78781 - RNA, 64 nt, hsa; identical to SEQ ID NO: 48663

SEQ ID NO: 78782 - RNA, 64 nt, hsa; identical to SEQ ID NO: 48664

SEQ ID NO: 78783 - RNA, 64 nt, hsa; identical to SEQ ID NO: 48665

SEQ ID NO: 78784 - RNA, 64 nt, hsa; identical to SEQ ID NO: 48666

SEQ ID NO: 78785 - RNA, 64 nt, hsa; identical to SEQ ID NO: 48667

SEQ ID NO: 78786 - RNA, 64 nt, hsa; identical to SEQ ID NO: 48668

SEQ ID NO: 78787 - RNA, 64 nt, hsa; identical to SEQ ID NO: 48669

SEQ ID NO: 78788 - RNA, 64 nt, hsa; identical to SEQ ID NO: 48670

SEQ ID NO: 78789 - RNA, 64 nt, hsa; identical to SEQ ID NO: 48671

SEQ ID NO: 78790 - RNA, 64 nt, hsa; identical to SEQ ID NO: 48672

SEQ ID NO: 78791 - RNA, 64 nt, hsa; identical to SEQ ID NO: 48673

SEQ ID NO: 78792 - RNA, 64 nt, hsa; identical to SEQ ID NO: 48674

SEQ ID NO: 78793 - RNA, 64 nt, hsa; identical to SEQ ID NO: 48675

SEQ ID NO: 78794 - RNA, 64 nt, hsa; identical to SEQ ID NO: 48676

SEQ ID NO: 78795 - RNA, 64 nt, hsa; identical to SEQ ID NO: 48677

SEQ ID NO: 78796 - RNA, 64 nt, hsa; identical to SEQ ID NO: 48678

SEQ ID NO: 78797 - RNA, 64 nt, hsa; identical to SEQ ID NO: 48679

SEQ ID NO: 78798 - RNA, 64 nt, hsa; identical to SEQ ID NO: 48680

SEQ ID NO: 78799 - RNA, 64 nt, hsa; identical to SEQ ID NO: 48681

SEQ ID NO: 78800 - RNA, 64 nt, hsa; identical to SEQ ID NO: 48682

SEQ ID NO: 78801 - RNA, 64 nt, hsa; identical to SEQ ID NO: 48683

SEQ ID NO: 78802 - RNA, 64 nt, hsa; identical to SEQ ID NO: 48684

SEQ ID NO: 78803 - RNA, 64 nt, hsa; identical to SEQ ID NO: 48685

SEQ ID NO: 78804 - RNA, 64 nt, hsa; identical to SEQ ID NO: 48686

SEQ ID NO: 78805 - RNA, 64 nt, hsa; identical to SEQ ID NO: 48687

SEQ ID NO: 78806 - RNA, 64 nt, hsa; identical to SEQ ID NO: 48688

SEQ ID NO: 78807 - RNA, 64 nt, hsa; identical to SEQ ID NO: 48689

SEQ ID NO: 78808 - RNA, 64 nt, hsa; identical to SEQ ID NO: 48690

SEQ ID NO: 78809 - RNA, 64 nt, hsa; identical to SEQ ID NO: 48691

SEQ ID NO: 78810 - RNA, 64 nt, hsa; identical to SEQ ID NO: 48692

SEQ ID NO: 78811 - RNA, 64 nt, hsa; identical to SEQ ID NO: 48693

SEQ ID NO: 78812 - RNA, 64 nt, hsa; identical to SEQ ID NO: 48694

SEQ ID NO: 78813 - RNA, 64 nt, hsa; identical to SEQ ID NO: 48695

SEQ ID NO: 78814 - RNA, 64 nt, hsa; identical to SEQ ID NO: 48696

SEQ ID NO: 78815 - RNA, 64 nt, hsa; identical to SEQ ID NO: 48697

SEQ ID NO: 78816 - RNA, 64 nt, hsa; identical to SEQ ID NO: 48698

SEQ ID NO: 78817 - RNA, 64 nt, hsa; identical to SEQ ID NO: 48699

SEQ ID NO: 78818 - RNA, 64 nt, hsa; identical to SEQ ID NO: 48700

SEQ ID NO: 78819 - RNA, 64 nt, hsa; identical to SEQ ID NO: 48701

SEQ ID NO: 78820 - RNA, 64 nt, hsa; identical to SEQ ID NO: 48702

SEQ ID NO: 78821 - RNA, 64 nt, hsa; identical to SEQ ID NO: 48703

SEQ ID NO: 78822 - RNA, 64 nt, hsa; identical to SEQ ID NO: 48704

SEQ ID NO: 78823 - RNA, 64 nt, hsa; identical to SEQ ID NO: 48705

SEQ ID NO: 78824 - RNA, 64 nt, hsa; identical to SEQ ID NO: 48706

SEQ ID NO: 78825 - RNA, 64 nt, hsa; identical to SEQ ID NO: 48707

SEQ ID NO: 78826 - RNA, 64 nt, hsa; identical to SEQ ID NO: 48708

SEQ ID NO: 78827 - RNA, 64 nt, hsa; identical to SEQ ID NO: 48709

SEQ ID NO: 78828 - RNA, 64 nt, hsa; identical to SEQ ID NO: 48710

SEQ ID NO: 78829 - RNA, 64 nt, hsa; identical to SEQ ID NO: 48711

SEQ ID NO: 78830 - RNA, 64 nt, hsa; identical to SEQ ID NO: 48712

SEQ ID NO: 78831 - RNA, 64 nt, hsa; identical to SEQ ID NO: 48713

SEQ ID NO: 78832 - RNA, 64 nt, hsa; identical to SEQ ID NO: 48714

SEQ ID NO: 78833 - RNA, 64 nt, hsa; identical to SEQ ID NO: 48715

SEQ ID NO: 78834 - RNA, 64 nt, hsa; identical to SEQ ID NO: 48716

SEQ ID NO: 78835 - RNA, 64 nt, hsa; identical to SEQ ID NO: 48717

SEQ ID NO: 78836 - RNA, 64 nt, hsa; identical to SEQ ID NO: 48718

SEQ ID NO: 78837 - RNA, 64 nt, hsa; identical to SEQ ID NO: 48719

SEQ ID NO: 78838 - RNA, 64 nt, hsa; identical to SEQ ID NO: 48720

SEQ ID NO: 78839 - RNA, 64 nt, hsa; identical to SEQ ID NO: 48721

SEQ ID NO: 78840 - RNA, 64 nt, hsa; identical to SEQ ID NO: 48722

SEQ ID NO: 78841 - RNA, 64 nt, hsa; identical to SEQ ID NO: 48723

SEQ ID NO: 78842 - RNA, 64 nt, hsa; identical to SEQ ID NO: 48724

SEQ ID NO: 78843 - RNA, 64 nt, hsa; identical to SEQ ID NO: 48725

SEQ ID NO: 78844 - RNA, 64 nt, hsa; identical to SEQ ID NO: 48726

SEQ ID NO: 78845 - RNA, 64 nt, hsa; identical to SEQ ID NO: 48727

SEQ ID NO: 78846 - RNA, 64 nt, hsa; identical to SEQ ID NO: 48728

SEQ ID NO: 78847 - RNA, 64 nt, hsa; identical to SEQ ID NO: 48729

SEQ ID NO: 78848 - RNA, 64 nt, hsa; identical to SEQ ID NO: 48726

SEQ ID NO: 78849 - RNA, 64 nt, hsa; identical to SEQ ID NO: 48731

SEQ ID NO: 78850 - RNA, 64 nt, hsa; identical to SEQ ID NO: 48732

SEQ ID NO: 78851 - RNA, 64 nt, hsa; identical to SEQ ID NO: 48733

SEQ ID NO: 78852 - RNA, 64 nt, hsa
cauuuauaaagaccguacaaacucagauccuugguaccccuaaaaagauugccaauuuucuuca

SEQ ID NO: 78853 - RNA, 64 nt, hsa
cugauuuagacaagguauuauggucauuacuuuguaccccuauccuuccaagcacuucugguac

SEQ ID NO: 78854 - RNA, 64 nt, hsa
gcccccaagcucucucacugaaugcugccucuucuaccccuauguccaaauuuucagccaccac

SEQ ID NO: 78855 - RNA, 64 nt, hsa
cauaugccugcaugccauuaacaccagcuggcccuaccccuauaaugauccuguguccuaaauu

SEQ ID NO: 78856 - RNA, 64 nt, hsa
gggggaaggccuugcugucaugugaaucccucaauaccccuaguaucuggcuggguuuucaggg

SEQ ID NO: 78857 - RNA, 64 nt, hsa
cccccuuuccccacuauuucugccugccccauuguaccccuagcacugagacuugugccuggaa

SEQ ID NO: 78858 - RNA, 64 nt, hsa
auucacauuuuagaauaacaagaacaccaagaauuaccccuaaaacagagacccuguauuuaau

SEQ ID NO: 78859 - RNA, 64 nt, hsa
uuccaugcacuuagaguugcuuucaguaacauuuuaccccuacucccaaagguagcuuaaauag

SEQ ID NO: 78860 - RNA, 64 nt, hsa
uucuucauuauugucauugcguguucuuaaguuuuaccccuauuagaugguaagaacaauuaau

SEQ ID NO: 78861 - RNA, 64 nt, hsa
uaacuaacuaugaacuauuuauuuccuccuccccuaccccuaguuaagugccacaaagacugug

SEQ ID NO: 78862 - RNA, 64 nt, hsa
aacuuaaucuguuauuugaaaugacuucauacacuaccccuauaaguuugccaauaaaaccauc

SEQ ID NO: 78863 - RNA, 64 nt, hsa
uguuagcaggaaagagugauuaagugagguuauuuaccccuaaaugguccauucugcauuguau

SEQ ID NO: 78864 - RNA, 64 nt, hsa
aauggggauuucagguuucuaugagccuccccauuaccccuaaaguagaacauuuuuuaaauug

SEQ ID NO: 78865 - RNA, 64 nt, hsa
aucacuuaauucagucugauacuugaaugugauuuaccccuaauuaaguacaaaaacagagucg

SEQ ID NO: 78866 - RNA, 64 nt, hsa
cugagguucuauuugauuacuaagcaaaaucuguuaccccuacaggguuuagaaccuaaguauu

SEQ ID NO: 78867 - RNA, 64 nt, hsa
uaaaauuguucuuucuuaguucaaaugauagcaauaccccuauagcauuagguagaaacaaauu

SEQ ID NO: 78868 - RNA, 64 nt, hsa
accaggaaggucguuucacauucuguaguaaaaauaccccuacaaucauuuugguagggucuuc

SEQ ID NO: 78869 - RNA, 64 nt, hsa
ccgucuccuguuuugucuuuuuuuucuuuucuccuaccccuaucuugggacauucagaaacugc

SEQ ID NO: 78870 - RNA, 64 nt, hsa
gaaguaucuuucuacaaacgcagacaagcuccacuaccccuaaccugccaggaugcucaagucc

SEQ ID NO: 78871 - RNA, 64 nt, hsa
gacugugaucuucaaucauccugcccaucucugguaccccuauaucacuccuuuuuuucaagaa

SEQ ID NO: 78872 - RNA, 64 nt, hsa
uugccuuugcuuuuuuuuggagggaaauacucccuaccccuaauuuuguuacuacuuauauaga

SEQ ID NO: 78873 - RNA, 64 nt, hsa
uuuuucuuuuuuuaacugcaauaaaguaggucguuaccccuaaagugagcgagucccuuccugc

SEQ ID NO: 78874 - RNA, 64 nt, hsa
ccuuaaaaauugaguugauguccuuauaggucacuaccccuaaauaaaccugaagcagguguuu

SEQ ID NO: 78875 - RNA, 64 nt, hsa
gguuagaacccgugacuguauucucucccuuggauaccccuaugccuacaucauauuccuuacc

SEQ ID NO: 78876 - RNA, 64 nt, hsa
uuucuuuugugggguguaacuacuagcuuuagauuaccccuauacacaagaauggccaaccuaa

SEQ ID NO: 78877 - RNA, 64 nt, hsa
cagguuauucucuggagguugguggaugaagggguaccccuaggagaugugaaguguggguuug

SEQ ID NO: 78878 - RNA, 64 nt, hsa
aguaaucuugacugaauggagaaaguuucugugcuaccccuacaaacccaugccucacugacag

SEQ ID NO: 78879 - RNA, 64 nt, hsa
agcagauccagggaucagugagaggagugguguguaccccuaaauccucccaccccagcacugc

SEQ ID NO: 78880 - RNA, 64 nt, hsa
cuuauucaguuccagcucaugacgcccuguagcauaccccuagguaccaacuuccacagcaguc

SEQ ID NO: 78881 - RNA, 64 nt, hsa
aaauucucauacccccuuucccaaucaauuccucuaccccuagcccuaggcagccacagauuug

SEQ ID NO: 78882 - RNA, 64 nt, hsa
gagggguggauaaacuaccccugccccaaaccucuaccccuaacuccaggucaggggugcguag

SEQ ID NO: 78883 - RNA, 64 nt, hsa
caucccucagugucugugggggauugguuccaguuaccccuauagauaccaaaaucugcagaug

SEQ ID NO: 78884 - RNA, 64 nt, hsa
agacaggccacaggagggcagaguggaguggaaauaccccuaaguuggaaccaagaauugcagg

SEQ ID NO: 78885 - RNA, 64 nt, hsa
gcucccugcauuccagggacuugcucgucuuguuuaccccuagccauccuuucuuucaagggug

SEQ ID NO: 78886 - RNA, 64 nt, hsa
ggccucagaacuaccccuuccagggccucagaacuaccccuacaguuucuccugcguaaccuuc

SEQ ID NO: 78887 - RNA, 64 nt, hsa
uuagauugucugcugaugcagccguccauagcaguaccccuaaaaucccaccagaauacggguc

SEQ ID NO: 78888 - RNA, 64 nt, hsa
agaguccaccucucauugcugaucaauuucucauuaccccuacacaucucuccacggagcccag

SEQ ID NO: 78889 - RNA, 64 nt, hsa
ugccagccuaggauuuugggcgucauucacccacuaccccuagugcuagucccagaggaugcug

SEQ ID NO: 78890 - RNA, 64 nt, hsa
ucuggggaaacuuuugcccuaugaaccugagaauuaccccuaccaauugggagaaauaucuucc

SEQ ID NO: 78891 - RNA, 64 nt, hsa
cugccagaaucaaauguaaaugaggaauuucucguaccccuacugcaugguaucgauuuuuaau

SEQ ID NO: 78892 - RNA, 64 nt, hsa
gcuauccggggcaauuguagcguuuggguccuuuuaccccuaugucccccggcuauacuuuuaa

SEQ ID NO: 78893 - RNA, 64 nt, hsa
uuuaucaguagaagugucacagccauagucaaaauaccccuaacauacugcauuucacucuggg

SEQ ID NO: 78894 - RNA, 64 nt, hsa
cccuccuguaggaauugagcgguuccccaccuccuaccccuacucuagaaacacacuagacaga

SEQ ID NO: 78895 - RNA, 64 nt, hsa
uaggcucagaucccagagggaugcaggagcccuauaccccuacacaggggcccccuaacuccug

SEQ ID NO: 78896 - RNA, 64 nt, hsa
gugggugcuggcugcaaaaauuucuggcuucucuuaccccuauugcccccggcaauaaauuguu

SEQ ID NO: 78897 - RNA, 64 nt, hsa
ccaggagaccagagucucugaggaugaaguuuccuaccccuauuuguagggaaaaggacuugag

SEQ ID NO: 78898 - RNA, 64 nt, hsa
caaucuuucaucauuuuacuucccucuuugcccuuaccccuaaauaaagcaagcaguucuugaa

SEQ ID NO: 78899 - RNA, 64 nt, hsa
ggaaagcuguaacucacgaagcccugagaccugcuaccccuaagaucgagcuuguuuucaguga

SEQ ID NO: 78900 - RNA, 64 nt, hsa
uucuuaaaccaauccuuuugcaauguccagcuuuuaccccuacucucuacuuuuucacccaaac

SEQ ID NO: 78901 - RNA, 64 nt, hsa
cucuugagaacuauaaagugaacaccuauaugccuaccccuaccuagauucuauacuuaacauc

SEQ ID NO: 78902 - RNA, 64 nt, hsa
ucucaguacacaaucauuuaauauuucccugucuuaccccuauucaagcaacuagaggccagaa

SEQ ID NO: 78903 - RNA, 64 nt, hsa
cugauuuucaagcuccucauuuacggcucugugcuaccccuagguagcaagagagaggcuggga

SEQ ID NO: 78904 - RNA, 64 nt, hsa
gugugauauuuuaggaauacagaagauuuagaaauaccccuauuucucauuugcaguuuuuuuu

SEQ ID NO: 78905 - RNA, 64 nt, hsa
auagaggaauaaaugucuucaguugucucuccauuaccccuaaguuauuaguuugucuaguuua

SEQ ID NO: 78906 - RNA, 64 nt, hsa
gugguuucaaacauucaugauggauguauuuuccuaccccuaacuuaaggagaaaaaaaaaaag

SEQ ID NO: 78907 - RNA, 64 nt, hsa
cgggggcauuaggguagggagaugaaucaaaaaauaccccuaguaaugcuuuauauuuuaauac

SEQ ID NO: 78908 - RNA, 64 nt, hsa
ucacaguaaaaacacuuuuuugaguuauuaggcuuaccccuagcuuuugaccuuugcauuucau

SEQ ID NO: 78909 - RNA, 64 nt, hsa
aguaaggaaggagaaagugguuacuagccaggcauaccccuagcauaagucugggcagcucuau

SEQ ID NO: 78910 - RNA, 64 nt, hsa
gaggucuccaaggccccagcaaagccauggcuucuaccccuaguuccccugacaggaaguucuu

SEQ ID NO: 78911 - RNA, 64 nt, hsa
guuuguuguuuuuuuuacauuguuaaauguuccuuaccccuaaaggucaauguuaaguacaaca

SEQ ID NO: 78912 - RNA, 64 nt, hsa
uuuaugguguuggagugaagccuuguagcuuccauaccccuaugucagaggaggucuuacggac

SEQ ID NO: 78913 - RNA, 64 nt, hsa
cccccagaacccugaggccaagggggccacuggcuaccccuacugcgcggcggcccaggagcuc

SEQ ID NO: 78914 - RNA, 64 nt, hsa
guaggaaaguuaagcaggcaccauccuggaagucuaccccuagguggucgagagaccuguucuu

SEQ ID NO: 78915 - RNA, 57 nt, hsa
cucacacccugaagacuugaacucugcuaccccuacugaaaucaagcuggaguacgu

SEQ ID NO: 78916 - RNA, 64 nt, hsa
acugggacccacuggcccagucuuggcugcugcuuaccccuagccuugaugccugcccagggac

SEQ ID NO: 78917 - RNA, 64 nt, hsa
aguuagaggagaaaaaggaauggagcagagccuguaccccuaacccuaacagcuaaaucaagga

SEQ ID NO: 78918 - RNA, 64 nt, hsa
ugauacuaagguggaugccaaccagagaagcugcuaccccuacaucaucuccaaccggucagaa

SEQ ID NO: 78919 - RNA, 64 nt, hsa
cuucugcuagggaccccaccgggugugguuuugauaccccuaaguuaaggcugagccagagcac

SEQ ID NO: 78920 - RNA, 64 nt, hsa
gggguauuuggggagaaaguaacuacuuuggcucuaccccuagaaauguccaguuuugagugac

SEQ ID NO: 78921 - RNA, 64 nt, hsa
aacagcccucagacugucaggcaagcccggguucuaccccuaaugcaaauacccaccagggaga

SEQ ID NO: 78922 - RNA, 64 nt, hsa
aggagcaguccucagugggggcaggugugggcccuaccccuaagcuagaaugugguugucagaa

SEQ ID NO: 78923 - RNA, 64 nt, hsa
aauucauuuugcagaaagccugaaagaaaaaaaauaccccuaaauaaaacuauuuaagaguuua

SEQ ID NO: 78924 - RNA, 64 nt, hsa
ccgggccaccuucuccugggaggacgaccaucucuaccccuagaggacugucacucuagcaucu

SEQ ID NO: 78925 - RNA, 64 nt, hsa
cccguccuaagccuccccacaaggcgaggggaguuaccccuaaaacaaagcuauuaaagggaca

SEQ ID NO: 78926 - RNA, 64 nt, hsa
aaaauucagauauuuucuuaguagugcagaccuuuaccccuagucuaugaaaaaacaaaccaaa

SEQ ID NO: 78927 - RNA, 64 nt, hsa
ugccagugaaauugcuuuccuaugguauaucuccuuaccagaaaaaucucuaaauaaaaaaagg

SEQ ID NO: 78928 - RNA, 64 nt, hsa
acagacuuauuggacaauuauguuuuuugcaguguuaccagaaucaaggcucuguuuauucccc

SEQ ID NO: 78929 - RNA, 64 nt, hsa
ggucguaaagaauacaaaugcugcagaggaauccuuaccagagauccagaaagaacaucgcaau

SEQ ID NO: 78930 - RNA, 64 nt, hsa
ucuagaauuugauguuugaccauuuaugacuuaauuaccagagagccaguaaauuaggacagug

SEQ ID NO: 78931 - RNA, 64 nt, hsa
cuauauagcuaagcuaaaagaauaaccauugacauuaccagacaaaccacucaucacaguauuc

SEQ ID NO: 78932 - RNA, 64 nt, hsa
auguauaucacaugaacccacauuuuauuuuuuauuaccagagcauaucuauuauagcaaaaca

SEQ ID NO: 78933 - RNA, 64 nt, hsa; identical to SEQ ID NO: 61116

SEQ ID NO: 78934 - RNA, 64 nt, hsa; identical to SEQ ID NO: 61117

SEQ ID NO: 78935 - RNA, 64 nt, hsa; identical to SEQ ID NO: 61118

SEQ ID NO: 78936 - RNA, 64 nt, hsa; identical to SEQ ID NO: 61119

SEQ ID NO: 78937 - RNA, 64 nt, hsa
aacuuuacugcagccgagguccaggccguggaggggguccuagcuccgcugcauucugcauccc

SEQ ID NO: 78938 - RNA, 64 nt, hsa
ggguggagugggcaagggcacacccuguggcaggggguccuauaauuuuguguaaauaucugua

SEQ ID NO: 78939 - RNA, 64 nt, hsa
cuguagaaccuugggcaaauaacuucaucuuuuuggguccuaauuuuccuccugucuaacugga

SEQ ID NO: 78940 - RNA, 64 nt, hsa
ugccgagaaggaagccucccacgacugcccggcaggguccuagaaauuccccacccugaaagcc

SEQ ID NO: 78941 - RNA, 64 nt, hsa
gaccuugaaugaugccuaggauggcagagccccuggguccuacuccauccuccagccuuugucc

SEQ ID NO: 78942 - RNA, 64 nt, hsa
cuuuuaaauucaaauuuuaucuccagauggaaugggguccuagcaaccuccacauguucaacua

SEQ ID NO: 78943 - RNA, 64 nt, hsa
accucugggcccugcaggaggccugggagggcaaggguccuacggagggaccaggugucuagag

SEQ ID NO: 78944 - RNA, 64 nt, hsa
uacugaaccuacuaacccuuuaacauacaguuuaggguccuagcgcagaguccuuguuuaaagg

SEQ ID NO: 78945 - RNA, 64 nt, hsa
uuugucaaucuuuggcauucgaauuccacacacgggguccuagagcccuucugagcaucagugg

SEQ ID NO: 78946 - RNA, 64 nt, hsa
gauaaucuugcauugcuuuccucugagcuuuaguggguccuaguugcacacuggccuuucugug

SEQ ID NO: 78947 - RNA, 64 nt, hsa
aauuauggauucuuucaagccacucccacaagguggguccuacuagaaaggguuagcauuuuaa

SEQ ID NO: 78948 - RNA, 64 nt, hsa
acagagagcaucuagccaugauggaaaggaucuuggguccuaucccuucccggaugauccgaaa

SEQ ID NO: 78949 - RNA, 64 nt, hsa
auggaugguuugguggauugagguguggggaggaggguccuaggcuagaggggguaucccuagu

SEQ ID NO: 78950 - RNA, 64 nt, hsa
gagucacuauuggaggcagagaggcaugcaggcaggguccuaggagccccugcuucuccaggcc

SEQ ID NO: 78951 - RNA, 64 nt, hsa
auccagacugugaaaucagccucugggccaaggaggguccuacagacaagguggcaucucaacc

SEQ ID NO: 78952 - RNA, 64 nt, hsa
ucagauuugcccugcacuucuuguuccaugcuugggguccuaagaacaagccaucugaugccuc

SEQ ID NO: 78953 - RNA, 64 nt, hsa
cguaaaaggaauaaaauaagcaaguuaagcuucaggguccuagaauuuuucugauuucuauaau

SEQ ID NO: 78954 - RNA, 64 nt, hsa
cccuuaaaauucguuaaaguuuuugaauaaucugggguccuaauguguucuggucaucccugau

SEQ ID NO: 78955 - RNA, 64 nt, hsa
acuucuggguucuuuccuucugcuaacccagggaggguccuaagaggaaggugacuucucucug

SEQ ID NO: 78956 - RNA, 64 nt, hsa
ggugagugcuggugaugugagccuacaucaggguggguccuaagaaacauggcaaaccaggcug

SEQ ID NO: 78957 - RNA, 64 nt, hsa
guaaagggcaugggaacagugagggacauaugugggguccuaacaauaucugcuaggcuggucu

SEQ ID NO: 78958 - RNA, 64 nt, hsa
ucauauaugugagaaaaaccugaauauaggacagggguccuacuuuuuuccccaccucugucgc

SEQ ID NO: 78959 - RNA, 64 nt, hsa
acucaaaugcuuggcuucucauacguccaccaugggguccuaccaauagauuccccauugccuc

SEQ ID NO: 78960 - RNA, 64 nt, hsa
cagguccuuguaucaugccacggucccaacuacaggguccuagcugggggccugggugggcccu

SEQ ID NO: 78961 - RNA, 64 nt, hsa
gagaugguggucuauuaaauaugaauugaauggaggguccuaaugccuuauuucaaaacaauuc

SEQ ID NO: 78962 - RNA, 64 nt, hsa
ccauacuccaaauuguauauuggauugcauuuugggguccuaggucauacguucuucaaaauua

SEQ ID NO: 78963 - RNA, 64 nt, hsa
cagaguauccugggggugguggugggguggggggggguccuaaauguaaucacgaguaagauua

SEQ ID NO: 78964 - RNA, 64 nt, hsa
uuacuuagaaguagauggugggggacagcggcguggguccuagccuggccagugaugcugcugg

SEQ ID NO: 78965 - RNA, 64 nt, hsa
uuguugguuugaagaugaaccgacuuuuuaguuuggguccuacuguuguuauuaaaaacagaac

SEQ ID NO: 78966 - RNA, 64 nt, hsa
guggaagauucccuauuuaaacacaugaagcucuggguccuagccuuuuuugguuauaagcccu

SEQ ID NO: 78967 - RNA, 64 nt, hsa
aaagugcucuaaaaauuaaauauuuugacuuuaaggguccuaguaagugccacuuccacuaaga

SEQ ID NO: 78968 - RNA, 64 nt, hsa
aggauucaguuccugccuauaauggucucagagaggguccuacuuuuagguuuucccaggacag

SEQ ID NO: 78969 - RNA, 64 nt, hsa
cauugugcuuggccccugguaagcagaggcuuugggguccuagcccagugcuucuccaacacug

SEQ ID NO: 78970 - RNA, 64 nt, hsa
ugccucccaacaguggggaagagugacucuccagggguccuaggccucaacuccucccauagau

SEQ ID NO: 78971 - RNA, 64 nt, hsa
aauaacaugugacuccuuaauggacuuauucucaggguccuacucuaagaagaaucuaauagga

SEQ ID NO: 78972 - RNA, 64 nt, hsa
uguguaaucuaucaaacacaccccuggccaaguuggguccuauaggaccugguacuauguacua

SEQ ID NO: 78973 - RNA, 64 nt, hsa
uuagaagugcauguauauguggagggagggaaaaggguccuauagaaugagggaagacaaaaau

SEQ ID NO: 78974 - RNA, 64 nt, hsa
cagcucugucauggugcuaucuauguauuaaguuggguccuaaguugggucuuuugugucaacg

SEQ ID NO: 78975 - RNA, 64 nt, hsa
uccauguguacuuauuacagucuuauuuaaccagggguccuaaccacuaacauugugacuuugc

SEQ ID NO: 78976 - RNA, 64 nt, hsa
ccaggagaugggccuaaaauguucuggaucccuuggguccuaguguuauguuccagucugccca

SEQ ID NO: 78977 - RNA, 64 nt, hsa
uaaugcgggggcuggaccaggcugaguccccacaggguccuaguggaggauguggaggggcggg

SEQ ID NO: 78978 - RNA, 64 nt, hsa
uguguaaguagucaucgccacucaaguaggacaaggguccuacccaaggcuaggaccgcccugc

SEQ ID NO: 78979 - RNA, 64 nt, hsa
gagcugagaccccggccccccuuggacuggcacaggguccuacagagucagaggaggccugaga

SEQ ID NO: 78980 - RNA, 64 nt, hsa
auaugcaauuccacacugguaaccugcagcaguuggguccuaaugauggcauuagacuuucaua

SEQ ID NO: 78981 - RNA, 64 nt, hsa
ugugacagccccgaugagcaccuggcuggcugcaggguccuaccucuggguuuccuggaagugg

SEQ ID NO: 78982 - RNA, 64 nt, hsa
acaguaauuauuaucuggcacaucaaugaauuugggguccuauacacuugacuagagacaugcu

SEQ ID NO: 78983 - RNA, 64 nt, hsa
auuuggggauuacuuuuuacuuaggcuugggaugggguccuacaaguuuugaguaugaugaaac

SEQ ID NO: 78984 - RNA, 64 nt, hsa
guucacgaacugugcccaacgcauguuauagccaggguccuacuaacuacucaguaaaagaacg

SEQ ID NO: 78985 - RNA, 64 nt, hsa
cgugcauucuguaucagcugguccaguccauucuggguccuagauuacugucauugucuaaaag

SEQ ID NO: 78986 - RNA, 64 nt, hsa
uauuuuuuauuuauaggauauacaguaacuauuuggguccuaugaaaauaguccuuaaagagcu

SEQ ID NO: 78987 - RNA, 64 nt, hsa
gggagaugcuucucuccuugccccccgcccucauggguccuagcccuucccugagugcgggcug

SEQ ID NO: 78988 - RNA, 64 nt, hsa
uucuccccuuuccgucugaauaauggguuuuagcggguccuagucugcuggcauugagcugggg

SEQ ID NO: 78989 - RNA, 64 nt, hsa
ccuuccuuuuccugggcuucgucuacuccuuucuggguccuaacccuuuugucgccuggaugca

SEQ ID NO: 78990 - RNA, 64 nt, hsa
ccagcuacccagccccucucugugugcagccggaggguccuaagaauggcucccggagcuaacu

SEQ ID NO: 78991 - RNA, 64 nt, hsa
caagcaggcccugggaugggaguggggcggaggaggguccuaagagcugauuauuuaauuucua

SEQ ID NO: 78992 - RNA, 64 nt, hsa
gcggucucgcuggcacagcgccccguacacuaggggguccuacagcuacguggccgugggcagu

SEQ ID NO: 78993 - RNA, 64 nt, hsa
aagcaagccgugccaggccaucugccugcucaugggguccuaaagcgcgggcuaagccugcagg

SEQ ID NO: 78994 - RNA, 64 nt, hsa
cacugaacguucagaugcauaccaaauuaugcauggguccuaaucacacauauaaggcuggcua

SEQ ID NO: 78995 - RNA, 64 nt, hsa
auaugagaauuuugcuguugcugaugccugguguggguccuaaugauaucucuguauaacaaag

SEQ ID NO: 78996 - RNA, 64 nt, hsa
agggccagcagcagcacaaccuugaccagagcuuggguccuaccugucuaccuggagugaacag

SEQ ID NO: 78997 - RNA, 64 nt, hsa
ggacaugcuggcagcaggcgccuucuucagcuguggguccuaaaggccuuugauccuuugaaga

SEQ ID NO: 78998 - RNA, 64 nt, hsa
ugcaagaucugaggcucugcccacaaaccucaguggguccuacagauccgggcucuccaggaau

SEQ ID NO: 78999 - RNA, 64 nt, hsa
ucccagcgcuccuaucauguuuacagucacccuuggguccuaaauuaagaguuguguucaugua

SEQ ID NO: 79000 - RNA, 64 nt, hsa
auuagccuggcagagcuuuaaaaaauugauaccuggguccuauuccauaacaacuaaaucaaaa

SEQ ID NO: 79001 - RNA, 64 nt, hsa
cagaaucccagccggccaauggaaaccucacgcuggguccuaauuaccagucuuuaaaggccca

SEQ ID NO: 79002 - RNA, 64 nt, hsa
ccggcccagagauuuggacuuggcuggcuugcagggguccuaagaaacuccacucuggacagcg

SEQ ID NO: 79003 - RNA, 64 nt, hsa
ggucaggugguccuaggacccaggggagguuuagggguccuaucuccugggggaaggggagauc

SEQ ID NO: 79004 - RNA, 64 nt, hsa
ggccagaugcacugggaacagagccacggguccuggguccuagaccaggacuuccugugugacc

SEQ ID NO: 79005 - RNA, 64 nt, hsa
agcugcagggcacuaaugacccuugacuucugcuggguccuaaguccucucagcagugggugac

SEQ ID NO: 79006 - RNA, 64 nt, hsa
gugcugggaauacaucuguggacaagacaugcuuggguccuacuccuggagcacuguaaaaaga

SEQ ID NO: 79007 - RNA, 64 nt, hsa
cuuaccucuccuccuuagcccaauaugcugucuuggguccuauucaaauaaaguuauuucuccu

SEQ ID NO: 79008 - RNA, 64 nt, hsa
ucaaacaggcccaagcaaaggcuggaagacauuuggguccuagaagaagggauauccuugaaua

SEQ ID NO: 79009 - RNA, 64 nt, hsa
guggggcauucccucuagauucagguuugggcagggguccuauagucccugccauggggcugcu

SEQ ID NO: 79010 - RNA, 64 nt, hsa
uaggggcaaccucguacugagaggaggugauaccggguccuagguagguagggcugauggugcg

SEQ ID NO: 79011 - RNA, 64 nt, hsa
cauucgaucuuccuuucaccucccugccaugcugggguccuacccagccuggaucugagcucug

SEQ ID NO: 79012 - RNA, 64 nt, hsa
ggguuuggacucuaaaaucucagcacugccccauggguccuagacuucccagggcaagaggaag

SEQ ID NO: 79013 - RNA, 64 nt, hsa
uucccuagggaccaggcacucauauggcggggugggguccuagccucaguuugaagaagugggg

SEQ ID NO: 79014 - RNA, 64 nt, hsa
aagugcacuguccuucuguccuggauguguuccuggguccuauguucauuugcuagugggacua

SEQ ID NO: 79015 - RNA, 64 nt, hsa
uuucuuuuccugaaauucacuguaaaacauucagggguccuaccauuucuguucaggaaaucuu

SEQ ID NO: 79016 - RNA, 64 nt, hsa
auucuguauguguaagagauguuuaaauauguuuggguccuaaacagcuuuuuaaaauuauacu

SEQ ID NO: 79017 - RNA, 64 nt, hsa
aaaagaagauggcagauacaggagagacgacagaggguccuaggcuggaauguuccuuucgaaa

SEQ ID NO: 79018 - RNA, 64 nt, hsa
ugguguuuaaagauggguauuugucauacaauauggguccuaaauccaaccaacuacacauuuu

SEQ ID NO: 79019 - RNA, 64 nt, hsa
gguucauaucaguuauguaggaccuuuggacccaggguccuacagauagauauggugugcccag

SEQ ID NO: 79020 - RNA, 64 nt, hsa
uucauucuaaagcagcaagcuugucauacccaugggguccuauguugauagaaauggagaggua

SEQ ID NO: 79021 - RNA, 64 nt, hsa
gaagagaguagaaacccuagggagcagugcuuuuggguccuagaaccuguugaguuucuaauga

SEQ ID NO: 79022 - RNA, 64 nt, hsa
uauggcagaugucacagcuuuagguagguaaaaaggguccuagaugaaaaccuuggaguuuuuu

SEQ ID NO: 79023 - RNA, 64 nt, hsa
ugcauucugaaauugacuuaaaaauuuuuaguguggguccuaaaguuuagagaugggcaaggag

SEQ ID NO: 79024 - RNA, 64 nt, hsa
ugggagagagcugugugcagaagucuggaaaccuggguccuagucccagcucuuccaugggauc

SEQ ID NO: 79025 - RNA, 64 nt, hsa
uaauguagaauuccugugguuacauaugcaaguaggguccuauuauguuuuuuuuucaguagug

SEQ ID NO: 79026 - RNA, 64 nt, hsa
ccucagcugacucacagagcugcagagccaggcuggguccuaacaacucucucuagcauuuccg

SEQ ID NO: 79027 - RNA, 64 nt, hsa
gccuuggugggggagccucuggaaugcauggggcggguccuagcuguuagggacauuuccaagc

SEQ ID NO: 79028 - RNA, 64 nt, hsa
agcuucuggaauagacaguuccuucugguuagauggguccuaccauguggcaggaaacagccau

SEQ ID NO: 79029 - RNA, 64 nt, hsa
aaaugaaauugccagaaagauauaaaacugguuaggguccuacagggaaauaaaauuauaaccg

SEQ ID NO: 79030 - RNA, 64 nt, hsa
ucaaacuguagggucacuuuugauugaggcaaagggguccuacuguaaguggaaaagacucacu

SEQ ID NO: 79031 - RNA, 64 nt, hsa
ccccccaaguggagggaacagauccuggccugagggguccuagccuggagcaggcgccugcgcc

SEQ ID NO: 79032 - RNA, 64 nt, hsa
uggcagccagccauagguuguuucuuugucuuccggguccuaaagagcacagagaaaauggagg

SEQ ID NO: 79033 - RNA, 64 nt, hsa
ucagggagccugucccuuuauguucccaaauaaaggguccuagaagacuagaaagccaaggucu

SEQ ID NO: 79034 - RNA, 64 nt, hsa
ccagccugggaccaagggauguggaguccaggcuggguccuagaaucagggcauaacuaagggg

SEQ ID NO: 79035 - RNA, 64 nt, hsa
uguugaggugggugggccugacuguugccccccaggguccuaaaacuuggauggacuuguauag

SEQ ID NO: 79036 - RNA, 64 nt, hsa
cuccucccugggacaauagugugcaugccacccgggguccuacaggcaggugcugggaaaggcc

SEQ ID NO: 79037 - RNA, 64 nt, hsa
auagaccaugcauuuuugaaguuaguguccacuaggguccuauuaacuguacauuugcaagauu

SEQ ID NO: 79038 - RNA, 64 nt, hsa
cagcagcgcacacaguggagggaugaggauggauggguccuaaccccugauuuugaugggaugu

SEQ ID NO: 79039 - RNA, 64 nt, hsa
ugucuuucuuggccccugucucucuccauguuggggguccuaacucccccaccccauaucuacg

SEQ ID NO: 79040 - RNA, 64 nt, hsa
ggaggccaccguuaccaacugaagcugggggccuggguccuacccugucuggucaugaccccau

SEQ ID NO: 79041 - RNA, 64 nt, hsa
cacugaacaucauguuuguagacgcugacaggugggguccuaaugagagccaacacaugcucac

SEQ ID NO: 79042 - RNA, 64 nt, hsa
cuuauuguggcugauauuaacugucaaugguuauggguccuauaaaaaugccccucccagauaa

SEQ ID NO: 79043 - RNA, 64 nt, hsa
ggggggcagggaaggggaacacagauuucuuuggggguccuagaccccaugccagccauuguaa

SEQ ID NO: 79044 - RNA, 64 nt, hsa
ucaagcuuuuaaaauugacccugaacgugugacaggguccuaugguguuacucaaagcugugca

SEQ ID NO: 79045 - RNA, 64 nt, hsa
gacagacccugcaguccuacuacagucuggagugggguccuaagaagaagggucccaccucaac

SEQ ID NO: 79046 - RNA, 64 nt, hsa
agguggcccugugggcugaggguaaggcuggguaggguccuaacagugcuccuuguccaucccu

SEQ ID NO: 79047 - RNA, 64 nt, hsa
gggcagggggcacuugagcugggcuggggcucagggguccuaacccuuuaggcagugacauggc

SEQ ID NO: 79048 - RNA, 64 nt, hsa
uggcuacugcacucuccacugggaccugacugugggguccuagaugccaaagggguuccccugc

SEQ ID NO: 79049 - RNA, 64 nt, hsa
agagagucacagguaccccaaggaguagaugccaggguccuaaguugaaaaugaugucgauugg

SEQ ID NO: 79050 - RNA, 64 nt, hsa
uacauuggcaagauaaauaguugucauauuuguuggguccuauucuacuguugauaguuuuaau

SEQ ID NO: 79051 - RNA, 64 nt, hsa
cuguugacuucccauugcucuuggagccaccaaucaaagagauucaaagagauuccugcaggcc

SEQ ID NO: 79052 - RNA, 64 nt, hsa
cccauugcucuuggagccaccaaucaaagagauucaaagagauuccugcaggccagaggcggaa

SEQ ID NO: 79053 - RNA, 64 nt, hsa
acacugucauuuaaggcugugcuugugcuuuauacaaagagaaagagguggucuuaaggggaug

SEQ ID NO: 79054 - RNA, 64 nt, hsa
uucugaugcauuaauaaaagcagccaaauagggccaaagagaaaaauaacaggacucuguacug

SEQ ID NO: 79055 - RNA, 64 nt, hsa
ccuggcugccuggccguggcuucucuuuggcucccaaagagaaggacaguguugggaguaucug

SEQ ID NO: 79056 - RNA, 64 nt, hsa
uugggaguaucugccguggcuucucuuuggcucccaaagagaaggacaguguugggaguaucug

SEQ ID NO: 79057 - RNA, 64 nt, hsa
guaguguccaccuuacucaacaucagaaaauucacaaagagaugcccuguaaguguacuguaug

SEQ ID NO: 79058 - RNA, 64 nt, hsa
gagcacaucuaguucaacaucagagcauucauaccaaagagaacucaugaauguaaugaagaug

SEQ ID NO: 79059 - RNA, 64 nt, hsa
uuucaaagucuguuuaauugccuauuacuucucucaaagagaaccugaagucagaacacaugag

SEQ ID NO: 79060 - RNA, 64 nt, hsa
guagcguaagagcugaguauaguaaguccucuuccaaagagauggcaauaugcugggcaucuac

SEQ ID NO: 79061 - RNA, 64 nt, hsa
gcauguacuguaugggaggaugauccagauguuucaaagagaauuucucuuaguuuaguuaggu

SEQ ID NO: 79062 - RNA, 64 nt, hsa
uauuagaaagcauuuucuagguguguuuaguguacaaagagacuuuauaacccuuacuggacaa

SEQ ID NO: 79063 - RNA, 64 nt, hsa
aggagcaggagacugaaaucgauauuaauuccugcaaagagaccuccucacccuggugcuuaug

SEQ ID NO: 79064 - RNA, 64 nt, hsa
uucuucugacuuagaauauaagucucgccaucgucaaagagaaacuuugaaggagcaggagacu

SEQ ID NO: 79065 - RNA, 64 nt, hsa
gccuaccauccccggaagggugcuuauucuuuaacaaagagaaucuaaaaaaaaaaacaaaaaa

SEQ ID NO: 79066 - RNA, 64 nt, hsa
uaauaaagccaauuguauuguauugauaauuggacaaagagagagaaagaaagaaggaaggaag

SEQ ID NO: 79067 - RNA, 64 nt, hsa
ugagggagagacucugaggacauggagagagacucaaagagacuccaagauucaaagagacuaa

SEQ ID NO: 79068 - RNA, 64 nt, hsa
gacauggagagagacucaaagagacuccaagauucaaagagacuaauagagacacagagaugga

SEQ ID NO: 79069 - RNA, 64 nt, hsa
ugucccagaacauuucugugcuuaauuacccaaccaaagagaucugaaguauguaugucguacu

SEQ ID NO: 79070 - RNA, 64 nt, hsa
uuauauacucaauaugguuuuacugugccuuacacaaagagaaacucuauacagaauguauauc

SEQ ID NO: 79071 - RNA, 64 nt, hsa
uuuuguuaaaucuagaaacaugaaauuaguauuccaaagagauucugaaauuucuuuucuuggg

SEQ ID NO: 79072 - RNA, 64 nt, hsa
gacauuuaaaggauuaaaacugagauuugaacaacaaagagaaaggcaagauaaucccaaacuu

SEQ ID NO: 79073 - RNA, 64 nt, hsa
agccgucaaguaguaagaagaacuuggaugccagcaaagagaauggggcugggcagaucuguga

SEQ ID NO: 79074 - RNA, 64 nt, hsa
uggaaaccacagugaagaagacagcacugaugaccaaagagaagacacucauauuaagccuauu

SEQ ID NO: 79075 - RNA, 64 nt, hsa
gaugcugguagugaugcuggcuguucggauaugccaaagagaaaccguaaggugcuuccuuuaa

SEQ ID NO: 79076 - RNA, 64 nt, hsa
gcagacuccugccagauggggcagguaguuuauucaaagagaacucuguaucccauaggcccag

SEQ ID NO: 79077 - RNA, 64 nt, hsa
cuugacagacucacucggccucacuucauccuugcaaagagaauccuguacuucauccuugcaa

SEQ ID NO: 79078 - RNA, 64 nt, hsa
auccuugcaaagagaauccuguacuucauccuugcaaagagaauccuguacuucacucagaaug

SEQ ID NO: 79079 - RNA, 64 nt, hsa
uugcuugcaauguugguuuggcuauucauuugcacaaagagacuguggcucucuguugugagau

SEQ ID NO: 79080 - RNA, 64 nt, hsa
auguuuuaugcucaccauuaugaauuggggucuucaaagagagaagguugaaaguggaaagcac

SEQ ID NO: 79081 - RNA, 64 nt, hsa
cagugggaauagcagcuuguaguauugaaauaaucaaagagauaauuucagcucuuacaacaag

SEQ ID NO: 79082 - RNA, 64 nt, hsa
agucuuuuuugcaaucuugaacuuucauuagcuucaaagagaagcuguauuuacaggagaaaga

SEQ ID NO: 79083 - RNA, 62 nt, hsa
caacauggucaucauguuuucuauaugguuuuuccagcuagcaguacucccuuccauaccug

SEQ ID NO: 79084 - RNA, 62 nt, hsa
cuucacucccaucaucaucuauuuucacacuauccagcuaagcaaagauuccuggaggcuga

SEQ ID NO: 79085 - RNA, 62 nt, hsa
uaguagggagugggagggcuuauauugguuuuuccagcuauuaaggggacauauugugucgu

SEQ ID NO: 79086 - RNA, 62 nt, hsa
aaaaauuaggcaugguggugcaugccuguaguuccagcuacuugggaggcugagacaggcga

SEQ ID NO: 79087 - RNA, 62 nt, hsa
uuuucugugccauuuuaaauuuaacuuugacauccagcuauagacagaaauaauaagccacc

SEQ ID NO: 79088 - RNA, 62 nt, hsa
ggggccuggggccuccuugccuggcuucuuccuccagcuauccucagggaagcuggagauuc

SEQ ID NO: 79089 - RNA, 62 nt, hsa
uccuggacuaagccaaugacaccuuccaucuuuccagcuauggugacuggguuagguaugau

SEQ ID NO: 79090 - RNA, 62 nt, hsa
gccauggucacgagucauuucugccugacugcuccagcuaacuuccagggucucagcaaacu

SEQ ID NO: 79091 - RNA, 62 nt, hsa
auuagccaggcaugguggugggugccuguaguuccagcuacuugggaggcugaggugggaaa

SEQ ID NO: 79092 - RNA, 64 nt, hsa
agaacauccauaauuuggggcccugaguuuuacccagacucaaggaguugguaaaggguuaaua

SEQ ID NO: 79093 - RNA, 64 nt, hsa
gccaagggcaggaccaauggcugagccucguguccagacucagagggcuggauuuugguucccu

SEQ ID NO: 79094 - RNA, 64 nt, hsa
cccggccccgcuccugcccauuccucugucccugcagacucagugcagcacuuccacaccaaga

SEQ ID NO: 79095 - RNA, 64 nt, hsa
cccugggcgggcagcagcuccccaucuucucuggcagacucagcccacugccuugccagucuug

SEQ ID NO: 79096 - RNA, 64 nt, hsa
cugcaccucggaaaaauaccaacucagugaaauacagacucaaguuucgcuuuggauaauauuc

SEQ ID NO: 79097 - RNA, 64 nt, hsa
ucuccugccucagccucccaaguagcugggauuacagacucaugccaccacgccagcuaauuuu

SEQ ID NO: 79098 - RNA, 64 nt, hsa
gucaggcuccaccgcacagaagagccacagucuccagacucauggcguucccuccagaacuccc

SEQ ID NO: 79099 - RNA, 64 nt, hsa
gcucccagugcuauucaggguccuuucuugaggccagacucaucaccaucuacuauugauuuua

SEQ ID NO: 79100 - RNA, 64 nt, hsa
ucgauggccagcauuacccuuuaccugugggcaucagacucagcgugggcugagugcugagugu

SEQ ID NO: 79101 - RNA, 64 nt, hsa
acaaacuuguucaaccaucaccacuaucuaauuccagacucacgcuuuuuuaaacaauaaaugu

SEQ ID NO: 79102 - RNA, 64 nt, hsa
acccaggcuagagugcaauggcaccaucuuggcucacugcaaccucuaccuccuggguucaagc

SEQ ID NO: 79103 - RNA, 64 nt, hsa
caccaggcuggagugcagugccgcaaucucggcucacugcaaccuccgccucccagguucaagc

SEQ ID NO: 79104 - RNA, 64 nt, hsa
acccaggcugcagugcaauggcgcgaucucagcucacugcaaccuccaccuccggguucaagcg

SEQ ID NO: 79105 - RNA, 64 nt, hsa
ugccagacuggagugcaguggcacgaucucggcucacugcaaccucugccucccggguucaagc

SEQ ID NO: 79106 - RNA, 64 nt, hsa
agccaggcuggagugcaguggcauaaucucagcucacugcaaccucugcuucccggguucaagc

SEQ ID NO: 79107 - RNA, 64 nt, hsa
gcccaggcuggaguguaguggcgcagucucagcucacugcaaccuccaccucccggguucaagu

SEQ ID NO: 79108 - RNA, 64 nt, hsa
auuuugacaguucuacugauccguaaaugauaaccacugcaaauuuuuucaguauaaaauuuuu

SEQ ID NO: 79109 - RNA, 64 nt, hsa
uaaccacugcaaauuuuuucaguauaaaauuuuucacugcaaaaaaauuucaguagaaaauaag

SEQ ID NO: 79110 - RNA, 64 nt, hsa
gcccaggcuggagugcguuggcguggucuuggcucacugcaaccucugccuccuugguucaagc

SEQ ID NO: 79111 - RNA, 64 nt, hsa
gcgcaggguggagugcgguggcacgaucucggcucacugcaaccucugccuccugggugcaagc

SEQ ID NO: 79112 - RNA, 64 nt, hsa
acucaggcuggagugcagugguacgaucuuggcucacugcaaccuccaccucccggguucaagc

SEQ ID NO: 79113 - RNA, 64 nt, hsa
acccaggcuggagugcuguggugugaucuuagcucacugcaaccuccgccucccagguucaagc

SEQ ID NO: 79114 - RNA, 64 nt, hsa
gcccaggcuggagugcaguggcgcgaacucggcucacugcaaccuccgccuccuggguucaagc

SEQ ID NO: 79115 - RNA, 64 nt, hsa
cccaggcugggggugcaauggcgcaaucuuugcucacugcaaccccugccucccgggcucaagc

SEQ ID NO: 79116 - RNA, 64 nt, hsa
uugaaaaauggcauucacucuuacagaugguguucacugcaagccccagaagcauauggcaugu

SEQ ID NO: 79117 - RNA, 64 nt, hsa
ccccaagcuggaguacaaugacaggaucucggcucacugcaagcucugccucccggguucaagc

SEQ ID NO: 79118 - RNA, 64 nt, hsa
acccaggcuggagugcaguggugcgaucucggcucacugcaagcuccgccucccggguucucac

SEQ ID NO: 79119 - RNA, 64 nt, hsa
caggcuggagugcaauggugcaaugaccucggcucacugcaaccucugccuccuggguucaagu

SEQ ID NO: 79120 - RNA, 64 nt, hsa
acccaggcuggagugcaauggcgcaaucucagcucacugcaaccucugccucccggguucaagc

SEQ ID NO: 79121 - RNA, 64 nt, hsa
gcccaggcuggagugcaguggcgugaucuuggcucacugcaaccucugccucccagcuucaagc

SEQ ID NO: 79122 - RNA, 64 nt, hsa
acccaggcuggagagcaguggcgugaucucggcucacugcaagcuccgccucccggguucacgc

SEQ ID NO: 79123 - RNA, 64 nt, hsa
acccaggcuggaaugcaauggcaccaucuuggcucacugcaaccucugcuuccuggguucaagu

SEQ ID NO: 79124 - RNA, 64 nt, hsa
acccaggcuagagugcgguggugugaucuuggcucacugcaaccucccccuccuggguucaagc

SEQ ID NO: 79125 - RNA, 64 nt, hsa
gcucaggcuggagugcaguggugcaaucuuggcucacugcaaccuacaccucccggguucaagu

SEQ ID NO: 79126 - RNA, 64 nt, hsa
gcucgcgcuggagugcaguggcaugaucucggcucacugcaagcuccgccucccagguucaugc

SEQ ID NO: 79127 - RNA, 64 nt, hsa
acccaggcuggaaugcaguggugugaucuuggcucacugcaaccuccacuucccggguucaagc

SEQ ID NO: 79128 - RNA, 64 nt, hsa
gccuaggcuggagugcaguggcgcaaucucggcucacugcaaccucugccuccugggcucaagc

SEQ ID NO: 79129 - RNA, 64 nt, hsa
caaacaguggcccccugcauuaguuuucuguugccacugcaaccuauuacuugguagcuuaaaa

SEQ ID NO: 79130 - RNA, 64 nt, hsa
caggcuggaggagugcaguggugugaucucagcucacugcaaccuccaccucccagguucaagc

SEQ ID NO: 79131 - RNA, 64 nt, hsa
gcccaggcuggaacgcaguggugacaucucggcucacugcaaccuccaccucccagguucaagu

SEQ ID NO: 79132 - RNA, 64 nt, hsa
gcccaggcuggagugcaguggcgcgaucucagcucacugcaaccuccgccucccagguucaagc

SEQ ID NO: 79133 - RNA, 64 nt, hsa
uaaauaaaccccuaauuagccuuagaagaaaaaccacugcaagauauuaagcguguguaaaugg

SEQ ID NO: 79134 - RNA, 64 nt, hsa
aaagcagggaggaaaccucugcagcucauucugccacugcaaagcugguguagccaugcuggug

SEQ ID NO: 79135 - RNA, 64 nt, hsa
uccuucacaccccuuccaaaagucagucacagaccacugcaacaugccuucccugcuggaucau

SEQ ID NO: 79136 - RNA, 64 nt, hsa
acccaggcuggagugcaguggcguagucucggcucacugcaagcuccgccucccggguucacgc

SEQ ID NO: 79137 - RNA, 64 nt, hsa
cgauaaccugaacuaauuuguucuuauuuuuugccacugcaaacauauaucuacagagagaaaa

SEQ ID NO: 79138 - RNA, 64 nt, hsa
guaagcuaagcaauaguuuauguccuacuagauacacugcaaacuacaguggggauuuuaucug

SEQ ID NO: 79139 - RNA, 64 nt, hsa
acacaggcuggaaugcagugaugccaucucagcucacugcaaccuccaccuccuggguucaagu

SEQ ID NO: 79140 - RNA, 64 nt, hsa
gcccaggcuggaguacaguggcgcgaucucagcucacugcaagcuccgccucccaaguucacuc

SEQ ID NO: 79141 - RNA, 64 nt, hsa
acccaggcuggaguguaguggcaugaucugggcucacugcaaccuccuccuccuggauucaagc

SEQ ID NO: 79142 - RNA, 64 nt, hsa
gcccaggcuggagugcaguggcucgaucucggcucacugcaagcuccgccucccggguucacgc

SEQ ID NO: 79143 - RNA, 64 nt, hsa
gcugaggcuggagugaaauggcaugaucucagcucacugcaaccuccgucucuuagguucaagc

SEQ ID NO: 79144 - RNA, 64 nt, hsa
ugcucugcuggagugcgguggugcaaucucggcucacugcaaccuccaccucccagguucaagc

SEQ ID NO: 79145 - RNA, 64 nt, hsa
acccaggcuagagugcaauggcacgaucucggcucacugcaagcucugcguccuggguugacgc

SEQ ID NO: 79146 - RNA, 64 nt, hsa
gcccaggcuggagugcaguggcgcgaucucgacucacugcaagcuccgccucccggguucacgc

SEQ ID NO: 79147 - RNA, 64 nt, hsa
gccagggcuguagugcaguggugugaucauagcucacugcaaccuccaccucccaggcucaagc

SEQ ID NO: 79148 - RNA, 64 nt, hsa
caggacuacacacuuguauauacauucuugagaacacugcaaugugaaaaucacguuugcuauu

SEQ ID NO: 79149 - RNA, 64 nt, hsa
gcccaggcuggagugcaguggcgcgaucucggcucacugcaaccucugcccccuggguucaagc

SEQ ID NO: 79150 - RNA, 64 nt, hsa
ugcccgggcuggaaugcaauggcgcgauucagcucacugcaaucuccgccucccggguucaagu

SEQ ID NO: 79151 - RNA, 64 nt, hsa
guccaggcuggagugcaguggcgcgaucuaggcucacugcaaccuccuucucccagguucaagc

SEQ ID NO: 79152 - RNA, 64 nt, hsa
gcggggaaggucucuccuggacacgcccguugcccacugcaaguucucuccaggugcaauugaa

SEQ ID NO: 79153 - RNA, 64 nt, hsa
gcucaggcuggaguacaguggcauaaucacagcucacugcaaccucaauccugggcucaaguga

SEQ ID NO: 79154 - RNA, 64 nt, hsa
ccccaggcuggagugcaguggcucgaucucugcucacugcaagcuccgccuccuggguucaugc

SEQ ID NO: 79155 - RNA, 64 nt, hsa
gcccaggcuugagugcaguggcgcgaucucggcucacugcaagcucugucuccuggguucaugc

SEQ ID NO: 79156 - RNA, 64 nt, hsa
ugccaggcuggagugcgguggugcaaucucagcucacugcaaucuccaccuccuggguucaaga

SEQ ID NO: 79157 - RNA, 64 nt, hsa
guaacuuggccagaugcuccagcauaugcacguucacugcaaagcacccuacugguuuugaaaa

SEQ ID NO: 79158 - RNA, 64 nt, hsa
auggagaucgauuugauuuguuuauaagcagacacacugcaauuuacaaagaucucuuuacggu

SEQ ID NO: 79159 - RNA, 64 nt, hsa
gcccagcccagaguacaguggcacuaucucagcucacugcaaucuccgccucccugguucaagu

SEQ ID NO: 79160 - RNA, 64 nt, hsa
acccaggcuggagugcuguggugcaaucucggcucacugcaaccucugccucccgaguucaagc

SEQ ID NO: 79161 - RNA, 64 nt, hsa
auuaagaguggcuggcagaguaggcagaaaaagacacugcaaauggcauaaaaauuaaaguccu

SEQ ID NO: 79162 - RNA, 64 nt, hsa
gcccaggcuggagugcaguggcacgaucucggcucacugcaaccuccgccucccaaguucaagc

SEQ ID NO: 79163 - RNA, 64 nt, hsa
acugaggcuggagugcaguggcgcaauuucagcucacugcaaccucugccucccagguucaagc

SEQ ID NO: 79164 - RNA, 64 nt, hsa
acccagacuggagugcaguggcgcgaucucggcucacugcaagcucagccuccccgauucacgc

SEQ ID NO: 79165 - RNA, 64 nt, hsa
accccccaucugucucuuccuccuaauuaagggccacugcaaagagagacgggcuggcuaaccc

SEQ ID NO: 79166 - RNA, 64 nt, hsa
cagagguugcagugaacugagauagugauagugccacugcaauucagccugggugacauagaga

SEQ ID NO: 79167 - RNA, 64 nt, hsa
acccagguuggagugccauggcaugaucuuggcucacugcaaccuccaccuccugggucaagcc

SEQ ID NO: 79168 - RNA, 64 nt, hsa
gcccaggcuggagugcaguggcacaaucucagcucacugcaagcuccgccuccuggguucacgc

SEQ ID NO: 79169 - RNA, 64 nt, hsa
acccgggcuggagugcaguggcgugaucucggcucacugcaacuuccaccuccuggguuccagc

SEQ ID NO: 79170 - RNA, 64 nt, hsa
aaugcacugauguuuucauaauguuuaagggacccacugcaagaagcuugcugccuccuuuuaa

SEQ ID NO: 79171 - RNA, 64 nt, hsa
acccaggcuggagugcaauggcaugaucucagcucacugcaaccuucgccuccuggguucaagc

SEQ ID NO: 79172 - RNA, 64 nt, hsa
gcccaggcuggagugcaguggcaugaucucggcucacugcaacuucugccucccagguucaagc

SEQ ID NO: 79173 - RNA, 64 nt, hsa
cccaggcuguguagugcagugguugaucuuggcucacugcaaccucugccuccuagauucaagc

SEQ ID NO: 79174 - RNA, 64 nt, hsa
gcccaggcuggagggcaauggcgcgaucucagcucacugcaaccuccgucuccuggguucuuga

SEQ ID NO: 79175 - RNA, 64 nt, hsa
gcccaggcuggaguacaauggugcgaucuuggcucacugcaaccuccaccuccuggguucaagc

SEQ ID NO: 79176 - RNA, 64 nt, hsa
gucacccaggcuggagugcaguggugcgaucgcucacugcaaccucagccuccuggauuuaagu

SEQ ID NO: 79177 - RNA, 64 nt, hsa
acccaggcuggagugcaguggcgugaucuuggcucacugcaaccucugccuccuggguucaagc

SEQ ID NO: 79178 - RNA, 64 nt, hsa
cuuuggaaaacuauugaagauugcuaaaaaauaccacugcaaagugauggaaaaggguggagaa

SEQ ID NO: 79179 - RNA, 64 nt, hsa
acccagguuggagugcaguggcgugaucucagcucacugcaaccuccaccucgcagguucaagc

SEQ ID NO: 79180 - RNA, 64 nt, hsa
uccuaagcuggagugcaguggcaucaucucagcucacugcaaccucugccucccagguucaagu

SEQ ID NO: 79181 - RNA, 64 nt, hsa
gcccaggcuggagugcaguggugcgaucuuggcucacugcaaccucugccuccuggguucaagc

SEQ ID NO: 79182 - RNA, 64 nt, hsa
accugagcucuagugcaguagugcaaucacagcucacugcaaccuuacuccuaggcucaaguua

SEQ ID NO: 79183 - RNA, 64 nt, hsa
gcccaggcuggaaugcaguugugagaucucggcucacugcaagcuccgccucccggguucacgc

SEQ ID NO: 79184 - RNA, 64 nt, hsa
acccaggcuggagugcaguggcaugauuucggcucacugcaaccucugucuccuggguucaaac

SEQ ID NO: 79185 - RNA, 64 nt, hsa
uguggucacccaugcaucuuccacuggaacguuucacugcaaacacaccuuggagaaguggcau

SEQ ID NO: 79186 - RNA, 64 nt, hsa
ggaccgagguucccacucugggcaaagccccucacacugcaagggauuguagauaacacugacu

SEQ ID NO: 79187 - RNA, 64 nt, hsa
uuucaguuugaaaauauuuuguugccuucaucuucacugcaauuuuguguaaauuucucaaaga

SEQ ID NO: 79188 - RNA, 64 nt, hsa
acccaggcuggagugcaguggugugaucucggcucacugcaaccucugccucccagguuccagc

SEQ ID NO: 79189 - RNA, 64 nt, hsa
aacagaagccuaguccuguucagagcagcacugucacugcaaguccagcccccuuugccagggg

SEQ ID NO: 79190 - RNA, 64 nt, hsa
acccaggcuggagugcaguggcgcgaucucggcucacugcaagcuccaccuccuggguucaugc

SEQ ID NO: 79191 - RNA, 64 nt, hsa
ggagcuggggcuggggcugcauucccuggagacucacugcaaguuccugcccaggaggcugagg

SEQ ID NO: 79192 - RNA, 64 nt, hsa
gcccaggcuggagugcaguggcgugaucucggcucacugcaagcucggccuccuggguucaaau

SEQ ID NO: 79193 - RNA, 64 nt, hsa
gcccaggcuggagugcaguggcgugaucucggcucacugcaaccuccacccccggggaucaagc

SEQ ID NO: 79194 - RNA, 64 nt, hsa
acccagguucgaguucaguggugccaucucuguccacugcaaccuccacauccuggguucaagu

SEQ ID NO: 79195 - RNA, 64 nt, hsa
ucccaggcuggagugcuauggugcaauuuuuguucacugcaaccucugccuuccaagaucaaga

SEQ ID NO: 79196 - RNA, 64 nt, hsa
gcccagguuggagugcaguggcgcaaucucggcucacugcaagcuccgccucccggguucacgc

SEQ ID NO: 79197 - RNA, 64 nt, hsa
acccaggcuggagugcaguggugugaucuuggcucacugcaaccuccgccuccuggguuccaac

SEQ ID NO: 79198 - RNA, 64 nt, hsa
cgccaggcuggagugcaguggcgcgaucuaggcucacugcaacuuccgccucccggguucaagc

SEQ ID NO: 79199 - RNA, 64 nt, hsa
gcucaggcuggagugccauggcgcgaucuuggcucacugcaaccucugccucccggguucaagu

SEQ ID NO: 79200 - RNA, 64 nt, hsa
ugccaggcuggagugcaguggcacaaucuuggcucacugcaaccuccacuucucagguucaagc

SEQ ID NO: 79201 - RNA, 64 nt, hsa
gcccaggcuggagugcaguggcgcgaucucagcucacugcaagcuccgccuccuggguucacgc

SEQ ID NO: 79202 - RNA, 64 nt, hsa
gcccaggccagagugcaguggcgcgaucucagcucacugcaagcucugccucccggguucaugc

SEQ ID NO: 79203 - RNA, 64 nt, hsa
gcccaggcuggagugcaguggcgugaucuuggcucacugcaacuuccgccuccuguguucaagc

SEQ ID NO: 79204 - RNA, 64 nt, hsa
guucugaaggugcccaggagcggcgaugcacucgcacugcaaaugccgcucucacguaugcgcc

SEQ ID NO: 79205 - RNA, 64 nt, hsa
uugaugggccuucagauuauuuccaguuuuuugccacugcaaacaauaaacauccuuguacaua

SEQ ID NO: 79206 - RNA, 64 nt, hsa
gcccaggcuggaguacaauggcacgaucuuggcucacugcaaccuccgccucccggguucaagc

SEQ ID NO: 79207 - RNA, 64 nt, hsa
gcccaggcuggagugcaguggcgccaucucggcucacugcaaccuccgccucccagguucaagc

SEQ ID NO: 79208 - RNA, 64 nt, hsa
gcccaggcuagagugcaguggcgugaucucggcucacugcaagcucugccucccguguucacac

SEQ ID NO: 79209 - RNA, 64 nt, hsa
caaagaaaagacauugaaagcucuauggauuauccacugcaaaguuuucuuuccaaaaucaggc

SEQ ID NO: 79210 - RNA, 64 nt, hsa
acccaggugggagugugguggcacaaucucggcucacugcaaccuccaccuccugaguucaagc

SEQ ID NO: 79211 - RNA, 64 nt, hsa
gcccaggcuggagugcagugucacgaucucagcucacugcaaccuccgccucccagguacaaga

SEQ ID NO: 79212 - RNA, 64 nt, hsa
gaccguccuugugacuuuuuaaagagguggggcucacugcaacuggggagaacacuuagcauau

SEQ ID NO: 79213 - RNA, 64 nt, hsa
acccaggcuggagugcaguggugugaucucggcucacugcaaccuccaccucccggauucaagu

SEQ ID NO: 79214 - RNA, 64 nt, hsa
gugcaggcuggagugcaguggcacagucuuggcucacugcaaccuccaccuccuggguucaagc

SEQ ID NO: 79215 - RNA, 64 nt, hsa
gugcaggcuguagugcaguggcacgaucuuggcucacugcaaccuccaccucccggguucaagc

SEQ ID NO: 79216 - RNA, 64 nt, hsa
ugccaggcuggagugcaguggcgcaaucuuggcucacugcaaccuccgccucccagguucaggc

SEQ ID NO: 79217 - RNA, 64 nt, hsa; identical to SEQ ID NO: 68416

SEQ ID NO: 79218 - RNA, 64 nt, hsa; identical to SEQ ID NO: 68417

SEQ ID NO: 79219 - RNA, 64 nt, hsa; identical to SEQ ID NO: 68418

SEQ ID NO: 79220 - RNA, 64 nt, hsa; identical to SEQ ID NO: 68419

SEQ ID NO: 79221 - RNA, 64 nt, hsa; identical to SEQ ID NO: 68420

SEQ ID NO: 79222 - RNA, 64 nt, hsa; identical to SEQ ID NO: 68421

SEQ ID NO: 79223 - RNA, 64 nt, hsa; identical to SEQ ID NO: 68422

SEQ ID NO: 79224 - RNA, 64 nt, hsa; identical to SEQ ID NO: 68423

SEQ ID NO: 79225 - RNA, 64 nt, hsa; identical to SEQ ID NO: 68424

SEQ ID NO: 79226 - RNA, 64 nt, hsa; identical to SEQ ID NO: 68425

SEQ ID NO: 79227 - RNA, 64 nt, hsa; identical to SEQ ID NO: 68426

SEQ ID NO: 79228 - RNA, 64 nt, hsa; identical to SEQ ID NO: 68427

SEQ ID NO: 79229 - RNA, 64 nt, hsa; identical to SEQ ID NO: 68428

SEQ ID NO: 79230 - RNA, 64 nt, hsa; identical to SEQ ID NO: 68429

SEQ ID NO: 79231 - RNA, 64 nt, hsa; identical to SEQ ID NO: 68430

SEQ ID NO: 79232 - RNA, 64 nt, hsa; identical to SEQ ID NO: 68431

SEQ ID NO: 79233 - RNA, 64 nt, hsa; identical to SEQ ID NO: 68432

SEQ ID NO: 79234 - RNA, 64 nt, hsa; identical to SEQ ID NO: 68433

SEQ ID NO: 79235 - RNA, 64 nt, hsa; identical to SEQ ID NO: 68434

SEQ ID NO: 79236 - RNA, 64 nt, hsa; identical to SEQ ID NO: 68435

SEQ ID NO: 79237 - RNA, 64 nt, hsa; identical to SEQ ID NO: 68436

SEQ ID NO: 79238 - RNA, 64 nt, hsa; identical to SEQ ID NO: 68437

SEQ ID NO: 79239 - RNA, 64 nt, hsa; identical to SEQ ID NO: 68438

SEQ ID NO: 79240 - RNA, 64 nt, hsa; identical to SEQ ID NO: 68439

SEQ ID NO: 79241 - RNA, 64 nt, hsa; identical to SEQ ID NO: 68440

SEQ ID NO: 79242 - RNA, 64 nt, hsa; identical to SEQ ID NO: 68441

SEQ ID NO: 79243 - RNA, 64 nt, hsa; identical to SEQ ID NO: 68442

SEQ ID NO: 79244 - RNA, 64 nt, hsa; identical to SEQ ID NO: 68443

SEQ ID NO: 79245 - RNA, 64 nt, hsa; identical to SEQ ID NO: 68444

SEQ ID NO: 79246 - RNA, 64 nt, hsa; identical to SEQ ID NO: 68445

SEQ ID NO: 79247 - RNA, 64 nt, hsa; identical to SEQ ID NO: 68446

SEQ ID NO: 79248 - RNA, 64 nt, hsa; identical to SEQ ID NO: 68447

SEQ ID NO: 79249 - RNA, 64 nt, hsa
agccuguuuguuuuaguauccaaggaagagaccaaggagccagcuggcgggaaggggugggggu

SEQ ID NO: 79250 - RNA, 64 nt, hsa
augaccuuuguuguaagucucccaacguccuauuaggagccacagcaggugaggcauuuggugc

SEQ ID NO: 79251 - RNA, 64 nt, hsa
uugcagaucccucuuuuccaguucuccuuccucuaggagccauguuauccucugucccccauag

SEQ ID NO: 79252 - RNA, 64 nt, hsa
gaguaaugggauugagcauuuauggcagcaacagaggagccacaaaauguucuuuguucuuugg

SEQ ID NO: 79253 - RNA, 64 nt, hsa
acuuuuccucagaguuucugccuugcgcugguccaggagccauuuugcaccaaggacuugguag

SEQ ID NO: 79254 - RNA, 64 nt, hsa
cuagggcagguagcacugaggcuccuguggaaacaggagccaccugcucaggagaccccuuucc

SEQ ID NO: 79255 - RNA, 64 nt, hsa
auuauuguacuaucccuguaacugccaagagcucaggagccaggcuagugaucacaccaggggu

SEQ ID NO: 79256 - RNA, 64 nt, hsa
uugugauaugucaccguaugccuuaggauguucaaggagccagacgaaauaaggccugucuucc

SEQ ID NO: 79257 - RNA, 64 nt, hsa
gcaugccugugggcuguccucccaggacaagccaaggagccaacgagggcucuggagcugugag

SEQ ID NO: 79258 - RNA, 64 nt, hsa
gguacauccgcccaccaugucccccugcugggucaggagccaacacaggacccugcgugugagc

SEQ ID NO: 79259 - RNA, 64 nt, hsa
ucacccugcugaagaucacucugugcccugggggaggagccaagcccucaccccacaaggggca

SEQ ID NO: 79260 - RNA, 64 nt, hsa
cauucuuuaacaggacaaacuuacugcagcuugaaggagccaaccauggauuugaggcguguga

SEQ ID NO: 79261 - RNA, 64 nt, hsa
gcccggcgcagugggaagcucgcagcagcuggggaggagccaaagccucggcgcucaccuaagc

SEQ ID NO: 79262 - RNA, 64 nt, hsa
agcagacacacacagggaugcucacgggugcaccaggagccaggugcggcgcagccaacccuga

SEQ ID NO: 79263 - RNA, 64 nt, hsa
augcccaggccugcccggugcccacccugcugguaggagccagcggcucuggccaagugcacga

SEQ ID NO: 79264 - RNA, 64 nt, hsa
cgucugcaagccacugcugagacccuucccagggaggagccacccaagagcugcacucuugugc

SEQ ID NO: 79265 - RNA, 64 nt, hsa
uaucccagccggauuuaaagcagucacuucagacaggagccacagggagccugugagggaguag

SEQ ID NO: 79266 - RNA, 64 nt, hsa
ggugccgucauugcuggcuuaaagacaaggggccaggagccaacaccagaggccacuccacaac

SEQ ID NO: 79267 - RNA, 64 nt, hsa
acuggguuucagggaaugggcaugccaggugccaaggagccaaacagauggcuuuccaggcagc

SEQ ID NO: 79268 - RNA, 64 nt, hsa
uuggugcagcugcagccaggaggggagcgggcccaggagccaggcucagguccagcugguuccu

SEQ ID NO: 79269 - RNA, 64 nt, hsa
ucgugccugcccugccucuccacgcacaguguuaaggagccaagaggagccacuucgcccagac

SEQ ID NO: 79270 - RNA, 64 nt, hsa
ccugccucuccacgcacaguguuaaggagccaagaggagccacuucgcccagacuuuguuuccc

SEQ ID NO: 79271 - RNA, 64 nt, hsa
acaggugcccaagaagauggaggaucccugugccaggagccaaccuggucuucccgagggucag

SEQ ID NO: 79272 - RNA, 64 nt, hsa
gcaaaaacccuccccaggaaggaggaggguguucaggagccagacuuuuggagagaaggcagcu

SEQ ID NO: 79273 - RNA, 64 nt, hsa
cgcugugauuaccaucaguccauuuuaccgaggaaggagccaagguccaggcccacugaaggac

SEQ ID NO: 79274 - RNA, 64 nt, hsa
uuuuaaagcuuuauaugccucaaauaucagggaaaggagccaaguccuugguauuuaguuuggu

SEQ ID NO: 79275 - RNA, 64 nt, hsa
gucacauaucaagucccgaggcagcaacaggaccaggagccagguguccugacuguccuacaau

SEQ ID NO: 79276 - RNA, 64 nt, hsa
uuuggacuccuuguuugccuuuaggcaggaagucaggagccagcagggcgggccaggagaaaga

SEQ ID NO: 79277 - RNA, 64 nt, hsa
gccgaacgcuucccugggcucccacugccuucuaaggagccaaggagaauucccugcccacuuu

SEQ ID NO: 79278 - RNA, 64 nt, hsa
uucucaguaggaacuuggaagggaagagcucugaaggagccagaggggcagccaccuugcauga

SEQ ID NO: 79279 - RNA, 64 nt, hsa
ggaacgcacucggugguggaggccccauguucccaggagccaagauucguagcauccuugaggc

SEQ ID NO: 79280 - RNA, 64 nt, hsa
aagccaggagugagaaggaauucagggagagcaaaggagccagugcugagaugcugcuguguug

SEQ ID NO: 79281 - RNA, 64 nt, hsa
gggagccgccaggccugcagcugggccagugcccaggagccauccuggcguggggccaggagcu

SEQ ID NO: 79282 - RNA, 64 nt, hsa
acccggggccuggggucucuguggugccugcagcaggagccaggaacgcccggcaggcaggcgc

SEQ ID NO: 79283 - RNA, 64 nt, hsa
aaggauauauaaggcacuguggugguuauucccgaggagccagagaaaccuggagaagagauca

SEQ ID NO: 79284 - RNA, 64 nt, hsa
aguucgagauuccuucacugucagaaugggcucaaggagccaucuuuugugauagguauugggg

SEQ ID NO: 79285 - RNA, 64 nt, hsa
agccagccacuggcuggacagggaagaagaccccaggagccaagcccaccccuucuuuguguag

SEQ ID NO: 79286 - RNA, 64 nt, hsa
acggagaugagccuggacccuggagaaggaggccaggagccagccacuggcuggacagggaaga

SEQ ID NO: 79287 - RNA, 64 nt, hsa
agagauccucuaccacagacauuaauagcugagcaggagccacauggauugauuguauccacuc

SEQ ID NO: 79288 - RNA, 64 nt, hsa
uacauagaaccaaggagcacucaaauagggagccaggagccagggagcuggugacacuugugug

SEQ ID NO: 79289 - RNA, 64 nt, hsa
uccugagggacucagcacaacaggauaagcguccaggagccacgggcucccaccccgagcauau

SEQ ID NO: 79290 - RNA, 64 nt, hsa
ggcccugugcccuccaaauucacaggggguaccuaggagccaggugggguacgacaggcugggg

SEQ ID NO: 79291 - RNA, 64 nt, hsa
auaguugaugagcuuaaaaaaauaaaaauagaaaauugcaaaaaaaaaaaaaaaaaaaaaucuc

SEQ ID NO: 79292 - RNA, 64 nt, hsa
guaguucuuauauaucccuauauauuauaucuauauugcaaaauuuugacugucagcuacaugu

SEQ ID NO: 79293 - RNA, 64 nt, hsa
aaugcugauuccaacaggacugaguuuugccagcauugcaaaggaauccaagugccuuucugua

SEQ ID NO: 79294 - RNA, 64 nt, hsa
aauaaaaccauagaacuaugaaaauaucaagauuauugcaaaaaucuuauuccaaacacaccug

SEQ ID NO: 79295 - RNA, 64 nt, hsa
uucuuuuuuauuaccagguccauuuugccugacaauugcaaaucagagcauacaaaauaaaacu

SEQ ID NO: 79296 - RNA, 64 nt, hsa
aacugaaauaaaaaauuauggauacguguuuugaauugcaaacuauuccucaggaauuccaauu

SEQ ID NO: 79297 - RNA, 64 nt, hsa
uucccagugcccucuguccauaccuacuucuaggauugcaaaggagucuuccaacuagagaaaa

SEQ ID NO: 79298 - RNA, 64 nt, hsa
uuuacuaagacaguaccuauuaggaaaaccaaauauugcaaauggucaauucgauuuuaauuuc

SEQ ID NO: 79299 - RNA, 64 nt, hsa
uaacuuucaucucuagggauguuuaacauuuauaauugcaaaauaaaccaacuauaaaaaaaga

SEQ ID NO: 79300 - RNA, 64 nt, hsa
caugcauauguacuacagagggauuuuuaaauuaauugcaaaaugugcauuagcuauugacuua

SEQ ID NO: 79301 - RNA, 64 nt, hsa
uauaacuuaugaaaaguacagugaauuuugcuuuauugcaaagcuuuaaauauaaauuucagag

SEQ ID NO: 79302 - RNA, 64 nt, hsa
auauugcaucucacucccacccuuaaaaccacagauugcaaagcauagcauuuuagcaucaacu

SEQ ID NO: 79303 - RNA, 64 nt, hsa
cacccauuccaaaugcaguuuauuuuuagacccgauugcaaauagugauguaguuuuaaccagu

SEQ ID NO: 79304 - RNA, 64 nt, hsa
aaggaacuguguacgccauuuauggcaugauuagauugcaaagcaaugaacucaagaaggaauu

SEQ ID NO: 79305 - RNA, 64 nt, hsa
ccguuuuuuuuuuuuuauuguuguuguuaauuuuauugcaaaguuguauucagcguacuugaau

SEQ ID NO: 79306 - RNA, 64 nt, hsa
uugaagaaugccaucucugacuauauggccuuguauugcaaagcggaucaguggcuggggugcc

SEQ ID NO: 79307 - RNA, 64 nt, hsa
cacuuugcacuucauagagaagguacauagagacauugcaaaaccugucuccauuugcuauccu

SEQ ID NO: 79308 - RNA, 64 nt, hsa
uaaaacauuuuucauaauuagugcuguacauuugauugcaaacaaauuggugauacuucuaaac

SEQ ID NO: 79309 - RNA, 64 nt, hsa
uguaagagcuuuaaaauauuuucacagauaaaaaauugcaaacaaguacucugguuaauaaaug

SEQ ID NO: 79310 - RNA, 64 nt, hsa
cuugaaagccacuugauccucaacauauacuauaauugcaaaggaaacaugaggccaucuuccc

SEQ ID NO: 79311 - RNA, 64 nt, hsa
aucaguuacuuccuauuuuuauccuuaaaagaccauugcaaaucaguguaaggguuuuuccagu

SEQ ID NO: 79312 - RNA, 53 nt, hsa
aagauauauuuuucauuugacauauugcaaaauuuucuuaggaaauuuguggg

SEQ ID NO: 79313 - RNA, 64 nt, hsa
ccucacauacugaucuaggauuuuaaauuauuucauugcaaaguaauugugucucuccuuucac

SEQ ID NO: 79314 - RNA, 64 nt, hsa
uaaaucaccuggaaggagagcauuacucaccaaaauugcaaaacaaggguaucaagaauuugug

SEQ ID NO: 79315 - RNA, 64 nt, hsa
gauuuuuauauugcccuccaagugguagaagaagauugcaaaguccauguuaugcuaggugcac

SEQ ID NO: 79316 - RNA, 64 nt, hsa
uugauuacuacuuuaagugauauucauuuaaaacauugcaaauuuauuuuauuuauuuaauuuu

SEQ ID NO: 79317 - RNA, 64 nt, hsa
auuacaggcuugagccaccacgcccggcuaaaacauugcaaauuuaaaugagaguuuuaaaaau

SEQ ID NO: 79318 - RNA, 64 nt, hsa
guuggucccuuugcuucuguugucaguguguugaauugcaaaccgaguacugcuguaaauacua

SEQ ID NO: 79319 - RNA, 64 nt, hsa
uccuccccuuucugucaauugguugucuuuaaauauugcaaaaguccugaugcuaaacaguauu

SEQ ID NO: 79320 - RNA, 64 nt, hsa
gagcuggaugccggguuccagaaucgcugcacaguuccaacaggacagcgccuucccccaugcg

SEQ ID NO: 79321 - RNA, 64 nt, hsa
gcuuucuuuggccucugacccugcugcccauucuuuccaacaucacagaugaacugccucuccu

SEQ ID NO: 79322 - RNA, 64 nt, hsa
acucaagggugguuuccuggcugcacggcaccuguuccaacaccuacugugccucucaucaggu

SEQ ID NO: 79323 - RNA, 64 nt, hsa
aggaaaugacugccuuccuugggaccaaggaccguuccaacagcauucacugccaguucuaaua

SEQ ID NO: 79324 - RNA, 64 nt, hsa
ccagggcucucugcuguagauuggcugugccagcuuccaacagguuacuggcaaugccagugag

SEQ ID NO: 79325 - RNA, 64 nt, hsa
gaauugguucauuuugcuuuacacaguagaucuguuccaacaguucuguguaaaccaaaugcua

SEQ ID NO: 79326 - RNA, 64 nt, hsa
aaagaugcacugccauauuaucuuucuuaacuuuuuccaacacauaauccucuccaacuggauu

SEQ ID NO: 79327 - RNA, 64 nt, hsa
gggcguuucccccaaugaaauacacaaguaaacauuccaacauugucuuuaggagugauuugca

SEQ ID NO: 79328 - RNA, 64 nt, hsa
ucccacaaggaauaaguuccaacaaaguaauaaauuccaacaaagcaacaaaucaaauaacuua

SEQ ID NO: 79329 - RNA, 51 nt, hsa
agaaaucccacaaggaauaaguuccaacaaaguaauaaauuccaacaaagc

SEQ ID NO: 79330 - RNA, 64 nt, hsa
caguacuaaaauuaaugcagauuucucuuuagccuuccaacauuucuuguugauagugauguau

SEQ ID NO: 79331 - RNA, 64 nt, hsa
gaucucuguuacaaaagaaaaaagcaaguacaaguuccaacaugcaauacuggucaacuuaagg

SEQ ID NO: 79332 - RNA, 64 nt, hsa
uuuagaacauagaguggcauggccgugcuggaaugacaaauaacuggcgugcuuuuuuuuugug

SEQ ID NO: 79333 - RNA, 64 nt, hsa
uaaggcuaacuccugaucguuucuguagaaagaugacaaauaaagaaaaaguuauaauuauuaa

SEQ ID NO: 79334 - RNA, 64 nt, hsa
gaguuggggagggagggaaugugggaggaauuaagacaaauauuucagacugguguaaaggaca

SEQ ID NO: 79335 - RNA, 64 nt, hsa
ggaauuaagacaaauauuucagacugguguaaaggacaaauaugacaacgacgucaaggacucg

SEQ ID NO: 79336 - RNA, 64 nt, hsa
aggauuauuugggaagcguaucaauaccuuuauagacaaauacgaacauguaugcacacaaaac

SEQ ID NO: 79337 - RNA, 64 nt, hsa
auauauuuucuucuaaaacuuauuaaauucgugugacaaauaaucauuuucaucuuggcagcaa

SEQ ID NO: 79338 - RNA, 64 nt, hsa
aguucuuaaauacuaccaacccugaacgucucaggacaaauaauucaaaaaagagaucuacauu

SEQ ID NO: 79339 - RNA, 64 nt, hsa
cauguaauauauagaauucuuugucuccauuugugacaaauauugugaauauuuucauguuugg

SEQ ID NO: 79340 - RNA, 64 nt, hsa
ccagggucauacgacgccauugccagaaugaagugacaaauaugaacagaagaaaaugguugcu

SEQ ID NO: 79341 - RNA, 64 nt, hsa
cccguuuccuuguccccuaauuauucaaggaagugacaaauauuguccagacaacuuacauaca

SEQ ID NO: 79342 - RNA, 64 nt, hsa
aguugaauaaguacuucauauuuuuccaucauuagacaaauacaaaauggacuaaauaauuuua

SEQ ID NO: 79343 - RNA, 64 nt, hsa
guaccaagugacugguggcccaauucuuuaaugggacaaauauuguuuccuauauauauguaua

SEQ ID NO: 79344 - RNA, 64 nt, hsa
gcuuuuccaguucuuagaaaauucuuuuuuuguagacaaauauucuauaaacuagaaucucuau

SEQ ID NO: 79345 - RNA, 64 nt, hsa
uaaauugauaaagacauuugugcauagcucaugagacaaauacugauuuaauauuuuauucuuu

SEQ ID NO: 79346 - RNA, 64 nt, hsa
gcuagcccuuaugaauauugaacuuaggaauugugacaaauauguaucugauauggucauuugu

SEQ ID NO: 79347 - RNA, 64 nt, hsa
cucccagaauccucagggcacugaggguaggucugacaaauaaggccugcugugcgaauauagc

SEQ ID NO: 79348 - RNA, 64 nt, hsa
uaagaaccugguguguuucuugggaucaugguacauuuaucacugaauuaagccaucagggaaa

SEQ ID NO: 79349 - RNA, 64 nt, hsa
ccccugugcuuggaaaccuuuuuuccuucuugacauuuaucaccucugauggcugaagaaugua

SEQ ID NO: 79350 - RNA, 64 nt, hsa
uuguauauuaaugaauuauccaagauucgaugggauuuaucaguguguagauagcucuauaaug

SEQ ID NO: 79351 - RNA, 64 nt, hsa
gucauuucuuauaaaaaacaaaacaacaacaauaauuuaucaaaauuggcauauuuaaagccua

SEQ ID NO: 79352 - RNA, 64 nt, hsa
uauucaugguauuuuaagagaucauuuguauauuauuuaucacacuguuguaaugauguuuuga

SEQ ID NO: 79353 - RNA, 64 nt, hsa
uagauguuuauuauuagaaaagauugcugagaguauuuaucagguuuuacaaagucauuuuaag

SEQ ID NO: 79354 - RNA, 64 nt, hsa
guuaaagguuuuuuuuuuuauauguauuaaaucaauuuaucacuguuuaaagcuuugaauaucu

SEQ ID NO: 79355 - RNA, 64 nt, hsa
auaaguuaaaugauugagaguuggcuguauuuagauuuaucacuuuuuaauagggugagcuuga

SEQ ID NO: 79356 - RNA, 64 nt, hsa
gcccugcuaaauaaugaaaaaacacuuuacuaaaauuuaucaaauuauacuggguucggauugu

SEQ ID NO: 79357 - RNA, 64 nt, hsa
uagcaguggugaggagugggagggcccagcaagcauuuaucagaaauagaaucacaauaggagg

SEQ ID NO: 79358 - RNA, 64 nt, hsa
caggccaaugcagcuaauuuugauagcugcauucauuuaucaccagcauauuguguucugagug

SEQ ID NO: 79359 - RNA, 64 nt, hsa
ugauauuucauuccuuuguuuacuaaagagacauauuuaucaguugcagauagccuauuuauua

SEQ ID NO: 79360 - RNA, 64 nt, hsa
ggccuauucauuauauguauauuuuuuuauaaauauuuaucaagaacaugaaaauauuuuauuu

SEQ ID NO: 79361 - RNA, 64 nt, hsa
cugucuucuuugaucauuugauuuuggauccaagauuuaucaucucucuauuuugcuauuugcc

SEQ ID NO: 79362 - RNA, 64 nt, hsa
uuaucaauggauuaagaaguuuaagauuuugcagauuuaucaauuuggguuuuuguacugaagu

SEQ ID NO: 79363 - RNA, 64 nt, hsa
uuuuacgguguuugaagaccagcuacuccuuaauauuuaucaauggauuaagaaguuuaagauu

SEQ ID NO: 79364 - RNA, 64 nt, hsa
auaaaaguugucauucuuaggaauuugguuugaaauuuaucaguuauacagaauugucauacug

SEQ ID NO: 79365 - RNA, 64 nt, hsa
uacuuuugaggcagccauuagguugaaaguauauauuuaucauauaaaacuugaugcguuuugc

SEQ ID NO: 79366 - RNA, 64 nt, hsa
uuuguuaucuguuguuaaguugaaauguauaaucauuuaucacuaaauugcacauugccuuuau

SEQ ID NO: 79367 - RNA, 64 nt, hsa
guaucugccacaguaaauuaaagcauuacacaguauuuaucaguauuuuuuaaacauccugucc

SEQ ID NO: 79368 - RNA, 64 nt, hsa
cuugaccugguguucuucaucauucuugcuauggauuuaucaauuuuguuccucuuuuccaaaa

SEQ ID NO: 79369 - RNA, 64 nt, hsa
uccaaacccauguauuagagaagaagggcgugaaauuuaucaccuaagcuuuccauucaggaag

SEQ ID NO: 79370 - RNA, 64 nt, hsa
ugauuuuucaaaauaaaagucaaucagcauuguuauuuaucauuaagguauugaacacuggauu

SEQ ID NO: 79371 - RNA, 64 nt, hsa
gcugcaaugccaaugauuguaagaaaacaaacaaauuuaucaugaaauucuccuugucauuuua

SEQ ID NO: 79372 - RNA, 64 nt, hsa
uaaaaagaaauucacugguucuuuacaaaauagaauuuaucaucaaguuauuacacaaacuuca

SEQ ID NO: 79373 - RNA, 64 nt, hsa
uuuucuaaguauauagaaagcuuguauaauucagauuuaucaauuuccugauuuaauguagacu

SEQ ID NO: 79374 - RNA, 64 nt, hsa
gcuugucaauuauguugugaaauuguuaguauucauuuaucaaaaaugaccuauguuuagucac

SEQ ID NO: 79375 - RNA, 64 nt, hsa
aaggcacaaaacaugagagaaaguguuguacagaauuuaucauggauuauugacugcugagaaa

SEQ ID NO: 79376 - RNA, 64 nt, hsa
uaaagcuauccagggcuuaaccuauaugaacucuauuuaucaugucuaaugcaugugauuuaau

SEQ ID NO: 79377 - RNA, 64 nt, hsa
uuuguuauaugcugcuuaauaaaguaagcuugaaauuuaucauuuuaucaugaaaacuucuuug

SEQ ID NO: 79378 - RNA, 64 nt, hsa
ucauacggaaaguguuugagagcaaguaguugacauuuaucagcaaaucucuugcaagaacagc

SEQ ID NO: 79379 - RNA, 64 nt, hsa
auaucucagauuguguagauaugcuauuuaaauaauuuaucaggaaauacugccuguagaguua

SEQ ID NO: 79380 - RNA, 64 nt, hsa
uaaacaugcaauuuaugaaaacauauaaacaauuauuuaucacuuuuaugacccaaaucacaau

SEQ ID NO: 79381 - RNA, 64 nt, hsa
uuggaaaacauaugugaugaaauugagcuauaugauuuaucagagaucugauuccaaagagcac

SEQ ID NO: 79382 - RNA, 64 nt, hsa
accaugaaaguguaaauacuguaaugccuaaucuauuuaucaaaacugacuacuggaccggagc

SEQ ID NO: 79383 - RNA, 64 nt, hsa
ucauuucacuaguggccgagacacccucucuggcauuuaucacuguuggccggugugaugagua

SEQ ID NO: 79384 - RNA, 64 nt, hsa
auuagugaaauuugaauuguaaacuugucagugaauuuaucacucugagcgagucucuagaggg

SEQ ID NO: 79385 - RNA, 64 nt, hsa
uaaaagaguuuaaacugaacuuuaaggugccuccauuuaucaaggguuaugaaacucagaaaau

SEQ ID NO: 79386 - RNA, 64 nt, hsa
ucaauuuugguuuuucucauuugaaauguuuuugauuuaucaauauuugugguuuaacuuugug

SEQ ID NO: 79387 - RNA, 64 nt, hsa
ugaaucugagaaaguacuuucugguggcaaaugaauuuaucauuuuaguauaguuuucgauaaa

SEQ ID NO: 79388 - RNA, 64 nt, hsa
ucauauacacagucuauacaaugaaauaaugaauauuuaucauauugauacaaacugugaccuc

SEQ ID NO: 79389 - RNA, 64 nt, hsa
cuaaauucagauccuuucuccacacagcaaugacauuuaucaaucugacucagguguggcuguu

SEQ ID NO: 79390 - RNA, 64 nt, hsa
gguucacugcagcuccugucacaagcugggauggauuuaucacauugaguuaugaaauuaccug

SEQ ID NO: 79391 - RNA, 64 nt, hsa
uuuccccaucaaugcugauucugagaaaagagcaauuuaucaaaauuaaacacuguaaaagaaa

SEQ ID NO: 79392 - RNA, 64 nt, hsa
auguggcuagguguagaaugauguugaaaccacaggcuaaaauguagaucuggaaguaucugug

SEQ ID NO: 79393 - RNA, 64 nt, hsa
cuagcugggauuacaggcacaagccaccaugccuggcuaaaauucuuuuguauuuuuacuacag

SEQ ID NO: 79394 - RNA, 64 nt, hsa
uugccuuuuuauaaaauugaagcuauagcuuuuaggcuaaaauuuuaacguagauauuuuuaua

SEQ ID NO: 79395 - RNA, 64 nt, hsa
aagguacccagaauuuuuagaagccuucagaagaggcuaaaauauccagcuuugggggaccugg

SEQ ID NO: 79396 - RNA, 64 nt, hsa
ggaauauugaagggccugacauggggaaagggaaggcuaaaaauacuuggucaaauuuuaacau

SEQ ID NO: 79397 - RNA, 64 nt, hsa
uuaugguauaacugggucccucaacaguaaccugggcuaaaauaggucuuaugugguucaacuc

SEQ ID NO: 79398 - RNA, 64 nt, hsa
gccuccagggccucuccuuggaaggucuuuugagggcuaaaaagguccuguaagaagcggcaua

SEQ ID NO: 79399 - RNA, 64 nt, hsa
gcaccucugagggagcagagagguggauccuguaggcuaaaaggcuuccaggcugagagccggc

SEQ ID NO: 79400 - RNA, 64 nt, hsa
agugcugggauuacaggcuugagccaccacgcccggcuaaaacauugcaaauuuaaaugagagu

SEQ ID NO: 79401 - RNA, 64 nt, hsa
ccucucuguggguuugucuugaccuggaaauuugggcuaaaacuuagaaaaaauucuuacauga

SEQ ID NO: 79402 - RNA, 64 nt, hsa
aggccuggaaaagaaccagaaggaggcugggcagaaccagaacaaccugcacuucugccaaggc

SEQ ID NO: 79403 - RNA, 64 nt, hsa
aagagagccuggaaaagaaccaggccuggaaaagaaccagaaggaggcugggcagaaccagaac

SEQ ID NO: 79404 - RNA, 64 nt, hsa
gcauauaguguuguauauuguaaauuguaauuucaaccagaaguaaauuuuuuucuuuugaagg

SEQ ID NO: 79405 - RNA, 64 nt, hsa
ugaccucacuggcccacuggcaaauccaaccagcaaccagaaauguucuaguguagagucugag

SEQ ID NO: 79406 - RNA, 64 nt, hsa
cuguauuuaggauaauuucaucacuuuuaauucaaaccagaauaugugaauaagcagacagaaa

SEQ ID NO: 79407 - RNA, 64 nt, hsa
ggggguggggguuacccaaauagguucacagaagaaccagaaauaaaaccugccuuucuagacu

SEQ ID NO: 79408 - RNA, 64 nt, hsa
cccccagguggugggaauaauuuacaaucuguccaaccagaaaagaauguguguguuugagcag

SEQ ID NO: 79409 - RNA, 64 nt, hsa
aaagcagggcacugagacacccguccguguuccuaaccagaaauccuaaagaagaggaauuaua

SEQ ID NO: 79410 - RNA, 64 nt, hsa
auaggucagcagagauuucaguuucccagggcuuaaccagaaccgccaccucaaugcauuguca

SEQ ID NO: 79411 - RNA, 64 nt, hsa
auagguuggcagagauuucaguuucccagggcuuaaccagaaccgccaccucaaugcauuguca

SEQ ID NO: 79412 - RNA, 64 nt, hsa
aaggauucuuaauuguuaauuugaagaacacauuaaccagaaagcuuaaacauuauuauuaaaa

SEQ ID NO: 79413 - RNA, 64 nt, hsa
cugccacccuaaauuucccaguggcacuacccuuaaccagaauuguuuauuagaugucauaugc

SEQ ID NO: 79414 - RNA, 64 nt, hsa
cauacaguucuugacuuuggacaauccaagagugaaccagaaugcaguuuuccuugagauaccu

SEQ ID NO: 79415 - RNA, 64 nt, hsa
aaacaauuccccuguggccugcuggacugguuggaaccagaacaggcuaaggcauacaguucuu

SEQ ID NO: 79416 - RNA, 64 nt, hsa
uuaucauuaguagauuuuauaagccacagagacaaaccagaaacggaauaauguuacuuuggau

SEQ ID NO: 79417 - RNA, 64 nt, hsa
gcgcacacauacuagguugaaagagaguugaggaaaccagaaggccaaguggaucugcuggcaa

SEQ ID NO: 79418 - RNA, 64 nt, hsa
cucccuggcugcuucacucaggaaagggaacuaaaaccagaauacacuaagaaguuucuaguuu

SEQ ID NO: 79419 - RNA, 64 nt, hsa
uugcuaaaguucucuuucuuugagaaaacugaggaaccagaaugcuuagaguucauaaaauaau

SEQ ID NO: 79420 - RNA, 64 nt, hsa
cauguaauuuauugaauacuguacugaaggugaaaaccagaaugguuguauggauaugcgaagu

SEQ ID NO: 79421 - RNA, 64 nt, hsa
gguuucaucugaaagcugccauagaaauucugugaaccagaaugagacaaggcagcaggcauac

SEQ ID NO: 79422 - RNA, 64 nt, hsa
gaugacagccaugaugaaacuuuuuaaaaaacuaaaccagaagagacuuuaaaauaagagaaag

SEQ ID NO: 79423 - RNA, 64 nt, hsa
acucugaauacuuggagaaacuaggugaagaugcaaccagaaaggagaauauguaugcgugaag

SEQ ID NO: 79424 - RNA, 64 nt, hsa
ccggccggccgagcauaagaaguuuaaucaaaguaaccagaaucccauguuuguuacuaggauu

SEQ ID NO: 79425 - RNA, 64 nt, hsa
agauuuauugaaaaggcuacuauuuauaacuuccaaccagaacuuugcaaugugcugauuuuau

SEQ ID NO: 79426 - RNA, 64 nt, hsa
cugaaggcaaaucuccuuuguccauuuaccuggaaaccagaaugauuuugacauacaggagagc

SEQ ID NO: 79427 - RNA, 64 nt, hsa
ugcauuucuuuauuucugucucauaauugucaaaaaccagaauuaggucaaguucauaguuucu

SEQ ID NO: 79428 - RNA, 64 nt, hsa
gcguuccguagcucgcucuaugaaggccuggagaaaccagaauccaagaccuccauucacaacu

SEQ ID NO: 79429 - RNA, 64 nt, hsa
ggagcgccuccgggcccccccgcccccgucccccaaccagaacaacaacgccauagacagcggc

SEQ ID NO: 79430 - RNA, 64 nt, hsa
caguuaccuuacauagcacuugauacguguuaaaugaacauaugaauguaauuuauauauuccu

SEQ ID NO: 79431 - RNA, 64 nt, hsa
aauuaccacucugaagucugcugacugugucucuugaacauacuuaggauauucugcacauuau

SEQ ID NO: 79432 - RNA, 64 nt, hsa
aguugaaacuugaacaaauagauggucacauugcugaacauaauucuaaaauaaaauauuggca

SEQ ID NO: 79433 - RNA, 64 nt, hsa
ugagacaaucaccacaguuauuacccaaauacuaugaacauauuuuuguaaaccagucauucug

SEQ ID NO: 79434 - RNA, 64 nt, hsa
agaucuuuucauucacgugcuuucugggucuguaugaacauaaguaagacacaagguacugucu

SEQ ID NO: 79435 - RNA, 64 nt, hsa
cugacuguuucugaacugucuucuuuugcaagacugaacauaguuugggccauuggugcaugca

SEQ ID NO: 79436 - RNA, 64 nt, hsa
uuuuuuuaaagugaaauauuuguuaacagcccauugaacauacuuuuaaaaacacuaugguaga

SEQ ID NO: 79437 - RNA, 64 nt, hsa
agacaucaucaaaauuagcuaacauggguauuuuugaacauauuuuugccaggaagaugaaaau

SEQ ID NO: 79438 - RNA, 58 nt, hsa
aagcuuuuaaccuaucuuaacaacuuacugaacauaagaaaauuuacacuagagagaa

SEQ ID NO: 79439 - RNA, 64 nt, hsa
guggcagagcuuuuaaccaguccgcaaagcucacugaacauaaguuaauucauacuggagaaaa

SEQ ID NO: 79440 - RNA, 64 nt, hsa
cuuguggagaacaugcauacuacaauuaagagagugaacauauccaucaucccucaaaguguca

SEQ ID NO: 79441 - RNA, 64 nt, hsa
agcuuuauugagauauaauuaacauaaaauaaacugaacauauuuaaaguguacuauuugauaa

SEQ ID NO: 79442 - RNA, 64 nt, hsa
gaaaauaauuucuucagagauaacuucaaguuguugaacauaaagguguuagauguuagcacau

SEQ ID NO: 79443 - RNA, 64 nt, hsa
cuguuuaauuuauuuuuauuguuugaacaggaagugaacauagucguuuccaacaaaguuuuac

SEQ ID NO: 79444 - RNA, 64 nt, hsa
auacaaagacgauuuuuucaggcugugauuauggugaacauaacaaaacccaguagucaccaag

SEQ ID NO: 79445 - RNA, 64 nt, hsa
agcuaaacagaaguuguugcuuaugaugugugagugaacauaugccacugccuggccuuuuuuu

SEQ ID NO: 79446 - RNA, 64 nt, hsa
cuggucagagagaccucauccugcucuuuugugaugaacauauucaugaaauguggaagucagu

SEQ ID NO: 79447 - RNA, 64 nt, hsa
uccuggaaggacacagugaugaauguacuaugucugaacauagaaacucgggcuugagugagaa

SEQ ID NO: 79448 - RNA, 64 nt, hsa
auagaugaaauacgaaaaauuacaguuuacuuaaugaacauaaggauaaauagaaaaacugaau

SEQ ID NO: 79449 - RNA, 64 nt, hsa
cgaacauuuuaacaauguuaauucuugcagaccaugaacauaagcuaccuucccauuuauaugc

SEQ ID NO: 79450 - RNA, 64 nt, hsa
ccgcaccuggaggcauggaguugugugcauccugcuuauguacaauuguuuucaguguuucuaa

SEQ ID NO: 79451 - RNA, 64 nt, hsa
cggagaaguguugcccaaacuugguucucugacucuuauguauuuguaaggcugggcuucaaaa

SEQ ID NO: 79452 - RNA, 64 nt, hsa
uuauugacaaacucucccuucacuccgaaaguuccuuauguauauuuaaaagaaagccucagag

SEQ ID NO: 79453 - RNA, 64 nt, hsa
caaagacauucugacaucuuaguauuugcauauucuuauguaugugaaaguuacaaauugcuug

SEQ ID NO: 79454 - RNA, 64 nt, hsa
gcauaaaguuaccuacaucaauuaauuaaaugaacuuauguacagaaaacauguauaaauauaa

SEQ ID NO: 79455 - RNA, 64 nt, hsa
uacuaaugcuuacaacuuucuaagaggguucuugcuuauguagcuuuuuauuauuuuaaguaac

SEQ ID NO: 79456 - RNA, 64 nt, hsa
cauacaacuauacacuaaaaucagugaauauuaccuuauguaaauuaaaaauuaggaaaucaaa

SEQ ID NO: 79457 - RNA, 64 nt, hsa
auguggaagacccuuccaaugcagcuaacccucccuuauguagcguccuccuugagccgagauu

SEQ ID NO: 79458 - RNA, 64 nt, hsa
gauauaaugcaaaaaaaaaaagagaaauguuugccuuauguauauucccuuuauuuccuuuacc

SEQ ID NO: 79459 - RNA, 64 nt, hsa
uguuuuuccuuggaccuaaacagagaaaauaaugcuuauguaucugaagaaaaggucagaucua

SEQ ID NO: 79460 - RNA, 64 nt, hsa
accauuuuaguaaaacaguccuguucaaguuguauucuuuuaaguucuuuuauucuccuuuccc

SEQ ID NO: 79461 - RNA, 64 nt, hsa
uaaaacaguccuguucaaguuguauucuuuuaaguucuuuuauucuccuuucccugagauuuuu

SEQ ID NO: 79462 - RNA, 64 nt, hsa
uacccagcacaugccacaauccuaugcucuugccuucuuuuaucugcacugugugaagggacuc

SEQ ID NO: 79463 - RNA, 64 nt, hsa
uggaacaacagcaguguuauuguaguguggcaguuucuuuuauacauaggugagaguuuuuaaa

SEQ ID NO: 79464 - RNA, 64 nt, hsa
uuuagucugcacagugagcaaggguucacaugcauucuuuuauacugcuggauuuuguugugca

SEQ ID NO: 79465 - RNA, 64 nt, hsa
aaauuggagcugcuuaaucauauugauaucuaauuucuuuuaaccacaaugaauuguccuuaau

SEQ ID NO: 79466 - RNA, 64 nt, hsa
aaauuucaucucaggccucccucaaccccaccacuucuuuuauaacuaguccuuuacuaaucca

SEQ ID NO: 79467 - RNA, 64 nt, hsa
uaugagacccauuccuauuucuuauagucaauguuucuuuuaucacgauauuauuaguaagaaa

SEQ ID NO: 79468 - RNA, 64 nt, hsa
ugagauauuauuuuaaauuucuuuuauuaauacuuucuuuuauuaauauaugggggaaaauuau

SEQ ID NO: 79469 - RNA, 64 nt, hsa
acuuuuuaaaaauaacugagauauuauuuuaaauuucuuuuauuaauacuuucuuuuauuaaua

SEQ ID NO: 79470 - RNA, 64 nt, hsa
uugguuugcuccagcauccgguagucuuuaaacauucuuuuagugaaauugucauuguuuuauc

SEQ ID NO: 79471 - RNA, 64 nt, hsa
cugucuuaaaaacaacugaagggguuaaagucguuucuuuuaguuuaauagaugugcauaaggu

SEQ ID NO: 79472 - RNA, 64 nt, hsa
ccgauguuuauaaacugguaaucaaaaagguuuuuucuuuuaggugagugggaaaguauuaccc

SEQ ID NO: 79473 - RNA, 64 nt, hsa
ugaaauaaaaugcuauauggcaccuaauuauuuuuucuuuuaaaaugccuuaaguugcagucuc

SEQ ID NO: 79474 - RNA, 64 nt, hsa
acuguuccugcaguauuggauagcuaucucauacuucuuuuagaaagaagccuuuuucauuaag

SEQ ID NO: 79475 - RNA, 64 nt, hsa
cagaguguccucuugguguauucuaaaacgagcauucuuuuaaaaaaccuaaaguuucuugaua

SEQ ID NO: 79476 - RNA, 64 nt, hsa
uucuaaagagcucuucuauuuauacaugccuaaauucuuuuaaaauguagagggauaccugucu

SEQ ID NO: 79477 - RNA, 64 nt, hsa
gaaaucucugccccuuuucugagcaguaugccucuucuuuuagaauuaaaugaaugcugcacag

SEQ ID NO: 79478 - RNA, 64 nt, hsa
caaauuuccuaauaacacaaucagauugguuuuauucuuuuauuuuacgaauaaaaaauguauu

SEQ ID NO: 79479 - RNA, 64 nt, hsa
augguuaaccuguagcuuauaaauuuacuuauuauucuuuuacucauuuacucagucauuucuu

SEQ ID NO: 79480 - RNA, 64 nt, hsa
ugggauuacaggcuugagcaaccauguuuggccuuucuuuuaaauuuguugauguuuuuugaag

SEQ ID NO: 79481 - RNA, 64 nt, hsa
ugcuuguggcagaaguuuuccuuauuugccauuuuucuuuuauuuuuuuuuuaauuguauuuuu

SEQ ID NO: 79482 - RNA, 64 nt, hsa
gaagcggugauaaaauucuuuggcuaguuauuaauucuuuuacgugucuuugcauuugagaggc

SEQ ID NO: 79483 - RNA, 64 nt, hsa
aaaaugaaaccaucauuauauucuuucguguuuuuucuuuuauuauaaacaaggggauuauucu

SEQ ID NO: 79484 - RNA, 64 nt, hsa
auacauguaauucuaccaaggucuucuuaauauguucuuuuaaaugauugaauuauauguucag

SEQ ID NO: 79485 - RNA, 64 nt, hsa
gcuuaauaaauuguguuuccuccaagcuauucaauucuuuuaacuguuguagaagacaaaaugu

SEQ ID NO: 79486 - RNA, 64 nt, hsa
aaaugaaaugugcguguugauagcaauaauuuguuucuuuuaaagauucuaaaaggucugagac

SEQ ID NO: 79487 - RNA, 64 nt, hsa
cucuaacaagcgauucuaaaccaccuaugaguauuucuuuuagggcucacuuaaauacauguuu

SEQ ID NO: 79488 - RNA, 64 nt, hsa
ggauuacaggcaugagccauugcacccagccauguucuuuuacuuucuaaauacaaucauauua

SEQ ID NO: 79489 - RNA, 64 nt, hsa
ugcuuuuauauagugugcuuguauuuugauuguguucuuuuacuauuuuuuuuuuuuuaagagu

SEQ ID NO: 79490 - RNA, 64 nt, hsa
gauggauauuuagauucuuuuaaguuuuguuuauuucuuuuaaguuuuguuugugguauaaaca

SEQ ID NO: 79491 - RNA, 64 nt, hsa
uaauuaaaaacaacccuaaugauggauauuuagauucuuuuaaguuuuguuuauuucuuuuaag

SEQ ID NO: 79492 - RNA, 64 nt, hsa
uccuucccauuguugucaacaauuaagucuauucuucuuuuagaaauuauauguaaaugauauu

SEQ ID NO: 79493 - RNA, 64 nt, hsa
uacaucuauuuuguguacuuguacacaguguacauucuuuuaaauuauaucguguauauagcuu

SEQ ID NO: 79494 - RNA, 64 nt, hsa
augaagaaugucaucaauuauguacauauguauuuucuuuuaauacaaaguguaauuuugugcc

SEQ ID NO: 79495 - RNA, 64 nt, hsa
gugccagugaaauggagucugaauaguuauguguuucuuuuaucccuggaaauauuuauuaaac

SEQ ID NO: 79496 - RNA, 64 nt, hsa
acucuggcauaguucaugagcuuaauacauagcuuucuuuuaagaaaggagccuuuuuuuucaa

SEQ ID NO: 79497 - RNA, 64 nt, hsa
uuggaaggagcccuaaguugucacucaguuuaauuucuuuuaaugguuaguuuagccuaaagau

SEQ ID NO: 79498 - RNA, 64 nt, hsa
auggggagaaaucuauuucucaaaaaaaaaaaucuucuuuuacagaaauguugaguaaggugac

SEQ ID NO: 79499 - RNA, 64 nt, hsa
uuacuuagccuauaaaacuaguuaaaaauggaauuucuuuuagcaauucaguuuaguacaggag

SEQ ID NO: 79500 - RNA, 64 nt, hsa
uacaaacaaaguaggauuuacacuuaaguuaucauucuuuuagaaacucagucuucagagccuc

SEQ ID NO: 79501 - RNA, 64 nt, hsa
aaguaaagaauugagagugugugcaaagcuuauuuucuuuuaucugggcaaaaauuaaaacaca

SEQ ID NO: 79502 - RNA, 64 nt, hsa
augcugaaacaucauuacagauucugcuagccuguucuuuuaccacugacagcuagacaccuag

SEQ ID NO: 79503 - RNA, 64 nt, hsa
uaauggaaucacagaaaugauauucugcaagaauuucuuuuaaauaaaaaguuugggggugcaa

SEQ ID NO: 79504 - RNA, 64 nt, hsa
gaucuuauugacaucagguauacuuggaagacauuucuuuuauucuucagcguaugaauuuaaa

SEQ ID NO: 79505 - RNA, 64 nt, hsa
uaagcuuuauugugauuacguguauguuucuucuuucuuuuaagcagacccauaccuuuccagg

SEQ ID NO: 79506 - RNA, 64 nt, hsa
caaaguacagaaaaauacuuugauuuuuauccauuucuuuuacucuguguaaagacuugagaag

SEQ ID NO: 79507 - RNA, 64 nt, hsa
agaccucugugugaagcaagugaaguauagcugcuucuuuuaaccugccuuuucacugaauguu

SEQ ID NO: 79508 - RNA, 64 nt, hsa
agauugaauuaaauagaaacuuauugaauauacauucuuuuaaaaaguauauuuguuauuuaag

SEQ ID NO: 79509 - RNA, 64 nt, hsa
aaaauucaucauggauaaaaacuaagcgcuugccuucuuuuaaaaagaaaaacugaugauuaga

SEQ ID NO: 79510 - RNA, 64 nt, hsa
aacaaagaacuagagaagaaaucuuaaauguucauucuuuuaaaucucgugauugguuagucca

SEQ ID NO: 79511 - RNA, 64 nt, hsa
uuuguuuauugaguuggcuuugcuuuuuuaguuuuucuuuuaaaaauaaaauccuuccuuccca

SEQ ID NO: 79512 - RNA, 64 nt, hsa
aguuauauuaucuaccaacagguaauauagcucuuucuuuuauuaacuguucucugucccccaa

SEQ ID NO: 79513 - RNA, 64 nt, hsa
uauuuuugggauuauacuuccuuucuguaccaauuucuuuuaauuuaaagaacuauaagucagu

SEQ ID NO: 79514 - RNA, 64 nt, hsa
gguauaauacauacaaugcaugaaucauaauggauucuuuuauaaguuauuaauuuuuaugguu

SEQ ID NO: 79515 - RNA, 64 nt, hsa
uuuugacuguuauagaaaccaaauauuuuacuguuucuuuuaaggacuaauauugucaaaaacu

SEQ ID NO: 79516 - RNA, 64 nt, hsa
aaacucuuacuaaaauguuaacuuucuaaaaaccuucuuuuagaucuuccuugggccuuuggaa

SEQ ID NO: 79517 - RNA, 64 nt, hsa
ugugaaaggaugaugaagaaaauaauuuuacuauuucuuuuaaaaguauguuuuggaaaaucaa

SEQ ID NO: 79518 - RNA, 64 nt, hsa
uaaaaguuauucuagacaaucacuauuggcuuuuuucuuuuauuuuuaaaaaacucacauagag

SEQ ID NO: 79519 - RNA, 64 nt, hsa
uccuucucacugcagccccaagcucuuauuaaccuucuuuuauguguucauuaaaugcagucau

SEQ ID NO: 79520 - RNA, 64 nt, hsa
ucagaaugaagacagucugccuuagagccugcuauucuuuuagacauagggaggaugcauuauc

SEQ ID NO: 79521 - RNA, 64 nt, hsa
uccagaaagaauucagcaauguuaucagaauuaauucuuuuauaugaguuuauguagcuugaua

SEQ ID NO: 79522 - RNA, 64 nt, hsa
aacauuauguaucauaugcagauacuuauugcauuucuuuuauuaguggugaaaguguucuaug

SEQ ID NO: 79523 - RNA, 64 nt, hsa
ucuuuguacuuggagggcacuucuuucgugguaguucuuuuauuuuuauuaaucucuguauccu

SEQ ID NO: 79524 - RNA, 64 nt, hsa
uauguguuuuuaaaaaucuaaagcugaauuccuuuucuuuuaaacuucuuuucuuguagaacau

SEQ ID NO: 79525 - RNA, 64 nt, hsa
uuauucuauuuugggaauuuuuaguuguauucuauucuuuuacuguacauuguuuacaucugga

SEQ ID NO: 79526 - RNA, 64 nt, hsa
guggagcccagguccccugacuccauaucuuacauucuuuuacuaauaacaugucaugcugaga

SEQ ID NO: 79527 - RNA, 64 nt, hsa
gcuuauucuucaguuaaaaggagguauccauugauucuuuuauaugaaauuaaaucaaacuguu

SEQ ID NO: 79528 - RNA, 64 nt, hsa
caaaauauacaaaacuuuaucagggaaacuaagauucuuuuaaauuagaaaauauucucuauuu

SEQ ID NO: 79529 - RNA, 64 nt, hsa
ccgucuccaaaaaaaaaaaaaauacaauuuuuauuucuuuuacuuuuuuuaguaaguuaaugua

SEQ ID NO: 79530 - RNA, 64 nt, hsa
uuaaaugccuucuccuuuuuaccgauauuucuguuucuuuuaaccguucucaggagcacuuugc

SEQ ID NO: 79531 - RNA, 64 nt, hsa
uuaaaaucccaguguucugaguuauugaaaggcuuucuuuuauuuugagagcuuuaggucuuuu

SEQ ID NO: 79532 - RNA, 64 nt, hsa
uuaaaaagaaaaaacuuagcaaacuuuugaaucuuucuuuuauugcuauuuacacauacauaca

SEQ ID NO: 79533 - RNA, 64 nt, hsa
uaugaucauugacaugugauuucaaaacacaguguucuuuuaaaaaucuauaauaugucaaaau

SEQ ID NO: 79534 - RNA, 64 nt, hsa
gucuccuugcuuccugucuuauccuccaccgucuuucuuuuauacugacacaagaauggucuuu

SEQ ID NO: 79535 - RNA, 64 nt, hsa
cacccugcucauccacucuacuaaugccucuucauucuuuuauacucagcuuucuuuaaaguuc

SEQ ID NO: 79536 - RNA, 64 nt, hsa
caguagaauuuuuaaacagauuuuuuuaaagcuuuucuuuuaaauuuuucuccguugcaaagaa

SEQ ID NO: 79537 - RNA, 64 nt, hsa
aagauccucagguccagaauuccagcaucauuuauucuuuuaaaauuuuuaagaacuugaucca

SEQ ID NO: 79538 - RNA, 64 nt, hsa
auaaacauauuaaaauucuucuaaaauauugcuuuucuuuuaagugacaauuugacuauucuua

SEQ ID NO: 79539 - RNA, 64 nt, hsa
uauuuaaagugaguguuuaagaaacuguagcugcuucuuuuacaaguggugccuauuaaaguca

SEQ ID NO: 79540 - RNA, 64 nt, hsa
cacuucuuuaucacaggugucuugaaacauuagcuucuuuuaccaaccugagaaaauuaggaug

SEQ ID NO: 79541 - RNA, 64 nt, hsa
uauauuuauuucuaaauguuuugacugggcauuuuucuuuuaaugaaauauguggacugcucua

SEQ ID NO: 79542 - RNA, 64 nt, hsa
auuacaggcgugagccaccagccaggccaagcuauucuuuuaaaguaagcuuccugacgacaug

SEQ ID NO: 79543 - RNA, 64 nt, hsa
ucuagagugucagccuuaucaguguuuaagauuuuucuuuuauuuuuaauuuuuuugagacaga

SEQ ID NO: 79544 - RNA, 64 nt, hsa
acgauguauucagaagccuuuacugauuaaaguuuucuuuuauuuggguggccgggagagaccc

SEQ ID NO: 79545 - RNA, 64 nt, hsa
gguuauugaaaggacgccucagaaaugcuuuguuuucuuuuacgauguauucagaagccuuuac

SEQ ID NO: 79546 - RNA, 64 nt, hsa
gauuugggcuauaaaauaucauuuuucagguuuauucuuuuagcagguguaguuaaacgaccuc

SEQ ID NO: 79547 - RNA, 64 nt, hsa
augcauaaccuaauuuuccugggacugccauauuuucuuuuaacuggaaauuuuuaugugaguu

SEQ ID NO: 79548 - RNA, 64 nt, hsa
auguauaaaaauauuuuuucuaauccuccaguuauucuuuuauuucccucuguauaacugcauc

SEQ ID NO: 79549 - RNA, 64 nt, hsa
guggaauauucauuugacaucugucucuuuucauuucuuuuaacuaccaugcccuugauauauc

SEQ ID NO: 79550 - RNA, 64 nt, hsa
cucuauuuuuuauuuauuacaaugauuuucucccuucuuuuacaguagcacaaacaaaguaggg

SEQ ID NO: 79551 - RNA, 64 nt, hsa
uuacuuuaaauauaauguuauuaauccucugcauuucuuuuaucuugauaacuccuagugaggg

SEQ ID NO: 79552 - RNA, 64 nt, hsa
uggagaagccuagaugaaugagacaaauaccuacuucuuuuauuccuccuuuugguaaacaacu

SEQ ID NO: 79553 - RNA, 64 nt, hsa
cuuauguggaauugaauuagagaacaaggcauuauucuuuuagggaaggugagagcuuauuugu

SEQ ID NO: 79554 - RNA, 64 nt, hsa
gguaugaaacagccuaaugcauuagagaaaaaaguucuuuuaguaaggcauuugggguugggga

SEQ ID NO: 79555 - RNA, 64 nt, hsa
auauguaguauguaauauauguaacaucuuccaauucuuuuaaaauaaaauuaauauuuauaau

SEQ ID NO: 79556 - RNA, 64 nt, hsa
aguaacauuaguaaacugucuuuaucuuugauuauucuuuuaauuuuuauuugagcuguuucaa

SEQ ID NO: 79557 - RNA, 64 nt, hsa
caguaauuacacgaggcaaacaguuccaaaacuguucuuuuagguucaaaaccuaauuccccca

SEQ ID NO: 79558 - RNA, 64 nt, hsa
gaaaguauacuguauuuuaccaacccccucucuuuucuuuuagcuccucuguggugaauuaaac

SEQ ID NO: 79559 - RNA, 64 nt, hsa
uguuucaucuguggacaauugcuuacuuuguggguucuuuuaaaaguaacacgaaaucaucaua

SEQ ID NO: 79560 - RNA, 64 nt, hsa
uauaggcgugagccacugcaccuggccaaguaauuucuuuuaggaauaaaagguacuuggcauu

SEQ ID NO: 79561 - RNA, 64 nt, hsa
augcaaaacagguucagauuucaucuuuugugauuucuuuuaaauacuauucauuuuuauuuaa

SEQ ID NO: 79562 - RNA, 64 nt, hsa
uguagaauuucugauugcaugacuauuauuuaucuucuuuuaguguagaaaauaauuuuuuaca

SEQ ID NO: 79563 - RNA, 64 nt, hsa
uaacuuuugaauuacauuuuuguaaguagauuuauucuuuuauuuuaugaaguaauguuaauuu

SEQ ID NO: 79564 - RNA, 64 nt, hsa
aauuuaaaagaaaaauugugagguucuaauuauuuucuuuuauaaaguauaauuagaauguuua

SEQ ID NO: 79565 - RNA, 61 nt, hsa
uucucuuucauaaaaagugaaugucaucuuuuucuuuuaaagaauuaaauuuugugguaug

SEQ ID NO: 79566 - RNA, 64 nt, hsa
uucaguuuuuaaucgacuggacugcagauguuuuuucuuuuaacaaacuggaauuuucaaacag

SEQ ID NO: 79567 - RNA, 64 nt, hsa
agccaauuugucuguuacauuuccuuucacguauuucuuuuagcagcacuucugcuacuaaagu

SEQ ID NO: 79568 - RNA, 64 nt, hsa
auguuuuuaggauuccccucaaugcagucaguguuucuuuuaaguauacaacaggagagagaug

SEQ ID NO: 79569 - RNA, 64 nt, hsa
ccuacuuuucuuuauuagcuuucuccucauccauuucuuuuauaccuuuccuuuuuggggaguu

SEQ ID NO: 79570 - RNA, 64 nt, hsa
auguucagaguucuauguaagguggguuuuauuuuucuuuuaagggauaguuuguaauaguaag

SEQ ID NO: 79571 - RNA, 64 nt, hsa
uuaaagguuguaauugaaauacaagaaaagagccuucuuuuagaagaaagcaaguauauuuuug

SEQ ID NO: 79572 - RNA, 64 nt, hsa
uuaaaauguuaaaauuuugugaccaugaauuucuuucuuuuauaaauuuucucauuuaaaaauc

SEQ ID NO: 79573 - RNA, 64 nt, hsa
agcuaucacagguuuguuagcuaauaauaguauuuucuuuuaguugaguuagguuuuuccccau

SEQ ID NO: 79574 - RNA, 64 nt, hsa
auuuacuuuuagaugaauggcauugugaaugccauucuuuuaaugaauuucaagagaauucucu

SEQ ID NO: 79575 - RNA, 64 nt, hsa
ucucauccucuuuuccuuccuucuuuccuuucucuucuuuuaucuccaagguuaaucaggaaaa

SEQ ID NO: 79576 - RNA, 64 nt, hsa
ccacuggaagaccaaacaagguuuucacugcuuuuucuuuuacauaauaugcugagaauuauuu

SEQ ID NO: 79577 - RNA, 64 nt, hsa
caacaucaccccauuaagaauacaaagcacuacauucuuuuaucuuuuuugcuccacauguaca

SEQ ID NO: 79578 - RNA, 64 nt, hsa
gaagaggaggccagaggucgggccagcugccccauucuuuuaacguuguagggccugcccaugg

SEQ ID NO: 79579 - RNA, 64 nt, hsa
ccaugccaggaaucugccuaccugccagguucaguucuuuuaaggugccucuucagggacacag

SEQ ID NO: 79580 - RNA, 64 nt, hsa
caaguuugaucaacagcaaaauagaguucugaauuucuuuuaaagugaugauauauuauuuugu

SEQ ID NO: 79581 - RNA, 64 nt, hsa
agaaauuacuuuuguaauuauuugcaauuaauuguucuuuuaucuuacaauuguuuaagccugu

SEQ ID NO: 79582 - RNA, 64 nt, hsa
cuauacugcagaauauaguguaucaaaaacuuuuuucuuuuaaauuauuaaagugucuuuuaua

SEQ ID NO: 79583 - RNA, 64 nt, hsa
aauuuuuuuuucuuuugauguugcaacuuuuggguucuuuuaaacugugauagugaugguaacu

SEQ ID NO: 79584 - RNA, 64 nt, hsa
acuaaacaccucugaagacugcaaacuggauuaguucuuuuacuucaguguuuaauaagcagau

SEQ ID NO: 79585 - RNA, 64 nt, hsa
uugguacacaaagaauguauucuucauagguuuauucuuuuaauaugugaacuauuauuaaagu

SEQ ID NO: 79586 - RNA, 64 nt, hsa
aggaugggaacaugggaaugauaauauauauuuuuucuuuuaauauuuuauuuuucuuuuuaug

SEQ ID NO: 79587 - RNA, 64 nt, hsa
uucuguuucugugaaacaauuauuuuaaauauuuuucuuuuaaaaauaacuuuuuaucaguaca

SEQ ID NO: 79588 - RNA, 64 nt, hsa
aguuguugcauguaugaauaguuucuuccuuuuuuucuuuuaaaaauguuuuauauauuuaggg

SEQ ID NO: 79589 - RNA, 64 nt, hsa
cccacuugcucagcagcuugggcuuccauucuaguucuuuuaccaagauuuuugugugaccaug

SEQ ID NO: 79590 - RNA, 64 nt, hsa
guuuuuaaaauguuuguuauauuucuuuucuuuuuucuuuuauauuacgugaagugaugaaauu

SEQ ID NO: 79591 - RNA, 64 nt, hsa
uaacaugaaccuucauuuguaaauuuuuuaaaauuucuuuuauaauaugcuuuccgcaguccua

SEQ ID NO: 79592 - RNA, 64 nt, hsa
aaucccagcgccuuuuaaaaguuguuaugugguuuucuuuuaaaaagcuccuguuuuuggaaag

SEQ ID NO: 79593 - RNA, 64 nt, hsa
auggaagaugcuccuuaaaaaucucuguaaccauuucuuuuauguacauuugaaaaugcccuuu

SEQ ID NO: 79594 - RNA, 64 nt, hsa
gacugcaacaaaaaaugugaaaaugaagauuuauuucuuuuaauuuacuuaaaaagaaaccucu

SEQ ID NO: 79595 - RNA, 64 nt, hsa
uaagaaccugggauauuccugacccaaucugguuuucuuuuacccauaaauaacaugaaugaaa

SEQ ID NO: 79596 - RNA, 64 nt, hsa
cgaagcugggccuuguuuggucucauacuuaauuuucuuuuauauacauguuuuucuuuuacau

SEQ ID NO: 79597 - RNA, 64 nt, hsa
gucucauacuuaauuuucuuuuauauacauguuuuucuuuuacaugcauauauauauauuuuau

SEQ ID NO: 79598 - RNA, 64 nt, hsa
gcagucuaguguugaaaguuuuauuuuuccauuuuucuuuuaaguaaauuuuuuuuaaaaaauu

SEQ ID NO: 79599 - RNA, 64 nt, hsa
accccuaucuguauuaaaaaaaaaucugauuuaauucuuuuauuuaucauaagggguuuaauuc

SEQ ID NO: 79600 - RNA, 64 nt, hsa
accuauuaaacuuaaaacugccaaaugauuuuuguucuuuuaugugcgugauaaaaauacaaag

SEQ ID NO: 79601 - RNA, 64 nt, hsa
agggggcccacaagcacgcccagcccccgccgaauucuuuuagcuucguaauuggaaccuuuga

SEQ ID NO: 79602 - RNA, 64 nt, hsa
uccccaccugcuccgaagacaaaccaaccuccguuucuuuuauaaacagucggcuuuuucuuaa

SEQ ID NO: 79603 - RNA, 64 nt, hsa
cagaaaaccagguuucuacauccaaagacugcuuuucuuuuagcugccagauuggauugugaau

SEQ ID NO: 79604 - RNA, 64 nt, hsa
ugucugaaauggagaucacuguaaaacugucuuuuucuuuuaaauuacaaguacacugggguua

SEQ ID NO: 79605 - RNA, 64 nt, hsa
gucaguaucgugggcauguguauagcuucccaaguucuuuuacagucccugcugggacucccug

SEQ ID NO: 79606 - RNA, 64 nt, hsa
acggaugguguugcugcugggcaacaguguuggcuucuuuuaaguacccccuuuccuccucacc

SEQ ID NO: 79607 - RNA, 64 nt, hsa
uggaaugaaaaaacucauucacuuuugucuuauuuucuuuuaagguguauuggcauguaauuug

SEQ ID NO: 79608 - RNA, 64 nt, hsa
cuucccugcugcauguaaugucucagaaucaacauucuuuuaaaaucuagacuauauuuugagg

SEQ ID NO: 79609 - RNA, 64 nt, hsa
caguaaguuaaguuguaaagacuuuggaauaaguuucuuuuaaaaauaugacauagccagugau

SEQ ID NO: 79610 - RNA, 64 nt, hsa
aagccacauuucuaaaguuuauuuuuaugaaagcuucuuuuaagauuuugaaaucuauucugca

SEQ ID NO: 79611 - RNA, 64 nt, hsa
uaaaaauagaagacagaaguauuaaaauuauauuuucuuuuauuuuaagucuucugccuucuuu

SEQ ID NO: 79612 - RNA, 64 nt, hsa
uucuuucuuauaauauguuguaguuacuagugaauucuuuuaaaagcaauaccuagaguuagaa

SEQ ID NO: 79613 - RNA, 64 nt, hsa
uuccgugguauacagcuccugugacauuugaaguuucuuuuaaagggguuuuucuuaaucaaag

SEQ ID NO: 79614 - RNA, 64 nt, hsa
ucaauuuuucaaacucauuuuucauugcuaggauuucuuuuaaaaaaauuaaaguaauuucacu

SEQ ID NO: 79615 - RNA, 64 nt, hsa
uauaaacucuauuccaguuuugguauacuaaauguucuuuuaaccaucuuuaggaauauauuga

SEQ ID NO: 79616 - RNA, 64 nt, hsa
aaaucucauuugagauuuaagaauauaaauaauuuucuuuuaaucuuuauuuugcucaauauuu

SEQ ID NO: 79617 - RNA, 64 nt, hsa
agucaugcacauucaagagagaaaauauaacaaguucuuuuaugagcaaucccuuaugcauaga

SEQ ID NO: 79618 - RNA, 64 nt, hsa
uucuuaauuuucuuuaauuuaguccaaguuccaguucuuuuaggccuucucuuugauuuauuuu

SEQ ID NO: 79619 - RNA, 64 nt, hsa
uaagaguccauuggggugguuugcauuguaacuuuucuuuuacauccuauuuuuccaggaacuu

SEQ ID NO: 79620 - RNA, 64 nt, hsa
uaaaacuaauaauguuacccucacaaaggaaauguucuuuuacuaaguuauugcugauucuuga

SEQ ID NO: 79621 - RNA, 64 nt, hsa
gugaguucucaucuuuguuuucugaaacagacguuucuuuuaguaagucacaauacaugcuaau

SEQ ID NO: 79622 - RNA, 64 nt, hsa
uuaacuggaggucauggagauuuucuccuacauuuucuuuuaaaaguuuuauaguuucagaguu

SEQ ID NO: 79623 - RNA, 64 nt, hsa
uaguauaccccuguauuuauuuguuuucuugaauuucuuuuaucauuguuuuguaguuuucacc

SEQ ID NO: 79624 - RNA, 64 nt, hsa
gaagacccucaucucagaguagcccuuuccucuguucuuuuauuucuuuuucucuuugauugaa

SEQ ID NO: 79625 - RNA, 64 nt, hsa
guguuuuggguuuuucucuuuguuuuuuucaagauucuuuuaaaggaguacugaagaauacuuu

SEQ ID NO: 79626 - RNA, 64 nt, hsa
ugagaauagaugaaaauuuugaugaauaguggaauucuuuuaaauggaaaccucuuacauguga

SEQ ID NO: 79627 - RNA, 64 nt, hsa
caaauuuccacuuccucugauagacguuuuuuaguucuuuuagagugguucugauagguacaga

SEQ ID NO: 79628 - RNA, 64 nt, hsa
uuuguaaugaaugaagcgguaggcagguucuaauuucuuuuaaccuuuuaauuauguacaggca

SEQ ID NO: 79629 - RNA, 64 nt, hsa
uguuuaggccaugacuucuacaagcagauuucuuuucuuuuaguuuagaagacaaaaaauuuca

SEQ ID NO: 79630 - RNA, 64 nt, hsa
uaguuuagaagacaaaaaauuucaauacagauacuucuuuuagaaguaaauuuuuagauuuuau

SEQ ID NO: 79631 - RNA, 64 nt, hsa
ugugucaaaagucucacuugggaguaguguuuuuuucuuuuagacauucugcagacaugcaggg

SEQ ID NO: 79632 - RNA, 64 nt, hsa
guugguaucuccagccccccuccuuuuuuuguuuuucuuuuaguuauuuacuuuguuuguauaa

SEQ ID NO: 79633 - RNA, 64 nt, hsa
gcagagaaagauaagaucaaaagguguuugguuuuucuuuuaauuuuuauuguaguuuuuuugg

SEQ ID NO: 79634 - RNA, 64 nt, hsa
uugaacacuuuugcccugcagccucaguuuugaauucuuuuagcaacuuggauuagaggggccc

SEQ ID NO: 79635 - RNA, 64 nt, hsa
guaaauuccuaacaggagaccacaaagguuucacuucuuuuagauccauccaauaugcgaaaaa

SEQ ID NO: 79636 - RNA, 64 nt, hsa
caaccaaguuauuuuuuauauauuuuguuauuuauucuuuuaauaauggaauuuuuuuaaaaag

SEQ ID NO: 79637 - RNA, 64 nt, hsa
aacuuuuuuggaaacuguugguugagauaguugguucuuuuaccccacgaagacaucaagauac

SEQ ID NO: 79638 - RNA, 64 nt, hsa
uagguguuugggaucggaccucaguuucuguuguuucuuuuauguggugguuucuauacaugaa

SEQ ID NO: 79639 - RNA, 64 nt, hsa
uuaacaggggaaguacugauacaauuguugacuuuucuuuuacuauguguaagaaauaccccaa

SEQ ID NO: 79640 - RNA, 64 nt, hsa
gaauuaucuuaagugagauguuaagcccacuuuguucuuuuaauguaauggagcuuauggguag

SEQ ID NO: 79641 - RNA, 64 nt, hsa
uccccuacaauguuauaccaaggcucugauguauuucuuuuaguaguuucuaaguguaaaauuu

SEQ ID NO: 79642 - RNA, 64 nt, hsa
ggaguagaaaaaacaauucuggcuuuauauuaaauucuuuuaguauuauagguuggugccaaaa

SEQ ID NO: 79643 - RNA, 64 nt, hsa
aaacauuaguuuucuccuguugucuguuauuuccuucuuuuauccucuuaacuggccauuaucu

SEQ ID NO: 79644 - RNA, 64 nt, hsa
uuuauauuuuuuauuauaauuauuauuucuuaucuucuuuuauauuuuuuggaaaccaaauuua

SEQ ID NO: 79645 - RNA, 64 nt, hsa
aaaauuuucuaaaauguauuuuagacuuccuguagggggcgauauacuaaauguauauaguaca

SEQ ID NO: 79646 - RNA, 64 nt, hsa
uauauaguacauuuauacuaaauguauuccuguagggggcgauauacuaaauguauuuuagacu

SEQ ID NO: 79647 - RNA, 64 nt, hsa
ggcgauauacuaaauguauuuuagacuuccuguagggggcgauaaaauaaaaugcuaaacaacu

SEQ ID NO: 79648 - RNA, 64 nt, hsa
cuacuaggaggagccagggacuggggcggggggcgggggcgagggagggcgaacugucgaaugu

SEQ ID NO: 79649 - RNA, 64 nt, hsa
cccauucugggcgggcccaguggaguuuggggaggggggcgaaagcaacgggacugcugggaga

SEQ ID NO: 79650 - RNA, 64 nt, hsa
uccucccucgcccggcccgccuucucuggguuaggggggcgaugcggccggguggcaacgcacg

SEQ ID NO: 79651 - RNA, 64 nt, hsa
ggagccgcacucuucgcccgcuccgggcaaaagcgggggcgaguguagagcgauccugggaaau

SEQ ID NO: 79652 - RNA, 62 nt, hsa
cuauuaaugcgaucuggcaucuucucccacaagcccccuacagggaacaacuacccccuacc

SEQ ID NO: 79653 - RNA, 62 nt, hsa
uuaggaggaccaugugguuggaaggauagacugcccccuaccucccaccaccaccaugaagu

SEQ ID NO: 79654 - RNA, 62 nt, hsa
guccccaccgccucuucuuccucacuguccccgcccccuauuuguggacuaaagaugaacuc

SEQ ID NO: 79655 - RNA, 62 nt, hsa
uguguuccugaccgaccccgggucccaccugugcccccuaaaccaggcgguggaucaggccc

SEQ ID NO: 79656 - RNA, 62 nt, hsa
uauucugguaacuaccaggaggcuuccuuccagcccccuauucugguaacuaccaaaauccc

SEQ ID NO: 79657 - RNA, 62 nt, hsa
ucaaaucgaaucucccaggaggcuuccuuccagcccccuauucugguaacuaccaggaggcu

SEQ ID NO: 79658 - RNA, 62 nt, hsa
acucugcccagcccugaaugugugccuuaaaggcccccuacaaggggccccauacgacagag

SEQ ID NO: 79659 - RNA, 62 nt, hsa
uggagggggcuugaggggcacuucagggcccugcccccuaauguaaccccucucucaccccg

SEQ ID NO: 79660 - RNA, 62 nt, hsa
cgcgcccggaacucgcucuccacgcgccccgggcccccuaccugcgcccgcagcgcccucgc

SEQ ID NO: 79661 - RNA, 62 nt, hsa
ucugucgacucugguggguccccacuccuggggcccccuaaccccaccccaggcagcggaag

SEQ ID NO: 79662 - RNA, 62 nt, hsa
uuagagcagacaagggcucucagcccuggcaugcccccuaaagggaccaagguccuccuauu

SEQ ID NO: 79663 - RNA, 64 nt, hsa
auuugaguccuaacuuggugcaagucuggcagcuagguagaaaaggcacucuagcagguguggu

SEQ ID NO: 79664 - RNA, 64 nt, hsa
cacucuagcaggugugguaggagcacgccccagaagguagaaugugguggggugugauggaaca

SEQ ID NO: 79665 - RNA, 64 nt, hsa
uuuuguuuuacaaaucacuugauuuaacacacucagguagaauauuuuuauuuuuacuguuuua

SEQ ID NO: 79666 - RNA, 64 nt, hsa
uagcacuucacagcaugguuaucauguaagcugcagguagaagcaaagcuguaaaguagauuua

SEQ ID NO: 79667 - RNA, 64 nt, hsa
guauuccuuuggcuuggcaucuuuuagcucaggaagguagaagagaucugugcccaugggucuc

SEQ ID NO: 79668 - RNA, 64 nt, hsa
aagagccuauucgauagcuagaagggaauaugaaagguagaagugacuucaaggucacgagguu

SEQ ID NO: 79669 - RNA, 64 nt, hsa
gucccaagguacauuguucuacuguuuuauacccagguagaaguuacacagcaauuuagcaaug

SEQ ID NO: 79670 - RNA, 64 nt, hsa
ugcaugccuguggucccagcuacuugggaggcuaagguagaagaauugcuugaaccugggaggc

SEQ ID NO: 79671 - RNA, 64 nt, hsa
agguagaacagaacucacaaaauagcaggggcuuagguagaaguuccuucacucaccgacuugu

SEQ ID NO: 79672 - RNA, 64 nt, hsa
caccuccucaguuccuguggauagccugggaggcagguagaacagaacucacaaaauagcaggg

SEQ ID NO: 79673 - RNA, 64 nt, hsa
acucucacugccauugccgagaguccuguuauugagguagaaacagaaaagaaagacguucuug

SEQ ID NO: 79674 - RNA, 64 nt, hsa
acaaacaauuucuggcuuggggaggagucccucuagguagaacacaguaagugucaaagacuga

SEQ ID NO: 79675 - RNA, 64 nt, hsa
aaggaagauuuucaguccugaacgugaauuauagagguagaacgucgcuaauaauuucugccau

SEQ ID NO: 79676 - RNA, 64 nt, hsa
agucuugaugaaugugaaccaugucggaauuguuagguagaaaccugggcugggaggccucgga

SEQ ID NO: 79677 - RNA, 64 nt, hsa
aucuauaacaguaauauugauucauucacauuccuguguuaagucauuuuauauggaaaggcuu

SEQ ID NO: 79678 - RNA, 64 nt, hsa
uaaaagcuuugacuuaaacauugauauuucagaauguguuaaauagauuaagacacaguaaguu

SEQ ID NO: 79679 - RNA, 64 nt, hsa
ugugugugugugugugugugugcgcgcgugcguguguguuaaucuguuuuuugauacauuccua

SEQ ID NO: 79680 - RNA, 64 nt, hsa
ggaggauuuucacuacguuuugacaacucugaaauguguuaacucuuagugccaucaagaaccc

SEQ ID NO: 79681 - RNA, 64 nt, hsa
uucauuaaaauaauaguggugaauuauauguuauuguguuaaaaccucacuugccaaauucugg

SEQ ID NO: 79682 - RNA, 64 nt, hsa
auugucuuccgaguuuuuugguuccuuuuuuaacuguguuaaaguacuugaaauguauugacug

SEQ ID NO: 79683 - RNA, 64 nt, hsa
guaugcuuuacugauaagugugccaauaauaaacuguguuaaugaccaaagcaagugaaucugg

SEQ ID NO: 79684 - RNA, 64 nt, hsa
guuccuccacacauguaaaggcacaguggcuccguguguuaaaaaacagcuguauuuuauguau

SEQ ID NO: 79685 - RNA, 64 nt, hsa
ggauucauguauuauuguuauugaauccaaacaauguguuaaguaauauuuagggccagaaaaa

SEQ ID NO: 79686 - RNA, 64 nt, hsa
cuaagacaaauauuuaaacauuuuaaagaaccacuguguuaaguuuaggauuauuuacuuacca

SEQ ID NO: 79687 - RNA, 64 nt, hsa
ccuuuaaaagaggggucaauccucaugaucccuguguguuaagcauaugcuuugcaggugcuca

SEQ ID NO: 79688 - RNA, 64 nt, hsa
gucuacuggauuucuuuacuacugauccuuucgcuguguuaaaaaucaagucacagagaccucu

SEQ ID NO: 79689 - RNA, 64 nt, hsa
gugucuaaauuugaauguuaagcagauggaaugcuguguuaaauaaaccucaaaaugucuaaga

SEQ ID NO: 79690 - RNA, 64 nt, hsa
cccugcuucugacacugaaacuucccuuucugcuuguguuaaguauguguaaaaugugaaguga

SEQ ID NO: 79691 - RNA, 64 nt, hsa
uaguuuguuuuaaagucaucuuuacuuucccaaauguguuaaauuuguaacuccucuuuggggu

SEQ ID NO: 79692 - RNA, 64 nt, hsa
cuuuuuaagcuuauuguguuuaagaaaguagcuauguguuaaacagaggugauggcagcccuuc

SEQ ID NO: 79693 - RNA, 64 nt, hsa
aauaucuauacagcacugauuuccuugaauauuguguguuaauugauauaucuucuagaggcaa

SEQ ID NO: 79694 - RNA, 64 nt, hsa
aauugauauaucuucuagaggcaaaagguuuaaauguguuaaaaugguuauauugccuccuuuu

SEQ ID NO: 79695 - RNA, 64 nt, hsa
acgauuuaggagaauguuaccuaggacauuuugauguguuaaguugaagaaagguaacucgugu

SEQ ID NO: 79696 - RNA, 64 nt, hsa
uguguggauaagccaucauuuguuuauucauccauguguuaauggguuuccagucucggcucuu

SEQ ID NO: 79697 - RNA, 61 nt, hsa
ggaaagagacuuugguguagagaaggcucuguguguuaacugaugggagagacuguuuguu

SEQ ID NO: 79698 - RNA, 64 nt, hsa
cugcaaauaaugaguuugaaaagaaacaaugaaauguguuaaaaauuugaccauauuagauaaa

SEQ ID NO: 79699 - RNA, 64 nt, hsa
gggcauaaacauguucauucuuguugagcugcauuguguuaaaccaaauugugugaagcgaggu

SEQ ID NO: 79700 - RNA, 64 nt, hsa
gggucucugugauuuccccaccuauguacuuuucuguguuaacucacuuauuaugguauaacuc

SEQ ID NO: 79701 - RNA, 64 nt, hsa
guauuacagcaauauucaaagaaagaaccacagauguguuaaccauuuaagcagaucaucugcc

SEQ ID NO: 79702 - RNA, 64 nt, hsa
cccuuuagaauggcuugucccaucagcagaugaauguguuaagcacaaagcaucuuccuuaaag

SEQ ID NO: 79703 - RNA, 64 nt, hsa
ucuuaucugaaaauuucaucuguaaccuuucauguguguuaagaaacacugaucugaucauuug

SEQ ID NO: 79704 - RNA, 64 nt, hsa
ggauuuugccaguuucuuuucacugaugcagauuuguguuaagauaguacugaauggaguauuu

SEQ ID NO: 79705 - RNA, 64 nt, hsa
acaauauuguuccuguccauucacccagccaaauuguguuaaagaggaaagccccacaaacuaa

SEQ ID NO: 79706 - RNA, 64 nt, hsa
ggaaagagguguuccucauuaucuaauauuucaauguguuaagaguuuaauuuuuuuguuauca

SEQ ID NO: 79707 - RNA, 64 nt, hsa
cauuuuagaaacaucuuagccguaaguuagguccuguguuaaacuguuuagugcucuguuuuua

SEQ ID NO: 79708 - RNA, 64 nt, hsa
gauacaguuuggcuguguccccaccaaauugaauuguguuaauaguucccauaaucccuacgug

SEQ ID NO: 79709 - RNA, 64 nt, hsa
uuugugcucaggcuacuaaaguaguuguuauagguguguuaacgaagaagcuuagugaggagca

SEQ ID NO: 79710 - RNA, 64 nt, hsa
gggucugaaugucuagcuggccauuggcuugugcuguguuaagaaaggggaaaaaaaaauaacc

SEQ ID NO: 79711 - RNA, 64 nt, hsa
uuaacagaauggcagacuaaacacacauucccuuuguguuaauaauuuaguuuuaagacaguaa

SEQ ID NO: 79712 - RNA, 64 nt, hsa
auuaggugugaaaauaggaaaauacagugcaaaauguguuaagggauuauaggacugucuuuga

SEQ ID NO: 79713 - RNA, 64 nt, hsa
aaagugcguuuucuguuuucauuuaauucaguuuuguguuaaggguggaacaaagcucuguucu

SEQ ID NO: 79714 - RNA, 64 nt, hsa
ccaauaugcgaaaaaaggguacauuuuaauuuaauguguuaaaaacacaaugucccuaccgugu

SEQ ID NO: 79715 - RNA, 64 nt, hsa
guucuagcuuuagauuuuggauuuucaccagucauguguuaauuuacauuagauaguaaagaau

SEQ ID NO: 79716 - RNA, 64 nt, hsa
cagguuguucauaauauuaaaaaucuuacguaguuguguuaaacugaaccaguucauuauaccu

SEQ ID NO: 79717 - RNA, 64 nt, hsa
cccuuucccuucccccaauaagaccauuuaaguguguguuaaacaacuacagaauacuaaauaa

SEQ ID NO: 79718 - RNA, 64 nt, hsa
cuuucgcauugcuuuucaacaagcaaauguuaaauguguuaagacuuguacuaguguuguaacu

SEQ ID NO: 79719 - RNA, 64 nt, hsa
gcugggauuacaggugugccaccgcgcccggccaagaugggaguauuuuuauggccauuuuaca

SEQ ID NO: 79720 - RNA, 64 nt, hsa
ggccaagaugggaguauuuuuauggccauuuuacagaugggagaacagucucagcacaauugag

SEQ ID NO: 79721 - RNA, 64 nt, hsa
gugguccugaacuggggccggguggggaagagugagaugggauaacauagccccugcuuggagg

SEQ ID NO: 79722 - RNA, 64 nt, hsa
cacacaccuguagucccagcuacuuaggaggcugagaugggaggauugaucgaucgcuugagcc

SEQ ID NO: 79723 - RNA, 64 nt, hsa
uuucugaaaaccaaugcgacaaauaaaguuggggagaugggaaucuuugacaaacaaauuauuu

SEQ ID NO: 79724 - RNA, 64 nt, hsa
aauaauagagagcuauggagucaaggcauguuuaagaugggagguagagcaugccaauauugau

SEQ ID NO: 79725 - RNA, 64 nt, hsa
auugauggcaacagucaagauggugugaugagagagaugggaggggcacaaagaggaggacccc

SEQ ID NO: 79726 - RNA, 64 nt, hsa
cacaagauggaaggcaggugaggaugucaggaugagaugggaccagguagccgaggacagugag

SEQ ID NO: 79727 - RNA, 64 nt, hsa
ggcucucccuccaggcugcugcugggcaugucauagaugggaugaaugaccaucugggguaugg

SEQ ID NO: 79728 - RNA, 64 nt, hsa
uagcuuccuaaggggggagggaaccgaguuaucaagaugggaggauuuuucuuuucucucuguc

SEQ ID NO: 79729 - RNA, 64 nt, hsa
cacaugccuguggccccagccacucugaacgcugagaugggaaggucacuugagcccaggaccc

SEQ ID NO: 79730 - RNA, 64 nt, hsa
gguuaauuguuuuuuuuuaauuuaucuuuuguagagaugggaucucacuauguugcucaggcug

SEQ ID NO: 79731 - RNA, 64 nt, hsa
caggaucaaggaauuaggguggucuacuugaggcagaugggauaguagcugggaacuguucccu

SEQ ID NO: 79732 - RNA, 64 nt, hsa
guguuuuuaagcaucccuugggcuuuggauuuggagaugggaagagcaucuccaggcaaugagu

SEQ ID NO: 79733 - RNA, 64 nt, hsa
gcucacuuggucugagcucagcugaaugcagggaagaugggacagagugacauuucuccucugu

SEQ ID NO: 79734 - RNA, 64 nt, hsa
caucuugaaaacucguggaaagggaaaggggaggagaugggacuuugaccacacacagugaugc

SEQ ID NO: 79735 - RNA, 64 nt, hsa
ugcgugccuguagucccagcuacucgggaggcugagaugggagaaucacuugaaccugggaggc

SEQ ID NO: 79736 - RNA, 64 nt, hsa
agagagaguguuuugguuacaucagaaauaauugagaugggaaagaauagugcagcuccauaga

SEQ ID NO: 79737 - RNA, 64 nt, hsa
gcggcagagaaagaagaaagaccuagaagguuguagaugggaaaucaggaaugauuugaacuga

SEQ ID NO: 79738 - RNA, 64 nt, hsa
gccauggcucucugagccugaggauggaaaugggagaugggagcuguuuugucagugucuuggg

SEQ ID NO: 79739 - RNA, 64 nt, hsa
aaccagugccaaauucugaaugccagaugggaugagaugggauguuaaaccacuucuuauuacc

SEQ ID NO: 79740 - RNA, 64 nt, hsa
auauuucaauaaccagugccaaauucugaaugccagaugggaugagaugggauguuaaaccacu

SEQ ID NO: 79741 - RNA, 64 nt, hsa
cauauaguggaaaucugccaauacuaauugguggagaugggaacuguaaaagaucaaguaugcu

SEQ ID NO: 79742 - RNA, 64 nt, hsa
acagccagcccuugccagcugacgucacagucuaagaugggaaacugugguacagauagacaug

SEQ ID NO: 79743 - RNA, 64 nt, hsa
aggagauaaacaggguacuguacuggagaauaacagaugggaugcuucagguaggacaucaagg

SEQ ID NO: 79744 - RNA, 64 nt, hsa
accuuguggaaucuguuuccuauauuugaauauuagaugggaaaauuagugucuagaaauacuc

SEQ ID NO: 79745 - RNA, 64 nt, hsa
caccacacccggcuaauuuuuggauuuuuaguagagaugggauuucaccguauuagccaggaug

SEQ ID NO: 79746 - RNA, 64 nt, hsa
gaguggaguucucuguucuagagugacaggcaccagaugggaugggcuuucucagugucagcac

SEQ ID NO: 79747 - RNA, 64 nt, hsa
gacccucaagaaaaugacggagaacaucccagacagaugggacucaagcaggaugggugcuaua

SEQ ID NO: 79748 - RNA, 64 nt, hsa
ccucucugguccucagcuuccuccaucauggaggagaugggaucauggauuuucugggcauaag

SEQ ID NO: 79749 - RNA, 64 nt, hsa
ugggguggcaguuggcacagcgcagaugcgguagagaugggaggaaacccagcuccucacuucc

SEQ ID NO: 79750 - RNA, 64 nt, hsa
aaguaggcuucagugcauaccaggguaucacuggagaugggaguuagugaaggggugacucccu

SEQ ID NO: 79751 - RNA, 64 nt, hsa
aagauuuuuguaaaaagcuacaaaaaacugcaguuugaucaaauuuggguauaugcaguaugcu

SEQ ID NO: 79752 - RNA, 64 nt, hsa
acacaaggagaacccaauuuuguuucaacaauuuuugaucaauguauaugaagcucuugauagg

SEQ ID NO: 79753 - RNA, 64 nt, hsa
cagaaauguacauacuacaucaucuacagaaaucuugaucaauaaccuagaaacuagguuaucu

SEQ ID NO: 79754 - RNA, 64 nt, hsa
gaucaauaaccuagaaacuagguuaucuagguuauugaucaagauuucuguagaugaugcagug

SEQ ID NO: 79755 - RNA, 64 nt, hsa
aacuaaaagccauauguggaauauugacauguguaagaagcacuuucagaauguuguccuuuuu

SEQ ID NO: 79756 - RNA, 64 nt, hsa
auuugcguugcauaaauagccaugugaauuccacaagaagcaccagggaaaguuuagagauuug

SEQ ID NO: 79757 - RNA, 64 nt, hsa
gacaagacugagagaguuacauguugggaaaaaaaagaagcauuaacuuaguagaacugaacca

SEQ ID NO: 79758 - RNA, 64 nt, hsa
ucacaugccauucaccagauuauuugaugguacaaagaagcagaaguguaauuuuccuuuuccc

SEQ ID NO: 79759 - RNA, 64 nt, hsa
gguauaauccaaccaucaaaauagaagaccuugcaagaagcagagucauucuccagaaggaacu

SEQ ID NO: 79760 - RNA, 64 nt, hsa
uuuccuucuguaucacuccaagcagccucagcagaagaagcagccaugcccaguauucccacuc

SEQ ID NO: 79761 - RNA, 64 nt, hsa
ccuuaauaucccacucaagguugaagaagaaaugaagaagcaugaaaguaauaaugugggauua

SEQ ID NO: 79762 - RNA, 64 nt, hsa
ccagcuagaaaauuuuauggcuaucgaagaaaugaagaagcacggaaguacucaugucggauuc

SEQ ID NO: 79763 - RNA, 64 nt, hsa
aacagugugaaucuuuauaguauuugaaaaugagaagaagcagcagauuguaauuugguuuauu

SEQ ID NO: 79764 - RNA, 64 nt, hsa
gacacuucuuacauuguggcaagaaaaaaugaggaagaagcaaaagcagaaaccccugauaaac

SEQ ID NO: 79765 - RNA, 64 nt, hsa
ggcacuucuuacauggcagcaagagaaaaugaggaagaagcaaaaguggaaaccccugauaagc

SEQ ID NO: 79766 - RNA, 64 nt, hsa
ucuuucuugggccugcaccuccaagauaacaaagaagaagcaauggucgugccaaagaggucca

SEQ ID NO: 79767 - RNA, 64 nt, hsa
accuuggcaucguugugccuaaccugggagacggaagaagcacgccaugggaaguguuuacacu

SEQ ID NO: 79768 - RNA, 64 nt, hsa
ggguuuaaagaaauggucugcauaaccugaaugaaagaagcaaaugacuauucucugaagacaa

SEQ ID NO: 79769 - RNA, 64 nt, hsa
agaugcugugguggaugagguuggaguucgaaagaagaagcaagcgcuggccuggccuugaaag

SEQ ID NO: 79770 - RNA, 64 nt, hsa
gaaauaggaauccggcagaagaccuucauuaauuaagaagcaaacaaaaagagagcaacccaac

SEQ ID NO: 79771 - RNA, 64 nt, hsa
cuuccaaacaaugugaauuuaaaaggucacacaaaagaagcaaucgggcuccgccaccacaaaa

SEQ ID NO: 79772 - RNA, 64 nt, hsa
ugcuacauaauuauccaggaagggaauaagguacaagaagcauuuuguaaguugaagcaaaucg

SEQ ID NO: 79773 - RNA, 64 nt, hsa
guggacuggccucaaagcaagcauucagaagaaaaagaagcaaccucaguaauuuagaaaucau

SEQ ID NO: 79774 - RNA, 64 nt, hsa
accuuugauacgcuaaugugcauuuuaaaucuccaagaagcaccucuauuuuauacaucauuuc

SEQ ID NO: 79775 - RNA, 64 nt, hsa
gagcucauguucuucugauauguagacuuugauaaagaagcauacuguaauguuuuaugaacug

SEQ ID NO: 79776 - RNA, 64 nt, hsa
gcucuucuucauuucccagcguggcccugguuggaagaagcagcugucacagcugcuguagaca

SEQ ID NO: 79777 - RNA, 64 nt, hsa
uuuaagaacauaauucuuuuguugcuguuuguuuaagaagcaccuuaguuuguuuaagaagcac

SEQ ID NO: 79778 - RNA, 64 nt, hsa
uugcuguuuguuuaagaagcaccuuaguuuguuuaagaagcaccuuauauaguauaauauauau

SEQ ID NO: 79779 - RNA, 64 nt, hsa
cgugaggacaguugaauuuggggcauuuuucuacaagaagcagucagccuucucucccccauaa

SEQ ID NO: 79780 - RNA, 64 nt, hsa
uggcucugacccccucucaucccggaagaagaggaagaagcagaacagacuaguuuugaguaaa

SEQ ID NO: 79781 - RNA, 64 nt, hsa
uaaggaagaagccucccauauagacuugaucucaaagaagcagauaagaagacagaaaaguguu

SEQ ID NO: 79782 - RNA, 64 nt, hsa
ccaaaugaaguuguucucaggugaacugagccaaaagaagcaacucuuaccaugaggugauuuc

SEQ ID NO: 79783 - RNA, 64 nt, hsa
auggaaacugugggacacagauguggaauacaagaagaagcaggaccccuacuugcugaagaca

SEQ ID NO: 79784 - RNA, 64 nt, hsa
aaauggauuuccaccugacaaaucuucgggauccaagaagcagaaacaauaucagcggauucgg

SEQ ID NO: 79785 - RNA, 64 nt, hsa
acuucuuacauggcggcagcaagagaaaaugagaaagaagcaaaaguggaaaccccuaauaaac

SEQ ID NO: 79786 - RNA, 64 nt, hsa
acuucguacauggugguggcaagagaaaaugaagaagaagcaaaaguggaaaccccugauaaac

SEQ ID NO: 79787 - RNA, 64 nt, hsa
cuaccuaauuaugugaaagaagcaaaacuuuuugaagaagcaccccucuuucauguauuaaaau

SEQ ID NO: 79788 - RNA, 64 nt, hsa
uaucuaaccuacagaaaucuaccuaauuaugugaaagaagcaaaacuuuuugaagaagcacccc

SEQ ID NO: 79789 - RNA, 64 nt, hsa
auugauguugucuuuaccagaaagguagacaaaaaagaagcagcagcagcucuuaaagugaggg

SEQ ID NO: 79790 - RNA, 64 nt, hsa
auaacagguacuuugaaggcaagacauaggguugaagaagcacagccagccucugaaaucauag

SEQ ID NO: 79791 - RNA, 64 nt, hsa
gcugcugcgcuagacuuggauauuuuggguagugaagaagcaauggcaaucuugagucuauuau

SEQ ID NO: 79792 - RNA, 64 nt, hsa
uuaaccucagaauucauaauuccugagggguguuaagaagcagucccauuggugaggauauuau

SEQ ID NO: 79793 - RNA, 64 nt, hsa
uguccggcauccaaaaaaacuaauguguuaugcaaagaagcaauaaaauaugacuuauaaccag

SEQ ID NO: 79794 - RNA, 64 nt, hsa
uugacuuaguacugacuugcacugaggccaggaaaagaagcacuggaaagcagcaggcugaaca

SEQ ID NO: 79795 - RNA, 64 nt, hsa
aauuaauugaaggcagcaaaaggcacaguaggucaagaagcaggucucgaucccggaccagaag

SEQ ID NO: 79796 - RNA, 64 nt, hsa
cccguucccguagucgcaaaucuuacagccggucaagaagcaggagcaggagccggagccggag

SEQ ID NO: 79797 - RNA, 64 nt, hsa
agggcacacuggcagaggguaucugaagugggagaagaagcagguagaccaccugucccaggcu

SEQ ID NO: 79798 - RNA, 64 nt, hsa
uuagcagcugcaggcaagcauuaugcugcuauugaagaagcauuagggguaugccuggcaggug

SEQ ID NO: 79799 - RNA, 64 nt, hsa
cuucaaccagaagagugcgcugcaggugcacaugaagaagcacacgggggagcggcccuacaag

SEQ ID NO: 79800 - RNA, 64 nt, hsa
aguaugucagauuuuccuucauguuucugguuauaagaagcauagcuuacaaagcaagcguaag

SEQ ID NO: 79801 - RNA, 64 nt, hsa
gcaagcaacgguggcccuguccaccccagcaaauaagaagcauaucuguagcuuaaggccacga

SEQ ID NO: 79802 - RNA, 64 nt, hsa
ggagaucacacaacauuuauucuucuuacagguaaagaagcagauuuuagaugaaaagaucuac

SEQ ID NO: 79803 - RNA, 64 nt, hsa
gaugaguuggagaggaggcugcugcagaugaaagaagaagcaacaauggccaacgaagcacugg

SEQ ID NO: 79804 - RNA, 64 nt, hsa
guaacaguguaguacucaguaacagugaaguacucaguaauacaguacaguauucaguaaggca

SEQ ID NO: 79805 - RNA, 64 nt, hsa
uacaguacaguauucaguaaggcagugaaguacucaguaauacaauacaguacucaguuaggca

SEQ ID NO: 79806 - RNA, 64 nt, hsa
ggcagugcaguacucaguaacacagugcaguacucaguaauacaguacaguacucaguaaggca

SEQ ID NO: 79807 - RNA, 64 nt, hsa
uuuucuuucacuggccugaguuaggacaugcuaucaguaauagucccaguuccauccaacuuuc

SEQ ID NO: 79808 - RNA, 64 nt, hsa
acugauuaauugguuacuccuucuuauuauaacucaguaauaccuguggucauuugguuccucu

SEQ ID NO: 79809 - RNA, 64 nt, hsa
gaugacagagaucuucauuaaacaagaucugggacaguaauaaaagauugcugcauaauuuaaa

SEQ ID NO: 79810 - RNA, 64 nt, hsa
aauuuaaaggaaaaauaggugccuccuuuauaaacaguaauagcuacguuugggaaggaggaaa

SEQ ID NO: 79811 - RNA, 64 nt, hsa
auuuguaaaauuuaguaguucauauuuaguauaucaguaauauagaagacaucuuuauagucaa

SEQ ID NO: 79812 - RNA, 64 nt, hsa
aaugagaagaaaugauucauaaauuuugaacuaacaguaauaacuucuugaaaauccaauaaaa

SEQ ID NO: 79813 - RNA, 64 nt, hsa
cuugaaaaaaaauuuuuugauaugacuacucuaacaguaauaacuauaaaucucacuuuaaaua

SEQ ID NO: 79814 - RNA, 64 nt, hsa
caaaaaaaauuguguaguauuuaccagcaccauucaguaauacagccuuaaccauaccuccuug

SEQ ID NO: 79815 - RNA, 64 nt, hsa
ccuuuaaggcagacaagggcuaagauuuccuuagcaguaauaaugacauacacugaauugaaaa

SEQ ID NO: 79816 - RNA, 64 nt, hsa
cuggagguacuacggucuauuucucaaccuuaggcaguaauagacaucacaaacugccaugguu

SEQ ID NO: 79817 - RNA, 64 nt, hsa
aauaccugcauuucuaauuuuuuaagcauguagccaguaauaauuugaaguuuuuuuucuaugc

SEQ ID NO: 79818 - RNA, 64 nt, hsa
uuuuuuaccacugauaguauuucauauggucccucaguaauauuucuuagagaugguuaaaaau

SEQ ID NO: 79819 - RNA, 64 nt, hsa
aguaggcuuuaaagaaacagugcagcagugguuucaguaauaauccucacuuccaucagaaucu

SEQ ID NO: 79820 - RNA, 64 nt, hsa
gguguuuacacaaccaaauuugaugcgaucugcucaguaauauaauuugccauuuuuauuagaa

SEQ ID NO: 79821 - RNA, 64 nt, hsa
gaaugauuuguaaauagcuacuggaaauauuauacaguaauaggaguggguauuaugcaacauc

SEQ ID NO: 79822 - RNA, 64 nt, hsa
cuuuaagguguuuucaaugugauuuuaguauuuacaguaauaaauaaaauuuauacaaaguuuc

SEQ ID NO: 79823 - RNA, 64 nt, hsa
acauuucaaaggaaauaaaucaguguccguuugccaguaauaaauuuaauauucuguuuuauac

SEQ ID NO: 79824 - RNA, 64 nt, hsa
uaccaugauuuucuuugaaagauaaggauguaaugauuuagauaaagcaucauguaaagaaauc

SEQ ID NO: 79825 - RNA, 64 nt, hsa
cucuuagaaaaaaaaaauucuguaauguccucuagauuuagauuaugagcccugaggaguuauu

SEQ ID NO: 79826 - RNA, 64 nt, hsa
uagacuaaaguuucacaucagacuguaccauugugauuuagaccuaucuaaaauucagagcaua

SEQ ID NO: 79827 - RNA, 64 nt, hsa
uuaccaaguaucugaagagaugaguucauacuaugauuuagaaagugguucaauuccccuguug

SEQ ID NO: 79828 - RNA, 64 nt, hsa
acgcuccuuuguaggguuuuaaacuuuucuaauagauuuagauucacuuuuggucuuggcuugu

SEQ ID NO: 79829 - RNA, 64 nt, hsa
uuugaggaaugaugugauguguagagaauagaaagauuuagauauaugccugugacaggaauag

SEQ ID NO: 79830 - RNA, 64 nt, hsa
ucugauauauauuguguaaccugucaggugaguugauuuagacaacauagcugaccuuuuauga

SEQ ID NO: 79831 - RNA, 64 nt, hsa
ucccuuauggucagugauugaugaccucgauauggauuuagauuaucaaauguguuugguuuug

SEQ ID NO: 79832 - RNA, 64 nt, hsa
uucagcuucacuugcagaucacuagugaaugugagauuuagagcucauugaguauauugcuuca

SEQ ID NO: 79833 - RNA, 64 nt, hsa
gauccagucacugacuugauugagggauaagugugauuuagaaauggaauggccuuggaugucu

SEQ ID NO: 79834 - RNA, 64 nt, hsa
acucuucaagucaccuaaagcuauuaugcaggaggauuuagaagucacauucauaaaacccaag

SEQ ID NO: 79835 - RNA, 64 nt, hsa
uaauuuuuuuuuaaguaggaccaaaggaaaacaagauuuagauagucugacuuugcuuuugaac

SEQ ID NO: 79836 - RNA, 64 nt, hsa
uuucagugugaaaugguaaacauccaauugacaggauuuagauuuugcuuaguuuuucugcuuu

SEQ ID NO: 79837 - RNA, 64 nt, hsa
ugaagaaaaaaacaaguuaaaaacugaauguacugauuuagaaaauauauauaaauauauauug

SEQ ID NO: 79838 - RNA, 64 nt, hsa
uuuuccuucuugaagacuaguaguaacaucuuaugauuuagaguaaguugauuguaaccauagg

SEQ ID NO: 79839 - RNA, 64 nt, hsa
gacaagacauuguguguauuagagacuccugaaugauuuagacaacuucaaaauacagaagaaa

SEQ ID NO: 79840 - RNA, 64 nt, hsa
aucaaauaguaaaguuguuguaaaaauaaaaguggauuuagaaagauccaguucuugaaaacac

SEQ ID NO: 79841 - RNA, 64 nt, hsa
aagaagcugcagaagaaaugaagaaagugaugaugauuuagauuuugauauugauuuagaagac

SEQ ID NO: 79842 - RNA, 64 nt, hsa
ugaagaaagugaugaugauuuagauuuugauauugauuuagaagacacaggaggagaccaucaa

SEQ ID NO: 79843 - RNA, 64 nt, hsa
agccuggcugucucuagcgagggguggagaaucagauuuagagggagggagagucugaccugga

SEQ ID NO: 79844 - RNA, 64 nt, hsa
agacucuccaccugaguucagugagagagaaaaugauuuagaucuuggugcuggggcaaggcca

SEQ ID NO: 79845 - RNA, 64 nt, hsa
gaaggacauugccuuuugagauuaaauauugucugauuuagagagcauggaggugggcagagua

SEQ ID NO: 79846 - RNA, 64 nt, hsa
auuuaauucuugguauuauaaguugcaaccauuugauuuagaauguaugcagcucucauguuug

SEQ ID NO: 79847 - RNA, 64 nt, hsa
ggcaaauuuaggagcuuguucccauugccaaauggauuuagaaauucccuugugagugccuggu

SEQ ID NO: 79848 - RNA, 64 nt, hsa
caaaguuuacaaccuuauuccaugcugucuuucagauuuagaaaagaucuaauuucugucucag

SEQ ID NO: 79849 - RNA, 64 nt, hsa
aagguugaauugaaaaaaaaaaacagucaauauggauuuagaaaaaggaacaccugaugaagaa

SEQ ID NO: 79850 - RNA, 64 nt, hsa
caagcauaaaaggaaaaagaguuaugaagauacagauuuagacaaagacaagagcaucagacaa

SEQ ID NO: 79851 - RNA, 64 nt, hsa
gucuggcauggcaauuaaucacuaaugaauuaugcgaaagcaacauauuugauaaccguugcag

SEQ ID NO: 79852 - RNA, 64 nt, hsa
aggcuccugcuuaaaguccacacguuauuauggccgaaagcaaccuggugcuucggccuggaua

SEQ ID NO: 79853 - RNA, 59 nt, hsa
guggucaaagcguuccauaguucccuccacgaaagcauucagaaacccuacaaccaaaa

SEQ ID NO: 79854 - RNA, 64 nt, hsa
uacugcaccguacaugccagcguacccauugcaccgaaagcaggcccuuagggcaggaagggac

SEQ ID NO: 79855 - RNA, 64 nt, hsa
agcuggaguuauuggaaccacuuuguagucaagacgaaagcacugaauuuugcuucaaagaacu

SEQ ID NO: 79856 - RNA, 64 nt, hsa
cauauugcccagaaaucuacuuuaaugucucuuucgaaagcauuaauucacuuuccuuuuuccu

SEQ ID NO: 79857 - RNA, 64 nt, hsa
aaugaggcugguucugcacucucagcaugcaguccgaaagcaugugggaguggggagggaaagu

SEQ ID NO: 79858 - RNA, 59 nt, hsa
uugggagugagaagccuuaagagaagcagcgaaagcagaucugagugucugacccagga

SEQ ID NO: 79859 - RNA, 64 nt, hsa
gugagacuccaucucuauauaaaaacaaaaaccacgaaagcacacacaaaauaaaucaguggga

SEQ ID NO: 79860 - RNA, 64 nt, hsa
aaaagugucucccuguggaaaggcauaacugugacgaaagcaacuuuuauaggcaaagcagcgc

SEQ ID NO: 79861 - RNA, 64 nt, hsa
uguauauuuuggaggacgggugaagaggucauaacgaaagcaagcgagugaauuaggauuucaa

SEQ ID NO: 79862 - RNA, 64 nt, hsa
gaaaugagaagcuaucaguaacagcuacucucaucgaaagcacuuuauuauuuuacggagcugc

SEQ ID NO: 79863 - RNA, 64 nt, hsa
uggagcauuuuaaagccccauacacagaaguauacgaaagcacacaaaacacuccaaguuucag

SEQ ID NO: 79864 - RNA, 64 nt, hsa
agggaaaaaagacaaaaagcauaaggcuccaaaacgaaagcaagcauuucacuggcagccucca

SEQ ID NO: 79865 - RNA, 64 nt, hsa
ccuugugugccacugguguucuuuccacuuuauacgaaagcaaguagccaugcuuugguugugu

SEQ ID NO: 79866 - RNA, 64 nt, hsa
uggcuuaauugccuaucagacgcauuuucccagacgaaagcaauguuggguuggggaagacagu

SEQ ID NO: 79867 - RNA, 64 nt, hsa
aggggaggcugugggacuucaccacguggacaaacgaaagcacaggcuacucagacuuggccac

SEQ ID NO: 79868 - RNA, 55 nt, hsa
gcgagggacaguucaacugaaacuucgaaagcaucauuauuugcagagacaggac

SEQ ID NO: 79869 - RNA, 64 nt, hsa
ggaaaacgaagauggagagagcacuuccccguaacgaaagcaaagugguaagcacagggugaga

SEQ ID NO: 79870 - RNA, 64 nt, hsa
aaaaaaagucaaagacaacauuauaacuaaaagucgaaagcacacaaaauauaaauaauagugu

SEQ ID NO: 79871 - RNA, 64 nt, hsa
gagccuguggaaaggcagagcccuuuugcagauacgaaagcaagcuuuugccaaugaucuuuaa

SEQ ID NO: 79872 - RNA, 64 nt, hsa
ucuuucuuaaugccugaaauuuucuccauuggcccgaaagcaguaaaaauuguucauuaaucuu

SEQ ID NO: 79873 - RNA, 64 nt, hsa
auucccagacuggcuugaccacuggaugcuuugccgaaagcagcuuggcuugguagcucuggga

SEQ ID NO: 79874 - RNA, 64 nt, hsa
ggcagugucaccgcaaagggaggaaacucaaagccgaaagcaaaauuccaggccugauucuggc

SEQ ID NO: 79875 - RNA, 64 nt, hsa
ucuguugcugcugcugaacucagcuguuguagcacgaaagcagccagguaauuacuagaugaag

SEQ ID NO: 79876 - RNA, 64 nt, hsa
agccaugacagauggcuuuuuggcuaggacuguucgaaagcaggcgagguaaauggacagugga

SEQ ID NO: 79877 - RNA, 64 nt, hsa
cuuaaaaggcccaagcacugaaaauggaaccuggcgaaagcagaggaggagaaugaagaaagau

SEQ ID NO: 79878 - RNA, 64 nt, hsa
guaagcacuucugagcucuuuagcauugaagugucgaaagcaacucacacgggaagaucauuuc

SEQ ID NO: 79879 - RNA, 64 nt, hsa
aaaccauaauucaacuuuucuuuuuaaaucagcucgaaagcauguacuuaaaugaagcauauuc

SEQ ID NO: 79880 - RNA, 64 nt, hsa
ccagccugcagcacaccccacagccaaguagaggcgaaagcaguggcucauccuaccuguuagg

SEQ ID NO: 79881 - RNA, 64 nt, hsa
uccaagggcaagacuuggugcccagcuggaaggacgaaagcacacuuugugaccgccauccuca

SEQ ID NO: 79882 - RNA, 64 nt, hsa
agugccucaugacugaaaacaaaaaacaaaaaaacgaaagcaucuucacaaugaagcuuccaga

SEQ ID NO: 79883 - RNA, 64 nt, hsa
guuugggaaagucagcaaaagaaagaaugcauuucgaaagcaaacagaagaaaaaaguauauuc

SEQ ID NO: 79884 - RNA, 64 nt, hsa
cccugugcccccagccucagcccaacuucuuacccgaaagcaucacugccuuggccccucccuc

SEQ ID NO: 79885 - RNA, 64 nt, hsa
cucuccacaccccuccuguuccagaaagcauguccgaaagcaguccaggagauuauuaaggggu

SEQ ID NO: 79886 - RNA, 64 nt, hsa
gauccagugggguccggacacugggccccgcaggcgaaagcacguuccagccaccaggaggcca

SEQ ID NO: 79887 - RNA, 64 nt, hsa
cacuguuaggccuuuauuuuauuuuauuuuccaucgaaagcauuggaggcccagugcaauggcu

SEQ ID NO: 79888 - RNA, 64 nt, hsa
uauauccuauauucuguuaaaauucaaaagugaacgaaagcauuuaacuggccaguuuugauug

SEQ ID NO: 79889 - RNA, 64 nt, hsa
ucugggcgggcccaguggaguuuggggaggggggcgaaagcaacgggacugcugggagaggagg

SEQ ID NO: 79890 - RNA, 64 nt, hsa
gacgacagaggguccuaggcuggaauguuccuuucgaaagcaaugcuucuaucaaauacuagua

SEQ ID NO: 79891 - RNA, 64 nt, hsa
gacggccaaccgccaugugauguaagccuccauacgaaagcacuguugcagauagaagaagagg

SEQ ID NO: 79892 - RNA, 64 nt, hsa
uuuuuucauacauuuaguaugaaaacuugaacagcgaaagcagagcauguuauuuauauaacug

SEQ ID NO: 79893 - RNA, 64 nt, hsa
ggaucauuucagacccgcacuucggcagccaacucgaaagcaggcgguugugugcggcagcagu

SEQ ID NO: 79894 - RNA, 64 nt, hsa
ugaacucuagcacugguguauaugagaaggaaggcgaaagcaugacaggaaaccugccgccugc

SEQ ID NO: 79895 - RNA, 64 nt, hsa
uaaacuaagaaaaagguaagaacugucucaaaaacgaaagcacaccacccaagacacaguaccc

SEQ ID NO: 79896 - RNA, 64 nt, hsa
cacagaauucaggaaacugcuagacagccugguccgaaagcauugccagcugcccguuuccucc

SEQ ID NO: 79897 - RNA, 64 nt, hsa
gauuucaugacaaagaucccaaaaauaauuguaacgaaagcaaaaauugacaaaugggacauga

SEQ ID NO: 79898 - RNA, 64 nt, hsa
ugcugcuacaauacggcuaaucuuucauugggaccgaaagcaaaggucaguacagaaacaaguu

SEQ ID NO: 79899 - RNA, 64 nt, hsa
uuuccuuucuuugucccccacucccgauacccagcgaaagcacccucugacugccagauagugc

SEQ ID NO: 79900 - RNA, 64 nt, hsa
uggagauaugaggacccccuguucuuccucccaacgaaagcauggaagcccuaagcuuaucccc

SEQ ID NO: 79901 - RNA, 64 nt, hsa
cucuguccccuugauccuggcauucuggaagacacgaaagcaagcaaggauauauaaggcacug

SEQ ID NO: 79902 - RNA, 64 nt, hsa
cuugaaaaagcaucacagaaguagaaaaaaaugucgaaagcauuauaacuguaacguucuuuga

SEQ ID NO: 79903 - RNA, 64 nt, hsa
gcccacuucacaucuccccuaccagcagauucugcgaaagcaccaaauuucucaagacccucuu

SEQ ID NO: 79904 - RNA, 64 nt, hsa
cuguguaaagacagauuauuuucuaggauucauucgaaagcacaucuuuuaaauuaagccacug

SEQ ID NO: 79905 - RNA, 64 nt, hsa
cggcgugagcggagggagugugaugauucccaaccgaaagcagcugucucgccuuuagaacgug

SEQ ID NO: 79906 - RNA, 64 nt, hsa
cuugggcuaggugacaaguucuuggacuuugccccgaaagcacauccauaaaagacaaaaucug

SEQ ID NO: 79907 - RNA, 64 nt, hsa
ucccagcugugcucuggacaggcauguucucugaggacacuaaccacgcuggaccuugaacugg

SEQ ID NO: 79908 - RNA, 64 nt, hsa
gaugcaccagcccuuagcagggaaacagcuaaugggacacuaauggggcggugagaggggaaca

SEQ ID NO: 79909 - RNA, 64 nt, hsa
gcggggaugacgaugccaaguacaccugcaaggcugucaacagucuuggagaagccaccugcac

SEQ ID NO: 79910 - RNA, 64 nt, hsa
ugcaccuggaccucaagccggagaacaucaugugugucaacaagacgggcaccaggaucaagcu

SEQ ID NO: 79911 - RNA, 64 nt, hsa
cgggccucgggccugacccguccacacagggccgugucaacagcagcgacucaagggacgugug

SEQ ID NO: 79912 - RNA, 64 nt, hsa
acguguguacauauguaaaugagaaauagagacgugucaacagaugcauucauuucucuuggaa

SEQ ID NO: 79913 - RNA, 64 nt, hsa
uuugucaacacaaagacauggaagauuagagguuugucaacacaaagacacaggaagaaugggc

SEQ ID NO: 79914 - RNA, 64 nt, hsa
gguuugucaacaaaaagacauggaagguuagguuugucaacacaaagacauggaagauuagagg

SEQ ID NO: 79915 - RNA, 64 nt, hsa
uuugucaacacaaagacauggaagguuagagguuugucaacaaaaagacauggaagguuagguu

SEQ ID NO: 79916 - RNA, 64 nt, hsa
ggauagggucagaugcaccacccauggagagguuugucaacacaaagacauggaagguuagagg

SEQ ID NO: 79917 - RNA, 64 nt, hsa
cacuugggggcacuggccucuuagguuuuaacgaugucaacaguguaguuuagaaaauggcccg

SEQ ID NO: 79918 - RNA, 64 nt, hsa
auaguuaaaucuugauuuuagaagaaaacccuuuugucaacaauuuuguguacauauuuggcau

SEQ ID NO: 79919 - RNA, 64 nt, hsa
auuuaaguguaauucauuucaaaugucacaaguaaagcaucauccucaaauaucucacugucaa

SEQ ID NO: 79920 - RNA, 64 nt, hsa
uucuuugaaagauaaggauguaaugauuuagauaaagcaucauguaaagaaauccuaacauuua

SEQ ID NO: 79921 - RNA, 64 nt, hsa
gaggaaggccuucagucagggcucaucccuuauuaagcaucagaaaauucauaccugagaaaaa

SEQ ID NO: 79922 - RNA, 64 nt, hsa
uggaaaaaucuucaguuguaucucuuccuuuacuaagcaucaagaacacauacuagagagaggc

SEQ ID NO: 79923 - RNA, 64 nt, hsa
caucacauuucaggccccaagcaaucucugugcaaagcaucagaaagaccugcuucccagcccc

SEQ ID NO: 79924 - RNA, 64 nt, hsa
cauccuaugcauguaagcauuauuucccaaaccaaagcaucauucaucuccauuuauuucuuuu

SEQ ID NO: 79925 - RNA, 64 nt, hsa
ggaauugaauggguuugcuagaaugugauauuugaagcaucacauaaaaaugaugggacaauaa

SEQ ID NO: 79926 - RNA, 64 nt, hsa
cuuauuaaccuauuuauuauuuauguauuuauuuaagcaucaaauauuugugcaagaauuugga

SEQ ID NO: 79927 - RNA, 64 nt, hsa
ugcauuauuuuuuaaaaaguuuugauaacucuuaaagcaucauuugcaccuaugugggaacuuu

SEQ ID NO: 79928 - RNA, 64 nt, hsa
gucggccauaaacagcuauccugcuuuggaagagaagcaucaugagccaauuugauagguguuu

SEQ ID NO: 79929 - RNA, 64 nt, hsa
gcugacaacuugcacaauguugaacauagccuuuaagcaucauuuaaauuuuaaaggaauggag

SEQ ID NO: 79930 - RNA, 64 nt, hsa
aaaaaggacugaauuaguuuuuauuacuauauuaaagcaucaacauuucaugccacauaaauua

SEQ ID NO: 79931 - RNA, 64 nt, hsa
auuugugauguuaauacaggcuucuuguuuuaggaagcaucaccuauacucugaagccuuuaaa

SEQ ID NO: 79932 - RNA, 64 nt, hsa
cuaaaaugugaagcuuuaggaccaaauuguuagaaagcaucaggaugaccaguuaucucgagua

SEQ ID NO: 79933 - RNA, 64 nt, hsa
guuaaaaagaaacauaguguugcccuuuuucuuaaagcaucagugaaauuauggaaaauuacuu

SEQ ID NO: 79934 - RNA, 64 nt, hsa
ugcccuccccacuucccccgauucagagacuuagaagcaucagaguugauaaauuagauugaaa

SEQ ID NO: 79935 - RNA, 64 nt, hsa
cucagccacaaaacucugucaggcauugaaugacaagcaucaguagcugagugcacuccuggug

SEQ ID NO: 79936 - RNA, 64 nt, hsa
cuucauuaacuugacagaguacgugucuuaaaggaagcaucaagaauucaauauuugcauuuaa

SEQ ID NO: 79937 - RNA, 64 nt, hsa
agaaaauggaaucccugacagcuguguccguaucaagcaucagucucucaaacaguugccccag

SEQ ID NO: 79938 - RNA, 64 nt, hsa
ucuccuguguaucuuugaaguggcagacaaggcgaagcaucagacugguauuaauguuagagaa

SEQ ID NO: 79939 - RNA, 64 nt, hsa
ucuccuguguaucuuugaaguggcagauaaggugaagcaucagacugguaucaauauuagacaa

SEQ ID NO: 79940 - RNA, 64 nt, hsa
ggcauggagagcaagagaagguauguacugccugaggucacaugacagugaccaaguggagaca

SEQ ID NO: 79941 - RNA, 64 nt, hsa
gcccugcacuauggcuggaggacacauuugguagaggucacacugcagcucccagugccccagu

SEQ ID NO: 79942 - RNA, 64 nt, hsa
aagagccagagugggaagucaggccucucugggaaggucacaaggccugggguuguucacacca

SEQ ID NO: 79943 - RNA, 64 nt, hsa
acgccaugcugugccugggguccacagagccgggaggucacacauguacauccuggaagcugcc

SEQ ID NO: 79944 - RNA, 64 nt, hsa
caaagcuuccuaugagaagcuucugagauguagcaggucacagaaguguucaccuguuucaucu

SEQ ID NO: 79945 - RNA, 64 nt, hsa
uuuuuccucagagacaccccuaaaggcucccauuaggucacagcgugacugaaagcugauuucu

SEQ ID NO: 79946 - RNA, 64 nt, hsa
ggaaacugaggcucagagcagcagguguuacccaaggucacaaggccgaacauuuucagaaauc

SEQ ID NO: 79947 - RNA, 64 nt, hsa
ugugaagaguccagugguagaauuugagcuuucuaggucacauuggguuaaguuuguaugacca

SEQ ID NO: 79948 - RNA, 64 nt, hsa
uacuuuguaagguuggaacagcagcacuauacaugaaauauaaaccaaaaaccuuuacuguuuc

SEQ ID NO: 79949 - RNA, 64 nt, hsa
guauugcugcuugcaaauaugcauuuccaaacuugaaauauaggugugaacaguguguaccagu

SEQ ID NO: 79950 - RNA, 64 nt, hsa
auuguaugcauauauguguauauguuauaaacgugaaauauauuugacacacacauucacauau

SEQ ID NO: 79951 - RNA, 64 nt, hsa
uaauucaaggauugaaaaauuaacuggauaucuugaaauauacaguaaugauuguccuuagacu

SEQ ID NO: 79952 - RNA, 64 nt, hsa
acaaaaguuuugcuggcacgaaagaaacuagauggaaauauauguaauucucucauauuuaaaa

SEQ ID NO: 79953 - RNA, 64 nt, hsa
gccuucaucauaauuuguucccucaguaauaggagaaauauaaauacaguaaguuuagauuauu

SEQ ID NO: 79954 - RNA, 64 nt, hsa
aucaucagaucagcaugugcuauacucccugcaagaaauauacugacaugaacaggcaguucuu

SEQ ID NO: 79955 - RNA, 64 nt, hsa
acccuaauggaauaauuauuaaugaaagauuuuugaaauauaaaaaauaaauuaggcccaaucc

SEQ ID NO: 79956 - RNA, 64 nt, hsa
ucucauuuuaaaauuggacaguauuaaugaaggggaaauauacaauuuauuucuauugaguggu

SEQ ID NO: 79957 - RNA, 64 nt, hsa
cauguggaacaccaaacaggaaagaacuaugucugaaauauaaaaaauaaaaauaaaaaaacaa

SEQ ID NO: 79958 - RNA, 64 nt, hsa
aauguucuuuucaaucccaucuagauaauuuauagaaauauaacccuaauuggacaugugguac

SEQ ID NO: 79959 - RNA, 64 nt, hsa
aacuguauuuccugucaccuauucacuagugcaggaaauauacuugcuccaaauaagucaguau

SEQ ID NO: 79960 - RNA, 64 nt, hsa
acauauaucuguguauauaaauccacaugcacaugaaauauauauauauauauaauuugugugu

SEQ ID NO: 79961 - RNA, 64 nt, hsa
aguaaacccuaaguaaagucaaaauggagaaggggaaauauacagauggcuaguugcauaaaau

SEQ ID NO: 79962 - RNA, 64 nt, hsa
ucuugucauuaauauuauuuuguauuuuuauguggaaauauauaauuuuaugacacuaauugcu

SEQ ID NO: 79963 - RNA, 64 nt, hsa
uuuaaauuugcuaguggauuuugucuaaugugcagaaauauauaugucuaaugugcagaaauau

SEQ ID NO: 79964 - RNA, 64 nt, hsa
ucuaaugugcagaaauauauaugucuaaugugcagaaauauauauguguguauguguguauaua

SEQ ID NO: 79965 - RNA, 64 nt, hsa
aaaauauaugauuuuuaugucaaucaagacaaaugaaauauauauguauguguauauauauaca

SEQ ID NO: 79966 - RNA, 64 nt, hsa
auauauguauguguauauauauacauguauguaugaaauauauauaugugcgugugugugugua

SEQ ID NO: 79967 - RNA, 64 nt, hsa
auauuuguauguaaauuauauuuauacaucuucugaaauauauuucaaaauauguguguacgug

SEQ ID NO: 79968 - RNA, 64 nt, hsa
agauuauuugaaaaucauucuaaauauauauuuugaaauauauagauuauauuuguauguaaau

SEQ ID NO: 79969 - RNA, 64 nt, hsa
uuaguucaauuuaagccuauucaacagaaauauagaaauauaguagcuaaaaaaauacucuggg

SEQ ID NO: 79970 - RNA, 64 nt, hsa
agccuacauuaguucaauuuaagccuauucaacagaaauauagaaauauaguagcuaaaaaaau

SEQ ID NO: 79971 - RNA, 64 nt, hsa
cugaugaggcauuucuuacuagaaucccauaagugaaauauaauauuuuucaaaguugauauca

SEQ ID NO: 79972 - RNA, 64 nt, hsa
guucuaguuucccggcauugauaguucccuauuugaaauauaauguuucucuuguaagugauau

SEQ ID NO: 79973 - RNA, 64 nt, hsa
cauuaucagacagucuugauauuauacauuuucagaaauauauuaaaaauaauaaacuaaaacc

SEQ ID NO: 79974 - RNA, 64 nt, hsa
uacuuuaaaagccaaggugcccauauggaaaaaggaaauauacgaagagucaucaacuuggaaa

SEQ ID NO: 79975 - RNA, 64 nt, hsa
accaaaacauguugaacauccauguuguacaacugaaauauaaauaauuuugucaauuauaccu

SEQ ID NO: 79976 - RNA, 64 nt, hsa
aaaaaagucaacuccccuccccuugcccaaguaugaaauauagggacaguauguaugguguggu

SEQ ID NO: 79977 - RNA, 64 nt, hsa
uugauuuauggcuguuccugauuuuucauauguggaaauauaccuaccucuuccguuggaaaga

SEQ ID NO: 79978 - RNA, 64 nt, hsa
aaaaggcagcauuugaauacuccuguuaguagcagaaauauauuaugaaaauuaagauuauugu

SEQ ID NO: 79979 - RNA, 64 nt, hsa
caauagagauauaucuauuuucaauucaacuacagaaauauauuuuauuggccgggugcggugg

SEQ ID NO: 79980 - RNA, 64 nt, hsa
gagacuccgucucaaaaacaaaaaaaaaagaaaagaaauauauuuuauucauucacauuagguc

SEQ ID NO: 79981 - RNA, 64 nt, hsa
uuccuuacuagaaauauauucauaauauauaaaagaaauauaucugugauuuuaaaauuuugcu

SEQ ID NO: 79982 - RNA, 64 nt, hsa
caguuucugaagacuaguuauauauuccuuacuagaaauauauucauaauauauaaaagaaaua

SEQ ID NO: 79983 - RNA, 64 nt, hsa
ugccacuguuuuuaucaagaagggaaauauauuugaaauauaaaauauuaaaauuaugcucauu

SEQ ID NO: 79984 - RNA, 64 nt, hsa
gguuagaaaaaugccacuguuuuuaucaagaagggaaauauauuugaaauauaaaauauuaaaa

SEQ ID NO: 79985 - RNA, 64 nt, hsa
agaccuucauuuaagaggcagaagauuaagauaagaaauauaagauagaaaagcuuuguuccua

SEQ ID NO: 79986 - RNA, 64 nt, hsa
aucuuguaugauuuuuuauuuuuuaauaacauuggaaauauauucaagagauuaugauucugua

SEQ ID NO: 79987 - RNA, 64 nt, hsa
acuugugauaagcugcugcuccuauauuuuuuaagaaauauaauaaagcacuuagggcagggga

SEQ ID NO: 79988 - RNA, 64 nt, hsa
gccuuauuaagaacacuacuacaguucugaaggggaaauauaacaucuaugguuauauauuuua

SEQ ID NO: 79989 - RNA, 64 nt, hsa
uaaucucaucuguuuaccuagaagauagguuaaggaaauauauuauuauuccuguuugaugugg

SEQ ID NO: 79990 - RNA, 64 nt, hsa
aaaguuaacaaagggguacacaguauggucuuuggaaauauaauaaaacaucaacuaacuugga

SEQ ID NO: 79991 - RNA, 64 nt, hsa
uuaauguaucuugcuuuuguguucccgucuuuuugaaauauagacauggauuuauaauggcauu

SEQ ID NO: 79992 - RNA, 64 nt, hsa
aguguuugagguuauauaugcacaaacacacacagaaauauauucaugucuauguguauauaga

SEQ ID NO: 79993 - RNA, 64 nt, hsa
uaaagaaaggaugauuuauuuucagcaacauauagaaauauacuauaaauauuaauaauacaac

SEQ ID NO: 79994 - RNA, 64 nt, hsa
cagaaaaaaaguggaagguuugguuuccucauuugaaauauauccguacuaaugaacaaacuug

SEQ ID NO: 79995 - RNA, 64 nt, hsa
cacagaaaaucauuuauauuugagaaaaauuguagaaauauagacugugaaaaagacgucaaua

SEQ ID NO: 79996 - RNA, 64 nt, hsa
aaauuugucuauguaaauaccagaauuuauaguagaaauauaugaggaagcgacacuucgaaua

SEQ ID NO: 79997 - RNA, 64 nt, hsa
auacauccuauagaaacucacaaauaaugcauaagaaauauauauauaauauauguauguaugu

SEQ ID NO: 79998 - RNA, 64 nt, hsa
gaaacauagcaagaccccaucucuuaaaaaaaaagaaauauauagacauauaucugcauugaaa

SEQ ID NO: 79999 - RNA, 64 nt, hsa
cugccuuaaauuuccucuguuuuucacauucuuggaaauauaucauuguuuugcaaauuucuau

SEQ ID NO: 80000 - RNA, 64 nt, hsa
auucaggucaguaguauagcccagaaaauuuaaggaaauauauuauuuguuagucuguaucugg

SEQ ID NO: 80001 - RNA, 64 nt, hsa
acucagauaccagugcuggggagggaggccugacuucagcaacagcugugggugggcuggaggc

SEQ ID NO: 80002 - RNA, 64 nt, hsa
acccgcaaucugcuccagauucaagcaguaauauuucagcaagaggagguggucaugggaagcc

SEQ ID NO: 80003 - RNA, 64 nt, hsa
gacauucccuaccuuuaauagugcaaagcacaguuucagcaauggcuacaugacuaugucuaaa

SEQ ID NO: 80004 - RNA, 64 nt, hsa
cuuuaagagcaauggcacaauugcauguuuacuguucagcaaaucugugccucuugauagagaa

SEQ ID NO: 80005 - RNA, 64 nt, hsa
gaagccaaacaccggcauuuuauguacuuuguccuucagcaagaaagguguggaagcaugauau

SEQ ID NO: 80006 - RNA, 64 nt, hsa
aguuaacacaacguaacacuuaaaagcauacauuuucagcaaccaguggcacauauuugaagug

SEQ ID NO: 80007 - RNA, 64 nt, hsa
gccugcucuagucucaucucauaucuuuaauucauucagcaaguauacacaauaguauuaucgu

SEQ ID NO: 80008 - RNA, 64 nt, hsa
gacugcauaaauguaauaacugaggaggccuuuguucagcaaagaaaccuuauacaaacucgua

SEQ ID NO: 80009 - RNA, 64 nt, hsa
gucaauauugcuaucagcauuuugggcaaagccauucagcaaguaucuaggaaguuccaaacuu

SEQ ID NO: 80010 - RNA, 64 nt, hsa
guuccaaacuugcuuucauauuuuuggcuaucuuuucagcaaugccccacucuacuguuagcag

SEQ ID NO: 80011 - RNA, 64 nt, hsa
accuuaaaucagugaugugcugcauucggcucccuucagcaaauuucagggguuuucugggacc

SEQ ID NO: 80012 - RNA, 64 nt, hsa
aaggggaaccagggcaaaucuuauguaaagauuuuucagcaacuugucccaauuuguguguauu

SEQ ID NO: 80013 - RNA, 64 nt, hsa
uuucucaucauugggguuagcgggugcagacaaauucagcaauaguaugcagaucagccccuca

SEQ ID NO: 80014 - RNA, 64 nt, hsa
auuugguauguaucugaauuaauucucacuaaaauucagcaaaggacuugauagccccuccccg

SEQ ID NO: 80015 - RNA, 64 nt, hsa
uucauuuaaaguuuuauccaauauucuaggaauuuucagcaauacugauauucacuuuauuuuu

SEQ ID NO: 80016 - RNA, 64 nt, hsa
guuauuuaaaguuuuauccaguauucuaggaauuuucagcaauacuaauauucucauuuuuaaa

SEQ ID NO: 80017 - RNA, 64 nt, hsa; identical to SEQ ID NO: 58312

SEQ ID NO: 80018 - RNA, 64 nt, hsa; identical to SEQ ID NO: 58313

SEQ ID NO: 80019 - RNA, 64 nt, hsa; identical to SEQ ID NO: 58314

SEQ ID NO: 80020 - RNA, 64 nt, hsa; identical to SEQ ID NO: 58315

SEQ ID NO: 80021 - RNA, 64 nt, hsa; identical to SEQ ID NO: 58316

SEQ ID NO: 80022 - RNA, 64 nt, hsa; identical to SEQ ID NO: 58317

SEQ ID NO: 80023 - RNA, 64 nt, hsa; identical to SEQ ID NO: 58318

SEQ ID NO: 80024 - RNA, 64 nt, hsa; identical to SEQ ID NO: 58319

SEQ ID NO: 80025 - RNA, 64 nt, hsa; identical to SEQ ID NO: 58320

SEQ ID NO: 80026 - RNA, 64 nt, hsa; identical to SEQ ID NO: 58321

SEQ ID NO: 80027 - RNA, 64 nt, hsa; identical to SEQ ID NO: 58322

SEQ ID NO: 80028 - RNA, 64 nt, hsa; identical to SEQ ID NO: 58323

SEQ ID NO: 80029 - RNA, 64 nt, hsa; identical to SEQ ID NO: 58324

SEQ ID NO: 80030 - RNA, 64 nt, hsa; identical to SEQ ID NO: 58325

SEQ ID NO: 80031 - RNA, 64 nt, hsa; identical to SEQ ID NO: 58326

SEQ ID NO: 80032 - RNA, 64 nt, hsa; identical to SEQ ID NO: 58327

SEQ ID NO: 80033 - RNA, 64 nt, hsa; identical to SEQ ID NO: 58328

SEQ ID NO: 80034 - RNA, 64 nt, hsa; identical to SEQ ID NO: 58329

SEQ ID NO: 80035 - RNA, 64 nt, hsa; identical to SEQ ID NO: 58330

SEQ ID NO: 80036 - RNA, 64 nt, hsa; identical to SEQ ID NO: 58331

SEQ ID NO: 80037 - RNA, 64 nt, hsa; identical to SEQ ID NO: 58332

SEQ ID NO: 80038 - RNA, 64 nt, hsa; identical to SEQ ID NO: 58333

SEQ ID NO: 80039 - RNA, 64 nt, hsa; identical to SEQ ID NO: 58334

SEQ ID NO: 80040 - RNA, 64 nt, hsa; identical to SEQ ID NO: 58335

SEQ ID NO: 80041 - RNA, 64 nt, hsa; identical to SEQ ID NO: 58336

SEQ ID NO: 80042 - RNA, 64 nt, hsa; identical to SEQ ID NO: 58337

SEQ ID NO: 80043 - RNA, 64 nt, hsa; identical to SEQ ID NO: 58338

SEQ ID NO: 80044 - RNA, 64 nt, hsa; identical to SEQ ID NO: 58339

SEQ ID NO: 80045 - RNA, 64 nt, hsa; identical to SEQ ID NO: 58340

SEQ ID NO: 80046 - RNA, 64 nt, hsa; identical to SEQ ID NO: 58341

SEQ ID NO: 80047 - RNA, 64 nt, hsa; identical to SEQ ID NO: 58342

SEQ ID NO: 80048 - RNA, 64 nt, hsa; identical to SEQ ID NO: 58343

SEQ ID NO: 80049 - RNA, 64 nt, hsa; identical to SEQ ID NO: 58344

SEQ ID NO: 80050 - RNA, 64 nt, hsa; identical to SEQ ID NO: 58345

SEQ ID NO: 80051 - RNA, 64 nt, hsa; identical to SEQ ID NO: 58346

SEQ ID NO: 80052 - RNA, 64 nt, hsa; identical to SEQ ID NO: 58347

SEQ ID NO: 80053 - RNA, 64 nt, hsa; identical to SEQ ID NO: 58348

SEQ ID NO: 80054 - RNA, 64 nt, hsa; identical to SEQ ID NO: 58349

SEQ ID NO: 80055 - RNA, 64 nt, hsa; identical to SEQ ID NO: 58350

SEQ ID NO: 80056 - RNA, 64 nt, hsa; identical to SEQ ID NO: 58351

SEQ ID NO: 80057 - RNA, 64 nt, hsa; identical to SEQ ID NO: 58352

SEQ ID NO: 80058 - RNA, 64 nt, hsa; identical to SEQ ID NO: 58353

SEQ ID NO: 80059 - RNA, 64 nt, hsa; identical to SEQ ID NO: 58354

SEQ ID NO: 80060 - RNA, 64 nt, hsa; identical to SEQ ID NO: 58355

SEQ ID NO: 80061 - RNA, 64 nt, hsa; identical to SEQ ID NO: 58356

SEQ ID NO: 80062 - RNA, 64 nt, hsa; identical to SEQ ID NO: 58357

SEQ ID NO: 80063 - RNA, 64 nt, hsa; identical to SEQ ID NO: 58358

SEQ ID NO: 80064 - RNA, 64 nt, hsa; identical to SEQ ID NO: 58359

SEQ ID NO: 80065 - RNA, 64 nt, hsa; identical to SEQ ID NO: 58360

SEQ ID NO: 80066 - RNA, 64 nt, hsa; identical to SEQ ID NO: 58361

SEQ ID NO: 80067 - RNA, 64 nt, hsa; identical to SEQ ID NO: 58362

SEQ ID NO: 80068 - RNA, 64 nt, hsa; identical to SEQ ID NO: 58363

SEQ ID NO: 80069 - RNA, 64 nt, hsa; identical to SEQ ID NO: 58364

SEQ ID NO: 80070 - RNA, 64 nt, hsa; identical to SEQ ID NO: 58365

SEQ ID NO: 80071 - RNA, 64 nt, hsa; identical to SEQ ID NO: 58366

SEQ ID NO: 80072 - RNA, 64 nt, hsa; identical to SEQ ID NO: 58367

SEQ ID NO: 80073 - RNA, 64 nt, hsa; identical to SEQ ID NO: 58368

SEQ ID NO: 80074 - RNA, 64 nt, hsa; identical to SEQ ID NO: 58369

SEQ ID NO: 80075 - RNA, 64 nt, hsa; identical to SEQ ID NO: 58370

SEQ ID NO: 80076 - RNA, 64 nt, hsa; identical to SEQ ID NO: 58371

SEQ ID NO: 80077 - RNA, 64 nt, hsa; identical to SEQ ID NO: 58372

SEQ ID NO: 80078 - RNA, 64 nt, hsa; identical to SEQ ID NO: 58373

SEQ ID NO: 80079 - RNA, 64 nt, hsa; identical to SEQ ID NO: 58374

SEQ ID NO: 80080 - RNA, 64 nt, hsa; identical to SEQ ID NO: 58375

SEQ ID NO: 80081 - RNA, 64 nt, hsa; identical to SEQ ID NO: 58376

SEQ ID NO: 80082 - RNA, 64 nt, hsa; identical to SEQ ID NO: 58377

SEQ ID NO: 80083 - RNA, 64 nt, hsa; identical to SEQ ID NO: 58378

SEQ ID NO: 80084 - RNA, 64 nt, hsa; identical to SEQ ID NO: 58379

SEQ ID NO: 80085 - RNA, 64 nt, hsa; identical to SEQ ID NO: 58380

SEQ ID NO: 80086 - RNA, 64 nt, hsa; identical to SEQ ID NO: 58381

SEQ ID NO: 80087 - RNA, 64 nt, hsa; identical to SEQ ID NO: 58382

SEQ ID NO: 80088 - RNA, 64 nt, hsa; identical to SEQ ID NO: 58383

SEQ ID NO: 80089 - RNA, 64 nt, hsa; identical to SEQ ID NO: 58384

SEQ ID NO: 80090 - RNA, 64 nt, hsa; identical to SEQ ID NO: 58385

SEQ ID NO: 80091 - RNA, 64 nt, hsa; identical to SEQ ID NO: 58386

SEQ ID NO: 80092 - RNA, 64 nt, hsa; identical to SEQ ID NO: 58387

SEQ ID NO: 80093 - RNA, 64 nt, hsa; identical to SEQ ID NO: 58388

SEQ ID NO: 80094 - RNA, 64 nt, hsa; identical to SEQ ID NO: 58389

SEQ ID NO: 80095 - RNA, 64 nt, hsa; identical to SEQ ID NO: 58390

SEQ ID NO: 80096 - RNA, 64 nt, hsa; identical to SEQ ID NO: 58391

SEQ ID NO: 80097 - RNA, 64 nt, hsa; identical to SEQ ID NO: 58392

SEQ ID NO: 80098 - RNA, 64 nt, hsa; identical to SEQ ID NO: 58393

SEQ ID NO: 80099 - RNA, 64 nt, hsa; identical to SEQ ID NO: 58394

SEQ ID NO: 80100 - RNA, 64 nt, hsa; identical to SEQ ID NO: 58395

SEQ ID NO: 80101 - RNA, 64 nt, hsa; identical to SEQ ID NO: 58396

SEQ ID NO: 80102 - RNA, 64 nt, hsa; identical to SEQ ID NO: 58397

SEQ ID NO: 80103 - RNA, 64 nt, hsa; identical to SEQ ID NO: 58398

SEQ ID NO: 80104 - RNA, 64 nt, hsa; identical to SEQ ID NO: 58399

SEQ ID NO: 80105 - RNA, 64 nt, hsa; identical to SEQ ID NO: 58400

SEQ ID NO: 80106 - RNA, 64 nt, hsa; identical to SEQ ID NO: 58401

SEQ ID NO: 80107 - RNA, 64 nt, hsa; identical to SEQ ID NO: 58402

SEQ ID NO: 80108 - RNA, 64 nt, hsa; identical to SEQ ID NO: 58403

SEQ ID NO: 80109 - RNA, 64 nt, hsa; identical to SEQ ID NO: 58404

SEQ ID NO: 80110 - RNA, 64 nt, hsa; identical to SEQ ID NO: 58405

SEQ ID NO: 80111 - RNA, 64 nt, hsa; identical to SEQ ID NO: 58406

SEQ ID NO: 80112 - RNA, 64 nt, hsa; identical to SEQ ID NO: 58407

SEQ ID NO: 80113 - RNA, 64 nt, hsa; identical to SEQ ID NO: 58408

SEQ ID NO: 80114 - RNA, 64 nt, hsa; identical to SEQ ID NO: 58409

SEQ ID NO: 80115 - RNA, 64 nt, hsa; identical to SEQ ID NO: 58410

SEQ ID NO: 80116 - RNA, 64 nt, hsa; identical to SEQ ID NO: 58411

SEQ ID NO: 80117 - RNA, 64 nt, hsa; identical to SEQ ID NO: 58412

SEQ ID NO: 80118 - RNA, 64 nt, hsa; identical to SEQ ID NO: 58413

SEQ ID NO: 80119 - RNA, 64 nt, hsa; identical to SEQ ID NO: 58414

SEQ ID NO: 80120 - RNA, 64 nt, hsa; identical to SEQ ID NO: 58415

SEQ ID NO: 80121 - RNA, 64 nt, hsa; identical to SEQ ID NO: 58416

SEQ ID NO: 80122 - RNA, 64 nt, hsa; identical to SEQ ID NO: 58417

SEQ ID NO: 80123 - RNA, 64 nt, hsa; identical to SEQ ID NO: 58418

SEQ ID NO: 80124 - RNA, 64 nt, hsa; identical to SEQ ID NO: 58419

SEQ ID NO: 80125 - RNA, 64 nt, hsa; identical to SEQ ID NO: 58420

SEQ ID NO: 80126 - RNA, 64 nt, hsa; identical to SEQ ID NO: 58421

SEQ ID NO: 80127 - RNA, 64 nt, hsa; identical to SEQ ID NO: 58422

SEQ ID NO: 80128 - RNA, 64 nt, hsa; identical to SEQ ID NO: 58423

SEQ ID NO: 80129 - RNA, 64 nt, hsa; identical to SEQ ID NO: 58424

SEQ ID NO: 80130 - RNA, 64 nt, hsa; identical to SEQ ID NO: 58425

SEQ ID NO: 80131 - RNA, 64 nt, hsa; identical to SEQ ID NO: 58426

SEQ ID NO: 80132 - RNA, 64 nt, hsa; identical to SEQ ID NO: 58427

SEQ ID NO: 80133 - RNA, 64 nt, hsa; identical to SEQ ID NO: 58428

SEQ ID NO: 80134 - RNA, 64 nt, hsa; identical to SEQ ID NO: 58429

SEQ ID NO: 80135 - RNA, 64 nt, hsa; identical to SEQ ID NO: 58430

SEQ ID NO: 80136 - RNA, 64 nt, hsa; identical to SEQ ID NO: 58431

SEQ ID NO: 80137 - RNA, 64 nt, hsa; identical to SEQ ID NO: 58432

SEQ ID NO: 80138 - RNA, 64 nt, hsa; identical to SEQ ID NO: 58433

SEQ ID NO: 80139 - RNA, 64 nt, hsa; identical to SEQ ID NO: 58434

SEQ ID NO: 80140 - RNA, 64 nt, hsa; identical to SEQ ID NO: 58435

SEQ ID NO: 80141 - RNA, 50 nt, hsa; identical to SEQ ID NO: 58436

SEQ ID NO: 80142 - RNA, 64 nt, hsa; identical to SEQ ID NO: 58437

SEQ ID NO: 80143 - RNA, 64 nt, hsa; identical to SEQ ID NO: 58438

SEQ ID NO: 80144 - RNA, 64 nt, hsa; identical to SEQ ID NO: 58439

SEQ ID NO: 80145 - RNA, 64 nt, hsa; identical to SEQ ID NO: 58440

SEQ ID NO: 80146 - RNA, 64 nt, hsa; identical to SEQ ID NO: 58441

SEQ ID NO: 80147 - RNA, 64 nt, hsa; identical to SEQ ID NO: 58442

SEQ ID NO: 80148 - RNA, 64 nt, hsa; identical to SEQ ID NO: 58443

SEQ ID NO: 80149 - RNA, 64 nt, hsa; identical to SEQ ID NO: 58444

SEQ ID NO: 80150 - RNA, 64 nt, hsa; identical to SEQ ID NO: 58445

SEQ ID NO: 80151 - RNA, 64 nt, hsa; identical to SEQ ID NO: 58446

SEQ ID NO: 80152 - RNA, 64 nt, hsa; identical to SEQ ID NO: 58447

SEQ ID NO: 80153 - RNA, 64 nt, hsa; identical to SEQ ID NO: 58448

SEQ ID NO: 80154 - RNA, 64 nt, hsa; identical to SEQ ID NO: 58449

SEQ ID NO: 80155 - RNA, 64 nt, hsa; identical to SEQ ID NO: 58450

SEQ ID NO: 80156 - RNA, 64 nt, hsa; identical to SEQ ID NO: 58451

SEQ ID NO: 80157 - RNA, 64 nt, hsa; identical to SEQ ID NO: 58452

SEQ ID NO: 80158 - RNA, 64 nt, hsa; identical to SEQ ID NO: 58453

SEQ ID NO: 80159 - RNA, 64 nt, hsa; identical to SEQ ID NO: 58454

SEQ ID NO: 80160 - RNA, 64 nt, hsa; identical to SEQ ID NO: 58455

SEQ ID NO: 80161 - RNA, 64 nt, hsa; identical to SEQ ID NO: 58456

SEQ ID NO: 80162 - RNA, 64 nt, hsa; identical to SEQ ID NO: 58457

SEQ ID NO: 80163 - RNA, 64 nt, hsa; identical to SEQ ID NO: 58458

SEQ ID NO: 80164 - RNA, 64 nt, hsa; identical to SEQ ID NO: 58459

SEQ ID NO: 80165 - RNA, 64 nt, hsa; identical to SEQ ID NO: 58460

SEQ ID NO: 80166 - RNA, 64 nt, hsa; identical to SEQ ID NO: 58461

SEQ ID NO: 80167 - RNA, 64 nt, hsa; identical to SEQ ID NO: 58462

SEQ ID NO: 80168 - RNA, 64 nt, hsa; identical to SEQ ID NO: 58463

SEQ ID NO: 80169 - RNA, 64 nt, hsa; identical to SEQ ID NO: 58464

SEQ ID NO: 80170 - RNA, 64 nt, hsa; identical to SEQ ID NO: 58465

SEQ ID NO: 80171 - RNA, 64 nt, hsa; identical to SEQ ID NO: 58466

SEQ ID NO: 80172 - RNA, 64 nt, hsa; identical to SEQ ID NO: 58467

SEQ ID NO: 80173 - RNA, 64 nt, hsa
gaauauagaugagcguagcugaguuuucacccguaggaccgaaguguuuugugguggaguaucu

SEQ ID NO: 80174 - RNA, 64 nt, hsa
cgaugcgggcagcuggggggcugagagcacccagaggaccgaggacaggggccggacauugggg

SEQ ID NO: 80175 - RNA, 64 nt, hsa
cagagagcauagaccaagucaucuggaauggucuacaugccaugcggaaguccaccgaaggguu

SEQ ID NO: 80176 - RNA, 64 nt, hsa
gguucacuucacggauguucaguggauaucggucacaugccagguccccagcuacgcauucaag

SEQ ID NO: 80177 - RNA, 64 nt, hsa
uagcuagaugaaaaucuuugcacucacagagcuuacaugccagugagugaagaucgaugauaaa

SEQ ID NO: 80178 - RNA, 64 nt, hsa
acuaaaaauacaaaaauuggcuggguguggugucacaugccaguaaccccagcuacuagggagg

SEQ ID NO: 80179 - RNA, 64 nt, hsa
cguauccugggccccacugccgggaccgggucugacaugccagugccuuccugggcugagcaca

SEQ ID NO: 80180 - RNA, 64 nt, hsa
ucuguggggaauaaggauaccuagagaacauuccacaugccaagaggaugcaggauuucuacac

SEQ ID NO: 80181 - RNA, 64 nt, hsa
caaauaauauaauauuaugccaggauagaaaugaacaugccaugguugacaguaauaggaauaa

SEQ ID NO: 80182 - RNA, 50 nt, hsa
augaccccaacgagguauagacaugccacggcgguccuccaggcagggaa

SEQ ID NO: 80183 - RNA, 64 nt, hsa
gcuugucugacugcaaguuuuuuaaagaaaagaggaacuggagaaacgacuuccauugaugugg

SEQ ID NO: 80184 - RNA, 64 nt, hsa
ugcucccagaauguccugugaugcaugauucuaagaacuggaagaaccuggugguuccauuugc

SEQ ID NO: 80185 - RNA, 64 nt, hsa
agguaguuguuuacauaugagucgggaccaaagagaacuggauccacgugaaguccugugugug

SEQ ID NO: 80186 - RNA, 64 nt, hsa
aaugauuggcaacuucuacaggggccagucuuuugaacuggacaaccuuacaaguauaugagua

SEQ ID NO: 80187 - RNA, 64 nt, hsa
caagaagacuacuggaacuggaugaccucagaaugaacuggauugugguguucacaagaaaauc

SEQ ID NO: 80188 - RNA, 64 nt, hsa
gaggaaaaugguguuuuccucaagaagacuacuggaacuggaugaccucagaaugaacuggauu

SEQ ID NO: 80189 - RNA, 64 nt, hsa
cuagcccuggcggaggugcaggcccugucagcuggaacuggacagaccuugguuuguuuacaug

SEQ ID NO: 80190 - RNA, 64 nt, hsa
ugagcgggauucagcaaugguggaauggaagacagaacuggaagagaaagaaggaaaagaugag

SEQ ID NO: 80191 - RNA, 64 nt, hsa
gggccagccugaggacccccgccuaccaccucgagaacuggaagccaaccucuaaccuccugac

SEQ ID NO: 80192 - RNA, 64 nt, hsa
gcuucaccagugcccaagucucuauggagaaugagaacuggaagccacugcuaccgucuaccca

SEQ ID NO: 80193 - RNA, 64 nt, hsa
auagcuaccaaguuaaccugcucuaaacuuuggagaacuggaucuguccaauaaacgcuuauuu

SEQ ID NO: 80194 - RNA, 64 nt, hsa
gcaggacuugccugauaaauauuuuuccuccucugaacuggauuuuauaggcauuaaagacaag

SEQ ID NO: 80195 - RNA, 64 nt, hsa
ucuuugccuccuacuugcucagucucugucacaagaacuggaucuccauccccuugaugcucug

SEQ ID NO: 80196 - RNA, 64 nt, hsa
uagagaauguaacugaccaaagucacacugccaggaacuggaagcacuaggauuugacagcaua

SEQ ID NO: 80197 - RNA, 64 nt, hsa
ggcaggaaggauccuccccuagagccuccagggggaacuggaggaugcguaagagacccagaac

SEQ ID NO: 80198 - RNA, 64 nt, hsa
ggcaggaaggacccuccccuagagucucuggagggaacuggauacaauugcagagugcacuaaa

SEQ ID NO: 80199 - RNA, 64 nt, hsa
uguacagccagcagggcccaggcagccaccaagcccaccccaggucaugccagcggcagaggac

SEQ ID NO: 80200 - RNA, 64 nt, hsa
aacacgaucugggggggggauccugucuuccuccccaccccaccccacucuuacccaauuucug

SEQ ID NO: 80201 - RNA, 64 nt, hsa
gaucugggggggggauccugucuuccuccccaccccaccccacucuuacccaauuucugggcuc

SEQ ID NO: 80202 - RNA, 64 nt, hsa
ugggugccuggccuccagugucccaccuccuucaccaccccacuuggcuccuuugccaucuuga

SEQ ID NO: 80203 - RNA, 64 nt, hsa
guuauuucuguaaagaugguuauuuaacccuccuccaccccaucacgguggcccugagggcuga

SEQ ID NO: 80204 - RNA, 64 nt, hsa
cagguuucaagucuggguucugguguccacucacccaccccaccccccaaaaucagacaaaugc

SEQ ID NO: 80205 - RNA, 64 nt, hsa
aaggaccagguccuguuccucuuucuccccgacuccaccccagcucccugugaagagagaguua

SEQ ID NO: 80206 - RNA, 64 nt, hsa
aaauuuuuuuaaauggaagcuucuagcaagccccccaccccaaucaaccucuaugcuuucuucu

SEQ ID NO: 80207 - RNA, 64 nt, hsa
gggagggcaucucccugcuccccucaacccccucccaccccauccacgcccccuaccuuuccca

SEQ ID NO: 80208 - RNA, 64 nt, hsa
cacucaucccucuuuuucuuucuuccaccacuccccaccccagcuguaguuaauuucagugccu

SEQ ID NO: 80209 - RNA, 64 nt, hsa
ugccccuuccuccuucaugccugggccugcaggcccaccccagccaccacugaguccacucgga

SEQ ID NO: 80210 - RNA, 64 nt, hsa
gugauccaggaaagaugucccacagggaccacauccaccccagccccacugcccuccagggcca

SEQ ID NO: 80211 - RNA, 64 nt, hsa
caggccucaccucccagggcuacacagacccugcccaccccaucccuggcugaccugcugugga

SEQ ID NO: 80212 - RNA, 64 nt, hsa
aguuguauuuagcuuugaguuucucugcaucuguccaccccauguguauauaacccagccccug

SEQ ID NO: 80213 - RNA, 64 nt, hsa
ggaccaaggugugugugucuggaggaaccacugcccaccccaccaccccggggucucuggggaa

SEQ ID NO: 80214 - RNA, 64 nt, hsa
ccaaccauacacacauacaaguccacacacacucccaccccagccaaaaauauauaaaaaacaa

SEQ ID NO: 80215 - RNA, 64 nt, hsa
aucaacaacccccaaccaccaucuaccacuacggccaccccaaaggaccccgacgccaacagac

SEQ ID NO: 80216 - RNA, 64 nt, hsa
ccugccagcugccacagcugcaugaccugcuuccccaccccacggugucguuuuguuuuuaaag

SEQ ID NO: 80217 - RNA, 64 nt, hsa
uggggaggguggcuggcccggccuccacagcaccccaccccauaucuucuuuccauuuauuucg

SEQ ID NO: 80218 - RNA, 64 nt, hsa
agggaggcccuuuucugaucaugccccuucucucccaccccaucuccccaccaccaccucugug

SEQ ID NO: 80219 - RNA, 64 nt, hsa
ugagcccaacagguccacgauggauccaccagucccaccccagccuuuuccuuucaucugaaca

SEQ ID NO: 80220 - RNA, 64 nt, hsa
cacccccagccccgacuccagccagcgccucccuccaccccaggacgccacucauuucaucuca

SEQ ID NO: 80221 - RNA, 64 nt, hsa
aauggaaaaucgucuaacuggagaagggcgguauccaccccacauucggaucccaggguccuga

SEQ ID NO: 80222 - RNA, 64 nt, hsa
agaaaggcacaauguggagccuggggugucucccccaccccaggaccgucagguuuaccagugu

SEQ ID NO: 80223 - RNA, 64 nt, hsa
ugagcagggccccucccccagcuccauuccgcucccaccccagccggcugcguuccucucucca

SEQ ID NO: 80224 - RNA, 64 nt, hsa
ccauuuauucagcuacaucaucccucuauuaaccccaccccaucaggcacgugugcaaaccucu

SEQ ID NO: 80225 - RNA, 64 nt, hsa
uucuuuccuguuguaggggaggaagcuguucuccccaccccaggugccuuuggagguuaaggcu

SEQ ID NO: 80226 - RNA, 64 nt, hsa
ccuggucgcuuugauucuuccugcacagcucagcccaccccaucuguacuggaagggacccugg

SEQ ID NO: 80227 - RNA, 64 nt, hsa
agguauccuucauuauccaccccaucccagacucccaccccagggauugcccgugaagacuuug

SEQ ID NO: 80228 - RNA, 64 nt, hsa
ccccacuucugcaaccccagguauccuucauuauccaccccaucccagacucccaccccaggga

SEQ ID NO: 80229 - RNA, 64 nt, hsa
ccccaccuccuguggacugaugccccagggauucccaccccacuucugcaaccccagguauccu

SEQ ID NO: 80230 - RNA, 64 nt, hsa
ggccuugccccuaguacccccuggcaggagcaacccaccccauggucgagguuccccuaccccu

SEQ ID NO: 80231 - RNA, 64 nt, hsa
uccuucccccgccgccacugugccccccgucccuccaccccagaagcccugaccucauuugggc

SEQ ID NO: 80232 - RNA, 52 nt, hsa
acagcuaccuggugagcugaugccaccccagcaucugucuuuucacccacgg

SEQ ID NO: 80233 - RNA, 64 nt, hsa
aaggacaccuuugcagggauucuuguccugcuggccaccccacccacaccugucccuggccagc

SEQ ID NO: 80234 - RNA, 64 nt, hsa
cccugagguaccuuuccacccagacccuccuuccccaccccauaagcccugagacucccgccuu

SEQ ID NO: 80235 - RNA, 64 nt, hsa
cugccccgcgucuucagcuguuucgcauccaccgccaccccacugagagcugcuccuuuggggg

SEQ ID NO: 80236 - RNA, 64 nt, hsa
auucucaaccaggaggugauuuugcccccugacuccaccccagggacauucaaaaaugucuggu

SEQ ID NO: 80237 - RNA, 64 nt, hsa
augcacagcacaaccuacaacagcaaagaaucauccaccccaaaauaucaguagugccgagauu

SEQ ID NO: 80238 - RNA, 64 nt, hsa
cguccugccauccccccccgccguccugccuuccccaccccacccuuaggucccagguaguugc

SEQ ID NO: 80239 - RNA, 64 nt, hsa
uugcaauguaagggccucagcuuccuuggagaagccaccccagguuuccagacauagauguuga

SEQ ID NO: 80240 - RNA, 64 nt, hsa
aaucaggcccauccaucccaugccucccuccuccccaccccacuccaacaguuccucuuucccg

SEQ ID NO: 80241 - RNA, 64 nt, hsa
uauaagcgcuucucuucgcauagucacguagcucccaccccacccucuuccugugucucacgca

SEQ ID NO: 80242 - RNA, 64 nt, hsa
uuacuauugacagucaccccguaagguucacaaaccaccccauugaacagaugaggaacugagg

SEQ ID NO: 80243 - RNA, 64 nt, hsa
cagugagaggagugguguguaccccuaaauccucccaccccagcacugcccaucuguaaaaucu

SEQ ID NO: 80244 - RNA, 64 nt, hsa
aaccccagguagggacgccccuuguuccucacccccaccccacuuagguccugggcccccacug

SEQ ID NO: 80245 - RNA, 64 nt, hsa
ccccuaucagggggacagcuggugggcaaagcagccaccccacagccuuguggcuagaguacag

SEQ ID NO: 80246 - RNA, 64 nt, hsa
cauucuggaaagcucucccaggaggaagcauuccccaccccaccuugccucuguccugcgcugg

SEQ ID NO: 80247 - RNA, 64 nt, hsa
cauucuccuguggcccucuaguccaccccccgccccaccccagccccuggcaaccacugaucug

SEQ ID NO: 80248 - RNA, 64 nt, hsa
ccacgacagccaggacugcccuccccaccccaccccaccccaggagcacggcacacaguucagc

SEQ ID NO: 80249 - RNA, 64 nt, hsa
acagcccacgacagccaggacugcccuccccaccccaccccaccccaggagcacggcacacagu

SEQ ID NO: 80250 - RNA, 64 nt, hsa
ccccgacagcccacgacagccaggacugcccuccccaccccaccccaccccaggagcacggcac

SEQ ID NO: 80251 - RNA, 64 nt, hsa
cccaacuucauuucccccucacuguagcccauuuccaccccaccacaaaguugccacagguuuu

SEQ ID NO: 80252 - RNA, 64 nt, hsa
ucuucuauaccuucuucuccuuccccaucucacuccaccccacuuugucccugaugucuugggg

SEQ ID NO: 80253 - RNA, 64 nt, hsa
agcuuccggcucccucuucuccccccucuacccgccaccccaccccaccccacccccgcccacu

SEQ ID NO: 80254 - RNA, 64 nt, hsa
ccggcucccucuucuccccccucuacccgccaccccaccccaccccacccccgcccacucguug

SEQ ID NO: 80255 - RNA, 64 nt, hsa
ucccucuucuccccccucuacccgccaccccaccccaccccacccccgcccacucguugccuga

SEQ ID NO: 80256 - RNA, 64 nt, hsa
aggggaggacuccuggguggacagccuuugacguccaccccacgcugaugcagaagcucccaga

SEQ ID NO: 80257 - RNA, 64 nt, hsa
gucacugcauggccucugcccauccugcaccuguccaccccaccccaacacccuggaagccacu

SEQ ID NO: 80258 - RNA, 64 nt, hsa
ugcauggccucugcccauccugcaccuguccaccccaccccaacacccuggaagccacugucaa

SEQ ID NO: 80259 - RNA, 64 nt, hsa
ggggagggaggggcccuggaggccacauccugccccaccccacccccacucccacggacacuaa

SEQ ID NO: 80260 - RNA, 64 nt, hsa
uggaucuggggcuguuccccccccuccguuuuuuccaccccacaguuccuccugggaucuggcc

SEQ ID NO: 80261 - RNA, 64 nt, hsa
uguucccuucccaccuccaaccuagcccuacugcccaccccaccccaacccaccccaugcccag

SEQ ID NO: 80262 - RNA, 64 nt, hsa
ccuucccaccuccaaccuagcccuacugcccaccccaccccaacccaccccaugcccagugguc

SEQ ID NO: 80263 - RNA, 64 nt, hsa
uccaaccuagcccuacugcccaccccaccccaacccaccccaugcccaguggucucaguagaua

SEQ ID NO: 80264 - RNA, 64 nt, hsa
cagcggcagccacuagaccgcgcccggcagccacccaccccacgugccaacuuccccuccccgu

SEQ ID NO: 80265 - RNA, 64 nt, hsa
auguuugcugugcuucccgccguggagggcagagccaccccacaucaggaucggacgugcuacc

SEQ ID NO: 80266 - RNA, 64 nt, hsa
gguuuacccccccggccugggcaucugaccucccccaccccagugugauuuaacauccaggaac

SEQ ID NO: 80267 - RNA, 64 nt, hsa
cagcccagccguguguggugucagguuccucuccccaccccagcuucaagcagaggccucgggg

SEQ ID NO: 80268 - RNA, 64 nt, hsa
uacagcuguguuuuuuaaagccaccucucugucuccaccccaugggcccacacccagguggggg

SEQ ID NO: 80269 - RNA, 64 nt, hsa
ccgcuuccacaugagcuaaagcccucccgcgcccccaccccagaccccgagccaccccaggaaa

SEQ ID NO: 80270 - RNA, 64 nt, hsa
aaagcccucccgcgcccccaccccagaccccgagccaccccaggaaaagcacaaggacugccgc

SEQ ID NO: 80271 - RNA, 64 nt, hsa
accaagcggaccuaggagacaucuacagaacgcuccaccccaaaucaacagaauauacauucuu

SEQ ID NO: 80272 - RNA, 64 nt, hsa
ugcccauccgagaccucuguccuuacaccacuagccaccccacgugggacuuccauggcuucug

SEQ ID NO: 80273 - RNA, 64 nt, hsa
aguaugcuuguccugaagagagguuuggcuauccccaccccaccccaccccacccuguuccuuu

SEQ ID NO: 80274 - RNA, 64 nt, hsa
gcuuguccugaagagagguuuggcuauccccaccccaccccaccccacccuguuccuuuuuuau

SEQ ID NO: 80275 - RNA, 64 nt, hsa
uccugaagagagguuuggcuauccccaccccaccccaccccacccuguuccuuuuuuaucagga

SEQ ID NO: 80276 - RNA, 64 nt, hsa
aagccccuucuccacuguagcaaaauaagcacccccaccccaucugccuucaggucuucuucac

SEQ ID NO: 80277 - RNA, 64 nt, hsa
caguugaaagcuccgaguuugggccaguuuaccaccaccccaaguacacagcagaauaguacaa

SEQ ID NO: 80278 - RNA, 64 nt, hsa
cccucaccaaugcaucuaucugucugccaccagcccaccccacccugcccccacccucacccac

SEQ ID NO: 80279 - RNA, 64 nt, hsa
cgaguggggggaucacaaagccaggggcuuggccccaccccagcgaagccaugaacucccaagc

SEQ ID NO: 80280 - RNA, 64 nt, hsa
ugcuggccuugccacacucuuucuccugcuuuaaccaccccaucugcauucccagcucuacccu

SEQ ID NO: 80281 - RNA, 64 nt, hsa
aagaaggaggcuaugcucaggggcccuggagcagccaccccaugcuggccuugccacacucuuu

SEQ ID NO: 80282 - RNA, 64 nt, hsa
uggcugccuuggugcagcagggucaucuguagggccaccccacagcucuuuccuuccccuccuc

SEQ ID NO: 80283 - RNA, 64 nt, hsa
guccuccagcugucugacuauccauccaucauaaccaccccagccugggaaggagagcuugcuu

SEQ ID NO: 80284 - RNA, 64 nt, hsa
accgcuccaccccaccacugucuucuccauccuuccaccccacccucagcgucucugccccuaa

SEQ ID NO: 80285 - RNA, 64 nt, hsa
gcauuccuccacccacccucuaucccccaccgcuccaccccaccacugucuucuccauccuucc

SEQ ID NO: 80286 - RNA, 64 nt, hsa
cuagaaucuucaaucaaccugggcucuccccaccccaccccagauaaccuccucaguucccuag

SEQ ID NO: 80287 - RNA, 64 nt, hsa
auucacuagaaucuucaaucaaccugggcucuccccaccccaccccagauaaccuccucaguuc

SEQ ID NO: 80288 - RNA, 64 nt, hsa
cucaccacccaaaggguggugggcacugcugugaccaccccagcugcagagucagugcccuggg

SEQ ID NO: 80289 - RNA, 64 nt, hsa
guggguccugggaccucuaaugugggcaugucguccaccccaggacgagccaucagggacagac

SEQ ID NO: 80290 - RNA, 64 nt, hsa
cuugaaggaugggccugcugcacgucucccuccuccaccccauaccacacuggggggucugagc

SEQ ID NO: 80291 - RNA, 64 nt, hsa
cucggucacccuccugguucugcccugucccauuccaccccaccccagggggaacaguagcuuc

SEQ ID NO: 80292 - RNA, 64 nt, hsa
ucacccuccugguucugcccugucccauuccaccccaccccagggggaacaguagcuucaccuu

SEQ ID NO: 80293 - RNA, 64 nt, hsa
ccacugugggacuuucuggugggcuccucagcucccaccccaggcuggggcccagauugugagg

SEQ ID NO: 80294 - RNA, 64 nt, hsa
ugcaggacccccaggccugagcccagcacccgcuccaccccagccagcugggcagggccggugu

SEQ ID NO: 80295 - RNA, 64 nt, hsa
acuguucuggguggcuggaucuccaggguacccuccaccccagcugccaagcccugggccagca

SEQ ID NO: 80296 - RNA, 64 nt, hsa
ggccugaaggggagcucugagacagagcaaacacccaccccagaacaagccgacacacagggag

SEQ ID NO: 80297 - RNA, 64 nt, hsa
uugagccccgccccuuucuuuccccggagucccuccaccccauaacaauaccucgaauuuccaa

SEQ ID NO: 80298 - RNA, 64 nt, hsa
agaccuccguccucugcuuuccgggcagcucucaccaccccaggccccggcaugaggccuuucc

SEQ ID NO: 80299 - RNA, 64 nt, hsa
ucccuaauagcuaggauuacagguguguggccucccaccccaccccacccuucacaccuggcug

SEQ ID NO: 80300 - RNA, 64 nt, hsa
aauagcuaggauuacagguguguggccucccaccccaccccacccuucacaccuggcugauuuu

SEQ ID NO: 80301 - RNA, 64 nt, hsa
ucucacucuccccaguccucaggcagcagcuuuuccaccccaggaaucucuguuccuucucugu

SEQ ID NO: 80302 - RNA, 64 nt, hsa
agcccagcauggaugugucucaggcaccucauccccaccccaccucaccccaacaaacuccucu

SEQ ID NO: 80303 - RNA, 64 nt, hsa
uguaggcuacauccugauaccuauaaguucacccccaccccacagcugcuggagagaaauccca

SEQ ID NO: 80304 - RNA, 64 nt, hsa
aucucuguauauacuuucccagcccugucugucuccaccccauccccucuugucucugagaacc

SEQ ID NO: 80305 - RNA, 64 nt, hsa
accccauccccucuugucucugagaaccauucucccaccccaaguuccaccuucuauguuucua

SEQ ID NO: 80306 - RNA, 64 nt, hsa
cuacuucccucacccacuuuggccuccguucaccccaccccaccccaccucuccccaccuuacc

SEQ ID NO: 80307 - RNA, 64 nt, hsa
ucccucacccacuuuggccuccguucaccccaccccaccccaccucuccccaccuuacccccgc

SEQ ID NO: 80308 - RNA, 64 nt, hsa
ggggcucugcucccggucuugggcccugggaaccccaccccaccccaccccacaggcguuguaa

SEQ ID NO: 80309 - RNA, 64 nt, hsa
ucugcucccggucuugggcccugggaaccccaccccaccccaccccacaggcguuguaaccuug

SEQ ID NO: 80310 - RNA, 64 nt, hsa
ucccggucuugggcccugggaaccccaccccaccccaccccacaggcguuguaaccuugaaucu

SEQ ID NO: 80311 - RNA, 64 nt, hsa
uaugugaguccuugugcuccugcuccucagcucuccaccccagguugccucucuccugugggcc

SEQ ID NO: 80312 - RNA, 64 nt, hsa
accugcauccccagcacugguccugggcacuuccccaccccagccaggugucccuccuaugcac

SEQ ID NO: 80313 - RNA, 64 nt, hsa
ccuugacuuuaguguagugguggggucuuucccaccaccccacuaagccuuggcaaccucauuu

SEQ ID NO: 80314 - RNA, 64 nt, hsa
uuugaugacauauuacccgcugacccagccccagccaccccauggacucaggacucaggucucc

SEQ ID NO: 80315 - RNA, 64 nt, hsa
acuuagcuucccucucccucauucccggacccuuccaccccacugggcccaaccaugggcucag

SEQ ID NO: 80316 - RNA, 64 nt, hsa
cccugcuuuuauuuauuuuggauuagccgguugcccaccccagcccucugguccaucccucccu

SEQ ID NO: 80317 - RNA, 64 nt, hsa
ggauggugucucccagcuuccccgcccagcuugcccaccccauaguuggugagaugccaaguuu

SEQ ID NO: 80318 - RNA, 64 nt, hsa
cccucuuuccugccccuccccaucauaccugcacccaccccagccagggcucccuguccagaau

SEQ ID NO: 80319 - RNA, 64 nt, hsa
cuugucacuuuccuacccugauggucacacuagcccaccccaagcuccgacauugagguuuuca

SEQ ID NO: 80320 - RNA, 64 nt, hsa
agguuuucaucucugcagggagagguuccaauguccaccccacccccagguacccgccucuucc

SEQ ID NO: 80321 - RNA, 64 nt, hsa
gcauccacccagccugaggcucaagcugcccuuaccaccccaucccccacgcaggaccaacuac

SEQ ID NO: 80322 - RNA, 64 nt, hsa
ucccaaaccacuuacuucccuguucaccucugccccaccccagcccagaggaguuugagccacc

SEQ ID NO: 80323 - RNA, 64 nt, hsa
gcucaccccgggguggcccuggaggccccugaccccaccccacccacagagcacgagggccccg

SEQ ID NO: 80324 - RNA, 64 nt, hsa
caucaucagaggacgccccgugcgcugucaccuuccaccccacaaggccaaccuuuuucugugg

SEQ ID NO: 80325 - RNA, 51 nt, hsa
gaaccgaccaccucccaugacccaccccagcccccugaacccccuucaugg

SEQ ID NO: 80326 - RNA, 64 nt, hsa
agucaccacuagggggugauggagaggaagggggccaccccagggccauuaacaaccaguacuc

SEQ ID NO: 80327 - RNA, 64 nt, hsa
ggacacuccgucugcuccaaugacugagcagcauccaccccaccccaucuuugcugccagcucu

SEQ ID NO: 80328 - RNA, 64 nt, hsa
cuccgucugcuccaaugacugagcagcauccaccccaccccaucuuugcugccagcucucagga

SEQ ID NO: 80329 - RNA, 64 nt, hsa
uguaccucuguguaucuguacagccucgcuccugccaccccacccuugcguucugcauuaggua

SEQ ID NO: 80330 - RNA, 64 nt, hsa
ccccgggcacugcacagccugucugggggccagaccaccccauuguccauccuuguuguccgug

SEQ ID NO: 80331 - RNA, 62 nt, hsa
uccgcaucaacaaaaccugaggccccuuccucccaccccaucucucuccuguggaugcuccu

SEQ ID NO: 80332 - RNA, 64 nt, hsa
gaaugucccugacccugccugaucccucccucacccaccccaaagguauuuuugauaacagagc

SEQ ID NO: 80333 - RNA, 64 nt, hsa
gugacugagccagggccugcauuuuugguuuuccccaccccacacauucucaaccauaguccuu

SEQ ID NO: 80334 - RNA, 64 nt, hsa
ccuggacuuaauaccagccggauaccucuggcccccaccccauuacuguaccucuggagucacu

SEQ ID NO: 80335 - RNA, 54 nt, hsa
uuuugcagaggcugccguaguaauccaccccaacggccggaggagccgccggag

SEQ ID NO: 80336 - RNA, 64 nt, hsa
gcucccggaaccggacggcacagggcguucuugcccaccccaggggccaggcuugcggaggggg

SEQ ID NO: 80337 - RNA, 64 nt, hsa
acgacguggcacacauuccacgugggugcugccgccaccccagucggucguggcgugcagcugg

SEQ ID NO: 80338 - RNA, 64 nt, hsa
cccuuuggccucuguuuguccccuuuccaguccuccaccccaccccuggagcccagccugggag

SEQ ID NO: 80339 - RNA, 64 nt, hsa
ugucugagaagugaggagccccuccgcccggcagccaccccaucugggaagugaggagcgucua

SEQ ID NO: 80340 - RNA, 64 nt, hsa
cuacugggaagugaggagccccucugccuggccaccaccccaucugggaggugugcccagcagc

SEQ ID NO: 80341 - RNA, 64 nt, hsa
gucuuugccuggugucuuccuuucccguguccgcccaccccagcgucuguugguacuuaccugu

SEQ ID NO: 80342 - RNA, 64 nt, hsa
cccaacaccagucagcccuauacccuaacucacuccaccccauuuucuccggcugccuggccgg

SEQ ID NO: 80343 - RNA, 64 nt, hsa
ggguauuuuguuuuuguucucaccugcugcccccccaccccaccaccccagggauaaauuggau

SEQ ID NO: 80344 - RNA, 64 nt, hsa
uguuuuuguucucaccugcugcccccccaccccaccaccccagggauaaauuggauauaaacac

SEQ ID NO: 80345 - RNA, 64 nt, hsa
guacauccauguguggcucugcuccaccccugugccaccccagagcccugggggguggucucca

SEQ ID NO: 80346 - RNA, 64 nt, hsa
cggugucuccacggugcucucgcccugcccauggccaccccagacucugaucuccaggaacccc

SEQ ID NO: 80347 - RNA, 64 nt, hsa
ugccauuucuccccucucuuccuucaucuccaccccaccccacccuacucuccagacgcccuga

SEQ ID NO: 80348 - RNA, 64 nt, hsa
acuccugccauuucuccccucucuuccuucaucuccaccccaccccacccuacucuccagacgc

SEQ ID NO: 80349 - RNA, 64 nt, hsa
guaaucauucacauguaaaaauaaccccaccuccccaccccaaaaagggcaagagcuguggaaa

SEQ ID NO: 80350 - RNA, 64 nt, hsa
augacuaaggacugagcccccuacccaacuacccccaccccaaucccaccuucacccucuuccu

SEQ ID NO: 80351 - RNA, 64 nt, hsa
cuaucagacuaagccagcaccggaccagccuggcccaccccacccacuucugcacuugcgguuc

SEQ ID NO: 80352 - RNA, 59 nt, hsa
cagacucugacuccaacugaggcucagccccaccccagggcagccagggagagcccagg

SEQ ID NO: 80353 - RNA, 64 nt, hsa
cagccuggaggccgggugcucagggcugacacguccaccccagugcacccacucugcuuugacu

SEQ ID NO: 80354 - RNA, 64 nt, hsa
ccccaguaagccacugccacacgucugacccucuccaccccauagugaccggcugcuuuucccu

SEQ ID NO: 80355 - RNA, 64 nt, hsa
cugcuggcacauuuccccagaccugagcuccccaccaccccagcugcuccccucccuccucugu

SEQ ID NO: 80356 - RNA, 64 nt, hsa
gggagacggucuugccucucagccccucccugccccaccccagcuccugcccuggaaaucugga

SEQ ID NO: 80357 - RNA, 64 nt, hsa
accgggagcucuuggcugcaucuucucccugcccccaccccacuaugaccuuugacccuacggc

SEQ ID NO: 80358 - RNA, 64 nt, hsa
ccaccggaggucacuccaccauccccaccccaccccaccccacccccgccaugcaacgggauug

SEQ ID NO: 80359 - RNA, 64 nt, hsa
gccugccaccggaggucacuccaccauccccaccccaccccaccccacccccgccaugcaacgg

SEQ ID NO: 80360 - RNA, 64 nt, hsa
cccccgccugccaccggaggucacuccaccauccccaccccaccccaccccacccccgccaugc

SEQ ID NO: 80361 - RNA, 64 nt, hsa
agaaucaggaucucuuucucauucaaggggggaaccaccccaggucagcgcugcgccugcugug

SEQ ID NO: 80362 - RNA, 64 nt, hsa
auuccuuuccuuugaaugauagcugugauucaccccaccccauuuucuuguuucugguccaucc

SEQ ID NO: 80363 - RNA, 64 nt, hsa
ucuuuucuucauuucuuuccagaacaacucuuucccaccccaacaccacugccaccaccccucu

SEQ ID NO: 80364 - RNA, 64 nt, hsa
uagcaggugcaacaaaaacaagaaacaaaugugcccaccccacuuuccgcuuaacugaaaagcu

SEQ ID NO: 80365 - RNA, 64 nt, hsa
uacagaugaggggaggggccgcagugcgcagaacccaccccaccccccagugcagacuucgggg

SEQ ID NO: 80366 - RNA, 64 nt, hsa
cccaccccaccccccagugcagacuucggggucuccaccccaggccagcagcgcccacugggcu

SEQ ID NO: 80367 - RNA, 64 nt, hsa
ccgaccaggagggggagagcagccuccacuuaccccaccccacccuugggcuaaaagcccccag

SEQ ID NO: 80368 - RNA, 64 nt, hsa
ccgaggggcaccccagccccgccucugcucccccccaccccacccacccucggggcgccccccu

SEQ ID NO: 80369 - RNA, 64 nt, hsa
gggggcuguugccccucccuccaucuccccacacccaccccaccccacagcagggcuccuggcc

SEQ ID NO: 80370 - RNA, 64 nt, hsa
cuguugccccucccuccaucuccccacacccaccccaccccacagcagggcuccuggcccccac

SEQ ID NO: 80371 - RNA, 64 nt, hsa
agucaccccuccucuccccccgccuccuggccugccaccccaccccagcguuuaccccaaagca

SEQ ID NO: 80372 - RNA, 64 nt, hsa
ccccuccucuccccccgccuccuggccugccaccccaccccagcguuuaccccaaagcacaaug

SEQ ID NO: 80373 - RNA, 64 nt, hsa
cuuacugagucccucugggcagcagcucccuucuccaccccaccccagcacccgucccaaaugu

SEQ ID NO: 80374 - RNA, 64 nt, hsa
ugagucccucugggcagcagcucccuucuccaccccaccccagcacccgucccaaauguggccu

SEQ ID NO: 80375 - RNA, 64 nt, hsa
uccgaaagaagcuaaaccuugcacaucccaacacccaccccagggagaguucccgugugugccu

SEQ ID NO: 80376 - RNA, 64 nt, hsa
aucacugaguuuauccaccgccauccaccucuauccaccccauaaggucccuacagcaaguggg

SEQ ID NO: 80377 - RNA, 64 nt, hsa
gcugcucaggagccagcacaggacaccccccaccccaccccaccauguccccauuacaccagag

SEQ ID NO: 80378 - RNA, 64 nt, hsa
aggaugcugcucaggagccagcacaggacaccccccaccccaccccaccauguccccauuacac

SEQ ID NO: 80379 - RNA, 64 nt, hsa
caccuccagggccuuagaaccaccgccccucuccccaccccaggcaccccucuuuuuacucaaa

SEQ ID NO: 80380 - RNA, 64 nt, hsa
gccuccaacccugccugcggccuccccccgucgcccaccccacgucuccuggccacugagacac

SEQ ID NO: 80381 - RNA, 64 nt, hsa
gggccccggcccucccuggcuccccuuccccccaccaccccaucgcuggguuucggggcuuggu

SEQ ID NO: 80382 - RNA, 64 nt, hsa
uucuggccucugagguugggggacuacuuguuucccaccccagguuccuccaggccaagucaug

SEQ ID NO: 80383 - RNA, 64 nt, hsa
ugcuuuguccgucuauccacccgcccacccgcccccaccccaccggcagcguccaggugcgggg

SEQ ID NO: 80384 - RNA, 64 nt, hsa
aggccggagccccugggagcccucgcaccgcuccccaccccacucagcggccccaucggaacug

SEQ ID NO: 80385 - RNA, 64 nt, hsa
gcccauagcaucccacaggcccaggcaggaggucccaccccagacccugccccagacgcucccu

SEQ ID NO: 80386 - RNA, 64 nt, hsa
gugcccggggaucccccgccccauccuccugcccccaccccaggcugggcuguucacucucucg

SEQ ID NO: 80387 - RNA, 64 nt, hsa
ggagaccacgcuucuccuccgugccgugcgacccccaccccaugacuauugugcgauucgugag

SEQ ID NO: 80388 - RNA, 64 nt, hsa
gccccagcgucuucuccccagccccguccucccaccaccccagggggcaggcaggcaggccccc

SEQ ID NO: 80389 - RNA, 64 nt, hsa
ucucguaauagaaaaguggggagccgcuggggagccaccccauucauccccguauuucccccuc

SEQ ID NO: 80390 - RNA, 64 nt, hsa
agggccccagaguuccuugcaucuaauuucacccccaccccacccuccaggguuagggggagca

SEQ ID NO: 80391 - RNA, 64 nt, hsa
aagcuuccucugacgguuacccuccccccaccuuccaccccaaccaucugaaccauuccugucu

SEQ ID NO: 80392 - RNA, 53 nt, hsa
ggcugcugccugcgcccugacucccaccccaagcccccggccaagccuggacu

SEQ ID NO: 80393 - RNA, 64 nt, hsa
gccaacaccaccacccccagggggucuccccaccccaccccauuuacagggugagcucagccug

SEQ ID NO: 80394 - RNA, 64 nt, hsa
ccggagccaacaccaccacccccagggggucuccccaccccaccccauuuacagggugagcuca

SEQ ID NO: 80395 - RNA, 64 nt, hsa
uuuaacauugugagccagcuagacccccagugcaccaccccauauugaaaaacaguugucuggc

SEQ ID NO: 80396 - RNA, 64 nt, hsa
agcaagaaggcuggugagggaagggcucagcuucccaccccacguacagcaagggacuccccag

SEQ ID NO: 80397 - RNA, 64 nt, hsa
ccaaagccaggggcccaccccgccccaccccaccccaccccacccucugaaaugugaaaagccu

SEQ ID NO: 80398 - RNA, 64 nt, hsa
gcagcccaaagccaggggcccaccccgccccaccccaccccaccccacccucugaaaugugaaa

SEQ ID NO: 80399 - RNA, 64 nt, hsa
ggagggcagcccaaagccaggggcccaccccgccccaccccaccccaccccacccucugaaaug

SEQ ID NO: 80400 - RNA, 64 nt, hsa
ccaaggguauuacugguggaauaauauccgccccccaccccaguuucuaauuugcuguaggcug

SEQ ID NO: 80401 - RNA, 64 nt, hsa
gaguggggguucucgccaauucccuaaugagauuccaccccaauaucaucaggcaccuuucccc

SEQ ID NO: 80402 - RNA, 64 nt, hsa
uccccaccaacuucucugccccagggacccgaggccaccccagccugguguggacccaucggcg

SEQ ID NO: 80403 - RNA, 64 nt, hsa
agcccucaggcccucccugccaaacuggagaaccccaccccaaggcaugccacguccgcagccc

SEQ ID NO: 80404 - RNA, 64 nt, hsa
uuggucccagggcggggcagggaauucuaaguguccaccccagggaggcaaggggcugcuuucc

SEQ ID NO: 80405 - RNA, 64 nt, hsa
uauuauggaucccuugggcugugggccuucccauccaccccaccacaacugcccagguagcugg

SEQ ID NO: 80406 - RNA, 64 nt, hsa
gcuuuugucugaugcucugggauucuggccagacccaccccagggcacauguccugcgggggcg

SEQ ID NO: 80407 - RNA, 64 nt, hsa
ccagccuuucgcgucaccuggaggccacaucuucccaccccaccugccagccccugucucuccu

SEQ ID NO: 80408 - RNA, 64 nt, hsa
ccacagggacaagaggggcccccucgccccagccccaccccacauggagcucagggggaagcag

SEQ ID NO: 80409 - RNA, 64 nt, hsa
cgcugcuagcgcaccccugcaguccagcgugcauccaccccacgcacgccccgugcuguguucc

SEQ ID NO: 80410 - RNA, 64 nt, hsa
acuacucucuucaccccuuuauuccagcugccugccaccccagacccccaccucccacccugac

SEQ ID NO: 80411 - RNA, 64 nt, hsa
uuccuuuaugcaacacccaaacaucuuggcauccccaccccaggaagugcggggaggagguuau

SEQ ID NO: 80412 - RNA, 64 nt, hsa
aaaaaaauaauaauaaucuuaaagaugagaaaagccaccccaucuggcaccacagcugcaucuu

SEQ ID NO: 80413 - RNA, 64 nt, hsa
uucuguuacacuguauaguaguccuauggcacccccaccccaucccuuucgugccacucccguc

SEQ ID NO: 80414 - RNA, 64 nt, hsa
ccccaucccuuucgugccacucccguccccacccccaccccaguguguauaagcuggcauuucg

SEQ ID NO: 80415 - RNA, 64 nt, hsa
aaugggggaaugacacaucccccccaaccuacccccaccccaaaagcagcuccaacagaauggc

SEQ ID NO: 80416 - RNA, 64 nt, hsa
ucacuccaccucaaagucauuugacugcccccauccaccccaccacccuaaucuuccaccaccu

SEQ ID NO: 80417 - RNA, 64 nt, hsa
cccccagucaccauugucaccacacucacccaucccaccccaccccuccuauccaccccucccc

SEQ ID NO: 80418 - RNA, 64 nt, hsa
ccaaggaccgggcccugccccgccacccuaccucccaccccagcagcccucucuucccccaccu

SEQ ID NO: 80419 - RNA, 64 nt, hsa
agcaccuguucugaggaggugagauguggacuugugcuuauaaacuggagaguuuagucauaau

SEQ ID NO: 80420 - RNA, 64 nt, hsa
acaaauauuuugauucuagagaacgucucagaugugcuuauaaagcuuccaaauacaacuccag

SEQ ID NO: 80421 - RNA, 64 nt, hsa
uuaaaagcuucuaaaugucuaauauaaagggagaugcuuauagccacaacaucuauuuuaccaa

SEQ ID NO: 80422 - RNA, 64 nt, hsa
ccuuauagguucauguaacuguccuguaauaaggugcuuauaaauggaacaacuacacagccua

SEQ ID NO: 80423 - RNA, 64 nt, hsa
aggcaauuuaaucaaaauuccugucaagaaaagcugcuuauaaauguaaaugaaaucacauuua

SEQ ID NO: 80424 - RNA, 64 nt, hsa
gagauagcuaacugcccauaaaacaaacucaaauugcuuauaaaguuucuucccauguucccau

SEQ ID NO: 80425 - RNA, 64 nt, hsa
uaaauauuaaguguuuaaaugaaaaauaaagaugugcuuauaucauuguauaauuguuaauaau

SEQ ID NO: 80426 - RNA, 64 nt, hsa
acauuuuacaagaaguauguaagcgucauggauaugcuuauacaagacuugauggacaaacacc

SEQ ID NO: 80427 - RNA, 64 nt, hsa
guagaaaccauauuuugguuaacagcaagaaaaaugcuuauaauguaguacaauuaaaaacaac

SEQ ID NO: 80428 - RNA, 64 nt, hsa
cuaauaucuguuauuuaauugaaaucugcuugugugcuuauaagaauuuacugaguucucacuu

SEQ ID NO: 80429 - RNA, 64 nt, hsa
auuaucugauaaugauuauuuaaauauuccuaucugcuuauaaaauggcugcuauaauaauaau

SEQ ID NO: 80430 - RNA, 64 nt, hsa
auagauaauuuaacaaaaguacaggauuagaacaugcuuauaccuauaaauaagaacaaaauuu

SEQ ID NO: 80431 - RNA, 64 nt, hsa
uuuuaucugcauuuuacugucugcuuuuuuuggcugcuuauaguuuuuaaaaaaguaauuuccu

SEQ ID NO: 80432 - RNA, 64 nt, hsa
agaggcuuggacugcuucuguguuuuuuuuguugugcuuauaugggagggagagugguguguuu

SEQ ID NO: 80433 - RNA, 64 nt, hsa
aguagagacaagaucuccguauguuauacaggcuggccucaagugauccucuuaccuuggccuc

SEQ ID NO: 80434 - RNA, 64 nt, hsa
aacaccgggauuauaggcgugagcccccgugccuggccucaaauuuuauuuuagcucgacccua

SEQ ID NO: 80435 - RNA, 64 nt, hsa
agagagcuggcuugagaguaguuauuaugaaaaaggccucaaggaguacguguucaguaugcuc

SEQ ID NO: 80436 - RNA, 64 nt, hsa
ccugcagcauacaguaagaugggucccugugccaggccucaauacugccagggaauaaaaccag

SEQ ID NO: 80437 - RNA, 64 nt, hsa
cuugcuauguugcccagguuggucuugaacuccuggccucaagagauccccccaaccuuggccu

SEQ ID NO: 80438 - RNA, 64 nt, hsa
agugcugggauuacaggcaugagccaccgcgccuggccucaaguaaguuuuuauaccaugauag

SEQ ID NO: 80439 - RNA, 64 nt, hsa
ugccauaugggcucacagcacccuggaggagaagggccucaaacugugcauguaagccuuuguu

SEQ ID NO: 80440 - RNA, 64 nt, hsa
aaacaugucgcaaaaugaaccaaacuucuggcuaggccucaaaacugacuuggucccacuugga

SEQ ID NO: 80441 - RNA, 64 nt, hsa
cuugcuauguugcccaggcuggucuugaacuccuggccucaagcaacccuccugccucagucuu

SEQ ID NO: 80442 - RNA, 64 nt, hsa
uucaccguguuggccaggcuggucucaaacuccuggccucaagugauccaccuaccuuagucuc

SEQ ID NO: 80443 - RNA, 64 nt, hsa
gagcacaacaaaaccugauucuggucuucuuuaccaauauaaucauaauguaaauaauaauuug

SEQ ID NO: 80444 - RNA, 64 nt, hsa
uuucuauuaccuugcuaccaaacaguuuagauagcaauauaauagcaaaaaagcaaauauggua

SEQ ID NO: 80445 - RNA, 64 nt, hsa
cacuuguuuuauucacagagguaaagugucuuuucaauauaaccagcaauuuagguggcaucua

SEQ ID NO: 80446 - RNA, 64 nt, hsa
guagucuaguagguaacuuuguggcaaaaauuuucaauauaauacauucugaaacaauaguugc

SEQ ID NO: 80447 - RNA, 64 nt, hsa
cccuuggcuauaagcaucuaaacucaucuucuuucaauauaauugaugcuaucuccuaauuacu

SEQ ID NO: 80448 - RNA, 64 nt, hsa
aaccuagaucauuuucuaccaacuaugguugccucaauauaaccuuuuauucauagauguuuuu

SEQ ID NO: 80449 - RNA, 64 nt, hsa
aaaccaaaaaccauuuugaucucccugugguuaucaauauaacgcacaaucacaaguguaugag

SEQ ID NO: 80450 - RNA, 64 nt, hsa
uuaaagaggaaaggcgauggugaugucuguaguacaauauaaaccauaauugugauuuaccuua

SEQ ID NO: 80451 - RNA, 64 nt, hsa
gucacucauagcauuucuauauuugaaaguagcccaauauaaaacuuuugauucuaaaauuaaa

SEQ ID NO: 80452 - RNA, 64 nt, hsa
ugaaggaaacaguuaauaccauuuuuuaaggaaacaauauaaccacaaagcacaguuugaacaa

SEQ ID NO: 80453 - RNA, 64 nt, hsa
aaaacaaaacaaaaaacuccccuuccucacugcccaauauaaaaggcaaauguguacauggcag

SEQ ID NO: 80454 - RNA, 64 nt, hsa
ucuuccucuuuuuuuuuuaauuggguaggacacccaauauaaaaacagucaauauuugacaaug

SEQ ID NO: 80455 - RNA, 64 nt, hsa
uuucuauauugaauaaacaauguaacauagauaacaauauaaauaaaagugguaugaccagugc

SEQ ID NO: 80456 - RNA, 64 nt, hsa
ccauauugcuauaguacuucuguaaagagaauaucaauauaaauaaggaaaauaaaucaaugaa

SEQ ID NO: 80457 - RNA, 64 nt, hsa
agucucauucuuuaagauacagaugugugaacuucaauauaaaguugcauuugccaaaauuuac

SEQ ID NO: 80458 - RNA, 64 nt, hsa
cuugaaccccuaaaauuaucagacuuccuuuuuccaauauaaagaaaaaaaguaaguuuucaga

SEQ ID NO: 80459 - RNA, 64 nt, hsa
guugcuuucuuugccugguccucaguuugcccaucaauauaauggguggauuggaugauuuuuu

SEQ ID NO: 80460 - RNA, 64 nt, hsa
auauaauguaugaacuuuuugcauuggcuugaagcaauauaauauauuguaaacaaaacacagc

SEQ ID NO: 80461 - RNA, 64 nt, hsa
aaaaaaaaauuacacugugguaguggcauuuaaacaauauaauauauucuaaacacaaugaaau

SEQ ID NO: 80462 - RNA, 64 nt, hsa
ggccaagaaauuaaagcacaugugaucaauauaacaauauaauccuaaaccuugacaguuggag

SEQ ID NO: 80463 - RNA, 64 nt, hsa
uuccuucuggccaagaaauuaaagcacaugugaucaauauaacaauauaauccuaaaccuugac

SEQ ID NO: 80464 - RNA, 64 nt, hsa
aauuaaaaugagcucacugauaugggccccgaugcaauauaauugguguccuuauaagaagggg

SEQ ID NO: 80465 - RNA, 64 nt, hsa
cagagucuggggugggaguguggacuuaggaaaacaauauaaaggacauccucaucaucacggg

SEQ ID NO: 80466 - RNA, 64 nt, hsa
gggcacagacaaccuuaucaaacaauauaaaagccaauauaaauucucauaagcacuauagaau

SEQ ID NO: 80467 - RNA, 64 nt, hsa
uggaagucuggggggcacagacaaccuuaucaaacaauauaaaagccaauauaaauucucauaa

SEQ ID NO: 80468 - RNA, 64 nt, hsa
aauauaacugauugaugaaagggcauauuuaggucaauauaaaauaauagcaaguauuuacuga

SEQ ID NO: 80469 - RNA, 64 nt, hsa
uauaacuuugcuacccuggauucugaugcaauuucaauauaaaaaguuguuccuuucauaguuu

SEQ ID NO: 80470 - RNA, 64 nt, hsa
cauuauuuucagaaccacauuuuaaaccuuuggguaaucagauuuccaacuuaugccuuccaga

SEQ ID NO: 80471 - RNA, 64 nt, hsa
uauuguuauguaucacuugcuaaaaauauuguuuuaaucagagauaaccucuuuaaaaaaauuu

SEQ ID NO: 80472 - RNA, 64 nt, hsa
gaauuuggaggcuggaguaaucagauuacugcuuuaaucagaaacccucauuguguuucuaccg

SEQ ID NO: 80473 - RNA, 64 nt, hsa
aacgaaugaaaauaacugaauuuggaggcuggaguaaucagauuacugcuuuaaucagaaaccc

SEQ ID NO: 80474 - RNA, 64 nt, hsa
agaguggcuuuuauaaauagcuuuauucugauauuaaucagauucccaacuuuacugagaauua

SEQ ID NO: 80475 - RNA, 64 nt, hsa
cuaacuuugaauccauccagccacuugcaaaugauaaucagaagucagcuuguucacuguuaga

SEQ ID NO: 80476 - RNA, 64 nt, hsa
uaauaauaauaaaguaaaaauaaaaauaaaaaaguaaucagaagcuaaaguaaaguuccuuucc

SEQ ID NO: 80477 - RNA, 64 nt, hsa
auuccucaguaucuauuccaagauacugaggucauaaucagaagcuaagcugggugcaguggcu

SEQ ID NO: 80478 - RNA, 64 nt, hsa
gccccagaggggccgguaauaaucacgugagggauaaucagauuccugcguauucagcaucuuc

SEQ ID NO: 80479 - RNA, 64 nt, hsa
auccucagauuuaaauaaguacuuuuuuuuuuuuuaaucagaagaacauuguuguuugauuaua

SEQ ID NO: 80480 - RNA, 64 nt, hsa
agggagaaagugguauuuauuaauauaauguguauaaucagagugccucuuauacauacuuuau

SEQ ID NO: 80481 - RNA, 64 nt, hsa
auguuuuacaaauuugaaacuuucauaauuguauuaaucagaaaacaagcacauugccauucuu

SEQ ID NO: 80482 - RNA, 64 nt, hsa
ucagaagagugaggcuucuuuuuucaaacuuuuguaaucagauuaagauugaccauugcuccuu

SEQ ID NO: 80483 - RNA, 64 nt, hsa
uuagaggauauacuuggugauaaugugaaugauguaaucagacuaacaguugaaucauugcugu

SEQ ID NO: 80484 - RNA, 64 nt, hsa
ugacauauaugaaagguuuaucuaagaagaaagaaacagagauaauauauauauagaaagaugu

SEQ ID NO: 80485 - RNA, 64 nt, hsa
aaaaacaagaaccacaaaaacuugaaaaaucugaaacagagaacagaaggccaagagccagcuu

SEQ ID NO: 80486 - RNA, 64 nt, hsa
gcugaacacuggcaacaacaaagccaacagucaaaacagagaugugauaaggaucagaacagca

SEQ ID NO: 80487 - RNA, 64 nt, hsa
ugcaucuggggaacuagagggauacacugaaguuaacagagacagauaacucuccucgggucuc

SEQ ID NO: 80488 - RNA, 64 nt, hsa
uaaaaacugaaggcagaauggaacuaauauauguaacagagaaaaacaauaaauuuuaugaacu

SEQ ID NO: 80489 - RNA, 64 nt, hsa
uuagaauaacaagaacaccaagaauuaccccuaaaacagagacccuguauuuaaucuacuuuga

SEQ ID NO: 80490 - RNA, 64 nt, hsa
ugcuaaacacugggcuucaucacccagggauaaaaacagagaucauugucuuggaccuccugca

SEQ ID NO: 80491 - RNA, 64 nt, hsa
caucaagccagcuucauucacucacuuuacuuagaacagagauauaagggccugggaugcauuu

SEQ ID NO: 80492 - RNA, 64 nt, hsa
uuuaaaugguuuucuuuuugaggcaaguuggaugaacagagaagggaagagaggaagaacgaga

SEQ ID NO: 80493 - RNA, 64 nt, hsa
ucucuagcaagggcucaacuucgaaaauggcaacaacagagaugcaaaaagcuaaaaagacacc

SEQ ID NO: 80494 - RNA, 64 nt, hsa
cuaguugaacacugguuuacaagauaauccguagaacagagagacuguagaaaaauauuccagc

SEQ ID NO: 80495 - RNA, 64 nt, hsa
gccuuuaaaagggcugguaaugcaguuacauucuaacagagaaguccaaacuacagguaaaaac

SEQ ID NO: 80496 - RNA, 64 nt, hsa
auuauuucagagggaauggcgauugaaauguuacaacagagauuucuuggugguagcuauuugg

SEQ ID NO: 80497 - RNA, 64 nt, hsa
aagcauuucuaaagcaccgacuggagaggaaggcaacagagacaaggagagaagccgagagaca

SEQ ID NO: 80498 - RNA, 64 nt, hsa
uuuacuuuuuuauuauaauuuugauauuaaaaagaacagagauggggucuugcuuuguugccca

SEQ ID NO: 80499 - RNA, 64 nt, hsa
cacaaaucagcaucauaagggaauguagccuuccaacagagaugaugcuguucguauguuaauc

SEQ ID NO: 80500 - RNA, 64 nt, hsa
cacuugagcucaggaguucuagaccaaucugggcaacagagagaccccaucucuuuuaaauaaa

SEQ ID NO: 80501 - RNA, 64 nt, hsa
cgauuucccacuccuuucuuagucuucuuccagaaacagagaaggggaugugugccugggagag

SEQ ID NO: 80502 - RNA, 64 nt, hsa
caccuccaagcucagacagggcccaggcuuggggaacagagagagcagguguacacccaaccaa

SEQ ID NO: 80503 - RNA, 64 nt, hsa
agguugugacaggugcagguagacaacgcccauaaacagagaugguccugaacucuggagagau

SEQ ID NO: 80504 - RNA, 64 nt, hsa
uguguguguguguaugagagagagagagagagacaacagagacagagagaggcagagaggcaua

SEQ ID NO: 80505 - RNA, 64 nt, hsa
agagaggcauagagagacagagagagagacaagaaacagagauagacagaaaauguucggggug

SEQ ID NO: 80506 - RNA, 64 nt, hsa
agaucaagaagagugguuugugcucaggcuggggaacagagaggcacgcuaugcugccagaauu

SEQ ID NO: 80507 - RNA, 64 nt, hsa
ucccucuucccuuacccccuuacaaaucucuggcaacagagaggcaaaguaucugaacaagaau

SEQ ID NO: 80508 - RNA, 64 nt, hsa
cacgaggcccggcucccuggggcagcugcuugagaacagagacugcuaccccauccugcccaug

SEQ ID NO: 80509 - RNA, 64 nt, hsa
uaggguugcccgcuguggccugcuuccagggagcaacagagaggccaccaagcagaggcccgug

SEQ ID NO: 80510 - RNA, 64 nt, hsa
caucaucuuaauguuuggagcuugccuuguaaucaacagagagagaaacuaaacacauacguaa

SEQ ID NO: 80511 - RNA, 64 nt, hsa
agcauuugguugagaggguuauuggaaagcuucaaacagagaauuagauuguuuccugauuuaa

SEQ ID NO: 80512 - RNA, 64 nt, hsa
cugaggucuuggcugagguuggcaucuccugaagaacagagagcacgguguccagagcuggccc

SEQ ID NO: 80513 - RNA, 64 nt, hsa
ccaugauggaagaagcugagcaugucuuaccaaaaacagagagaacgagccugaauacagcaga

SEQ ID NO: 80514 - RNA, 64 nt, hsa
agccuuucuccuguuuauggguuucuuccagcagaacagagacauugccaaccauauuggaucu

SEQ ID NO: 80515 - RNA, 64 nt, hsa
ucaacaagggucucauaucuaacuuccuccuuaaaacagagaaggucaaucuaguuccagaggg

SEQ ID NO: 80516 - RNA, 64 nt, hsa
aggauaguguuugauauaucuaagaaaguccaguaacagagaagaaaugucucaaaugucucgu

SEQ ID NO: 80517 - RNA, 64 nt, hsa
ugauaacucuuccauguuucacauuucuaaauuuaacagagaugcuguagcuuaaaacauguuu

SEQ ID NO: 80518 - RNA, 64 nt, hsa
caguuaccucauugcuuaccagcucaugauagcaaacagagacuagauucuauuagcuacuguc

SEQ ID NO: 80519 - RNA, 64 nt, hsa
aaagauaggagauagcucuguagaaacacacaggaacagagaaaugguugaugucagacccaga

SEQ ID NO: 80520 - RNA, 64 nt, hsa
gauuugcuauggcaggucgucaagagaacugugucauuccaaacucaccaagguggcuuauaga

SEQ ID NO: 80521 - RNA, 64 nt, hsa
auccaaauguuccccagaaauucugauaucaaaacauuccaauaacuuuuuuuuuucaggcgca

SEQ ID NO: 80522 - RNA, 64 nt, hsa
ugugacaggccaagucuuacagugccauggcccacauuccaacuuaccauguacuuagugacuu

SEQ ID NO: 80523 - RNA, 64 nt, hsa
uugaguacugugaaggauuauuugucuaacaguucauuccaaucagaccagguaggagcuuucc

SEQ ID NO: 80524 - RNA, 64 nt, hsa
gcuucaugugucauuccaagguuucuucaugagucauuccaaguuuucuaguccauaccacagu

SEQ ID NO: 80525 - RNA, 64 nt, hsa
ccucagaaugacuuuccuaucaugcuucaugugucauuccaagguuucuucaugagucauucca

SEQ ID NO: 80526 - RNA, 64 nt, hsa
aaagcaccuuuaaaaaaaauacauuuuaaaaaaacauuccaagccaauuggaagacaucauugg

SEQ ID NO: 80527 - RNA, 64 nt, hsa
gcuaccuagaaaucuuuuccauuccucuuucauacauuccaacccacuggaagucuuuagaggu

SEQ ID NO: 80528 - RNA, 64 nt, hsa
aguugccaguggcacauuacaccaguacagagcacauuccaaaggagacauuggaccaguuaau

SEQ ID NO: 80529 - RNA, 64 nt, hsa
ugucauucacaucucacaaaaucuugacaucuuacauuccaauacauuaucaagcaagcacaag

SEQ ID NO: 80530 - RNA, 64 nt, hsa
uuaaugaccaaaucacauuaucuauuuuagcacucauuccaaaauucaguauuuaauguaauua

SEQ ID NO: 80531 - RNA, 64 nt, hsa
acacuuuaaaaaccgccuuguaaguucuggggagcauuccaaagcaguauauugguuccaauua

SEQ ID NO: 80532 - RNA, 64 nt, hsa
agcgauuugcugaaggaaaaaucggacugcaaaucauuccaaggccaaacugcaacugagccac

SEQ ID NO: 80533 - RNA, 64 nt, hsa
uguacuuugauuguaauagguuggcucuuacacccauuccaaaugcaguuuauuuuuagacccg

SEQ ID NO: 80534 - RNA, 64 nt, hsa
gaggcuagugagaaagaaaagcuccucucugcuccauuccaaaggccaucuuguggucaguuuc

SEQ ID NO: 80535 - RNA, 64 nt, hsa
ccuucagccacuugaagaagaaauagaaggcgcucauuccaauauagucuuuauuucccauuca

SEQ ID NO: 80536 - RNA, 64 nt, hsa
ccugucuaaagucaaucauccgagauggguuuuccauuccaaagaaaggcaauaugguuccuuc

SEQ ID NO: 80537 - RNA, 64 nt, hsa
uguugucuaggccuuccccuugugaaucuggguucauuccaauacggcaaguaagaguuggaaa

SEQ ID NO: 80538 - RNA, 64 nt, hsa
guccugguacagcagggucuugcuguaacucagacauuccaaggguaugggaagccauauucac

SEQ ID NO: 80539 - RNA, 64 nt, hsa
ccccccgccccccaccuuugggaucagccuccgccauuccaagucaacacucuucuugagcaga

SEQ ID NO: 80540 - RNA, 64 nt, hsa
aauguuuuuugcauucaaaggacauccacaucuguuggaagacuuuuaagugaguuuuuguucu

SEQ ID NO: 80541 - RNA, 64 nt, hsa
aacuaauucugugagaguugagcucauuuucuaguuggaagaaugugauauuuguuguguuggu

SEQ ID NO: 80542 - RNA, 64 nt, hsa
guggugcgguaaccugcguggcuccugauagcguuuggaagaacgcgggggagacugaagagca

SEQ ID NO: 80543 - RNA, 64 nt, hsa
acgcaucuggaggggacuggaggaaacccccuuguuggaagagauuccaagagaagcacgguuu

SEQ ID NO: 80544 - RNA, 64 nt, hsa
cacugcuaaaaugauucacagggagaguggccaguuggaagaaggauccuaaggaugugacacu

SEQ ID NO: 80545 - RNA, 64 nt, hsa
ucauuugguggcaaaguucauagaacuaggggacuuggaagaugcuuugaaaauauuguuacaa

SEQ ID NO: 80546 - RNA, 64 nt, hsa
agccugucauccuuggucuuuguaucuuccauauuuggaagaaaaaaaucuucuccagauuuuu

SEQ ID NO: 80547 - RNA, 64 nt, hsa
agaacuguaaguguuuuuucauauguacuuuucauuggaagauucccaacaagaauuuggaugg

SEQ ID NO: 80548 - RNA, 64 nt, hsa
cauggccauucaugacccuuaagugccacccuucuuggaagacccccuccagaagcauacugga

SEQ ID NO: 80549 - RNA, 64 nt, hsa
gccagaacuggggggcugagucuucccuggccccuuggaagaggcccccagaugcccaggcuca

SEQ ID NO: 80550 - RNA, 64 nt, hsa
ucuauaacuugacguuggugagcuuauauuucccuuggaagagagcauuugugguacaauaugc

SEQ ID NO: 80551 - RNA, 64 nt, hsa
caccaaagaugcuucugaaauacagauaaaaugguuggaagaaaauguuuugaguauaugugac

SEQ ID NO: 80552 - RNA, 64 nt, hsa
aagaggcaugacagcuaacagggacgggcuuucuuuggaagaugaugaaauuguggaaugaugg

SEQ ID NO: 80553 - RNA, 64 nt, hsa
ugugaauauacuagaaaccaaugaauuaaaaacuuuggaagaugaauuuuauggucugugaauu

SEQ ID NO: 80554 - RNA, 64 nt, hsa
uacccuccuuggaguugcaaguauucuuucaagguuggaagagggauuuugaagagguaucucu

SEQ ID NO: 80555 - RNA, 64 nt, hsa
uuuuuccauaagggacaugagcauuuuacuaggcuuggaagagcugacaugaugagcauuauug

SEQ ID NO: 80556 - RNA, 64 nt, hsa
cauagaaucccagucaccuuuauauaucauauuauuggaagagauucaucuucauaaucuccag

SEQ ID NO: 80557 - RNA, 64 nt, hsa
uagaaucacaauuaccuuuauauaucauauguuauuggaagagauuccucaguaaucuccaauc

SEQ ID NO: 80558 - RNA, 64 nt, hsa
uuuuguucugcauugacucauuuaccagaauucauuggaagaaaucaccaaagauuauuacaaa

SEQ ID NO: 80559 - RNA, 64 nt, hsa
aucucuauagaucgucagcucauuuuaucuguaauuggaagaacagaaagugcuggcucacuuu

SEQ ID NO: 80560 - RNA, 64 nt, hsa
uugagauuaugaugaaaaccuacauauuccauguuuggaagacccuuggaagaggaaaauugga

SEQ ID NO: 80561 - RNA, 64 nt, hsa
augaaaaccuacauauuccauguuuggaagacccuuggaagaggaaaauuggauucccuuaaac

SEQ ID NO: 80562 - RNA, 64 nt, hsa
uuucaugaguccagggaagaggguccuccaggucuuggaagacagaggggagcugcuuuagagg

SEQ ID NO: 80563 - RNA, 64 nt, hsa
accaucuuguggccaccucagacaucacuucucuuuggaagacuccauuaaauauuucucugug

SEQ ID NO: 80564 - RNA, 64 nt, hsa
aauuuaauuuuagcuuuaaaauauuggauuggcuuuggaagaauuauauuagguagaauacaca

SEQ ID NO: 80565 - RNA, 64 nt, hsa
acauaagacuaaacaugagaaaaacgcuaacuuauuggaagaaaaucggagaaacguugguguc

SEQ ID NO: 80566 - RNA, 64 nt, hsa
guagguagccuucucuguggucacuguguuggauuuggaagaaaauauaaguagauguuaaggu

SEQ ID NO: 80567 - RNA, 64 nt, hsa
cucuacaauguuaagggguuguuguguaguugcauuggaagagagaaaggaaacacacucuuuc

SEQ ID NO: 80568 - RNA, 64 nt, hsa
aaaaaaguuccuuccuaaaauaauuucucuacaauuggaagauuggaagauucagcuaguuagg

SEQ ID NO: 80569 - RNA, 64 nt, hsa
uccuuccuaaaauaauuucucuacaauuggaagauuggaagauucagcuaguuaggagcccacc

SEQ ID NO: 80570 - RNA, 64 nt, hsa
cacuaauugucacaccuggaagcuuggugaauaauuggaagaaagaauuucaaaaauggcuagg

SEQ ID NO: 80571 - RNA, 64 nt, hsa
ucauuuauauuaaagaauuuggaaggcaaagacauuggaagaggcauugguuauaaauucaaag

SEQ ID NO: 80572 - RNA, 64 nt, hsa
acucaauuuaaaaauccaaaucuuuuuaagcuucuuggaagaauuuccuccugcuuauauuguu

SEQ ID NO: 80573 - RNA, 64 nt, hsa
agcaggaugugucacuaaugcuccaccucacccuuuggaagaaaggaaagcuguuuccuccugg

SEQ ID NO: 80574 - RNA, 64 nt, hsa
aauauuuuugagauaucccuuuggaagaccuugcuuggaagagccuggacacuaacaauucuac

SEQ ID NO: 80575 - RNA, 64 nt, hsa
cuucaacucuaaggaauauuuuugagauaucccuuuggaagaccuugcuuggaagagccuggac

SEQ ID NO: 80576 - RNA, 64 nt, hsa
gagaaaggggaaucucccaaaauuuaaaaacaaauuggaagaauaaccaggacagccaagugaa

SEQ ID NO: 80577 - RNA, 64 nt, hsa
ucaccccaggcccagaaguagguugcaacugccuuuggaagauuuugccccuuagccaucccca

SEQ ID NO: 80578 - RNA, 64 nt, hsa
uguaauacaguuuauaccaguguaugcucuagacuuggaagauguaguauguuugauguggauu

SEQ ID NO: 80579 - RNA, 64 nt, hsa
gugcuuaaaugguaauguacuccacuucuuccuauuggaagauuaacauuauuuaccaagaagg

SEQ ID NO: 80580 - RNA, 64 nt, hsa
cucuuuaaagguaaaagguuuaaggauaauccauuuggaagaagaaaagagugaggcugaaagu

SEQ ID NO: 80581 - RNA, 64 nt, hsa
ccccuuuuuauccagaguugugggaaucucaggauuggaagagauuuuaaaggccacauaggcc

SEQ ID NO: 80582 - RNA, 64 nt, hsa
gccaggagagcaggaacagaacagagaaaugcccuuggaagaaguggaguugguggaugggugg

SEQ ID NO: 80583 - RNA, 64 nt, hsa
gugugugagggagcugaguaggccagguaggcgauuggaagagugagcaggacacagaggggag

SEQ ID NO: 80584 - RNA, 64 nt, hsa
uucuccuuagcaguaggacuugauauuuucaauuuuggaagaacuaaaagaugaauaaacuggg

SEQ ID NO: 80585 - RNA, 64 nt, hsa
ugccucgugcagauucugagguauaucugcugccuuggaagacauaagaagcagugauacuccc

SEQ ID NO: 80586 - RNA, 64 nt, hsa
cuuuauugaugagguggauaucugcauucucagcuuggaagaccucagaaccaagcugacugug

SEQ ID NO: 80587 - RNA, 64 nt, hsa
uugaacauacaaagugggcagacagucgggauuguuggaagaacagguuccggugaggacaagc

SEQ ID NO: 80588 - RNA, 64 nt, hsa
auugguuucagaugaugaagaaagaggaacgggcuuggaagaaaauaaucaagaagagcaaagc

SEQ ID NO: 80589 - RNA, 64 nt, hsa
uucugcuagcuuguuuucuucacagugcagugaauuggaagacuugacugcaaauacaaacacc

SEQ ID NO: 80590 - RNA, 64 nt, hsa
uuugugggagacuuggcuuuuuuuuuucuucugguuggaagaaccuaaauuagcgaauguuuuu

SEQ ID NO: 80591 - RNA, 64 nt, hsa
uccuugagcaaguggagcugugggaauugcacucuuggaagaucccgcauggguucgaggugag

SEQ ID NO: 80592 - RNA, 64 nt, hsa
uauugggaaggaaucauuguuccaggcauccaucuuggaagaaaggaccagcuuugagcuccau

SEQ ID NO: 80593 - RNA, 64 nt, hsa
aucucuuaaauacacguaggugggccagagaacauuggaagaaucaagagagauuagaauaucu

SEQ ID NO: 80594 - RNA, 64 nt, hsa
uuuucccauauacaaucuuccuuccuuagguaauuuggaagaaaacuaugacccauuuaauuuc

SEQ ID NO: 80595 - RNA, 64 nt, hsa
aaguuacuacuuacaggugauaacuugcauacuauuggaagauaaacuugucaaacuugucaag

SEQ ID NO: 80596 - RNA, 64 nt, hsa
ggaagacuugauuuacuggaagacuuggagcuucuuggaagacauggauuguccggaagacaug

SEQ ID NO: 80597 - RNA, 64 nt, hsa
gaagaucuguauuugauggaagaccuugaaauuauuggaagacauggauuuccuggaagacgug

SEQ ID NO: 80598 - RNA, 64 nt, hsa
ccuaagaguuuucucaccuguucagucucaucuaaccuuccaaugucugauguuccugccaaau

SEQ ID NO: 80599 - RNA, 64 nt, hsa
cagcagagcagcagcuagagaccccuuuggccacaccuuccaggcacuggccugaugccccgcc

SEQ ID NO: 80600 - RNA, 64 nt, hsa
uaugggucuuagucuuaaggguaacagagugaauaccuuccaaauaaaaagcuaaauauuccuc

SEQ ID NO: 80601 - RNA, 64 nt, hsa
gaauaacuuuaguaaguuagcugccagcauuagaaccuuccaggaagaauuuuaacuaguaugc

SEQ ID NO: 80602 - RNA, 64 nt, hsa
uuacauugcugcugcuagagaggguggggauugcaccuuccaaaucuguuucuguaccaauauu

SEQ ID NO: 80603 - RNA, 64 nt, hsa
uguggcuugucuugccaauagacuccaggcuuauaccuuccauuuccaucguauucuccaguuu

SEQ ID NO: 80604 - RNA, 64 nt, hsa
cucccccaagccaggccccuguccccaccccaccaccuuccagggugccaggcagggcuggccu

SEQ ID NO: 80605 - RNA, 64 nt, hsa
ccacagggacacugcucugccugccuggcccucaaccuuccaugaccagcgugugcgcagggcc

SEQ ID NO: 80606 - RNA, 64 nt, hsa
gagacuccaucucaauaaaauuaauaauaauaaaaccuuccaaaaaaagugccgggaccaaaug

SEQ ID NO: 80607 - RNA, 64 nt, hsa
auaucuauuaaauaaauugaagcaguaauuaauaaccuuccaagaccaggcgcgguggcuaaaa

SEQ ID NO: 80608 - RNA, 64 nt, hsa
gccccgcggaagaccgcccagugagccagcccccaccuuccaggcgccuucgcccuggggaucc

SEQ ID NO: 80609 - RNA, 64 nt, hsa
uuuccuccaccccuccaucccccaaugcuuguagaccuuccauucauuccgucucaucgugcgu

SEQ ID NO: 80610 - RNA, 64 nt, hsa
ugcaucagacaaugccauuucuccccaccacggaaccuuccaucuaagauuucuuccagggaau

SEQ ID NO: 80611 - RNA, 64 nt, hsa
gauguggcuccuagugcaaaccggaaaccauggcaccuuccagagccguggucucaaggaguca

SEQ ID NO: 80612 - RNA, 64 nt, hsa
ggcuguggguggggaaggaaggcguguccaggagaccuuccacaaaggguagccuggcuuuucu

SEQ ID NO: 80613 - RNA, 64 nt, hsa
ggcccuagacccucccccaccauuccacauccccaccuuccaaggaaaagcagaaguucauggg

SEQ ID NO: 80614 - RNA, 64 nt, hsa
uucucuggggauugcugggucacaggugccccucaccuuccacagucaggcagggaaguuauag

SEQ ID NO: 80615 - RNA, 64 nt, hsa
aguucuuccucccacaauguaggaccuuuccuuuaccuuccaauggauaaaauaguucagaguu

SEQ ID NO: 80616 - RNA, 64 nt, hsa
acguugcuggggagagaaaagcaguauagacuccaccuuccaggauguccauuucggggagagg

SEQ ID NO: 80617 - RNA, 64 nt, hsa
cucuccucguccccacccacccccacauuugcacaccuuccacagggucaggauggaguagcug

SEQ ID NO: 80618 - RNA, 64 nt, hsa
acuaaaauuaggacauguuuucucuuugaaaugaagaauauaguuuaaaagcuuccuccuccau

SEQ ID NO: 80619 - RNA, 64 nt, hsa
aguuguacuuaaguguguaacaggaauauuuugcagaauauagguuuaacugaaugaagccaua

SEQ ID NO: 80620 - RNA, 64 nt, hsa
uacuauauuuauacuguauauauaauacugacugagaauauaauacuguauuugagaauauaaa

SEQ ID NO: 80621 - RNA, 64 nt, hsa
uauaauacugacugagaauauaauacuguauuugagaauauaaaaaacuuuuuucagggaagaa

SEQ ID NO: 80622 - RNA, 64 nt, hsa
cacuuacuuauagaggugauuuacagauuuaaugagaauauaucaaaguacuuuauaacucaca

SEQ ID NO: 80623 - RNA, 64 nt, hsa
ugguaauucauuaaaauugccuuaguaauauauuagaauauacaaauauguguguauaaaauaa

SEQ ID NO: 80624 - RNA, 64 nt, hsa
gaauugagugucuaugaaaaccauauuccagacaagaauauagucuaagguaaauguucucaua

SEQ ID NO: 80625 - RNA, 64 nt, hsa
cuccacaauaaauuuuaaugagcacuacaaauuuagaauauauaaaaauaucaguaaccuauga

SEQ ID NO: 80626 - RNA, 64 nt, hsa
agaacaaaagaggauuaguagaaaauacauuauuagaauauaaaaaauguuauuacugaggaaa

SEQ ID NO: 80627 - RNA, 64 nt, hsa
uguuuuaggugccuggauauuuuuugauggaaaaagaauauauugccaaauauuaagaagcuca

SEQ ID NO: 80628 - RNA, 64 nt, hsa
aaaucauaauuugaagaaggccagcauuuaugguagaauauauaauuauauauaagguggccac

SEQ ID NO: 80629 - RNA, 64 nt, hsa
uuagaaagcugaguguuucacaccuuaucuauguagaauauauuuccuuauucagaauuucuaa

SEQ ID NO: 80630 - RNA, 64 nt, hsa
uuauagagauauuucuuacagaaagcuuuguagcagaauauauuugcagcuauugacuuuguaa

SEQ ID NO: 80631 - RNA, 64 nt, hsa
augcagaagaauggcuaaaauaagaaacgugauaagaauauagaugaucacaaaaagggagaaa

SEQ ID NO: 80632 - RNA, 64 nt, hsa
auuuaaaugauuuuaauuuuaacauuuuauuucuagaauauauggcuccauuuuauuuuauagu

SEQ ID NO: 80633 - RNA, 64 nt, hsa
acagucaaagauugugucaccucaaaggccuugaagaauauauuuucuuggugaauuuuuguau

SEQ ID NO: 80634 - RNA, 64 nt, hsa
agacuuuuuaaaauguacauaaagaauuuaagaaagaauauauuugucaaauaaaaucaugauc

SEQ ID NO: 80635 - RNA, 64 nt, hsa
aagcaccuauagacuugaacuccuaagugccaccagaauauauaaaaagggaauuuaggaucca

SEQ ID NO: 80636 - RNA, 64 nt, hsa
aagagaauuaaaaucguagcuuguacagaucaagagaauauacugggcagaaugaaguauguuu

SEQ ID NO: 80637 - RNA, 64 nt, hsa
uuaaaaauaaaggauuuuggaacucuggagaguaagaauauaguauagaguuugccucaacaca

SEQ ID NO: 80638 - RNA, 64 nt, hsa
uguaaaaaauaaagcaaguguaauuaauucuuucagaauauaaaauuugggcauucucugcuga

SEQ ID NO: 80639 - RNA, 64 nt, hsa
aacauuuaauuguguucaucauauuuaaaaauauagaauauauuagagaacugugauuuaaaag

SEQ ID NO: 80640 - RNA, 64 nt, hsa
gaaagaauaacagaaaaugugucauucauuuuucagaauauaaccacucaagcuacuggcacau

SEQ ID NO: 80641 - RNA, 64 nt, hsa
uaugaaauguuacuucguucccuggaucaaauuaagaauauaaaauuugaucuucuaaucugug

SEQ ID NO: 80642 - RNA, 64 nt, hsa
uuaguuuguugggggauauaaauuauucucaggaagaauauaaugaacuguacaguuacuuuga

SEQ ID NO: 80643 - RNA, 64 nt, hsa
ccuucaguugcaauaugcuaaucccacuuuacaaagaauauaaaagcuauauuuugaagacuug

SEQ ID NO: 80644 - RNA, 64 nt, hsa
cccugacccacacaaagguucuggagauuacuggagaauauauauaaauauauauauguacgua

SEQ ID NO: 80645 - RNA, 64 nt, hsa
ggauuacaggcaugagccacugcacccggcccugagaauauauuuauuaaagccaccucuucac

SEQ ID NO: 80646 - RNA, 64 nt, hsa
guuaggauauagcuaugccuuuaugguuaagauuagaauauaugauccauaaaaauuuaaagug

SEQ ID NO: 80647 - RNA, 64 nt, hsa
uugguaguuguaacugcuaauaaaaccagugacuagaauauaagggagguaaaaaggacaagau

SEQ ID NO: 80648 - RNA, 64 nt, hsa
gggaaaaauaauguuggagaaauacucuaugaauagaauauacuuuggaagcccuuaacuaaac

SEQ ID NO: 80649 - RNA, 56 nt, hsa
aucaaaauuuguacuggugaugaaacagaauauaugaaauguguagggaggcuuuu

SEQ ID NO: 80650 - RNA, 64 nt, hsa
ggggaaugggaagaagcaguuuacuuuagacuaaagaauauauuggggggccggguguaguggc

SEQ ID NO: 80651 - RNA, 64 nt, hsa
agagcgagacuccaucucaaaaaaaaaaaaaaaaagaauauauugacggaagaauagagaggag

SEQ ID NO: 80652 - RNA, 64 nt, hsa
ugacagagaugugcauguggguauuguuaggaaaugucaucaaacuccacccaccuggcuucau

SEQ ID NO: 80653 - RNA, 64 nt, hsa
cuuucacacaaugcccaacuuacugucuucuucaugucaucaaaaucugcacagucacuggccc

SEQ ID NO: 80654 - RNA, 64 nt, hsa
ugacagagaugugcauguggguauuguuaggagaugucaucaagcuccacccuccuggccucau

SEQ ID NO: 80655 - RNA, 64 nt, hsa
cuuucauacaauggccaacuuauuguauuccucaugucaucaaaaccugcgcagucauuggccc

SEQ ID NO: 80656 - RNA, 64 nt, hsa
acuccaaagucaucuugccagucccgguguucaaugucaucaauggcaguucucaugcugucac

SEQ ID NO: 80657 - RNA, 64 nt, hsa
ccauuggagcggagguuuaccacagccugaagaaugucaucaaggagaaauaugggaaagaugc

SEQ ID NO: 80658 - RNA, 64 nt, hsa
gugcagccuugcagaggacaaggcuggaggcauuugucaucacuacagauaugcaacuaaaaua

SEQ ID NO: 80659 - RNA, 64 nt, hsa
agaguuccugcuuuggguggaugcauuucucaauugucaucagccugguggggcuacugcagug

SEQ ID NO: 80660 - RNA, 64 nt, hsa
uuuagucuucugagguccagccccuuaggcugucugucaucacuguacccaagugaugucacua

SEQ ID NO: 80661 - RNA, 64 nt, hsa
aaggaggauuaggaaugaguauuccauuccuaggugucaucagaugaccuugaccaccacaaua

SEQ ID NO: 80662 - RNA, 64 nt, hsa
auuuuuuauguuccaauaauguuuuguacaucauugucaucaauaucuacagaagcucuuugac

SEQ ID NO: 80663 - RNA, 64 nt, hsa
ggggucuccugaauaaauagaguauuaguccuuaugucaucauuguucaaaauuggagauguac

SEQ ID NO: 80664 - RNA, 64 nt, hsa
cuaucacauagauuucaguuuuuagaaggguuucugucaucauggaagagguggucugggacua

SEQ ID NO: 80665 - RNA, 64 nt, hsa
accuggguugacaccuuccuacuuauccacuagaugucaucagaggugcuguuccgugguucug

SEQ ID NO: 80666 - RNA, 64 nt, hsa
guccugggugacagggcgcucacugagcaccaugugucaucacagacacuuacacauacuugaa

SEQ ID NO: 80667 - RNA, 64 nt, hsa
ccagucuugaccgggaugaggcccacagacagguugucaucagcuugucccauucaagccaccg

SEQ ID NO: 80668 - RNA, 64 nt, hsa
guuucaccaccucccucuuccagacugcacucucugucaucaguccccuccuuucuaacagaaa

SEQ ID NO: 80669 - RNA, 64 nt, hsa
auccuuccuucucuuucccccuaagucuuuugagugucaucauguacuggugguuucucgguuc

SEQ ID NO: 80670 - RNA, 64 nt, hsa
cuccaucaaggaaaaaugaucuguuaaaugaagcugucaucagggaaugcugagcugcaaugac

SEQ ID NO: 80671 - RNA, 64 nt, hsa
gccuucaaagaaagaccagaagccaaguguacucugucaucacuuaauaaugcuugaagcuuuu

SEQ ID NO: 80672 - RNA, 64 nt, hsa
auugucaucacaauguuauauauugacaccccagugucaucagucaggcaggagccaaacaaug

SEQ ID NO: 80673 - RNA, 64 nt, hsa
guaguucuggaauauugccgggugaaaguccaauugucaucacaauguuauauauugacacccc

SEQ ID NO: 80674 - RNA, 64 nt, hsa
acaaaaaauuaugggauguaacuaaugcuucaguagaauacagcagggccaaaacuagagugau

SEQ ID NO: 80675 - RNA, 64 nt, hsa
aauuauuuuaaaagaacucagcauucaguuagauagaauacacaccauccuggaaaguugggau

SEQ ID NO: 80676 - RNA, 64 nt, hsa
uuucccagauauuuauguuugaacauaauggcucagaauacauauuugaacaucauaguuguau

SEQ ID NO: 80677 - RNA, 64 nt, hsa
uugaaauaagauuuuguuccaaguauuaucugauagaauacaagaugauucaaaauuauauaga

SEQ ID NO: 80678 - RNA, 64 nt, hsa
uugugauuuagauguauccauccuuuuucuauuaagaauacaaaugcugggcugggcacagugg

SEQ ID NO: 80679 - RNA, 64 nt, hsa
ccuggaugacagagcgagacuccgccucaaaaaaagaauacaaaugcuccaacauuauuuuuua

SEQ ID NO: 80680 - RNA, 64 nt, hsa
ggacucuacuauugaugcagaucagagaguucuuagaauacagaauaccgaugacaaugauaag

SEQ ID NO: 80681 - RNA, 64 nt, hsa
uuucagucagagcucaagucuuagucgacauaaaagaauacacacuagagaaaaaccuuacaaa

SEQ ID NO: 80682 - RNA, 64 nt, hsa
ccccaaugauccuggcuuuuucacugaacguaucagaauacauggaugaauugggguaaauaag

SEQ ID NO: 80683 - RNA, 64 nt, hsa
uccuaacuugauuagcuugagcugacagacuguuagaauacaguucucuggccacagcugauga

SEQ ID NO: 80684 - RNA, 64 nt, hsa
uuacucucucauuguuuuaaguaauugccaacucagaauacaucauucuuaggcugaaauuugu

SEQ ID NO: 80685 - RNA, 64 nt, hsa
ccagguucgcugaucuaucaacaucaccccauuaagaauacaaagcacuacauucuuuuaucuu

SEQ ID NO: 80686 - RNA, 64 nt, hsa
uuaguuuuuaaaauauuccguggucaaaauucuuccucacuauaauugguauuuacuuuuacca

SEQ ID NO: 80687 - RNA, 64 nt, hsa
gguucaccauuaccaguggaaugaagucaauucuccucacuauaacugggugugguaguuuaag

SEQ ID NO: 80688 - RNA, 64 nt, hsa
agggucccccagcugggugggcuggaauggaacuccucacuagcugcuggggcuccgcccaccc

SEQ ID NO: 80689 - RNA, 64 nt, hsa
cagaagacagagcuauuucagaggcucugugugcccucacuagauaguuuuucuucuggguuca

SEQ ID NO: 80690 - RNA, 64 nt, hsa
uuugcucucucccgcuuugucuaauuuagaacugccucacuaaauucuuagggauggaaguauu

SEQ ID NO: 80691 - RNA, 64 nt, hsa
ugucugugugguuaauguucugguuucucagucuccucacuauauccacuucacuccucauuug

SEQ ID NO: 80692 - RNA, 64 nt, hsa
cccuccuuacccaccagaacagggguuuugaugcccucacuaguguugaagccuguuccagaga

SEQ ID NO: 80693 - RNA, 64 nt, hsa
aauauagcugagacuacaagugugugccaccaugccucacuaauuuuuguauuauuuuuguaga

SEQ ID NO: 80694 - RNA, 64 nt, hsa
auucagccuuacagcauaacuaauuauuuguuuuccucacuacauuguacaugugggaauuaca

SEQ ID NO: 80695 - RNA, 50 nt, hsa
ccugggcgggcaggaaauaaccucacuaucccggcugcccuuucugggca

SEQ ID NO: 80696 - RNA, 64 nt, hsa
uuccuccucugacgagugaagauagcaucgucgaccucacuacuuggaaccuucccaggugggc

SEQ ID NO: 80697 - RNA, 64 nt, hsa
uccugcucuguuuggugggccauaugccuacagcccucacuaacaaagaaccccucugucuuca

SEQ ID NO: 80698 - RNA, 64 nt, hsa
ggauuuuggaaaauuguuccccaugggauucuaaccucacuaccaaaugagugaaagcuugauu

SEQ ID NO: 80699 - RNA, 64 nt, hsa
cugcacgggcuuuaggguaaaugcucaucuuaaaccucacuagagggaagucuucucaaguuuc

SEQ ID NO: 80700 - RNA, 64 nt, hsa
aauacaucuuguacccagcgcuaauuuugaaugcccucacuauugaugcauuuuuaauaagcaa

SEQ ID NO: 80701 - RNA, 64 nt, hsa
gauaaauauaaauuggaguuaggaauuucaugaaccucacuaugaccaaaauuaauuuuuugau

SEQ ID NO: 80702 - RNA, 64 nt, hsa
guacuuuguaagucguuugcgagaaugcagaccaccucacuaaacuguaaacgguaaagagauu

SEQ ID NO: 80703 - RNA, 64 nt, hsa
augcacaaagaauuaauuagcauuauuaaagaguccucacuaaacauuucauaugaucacacug

SEQ ID NO: 80704 - RNA, 64 nt, hsa
aucauucuaccccuggccccuccaaaucucauguccucacuauucaaaaccaaucaugccuucc

SEQ ID NO: 80705 - RNA, 64 nt, hsa
ucgucagggcccaguuuguuuccucauacaccuuccucacuaccccaccccacaugguugacuc

SEQ ID NO: 80706 - RNA, 64 nt, hsa
ugcggcgaugccacgggccugccuuuucuaugcgccucacuagcuuaccacccugugcagguaa

SEQ ID NO: 80707 - RNA, 64 nt, hsa
ccacgccugcccacuuugcuagcccggcugugccccucacuaucagagacugggcgaagcaaac

SEQ ID NO: 80708 - RNA, 64 nt, hsa
ccuuggcuauucugugcauauuguucuucagagaccucacuacccacaugcugaucuauugggg

SEQ ID NO: 80709 - RNA, 64 nt, hsa
cugaugguuccccaucucucucccucuccucagaccucacuauucucucagacacaacaguauu

SEQ ID NO: 80710 - RNA, 64 nt, hsa
uuccuauccuaaauccucuuccagucuguccaucccucacuaccaugauagucuacauucugau

SEQ ID NO: 80711 - RNA, 64 nt, hsa
guagccuggcagccuacaucuccccucagccucuccucacuauggccccagugccuugaggccc

SEQ ID NO: 80712 - RNA, 64 nt, hsa
ucuccccugagggagucccugggccuagccauccccucacuauucccgacccaaagggugacuu

SEQ ID NO: 80713 - RNA, 64 nt, hsa
guuagggcugccagccuagggcuuugugccuacaccucacuaagcccauggagaggucacagau

SEQ ID NO: 80714 - RNA, 64 nt, hsa
ucugacuggcuacugcuaaggacaacaaacugccccucacuacuggcuugguuuggucuacugg

SEQ ID NO: 80715 - RNA, 64 nt, hsa
aucagccauguucaggaaaugaucucuguuugaaccucacuauccuguaagguuauccaaguag

SEQ ID NO: 80716 - RNA, 53 nt, hsa
gauuuaggaagagagauugaaaaccucacuaaggaguuagagagguaccggca

SEQ ID NO: 80717 - RNA, 64 nt, hsa
uaaagccuuuagagccagcccauggcuuuagcuaccucacuaugcugcuucacaaaccuugcuc

SEQ ID NO: 80718 - RNA, 64 nt, hsa
uuuuaacuugggggugaaagauuuaagaacucagccucacuagaucaacggaccaaauaaacaa

SEQ ID NO: 80719 - RNA, 64 nt, hsa
aaaaaaacaaaauaaauaaaauuagacuuccuucccucacuauauaucuuuaugcagucagaau

SEQ ID NO: 80720 - RNA, 64 nt, hsa
auggcuggguacaaucaagugauauuuuguagcaccucacuaucugaaaggccaugaguuuuca

SEQ ID NO: 80721 - RNA, 64 nt, hsa
gaagucucaguuuucaguacaguacaucauuccuccucacuaggagcacuuugauguaaaccag

SEQ ID NO: 80722 - RNA, 64 nt, hsa
gcauuucuuucucuccccauuauuuauugguuuuccucacuaaucuuuuuuuuuuuaguccaaa

SEQ ID NO: 80723 - RNA, 64 nt, hsa
aaaacaccuaagugacuaccacuuauuucuaaauccucacuauuuuuuuguugcuguuguucag

SEQ ID NO: 80724 - RNA, 64 nt, hsa
cuaccccuggcuauccuaauucccuguucuccugccucacuauuacuguauucucuacuucuaa

SEQ ID NO: 80725 - RNA, 64 nt, hsa
accuaacaugcuggugaauauuuucaacuuuuucccucacuaauugguacuuuuaaaaacauaa

SEQ ID NO: 80726 - RNA, 64 nt, hsa
aaaccggcauuugcugcuaaaggauacccagaacccucacuacuguaacauacaacgguucagc

SEQ ID NO: 80727 - RNA, 52 nt, hsa
ucgccgacacucaccuguagcaccucacuaaccauucgacugagcacacuuu

SEQ ID NO: 80728 - RNA, 64 nt, hsa
ucugcuauauuuucaugacuuuuccauguaucuaccucacuauucaaguauuagggguaauaua

SEQ ID NO: 80729 - RNA, 64 nt, hsa
acagagccucugcccggcccucccguucgcccguccucacuagcugcacccuguuugcucgcag

SEQ ID NO: 80730 - RNA, 64 nt, hsa
gagucuuuugcaaugacuugggaaaaacacccucccucacuacaggaucuucauguuguuaaua

SEQ ID NO: 80731 - RNA, 64 nt, hsa
ugggacacaguuggaaagccacugggaggaaaugccucacuacaggggggccuccuguagcaag

SEQ ID NO: 80732 - RNA, 64 nt, hsa
cacuuccucauuugauacagguauuaagcugaauccucacuaauucacuuuugaaaaguucuua

SEQ ID NO: 80733 - RNA, 64 nt, hsa
cuacacuguacgauucacuagggcauccugcgagccucacuagccuucugguucaugccuuuga

SEQ ID NO: 80734 - RNA, 64 nt, hsa
ccucaguggcccagugggcagaggccagggagugccucacuauuuugcaaaugccgacccugug

SEQ ID NO: 80735 - RNA, 64 nt, hsa
cacccacuccagcccucugccccaguuuucuccuccucacuagucuguggcuuuaguaguuccu

SEQ ID NO: 80736 - RNA, 64 nt, hsa
cacccacuacagaccucagccccaguuuucuccuccucacuaggcuguguuuuuaguaguuccu

SEQ ID NO: 80737 - RNA, 64 nt, hsa
uaauauggauucugacucuuaagugcuuccgcccccucacuaccuccuuuaauacaaauucaau

SEQ ID NO: 80738 - RNA, 64 nt, hsa
cacccaacugcuucaggguacuucguagacucugccucacuacaugucgaaagaguuauuugag

SEQ ID NO: 80739 - RNA, 64 nt, hsa
caacaucagcucugugccaccucccaagagggcuccucacuaucuagggagcccugggccaggg

SEQ ID NO: 80740 - RNA, 64 nt, hsa
augggaaauggcccuucauuuaaaaaaagauguaccucacuacccacuacaaauuuggaacuuu

SEQ ID NO: 80741 - RNA, 64 nt, hsa
gaauuucucaguguugguaaguuucuuuaccuacccucacuauauauuauucucguuuuaaaac

SEQ ID NO: 80742 - RNA, 64 nt, hsa
aauaauguggcaauacuuuaaaccaauccucaaaccucacuaaacauaagauaauacugaaaac

SEQ ID NO: 80743 - RNA, 64 nt, hsa
ugcaguaucauacuuguuuauauuacauuguaugccucacuauucauuaaaaaucaagaaaguu

SEQ ID NO: 80744 - RNA, 64 nt, hsa
uggaguucgugccaauccugacaucucgagguuuccucacuagacaacucucuuucgcaggcuc

SEQ ID NO: 80745 - RNA, 64 nt, hsa
aaggacaucagggagccaacaagacuccuaauagccucacuacauucauccagugccuauucug

SEQ ID NO: 80746 - RNA, 64 nt, hsa
gagagugugaacuguguggcaagagagccucacaccucacuaggugcagagagcccaggccuua

SEQ ID NO: 80747 - RNA, 64 nt, hsa
caucuuuucuguaaacuucuuccccuaguuccauccucacuaguaaaaaauaaauacuuuuuaa

SEQ ID NO: 80748 - RNA, 64 nt, hsa
uuccuaucauucacccauuucacugugcaagacaccucacuagucaccagugauacagaaauga

SEQ ID NO: 80749 - RNA, 64 nt, hsa
ggcuacauuuccauggggccagcacugucaugagccucacuaagcuauuuugaagauuuuuaag

SEQ ID NO: 80750 - RNA, 64 nt, hsa
aucucugauaauggagagagagacagaggacccuccucacuacccuauauaaaaaucauuggca

SEQ ID NO: 80751 - RNA, 64 nt, hsa
ugcaguaucauacuuguuuauauuacauugugugccucacuauucauuaaaaaucaagaaaguu

SEQ ID NO: 80752 - RNA, 64 nt, hsa
uguggguguucuuuccugcccuguccaaaagcgcccucacuauucuuggaccaugccagauucu

SEQ ID NO: 80753 - RNA, 64 nt, hsa
uaucugcuacugaauaacucucuaaauauguagaccucacuaauaacuaaccuuuagguaaaaa

SEQ ID NO: 80754 - RNA, 64 nt, hsa
auuuucuccaucauccugauuagcauguuuauucccucacuacccccaggagauauucacugua

SEQ ID NO: 80755 - RNA, 64 nt, hsa
ccuugguaaaggaaccagucagcuggccagauuuccucacuaccugccaugcauacaugcugcg

SEQ ID NO: 80756 - RNA, 64 nt, hsa
ugugcauccgccugaaaguguuuugcccuauauaccucacuagccaugcuuuauguggguuauc

SEQ ID NO: 80757 - RNA, 64 nt, hsa
ugcauuuuuagauuccuuuuaguucuaauugaggccucacuagaugcucuucaguucuguguau

SEQ ID NO: 80758 - RNA, 64 nt, hsa
ugugguuuuuuaaaaaagcaauaauuaacucagaccucacuaaaaaucauuuuuguuuuuauau

SEQ ID NO: 80759 - RNA, 64 nt, hsa
acggggaggccaacccuucucugcagaccgugauccucacuagacagaggagcuccaaaccugc

SEQ ID NO: 80760 - RNA, 64 nt, hsa
ucuuggauggugacauugaaacuacacuaaauccccucacuaugaauggguuguuaaaggcaau

SEQ ID NO: 80761 - RNA, 64 nt, hsa
accaggccuagcacccaaggcccucaaaugaauuccucacuauuaaucuuuguuguuguuguug

SEQ ID NO: 80762 - RNA, 64 nt, hsa
cacugcugcuuauaaauucaucuuuugguugaauccucacuaugcuauuugguaccuaaaaaua

SEQ ID NO: 80763 - RNA, 64 nt, hsa
aguuaugaagguggguuagaaacuagugccuaucccucacuaaguugccagauggauuuaacag

SEQ ID NO: 80764 - RNA, 64 nt, hsa
uaagaaaauuuuccuuuucuaaccuauuaaaauaccucacuaucauuucaaaagguuaaaugag

SEQ ID NO: 80765 - RNA, 64 nt, hsa
ugugaccuucacauagauggaucauggcugacuuccucacuauccucuucacauguaacuucug

SEQ ID NO: 80766 - RNA, 64 nt, hsa
gugacagcagaccuggcuguguugccccucuccuccucacuauucucaccaggccaugggacuu

SEQ ID NO: 80767 - RNA, 64 nt, hsa
uuucucacggcgugucaccccaccagggcgcaagccucacuauuacuugaacuuuccaaaaccu

SEQ ID NO: 80768 - RNA, 64 nt, hsa
uccgauugucccuuggggguuaccccucagcccaccucacuauggugcuggguagaggggauac

SEQ ID NO: 80769 - RNA, 64 nt, hsa
ucacuuacugugcggguuugacucagucccuuccccucacuaggucccaguuucuccauuugua

SEQ ID NO: 80770 - RNA, 64 nt, hsa
ugcaaguaagcaucuuacaacuggcucuuccuccccucacuaagaagacccaaaccucugcaua

SEQ ID NO: 80771 - RNA, 64 nt, hsa
gggcuugggcccugcacagauauuuccauuucuuccucacuaugacacugagcaagaucuuguc

SEQ ID NO: 80772 - RNA, 64 nt, hsa
ucguugagccccaaaccacugcucaggguccauuccucacuauaagaugaagccauaucugccu

SEQ ID NO: 80773 - RNA, 64 nt, hsa
cuuggauucuagguggacauuacagaguugaauuccucacuacccccucccgcugucauuuguu

SEQ ID NO: 80774 - RNA, 64 nt, hsa
uugugagggaauauccauucccucacucuacucuccucacuaucggaaauucauuuugauucag

SEQ ID NO: 80775 - RNA, 59 nt, hsa
uccccauggugauagccugaaagagcuuuccucacuagaaaccaaaugguguaaauauu

SEQ ID NO: 80776 - RNA, 64 nt, hsa
aguaaaggucuuucagaaccacuaaggucccagcccucacuaggaugucaggagccaggucuag

SEQ ID NO: 80777 - RNA, 64 nt, hsa
agcugaagcaaagaaggaaaaguaauaccuuuaaccucacuagcuucaagaguagacauucuua

SEQ ID NO: 80778 - RNA, 64 nt, hsa
ugugaacugcuuucaagucugacucuccacuccuccucacuaaaaaggaaacuucaguugaucu

SEQ ID NO: 80779 - RNA, 64 nt, hsa
ucaggaagcagccuuagcacacgggccucuccucccucacuacugggugcugcccugcguggcu

SEQ ID NO: 80780 - RNA, 64 nt, hsa
aaacaucagucccgaggaggggacaacaauacuaccucacuacuacaucugugaugacugguug

SEQ ID NO: 80781 - RNA, 64 nt, hsa
ucucccccuacgcucugccaggaauucuuucagaccucacuagcacaagcccgguugcuccuug

SEQ ID NO: 80782 - RNA, 64 nt, hsa
cccaaacccccaauagcuagugacagccacuuggccucacuaccagaagaaggguggagucaga

SEQ ID NO: 80783 - RNA, 64 nt, hsa
ccccaccauuucccaaggaguuuugcuuuguagcccucacuacuggccaccugaccucacaccu

SEQ ID NO: 80784 - RNA, 64 nt, hsa
cccagccaguccugagccucccgccaaaucccagccucacuaggugggacccccuucccagugu

SEQ ID NO: 80785 - RNA, 64 nt, hsa
uucgagaucucucacggguuuuuaauggucuuguccucacuaacccggagcggugaguuugauu

SEQ ID NO: 80786 - RNA, 64 nt, hsa
ggacuaaugcaugugguaugaguagguuuggcccccucacuaucucuagagugagaaucuggcu

SEQ ID NO: 80787 - RNA, 64 nt, hsa
aaccaaaaugggaacauuaaacaaacaucacagcccucacuaauaacauugcugucaaguguag

SEQ ID NO: 80788 - RNA, 64 nt, hsa
uccucgagggaccaaaucuccaacuuuuuuuuccccucacuagcaccuggaaugaugcuuugua

SEQ ID NO: 80789 - RNA, 64 nt, hsa
cccuuuccccaucauggggcagaugcccaccagcccucacuaucuacugcuugaccauccucug

SEQ ID NO: 80790 - RNA, 64 nt, hsa
ggggcuuaugagucucaccggucaacccaggaggccucacuacaagagccuugacaaggcacug

SEQ ID NO: 80791 - RNA, 64 nt, hsa
ucucuguaaucgcacauuuaaaacauaacuguagccucacuaauggaaaaguaguaugaugaac

SEQ ID NO: 80792 - RNA, 64 nt, hsa
aggggaguuccgcgcuggggucugggcugugcucccucacuaaagggaaggaaaggaagcuggg

SEQ ID NO: 80793 - RNA, 64 nt, hsa
gggccucaguucaaccugguggcaccagaugcaaccucacuaugguaugcuggccagcacccuc

SEQ ID NO: 80794 - RNA, 64 nt, hsa
cuaugaaacagcaugcuaaaugugaaaugucaacccucacuaaacuuugccgguucagagcauc

SEQ ID NO: 80795 - RNA, 64 nt, hsa
auguccaugaauucuucuuuucucagcacguguuccucacuagaagaaaaugcuguuaccuuua

SEQ ID NO: 80796 - RNA, 64 nt, hsa
ucagaucuaaucaauuaguccauguacccuccuuccucacuacagucauaacacaugagcauau

SEQ ID NO: 80797 - RNA, 64 nt, hsa
ugcauugagcaggcccaccugcuucccagaaccuccucacuagggcugagcaccuucucugagu

SEQ ID NO: 80798 - RNA, 64 nt, hsa
guuuggaggggaggaugagugccugucacugaggccucacuaugguuggcgucugaagcugggc

SEQ ID NO: 80799 - RNA, 64 nt, hsa
ccagaagcguccugugacucugggagaggugacaccucacuaaggggccgaccccauggaguaa

SEQ ID NO: 80800 - RNA, 64 nt, hsa
aacagaaggcucgcacucuugucuucuggucacaccucacuauguccccucagcuccuaucucu

SEQ ID NO: 80801 - RNA, 64 nt, hsa
uuaaaaaauuaaucugggccagaauuucaaacggccucacuaggcuucugguugaugccuguga

SEQ ID NO: 80802 - RNA, 64 nt, hsa
cauccagcccucucagcguggggcuguggcugguccucacuauuccccagucucccgcuguggg

SEQ ID NO: 80803 - RNA, 64 nt, hsa
gucuacauguauuuauauucuugauauuuucuacccucacuagaauguaaacuccaugaaggca

SEQ ID NO: 80804 - RNA, 64 nt, hsa
guauagugaccaauagaugccaaacagcuuguggccucacuaaagguggggucgcuuagucccc

SEQ ID NO: 80805 - RNA, 64 nt, hsa
uucucuguggacugggcaaggugggguauuuauuccucacuagcuggguuaccaucuucaggca

SEQ ID NO: 80806 - RNA, 64 nt, hsa
guagcucucugcuaaaauggcaucucacuaaugaccucacuaucugacuuccauuguguuuuau

SEQ ID NO: 80807 - RNA, 64 nt, hsa
uuugcaauguuuuuuauaaaaaugcaauuaaauaccucacuauuaaacugccaugaugccucag

SEQ ID NO: 80808 - RNA, 64 nt, hsa
acaggaccccaaaugccucuucccucuggucaugccucacuaucucuaggagcuccauccugug

SEQ ID NO: 80809 - RNA, 64 nt, hsa
accaugcuuggcuaauuuuuuugcagaaacgaggccucacuauauuguccaggcugaguggcuc

SEQ ID NO: 80810 - RNA, 64 nt, hsa
cuuaucuuacaacucccccaccgcccacucuccaccucacuagcuccccaaucccugacccuuu

SEQ ID NO: 80811 - RNA, 64 nt, hsa
uucuggaggcaguugggagcuauccuuguuuaugccucacuauuggcagaaaagaccccauuua

SEQ ID NO: 80812 - RNA, 64 nt, hsa
ugccuuguauucuaguuauuuguguauuugucucccucacuagauuauacgcuccuugugggca

SEQ ID NO: 80813 - RNA, 64 nt, hsa
cagcuaauauuuuuuuauuuucguggagacggggccucacuauguugccuaggcuggaaauagg

SEQ ID NO: 80814 - RNA, 64 nt, hsa
uccagaagacauuuccaacaguuugccagugguuccucacuacacugguacugaaaguguaauu

SEQ ID NO: 80815 - RNA, 64 nt, hsa
aaaugcccauguccacagcuuguacacacugcccccucacuaucuuguuauccaguggcaugcc

SEQ ID NO: 80816 - RNA, 64 nt, hsa
uccccuguggugaguaccguggaaccccagcccaccucacuaucauacucagcuuccccugaug

SEQ ID NO: 80817 - RNA, 64 nt, hsa
ucugcuugcucuuguccuagcuugggaggcuuccccucacuauccuaccccacccgcuccuuga

SEQ ID NO: 80818 - RNA, 64 nt, hsa
ugcacccccaccaaccuuacccucaccggggaacccucacuagcaggacuggugguggagucuc

SEQ ID NO: 80819 - RNA, 64 nt, hsa
aggagaagguggaaaugggugaagagagaaguccccucacuagcugcaugagaaaucuaucuua

SEQ ID NO: 80820 - RNA, 64 nt, hsa
cccgcccgcacagcucccggcgggugcucugaggccucacuacucgagcccacccagcaucccg

SEQ ID NO: 80821 - RNA, 64 nt, hsa
caugaugccuuaacauguggaguguaccguggggccucacuagccucuaacucccugugucugc

SEQ ID NO: 80822 - RNA, 64 nt, hsa
uuuccugucuucucuuuaguaugaucccucaaaaccucacuaacuggaaggaugauuuugucuc

SEQ ID NO: 80823 - RNA, 64 nt, hsa
uggugaacaaugacgaauugaggcagggaauagaccucacuagcccuuugcaauggagaucauc

SEQ ID NO: 80824 - RNA, 64 nt, hsa
ugaagucugcaaggagguugcuggcuugggcugaccucacuaaugccaucagcagcgguaggua

SEQ ID NO: 80825 - RNA, 64 nt, hsa
uccugacaccaccagaauaaacuugccgaguuuaccucacuagggccggacccguggcuccuua

SEQ ID NO: 80826 - RNA, 64 nt, hsa
aaacaggagaugcuggauuucaaucccagcagggccucacuaguugagguauugaauuugaaca

SEQ ID NO: 80827 - RNA, 64 nt, hsa
aguuugagaccagccugggcaauauagcaagaccccucacuacaaaaauaaaacaucaaaaaca

SEQ ID NO: 80828 - RNA, 64 nt, hsa
gaucuuuaaugggcccaaggccaacaggcauaugccucacuacugccuggagaagggagagauu

SEQ ID NO: 80829 - RNA, 64 nt, hsa
ugcccauccgucugucugucgcccuucucccggcccucacuaagccccggcacuucuagugguc

SEQ ID NO: 80830 - RNA, 64 nt, hsa
ucccugcccagcuguaaggaccgggggucucccuccucacuaccgccagacaccccgguggaag

SEQ ID NO: 80831 - RNA, 64 nt, hsa
gaauccccucauuacaagauccaaucauaucaugccucacuacccucuguauauaaaaucugcc

SEQ ID NO: 80832 - RNA, 64 nt, hsa
ccccgccccuccggccuccccacaccccccuugcccucacuaccuguaucucaccggcgugugu

SEQ ID NO: 80833 - RNA, 64 nt, hsa
cugacauucauuuucauuguuuuacuuuugucuuccucacuaguguaaacaaaaauuucaacca

SEQ ID NO: 80834 - RNA, 64 nt, hsa
guaacgaagacacagacugcgauuugucccagguccucacuaccgggcgcaggagggugagcgu

SEQ ID NO: 80835 - RNA, 64 nt, hsa
uguacuuuuguaaugacugugaaauacacuuuucccucacuacgacugcuucuuuauuugcuga

SEQ ID NO: 80836 - RNA, 64 nt, hsa
caucguuuuaugaaaagguaccgcugugugcauuccucacuagaacucauccgacccccgaccc

SEQ ID NO: 80837 - RNA, 64 nt, hsa
aaagugagauuuuacuaagaccuguuuuacuuuaccucacuaacaauggggggagaaaggagua

SEQ ID NO: 80838 - RNA, 64 nt, hsa
uguuggccugugggccgcccacaacauauccuucccucacuaccugugugaccaagguuggcuu

SEQ ID NO: 80839 - RNA, 64 nt, hsa
gccccacaacaaggccagggaugguggggacaggccucacuagucuugaggcccagccuaggau

SEQ ID NO: 80840 - RNA, 64 nt, hsa; identical to SEQ ID NO: 80839

SEQ ID NO: 80841 - RNA, 64 nt, hsa
gcgguuagagccuggaagaaggagggaaguggcaccucacuagcauuuaucacuuuuuuccuuc

SEQ ID NO: 80842 - RNA, 64 nt, hsa
acucaccaggccgugcucccaucgccuggggccuccucacuaggggccccaaguucaacucaac

SEQ ID NO: 80843 - RNA, 64 nt, hsa
guuuuuauuuaucucuuuggcccagccaagcugcccucacuacagagaccuuggacaaggaucc

SEQ ID NO: 80844 - RNA, 64 nt, hsa
aaaaacacaaaaaaagaaagaauacuuuuuuauaccucacuauguucuuugaauauguauuuuu

SEQ ID NO: 80845 - RNA, 64 nt, hsa
ucaggccucuuguccucuccccaguggcuccaggccucacuaguggcaagggcaggaugaggcu

SEQ ID NO: 80846 - RNA, 64 nt, hsa
aguguguuuucuucuguguaaaguacaugagcugccucacuaagcauucccaacucauugaaug

SEQ ID NO: 80847 - RNA, 64 nt, hsa
guccacccuugacugcucuuggcuuggucucuacccucacuaccucaguucucaauaacuuagu

SEQ ID NO: 80848 - RNA, 64 nt, hsa
uuuucauuuucauuauuucaaggaauagaguuuuccucacuaccacuuguaauuagagauugac

SEQ ID NO: 80849 - RNA, 64 nt, hsa
ugugaccuucacauagauggaucauggcugacuuccucacuaaccucuucacguguaacuucug

SEQ ID NO: 80850 - RNA, 64 nt, hsa
aacugccuaaaaaugucuuguuuguuuuaugagcccucacuagaaggcugaguuugacauguug

SEQ ID NO: 80851 - RNA, 64 nt, hsa
auucaucaaaaauaagccauagacaugaacaacaccucacuaccccauugaagacgcaucaccu

SEQ ID NO: 80852 - RNA, 64 nt, hsa
gacaacuucuauaauuaaauccaugagaauuuuuccucacuagagaauuuaaaggugcaccugu

SEQ ID NO: 80853 - RNA, 64 nt, hsa
cuaauaaaaugaaacuagggcugagcuaguuagcccucacuagccaaacugaaacucuaugcaa

SEQ ID NO: 80854 - RNA, 64 nt, hsa
ugugugaccuuacuucaccucuuagccuuguucuccucacuagcaguaggaaaguaacaccuac

SEQ ID NO: 80855 - RNA, 64 nt, hsa
cuagucaaacauggagaaaccaaauuggacaaauccucacuaccaauggcgaugauuacaauaa

SEQ ID NO: 80856 - RNA, 64 nt, hsa
aauauuagaauggccgaccauggcagugaccaggccucacuacaggccugguuggauucugguc

SEQ ID NO: 80857 - RNA, 64 nt, hsa
cuugaagggguauaccuuacccugguaaccuuacucaaaagaagggucagugugugcuggggga

SEQ ID NO: 80858 - RNA, 64 nt, hsa
acuuaaggaaggaucagcaucacggaaggucuugucaaaagagugcugggcaccacucccagca

SEQ ID NO: 80859 - RNA, 64 nt, hsa
uuacaacuguuaaaaaaccucaaaauaguucucuucaaaagaagagagauuccaagcaacccau

SEQ ID NO: 80860 - RNA, 64 nt, hsa
agauuuauaaucaugauacucuucggugguaguuucaaaagacacuacuaauacgcaggaagcg

SEQ ID NO: 80861 - RNA, 64 nt, hsa
uuuaucaggcagauguacaggauaaugguauaaaucaaaagagagaugggaugguaucuaaaaa

SEQ ID NO: 80862 - RNA, 64 nt, hsa
uuuuuccagaguuucacaggcauuuuuggauccuucaaaagaagagguauauaacaguucuuuu

SEQ ID NO: 80863 - RNA, 64 nt, hsa
caaaaagugggugaaggacaugaacagacacuucucaaaagaagacauuuaugcagccaaaaaa

SEQ ID NO: 80864 - RNA, 64 nt, hsa
agggaaacuguaaauauauuuugcaaauuguuguucaaaagauaauuggaaaaaauugaauaua

SEQ ID NO: 80865 - RNA, 64 nt, hsa
auuugucuaauaaaacagaggcaagauaauuuaaucaaaagaaauuaagaaaauuuuccaaaaa

SEQ ID NO: 80866 - RNA, 64 nt, hsa
uuuuuauuguugaauguacaucuaccccagccccucaaaagaaaaacuguuuacauagaaauuc

SEQ ID NO: 80867 - RNA, 64 nt, hsa
uuuguuuuguaccuuaaauuguucgauuacgucaucaaaagagaugaaagguauguagaacagg

SEQ ID NO: 80868 - RNA, 64 nt, hsa
acuuuaucauacaggaaacuuaaaacaagaggugucaaaagacccaaauuaggugcauuuuacu

SEQ ID NO: 80869 - RNA, 64 nt, hsa
gugauagaaacagcuuuuugaaguaaugaaaaccucaaaagaucauguugauucuuaauuuuug

SEQ ID NO: 80870 - RNA, 64 nt, hsa
gugaaauaguuuuuauugaaagucaagugacauuucaaaagaaguucuauaacaauuauguuuc

SEQ ID NO: 80871 - RNA, 64 nt, hsa
uuuuugccacaucugcaaugauuauuguuuaauuucaaaagaauccucaggcucuacaaucuag

SEQ ID NO: 80872 - RNA, 64 nt, hsa
uuauuuugcuucuauuuauagccucugucaaaagucaaaagacuauaaaugcuuugcaaaaaug

SEQ ID NO: 80873 - RNA, 64 nt, hsa
ggagaagguugacuuuuugcacuucuguauauagucaaaagagagaaaccuguauaauaguaag

SEQ ID NO: 80874 - RNA, 64 nt, hsa
cacuuuuaauguuuucucucucacacacaaagauucaaaagaaaugugcauauauuuauucugu

SEQ ID NO: 80875 - RNA, 64 nt, hsa
agagagaagaaaauauauuagugcuuuuuuuuuuucaaaagaaaaggaaaauaaaagaaauaua

SEQ ID NO: 80876 - RNA, 64 nt, hsa
uugcucuugcuuguaaauccuaaucuuagaguuaucaaaagaagaaaaaacugaagguacuuua

SEQ ID NO: 80877 - RNA, 64 nt, hsa
cuucuccaugaugugacuuccggagauaaaggauucaaaagauaaagacaaaguacgcucagag

SEQ ID NO: 80878 - RNA, 64 nt, hsa
agaaaagagaugacuaagucaagugucugccuuaucaaaagagcaaaaaugccucugguuuugu

SEQ ID NO: 80879 - RNA, 64 nt, hsa
uucccugucucucuuccccaggcaauuacuggccucaaaagaggaacagaggugcugcgaggug

SEQ ID NO: 80880 - RNA, 64 nt, hsa
uguagcuuuagaaguggcccucuauagaaagaagucaaaagaugaggccccuucuagaaucuag

SEQ ID NO: 80881 - RNA, 64 nt, hsa
gcauacuguaauguuuuaugaacugaaauuuuaaucaaaagaggucauuuuagaauaacaagua

SEQ ID NO: 80882 - RNA, 64 nt, hsa
guaaauuuaacuccaaguuucuccaugggcaaagucaaaagauaaugcuagguuaugucaauuu

SEQ ID NO: 80883 - RNA, 59 nt, hsa
cccauauguuaagaaaaugagcuuuguagucaaaagacucaucuaauuugagcugagug

SEQ ID NO: 80884 - RNA, 64 nt, hsa
ugacuucugcacuaauccagugaaggaggcugugucaaaagaagggcucagaagcccucuuuuc

SEQ ID NO: 80885 - RNA, 64 nt, hsa
aaagaaacuucagaaagcuagaauugcuuaucaaucaaaagacuuucucaaucuauuuuggcca

SEQ ID NO: 80886 - RNA, 64 nt, hsa
ucaauggugccuugaaaucuaugaccucaacuuuucaaaagacuuuuuucaauguuauuuuagc

SEQ ID NO: 80887 - RNA, 64 nt, hsa
guaaagcuuuuuuuugcauguaaguuauugcauuucaaaagacccccccuuuuuuuacagagga

SEQ ID NO: 80888 - RNA, 64 nt, hsa
uuuaauuuugauccugcccucuccagcugcuccuucaaaagauacaucaaaagauagaaacucu

SEQ ID NO: 80889 - RNA, 64 nt, hsa
ccugcccucuccagcugcuccuucaaaagauacaucaaaagauagaaacucugggcugggcaca

SEQ ID NO: 80890 - RNA, 64 nt, hsa
uaacaauaugaagggcucuuaugagucauuuuuuucaaaagaugaaaacuccagaaacgcacag

SEQ ID NO: 80891 - RNA, 64 nt, hsa
uuuucuugaauagauaucacaagguugcuuauuaucaaaagaauaauuaaaaucauguaaccau

SEQ ID NO: 80892 - RNA, 64 nt, hsa
aucuuaaucuauauucuacccuuauaauaaaagaucaaaagauauaucuccuaugaacagauug

SEQ ID NO: 80893 - RNA, 64 nt, hsa
gaaaagaaaaacacgucucaccacugugguugauucaaaagaaagugauucuauuuuuuaaaga

SEQ ID NO: 80894 - RNA, 64 nt, hsa
gaacacuuggaggcaauuaaugaguauaucuuagucaaaagaauuguuggagcuuuuuauuaaa

SEQ ID NO: 80895 - RNA, 64 nt, hsa
uuuuucuaccugguaaacauucucuauucuuuucucaaaagauugcuguaagaaaaaauguaag

SEQ ID NO: 80896 - RNA, 64 nt, hsa
ggacuuuccagugaugccacugagauggcaccugucaaaagagcagugguuccauuucuagauu

SEQ ID NO: 80897 - RNA, 64 nt, hsa
aauguucuuacguuuuccauugguugaaaaauaaucaaaagaacauuuugugacgugaaaauuu

SEQ ID NO: 80898 - RNA, 64 nt, hsa
ucauguguguaaauaauucauuucugggcuaauuucaaaagaaucccaauauugcuguauagaa

SEQ ID NO: 80899 - RNA, 64 nt, hsa
uuucaauucacuugaaugagaaacguguuuaguaucaaaagagcccaagaagacacugguguga

SEQ ID NO: 80900 - RNA, 64 nt, hsa
cugaggauuuuaucaagaaagcagauuuggcaguucaaaagacuccugaaaugauaaaucaggg

SEQ ID NO: 80901 - RNA, 64 nt, hsa
ugagaacucugaggacaaagcagcggauacaaccucaaaagacgucugucuacauugaauuggg

SEQ ID NO: 80902 - RNA, 64 nt, hsa
gucucugauaaaacagaauuuaaaccaacaaagaucaaaagagacaaggccauuauauaauggu

SEQ ID NO: 80903 - RNA, 64 nt, hsa
caaaaagucggcaaaggacaugaacagacacuucucaaaagaagacauuuaugcagccaaaaaa

SEQ ID NO: 80904 - RNA, 64 nt, hsa
gauuuaccagggauguagauuaaggugaugugauucaaaagaugccauucauagagagcccuag

SEQ ID NO: 80905 - RNA, 64 nt, hsa
guugcucccugugacaaaauuuuauaagcaaauuucaaaagacauguuguaaauuaggaggcuc

SEQ ID NO: 80906 - RNA, 64 nt, hsa
agaauucuguuugccuaacucccaaacuguuggggugguacauuccuuuaggaccaauuaaaac

SEQ ID NO: 80907 - RNA, 64 nt, hsa
uaaaaagaagcaaaucauuugcacucuauaauuugugguacaguauugcuuauugugacuuugg

SEQ ID NO: 80908 - RNA, 60 nt, hsa
aauugcuuauguuuauucccugucagcggaguggagaaugucauucaucaauaaaccaaa

SEQ ID NO: 80909 - RNA, 60 nt, hsa
uaaagaucuggcaacuuuucaggauuauuuguggagaacucuaagguuaagaucaggaaa

SEQ ID NO: 80910 - RNA, 60 nt, hsa
uugcggaccgugguacccaguuuuaggaauguggagaaaggaauucuguugauuccguug

SEQ ID NO: 80911 - RNA, 60 nt, hsa
uacagguagguuggucuuugaaguccacuaguggagaaugucaagacaagauacuuauua

SEQ ID NO: 80912 - RNA, 60 nt, hsa
aaauucauacuggggagaaaccccacaaauguggagaaugcggaaaagccuuuaacuggu

SEQ ID NO: 80913 - RNA, 60 nt, hsa
caacucuuauuacacauaagauaauucacaguggagaaaaacccuacaaaugugaagaau

SEQ ID NO: 80914 - RNA, 60 nt, hsa
uucaaucugucaaauuuguuuuauucucaaguggagaacuucucccacauaauauauaua

SEQ ID NO: 80915 - RNA, 60 nt, hsa
ggacaacuuaucuucacuaagcugaaucagguggagaaaguaaucuccuugcaaucaugu

SEQ ID NO: 80916 - RNA, 60 nt, hsa
uagcagcaacugaagacaauuaucaaccacguggagaaaaucaaaccgagcagggcugug

SEQ ID NO: 80917 - RNA, 60 nt, hsa
gagucucccucugauugguuuuggggaaauguggagaagagugcccugcuuugcaaacau

SEQ ID NO: 80918 - RNA, 60 nt, hsa
ucacuuucucuucuugcguguggggcagguguggagaagggcuuuaaggaggccaauuug

SEQ ID NO: 80919 - RNA, 60 nt, hsa
uuaagccaugggugggucuaacuggcuuuuguggagaaauuagcacaccccaacuuuaau

SEQ ID NO: 80920 - RNA, 60 nt, hsa
aucaggaaggcauuuucaaucauucaaaauguggagaauuuaauggcuaaaucuuuaaaa

SEQ ID NO: 80921 - RNA, 60 nt, hsa
gccguaccccacccucagcaccccuuccauguggagaaaggagugaaaccuuuagggcag

SEQ ID NO: 80922 - RNA, 60 nt, hsa
ggcacugagcccccccaacacugugcccugguggagaaagcacugaccugucaugccccc

SEQ ID NO: 80923 - RNA, 60 nt, hsa
cauuaggcagauaggccacaggaagaagguguggagaacccaccugaaccagauugagac

SEQ ID NO: 80924 - RNA, 60 nt, hsa
uggauuccagaauguuucaugguaagcacuguggagaaccuacaugucagguucuggagu

SEQ ID NO: 80925 - RNA, 60 nt, hsa
ucuuuuuuuagggagaagggcuuuucuuuaguggagaaauggaacucgccccccuacccc

SEQ ID NO: 80926 - RNA, 60 nt, hsa
aagccuuccuccauggcccaucacucggcuguggagaacaaagaccaaugugaagacacu

SEQ ID NO: 80927 - RNA, 60 nt, hsa
aaauuccuguguugugugccaagguauaaaguggagaaguuagaugagugcaaggagcuc

SEQ ID NO: 80928 - RNA, 60 nt, hsa
agcagccaacacguuuagcagacacugcgcguggagaagggcuuaucugcaguacacucu

SEQ ID NO: 80929 - RNA, 60 nt, hsa
uccuggaguagguccacgugaaaacaaugaguggagaagucgucacgggucuuucauccc

SEQ ID NO: 80930 - RNA, 60 nt, hsa
gcuucggugaaaguaaagacaguagucauuguggagaaacaucuagccagauuggagaua

SEQ ID NO: 80931 - RNA, 60 nt, hsa
gcagggguacuuccgccuugccguuagcuuguggagaacgugcuucuuauuccuggcagg

SEQ ID NO: 80932 - RNA, 60 nt, hsa
cgaagccuuagagggugacauagcuagaaaguggagaagcucacuguucacugugcaaag

SEQ ID NO: 80933 - RNA, 64 nt, hsa
cacacacacacacacacacacacauacacagacaaaaacacaaaaacucugaggggaucuggug

SEQ ID NO: 80934 - RNA, 64 nt, hsa
aggauuaaaacuaaccgugaccacuacuccaaacaaaacacaauaugccuaggggcacggauga

SEQ ID NO: 80935 - RNA, 64 nt, hsa
ucuauuuucucuacggcuuaggcuaugugagggcaaaacacaaaucccuuugcuaaaaagaacc

SEQ ID NO: 80936 - RNA, 64 nt, hsa
cagugaaauuaucuugagucuacacauuauuuuuaaaacacaaaaauuguucggcuggaacuga

SEQ ID NO: 80937 - RNA, 64 nt, hsa
cauuacuguagugcugagguuauugaaguuauacaaaacacaucucagucucuguuucuuggaa

SEQ ID NO: 80938 - RNA, 64 nt, hsa
guugaauauugaacucuaacaguuuucuacauacaaaacacagugucaugaagguuauucauaa

SEQ ID NO: 80939 - RNA, 64 nt, hsa
ccuguuguuagagaaccuaucuuuguuuuuggucaaaacacacauagaaaacaaaaugauccaa

SEQ ID NO: 80940 - RNA, 64 nt, hsa
uuaauauguuuaauucaccuaucacacucuguuaaaaacacauagaaucaucaauaaaaacuca

SEQ ID NO: 80941 - RNA, 64 nt, hsa
uccagcaacauacuauagaaaacaccugcuacucaaaacacaacuucucagugucauccauugc

SEQ ID NO: 80942 - RNA, 64 nt, hsa
auggauuccuauaaugggagcaucaccacuuauuaaaacacacauagaaugaugaauuaaaaaa

SEQ ID NO: 80943 - RNA, 64 nt, hsa
uaauuaaaaaagaaaaauucauauaaucguguuuaaaacacaaaugaagucaguauuugccuuu

SEQ ID NO: 80944 - RNA, 64 nt, hsa
uccauuuguugacauguagacuguuuacaaaaaaaaaacacaugguuaaauguuaaauuuuaau

SEQ ID NO: 80945 - RNA, 64 nt, hsa
cacugggcauggaccccucaaagcaggcacacccaaaacacaagucuguggcuagaaccugaug

SEQ ID NO: 80946 - RNA, 64 nt, hsa
ggugccugugcuauaaaugaguuucuucacaugaaaaacacagccagcccaagaugacuuaucu

SEQ ID NO: 80947 - RNA, 64 nt, hsa
gaauuacacaacguuuuccucaagaaaaugguacaaaacacaaccgaggagcguauacaguuga

SEQ ID NO: 80948 - RNA, 64 nt, hsa
uguuugauauuucuuaaugucugcucugagccuuaaaacacagauugaagaagaaaagaaagaa

SEQ ID NO: 80949 - RNA, 64 nt, hsa
gauuaguauuuuccacgucacuguuuauuuuuuuaaaacacaaauucuaaagcuacaacaaaua

SEQ ID NO: 80950 - RNA, 64 nt, hsa
ccugagacuuucagugcacuguauauagaagucuaaaacacaccuaagagaaaaagaucgaauu

SEQ ID NO: 80951 - RNA, 64 nt, hsa
cuuucauuuuucucuuccugggauucauuuuuucaaaacacaaugcuggaaaaaaaagauuugu

SEQ ID NO: 80952 - RNA, 64 nt, hsa
uagaauuccugcacaugaucaaacagauccuccuaaaacacaccuuuugaaauguugaacauaa

SEQ ID NO: 80953 - RNA, 64 nt, hsa
auuuuaguccuauuuguauuauuuuaugcauuuaaaaacacaguccugagagggauggaccaga

SEQ ID NO: 80954 - RNA, 64 nt, hsa
uuucagcccuauuuguauuauuuugugcauuuaaaaaacacaaucuuaaggggauagacuagac

SEQ ID NO: 80955 - RNA, 63 nt, hsa
uaauugcaucuucauuaggaaaaauaaaaagcauaaaacacaauuucugguuacuaugaauaa

SEQ ID NO: 80956 - RNA, 64 nt, hsa
aacuuucuaaaacuaaaagagucuuuuuauuuuuaaaacacaaguagaaugauuuaaauaggau

SEQ ID NO: 80957 - RNA, 64 nt, hsa
aucguaaaacugacaaaauauuuuaaaaauauauaaaacacaaaauuaaaauaaaguugcuggu

SEQ ID NO: 80958 - RNA, 64 nt, hsa
gcaaagcuuauuuucuuuuaucugggcaaaaauuaaaacacauuccuuggaacagagcuauuac

SEQ ID NO: 80959 - RNA, 64 nt, hsa
gaacaguagugaccccuggcagcaauucauuaccaaaacacagacaaaccaaagguaaccagcu

SEQ ID NO: 80960 - RNA, 64 nt, hsa
uuggccugugauggaaaggaaggcuucuaauuagaaaacacagcaacagaagaccuauaccccg

SEQ ID NO: 80961 - RNA, 64 nt, hsa
uguucuucacaagugcuuugugccccuuuaauuaaaaacacaugaaaugaauaacaaaacaaga

SEQ ID NO: 80962 - RNA, 64 nt, hsa
uuacugcaccucuuguuagacucugugcauuaauaaaacacaccuagagucuguugucauuuca

SEQ ID NO: 80963 - RNA, 64 nt, hsa
gugacuaugcuuaaguguuuaauuuaguuugcuuaaaacacacacaccacacacacacacacac

SEQ ID NO: 80964 - RNA, 64 nt, hsa
cccugcacccuucugacugacaguucauccccacaaaacacauugguuuugagaggugaugcaa

SEQ ID NO: 80965 - RNA, 64 nt, hsa
uugacuggauccacuaaaccaacacuaagaugggaaaacacacaugguuuggagcaauaggaac

SEQ ID NO: 80966 - RNA, 64 nt, hsa
uaauaucacuauuuacaacucauguggacucagaaaaacacacaccaccuuuuggcuuacuucg

SEQ ID NO: 80967 - RNA, 64 nt, hsa
aacuuccauaagauacugcuaaugcaccaguauuaaaacacaucgacguaaguagcucauuuag

SEQ ID NO: 80968 - RNA, 64 nt, hsa
cagccugggcgacagagcaggacucucucucaaaaaaacacaaaaaaacaaaaacaaaaaacca

SEQ ID NO: 80969 - RNA, 64 nt, hsa
gccugaccaacauggagaaaccccaucucuacuaaaaacacaaauuagccaggcguggugguac

SEQ ID NO: 80970 - RNA, 64 nt, hsa
auauggucauccucuaaugaguguaaaagugcgcaaaacacauccuuauuguuccugaucucuu

SEQ ID NO: 80971 - RNA, 64 nt, hsa
ucuaucagcugacuuuucaggguauccuuaaaaaaaaacacacacgaaaaacaaaaguuugcuu

SEQ ID NO: 80972 - RNA, 64 nt, hsa
gguugauccugcuguguugaaggcugugguuaauaaaacacaaguaugauaaacaggaccuagc

SEQ ID NO: 80973 - RNA, 64 nt, hsa
guaggacucuguaaucuuuugauuaguuucugagaaaacacaaugaagcacuucacuuuuuuuu

SEQ ID NO: 80974 - RNA, 64 nt, hsa
gcacuucacuuuuuuuuauucaaagccauuuaauaaaacacaguuggucagcccagugcaaagc

SEQ ID NO: 80975 - RNA, 64 nt, hsa
cggcgauuuucgggcugagaaggcaguaguuuucaaaacacauaguuaaaaaagaaacaaauga

SEQ ID NO: 80976 - RNA, 64 nt, hsa
gugacaaaccauuuccaacagcaacacagccacuaaaacacaaaaagggggauugggcggaaag

SEQ ID NO: 80977 - RNA, 64 nt, hsa
uuuucaaaaaaaaaaaaaaaacaaaaacaaaaaaaaaacacaaaagcugcaugucuaaaauuac

SEQ ID NO: 80978 - RNA, 64 nt, hsa
aacauaucuuucaugacuauuuugacaaaaguuuaaaacacauaugaaguucaaauuucaggaa

SEQ ID NO: 80979 - RNA, 64 nt, hsa
ggccauuuuauucaaaugcuugcuauacaaucugaaaacacacuggcaggugcuccucuccuug

SEQ ID NO: 80980 - RNA, 64 nt, hsa
uucagaauauuugcaauaagagucuggauuuuaaaaaacacaugcauacacacaauuaagagcu

SEQ ID NO: 80981 - RNA, 64 nt, hsa
uuuaaggaaucauaaucauuuguauuuauacuuaaaaacacacaauguuaaaaaaaauaaagca

SEQ ID NO: 80982 - RNA, 64 nt, hsa
uguagcaaaagaguauuuauacaucccaccaaucaaaacacagcuuuauuaccucaugcgaacu

SEQ ID NO: 80983 - RNA, 64 nt, hsa
guuuccauucccaaauauguagcugugguucuugaaaacacauccuacauugcauaugggcaua

SEQ ID NO: 80984 - RNA, 64 nt, hsa
uugguccauuuuacacuuuuuuaaaggggauuaaaaaacacagccucucccccaaagggugucc

SEQ ID NO: 80985 - RNA, 64 nt, hsa
gccucuguucuuucaacuccuuugaggcucaaaaaaaacacaaagaucagaagccuucagauag

SEQ ID NO: 80986 - RNA, 64 nt, hsa
aacaguucaauaaugaggaaacaggugagcccugaaaacacaaaaggacaguucuguguugaaa

SEQ ID NO: 80987 - RNA, 64 nt, hsa
aaaaaaucaaaaggcacugugaacuauuuugaagaaaacacaacauuuuaauacagauugaaag

SEQ ID NO: 80988 - RNA, 64 nt, hsa
aacagggaaaacagcuagcuugaaaacuugcugaaaaacacaacuuguguuuauggcauuuagu

SEQ ID NO: 80989 - RNA, 64 nt, hsa
guucccucuguauagccucugggacaagaaaaagaaaacacaagaauguauacacuggaagauu

SEQ ID NO: 80990 - RNA, 64 nt, hsa
gcuauagaugaagguagagggcugucagcccugaaaaacacacaggucagacauuuaaaaggca

SEQ ID NO: 80991 - RNA, 64 nt, hsa
ccugggggucaaguauuuuaagauaagagggggaaaaacacauaaagucaaacaaauguuuuaa

SEQ ID NO: 80992 - RNA, 64 nt, hsa
gccacuggguauacugcugacaaccgcaacaacaaaaacacaaauccuuggcacuggcuagucu

SEQ ID NO: 80993 - RNA, 64 nt, hsa
uauguaacuauucuaauccaguggaaucuuacggaaaacacagagaaaaccccuuuuaucauuu

SEQ ID NO: 80994 - RNA, 64 nt, hsa
ccccuuucucuagagcaguuuuaugucauuuguaaaaacacauauuagcaaauucguuugcgua

SEQ ID NO: 80995 - RNA, 64 nt, hsa
uaaguggcuugauuaaauggcugaucaaaacuuaaaaacacacuaggucaauguuuuucaagau

SEQ ID NO: 80996 - RNA, 64 nt, hsa
agggagaagguggcauaacuuuuuggaacaaaagaaaacacaaaauccuagcuugggauuccca

SEQ ID NO: 80997 - RNA, 64 nt, hsa
uuaaucugauucacaggauuauguuuaaucgccaaaaacacacuggccaguguaccauaauaug

SEQ ID NO: 80998 - RNA, 64 nt, hsa
cagcacuguucaucuggccaaacaacugugguuaaaaacacauguaaaaugcuuuuuaacagcu

SEQ ID NO: 80999 - RNA, 64 nt, hsa
uucauaaugcagcaguuucuccaaaaacaaaaacaaaacacacaccacacacacgcgcuuuucc

SEQ ID NO: 81000 - RNA, 64 nt, hsa
uuccaaaagaggucaccagaugcacaugggccgcaaaacacacagucaggcuuccagcacauuc

SEQ ID NO: 81001 - RNA, 64 nt, hsa
aguuugccccuuuuggaaugaucucugaauauauaaaacacacacacaaagagcaauaguuugc

SEQ ID NO: 81002 - RNA, 64 nt, hsa
aguuugccccuuuuggaacgaccccugaauauauaaaacacacacacaccccgcgcacucucac

SEQ ID NO: 81003 - RNA, 64 nt, hsa
acuuuauacucacuuaaaaucaagaaucccaucuaaaacacauagguaccuuaucugaaacucu

SEQ ID NO: 81004 - RNA, 64 nt, hsa
uggaaaaaaugaucauggcuuuaaaaaaaaaacaaaaacacacacacaugaacucagauuugca

SEQ ID NO: 81005 - RNA, 64 nt, hsa
gcccaggcugcagucuccacaccaaacagucaacaaaacacaaacccugaaggaaaaccuuuuc

SEQ ID NO: 81006 - RNA, 64 nt, hsa
caacuuugucagguucacguccuauaacgguuaaaaaacacacacacacauacacaaaccguuu

SEQ ID NO: 81007 - RNA, 64 nt, hsa
gaauuaccaagacgucugcuuuugugacagucagaaaacacaccuggaauacgaugcagcccac

SEQ ID NO: 81008 - RNA, 64 nt, hsa
cuuuuauuguggcugaauuuuugugccuaucuauaaaacacacuuucaaauuauuugaauuacc

SEQ ID NO: 81009 - RNA, 64 nt, hsa
uucuuaaaaucaaaaacaaaacaaaaaaacacaaaaaacacauucuaaauacuagagauaacuu

SEQ ID NO: 81010 - RNA, 64 nt, hsa
aagaauuccuucuuaaaaucaaaaacaaaacaaaaaaacacaaaaaacacauucuaaauacuag

SEQ ID NO: 81011 - RNA, 64 nt, hsa
uauuuccaggucacagaauugcuguuaacacuagaaaacacacuuccugcaccaacaccaauac

SEQ ID NO: 81012 - RNA, 64 nt, hsa
aagggagggggggauuuaaagggaaggagugggcaaaacacauaaaaugaauuuauuauaucua

SEQ ID NO: 81013 - RNA, 64 nt, hsa
cccuagaaacccaauucuaagcagaaaaagaaaaaaaacacaaaaaauaaaaaaccccuacaaa

SEQ ID NO: 81014 - RNA, 64 nt, hsa
acauaccucuguccuagaagccggaaaaggaguaaaaacacauuggggagaucaugccuaaaag

SEQ ID NO: 81015 - RNA, 64 nt, hsa
uguuuuggaaguaugcaugcaggccuauaaaugaaaaacacaauucuuuauguguauagcaugu

SEQ ID NO: 81016 - RNA, 64 nt, hsa
cuggaugggaaagugcagucuuguuguucauauaaaaacacacuucuuauuaguuuaccacuug

SEQ ID NO: 81017 - RNA, 64 nt, hsa
gaugggugccuguggguguuuuuagacaccagagaaaacacagucucugcuagagagcacuccc

SEQ ID NO: 81018 - RNA, 64 nt, hsa
augauguacacuuugugcuuggcauuaaaagaaaaaaacacacauccuggaagucuguaaguug

SEQ ID NO: 81019 - RNA, 64 nt, hsa
uuugccuaacaggaaucugaaauauaacuugccaaaaacacacaguugguguggaauggucauu

SEQ ID NO: 81020 - RNA, 64 nt, hsa
uaaacacagaguguagagugaaaacacuagagugaaaacacaugcuacaaugaggcagcaucag

SEQ ID NO: 81021 - RNA, 64 nt, hsa
ugauuauucagcauacuguugauucgucauuugcaaaacacacauaauaccgucagagugcugu

SEQ ID NO: 81022 - RNA, 64 nt, hsa
aacuccugggaaccucgauauucugacauuuggaaaaacacauuuaauuuaucuccuguguuuc

SEQ ID NO: 81023 - RNA, 64 nt, hsa
guuugggaaugagaggaugagugagugaggcuugaaaacacaccacauugaaaauccugccaca

SEQ ID NO: 81024 - RNA, 64 nt, hsa
aagagauguaaaaaaaaaaaaaaaaaaaaaaaaaaaaacacacacacagaggaaagacgcucuu

SEQ ID NO: 81025 - RNA, 64 nt, hsa
aaaguuugugcgcauguuuuucauuauaacaaugaaaacacaaaaguggagaagcuguacaacg

SEQ ID NO: 81026 - RNA, 64 nt, hsa
auaagacacccaauuuuucaugggaguugacaccaaaacacagcuggauuccaucaggaaagcu

SEQ ID NO: 81027 - RNA, 64 nt, hsa
uuagagaagaacauaaaugaccugauggagcugaaaaacacagcaugagaacuucgugaagcau

SEQ ID NO: 81028 - RNA, 64 nt, hsa
uggaauuuauccacuucuuuugguuccccaguccaaaacacagucauuucaccuggacuauuuc

SEQ ID NO: 81029 - RNA, 64 nt, hsa
ugggauuacaggccugagccaccguaucuggcccaaaacacaaauuuauauucucacauaucug

SEQ ID NO: 81030 - RNA, 64 nt, hsa
uagaaauuaauuuaauuuuaaaucaaugagguuaaaaacacaggauuuuuuuuuuuuuuuuuuu

SEQ ID NO: 81031 - RNA, 64 nt, hsa
ccacccccaagacugggaggggacuucuuuuucuaaaacacaaaacucagcccagccaggcccc

SEQ ID NO: 81032 - RNA, 64 nt, hsa
caaacagaagaggaaaaaaaagcaacaaaaaaagaaaacacacagaagagauuuaaaaaaaaaa

SEQ ID NO: 81033 - RNA, 64 nt, hsa
gaacaaaaaagaaaaaaaucaaaaaagcgacaaaaaaacacaaacagaagaggaaaaaaaagca

SEQ ID NO: 81034 - RNA, 64 nt, hsa
aauuuuuacuggggauucuugaacuugaaaaaaaaaaacacaaaaaaagacaaaaaaaaaaaaa

SEQ ID NO: 81035 - RNA, 64 nt, hsa
auaauacaguggaucugaauuuauuauugcuuauaaaacacauuugauggaauaggaguacugg

SEQ ID NO: 81036 - RNA, 64 nt, hsa
auaaugguuaaaaaugaaaccagcuguggauuucaaaacacaguguauucuagaucaucuaaga

SEQ ID NO: 81037 - RNA, 64 nt, hsa
auuuuauuccuuuaacugccaugguuauuuuuauaaaacacaucuauguuucucuuauuaaaag

SEQ ID NO: 81038 - RNA, 64 nt, hsa
caccaguguuucuugagccauuucagauguauguaaaacacaaaauaugccaaauauauauugc

SEQ ID NO: 81039 - RNA, 64 nt, hsa
aaaaaaaaaaccuauuuuauuauccaaaugcuagaaaacacacaugaauuuucuauaaaaucac

SEQ ID NO: 81040 - RNA, 64 nt, hsa
caucgauaguauuuaauaauuuguuuuaccucccaaaacacaguucuucuuucagcuugucuua

SEQ ID NO: 81041 - RNA, 64 nt, hsa
uuuuuuauaaacuggugauuuuucuuuugucuaaaaaacacaugaagaaaauuuaccaaaaaaa

SEQ ID NO: 81042 - RNA, 64 nt, hsa
ucaaguuuuuauuuuguuguuguuguuauuuugaaaaacacauuguaauauguuggguuuauuu

SEQ ID NO: 81043 - RNA, 64 nt, hsa
ugauuagggugaggcacaaagaguuucuugaucauccagagaacauugacagacaauuaugaau

SEQ ID NO: 81044 - RNA, 64 nt, hsa
uguguuuuguucugaucaagggguagggaaccuuuccagagaagucccauuaguaagaaaugac

SEQ ID NO: 81045 - RNA, 64 nt, hsa
gcaauuaauuuuauuaacugauuucuggucuaucuccagagauaaaauaccauuccuucacaac

SEQ ID NO: 81046 - RNA, 64 nt, hsa
cgagccacaccuuuggaaguaaugauuuggccauuccagagauucuggggcuaaaguuuguuuu

SEQ ID NO: 81047 - RNA, 64 nt, hsa
gccccucacuuuacagaugaggaaauggaggugguccagagagggucugggauucccaagguca

SEQ ID NO: 81048 - RNA, 64 nt, hsa
ugacuggaggggcaggagaugguccaaguguccauccagagaugagacucuuagaaucaaagug

SEQ ID NO: 81049 - RNA, 64 nt, hsa
auuuauagccagccaucuaucaccucuagaagguuccagagacagugaaacugcaagaugcucu

SEQ ID NO: 81050 - RNA, 64 nt, hsa
uuaaaucacuugagguaugaaguuuauccuguuuuccagagauaaacauaaguugaucuuccca

SEQ ID NO: 81051 - RNA, 64 nt, hsa
ugauggcauucacuucacacagucgucuauguuauccagagauuuuuauuucauuuuacauuuu

SEQ ID NO: 81052 - RNA, 64 nt, hsa
auuguuuaacaguauguguggugaugucauuaucuccagagaggcuucaagaaauccuuuggaa

SEQ ID NO: 81053 - RNA, 64 nt, hsa
accauucccauuuucucagccucuucucacugccuccagagaggugggugccuggguugagaga

SEQ ID NO: 81054 - RNA, 64 nt, hsa
ccucaucugaccccacccugggccacugcccugcuccagagaguggaccuugacucuuccacac

SEQ ID NO: 81055 - RNA, 64 nt, hsa
cuguagcacugcuuuuuugaggccaguagcaacauccagagaucauucuuccauacuuuacucc

SEQ ID NO: 81056 - RNA, 64 nt, hsa
gcuuuuccuacgaucugcauuauguaaucacagguccagagagcuuuauggaagcgggagagga

SEQ ID NO: 81057 - RNA, 64 nt, hsa
cuaaauuuguccagagcuuucuuuuuccuagaaauccagagagcaaagucagagccuggcaccu

SEQ ID NO: 81058 - RNA, 64 nt, hsa
gugguucuucagaaucaccuagaugccuccacccuccagagauccugaguccaggagucugaag

SEQ ID NO: 81059 - RNA, 64 nt, hsa
ccuuaguggccagagacugacuucaagguuuuauuccagagacuccagagacuuaagcuaagua

SEQ ID NO: 81060 - RNA, 64 nt, hsa
ccagagacugacuucaagguuuuauuccagagacuccagagacuuaagcuaaguauuuuuucau

SEQ ID NO: 81061 - RNA, 64 nt, hsa
uuguuagucccaacucuggccaaagauacuuuuuuccagagacagaggccaggaggcagugagg

SEQ ID NO: 81062 - RNA, 64 nt, hsa
ggagggcaucuguacuccugugcaaaaugcccaguccagagacaaaaccucagacuuugugcac

SEQ ID NO: 81063 - RNA, 64 nt, hsa
caaagauugaacacugcguaggagagggagaugauccagagacauguggcagcaggcauggcuu

SEQ ID NO: 81064 - RNA, 64 nt, hsa
ggcagccuauugguguuauguuuauguaacauaguccagagaacugacaugcaggucaaaaguc

SEQ ID NO: 81065 - RNA, 64 nt, hsa
cuuauguauuuuaacaguuggguucuguggaguguccagagaccuuggguuagguauauccauc

SEQ ID NO: 81066 - RNA, 64 nt, hsa
acaacuuguugguaguuaggcacccaugaaugucuccagagacauccugagaggcaagauuccu

SEQ ID NO: 81067 - RNA, 64 nt, hsa
gggcauuugauggcaauaggccaaaauuauuguguccagagaguacacuuuuucaaaaugcuca

SEQ ID NO: 81068 - RNA, 64 nt, hsa
ucucggguuaagggaagugacaauuuuauuccauuccagagaauggacaaacucuuaacuuuua

SEQ ID NO: 81069 - RNA, 64 nt, hsa
ugugcuggucuaaauuaauccaucgcagugauccuccagagacagcgcucugcucauguccgua

SEQ ID NO: 81070 - RNA, 64 nt, hsa
ccgagaaugaggagcccucccugccccaccguccuccagagaaugcgccccuccugguucccug

SEQ ID NO: 81071 - RNA, 64 nt, hsa
gauguccagagacuaggccucuccccuuuaccccuccagagaaggggcuucccugucccggagg

SEQ ID NO: 81072 - RNA, 64 nt, hsa
agugaauggcccuuccuuaguagccugggggauguccagagacuaggccucuccccuuuacccc

SEQ ID NO: 81073 - RNA, 64 nt, hsa
guucccauuucccagguucuccagagagcgggcauccagagaggaguccugggagagcgggcgg

SEQ ID NO: 81074 - RNA, 64 nt, hsa
uccacugagccucugguucccauuucccagguucuccagagagcgggcauccagagaggagucc

SEQ ID NO: 81075 - RNA, 64 nt, hsa
aagccacauauaaaaaggcauugagggcucacuguccagagaauugcuuuuguaaaugcuccac

SEQ ID NO: 81076 - RNA, 64 nt, hsa
uguucauuccaaaucuguuaagcauuuccaaacauccagagaaugguuucacuguugagggugc

SEQ ID NO: 81077 - RNA, 64 nt, hsa
ggggcacggccccuacccgagaacaggaggguccuccagagaaugugccaugaucagggauaug

SEQ ID NO: 81078 - RNA, 64 nt, hsa
aucuggccaacgggccuuuuuacaggaacugagguccagagaggacauggacacccccagcucu

SEQ ID NO: 81079 - RNA, 64 nt, hsa
ucagcgugaauuaauuuuuaaucaguuugcuuucuccagagaaauuuuaaaauaauagaagaaa

SEQ ID NO: 81080 - RNA, 64 nt, hsa
gcagcugggguucccugcuuuuugguagcaaggguccagagaugagguguuuuuuucggggagc

SEQ ID NO: 81081 - RNA, 64 nt, hsa
cacggccgggcccccuggcgacaacuuccaucauuccagagaaaagccacuuuaaaaacagcug

SEQ ID NO: 81082 - RNA, 64 nt, hsa
uuccuuguaauuaagucacaggcaggacccaguuuccagagagcaggcggggccgcccaguggg

SEQ ID NO: 81083 - RNA, 64 nt, hsa
uuucuagagacccagcuuuauucaccugacuguuuccagagacccagcuaaagucaccugccug

SEQ ID NO: 81084 - RNA, 64 nt, hsa
agcagcuccuuggacagacuguuucucaguuauuuccagagacccagcuacaguucccuggcug

SEQ ID NO: 81085 - RNA, 64 nt, hsa
cucaacggggacaacuccagaaggucauuccagauccagagauccccaucgaacugaaggauca

SEQ ID NO: 81086 - RNA, 64 nt, hsa
ugagagaacaguguugcugcuggcagagaugcauuccagagaugcacuccgcucuggaacucac

SEQ ID NO: 81087 - RNA, 64 nt, hsa
aguagacccuguguacacagauugugagugaaguuccagagaugugucagcccuuaucaggcau

SEQ ID NO: 81088 - RNA, 64 nt, hsa
ugaaggagaaccugguggcauugccccagagcucuccagagaugagccuccccuauccccaccc

SEQ ID NO: 81089 - RNA, 64 nt, hsa
gcuuauguauaaguaaaggggcaggugcuugggcuccagagagacccuagguacugccuucuaa

SEQ ID NO: 81090 - RNA, 64 nt, hsa
agaaacugaggaguagcugagaggaagaugaagagaagcugagaagaagcugaggauccucaca

SEQ ID NO: 81091 - RNA, 64 nt, hsa
aguagcugagaggaagaugaagagaagcugagaagaagcugaggauccucacaggagcagacag

SEQ ID NO: 81092 - RNA, 64 nt, hsa
gaaacagggcagugacaaguggagggggugucuggaagcugagcaggcccgacagagagaugaa

SEQ ID NO: 81093 - RNA, 64 nt, hsa
ccacuggggaaugcucccagcugugcuguggagagaagcugauguuuugguguauugucagcca

SEQ ID NO: 81094 - RNA, 64 nt, hsa
cacccuccucuuggaauuacaagcccugggguuugaagcugacuuuauagcugcaaguguaucu

SEQ ID NO: 81095 - RNA, 64 nt, hsa
uuuauuuucaaaugaaugaggccaagcugaagcugaagcugaagauucuucccaucuggccagc

SEQ ID NO: 81096 - RNA, 64 nt, hsa
aaacauuuuauuuucaaaugaaugaggccaagcugaagcugaagcugaagauucuucccaucug

SEQ ID NO: 81097 - RNA, 64 nt, hsa
cauuuggggaccacagaggcuguggucagagagggaagcugaggcccauggccacauccucaug

SEQ ID NO: 81098 - RNA, 64 nt, hsa
ggcaaugggcuacccucauuucacacguugugaugaagcugaggcugcugccaggcccggcaug

SEQ ID NO: 81099 - RNA, 64 nt, hsa
gugguguuucgcgucuguagucccagcuauuugggaagcugaggugggaggaucucgagccugc

SEQ ID NO: 81100 - RNA, 64 nt, hsa
caccuguguaaaaggaugugggagaggagggucugaagcugagcugcuaaaugaauaucccugc

SEQ ID NO: 81101 - RNA, 64 nt, hsa
auaauuuucaagggaucuucauggguugugacuggaagcugaccuuagucuugcgucucauccu

SEQ ID NO: 81102 - RNA, 64 nt, hsa
aggugauuuucagauuucuuguucuauggaagaggaagcugagcucagggagauaugagcucca

SEQ ID NO: 81103 - RNA, 64 nt, hsa
uagugcuuacauuugcucaaaaagcauguuguaugaagcugacugccaccaugcuaaagcagau

SEQ ID NO: 81104 - RNA, 64 nt, hsa
aaggaauucagacuuaaaugccuaccucugugcugaagcugacagacaguauuaacucuuauca

SEQ ID NO: 81105 - RNA, 64 nt, hsa
aaggcagacauuuccaaguuuguugaaauaauacgaagcugacuagcuuacgugaaugauguug

SEQ ID NO: 81106 - RNA, 64 nt, hsa
aggccagaaugaggaagcccugaagagcuuaaaagaagcugaaaacuuaaugcaggaagaacau

SEQ ID NO: 81107 - RNA, 64 nt, hsa
ucuccuugcccugaagcuucaggaugaaggacaggaagcugaaggagaaaaguacauugaagaa

SEQ ID NO: 81108 - RNA, 64 nt, hsa
accugcaggaccaagugcagaggcucaugcgggagaagcugacggacuggaaggacuucuugcu

SEQ ID NO: 81109 - RNA, 64 nt, hsa
ccucucucgugcucaggcugcuccaggcaugugggaagcugaagcggcagcucugcgccaucua

SEQ ID NO: 81110 - RNA, 64 nt, hsa
cccagcugauggauggcuucuccaugcuggagaagaagcugaaggaagggccggagcccggggc

SEQ ID NO: 81111 - RNA, 64 nt, hsa
ccagguccagagaaccuggcaugcaauggacauggaagcugaaaauuacuuggguauucucuga

SEQ ID NO: 81112 - RNA, 64 nt, hsa
caggccuuacugccccuacucguguacugugccugaagcugaaguuggaggcauccaaaauaag

SEQ ID NO: 81113 - RNA, 64 nt, hsa
gccuagagccagaugccuaugcguuguuccauaagaagcugaccgagggugugcugaugcggga

SEQ ID NO: 81114 - RNA, 64 nt, hsa
aggaucccccugcuuaccaggcccgcuuguuacagaagcugacagaagagguacccuugggaca

SEQ ID NO: 81115 - RNA, 64 nt, hsa
agaauuuugagggugggagagaagaaaagggaaagaagcugaaaauguaaaaccacaccaggga

SEQ ID NO: 81116 - RNA, 64 nt, hsa
ccuuuauaugacuuucucugaguugggcaaagaagaagcugacacaccguauguuguuagaguc

SEQ ID NO: 81117 - RNA, 64 nt, hsa
ugaugucagugucugggcucaugacuuguaaauggaagcugaugugaacagguaauuaauauua

SEQ ID NO: 81118 - RNA, 64 nt, hsa
guuuaagauguauauuuagaaugacaucaucuaagaagcugauuuugcuaaacuccuguucccu

SEQ ID NO: 81119 - RNA, 64 nt, hsa
uacucaugagaaguggaagcuccuaguaucagaagaagcugauacauagugucaugugcucagu

SEQ ID NO: 81120 - RNA, 64 nt, hsa
gaccagaaggaguaaugagacaagugaugguggggaagcugaauguugagggagguggaggaag

SEQ ID NO: 81121 - RNA, 64 nt, hsa
ggugguaaacuaugggaugguaaauauccgagaggaagcugaugcaacaggauuugucugcagc

SEQ ID NO: 81122 - RNA, 64 nt, hsa
cuuuacguggagggagaacaggcacauuagccuugaagcugaagcucauuuuagguuccuucca

SEQ ID NO: 81123 - RNA, 64 nt, hsa
gcccaaggcaccagaagguuuguuucaguuugcugaagcugauuuguaaugauuggcacucuuc

SEQ ID NO: 81124 - RNA, 64 nt, hsa
uagcucuccugaaccuccuccuuccccaagcugagaagcugagagcuggaggacaauauccagg

SEQ ID NO: 81125 - RNA, 64 nt, hsa
cuuaggcuccacagcugggaacaaguggggcugggaagcugacuucgugcucuucaccaccaca

SEQ ID NO: 81126 - RNA, 64 nt, hsa
uggaccugcuacuggagaagaccaaggagcugcagaagcugauugaagcugacaucuccaagag

SEQ ID NO: 81127 - RNA, 64 nt, hsa
acuggagaagaccaaggagcugcagaagcugauugaagcugacaucuccaagagguacagcggg

SEQ ID NO: 81128 - RNA, 64 nt, hsa
agcccagcagaagcugagccaggcagaggggaaagaagcugauaugaggaagggucugacaggc

SEQ ID NO: 81129 - RNA, 64 nt, hsa
gagagaggaaaggagggaggggagaagcccagcagaagcugagccaggcagaggggaaagaagc

SEQ ID NO: 81130 - RNA, 64 nt, hsa
ccuucagaucagccacaccuuuuccaggaguucugaagcugacagcacuacaaaggagacgggg

SEQ ID NO: 81131 - RNA, 64 nt, hsa
gugguggcacaugccuguaaucccagcuacucgggaagcugaggcaggagaauugcuugaacca

SEQ ID NO: 81132 - RNA, 64 nt, hsa
gagaagaggccaaagcccucauuuuacagaugaggaagcugaagcccggggaggggagcgaccc

SEQ ID NO: 81133 - RNA, 64 nt, hsa
agcuagaguucacaggagagccaaaaaagaaaaggaagcugagcaucucccgaguccugggcag

SEQ ID NO: 81134 - RNA, 64 nt, hsa
gcagugagccgugauggcgccacugcacuucagccuuggagacaggggagacccuaugucaaaa

SEQ ID NO: 81135 - RNA, 64 nt, hsa
gcgcccagggcgcauggggccuccuuggccuccucuuggagagucuccuggccuccccuccugu

SEQ ID NO: 81136 - RNA, 64 nt, hsa
ugcuucugguuacuagggucucaugcguguccugcuuggagagccauaaggaaauugcugucuu

SEQ ID NO: 81137 - RNA, 64 nt, hsa
agggaauggggugggagucgggggaagugcaguccuuggagauguacugguguccgucucccag

SEQ ID NO: 81138 - RNA, 64 nt, hsa
cugucaaacagaugcaaaccuuccugaauaaagccuuggagaccagcgcugucuguggugugau

SEQ ID NO: 81139 - RNA, 64 nt, hsa
cucuuccuguucugcaccccucuccccaugggaccuuggagaaaacugaacuguuacaaacccc

SEQ ID NO: 81140 - RNA, 64 nt, hsa
gcacuccagccugggcaacagagcaagacccugucuuggagaaaccagaauuuuggaagagcaa

SEQ ID NO: 81141 - RNA, 64 nt, hsa
uacuuuuaaaacugguggcaccacucauuugggacuuggagacugcuuuuauccagaaccuguu

SEQ ID NO: 81142 - RNA, 64 nt, hsa
cucacuuuauucuuguauggcuuugguaggcauacuuggagaacauaucccacauuaggaauug

SEQ ID NO: 81143 - RNA, 64 nt, hsa
agccugagaguuugagggcuuuaauccuuuaaaacuuggagaagcuggcugggcgcgguggcuc

SEQ ID NO: 81144 - RNA, 64 nt, hsa
guguuuguuuuuaucaaaaugucaaaauaacauacuuggagaaguauguaauuuugucuuugga

SEQ ID NO: 81145 - RNA, 64 nt, hsa
uuuucuagagguuggcuuucaauucuguagcauacuuggagaaacugcauuaucuuaaaaggca

SEQ ID NO: 81146 - RNA, 64 nt, hsa
agcccuaccugauacccugugucaaugaguguaccuuggagagcuauccacucaggccccagug

SEQ ID NO: 81147 - RNA, 64 nt, hsa
uaggcuugguuuugaugcuagagaggaaaaaggacuuggagagagagaaggaauggcuggucca

SEQ ID NO: 81148 - RNA, 64 nt, hsa
ccucccuccgagaugccagaaguuuuuccacagccuuggagaggggcuuugacugagggcuggg

SEQ ID NO: 81149 - RNA, 64 nt, hsa
ggccacccaggaccaggucuguguggggaugugccuuggagaccaaggcaauaguccuuuccac

SEQ ID NO: 81150 - RNA, 64 nt, hsa
aguccuguaaaugaaugcucugggcuagauacagcuuggagaaccugcuggccuuguuagacag

SEQ ID NO: 81151 - RNA, 64 nt, hsa
ccccucccaccugcccccugcguaggcacccagacuuggagagacccgucugcuguuaauacuu

SEQ ID NO: 81152 - RNA, 64 nt, hsa
guccaagaacaaaugccagccacguccuccgccacuuggagagaugagaacccaguggggucac

SEQ ID NO: 81153 - RNA, 64 nt, hsa
gcaggcaucuguggggaaucccagccugcagguucuuggagaagcaggugaaccuaaggaugaa

SEQ ID NO: 81154 - RNA, 64 nt, hsa
cacggccaagggccacgggaacuuggagagggagcuuggagaacucacugugggcuaggguggu

SEQ ID NO: 81155 - RNA, 64 nt, hsa
cgauggucagggccacggccaagggccacgggaacuuggagagggagcuuggagaacucacugu

SEQ ID NO: 81156 - RNA, 64 nt, hsa
ugagauggggugccgcccaccuccugcggauacucuuggagaguuguucccccagggggcucug

SEQ ID NO: 81157 - RNA, 64 nt, hsa
ucauuucuuagauggagaaguugugaaagauguccuuggagaugaguuuuaggaccagcauuac

SEQ ID NO: 81158 - RNA, 64 nt, hsa
gcuguaucuacucuguggaguagaaccaagucuacuuggagaaaagaaccaaguccuuggauau

SEQ ID NO: 81159 - RNA, 64 nt, hsa
cacuggaacaggguugaaaacccaggguuuuguacuuggagaggaaagaugccaagcugcuucu

SEQ ID NO: 81160 - RNA, 64 nt, hsa
cagagaaagguuuuagacuccaguuuaccuuucucuuggagaaacucaaugcuaaucccaccuu

SEQ ID NO: 81161 - RNA, 64 nt, hsa
gcaugaggacaacuauucagcaugguuuuagcuucuuggagaugauuccaacuuaacuauuuug

SEQ ID NO: 81162 - RNA, 64 nt, hsa
gugaagccagcugggcuccugagucugguggggacuuggagaaccuuuaugucuagcuaaggga

SEQ ID NO: 81163 - RNA, 64 nt, hsa
auccacacucuguaucuggcuacucugguggggacuuggagaaccuuuguguccacacucugua

SEQ ID NO: 81164 - RNA, 64 nt, hsa
guacaccuggcaucuguggcauguguucuggucacuuggagaagggcauguguggggugugugu

SEQ ID NO: 81165 - RNA, 64 nt, hsa
ggugugggcgcgucugugguguguguccuagucacuuggagaagggugugugugggaugcgugu

SEQ ID NO: 81166 - RNA, 64 nt, hsa
gugacgagacuuuugaaaaaauggugaacacacucuuggagagguaccccaggcugcacagcau

SEQ ID NO: 81167 - RNA, 64 nt, hsa
accuuguauugugauauuaacuggcaaagauccucuuggagaaaccuuucccagguacaguuuc

SEQ ID NO: 81168 - RNA, 64 nt, hsa
ccaucuuguggggccaggaccauggccgaagccccuuggagagagaggcugccucagccagugg

SEQ ID NO: 81169 - RNA, 64 nt, hsa
uuacuccuccugcuccucaccccuguagggaaaccuuggagaggagaguggcaggugggcugcc

SEQ ID NO: 81170 - RNA, 64 nt, hsa
cuuccaucuugcugugauuugcaauagguauuuucuuggagaauguaagaacuuaacaauaaag

SEQ ID NO: 81171 - RNA, 64 nt, hsa
uauacugccuuuagguuucucuuccaucgggugacuuggagauuucuuuuuguuuccuuuuggu

SEQ ID NO: 81172 - RNA, 64 nt, hsa
cccgggggcgcagcuuggagagccgggggcgcagcuuggagauccaggggcgcauggagaggcc

SEQ ID NO: 81173 - RNA, 64 nt, hsa
gcaggagaguguguucugagucccgggggcgcagcuuggagagccgggggcgcagcuuggagau

SEQ ID NO: 81174 - RNA, 64 nt, hsa
gcaagcaacaauucuguagccucaaguaagaccaccugugaacuugaucauuaucuggcccaaa

SEQ ID NO: 81175 - RNA, 64 nt, hsa
ugcugggauuacaggcaugagccagcaugccuggccugugaacgcagaauucuuauaagguguu

SEQ ID NO: 81176 - RNA, 64 nt, hsa
gcccucagucuagggaucuggccacagacucccuccugugaaccaacacagacacccaagcaga

SEQ ID NO: 81177 - RNA, 64 nt, hsa
aguuaaugauuaucauuuacuuggaaagauuuuaccugugaagugaaauucuuucauugggggu

SEQ ID NO: 81178 - RNA, 64 nt, hsa
agaucucugccaucucuggcugagauacugcuguccugugaaguguuucccaugaccuuuuucu

SEQ ID NO: 81179 - RNA, 64 nt, hsa
cucauagggcuguugugaggauuaggaugaaauaccugugaaagugccuaggcagugccagcca

SEQ ID NO: 81180 - RNA, 64 nt, hsa
uugggaucugccuuuuucauccagagcucugaugccugugaacacugaaagagaaagccuaaug

SEQ ID NO: 81181 - RNA, 64 nt, hsa
caggaguucaaggcuauagugugcuaugaucaugccugugaauagccacugcacuugagccucu

SEQ ID NO: 81182 - RNA, 64 nt, hsa
auuuguuccugccccaccuuaacugagcgauuaaccugugaacuuccuucuccuggcucagaag

SEQ ID NO: 81183 - RNA, 64 nt, hsa
gcuaguauuccagagcugcuauuagaagcugcuuccugugaagaucaaaucuuccugaguaauu

SEQ ID NO: 81184 - RNA, 64 nt, hsa
ucacaaaggauggucuuggccauaugcuagggccccugugaaaauaaguaguuuugagaaguuu

SEQ ID NO: 81185 - RNA, 64 nt, hsa
cuucuuccauuacaccuucuuuauauuuuaaaggccugugaauauacuuauaaccugcauauca

SEQ ID NO: 81186 - RNA, 64 nt, hsa
uuccauguuucaacaacuauugaaauaugaaaugccugugaacucuuaaagcuucaugagcagc

SEQ ID NO: 81187 - RNA, 64 nt, hsa
ugguggugucggguguugguggguagaguuaguuccugugaacaaugcacugggaaggguggag

SEQ ID NO: 81188 - RNA, 64 nt, hsa
cuguuccucuuucuccccgacuccaccccagcucccugugaagagagaguuaauauauuuguuu

SEQ ID NO: 81189 - RNA, 64 nt, hsa
gugggcccagcccggcccgcgucucgaaggggcaccugugaacucaaaaggcucuuuucagagc

SEQ ID NO: 81190 - RNA, 64 nt, hsa
accccggugccugugacaccucuaagcucuggcaccugugaagcccuuuaaacacccuuaagcc

SEQ ID NO: 81191 - RNA, 64 nt, hsa
ggggcauuguuuuuucacugcuuucucaacaguuccugugaauaaaugaaacauuucggagcuc

SEQ ID NO: 81192 - RNA, 64 nt, hsa
agagaugauaccucuuacaaacuuuaccucauagccugugaagcagguuggcauguggauuaca

SEQ ID NO: 81193 - RNA, 64 nt, hsa
gggacccuuaggauggggcucccagcuccuuucuccugugaauggaggcagagaccuccaauaa

SEQ ID NO: 81194 - RNA, 64 nt, hsa
ggaccaagaagucuggcuccugcuuuucuacaugccugugaaggagacuuuucaugaaacugaa

SEQ ID NO: 81195 - RNA, 64 nt, hsa
cuuccuuuguugcacaaauagaguuuggaaaaagccugugaaaggugucuucuuugacuuaaug

SEQ ID NO: 81196 - RNA, 64 nt, hsa
ucaguggaaaguaucugccagccacagcaugaggccugugaaggcugacugagaaauccucugc

SEQ ID NO: 81197 - RNA, 64 nt, hsa
uuuugaauguacugguaaugccuaauguggucugccugugaaucuccccauguagaauuugccc

SEQ ID NO: 81198 - RNA, 64 nt, hsa
uugccaguacuucaucuucaagauuuacccuuuuccugugaaguucagaguuacugaagaugcu

SEQ ID NO: 81199 - RNA, 64 nt, hsa
gucugcagucaaggauucuucauuuuuagaaaugccugugaagaccuuggcagcgacguggcuc

SEQ ID NO: 81200 - RNA, 64 nt, hsa
ccuguuuucccacauacuaggugcucaauucaugccugugaauggcgugagcccauaauggaua

SEQ ID NO: 81201 - RNA, 64 nt, hsa
uuuauaaaugucuuacucaaguucaaaccuccagccugugaaucaacugugucucuuuuuugac

SEQ ID NO: 81202 - RNA, 64 nt, hsa
uuucuagccuugaauucauuuuaucuucauuaucccugugaaguaggugggacaaguauaaggg

SEQ ID NO: 81203 - RNA, 64 nt, hsa
gcccuguugguggagaccagugccugaacuggacccugugaaaucugucccgugggaauccuga

SEQ ID NO: 81204 - RNA, 64 nt, hsa
uucaugccauaugcagauauccaauuaugugcauccugugaauaaaccacgucuuggucacugu

SEQ ID NO: 81205 - RNA, 64 nt, hsa
uuuuuuuuuuuuuuuucaugaaucauguuugguuccugugaaagucccugguccagggauccuc

SEQ ID NO: 81206 - RNA, 64 nt, hsa
ucagcauuccacaucagauuuaaagcaucaaaugccugugaaacagcaaagaugguugaagauu

SEQ ID NO: 81207 - RNA, 64 nt, hsa
uuccccuacuggcucucauucucacucuugccgcccugugaagaggugccuuccaccgugauug

SEQ ID NO: 81208 - RNA, 64 nt, hsa
guggcagcaggcaccuggucuucagaaauuguuuccugugaauucugugacuccuaauaggcca

SEQ ID NO: 81209 - RNA, 64 nt, hsa
ggagagagcagguguguuaaaugggacuggagucccugugaagacugggugaggauaacacaag

SEQ ID NO: 81210 - RNA, 64 nt, hsa
gcuaagcauuucuaaagcauuagacuaacagauuccugugaaguucugugcauaugucccagcc

SEQ ID NO: 81211 - RNA, 64 nt, hsa
cagaacaaaaauaauguucuuuuuaugcaaauccccugugaaaauaaaauuuucaauguuuuuu

SEQ ID NO: 81212 - RNA, 64 nt, hsa
auuauuauuaauauuguuaaacuucugugcuguuccugugaaucuccaaauuuuguaccuuguu

SEQ ID NO: 81213 - RNA, 64 nt, hsa
uguccaggaugucacauguucccuuaccccuguaccugugaaggauuggcagugcuugugccug

SEQ ID NO: 81214 - RNA, 64 nt, hsa
cagaguucacuccuuccuccuggcucucuauauaccugugaauaugugaaauaguguaaauaug

SEQ ID NO: 81215 - RNA, 64 nt, hsa
cacacuuucaugugcuuguggaucaccugaggauccugugaaaauacagauacugauucagugg

SEQ ID NO: 81216 - RNA, 64 nt, hsa
ccaggcagcccagagaagaucuguuucccuguguccugugaauggaaggacccaagccaauaug

SEQ ID NO: 81217 - RNA, 64 nt, hsa
augcaagaacccuguuguacuggcguuuuccuccccugugaaaacguaacuacuguugggagug

SEQ ID NO: 81218 - RNA, 64 nt, hsa
ggggucccugugcugauccugcugaccucacuguccugugaaguaaccccuccuggcugugaca

SEQ ID NO: 81219 - RNA, 64 nt, hsa
acucaugcuggagaggagccgcccacuuccaggaccugugaauaagggcuaaugaugaggguug

SEQ ID NO: 81220 - RNA, 64 nt, hsa
ccucucuucccccaacauacucacuagaguggcuccugugaagcagagaccaaaguucugacuu

SEQ ID NO: 81221 - RNA, 64 nt, hsa
cccagaaaaggcggugcucagcacggggugucauccugugaagggacacagagaacaggugggu

SEQ ID NO: 81222 - RNA, 64 nt, hsa
cuuuggugcuaggagcugacaauuuccaaagcagccugugaaguccuaggggcugggggccacu

SEQ ID NO: 81223 - RNA, 64 nt, hsa
cuggggaguucugcguugaguggacggacuuauuccugugaagcggcauaauuugucuccauug

SEQ ID NO: 81224 - RNA, 64 nt, hsa
acccccaucacucaccuuugucugcaucccugggccugugaaugaugacagcaccugacauucu

SEQ ID NO: 81225 - RNA, 64 nt, hsa
uugcgcaguaguuugguuugacuuguuugugcauccugugaaaaauaacggugcuugugucacu

SEQ ID NO: 81226 - RNA, 64 nt, hsa
agcccuccugucccuuccccccagucaguauuacccugugaagccccuucccuccuuuauuauu

SEQ ID NO: 81227 - RNA, 64 nt, hsa
auucaagauacugaaaaauagagcugggacugagccugugaaugacaggaaugaucuauuacca

SEQ ID NO: 81228 - RNA, 64 nt, hsa
ggauuuuuuugugaguuaacaauuuccuugaaauccugugaaauagauuugcacagacaccuug

SEQ ID NO: 81229 - RNA, 64 nt, hsa
agcucucuuuaaaccagcuaagccauuccagucuccugugaagccaaaagggaccaggaaccgu

SEQ ID NO: 81230 - RNA, 64 nt, hsa
guacugcugcagcuuuaaguaccuuaaagcuucuccugugaacuucuuagggaaauguuagguu

SEQ ID NO: 81231 - RNA, 64 nt, hsa
ucuucaaauguaccagaaccugagccaacgccucccugugaaacuguugcugaucuguaguaca

SEQ ID NO: 81232 - RNA, 64 nt, hsa
gcucuaggcuucuccugcugaguccuggucuuggccugugaaugugccucguucaucccuggug

SEQ ID NO: 81233 - RNA, 64 nt, hsa
uugaaguuuucugcucuacuuuccuuggcagcagccugugaacuacucaaaagaguccccuugg

SEQ ID NO: 81234 - RNA, 64 nt, hsa
aucuuuccagagguccaugguggaagacgauaacccugugaaauacuuuauaaaaugucuuaau

SEQ ID NO: 81235 - RNA, 64 nt, hsa
ccuugcugcucccuacugacucuagcuuacuuccccugugaagaaacagguguucucggcugag

SEQ ID NO: 81236 - RNA, 64 nt, hsa
agaaauuuucucagagcaaacuuucuauuuuuuaccugugaaauaacagugacuuuuuaaaaug

SEQ ID NO: 81237 - RNA, 64 nt, hsa
agaauguuuuaaagugaauuguuguaaugaaguuccugugaacaucauuaugguuuuguacaaa

SEQ ID NO: 81238 - RNA, 64 nt, hsa
ugguagggauguuaauaauuuuaguggaacaaagccugugaaaugauuguacauaguguuaauu

SEQ ID NO: 81239 - RNA, 64 nt, hsa
uccaucaugcaaaaaaaaagcuccugcugaaacuccugugaaagaaagacuuuuuauuguguuu

SEQ ID NO: 81240 - RNA, 64 nt, hsa
aaguguggaaucaaaugagcacauaagcugugucccugugaaaagagguuuguagccuuucagg

SEQ ID NO: 81241 - RNA, 64 nt, hsa
gugcaaaaccgagggcuccaguaacaccuucuaaccugugaauuggcagaaaaggguagcggua

SEQ ID NO: 81242 - RNA, 64 nt, hsa
uucuguuaauuuguaaaagcacauuagugcuuuaccugugaaauuccccgccccccugcacaca

SEQ ID NO: 81243 - RNA, 64 nt, hsa
uuuccaaauguaauaaacuuuaauauaaaguaguccugugaaugccacugccuucgcuucuugc

SEQ ID NO: 81244 - RNA, 64 nt, hsa
aauuggggcuugaaaguauauaaaaucuuccuguccugugaauuuuaaaaagcuaucccauauc

SEQ ID NO: 81245 - RNA, 64 nt, hsa
cuaaaagcuuucaugucccagaacuuagccuuuaccugugaaguguuacuacagccuuaauauu

SEQ ID NO: 81246 - RNA, 64 nt, hsa
uauuaagcaucagaaaauucauaccugagaaaaaccugugaauguggguaaugugggagagccu

SEQ ID NO: 81247 - RNA, 64 nt, hsa
ucacccauugacucaccuuauccaaagcaaguuuccugugaaucggccaguucuucuauauuca

SEQ ID NO: 81248 - RNA, 64 nt, hsa
ccaacugaucaucugagaaaccaacacauuuuuuccugugaauuuguuaauuaaagauaguuaa

SEQ ID NO: 81249 - RNA, 64 nt, hsa
gaaagcaaaacuaauauuuauuuucuagauuaucccugugaauaauugagaacuuuuuggaguc

SEQ ID NO: 81250 - RNA, 64 nt, hsa
aaauagagcuucauuuuugauauauuguuuacagccugugaaagugauuuauuuguguuaauaa

SEQ ID NO: 81251 - RNA, 64 nt, hsa
auauauauuauuauauuuguacuuuggcaagaauccugugaagauuuuuaucuuuggacuacua

SEQ ID NO: 81252 - RNA, 64 nt, hsa
caaaucucagaacauuccucaccaucacugcaggccugugaacagauaacuuucaucaauuagg

SEQ ID NO: 81253 - RNA, 64 nt, hsa
cuuuaaguguaacuggcaguuuuccauugguuuaccugugaaauaguucaaagccaaguuuaua

SEQ ID NO: 81254 - RNA, 64 nt, hsa
ucauuuguccaugugcaaacgcuguauuccaaggccugugaauggcagccugaggaaguuuugc

SEQ ID NO: 81255 - RNA, 64 nt, hsa
auguuuacaauguauguguaugucacuuucgguaccugugaaugcauggggacgugcugaaccc

SEQ ID NO: 81256 - RNA, 64 nt, hsa
uauuugauauaagacaccuucgggggaaauaauuccugugaauauucuuuuucaauucagcaaa

SEQ ID NO: 81257 - RNA, 64 nt, hsa
guucaggcugccccgccuccacugggggaucgcaccugugaauuaccugagguaugcauuuccc

SEQ ID NO: 81258 - RNA, 64 nt, hsa
gaaagucacccccacauaccaacucaacuuuuuuccugugaacacauaaauauauuuuuauaga

SEQ ID NO: 81259 - RNA, 64 nt, hsa
accagcccauuucuccacacugguacaguagucaccugugaaaaaaaaauuggaacuuacuaau

SEQ ID NO: 81260 - RNA, 64 nt, hsa
accggaucugcugaagcaucuguccagcugguauccugugaaaguuuguuauuuucugaguaga

SEQ ID NO: 81261 - RNA, 64 nt, hsa
cuugguuuauuguugggggugcucucagaaggaaccugugaaagccuuuaucagucauuuauug

SEQ ID NO: 81262 - RNA, 64 nt, hsa
ccauccccuguucacuuucucuagcccaucauuaccugugaacugcaguggggcagucauggca

SEQ ID NO: 81263 - RNA, 64 nt, hsa
accaugggggaggcucccaaccuguggaagugguccugugaaaaggagacagaaacaaguaaga

SEQ ID NO: 81264 - RNA, 64 nt, hsa
uugguugccauggugaccagggaccacguugcugccugugaaugcugagugagcgaguaaggga

SEQ ID NO: 81265 - RNA, 64 nt, hsa
uuugguuuuuuguguguuuuccccuucaucucuaccugugaaagugaaauucuauuguaaaugg

SEQ ID NO: 81266 - RNA, 64 nt, hsa
ggaaugaaaaagcgagcagauacuguuggucuagccugugaagcaauuaaucgaauguuucaga

SEQ ID NO: 81267 - RNA, 64 nt, hsa
uacccaggaccacucuguaccaucuuuguaacuuccugugaauuuauaauaauuucaaaauaaa

SEQ ID NO: 81268 - RNA, 64 nt, hsa
gaaaucuuuuccaucuccauccuaacaugcacaaccugugaagagaauuguuucuauaguaacu

SEQ ID NO: 81269 - RNA, 64 nt, hsa
gccuucaaaacucagcuguuccagccggugccaaccugugaacuucccaccauaucccagaauc

SEQ ID NO: 81270 - RNA, 64 nt, hsa
uuaacuggccuccacucaaugggaaacugacucgccugugaaagacacagugggagagcugaaa

SEQ ID NO: 81271 - RNA, 64 nt, hsa
gcccgugccccuagcaggagcccuggugcuacccccugugaagagccaagcagcagggcacgcc

SEQ ID NO: 81272 - RNA, 64 nt, hsa
ggaaacaaauauaacuguaaaugaaucuugguauccugugaaacagaauaauucguaauuuaag

SEQ ID NO: 81273 - RNA, 64 nt, hsa
guuacuuuaggggguuuuuggugggguuuuucccccugugaaaacuuacuuugccccuagucug

SEQ ID NO: 81274 - RNA, 64 nt, hsa
ucugaauacaaacauuucacuucuccaacaaguaccugugaacaguacaguauuuacaguauug

SEQ ID NO: 81275 - RNA, 64 nt, hsa
uaaaagguaggaaguaagcuacuuagugguuucaccugugaaauaacuauuuugacugaaaugu

SEQ ID NO: 81276 - RNA, 64 nt, hsa
auguuggagacugagcugggugcacuggccaugcccugugaauccucaggcugugacgcccuca

SEQ ID NO: 81277 - RNA, 64 nt, hsa
auuuuuaaacagguggugagaaauuucugugaaaccugugaagcugaaaagggggugggauggg

SEQ ID NO: 81278 - RNA, 64 nt, hsa
ggccugagcagagcaugugggaacuguucaguggccugugaacugucuuccuuguucuagccag

SEQ ID NO: 81279 - RNA, 64 nt, hsa
aaacuucaaauuagccucaugaagagaauuuuucccugugaaaaguaagaccaagaaaaaacaa

SEQ ID NO: 81280 - RNA, 64 nt, hsa
aauuuaaagacguuuacuucccuugaacuuugaaccugugaaaugcuuuaccuuguuuacaguu

SEQ ID NO: 81281 - RNA, 64 nt, hsa
augacauaguaaguuauauuuguuugaaccuuauccugugaaagcauuaucugucccaaacagu

SEQ ID NO: 81282 - RNA, 51 nt, hsa
aaugcuuuagcaagauguaauccugugaauugaauuucucuucaaucaaag

SEQ ID NO: 81283 - RNA, 64 nt, hsa
ugugaagugacugaccuuaagauguuuccauucuccugugaauuuuaacuugaacucauuccug

SEQ ID NO: 81284 - RNA, 64 nt, hsa
auugugguguaaaugaacuuucacaauauuuucaccugugaacccaaauaaaaugauuaaaguu

SEQ ID NO: 81285 - RNA, 64 nt, hsa
ggggagcucuuuccugugucagaaccaguccugcccugugaauuacugcuacaaucaaggccac

SEQ ID NO: 81286 - RNA, 64 nt, hsa
ccucauaccuugcugggaagaaguuucuaguaguccugugaagauucauucuucuugcucuuuc

SEQ ID NO: 81287 - RNA, 64 nt, hsa
gagaaacuguacaaaugugaagaauauggcaaagccugugaaugguccacaaaccugaaugagc

SEQ ID NO: 81288 - RNA, 64 nt, hsa
agguccccuccucuccuagcuucccgccucugccccugugaacacccaucugcaguauccccug

SEQ ID NO: 81289 - RNA, 64 nt, hsa
cuaccuuaacuguuuuuaacauggauccucugugccugugaauuuacuugcaugcuuguacuug

SEQ ID NO: 81290 - RNA, 64 nt, hsa
gcgaagcuuuauaucuguuccuaaaacaguuaauccugugaaauaaauauugaacauaauccag

SEQ ID NO: 81291 - RNA, 64 nt, hsa
uaaaaaacuagcauauguaaagguauucguuaauccugugaaugguagcuuuugcacagaacuu

SEQ ID NO: 81292 - RNA, 64 nt, hsa
aaaacuugugugcauuauaaccuaagcugugcaaccugugaagccaagagugaacugauguuuc

SEQ ID NO: 81293 - RNA, 64 nt, hsa
gcaaauugguacauaugcauuuuucuggagagagccugugaaacugaacagauuuucaguggga

SEQ ID NO: 81294 - RNA, 64 nt, hsa
aaggguuaauuuucguguguguguucucuaaaauccugugaacaugacuuaaccagcuuaacau

SEQ ID NO: 81295 - RNA, 64 nt, hsa
acgguuucauuuaaaaaguaacuuuuuuuuuuugccugugaauugagugcucugauguaaaacu

SEQ ID NO: 81296 - RNA, 64 nt, hsa
aauuaauauaauuaaaagcaacagcaagcagcagccugugaagauuuugcucaucuuuuuuaug

SEQ ID NO: 81297 - RNA, 64 nt, hsa
aauucuauuuuauauauauauauauguuucuuuuccugugaaaagcuguuuuucucacauguga

SEQ ID NO: 81298 - RNA, 64 nt, hsa
uaaaucagcaaaauauuguaauaaagaaaucuuuccugugaagauaccaugaccccauggaugg

SEQ ID NO: 81299 - RNA, 64 nt, hsa
uguuuccuuugugacucaagguugaauuaaaaugccugugaacugcaaacuugcuuaugauuga

SEQ ID NO: 81300 - RNA, 64 nt, hsa
cuuucaaaagacaccugccuuaugcaaggggaaaccugugaaagcugcacucagagggaggagu

SEQ ID NO: 81301 - RNA, 64 nt, hsa
acaacaaacagugcagccugacugggaacaggauccugugaaagcugaugcccaugugcccuga

SEQ ID NO: 81302 - RNA, 64 nt, hsa
uagguguggucccauaggagcagccuuagcauccccugugaacuuaucaaaaaugcaaauucuc

SEQ ID NO: 81303 - RNA, 64 nt, hsa
aggagauacaacagaggagauaaucuccaggaugccugugaagaaagaucccuggaucccagga

SEQ ID NO: 81304 - RNA, 64 nt, hsa
aaguaaaucuugaacagguucacuaagcacccacccugugaaaaguauuauggaaaucacugcu

SEQ ID NO: 81305 - RNA, 64 nt, hsa
aacucucuaaguacauccaccuguguaauaggaaccugugaauuguacuggaugauuaauacaa

SEQ ID NO: 81306 - RNA, 64 nt, hsa
ccaggagacggggugaagcuauuccccacacucuccugugaacacuggagucuugcaagaccca

SEQ ID NO: 81307 - RNA, 64 nt, hsa
uugaauguaauuccauuauauuuccuuuuguacaccugugaaaaaguggaguaguguuuuuuua

SEQ ID NO: 81308 - RNA, 64 nt, hsa
cccggugacagggugcucacuggcaccccaucuuccugugaauaacucaaauaauuagaaaaug

SEQ ID NO: 81309 - RNA, 64 nt, hsa
agugggcggcaguguuccuggcaugaccaggauuccugugaaagcaggagcagcagcaagccgu

SEQ ID NO: 81310 - RNA, 64 nt, hsa
cucccccagccuugaggugcccugcccggcggggccugugaauaugcaaugggagucccaggcu

SEQ ID NO: 81311 - RNA, 64 nt, hsa
ucguggccuccuucccccacucccuaucccuucaccugugaaaugccuuugcuuugcauauugu

SEQ ID NO: 81312 - RNA, 64 nt, hsa
uagucacuuuaggaguugggacagagucgagcacccugugaaagucucccuugaguucaggugc

SEQ ID NO: 81313 - RNA, 64 nt, hsa
caggaguuccagccugaaguaugcugugaucaugccugugaauaaccacugcacuccagccagg

SEQ ID NO: 81314 - RNA, 64 nt, hsa
ggacuggaguguaaugcucggugggagccgucagccugugaacugccaggcagcugcaguuagc

SEQ ID NO: 81315 - RNA, 64 nt, hsa
uauguuugcgaauggcuuuuuaaaaucauauuuaccugugaaucaaaacaaauucaagaaugca

SEQ ID NO: 81316 - RNA, 64 nt, hsa
accaccucuucuuaucaaaauuugcaacuuucuuccugugaaaauaggcuuauaguuccuuaac

SEQ ID NO: 81317 - RNA, 64 nt, hsa
uugcuacaucagcacugggcauucuuggagggauccugugaaguauuguuaggaggugaacuuc

SEQ ID NO: 81318 - RNA, 64 nt, hsa; identical to SEQ ID NO: 81303

SEQ ID NO: 81319 - RNA, 64 nt, hsa
uaggcauuuggucucacuacuugaccauucucacccugugaaacgucccacacuuugaagcaaa

SEQ ID NO: 81320 - RNA, 64 nt, hsa
uagugugacauuccaaucauuuaguauuuuaggaccugugaauaacuuccaacaaaauuaauga

SEQ ID NO: 81321 - RNA, 64 nt, hsa
gagcuuucauuaaauugcgucugaugcaaguuauccugugaaucacaaaguguacugucucaaa

SEQ ID NO: 81322 - RNA, 64 nt, hsa
cauacucaucauuucuuuguucagcuccacauuuccugugaaacuaacaucuuauugagauuug

SEQ ID NO: 81323 - RNA, 64 nt, hsa
uuuuuggcuuuuguaauggaauccauguucacauccugugaacucugucuccugaaacccugaa

SEQ ID NO: 81324 - RNA, 64 nt, hsa
aucccuaaugugugccauagaguuuaacacaaguccugugaauuucuucacuguugaaaauuau

SEQ ID NO: 81325 - RNA, 64 nt, hsa
cacuuuaucuuuaguaucaugaugauuggaaaaaccugugaaguuguuaaggcacucucauuug

SEQ ID NO: 81326 - RNA, 64 nt, hsa
ugccuuguggguggcuuggcgcucgugauugcuuccugugaacgccucccaaggacgagcccag

SEQ ID NO: 81327 - RNA, 64 nt, hsa
uaucauaggucuaaaaauauuuguuuacuaaauaccugugaagaaauaccauuaaaaaacuauu

SEQ ID NO: 81328 - RNA, 64 nt, hsa
ggagagaagaaugagccuacgcugaagauggcauccugugaaguccuucaccucacugaaaaca

SEQ ID NO: 81329 - RNA, 64 nt, hsa
uuacuugcauuuauccggcauuauuucaacaccuccugugaagaaaguacuuuucuggcauagc

SEQ ID NO: 81330 - RNA, 64 nt, hsa
ucuguuucuuccuguuggguggcaauuaauuaauccugugaagguuacauugcugcugcuagag

SEQ ID NO: 81331 - RNA, 64 nt, hsa
acaggaaaacccaccuauggaauaggugccuaucccugugaagaugaaccucuggcccuuccag

SEQ ID NO: 81332 - RNA, 64 nt, hsa
cagggcuggaagaagcggcacccgggggcgcucaccugugaagccaucugcgccaagccuugcc

SEQ ID NO: 81333 - RNA, 64 nt, hsa
ucuguuuaguugagaggcugugauuuuacucuugccugugaaccucaugcaugaaagcagcaca

SEQ ID NO: 81334 - RNA, 64 nt, hsa
cauauguuuuaucuuuaaaauuauucuuauuuuaccugugaauauauacaacagaacuuuuuaa

SEQ ID NO: 81335 - RNA, 64 nt, hsa
aagaacaaaguuuacuucaacuaaaauguuucuuccugugaagacauaugguaucauuuuaauu

SEQ ID NO: 81336 - RNA, 64 nt, hsa
uccaaagaugugauuacuuuucuucuaauuucuuccugugaauaaucaaauauauucuauuuaa

SEQ ID NO: 81337 - RNA, 64 nt, hsa
ucaucccuuuucagaauauagggcuccucucauuccugugaacccccaguccuggcuucuuugu

SEQ ID NO: 81338 - RNA, 64 nt, hsa
aaugaagucccucacugagccucagauuuccucaccugugaaaugggcugaggcaggaaauggg

SEQ ID NO: 81339 - RNA, 64 nt, hsa
gggcucccuggcuacugggaagauacagaaccauccugugaaaaucauuucagcacuggagacc

SEQ ID NO: 81340 - RNA, 64 nt, hsa
agguacacagcacaucugcagucauucaggagguccugugaaguguggugaugcaucuaacacc

SEQ ID NO: 81341 - RNA, 64 nt, hsa
ugacaggacaaagcaaaaacaaacaaaaagcaagccugugaauauaauuuaauuugaaacugcu

SEQ ID NO: 81342 - RNA, 64 nt, hsa
gaugcuggcucaggcucagagccucucaucaccgccugugaaauggggaccacccuccuaaucu

SEQ ID NO: 81343 - RNA, 64 nt, hsa
auuucuagaaacaaacaucuaauaaguauauaauccugugaaaauaugaggcuugauaauauua

SEQ ID NO: 81344 - RNA, 64 nt, hsa
uauuuuagguaagcuucuguguaaagcuaaaaauccugugaauacaauacuauccuuuacaggc

SEQ ID NO: 81345 - RNA, 64 nt, hsa
gcucacugcuugggcccccuugauuucuaagacaccugugaagggucccacaaggccaggcaca

SEQ ID NO: 81346 - RNA, 64 nt, hsa
gaaaaaccuuacaaaugugaagcaucugauaaauccugugaagcgucugauaaauccuguaguc

SEQ ID NO: 81347 - RNA, 64 nt, hsa
gacuucuacaggacuucuacgugugugauaaaagccugugaaucgugagucccugaaauauggu

SEQ ID NO: 81348 - RNA, 64 nt, hsa
uauucuuucuguaaagucaaacaggauuccauccccugugaaauaacacaaaauuucacucucu

SEQ ID NO: 81349 - RNA, 64 nt, hsa
ccccaaccucacggaccaagaggaucccuggcugccugugaauggcccacauuugaguggugcu

SEQ ID NO: 81350 - RNA, 64 nt, hsa
ucggaugccgcuguccugggggagcccgcgggagccugugaauguugauacgagcuggccaguc

SEQ ID NO: 81351 - RNA, 64 nt, hsa
ugcaguaauugcuuuaugcggcuguaauccauaaccugugaagacagcacaucaucuaaauccc

SEQ ID NO: 81352 - RNA, 64 nt, hsa
cuuucaugugacuggagucaucuuguccaaacugccugugaauauaucuucucucaauuggaau

SEQ ID NO: 81353 - RNA, 64 nt, hsa
caggugaaucucuuccuuuaagccauuuuugucuccugugaauacagccuuaucuccaccuguu

SEQ ID NO: 81354 - RNA, 64 nt, hsa
uuucugauguacaagccccuggggcucuguugaaccugugaaauacugacaaugucuucuaccu

SEQ ID NO: 81355 - RNA, 64 nt, hsa
cauuuaaaucaguuaugguguagcugcugcaauuccugugaauacccgaaaccugcuguuauaa

SEQ ID NO: 81356 - RNA, 64 nt, hsa
ggagccagccauguaagaaucagagcugcuccuuccugugaauccuagguggcccuaugucuuc

SEQ ID NO: 81357 - RNA, 64 nt, hsa
aguacguagaccagugucgucgugagggugggacccugugaaggucugaccaccguuucgcuuu

SEQ ID NO: 81358 - RNA, 64 nt, hsa
gacaccagcacuucugcuugcugggcuggcuggaccugugaagccaugggcagguagugcccuc

SEQ ID NO: 81359 - RNA, 64 nt, hsa
gagggaaaggaaaagccccuggaaaugcgugugaccugugaagugguguauugucacaguagcu

SEQ ID NO: 81360 - RNA, 64 nt, hsa
aauaucuucuacugccaaacuucuggcaaauuuaccugugaauuucaaaauguuauaaaaucuc

SEQ ID NO: 81361 - RNA, 64 nt, hsa
ccaacaaccgcugacuccaggauugcauaagcccccugugaaaucggugcuguacugcauaccc

SEQ ID NO: 81362 - RNA, 64 nt, hsa
uguaguuccucauugaacaugugauaaucuaauaccugugaaaacugacuaaucagcugccaau

SEQ ID NO: 81363 - RNA, 64 nt, hsa
aauuugaauuuugucguguuuggguuuguucauuccugugaaugaugguacaguuaggugagau

SEQ ID NO: 81364 - RNA, 64 nt, hsa
agacuuguauuuuuuauugucucugaacuuuaauccugugaaaaugcucaaaguuuuggcgaga

SEQ ID NO: 81365 - RNA, 64 nt, hsa
caaaacuuguuucuuaaaaaugcgguuaauaaugccugugaacuaaaaaaaugggaagcccucc

SEQ ID NO: 81366 - RNA, 64 nt, hsa
uugaguggaaaaguguuucuuuaguuuggaaagaccugugaaguauccuagucagggaaagaac

SEQ ID NO: 81367 - RNA, 64 nt, hsa
uuauaccauuguuuuuucccucaaguauuuuuucccugugaagaagauuauuuaucugcuuuua

SEQ ID NO: 81368 - RNA, 64 nt, hsa
gcacaaaucuugggucuuggggacuaacccaaugccugugaagcagucagcccuuauggccaau

SEQ ID NO: 81369 - RNA, 64 nt, hsa
cuccgcuuugccugcaaaaguaacccaguugcacccugugaagugucugacaaaggcagaaugc

SEQ ID NO: 81370 - RNA, 64 nt, hsa
cgacuacuauaaaaagacaaccaacggccgacugccugugaaguggauggcacccgaggcauua

SEQ ID NO: 81371 - RNA, 64 nt, hsa
uuuuuguaugucuuuugagauccugaguucauccccugugaaucagagugcacaagcaccucuc

SEQ ID NO: 81372 - RNA, 64 nt, hsa
gcacacucaggcuaucugagauacugguaaucauccugugaaaaauguacagagaugcaggucu

SEQ ID NO: 81373 - RNA, 64 nt, hsa
uuaugugucugccacauuaacuacacgguucaaaccugugaagaaaggaccugcaaacgcuuca

SEQ ID NO: 81374 - RNA, 64 nt, hsa
gcugcaaaacaucacaaagugaccggucuugagaccugugaacugcugcccuguuuaguaaaua

SEQ ID NO: 81375 - RNA, 64 nt, hsa
gguuauucuuggaaguagcauuuuuuuucccucuccugugaaucugugcaaaacauugaaggua

SEQ ID NO: 81376 - RNA, 64 nt, hsa
caaggcuggcacaggcuuuggggaagcccuggagccugugaagacccuggaaaccucaugaggc

SEQ ID NO: 81377 - RNA, 64 nt, hsa
gaaaggagagaggauaagaagggaaaguucacaaccugugaacagggacuugagcacgagacac

SEQ ID NO: 81378 - RNA, 64 nt, hsa
aaggauucuuaucacauaaugugcaggccaugugccugugaacuugaaguuugcgcaaaaugug

SEQ ID NO: 81379 - RNA, 64 nt, hsa
uucuaucaggggugcauucuggccaaggggugggccugugaaucaauccugggcaaucagacac

SEQ ID NO: 81380 - RNA, 64 nt, hsa
uggaggcugcccuaccugggaaggcaccccagcaccugugaaggacauuuacugcucauccuca

SEQ ID NO: 81381 - RNA, 64 nt, hsa
gugagaaggagccacaaguuguggcugagaguucccugugaacuugaguaguucauagagugcu

SEQ ID NO: 81382 - RNA, 64 nt, hsa
uuggagcuggaagaaucugcucuccgguggcugcccugugaacagagggcucccggucagcuuc

SEQ ID NO: 81383 - RNA, 64 nt, hsa
agccaagggcccacguccucaccacaaagggacuccugugaaacugcugccaaaaagauaccaa

SEQ ID NO: 81384 - RNA, 64 nt, hsa
uauccccgugguucaucugauauaauuaguguucccugugaauucccccccucuaugggaagga

SEQ ID NO: 81385 - RNA, 64 nt, hsa
agaugaugaggucuuugaaguaauucugaacuccccugugaaugcaguucuuggcacaaagaca

SEQ ID NO: 81386 - RNA, 64 nt, hsa
aacauaguggguauaaucauggaucgcuuguaccccugugaaaauauauuuuuuaaaaauaucu

SEQ ID NO: 81387 - RNA, 64 nt, hsa
auauaauuccuggacuggugagauuggugguaggccugugaaauuugcccuaguuacuaccauu

SEQ ID NO: 81388 - RNA, 64 nt, hsa
gaugugggaaagagcccauuggaggauaugagguccugugaaauucaguuguguguguggcucc

SEQ ID NO: 81389 - RNA, 64 nt, hsa
auuguugcaauggcuaaaucccaaacauccuuggccugugaagucuucauuuccagaauacuga

SEQ ID NO: 81390 - RNA, 64 nt, hsa
cccucggagagagguggugggaugggagagagccccugugaaagccugugaggaucugaagagu

SEQ ID NO: 81391 - RNA, 64 nt, hsa
ccaggaguuuaagguuguagugcgcuagacggcgccugugaauagccacugcacucuagucugg

SEQ ID NO: 81392 - RNA, 64 nt, hsa
acuguuaccagacagaggcaacugaugaaaaagcccugugaaagauaggaugugaggugagcau

SEQ ID NO: 81393 - RNA, 64 nt, hsa
ugguaauagagcaaccauagccuuaacuuacagaccugugaaauaaagggcauuuugaccuaau

SEQ ID NO: 81394 - RNA, 64 nt, hsa
gagguagacaguuucaaacaucacaguuugaaugccugugaaugacaagucagugggaaagagc

SEQ ID NO: 81395 - RNA, 64 nt, hsa
ucuauuuacauguaugucaacucauuacuuuuuuccugugaacaguauugaaaaaccccaacgg

SEQ ID NO: 81396 - RNA, 64 nt, hsa
aggggaaaauuuugggaugggggacucaggaggaccugugaagcauguaguuaucuagaucugg

SEQ ID NO: 81397 - RNA, 64 nt, hsa
uggugaccucauucagucgguuaagagccugagcccugugaaguuaaacaccugcucaugguca

SEQ ID NO: 81398 - RNA, 64 nt, hsa
agcugcagugaaggcugugggaagggugucagauccugugaagaauggcaaaacagccugaccu

SEQ ID NO: 81399 - RNA, 64 nt, hsa
guaaugguuuccaucuccgauuuccucaucagggccugugaauacccaggugccuguaucuuug

SEQ ID NO: 81400 - RNA, 64 nt, hsa
gcccuacuggccuucccccaccacagcagcccugccugugaagcucuuguuucugacauuucac

SEQ ID NO: 81401 - RNA, 64 nt, hsa
cugucuguugugugugugccucaagcccuguuuuccugugaagauacuuugaguggcagccauu

SEQ ID NO: 81402 - RNA, 64 nt, hsa
uuauguuguauuacaauguauguagaaauaguaaccugugaacuaugcuuuuccauaacuuuuu

SEQ ID NO: 81403 - RNA, 64 nt, hsa
auguauuuucuucauugcagguccaccuaaucauccugugaaagugguuucucuauggaaagcu

SEQ ID NO: 81404 - RNA, 64 nt, hsa
gacuuaagccugguuucucaguuacugagagaggccugugaacaguucuagcuaugaucaugaa

SEQ ID NO: 81405 - RNA, 64 nt, hsa
ggcagacggguucagccugcagaacuggaggcgaccugugaaacccacccgggcaccccaacag

SEQ ID NO: 81406 - RNA, 64 nt, hsa
cgcccugccggaggacacuguaguuuuugagaagccugugaagaccauccacuggaacgggucc

SEQ ID NO: 81407 - RNA, 64 nt, hsa
cagaccacccacuucugcugaaaugcauugggagccugugaaagcacaaagcuggaggcugggc

SEQ ID NO: 81408 - RNA, 64 nt, hsa
aagugcaugaguucuuuacuggauuuuuuaaaaaccugugaaccccccgaaacuguaugugaaa

SEQ ID NO: 81409 - RNA, 64 nt, hsa
gauagggaagaaggccugcucaccaaugaugaggccugugaagccacgggcugggucauaagga

SEQ ID NO: 81410 - RNA, 64 nt, hsa
aagcuuugcacucaaguauugucaagggaagcuuccugugaaccaaaguucucaggccaagguc

SEQ ID NO: 81411 - RNA, 64 nt, hsa
guuggauggcgguuauuuuuaaacuuaauuaauaccugugaaaaggccucuuaccuuuauguau

SEQ ID NO: 81412 - RNA, 64 nt, hsa
gcgucuguguccuugcugccuucauccccuggggccugugaauaaagcugcagaacccccuuca

SEQ ID NO: 81413 - RNA, 64 nt, hsa
acagacuacuguugggucccugauuccaggcuggccugugaaggauugccccagguguccccuu

SEQ ID NO: 81414 - RNA, 64 nt, hsa
accacauuugaaauuguuuucccuuucauuuuacccugugaaagcaucucuccuagagccuugc

SEQ ID NO: 81415 - RNA, 64 nt, hsa
gccucuuuuaugguuuaauggccaccuguucucuccugugaaaggcuuugcaaagucacauuaa

SEQ ID NO: 81416 - RNA, 64 nt, hsa
uacuguaggaauccuauuuauauuauuuuucaguccugugaaugcugugaaaagauuuauuccu

SEQ ID NO: 81417 - RNA, 64 nt, hsa
auacugggacuucagaagugcaauguauuuuucuccugugaaaccugaaucuacaaguuuuccu

SEQ ID NO: 81418 - RNA, 64 nt, hsa
aaggugaauggccugcucucccuggcccuaucagccugugaacuucacuuaggccccaagcuga

SEQ ID NO: 81419 - RNA, 64 nt, hsa
uggcugccuucuuuccaucaacucccaacuucuuccugugaaguuuaauugucucaacgccucc

SEQ ID NO: 81420 - RNA, 64 nt, hsa
auguuuauauuguauuguucuaaauaauggguagccugugaaauaagaucuugccacccaugua

SEQ ID NO: 81421 - RNA, 64 nt, hsa
ugaaacaguuuugucuugcaguggaaagagacuuccugugaauguuucucaacugguuucuacu

SEQ ID NO: 81422 - RNA, 64 nt, hsa
ugacuucuuucacaaguacuaucuguuccccuguccugugaauggaagcaaagugcuggauugu

SEQ ID NO: 81423 - RNA, 64 nt, hsa
aauuuucuuuguguucugaauucucagacuugguccugugaaauacaggcacaaaauguaucug

SEQ ID NO: 81424 - RNA, 64 nt, hsa
guguggaugcagagagagugugacagaggaucugccugugaaccaccugggauuagucaagucc

SEQ ID NO: 81425 - RNA, 64 nt, hsa
uuauuuuuagaagcuaaagaaaguaauuaugcuuccugugaauugucuuuuacuggcaucuuug

SEQ ID NO: 81426 - RNA, 64 nt, hsa
aaagaguuugcucacguaaacgcccgugcugggcccugugaagccagcauguucaccacugguc

SEQ ID NO: 81427 - RNA, 64 nt, hsa
cugacucuuccugguagguguaacagauaguucaccugugaacgaacaucagcuuacagaugau

SEQ ID NO: 81428 - RNA, 64 nt, hsa
gacuuuucuaucauuuccauuuuauaaauugccaccugugaaaaugguuuuugcacauuauuug

SEQ ID NO: 81429 - RNA, 64 nt, hsa
aauucuuuuuuuuugcuuacucuauuuuuuuuaaccugugaaauuucuuuacaguuuuccaaga

SEQ ID NO: 81430 - RNA, 64 nt, hsa
gcgugaagcagugugggccugaagugugauuuggccugugaacuugggcugugccagggcuucu

SEQ ID NO: 81431 - RNA, 64 nt, hsa
aggaaagaugcccaauuguacuuuuguucuauagccugugaaauggcuaguugaucauuuuucc

SEQ ID NO: 81432 - RNA, 64 nt, hsa
ugaguuaaagcagugcuucucaaaccuugaugugccugugaaucaccuaggggucuuguuaagu

SEQ ID NO: 81433 - RNA, 64 nt, hsa
gaguggagguuuucaaagugcaucaucagcauuaccugugaacuugcuggaaauacaaauccuc

SEQ ID NO: 81434 - RNA, 64 nt, hsa
aacauguauaacaaaaagcucucuccagaucaucccugugaaugccaaaguaaacuuuauguac

SEQ ID NO: 81435 - RNA, 64 nt, hsa
gagcaaguaacauuaacucaguggaaggcauuguccugugaaauauucuuaggcagaucugccc

SEQ ID NO: 81436 - RNA, 64 nt, hsa
acgcucuuccucuucauaacugcuuugcaaguuuccugugaaaacaucaguuuccuguaccaaa

SEQ ID NO: 81437 - RNA, 64 nt, hsa
uuuauucaucauggguaccacaggaaccugggggccugugaaacuacaaccaaaaggcacacaa

SEQ ID NO: 81438 - RNA, 64 nt, hsa
gugagugcggcaaucccucauccucuuagaagcaccugugaaugggaauugagccaacuguuau

SEQ ID NO: 81439 - RNA, 64 nt, hsa
gaaucaaagauucagcccuacaaggauauguuuuccugugaaauuaucuaagagguagguuuag

SEQ ID NO: 81440 - RNA, 64 nt, hsa
uuacaugugauuauuuuaaaauuugauuaugaaaccugugaagugugcucuuccaugauguuga

SEQ ID NO: 81441 - RNA, 64 nt, hsa
augugaaugcuuuuguaguaaccaucuuguaguaccugugaaaucuauaacucagaaaugguca

SEQ ID NO: 81442 - RNA, 64 nt, hsa
gcucuccauuaucaccuuuauacaaaauguacauccugugaauucuguuccagauuucacaccu

SEQ ID NO: 81443 - RNA, 64 nt, hsa
cggaaagcagaagggauuuaggacuacgucuccuccugugaagaauucccuugcguauucucuc

SEQ ID NO: 81444 - RNA, 64 nt, hsa
acccccacauaacaugcauuugcaugggcccgaaccugugaaauguuacguuugugcuucauuu

SEQ ID NO: 81445 - RNA, 64 nt, hsa
cugcguggauguuuccuuaaccucagcugacuucccugugaaugucuaaugcuaguucagggcc

SEQ ID NO: 81446 - RNA, 64 nt, hsa
gagguccugagcacugccaggagggacaaaggagccugugaacccaggacaagcauggucccac

SEQ ID NO: 81447 - RNA, 64 nt, hsa
cuuauagaguagaacauucacagcaaagaagaauccugugaauguccaaaagccuuccagaagu

SEQ ID NO: 81448 - RNA, 64 nt, hsa
gguacaguuguaagucagaguuaauauaauagggccugugaaaacagaggcuuuugcauugucu

SEQ ID NO: 81449 - RNA, 64 nt, hsa
uaauaagaagcacuuaauuuacacauauuuuaauccugugaaagauuccacauagagaaaagaa

SEQ ID NO: 81450 - RNA, 64 nt, hsa
uccaugauucaaaaucuaagcaguuucgauuuugccugugaauauggugucugucauucagggc

SEQ ID NO: 81451 - RNA, 64 nt, hsa
uauucccagaguuuugguuuuugaacuagcaaugccugugaaaaagaaacugaauaccuaagau

SEQ ID NO: 81452 - RNA, 64 nt, hsa
gccugauugggguggggacuguccuacuguaaccccugugaaaaaccuugaaauauaacacucc

SEQ ID NO: 81453 - RNA, 64 nt, hsa
guaaccccaacugaaaugaggagcuuccucucuuccugugaaggauaugacaguccagcaucga

SEQ ID NO: 81454 - RNA, 64 nt, hsa
auuugggagcuggagaacagggguuaucccuaccccugugaacucuguuaacagcuuacauagg

SEQ ID NO: 81455 - RNA, 64 nt, hsa
gucacaucaaccgccagaaguggaguugggcagcccugugaagccagaggagauggacuggucu

SEQ ID NO: 81456 - RNA, 64 nt, hsa
uaugggccagccuggauauacaacagaguaguaaccugugaaacaaacauagaauauccucuua

SEQ ID NO: 81457 - RNA, 64 nt, hsa
cuucugcauuugguugguuuccugaagcgcagccccugugaauaacagguggcuuuucauggau

SEQ ID NO: 81458 - RNA, 64 nt, hsa
caugguggacgcguucugcucacgggcccagagcccugugaaaugcaucaagguccucuccgcu

SEQ ID NO: 81459 - RNA, 64 nt, hsa
ccugucugaguaagcccucaggagccucugcuccccugugaacccacugaaccuucugagcccc

SEQ ID NO: 81460 - RNA, 64 nt, hsa
gggcugggagaguggaguucccguagggcauaggccugugaaguaacacuggggcagauaugua

SEQ ID NO: 81461 - RNA, 64 nt, hsa
gggcuuuaaggaggccaauuugcugcgcgggugaccugugaaaggucacagucauuuuuguagu

SEQ ID NO: 81462 - RNA, 64 nt, hsa
uuccaagaauuuuauaguacaucuuguuugucucccugugaaaacaacuggaaucuuaaaaaag

SEQ ID NO: 81463 - RNA, 64 nt, hsa
caguuuugagaauaggaaagauuccgccugcuuaccugugaagacauaagaaaaucuuaguaac

SEQ ID NO: 81464 - RNA, 64 nt, hsa
ugagguguuugcauguggccauuaccgucauuggccugugaagcauuggacauuuauagauaau

SEQ ID NO: 81465 - RNA, 64 nt, hsa
ccaaaagacuuuuuugaaucugucauucacauacccugugaagacaauacuaucuacaauuuuu

SEQ ID NO: 81466 - RNA, 64 nt, hsa
aguggccaagcgcgcaagggcgcgggcgagcaggccugugaauucgcaggaucauuucagaccc

SEQ ID NO: 81467 - RNA, 64 nt, hsa
gccaugaagggccaggaugcccagaugcuuggccccugugaagugcugucuggagcagcaggau

SEQ ID NO: 81468 - RNA, 64 nt, hsa
caccuuacuguucaccucaucaaaucaguucugcccugugaaaagauccagccuucccugccgu

SEQ ID NO: 81469 - RNA, 64 nt, hsa; identical to SEQ ID NO: 81468

SEQ ID NO: 81470 - RNA, 64 nt, hsa
cacuggcaacauauuugaaauaagugaauauuguccugugaaaagaauagcaggacuuuuagau

SEQ ID NO: 81471 - RNA, 64 nt, hsa
gcaugguguagaugcccugauaaagaacaucuguccugugaaagacucaaugagcuguuauguu

SEQ ID NO: 81472 - RNA, 64 nt, hsa
cauggcugaaacuugagggugacuaaaaguaaugccugugaaacaugauaucuaucugggaugg

SEQ ID NO: 81473 - RNA, 64 nt, hsa
agugaugcauagggaaacaggggacaugggcacuccugugaacaguuuuucacuuuugaugaaa

SEQ ID NO: 81474 - RNA, 64 nt, hsa
uuaauaacacuuuauuuauaaagcaccucaauguccugugaacacuaauuauuuuaaauguguu

SEQ ID NO: 81475 - RNA, 64 nt, hsa
cagcagcugaaacucuucaauguuugaauggcugccugugaagguagugagugccccaucacug

SEQ ID NO: 81476 - RNA, 64 nt, hsa
auuacaggcgugagacacugcgcccagccucaucccugugaauuucuuauuguacacaaguucu

SEQ ID NO: 81477 - RNA, 64 nt, hsa
gccucccaggcauucucagugccagggcuucaucccugugaaggcacagggccugcuagugggc

SEQ ID NO: 81478 - RNA, 64 nt, hsa
ucagcauggcuuaugugcacguguaaauggagucccugugaaugacagcauguuucuuacauag

SEQ ID NO: 81479 - RNA, 64 nt, hsa
ucuccaaucuccauuacauagggacuguacagagccugugaagauguaugaaugguaucuuuua

SEQ ID NO: 81480 - RNA, 64 nt, hsa
auuuauccagaugcaugucaucucaaggacaaagccugugaaaguacaagugagaugguugcau

SEQ ID NO: 81481 - RNA, 64 nt, hsa
ggaucccagcuagacuuagaacuuggacuuuuccccugugaagggggcugccaggacaucucag

SEQ ID NO: 81482 - RNA, 64 nt, hsa
uauugaaaugcagaucccagagucaguaaaucugccugugaaguaugauagucugcauuuguaa

SEQ ID NO: 81483 - RNA, 64 nt, hsa
uucggagaaugagccaggucagucacugggaggaccugugaaagaaaguuggucacugagugcc

SEQ ID NO: 81484 - RNA, 64 nt, hsa
gggccagaguauuggucuccucucagccccugauccugugaaguaaggaugugggggaagaccu

SEQ ID NO: 81485 - RNA, 64 nt, hsa
ucuggucuuuucuuuucauuguauuuuaagcuuaccugugaauagcccaauaaacaugacacac

SEQ ID NO: 81486 - RNA, 64 nt, hsa
caguacuaggcagaacagcccccgaucugcauagccugugaaagcccacggggacaucaguaac

SEQ ID NO: 81487 - RNA, 64 nt, hsa
cuuaucaccuuuauuagauaaaucaugaagugucccugugaaauugaagugaaacuaucucugu

SEQ ID NO: 81488 - RNA, 64 nt, hsa
uggccuugggguucagguuccuucuucccucccuccugugaaguuacacuguaggacacaagcu

SEQ ID NO: 81489 - RNA, 64 nt, hsa
uucagcaaaaaaaaaaccuuaaccaggaagggggccugugaagguuaggacccuucccacagcc

SEQ ID NO: 81490 - RNA, 64 nt, hsa
uccuuuuugaauguucguggaagggccaggaguuccugugaaaccaggauacugcagcuuuauu

SEQ ID NO: 81491 - RNA, 64 nt, hsa
cgagaggggacucgcggccgcgauggcaaggcauccugugaauucaugcgcugcgaguggcggg

SEQ ID NO: 81492 - RNA, 64 nt, hsa
gcucccuuucccuccccuuuuuuuuuucuuuguuccugugaaauguuaaucuccgugaguucuu

SEQ ID NO: 81493 - RNA, 64 nt, hsa
auggagcuacuacuguaaugcgugaacuaacaaaccugugaacuguaaauaggccccuggaagc

SEQ ID NO: 81494 - RNA, 64 nt, hsa
gcacuguccugacugcuccccaccagcacgcugaccugugaaccccagccucaccaucaccccc

SEQ ID NO: 81495 - RNA, 64 nt, hsa
auuucaaacggccucacuaggcuucugguugaugccugugaacugaacucugacaacagacuuc

SEQ ID NO: 81496 - RNA, 64 nt, hsa
uauaccaccuugacccauuugcuacauuccuuuuccugugaaauaugugagugauaauuaaaca

SEQ ID NO: 81497 - RNA, 64 nt, hsa
ccucugcauuuucccaucacauagaagacuuugaccugugaagcugccaucuguuaauacuaaa

SEQ ID NO: 81498 - RNA, 64 nt, hsa
gaaaaaagcucguccauguccgccauguacuuguccugugaagaguugagugcugugcuugggg

SEQ ID NO: 81499 - RNA, 64 nt, hsa
ccuaugagcccacgcccggccccacucccaccauccugugaaccccacuccacucgcacgugau

SEQ ID NO: 81500 - RNA, 64 nt, hsa
aaacaugccuuucuauuuauuagaguauuauauuccugugaaaauuuuucuaauuuucuucacu

SEQ ID NO: 81501 - RNA, 64 nt, hsa
ucugcagugccagcugacuuaagggagugaacuaccugugaaguagaaaaucagagggaaguuu

SEQ ID NO: 81502 - RNA, 64 nt, hsa
ggaggcgggucaaggcaaaaggaguaaugcaacgccugugaagccagccccacgcgcgcaccag

SEQ ID NO: 81503 - RNA, 64 nt, hsa
guguuggcugccaacagaacuucugacccuguuaccugugaaaugaggcaguuucccucacguu

SEQ ID NO: 81504 - RNA, 64 nt, hsa
cuaacuguugcguggaguucacaguucgacuaacccugugaacacccaagccaggaguucuaug

SEQ ID NO: 81505 - RNA, 64 nt, hsa
gcacaaacccucacaauacgcguuaacauugaaaccugugaaauguccuuaguuugggucauau

SEQ ID NO: 81506 - RNA, 64 nt, hsa
acaucccggguggcucuggggcucugaacucugaccugugaauagaagcagcaugcacuuugga

SEQ ID NO: 81507 - RNA, 64 nt, hsa
ugcggaacagccaacauagaguacuugcucucguccugugaauuuucuuucaugagggagucaa

SEQ ID NO: 81508 - RNA, 64 nt, hsa
auuauuacacugucuuuuugccaucaaaaugaggccugugaaauacaagguucccuucugcacc

SEQ ID NO: 81509 - RNA, 64 nt, hsa
uaagggccaguuuacuugucugccucuuugaccaccugugaacucuguuggguguacucugcua

SEQ ID NO: 81510 - RNA, 64 nt, hsa
cauuagggcacaaccuguuggauaguuuuagcuuccugugaacauuuguaaccacugcuucagu

SEQ ID NO: 81511 - RNA, 64 nt, hsa
auuacugauauuucauuauaauuaguucaccuucccugugaaacaagagaauuguaaaauguug

SEQ ID NO: 81512 - RNA, 64 nt, hsa
cuuugaaccaccugcaucccagcccuucaggaagccugugaaaaacgugauuccugggccccac

SEQ ID NO: 81513 - RNA, 64 nt, hsa
ugaagcugacaucuccaagagguacagcgggcgcccugugaaccugaugggaaccucucuguga

SEQ ID NO: 81514 - RNA, 64 nt, hsa
ccgagccacugcaaagcacagcugauccuggcccccugugaagaaguguucuggucaaaacuaa

SEQ ID NO: 81515 - RNA, 64 nt, hsa
uuugauaugauuuuaauucauuacagaaagaaacccugugaaggguauucaaaaacauaacuca

SEQ ID NO: 81516 - RNA, 64 nt, hsa
ucuucauaggagagcaacuguaggugaucauuauccugugaaaauauuuugaaccuaaaaagca

SEQ ID NO: 81517 - RNA, 64 nt, hsa
uucuggcaaauaagauucuaaaagcacuuauaucccugugaauacuucagaggacuuuggccuu

SEQ ID NO: 81518 - RNA, 64 nt, hsa
ugccuuuauuaaccagcauucuugauaugauccaccugugaacugaaucaugcaaggccaauug

SEQ ID NO: 81519 - RNA, 64 nt, hsa
cacagcugugugacgauuucuaaauguaggaaggccugugaaacaugacacugcaguuaaauug

SEQ ID NO: 81520 - RNA, 64 nt, hsa
acaaaugggaaaaccagacuacuugggagcaccgccugugaaauaccaaccugaagacaccguu

SEQ ID NO: 81521 - RNA, 64 nt, hsa
acguguucuucugucagggccaaaacucaaaucuccugugaaauacguauugauaauccaaucu

SEQ ID NO: 81522 - RNA, 64 nt, hsa
aauauggauuuccucauuucaguuccuucugcagccugugaaucuccacaaaguguuaccaguu

SEQ ID NO: 81523 - RNA, 64 nt, hsa
auguuagaaguccaggcagagacaauaaaacauuccugugaaaggcacuuuucauuccacuuua

SEQ ID NO: 81524 - RNA, 64 nt, hsa
ucaccccacccccccaccccccaucacacgugcuccugugaacuuuccaugguuaugucuacgg

SEQ ID NO: 81525 - RNA, 64 nt, hsa
uccuuguuuuugaaaguuagcauaauuuuagaugccugugaaauaguacugcacuuacauaaag

SEQ ID NO: 81526 - RNA, 64 nt, hsa
gaugcaguaguaggcacuguugauucaaauuuauccugugaaacuggcuuuauagaguuaacaa

SEQ ID NO: 81527 - RNA, 64 nt, hsa
uauacauaaauaaauauugggcuguuucccucuuccugugaagugguucucaaauuccuaugua

SEQ ID NO: 81528 - RNA, 64 nt, hsa
caucgguuguuuggcagcagcuuugaacguagcgccugugaacucaggaaugcacaguugacuu

SEQ ID NO: 81529 - RNA, 64 nt, hsa
agccauauugucaccucagcacuguggacaccucccugugaagagauccuuccauuccaucuag

SEQ ID NO: 81530 - RNA, 64 nt, hsa
aauuguggccaucuuugcaaaugacuaccuauagccugugaaaauacauuucaaaaaauguuau

SEQ ID NO: 81531 - RNA, 64 nt, hsa
ugcuuuuuuucaguuuugaaauauaguuugucauccugugaaaaccaccucguuugcuuuuugu

SEQ ID NO: 81532 - RNA, 64 nt, hsa
gggaucagccccuccugaguggccagccuuucccccugugaaagcaaaauagcuuggaccccuu

SEQ ID NO: 81533 - RNA, 64 nt, hsa
agcuuccccacugccucugugugccccuuugcguccugugaaggccauugagaaaugcccagug

SEQ ID NO: 81534 - RNA, 64 nt, hsa
aguuaccaacccugccugagccucaguuuccuccccugugaaaugagaacacgggguaacugcg

SEQ ID NO: 81535 - RNA, 64 nt, hsa
cgauuucauaaaaggacacacacuggagagaaacccugugaauguaagaaauguagaaaagcau

SEQ ID NO: 81536 - RNA, 64 nt, hsa
gaggugacuuuuguaacuuuuguucugugugugaccugugaaccacuaggaugugaucugcccu

SEQ ID NO: 81537 - RNA, 64 nt, hsa
ggaaggauacagaccaaacucuugauaguggucaccugugaagaguggagaagggaaaauaaug

SEQ ID NO: 81538 - RNA, 64 nt, hsa
cuguuccuucaagcaagcuggccugggccaugugccugugaaaggcaggcucuggccccuuucc

SEQ ID NO: 81539 - RNA, 64 nt, hsa
acuaggcagcagagaauucauacuggagagaagcccugugaauguuaacaaauguggaaaagcu

SEQ ID NO: 81540 - RNA, 64 nt, hsa
aaccaggagcccggaggaagggugaaagagaaagccugugaaauaggcagggccagaucaccca

SEQ ID NO: 81541 - RNA, 64 nt, hsa
ggauucaugugacagcucacacuaagggagaaaaccugugaaggucucagaaggcuucagugac

SEQ ID NO: 81542 - RNA, 64 nt, hsa
uaugugggaaagaauuucuguauuccucaccccaccugugaacuccuaccagagagaaaccuuu

SEQ ID NO: 81543 - RNA, 64 nt, hsa
ucagauacuuguacgaaacacauuggagauagacccugugaauguaagcacuugguaaagccuu

SEQ ID NO: 81544 - RNA, 64 nt, hsa
cacuuccagacucuccccucucccacccuucuacccugugaagggaaaugagggcuuuaguuuc

SEQ ID NO: 81545 - RNA, 64 nt, hsa
uuuacaaaauauauauauggagaugcucccucccccugugaaccccccagugcccccguggggc

SEQ ID NO: 81546 - RNA, 64 nt, hsa
cugauaauuuauacuaacuagaaacagaauugucccugugaaaucuuuuuauggcagguaauca

SEQ ID NO: 81547 - RNA, 64 nt, hsa
ccuuuuucugggacauuguuggucucauguuaugccugugaaggauuuguccagccuucauguu

SEQ ID NO: 81548 - RNA, 64 nt, hsa
ucuccucucuccccagaacauccagagucuguccccugugaagaagaagaagauggugccuggg

SEQ ID NO: 81549 - RNA, 64 nt, hsa
acuguauuuuacauaauugauuuucuacuccugcccugugaauuaaggcagaguuuuacuguaa

SEQ ID NO: 81550 - RNA, 64 nt, hsa
gggagacuuguucuagagaggaccagguuugaugccugugaagaacccugcagggcccuuaugg

SEQ ID NO: 81551 - RNA, 64 nt, hsa
gaguuuaagcauuaacagacaucagaguucaaauccugugaauauacuauguaugacagaagcu

SEQ ID NO: 81552 - RNA, 64 nt, hsa
uguagcguguggaccgguccacgcaauucuuuauccugugaacucaucugagugggagguggug

SEQ ID NO: 81553 - RNA, 64 nt, hsa
aacuaacacaugagcagucacuuuggagagaagcccugugaauacagugaauguaaggaucccu

SEQ ID NO: 81554 - RNA, 64 nt, hsa
ucguugcaggagggcaaacuaggugaauaaauuaccugugaaugaacaaugaagucguuccucu

SEQ ID NO: 81555 - RNA, 64 nt, hsa
augugcaaacaugggggugacaccacagagagaaccugugaaugcauucagaacaugauuggaa

SEQ ID NO: 81556 - RNA, 64 nt, hsa
accaucuccccccgccgggcuacgaugacauguaccugugaaggccucaagaauguaacauccc

SEQ ID NO: 81557 - RNA, 64 nt, hsa
guucugagcccccuuuucuggacaccaacuguguccugugaauguaucgcuacugugagcuguu

SEQ ID NO: 81558 - RNA, 60 nt, hsa
augacaucuuggauugcuagaagagaaggaccugugaaacuacugaggccagcugguauu

SEQ ID NO: 81559 - RNA, 64 nt, hsa
caggaguuuaaagcugcagugcccugugguugcaccugugaauaacugcacuccagccugggca

SEQ ID NO: 81560 - RNA, 64 nt, hsa
guaaugaaaguucagugacaaacuagauagugaaccugugaaagucauuauuuacauuugcuuu

SEQ ID NO: 81561 - RNA, 64 nt, hsa
agccggggcugccagcgcauccagccagcccagcccugugaaagauggagcugacuugcugcag

SEQ ID NO: 81562 - RNA, 64 nt, hsa
agcuguauuuuacccuugagcuuagccgcgggucccugugaaccggcacauuccuuuccuuuag

SEQ ID NO: 81563 - RNA, 64 nt, hsa
augacaaagacauaugugauguucuauguggaaaccugugaagaguggauucugccuccaucuc

SEQ ID NO: 81564 - RNA, 64 nt, hsa
ggucgugguugugcuggccucuugggugagugaaccugugaagcccaggaggugguguuggcug

SEQ ID NO: 81565 - RNA, 64 nt, hsa
aggccuggggccggcgagaaaucuccugugaugcccugugaaauggcuugucuccucccccauc

SEQ ID NO: 81566 - RNA, 64 nt, hsa
uauuaaacuugucagaauuucuuugucauucaagccugugaauaaaaacccuguauggcacuua

SEQ ID NO: 81567 - RNA, 64 nt, hsa
auauuguggacacauuaucuuauguuuugaaauaccugugaauuguuggcauugagcagcugaa

SEQ ID NO: 81568 - RNA, 64 nt, hsa
aacucaacuugagcucuugaacuccuccugugggccugugaauguauucauucauuccacaacu

SEQ ID NO: 81569 - RNA, 64 nt, hsa
caggaguuugaggcugcagugcacuaugcuugcaccugugaauagccacugcacuccaucuugg

SEQ ID NO: 81570 - RNA, 64 nt, hsa
ugacacgcagcgcguuggugucuccguguuugucccugugaaaacauguaacgucugccuuaga

SEQ ID NO: 81571 - RNA, 64 nt, hsa
aaaaauugacgauugcccugcauuucuaccaaguccugugaauaaagagaugggagauuugauu

SEQ ID NO: 81572 - RNA, 64 nt, hsa
uaaagucagugguacacagacauucuguacauauccugugaaacgugcugucauaugaaauaaa

SEQ ID NO: 81573 - RNA, 64 nt, hsa
guauggcagugggagacuaagauguauuaaccuaccugugaaucauauguuguaggaaaagcug

SEQ ID NO: 81574 - RNA, 64 nt, hsa
ccaaucacacaugauuggccucauugggucagcaccugugaaaggaagauuaaaaacucgacac

SEQ ID NO: 81575 - RNA, 64 nt, hsa
gacugugacuguugcccuuagccagccagaugcgccugugaaccaaagcuucgugcacaugugu

SEQ ID NO: 81576 - RNA, 64 nt, hsa
cuaagccuuaccaugagucagaguguuaagggggccugugaaccagucguuugguggaggaggg

SEQ ID NO: 81577 - RNA, 64 nt, hsa
ucucagagacucgcagcauagccauacaccucagccugugaaaugaacgauccggacccucacc

SEQ ID NO: 81578 - RNA, 64 nt, hsa
uucccagaaccccguuggggcagauguuacugaaccugugaaucagacgccaggagugagggcu

SEQ ID NO: 81579 - RNA, 64 nt, hsa
cccgcgccugagacuggcuggaaaugcucugacuccugugaaggcacagccagcguuguggccu

SEQ ID NO: 81580 - RNA, 64 nt, hsa
augaagccuuuuuccuggucccagcagcaucugcccugugaaguuuguuuucucccacugccuc

SEQ ID NO: 81581 - RNA, 64 nt, hsa
uggaccugcugggcaggaucccagggugaaccugccugugaacucugaagucacuaguccagcu

SEQ ID NO: 81582 - RNA, 64 nt, hsa
gggacaucugaggacauccgcagauucuugucagccugugaacuaggcccugccucugucaccu

SEQ ID NO: 81583 - RNA, 64 nt, hsa
ccccagcagccuccuacagagcaggaagaggcgcccugugaacccugaguguugcaggcccagc

SEQ ID NO: 81584 - RNA, 64 nt, hsa
ugugguucaagugugcacugggaggaggcugaggccugugaagccaaacaauaugcuccugccu

SEQ ID NO: 81585 - RNA, 64 nt, hsa
uugauguaaccuuuuaaaggccucaguucgcucaccugugaaaugggucuaagaauagcacuga

SEQ ID NO: 81586 - RNA, 64 nt, hsa
agcuauugcauuucauucugccucaguuugcccaccugugaaauggggcugauaccaccuaccu

SEQ ID NO: 81587 - RNA, 64 nt, hsa
uugcccccugccaucucgcacucagcccugggugccugugaagccuggccccacugccugccgg

SEQ ID NO: 81588 - RNA, 64 nt, hsa
uugggggcauaugaucaccagggcacacagugugccugugaaaauuuggcaccuacauuuguau

SEQ ID NO: 81589 - RNA, 64 nt, hsa
ucuucacaauuugugucucguuguucagaacaacccugugaaguaguuuuggcaaugucugugu

SEQ ID NO: 81590 - RNA, 64 nt, hsa
cgcagcguuaaugcgcauugcgugcgaaugaaccccugugaacgguugacuagaugaguaaucu

SEQ ID NO: 81591 - RNA, 64 nt, hsa
gccaugcaccaccucagaucuccaaacugaugucccugugaacaccugcacuaugagaagguuu

SEQ ID NO: 81592 - RNA, 64 nt, hsa
aaguacacauaaguuauuuccuaggauuuuucccccugugaacaggcauguuguauuauauaac

SEQ ID NO: 81593 - RNA, 64 nt, hsa
acagcuucgugucuaguaugagcucaguacuugcccugugaaaaucccagaagcccccgcuguc

SEQ ID NO: 81594 - RNA, 64 nt, hsa
gucacagaguaauggcauuaauccccauaauaauccugugaaggugauauucucaucccaucuu

SEQ ID NO: 81595 - RNA, 64 nt, hsa
gcaaaaaaaaaaaaaaaguugagugcucugcaggccugugaagggugccaccugagggagccgc

SEQ ID NO: 81596 - RNA, 64 nt, hsa
gguguuuuccaguauuacaagaucaacuucugacccugugaaaugugagaaguacacauuucug

SEQ ID NO: 81597 - RNA, 64 nt, hsa
cuacuuuauccuuccuuuuaauaguuccuuuagaccugugaaauuucuucacuacauuuaauag

SEQ ID NO: 81598 - RNA, 64 nt, hsa
auagggcuggagggcuauggauucccagcccaucccugugaaggaguaggccacucuuuaagug

SEQ ID NO: 81599 - RNA, 64 nt, hsa
cacaacuguauuucccaauacacuugagcaguugccugugaauguaagaggugucaacaaacug

SEQ ID NO: 81600 - RNA, 64 nt, hsa
uuuuuucuuuaauuuuaggacauuuaggguccccccugugaauuagaaaguugcuuggcuggag

SEQ ID NO: 81601 - RNA, 64 nt, hsa
uccacaaaugaugcaggugcaaaugguuuauagcccugugaaguucuuaaaguuuagaggcuaa

SEQ ID NO: 81602 - RNA, 64 nt, hsa
ucagacauagauuucauaguauuuuucugagaauccugugaaggaacgcugucucuuugcaaag

SEQ ID NO: 81603 - RNA, 64 nt, hsa
ucugaacacaagcauuucacuucuccaagaaguaccugugaacaguacaauauuucaguauuga

SEQ ID NO: 81604 - RNA, 64 nt, hsa; identical to SEQ ID NO: 81603

SEQ ID NO: 81605 - RNA, 64 nt, hsa
ccagguuuaucuuugucuuaucuaccaguuuauuccugugaacuucagauugaaccauucauug

SEQ ID NO: 81606 - RNA, 64 nt, hsa; identical to SEQ ID NO: 76027

SEQ ID NO: 81607 - RNA, 64 nt, hsa; identical to SEQ ID NO: 76028

SEQ ID NO: 81608 - RNA, 64 nt, hsa; identical to SEQ ID NO: 76029

SEQ ID NO: 81609 - RNA, 64 nt, hsa; identical to SEQ ID NO: 76030

SEQ ID NO: 81610 - RNA, 64 nt, hsa; identical to SEQ ID NO: 76031

SEQ ID NO: 81611 - RNA, 64 nt, hsa; identical to SEQ ID NO: 76032

SEQ ID NO: 81612 - RNA, 64 nt, hsa; identical to SEQ ID NO: 76033

SEQ ID NO: 81613 - RNA, 64 nt, hsa; identical to SEQ ID NO: 76034

SEQ ID NO: 81614 - RNA, 64 nt, hsa; identical to SEQ ID NO: 76035

SEQ ID NO: 81615 - RNA, 64 nt, hsa; identical to SEQ ID NO: 76036

SEQ ID NO: 81616 - RNA, 64 nt, hsa; identical to SEQ ID NO: 76037

SEQ ID NO: 81617 - RNA, 64 nt, hsa; identical to SEQ ID NO: 76038

SEQ ID NO: 81618 - RNA, 64 nt, hsa; identical to SEQ ID NO: 76039

SEQ ID NO: 81619 - RNA, 64 nt, hsa; identical to SEQ ID NO: 76040

SEQ ID NO: 81620 - RNA, 64 nt, hsa; identical to SEQ ID NO: 76041

SEQ ID NO: 81621 - RNA, 64 nt, hsa; identical to SEQ ID NO: 76042

SEQ ID NO: 81622 - RNA, 64 nt, hsa; identical to SEQ ID NO: 76043

SEQ ID NO: 81623 - RNA, 64 nt, hsa; identical to SEQ ID NO: 76044

SEQ ID NO: 81624 - RNA, 64 nt, hsa; identical to SEQ ID NO: 76045

SEQ ID NO: 81625 - RNA, 64 nt, hsa; identical to SEQ ID NO: 76046

SEQ ID NO: 81626 - RNA, 64 nt, hsa; identical to SEQ ID NO: 76047

SEQ ID NO: 81627 - RNA, 64 nt, hsa; identical to SEQ ID NO: 76048

SEQ ID NO: 81628 - RNA, 64 nt, hsa; identical to SEQ ID NO: 76049

SEQ ID NO: 81629 - RNA, 64 nt, hsa; identical to SEQ ID NO: 76050

SEQ ID NO: 81630 - RNA, 64 nt, hsa; identical to SEQ ID NO: 76051

SEQ ID NO: 81631 - RNA, 64 nt, hsa; identical to SEQ ID NO: 76052

SEQ ID NO: 81632 - RNA, 64 nt, hsa; identical to SEQ ID NO: 76053

SEQ ID NO: 81633 - RNA, 64 nt, hsa; identical to SEQ ID NO: 76054

SEQ ID NO: 81634 - RNA, 64 nt, hsa; identical to SEQ ID NO: 76055

SEQ ID NO: 81635 - RNA, 64 nt, hsa; identical to SEQ ID NO: 76056

SEQ ID NO: 81636 - RNA, 64 nt, hsa; identical to SEQ ID NO: 76057

SEQ ID NO: 81637 - RNA, 64 nt, hsa; identical to SEQ ID NO: 76058

SEQ ID NO: 81638 - RNA, 52 nt, hsa; identical to SEQ ID NO: 76059

SEQ ID NO: 81639 - RNA, 64 nt, hsa; identical to SEQ ID NO: 76060

SEQ ID NO: 81640 - RNA, 64 nt, hsa; identical to SEQ ID NO: 76061

SEQ ID NO: 81641 - RNA, 64 nt, hsa; identical to SEQ ID NO: 76062

SEQ ID NO: 81642 - RNA, 64 nt, hsa; identical to SEQ ID NO: 76062

SEQ ID NO: 81643 - RNA, 64 nt, hsa; identical to SEQ ID NO: 76064

SEQ ID NO: 81644 - RNA, 64 nt, hsa; identical to SEQ ID NO: 76065

SEQ ID NO: 81645 - RNA, 64 nt, hsa; identical to SEQ ID NO: 76066

SEQ ID NO: 81646 - RNA, 64 nt, hsa; identical to SEQ ID NO: 76067

SEQ ID NO: 81647 - RNA, 64 nt, hsa; identical to SEQ ID NO: 76068

SEQ ID NO: 81648 - RNA, 64 nt, hsa; identical to SEQ ID NO: 76069

SEQ ID NO: 81649 - RNA, 64 nt, hsa; identical to SEQ ID NO: 76070

SEQ ID NO: 81650 - RNA, 64 nt, hsa; identical to SEQ ID NO: 76071

SEQ ID NO: 81651 - RNA, 64 nt, hsa; identical to SEQ ID NO: 76072

SEQ ID NO: 81652 - RNA, 64 nt, hsa; identical to SEQ ID NO: 76073

SEQ ID NO: 81653 - RNA, 64 nt, hsa; identical to SEQ ID NO: 76074

SEQ ID NO: 81654 - RNA, 64 nt, hsa; identical to SEQ ID NO: 76075

SEQ ID NO: 81655 - RNA, 64 nt, hsa; identical to SEQ ID NO: 76076

SEQ ID NO: 81656 - RNA, 64 nt, hsa; identical to SEQ ID NO: 76077

SEQ ID NO: 81657 - RNA, 64 nt, hsa; identical to SEQ ID NO: 76078

SEQ ID NO: 81658 - RNA, 64 nt, hsa; identical to SEQ ID NO: 76079

SEQ ID NO: 81659 - RNA, 64 nt, hsa; identical to SEQ ID NO: 76080

SEQ ID NO: 81660 - RNA, 64 nt, hsa; identical to SEQ ID NO: 76081

SEQ ID NO: 81661 - RNA, 64 nt, hsa; identical to SEQ ID NO: 76082

SEQ ID NO: 81662 - RNA, 64 nt, hsa; identical to SEQ ID NO: 76083

SEQ ID NO: 81663 - RNA, 64 nt, hsa; identical to SEQ ID NO: 76084

SEQ ID NO: 81664 - RNA, 64 nt, hsa; identical to SEQ ID NO: 76085

SEQ ID NO: 81665 - RNA, 64 nt, hsa; identical to SEQ ID NO: 76086

SEQ ID NO: 81666 - RNA, 64 nt, hsa; identical to SEQ ID NO: 76087

SEQ ID NO: 81667 - RNA, 64 nt, hsa; identical to SEQ ID NO: 76088

SEQ ID NO: 81668 - RNA, 64 nt, hsa; identical to SEQ ID NO: 76089

SEQ ID NO: 81669 - RNA, 64 nt, hsa; identical to SEQ ID NO: 76090

SEQ ID NO: 81670 - RNA, 64 nt, hsa; identical to SEQ ID NO: 76090

SEQ ID NO: 81671 - RNA, 64 nt, hsa
acuccuaaaggaagggccaaacuagagauuuucaaucauagacuuugugacagcauuuggggaa

SEQ ID NO: 81672 - RNA, 64 nt, hsa
gaagagagagagagagcauguauacccguauguuaucauagagcacgauucuccaguggaugga

SEQ ID NO: 81673 - RNA, 64 nt, hsa
auucagauauuuaauaucuuuuaucaguguucagaucauagauuaauggagaaaacauuuaaaa

SEQ ID NO: 81674 - RNA, 64 nt, hsa
uauggacuuccagugaaguagugacggaagccugaucauagacauuaaggaaagcgguguaggu

SEQ ID NO: 81675 - RNA, 64 nt, hsa
aagguuuuuaaucaaaaaacaacccuugcacgucaucauagaauucauacugcagagaaacuuu

SEQ ID NO: 81676 - RNA, 64 nt, hsa
aagaccuucagucagaugucaaaccuuguauaccaucauagacuucauaguggagagaaaccuu

SEQ ID NO: 81677 - RNA, 64 nt, hsa
aguuccuuagagaaucuguuuugauucugggcugaguuauuacaguuaugguaugaccagugag

SEQ ID NO: 81678 - RNA, 64 nt, hsa
auuuuuuaacuuagauuucucacuaaguuuccugaguuauuaguaagauugcucccuaaaugua

SEQ ID NO: 81679 - RNA, 64 nt, hsa
aacauuucuccccucacucccuugcuggugucauaguuauuagaaucagcagccucuuaacuaa

SEQ ID NO: 81680 - RNA, 64 nt, hsa
aauguuucaagccauuauugcugaaugguucuuuaguuauuaaccuagacccaaaucaaagacc

SEQ ID NO: 81681 - RNA, 64 nt, hsa
caggaucuuuaauacaauauagaaauuguguaauaguuauuauaaauguuaauacacaacuuuc

SEQ ID NO: 81682 - RNA, 64 nt, hsa
uuuaacugauuauuucuuuugcucuuuuaacuuaaguuauuaaaguuuaaaaguucguaaguac

SEQ ID NO: 81683 - RNA, 64 nt, hsa
ggauaaauaaauuauugaucuuuuuuaaggcagcaguuauuaaauugguaauagaagaugcugc

SEQ ID NO: 81684 - RNA, 64 nt, hsa
caugauaaaacauuuugagaagggguaagcagugaguuauuacccacaauuuaaagcaaauuuu

SEQ ID NO: 81685 - RNA, 64 nt, hsa
gcauuguuaaagauaguuauuaccaaaaaaagagaguuauuacaaauaaauaugucucuuuauu

SEQ ID NO: 81686 - RNA, 64 nt, hsa
auggguaaaaauaaauaauagcauuguuaaagauaguuauuaccaaaaaaagagaguuauuaca

SEQ ID NO: 81687 - RNA, 64 nt, hsa
acuuuggccuguauuaaagcaguagagcagcaucaguuauuauaguccagaaaaagugugcauc

SEQ ID NO: 81688 - RNA, 64 nt, hsa
acuuauaaaaggagucaaaguuucaaagcaagauaguuauuaagcaaaaggaaaaaugguaaug

SEQ ID NO: 81689 - RNA, 64 nt, hsa
aaucuguuuggcccaugaccuuuuaccuagucccaguuauuaccugagucucccauggaugacu

SEQ ID NO: 81690 - RNA, 64 nt, hsa
cauugauuaaaaaaagaaaaccacuuguuuauucaguuauuaaauauauuuacuauauaacaca

SEQ ID NO: 81691 - RNA, 64 nt, hsa
aguccuuuuaugaaaaaguuacugauugcuucucaguuauuaggaaaacaguuguuucacaauu

SEQ ID NO: 81692 - RNA, 64 nt, hsa
auacaaugcaugaaucauaauggauucuuuuauaaguuauuaauuuuuaugguuuaaucagucu

SEQ ID NO: 81693 - RNA, 64 nt, hsa
auuuacuucacuguguaauuaguuacaaccacucaguuauuaagagacguaacgcuucaaacuu

SEQ ID NO: 81694 - RNA, 64 nt, hsa
accaagucuguguucuguuuaaucuguccauacaaguuauuacugagaaaguguuuaugccaua

SEQ ID NO: 81695 - RNA, 64 nt, hsa
aucacaaaaccaccugguugaauauaauagauugaguuauuaacuguauuuucuuucacuuuau

SEQ ID NO: 81696 - RNA, 64 nt, hsa
auggauauuugucaacagauuuaaagaaaaccacaguuauuaauuaaagaaaauuaauuaugug

SEQ ID NO: 81697 - RNA, 64 nt, hsa
uuuagcuguuuugugguaauugcuuuuuaaaggaaguuauuaauaucauaaguuauuauuaaua

SEQ ID NO: 81698 - RNA, 64 nt, hsa
uaauugcuuuuuaaaggaaguuauuaauaucauaaguuauuauuaauauuuugaacacaggugg

SEQ ID NO: 81699 - RNA, 64 nt, hsa
auguuuguguugguuuuuuaagaagucuaaaugaaguuauuaauaccugaagcuuuaaguuaag

SEQ ID NO: 81700 - RNA, 64 nt, hsa
uaauuugguuuuauuaagagucuacucucaauccaguuauuagagauguacugaguuugauuug

SEQ ID NO: 81701 - RNA, 64 nt, hsa
uucagcauggacuguucauuugaaaccuuuuucuaguuauuagcguuuuaacaguuacaagcuu

SEQ ID NO: 81702 - RNA, 64 nt, hsa
aaguugaacaauccuagccauugacaaucgugauaguuauuauuuucccauuugcugucuuuuu

SEQ ID NO: 81703 - RNA, 64 nt, hsa
acccugaggcuuuaagugguuucuauuucuucuuaguuauuaugugccaccuucuuaguuauua

SEQ ID NO: 81704 - RNA, 64 nt, hsa
cuauuucuucuuaguuauuaugugccaccuucuuaguuauuaugugccaccuccccuaugagug

SEQ ID NO: 81705 - RNA, 64 nt, hsa
uugaguuacaaacaauccaguuacaaucuuuuuaaguuauuauuauuauuauuauuuuuuuuuu

SEQ ID NO: 81706 - RNA, 64 nt, hsa
ugggauuauaggugugagccacugcgccuggcuaaguuauuauuauuuuuuugagacagucucc

SEQ ID NO: 81707 - RNA, 64 nt, hsa
ugaagcagucugaauguucuuugaaaauaacuggaguuauuagcauacccuaguacaucuuaca

SEQ ID NO: 81708 - RNA, 64 nt, hsa
gaaaaaauugauacuggaaaagauuguugugcauaguuauuagucauuuguaaccuugcuuaag

SEQ ID NO: 81709 - RNA, 64 nt, hsa
ccaacuguucuauauuucuuuagaaaaagauuauaguuauuaauauugauaccucugauaauau

SEQ ID NO: 81710 - RNA, 64 nt, hsa
agaauaaugguucuuacugcuaagagggaguaauaguuauuacuaaugauuuugauuggguugc

SEQ ID NO: 81711 - RNA, 64 nt, hsa
aucucacauuuuuauaccuguuuaaauugcucacaguuauuacauacacaucagccaucaacua

SEQ ID NO: 81712 - RNA, 64 nt, hsa
ucuaaagauagaguaaaaagaaaacaaaaccaaaaguuauuaaaauuguuguccgguuuacuuu

SEQ ID NO: 81713 - RNA, 64 nt, hsa
aagauggaugugcuuugcauuccuacaaagauguuugucagauaugauauguaaacauaauucu

SEQ ID NO: 81714 - RNA, 64 nt, hsa
uuggagaguaaaaacugaauggaagguuuguauauugucagauauuuuuucagaaauauguggu

SEQ ID NO: 81715 - RNA, 64 nt, hsa
agaauagcuaagagauaaauugggcuggggaaacuugucagaaagcacugaacaauuaagaaau

SEQ ID NO: 81716 - RNA, 64 nt, hsa
cacuguaaggcagaugaucguccccguaugaugauugucagaagacaggacuaaguagcagaga

SEQ ID NO: 81717 - RNA, 64 nt, hsa
aaagggagacuguugcucaaccaucaggaaacaguugucagaagacaucauugguucuguguuu

SEQ ID NO: 81718 - RNA, 64 nt, hsa
cagaaagucgcauaggguuuuuuaaugcagaauuuugucagaagacaauggcgcugcauguuuu

SEQ ID NO: 81719 - RNA, 64 nt, hsa
gaaagggcagugagacaagaccucauccuaccucccugaccagcucuggcuucugcuccugccc

SEQ ID NO: 81720 - RNA, 64 nt, hsa
aguggaucaccugaggucagaaguuugagaccagccugaccaacauggugaaaugaaaccccau

SEQ ID NO: 81721 - RNA, 64 nt, hsa
gaugaggcuucuuccuggauggggcagagcuucuccugaccagggcaaggccccuuccacgggg

SEQ ID NO: 81722 - RNA, 64 nt, hsa
ccaccccuuccucagccugggguuugaccacccaccugaccaggggcccuaccuggggaaagcc

SEQ ID NO: 81723 - RNA, 64 nt, hsa
agggccuaagguccacuggacaguugggaaaacaccugaccaccauuuaaggacucuaagccag

SEQ ID NO: 81724 - RNA, 64 nt, hsa
ggggaaggggcuuguggggaggggacccaugaauccugaccacucuugaacccagaaggaggac

SEQ ID NO: 81725 - RNA, 64 nt, hsa
aaauccuaagcucuugaggccauucaccugccaaccugaccauacugcuuucaaaagucuuuuc

SEQ ID NO: 81726 - RNA, 64 nt, hsa
gcagaucaccugagaucgggaguuugagaccaagccugaccaauauggagaaacccugucucua

SEQ ID NO: 81727 - RNA, 64 nt, hsa
ggcaggugugugacuggguuccuggguacccaggccugaccagagggagcgggagggcagaggu

SEQ ID NO: 81728 - RNA, 64 nt, hsa
cuggccuccgucuucuaucuucuuuucuugccucccugaccagcagacucaccucccaagaacg

SEQ ID NO: 81729 - RNA, 64 nt, hsa
uagggacugaccagcagcuuuagaaucccagcccccugaccacucagagacaugcagagauugg

SEQ ID NO: 81730 - RNA, 64 nt, hsa
gaauucccucacucgucucccccaacagcuggacccugaccagcucccccucccuccccuugcc

SEQ ID NO: 81731 - RNA, 64 nt, hsa
gagcuggcggaagccccacggcggugagguccauccugaccaaggagcggcggccggagggcgg

SEQ ID NO: 81732 - RNA, 64 nt, hsa
ccagccccaaggcuuugacaaccaggcguuccucccugaccacaaggccaacugggcgcccguc

SEQ ID NO: 81733 - RNA, 64 nt, hsa
ucaguggaggaggcagugggggcagcagcagccuccugaccaaugcccgcucuuggggagugag

SEQ ID NO: 81734 - RNA, 64 nt, hsa
cggguggaucacaaggucaagaguucgagaccagccugaccaacguggugaaaccccgucucua

SEQ ID NO: 81735 - RNA, 64 nt, hsa
gcccuggcgggggccaugggggugaugaaugacccuccaacagccccacauggguuguuucugu

SEQ ID NO: 81736 - RNA, 64 nt, hsa
acggcacugcuucaggacgcgcuugcugaaacgacuccaacagcuaguucacagcccagcuuug

SEQ ID NO: 81737 - RNA, 64 nt, hsa
uuguuguaggacugcaagacacuggaccgaaagccuccaacacaaacccuagcugccaaccugc

SEQ ID NO: 81738 - RNA, 64 nt, hsa
cccucaggccgagauccgugagagacccacuuugcuccaacaacuugaaacaagucacuuuacc

SEQ ID NO: 81739 - RNA, 64 nt, hsa
cugccaggucucaaaaauucaucaagcaauuucccuccaacaagggcugcaguucuagugauaa

SEQ ID NO: 81740 - RNA, 64 nt, hsa
ugcuagaauuuuuuauagcuuagauauaaaaggucuccaacaaagaccuuugcaauauauuuua

SEQ ID NO: 81741 - RNA, 64 nt, hsa
aggagcugaacauuaauaugugcaaagauuggcucuccaacaagaaggaaagcagggaggaagg

SEQ ID NO: 81742 - RNA, 64 nt, hsa
cgcuggaaggcugcgagaggacucuaguaugagucuccaacauuuggaacguuuccugggcugu

SEQ ID NO: 81743 - RNA, 64 nt, hsa
agggcacuggacuuaguuaguaucaggagcacugagcucacagacugacuugggcuccuacugg

SEQ ID NO: 81744 - RNA, 64 nt, hsa
uauagcuagauaaauauuguuagucuuagacaauagcucacauuuuuugagaagcaugcccucc

SEQ ID NO: 81745 - RNA, 64 nt, hsa
uccggacaggcgcugcugccccgaguggcaggccagcucacacucugcugcacaacagcucggc

SEQ ID NO: 81746 - RNA, 64 nt, hsa
cucagacucugucccugguaaggagugacaaggaagcucacagcugggcgagugcauuuugaau

SEQ ID NO: 81747 - RNA, 64 nt, hsa
gugcauguguguguuuuagugaaucugcucucccagcucacacacuccccugccucccauggcu

SEQ ID NO: 81748 - RNA, 64 nt, hsa
ccuccucccugacuccucucugcccaugcaaauuagcucacaucuuuccuccugcugcaaucca

SEQ ID NO: 81749 - RNA, 64 nt, hsa
agccuucagugcuaucagcagggauucaugugacagcucacacuaagggagaaaaccugugaag

SEQ ID NO: 81750 - RNA, 64 nt, hsa
ucauugaucuuucaucccuaagauaguuugagagagcucacacuggauauauaaguuauuuguu

SEQ ID NO: 81751 - RNA, 64 nt, hsa
cuuugagcucacagguugccaggcagagcuuuugagcucacaggugacaggcucaggguucuca

SEQ ID NO: 81752 - RNA, 64 nt, hsa
aagaaacugcccaugguugccuggcagagcuuugagcucacagguugccaggcagagcuuuuga

SEQ ID NO: 81753 - RNA, 64 nt, hsa
gaaaaguagaaaaaugucacguuuccauaucuccugcuggaaaucagaaaauauaauaaaauug

SEQ ID NO: 81754 - RNA, 64 nt, hsa
ucauugaaucaauggaucuguugaagaacucagcugcuggaaaccaugcaaaauguuuugaauu

SEQ ID NO: 81755 - RNA, 64 nt, hsa
cucagaaacugcagcagccacgcacacagaagccugcuggaagacaggucucucuccguccaca

SEQ ID NO: 81756 - RNA, 64 nt, hsa
uaauuuuacauaagaucugccuuccacacuucccugcuggaaggcauucucagagcuuuauguc

SEQ ID NO: 81757 - RNA, 64 nt, hsa
gaccuugugauccacccaccucggccucccaaagugcuggaauuacaggcaugagccaccgcgc

SEQ ID NO: 81758 - RNA, 64 nt, hsa
aguagugcugccccugugacaggcaucagcucccugcuggaacugagguagacacagguguggg

SEQ ID NO: 81759 - RNA, 64 nt, hsa
uucuuauaaaagaaacuuucgagccuccuuauauugcuggaaacucagcugugcuccagacuag

SEQ ID NO: 81760 - RNA, 64 nt, hsa
acucaagacugacuuacagaccaaccaaccaccuugcuggaacccuugcuagcaggcauucuua

SEQ ID NO: 81761 - RNA, 61 nt, hsa
acgacccguuacccaccuagaggaagcgcgaugcuggaacacaucccugccuccgggaagu

SEQ ID NO: 81762 - RNA, 64 nt, hsa
aggcccuugaguaacugaccacauuuggagguuuugcuggaaaugccugaccucucagucuggc

SEQ ID NO: 81763 - RNA, 64 nt, hsa
ccucaggugaucugcccaccucggcuucccaaagugcuggaauuacaggccugagccaccccac

SEQ ID NO: 81764 - RNA, 64 nt, hsa
gccuuuaguaccaagguucucaacacugacuacaugcuggaaugacugugaagcuuuuaaaaaa

SEQ ID NO: 81765 - RNA, 64 nt, hsa
gggaugauugccacauacauggaacaccugggagugcuggaaauguacugugaucgaagugaca

SEQ ID NO: 81766 - RNA, 64 nt, hsa
acacacacacgaauccacagcaauccaucagauaugcuggaagauccaaacgugcauacaguag

SEQ ID NO: 81767 - RNA, 64 nt, hsa
acaguguuuucauuuacucugcuugucuuuauguugcuggaacauuucuaaaagacagugauga

SEQ ID NO: 81768 - RNA, 64 nt, hsa
ccaauagaagccaaauccagcuuugguauuuauuugcuggaagcuaaauuuacacuuaaaguug

SEQ ID NO: 81769 - RNA, 64 nt, hsa
gguacuuacaaggcacauauaaaauaauuucccaugcuggaaauuccaaaugaccaguuccagu

SEQ ID NO: 81770 - RNA, 56 nt, hsa
aagccaaaggaauugaguaagacaacugcuggaagaugucuuaaaucaagcuuuca

SEQ ID NO: 81771 - RNA, 64 nt, hsa
gcucaaaugauccuccugccuuggccucccaaagugcuggaauuacaggcaugagccaccacac

SEQ ID NO: 81772 - RNA, 64 nt, hsa
guaccugccagcaggagcaugauggggacuuccaugcuggaauugcucccugauuaaaaugaga

SEQ ID NO: 81773 - RNA, 64 nt, hsa
ucugcacacgcuagcucuccuucgccuucugccaugcuggaaguagccugaggcccucaccaga

SEQ ID NO: 81774 - RNA, 64 nt, hsa
uaugauagaguuuauaaaacaguccuguguaaacugcuggaaguucuuccacagucaggucaau

SEQ ID NO: 81775 - RNA, 64 nt, hsa
aagcccuuuaaaaagcugccuuccucuaccacuuugcuggaaagcuucacaauugucacagaca

SEQ ID NO: 81776 - RNA, 64 nt, hsa
aggguuccugugauuaauuuugugaugacuaaaaugcuggaaagcgagugaguugcccauuaau

SEQ ID NO: 81777 - RNA, 64 nt, hsa
auugaauuagcauaauugggccauggaacacauaugcuggaaaucuuugaaccauuucaagucu

SEQ ID NO: 81778 - RNA, 64 nt, hsa
gcagcccugggcucugucucuacucccagggaccugcuggaaggcuggagugcccagggagagg

SEQ ID NO: 81779 - RNA, 64 nt, hsa
ccagaagguggcuuggggguggauaucuuuggguugcuggaaaaggugugggaagguucaggau

SEQ ID NO: 81780 - RNA, 64 nt, hsa
uuucacaagagaugagggagcaggcuuuccaauaugcuggaaguaauugugcuuagacaccuca

SEQ ID NO: 81781 - RNA, 64 nt, hsa
aaagagagccuauucucacacaugaucuucagagugcuggaaacacacuccugcagaagcugua

SEQ ID NO: 81782 - RNA, 64 nt, hsa
ugccccaggcuuccuuucagaggaaggccuguccugcuggaacuggagccaaggggaggcugcc

SEQ ID NO: 81783 - RNA, 64 nt, hsa
aaucagguugugcugccagugaguuguagauuuaugcuggaagaauggagaauggaaacaggcc

SEQ ID NO: 81784 - RNA, 64 nt, hsa
uucagugucuugucaaaucuagcucuguaucagaugcuggaauauuccuaacauuugacaaacu

SEQ ID NO: 81785 - RNA, 64 nt, hsa
aggacccauauguuaucaaacuuugaaauugaguugcuggaaugaaguagaggugacucucucu

SEQ ID NO: 81786 - RNA, 64 nt, hsa
cugaggggacugacucuggcaucucugccgaggcugcuggaaucgacuggggcaucuucccgga

SEQ ID NO: 81787 - RNA, 64 nt, hsa
uggggagacgaugcuguugcuuugcagaucacagugcuggaagcaggaacccaggguaagugca

SEQ ID NO: 81788 - RNA, 64 nt, hsa
gggacacuucccugggccucaacaaggaucaggcugcuggaaacacagucacuugggagcugcu

SEQ ID NO: 81789 - RNA, 64 nt, hsa
ggccuagaccgcgugauaaaacuggguugagggaugcuggaaccaguuacgacugaagucagug

SEQ ID NO: 81790 - RNA, 64 nt, hsa
accgugaagugaauucucugagcuggugguguggugcuggaaggaagguuauuuuuggagccac

SEQ ID NO: 81791 - RNA, 64 nt, hsa
ggcucccacugcuucuggucuccagggacagugcugcuggaaaggcuagugaugagcuucaccc

SEQ ID NO: 81792 - RNA, 64 nt, hsa
gucaccaguccucuugggguuuuguaccaucugaugcuggaaguuuugauuagugauauuuucu

SEQ ID NO: 81793 - RNA, 64 nt, hsa
caucgcaagaugaacaguuguuaauaaaagcuguugcuggaaacuugcuuuaggaacagcucaa

SEQ ID NO: 81794 - RNA, 64 nt, hsa
uugaagagagugacuggagugguaaagauggaaaugcuggaaaugauacuggcgcucacgcugc

SEQ ID NO: 81795 - RNA, 64 nt, hsa
acaauagccacacccacaccugagcuguucucagugcuggaacuugaccauccuggaacacccu

SEQ ID NO: 81796 - RNA, 64 nt, hsa
gcacaacccaaccucgcuuagggacccccagagaugcuggaaucgcuaggaggguuggcuccag

SEQ ID NO: 81797 - RNA, 64 nt, hsa
ggcuugcaggguguauaccugcgcauugggaacuugcuggaaccccugaugcauuuuccuugag

SEQ ID NO: 81798 - RNA, 64 nt, hsa
ccucugauucaaaacuuauuagaacaguagcuucugcuggaauuugcaaucacugaagucauag

SEQ ID NO: 81799 - RNA, 64 nt, hsa
uuauuuuguuugcugucugucuccccugccccacugcuggaacagaggcuccaagaaaacaggg

SEQ ID NO: 81800 - RNA, 64 nt, hsa
uuuuauuucacuuguguuuugucuuaaacccuacugcuggaaacaauuuuauguaauaagcaau

SEQ ID NO: 81801 - RNA, 64 nt, hsa
gguggaagaccaguaauugcuggaagacuggauuugcuggaagacuugauuuacuggaagacuu

SEQ ID NO: 81802 - RNA, 64 nt, hsa
cuggaagaucuggauuugguggaagaccaguaauugcuggaagacuggauuugcuggaagacuu

SEQ ID NO: 81803 - RNA, 64 nt, hsa
uaguugguaacucugccagagccuguacuuaccugccaaaaacaauuaaaucugguuaaugccu

SEQ ID NO: 81804 - RNA, 64 nt, hsa
cuuaucaaaugaaguauuauuuuguggacuggaggccaaaaagucaaugugagcuucucacagg

SEQ ID NO: 81805 - RNA, 64 nt, hsa
augcaauuugaaaacuacaggcuuaggacucugugccaaaaaucucuauuuuaaaugaaaauau

SEQ ID NO: 81806 - RNA, 64 nt, hsa
ugauucaagaaaugugauguagauuuuugagaaugccaaaaaucagguuucagaaaagcuacag

SEQ ID NO: 81807 - RNA, 64 nt, hsa
ggaccaggaugaagagggaucaaagagauaauuagccaaaaacccaguagccuagaagauacaa

SEQ ID NO: 81808 - RNA, 64 nt, hsa
guugagaaugaguaccacucucaccauugguauagccaaaaaagcuuggaagugaccaaggcua

SEQ ID NO: 81809 - RNA, 64 nt, hsa
uuguaaugcacaggcaacugugagaaacuguugugccaaaaauagaauuccuucuaguuuuucu

SEQ ID NO: 81810 - RNA, 64 nt, hsa
gaaaucuuguuacuagaacaagaaaugucagauggccaaaaacaagaugaccagauuugaucuc

SEQ ID NO: 81811 - RNA, 64 nt, hsa
aaagaaaaccuuucuucaccaaaucuugguugaugccaaaaaaaaauacaugcuaagagaagua

SEQ ID NO: 81812 - RNA, 64 nt, hsa
uacuauuucacaacagccugacaacauuucuauagccaaaaauagcuaaauaccucaaucaguc

SEQ ID NO: 81813 - RNA, 64 nt, hsa
aucauuuuucaaagaaaauuauucucaucucaaugccaaaaagauaguuucuacacaucaccug

SEQ ID NO: 81814 - RNA, 64 nt, hsa
aauagaaagaucuauguuuauaaaccagcacuuggccaaaaacaaaauuguaaaggaaauuuaa

SEQ ID NO: 81815 - RNA, 64 nt, hsa
ugcugccaauaguggauaacauguaucacucacugccaaaaauagaaagugaccaugaaaaaua

SEQ ID NO: 81816 - RNA, 64 nt, hsa
gaaggagccagccaggacuccuuagacugaucaagccaaaaaagaaggugccgauuucaugcau

SEQ ID NO: 81817 - RNA, 64 nt, hsa
cagcuugucuuaagaaugguugccaaaaacaacagccaaaaaaaaaaaaccuauuuuauuaucc

SEQ ID NO: 81818 - RNA, 64 nt, hsa
acaguucuucuuucagcuugucuuaagaaugguugccaaaaacaacagccaaaaaaaaaaaacc

SEQ ID NO: 81819 - RNA, 64 nt, hsa
gguaaauacaccauaccauaauaucugcuuggagaaccacaaugcacauuagcauauuagucug

SEQ ID NO: 81820 - RNA, 64 nt, hsa
auuuugaaguauuugggcaggugagucauguuuuaaccacaagccauaacucaucuguugucuu

SEQ ID NO: 81821 - RNA, 64 nt, hsa
uuuuaguaaacuggacauguuauuccacuacaaaaaccacaaguuaucuggccuuuuagaucuu

SEQ ID NO: 81822 - RNA, 64 nt, hsa
uuggaaacaguuccugucugaaaacucuucugagaaccacaaaccuuguguauggauucggcau

SEQ ID NO: 81823 - RNA, 64 nt, hsa
ugaccccaguggaaaacaaagccaaacaaaacugaaccacaaaaaaaaaggcugguguucacca

SEQ ID NO: 81824 - RNA, 64 nt, hsa
uugcuggaagaaacuaaaaauauagcaaaugcagaaccacaaacaauucgaaugggguagaaac

SEQ ID NO: 81825 - RNA, 64 nt, hsa
uuuaucaaaacaagaugaaacacagaaaaguugaaaccacaacaaaaugaauucuauuaaagaa

SEQ ID NO: 81826 - RNA, 64 nt, hsa
acuggaaauggagaaguuauugcagacagucaugaaccacaaaucacugugauuaaaauuuucu

SEQ ID NO: 81827 - RNA, 64 nt, hsa
auuuccguguagauggagaucacuguguguaauaaaccacaagugcgugucugggugugccugu

SEQ ID NO: 81828 - RNA, 64 nt, hsa
gcuguugcuccuggccucaucagccuccaaacucaaccacaaccagcugccucugcaguuggac

SEQ ID NO: 81829 - RNA, 64 nt, hsa
accacgguccccaccacgacacaaucacguucacaaccacaaccacgcagccacagcuauaacc

SEQ ID NO: 81830 - RNA, 64 nt, hsa
ccuugaugucugugaucaaaccaugacaggaugcaaccacaacacacggcuaugaucaugacaa

SEQ ID NO: 81831 - RNA, 64 nt, hsa
ugggacagggugaauaaagcagggaauauuuuagaaccacaagagaucagcaguggcaggaccc

SEQ ID NO: 81832 - RNA, 63 nt, hsa
gcaaaccacauaaucucucuagguccauuuuccuaaccacaagauaaagauguuacauuguca

SEQ ID NO: 81833 - RNA, 64 nt, hsa
gcuuccucuccugucaauuccaggcucuuuccauaaccacaagccugaggcugcagccuuuuau

SEQ ID NO: 81834 - RNA, 64 nt, hsa
cuaacuuugucgcuaguccuaaggagaaaccuuuaaccacaaaguuuuuaucauugaagacaau

SEQ ID NO: 81835 - RNA, 64 nt, hsa
auauauuuauagauuguguucacagcaaucauuuaaccacaaauaaaauaucccuugaugauac

SEQ ID NO: 81836 - RNA, 64 nt, hsa
gcaagcaggaaaaaaaaauugggaccucaguugcaaccacaaggaacugaauucugccaaaaau

SEQ ID NO: 81837 - RNA, 64 nt, hsa
uggaugucaacaaaccucaccacuggauccugacaaccacaaugccuggauccuggggccccca

SEQ ID NO: 81838 - RNA, 64 nt, hsa
aucccuuacuucagcaacucaagucugcuacccuaaccacaagauucaagauuauccacacccc

SEQ ID NO: 81839 - RNA, 64 nt, hsa
cauuucugcaagcaauguaugaccccaccugagcaaccacaaauaggcucucugugaaacuaca

SEQ ID NO: 81840 - RNA, 64 nt, hsa
aagaaaaauguauauagcugugaguuuaaacaaaaaccacaaacagacaaacaagaaaaaaagc

SEQ ID NO: 81841 - RNA, 64 nt, hsa
gauccccggggaggcaggucccaggagcagacccugcccccagcccccacagacacaccccaau

SEQ ID NO: 81842 - RNA, 64 nt, hsa
cguuuccugggguuucuuugcccaugggguucucugcccccacccccggcccuuuguuugacuu

SEQ ID NO: 81843 - RNA, 64 nt, hsa
uagaggcuagcuucugcuuuucugcccuggcugcugcccccaccccggggacccugugacaugg

SEQ ID NO: 81844 - RNA, 64 nt, hsa
uuccucugccugccccgcccccaguccccaccccugcccccagccccggggugaguccauucuc

SEQ ID NO: 81845 - RNA, 64 nt, hsa
ccucacuggccuccagugggauucacuccugcccugcccccaccuucccagucccacaggccac

SEQ ID NO: 81846 - RNA, 64 nt, hsa
ugcuggcaggggcuggcacccaugggacacccucugcccccagccgcagccugucagagcucug

SEQ ID NO: 81847 - RNA, 64 nt, hsa
gguggaggaaggugcugagcuuagccuugugcccugcccccaucuccccaggccuccagccucu

SEQ ID NO: 81848 - RNA, 64 nt, hsa
cuguagccauggcucaggcaagccccucagcccuugcccccaucccucggacccaccaaacugc

SEQ ID NO: 81849 - RNA, 64 nt, hsa
ccuuccaucagccuuaacccugggaaaugccugcugcccccaaugacucuugguuucgucuccc

SEQ ID NO: 81850 - RNA, 64 nt, hsa
cccacgccagcgagcaggcugccugcccaccccgugcccccagccagcuggcugugccagggca

SEQ ID NO: 81851 - RNA, 64 nt, hsa
agcccccucccaggaguggucagcgggucacagcugcccccacucuauaagcagggcuaauugu

SEQ ID NO: 81852 - RNA, 61 nt, hsa
gggaccuguugauuaauugaguggcccugccugcccccagcagccugcccccgacucuacc

SEQ ID NO: 81853 - RNA, 64 nt, hsa
agugcagacugucuaaaugcccccagcccaccccugcccccauuugcagccuugguguucguuc

SEQ ID NO: 81854 - RNA, 51 nt, hsa
ccccagugcagacugucuaaaugcccccagcccaccccugcccccauuugc

SEQ ID NO: 81855 - RNA, 64 nt, hsa
gggacuggggaggcgcagccuagacccaauugcuugcccccaugaggcuagcacuaauaggaaa

SEQ ID NO: 81856 - RNA, 64 nt, hsa
uuuauuuaaaacaaaacaacacaaaaaaacaaugugcccccagaugucagaaugaggcgacuag

SEQ ID NO: 81857 - RNA, 64 nt, hsa
ggcugggggugucagcauucccagcuuuccaagcugcccccaggcggcagagucugaggguccc

SEQ ID NO: 81858 - RNA, 64 nt, hsa
gcugccacacccagcucaggccugggccagccccugcccccagcccacugagggggugggcuua

SEQ ID NO: 81859 - RNA, 64 nt, hsa
gacccacccgucugugaauguguccacucucuucugcccccagccauauuuggggaggauggac

SEQ ID NO: 81860 - RNA, 64 nt, hsa
ggagaggggaggugucacacaacuuggagguaaaugcccccaggccgcauguggcuucauuaua

SEQ ID NO: 81861 - RNA, 64 nt, hsa
ccuugcagggcagacagugccuggcacugaggggugcccccagaccccgcugggacuggaugug

SEQ ID NO: 81862 - RNA, 64 nt, hsa
gcccagcucugccucgcagcccccucagcaugggugcccccagaaguaagcagcucuuggaccc

SEQ ID NO: 81863 - RNA, 64 nt, hsa
gccaauucaccuaauuuuuauacugaaauguagaugcccccaacaugauuuuggaaagauauaa

SEQ ID NO: 81864 - RNA, 64 nt, hsa
gagaacaggaggcucacaaaagaacgauuuucagugcccccagcaaggcugcacccuccuugau

SEQ ID NO: 81865 - RNA, 64 nt, hsa
gguccccagggcauuuucauggcaaguaccccucugcccccacuccagcagugcuucccaaagu

SEQ ID NO: 81866 - RNA, 64 nt, hsa
uuaaagcaguaguccacaaaguauucugcucaugugcccccaaaaguauuuugaaaaaucaugu

SEQ ID NO: 81867 - RNA, 64 nt, hsa
ucucccacccagaucaacauccccccaaccccugugcccccaucaucuggaccccagagccagc

SEQ ID NO: 81868 - RNA, 64 nt, hsa
gcaucuaucugucugccaccagcccaccccacccugcccccacccucacccacgcuucugcuca

SEQ ID NO: 81869 - RNA, 64 nt, hsa
gaaaggcagcuucacccaguuuucuggacucucaugcccccaucuccgaccugggagacuucag

SEQ ID NO: 81870 - RNA, 64 nt, hsa
ucucucucugucccggcagcccaggauggccuggugcccccaccugcugcagcaggagccccaa

SEQ ID NO: 81871 - RNA, 64 nt, hsa
cucagggucugaagcagcugcugucucccuccucugcccccauccccuggcucuccccugggca

SEQ ID NO: 81872 - RNA, 64 nt, hsa
cuugggaagccugaggcgggccucugccucucccugcccccagcacaauuggcagagaugaggc

SEQ ID NO: 81873 - RNA, 64 nt, hsa
acacauggaagaauguuuaucggcugggcugcagugcccccacccucaccuucuccuggugcau

SEQ ID NO: 81874 - RNA, 64 nt, hsa
auuuauugugagaauggcuacacuucuuuaggaaugcccccacuuacaaccagguggguggaac

SEQ ID NO: 81875 - RNA, 64 nt, hsa
caccugccaccugagaagauggaaaggaaggagcugcccccagagcaucaguccuugaagagca

SEQ ID NO: 81876 - RNA, 64 nt, hsa
uuccuucugucucuuuagcugccagagacauuuaugcccccagcaccaauuacugcuccaguua

SEQ ID NO: 81877 - RNA, 64 nt, hsa
gcaaugguaacugcaccugggcagcuccucccugugcccccagccucagcccaacuucuuaccc

SEQ ID NO: 81878 - RNA, 64 nt, hsa
gaaagcaucacugccuuggccccucccucccggcugcccccaucaccucuacugucuccucccu

SEQ ID NO: 81879 - RNA, 64 nt, hsa
cuuggggaguacagggaaguaccugcagugacccugcccccaugaccuuggccaggcaggauga

SEQ ID NO: 81880 - RNA, 64 nt, hsa
gaaggccugagugcaagcacccuugcuccuguacugcccccagcagcgcagucugggguauuuc

SEQ ID NO: 81881 - RNA, 64 nt, hsa
aggugacugagauuguagggggggcauuuuugguugcccccaugcgugggggcacuacuaagaa

SEQ ID NO: 81882 - RNA, 64 nt, hsa
cucccccccccccaccgugcccuccaucacgcccugcccccagggugguucauuucccagcccu

SEQ ID NO: 81883 - RNA, 64 nt, hsa
uuguguuuuagggugaaacuuaaaaaaaaaauucugcccccaccuagaucauauuuaaagaucu

SEQ ID NO: 81884 - RNA, 64 nt, hsa
cuccuccccucuucucuuuugcccccucccuuccugcccccagucuggguuacucuucgcuucu

SEQ ID NO: 81885 - RNA, 64 nt, hsa
acauuaccagguuauaaaacauaacucacaccccugcccccaccccaugcccccacccuccccu

SEQ ID NO: 81886 - RNA, 64 nt, hsa
auaaaacauaacucacaccccugcccccaccccaugcccccacccuccccucacacacaaauug

SEQ ID NO: 81887 - RNA, 64 nt, hsa
gcugggguccuacccagccuggaucugagcucugugcccccagccggguuguucccagccugag

SEQ ID NO: 81888 - RNA, 64 nt, hsa
ccucccaguaggcaguagucagaacuggaugggcugcccccagccagcucccagcagcuucucc

SEQ ID NO: 81889 - RNA, 64 nt, hsa
ugaggcccagggccugagcucucuuccccagcauugcccccacccggaaaccccaccuuuggag

SEQ ID NO: 81890 - RNA, 64 nt, hsa
cuggcuccccuacuaacgucccccucuucgcccuugcccccauccccacccgccccucucccgg

SEQ ID NO: 81891 - RNA, 64 nt, hsa
gcccccaacuccccgggcccggccccugcccugcugcccccaacagcgucuggcuccccuacua

SEQ ID NO: 81892 - RNA, 64 nt, hsa
cccuccccugcagcgacucggacccgcuacugccugcccccaacuccccgggcccggccccugc

SEQ ID NO: 81893 - RNA, 64 nt, hsa
cucagccucccacguggcugggauuacaggugccugcccccauggcuaauuuuuuguauuuuuu

SEQ ID NO: 81894 - RNA, 64 nt, hsa
uauuuauggcacgauuccuuuggauggcuucauuugcccccagacuguaugaaaacaucuccga

SEQ ID NO: 81895 - RNA, 64 nt, hsa
gaggauggaacucagaaugaaacugcaacccaccugcccccagcccugccccucgcccugaugc

SEQ ID NO: 81896 - RNA, 64 nt, hsa
cgaagcuggagaggggcgugcugcggggcccugaugcccccacccaccucgguccagcgcggcc

SEQ ID NO: 81897 - RNA, 64 nt, hsa
ggaggcccaccucaaggagugcgagcacaucaaaugcccccacuccaaguacgggugagugggg

SEQ ID NO: 81898 - RNA, 64 nt, hsa
ugcuggccuccagucccaucucccccaacacaugugcccccaaaaagugagccaggcaccucug

SEQ ID NO: 81899 - RNA, 64 nt, hsa
agccccgguucccccaacauguucccguucacucugcccccacccccaaaggcucagccucuaa

SEQ ID NO: 81900 - RNA, 64 nt, hsa
uuaauggcucaguccccuucaccccauuuccaagugcccccaggacuccugggcccugcuuccc

SEQ ID NO: 81901 - RNA, 64 nt, hsa
agcccaagggucagcccucuugacugucacaugcugcccccacccagccuaaaauaaagagcuc

SEQ ID NO: 81902 - RNA, 64 nt, hsa
ggcccaggagcucggacugcugguccuggagagcugcccccagaagaagcuggagugcauaggu

SEQ ID NO: 81903 - RNA, 64 nt, hsa
ccuuucuaccgaccaugugaccccgcaccagcccugcccccaccugcccucccgggcaguacug

SEQ ID NO: 81904 - RNA, 64 nt, hsa
ccccacugugaaggggcuggccaggggcccgagcugcccccacccccggccucagccaccagca

SEQ ID NO: 81905 - RNA, 64 nt, hsa
uggcacccaccgucucggcccugaaccacgaggcugcccccauccagccacggagggaggcacc

SEQ ID NO: 81906 - RNA, 64 nt, hsa
uugccacagcucaacucgggggcgccuggagggaugcccccaggcagccaccaguggaccuagc

SEQ ID NO: 81907 - RNA, 64 nt, hsa
caggggacuccgcagcgggccccugccuuccacaugcccccaccauuuuucuuugccgguuugc

SEQ ID NO: 81908 - RNA, 64 nt, hsa
cgagcccuugcuccuuaggauccccgcccccaccugcccccaaugcacacacagacccaccggg

SEQ ID NO: 81909 - RNA, 64 nt, hsa
ccucagcuucccaucucugcccgcuugcuuccccugcccccaaccccugccuccucuauccccc

SEQ ID NO: 81910 - RNA, 64 nt, hsa
cugggggcugggcuggggguuagggcugggacugugcccccacacugcgccucagcuucccauc

SEQ ID NO: 81911 - RNA, 64 nt, hsa
ggaacagggcuggggcuggguuggaacaggugugugcccccaccacagcucuaugacucuguuc

SEQ ID NO: 81912 - RNA, 64 nt, hsa
auagacuauacacaugggguggaaaggccaggccugcccccaucucguugguguggcucugcgu

SEQ ID NO: 81913 - RNA, 64 nt, hsa
ucuaagugcaauacuuggcccgccggcuucccgcugcccccaucgcgcucacgcaauaaccggc

SEQ ID NO: 81914 - RNA, 64 nt, hsa
ccgugaugaauguacugacgagccgaggcagcagugcccccaccguggccccccacgccccauu

SEQ ID NO: 81915 - RNA, 64 nt, hsa
aauggagucugggggagggggaaccccggggacaugcccccacccgggaggggccgguaacccc

SEQ ID NO: 81916 - RNA, 64 nt, hsa
agacccucauuugccacccagaccaaugugagccugcccccagcccccucucauuggaaguggc

SEQ ID NO: 81917 - RNA, 64 nt, hsa
agccagccguaauggggacucuccaggcaccgccugcccccagcguggggguggccacuccugg

SEQ ID NO: 81918 - RNA, 64 nt, hsa
ccgccaugcaugauggguaaagcaauacugccgcugcccccacccugcuucugcugccuguuug

SEQ ID NO: 81919 - RNA, 64 nt, hsa
ccuguacagcgacugucuccgaaccuucuggaccugcccccacuguggccugcaugcgccccuc

SEQ ID NO: 81920 - RNA, 64 nt, hsa
cacgccccuggagcgcaucgcccaugagaacaccugcccccaggccccacaggaugggccccca

SEQ ID NO: 81921 - RNA, 64 nt, hsa
ucuuuucuuuccuuccuuccuucuuuuuuguuuuugcccccaauucugcccauacccauuucuu

SEQ ID NO: 81922 - RNA, 64 nt, hsa
uucuuucuuuccuuccuuccuucuuuuuuguuuuugcccccaguucuguccacaccccuucccu

SEQ ID NO: 81923 - RNA, 64 nt, hsa
guuucuuuuuucggcuaaaaagaaugcagagaugugcccccacccccacccucgaccacccccg

SEQ ID NO: 81924 - RNA, 64 nt, hsa
ggggggugcccggggaucccccgccccauccuccugcccccaccccaggcugggcuguucacuc

SEQ ID NO: 81925 - RNA, 64 nt, hsa
uccaggcucuaggacugcgcgaugagccccagggugcccccaggcuccggccgguucccccggu

SEQ ID NO: 81926 - RNA, 64 nt, hsa
cugcugcccucgcugccccugacccgcgcccccgugcccccaggcccagccgccgcccugcucc

SEQ ID NO: 81927 - RNA, 64 nt, hsa
aagcaacuguuuaaacccuuuguaaccggggccuugcccccaccuccugucuuuucuccuugcc

SEQ ID NO: 81928 - RNA, 64 nt, hsa
cucugcucuccaucaaaucacuuccacuuuccugugcccccacccccgccuccaguuuuccgcu

SEQ ID NO: 81929 - RNA, 64 nt, hsa
caguugguccugcagaacuggaugcucaaggcccugcccccagcccugcagguaggcuuagccc

SEQ ID NO: 81930 - RNA, 64 nt, hsa
agcgggccaagcagaggagcccucgggucagcccugcccccagagcugccccccacgggcaucc

SEQ ID NO: 81931 - RNA, 64 nt, hsa
gccagacgccagggccugcccggccuccuguuccugcccccacccaccaccugccuggagagga

SEQ ID NO: 81932 - RNA, 64 nt, hsa
gcacugaggauucuugcccccuuguggugcccgcugcccccaaccuucaggcugccagaugcuc

SEQ ID NO: 81933 - RNA, 64 nt, hsa
uggaguugcuggccaaagaauuccaggacaagacugcccccaggcugcagaaauaccuggugcu

SEQ ID NO: 81934 - RNA, 64 nt, hsa
uugggcuucagguaccuaaaacagauccaggaccugcccccaacuggccucccugagaugaacc

SEQ ID NO: 81935 - RNA, 64 nt, hsa
cuguuugggaagacguggaggaaaaggugacuucugcccccaccgcucuuacccccacuguagu

SEQ ID NO: 81936 - RNA, 64 nt, hsa
ccgcucuuacccccacuguaguggccuuuggagaugcccccaccucccccccaccaacucucgc

SEQ ID NO: 81937 - RNA, 64 nt, hsa
aaagagucaagugaccaucauuucaccugcugcuugcccccaauaguagucucugugaggccuu

SEQ ID NO: 81938 - RNA, 64 nt, hsa
ucugcuccugcgaggcuaugagugggaugagugaugcccccacagcaccuccauguggacuuag

SEQ ID NO: 81939 - RNA, 64 nt, hsa
ccagcugggcuggaagguuccauaacuggccagcugcccccauaacuggcagcauucccagacc

SEQ ID NO: 81940 - RNA, 64 nt, hsa
ugccuuagugugccucccaauacucccuucuuccugcccccacaccccauccccagcuagccca

SEQ ID NO: 81941 - RNA, 64 nt, hsa
ccucaggugaucugcccgccucggccucccaacgugcccccaguuuuauaaacagcagauagca

SEQ ID NO: 81942 - RNA, 64 nt, hsa
uugaaaugaccuaaccaaaaacauucaaggguucugcccccagauuucgggagauccacguucc

SEQ ID NO: 81943 - RNA, 64 nt, hsa
ugggaaaacugaggccuggagguaggaagggacuugcccccaaggccgcacacugaguuaacag

SEQ ID NO: 81944 - RNA, 64 nt, hsa
gguggguagcuaauuaacuaucagguguugaggcugcccccaguggacaucaccuuuggcucug

SEQ ID NO: 81945 - RNA, 64 nt, hsa
aauuggauauggaaggacugugauuucugcaaugaacccaaacuuuuagaguaaaaagccaaau

SEQ ID NO: 81946 - RNA, 64 nt, hsa
ucuauuuggaagagagggaggaagagaaggaaguaacccaaaguacuacucauuuaucauugua

SEQ ID NO: 81947 - RNA, 64 nt, hsa
uaauacuaauguaacagcagaugaaaauugauaaaacccaaaagagagucaucuaaauuuguag

SEQ ID NO: 81948 - RNA, 64 nt, hsa
cguguuuauuuugagucaugagauaaucaauuuuaacccaaagucauuggauuauuuauaugaa

SEQ ID NO: 81949 - RNA, 64 nt, hsa
guguaaaugaacuuucacaauauuuucaccugugaacccaaauaaaaugauuaaaguucugaug

SEQ ID NO: 81950 - RNA, 64 nt, hsa
gcagaauuauucauaauggccaaaagcugaauacaacccaaaugucuaugaacuaaugaauaga

SEQ ID NO: 81951 - RNA, 64 nt, hsa
ucaguuaaguuguucuguuugggaccuggaaaagaacccaaagaaaaccugaguggacagguuc

SEQ ID NO: 81952 - RNA, 64 nt, hsa
aggaucacaaugucacagaugaaacuuaaaugauaacccaaagguagaccugcuguuaaugauc

SEQ ID NO: 81953 - RNA, 64 nt, hsa
gaggaacccaaaggcaguaaaucaaauauucuaaaacccaaaguucauuauuuucauccaaaag

SEQ ID NO: 81954 - RNA, 64 nt, hsa
cugaauauuuagcaagagaaacaggcagcagaggaacccaaaggcaguaaaucaaauauucuaa

SEQ ID NO: 81955 - RNA, 64 nt, hsa
acauguaaagaaaauaagucagcgaaaaaaaugaaacccaaaacucucugcauguacacauuac

SEQ ID NO: 81956 - RNA, 64 nt, hsa
uuuuguacauaguagcauuagguagaaaagacaaaacccaaacaccuaguuaauugagggaugg

SEQ ID NO: 81957 - RNA, 64 nt, hsa
aauaagacuuuaacugcaguuccaaagcuucucuaacccaaaaauuacaguaccaaaugauuga

SEQ ID NO: 81958 - RNA, 64 nt, hsa
uuggucugcauuuguuagaaguuuaacuccuaacaacccaaagaccuauuuaacaauuggugca

SEQ ID NO: 81959 - RNA, 64 nt, hsa
caaugauuucaaaauacuugaaaaauaaaauuuuaacccaaaugaauaacuaagaaauauaaaa

SEQ ID NO: 81960 - RNA, 64 nt, hsa
uuaauguauaaaauuucuaggaauuaaaagcuuaaacccaaaaauuguucauccauauauaaga

SEQ ID NO: 81961 - RNA, 64 nt, hsa
gaggcuaggaauagugauccugcuauaaugugagaacccaaaucauguuuauaaaauaggacgc

SEQ ID NO: 81962 - RNA, 64 nt, hsa
gugcccggcccagauagguugaucuuaauguaacaacccaaaaauaaaugucauagucaagauu

SEQ ID NO: 81963 - RNA, 64 nt, hsa; identical to SEQ ID NO: 68551

SEQ ID NO: 81964 - RNA, 64 nt, hsa; identical to SEQ ID NO: 68552

SEQ ID NO: 81965 - RNA, 64 nt, hsa; identical to SEQ ID NO: 68553

SEQ ID NO: 81966 - RNA, 64 nt, hsa; identical to SEQ ID NO: 68554

SEQ ID NO: 81967 - RNA, 64 nt, hsa; identical to SEQ ID NO: 68555

SEQ ID NO: 81968 - RNA, 64 nt, hsa; identical to SEQ ID NO: 68556

SEQ ID NO: 81969 - RNA, 64 nt, hsa; identical to SEQ ID NO: 68557

SEQ ID NO: 81970 - RNA, 64 nt, hsa; identical to SEQ ID NO: 68558

SEQ ID NO: 81971 - RNA, 62 nt, hsa
uaauuugccuaaggucacagcuaauaaguggcacagcuaauauucccaguaaagauaccaug

SEQ ID NO: 81972 - RNA, 62 nt, hsa
ggccagauaagugaaguaauuugccuaaggucacagcuaauaaguggcacagcuaauauucc

SEQ ID NO: 81973 - RNA, 62 nt, hsa
uugaccuuuucucagauaaucuguguauguacacagcuaacacagcucuuuagauucccugu

SEQ ID NO: 81974 - RNA, 62 nt, hsa
ugccaaggguacauuauggccauuuuuaauuuacagcuaaaauauuuuuuaaaaugcauugc

SEQ ID NO: 81975 - RNA, 62 nt, hsa
uucucuagaaugagcacaaaacaaaucgaauaacagcuaaacaaaucgaauaacagcuaaac

SEQ ID NO: 81976 - RNA, 62 nt, hsa
acaaaucgaauaacagcuaaacaaaucgaauaacagcuaaacgaaucgaauaacagcuuuug

SEQ ID NO: 81977 - RNA, 62 nt, hsa
ugcuuuaugccaaacauguuuauuuuuaucacacagcuaaagucuguaguuaaguugcugcu

SEQ ID NO: 81978 - RNA, 62 nt, hsa
acaaggcaggaaaagggauggaauugauggugacagcuaagucugucuuuuuucuuaggaaa

SEQ ID NO: 81979 - RNA, 62 nt, hsa
uauugcuaauaccaaaaaugaaagaggccaucacagcuaauccuauggucaccaaaaggauu

SEQ ID NO: 81980 - RNA, 62 nt, hsa
aaguugguaaagaacauacuacaaaaaacccuacagcuaacauuauccuugauguuuccaac

SEQ ID NO: 81981 - RNA, 62 nt, hsa
gcaggacaugcugaagccaaagccaauaacacacagcuaacacacagcucccauaaccgcug

SEQ ID NO: 81982 - RNA, 62 nt, hsa
aggcaaugccauccucaaacacugcaggcaucacagcuaacaauugugaagucgucuuaacu

SEQ ID NO: 81983 - RNA, 62 nt, hsa
ugugagugcaucucuucuuuccuuuagucuucacagcuaacucuggagagcuucaaaacuag

SEQ ID NO: 81984 - RNA, 62 nt, hsa
ggaugaguugccccgggcugcaaauuaagaguacagcuaagugcggggguggcgguggaggg

SEQ ID NO: 81985 - RNA, 62 nt, hsa
ucuucagugauuccuuuuacuauagauucaugacagcuaauuaguacuaacugauuuagagg

SEQ ID NO: 81986 - RNA, 62 nt, hsa
agacuuaacaacaaccgguauugacuggauugacagcuaaaguaucagaaugaaagcaaggu

SEQ ID NO: 81987 - RNA, 64 nt, hsa
aaggcagcaucccucugacaggggggcaguugugaggccacagagugccuugacacaaagauua

SEQ ID NO: 81988 - RNA, 64 nt, hsa
gcuaguuugggugaaguucacuccagcaagucucaggccacaauggggugguuugguuugguuu

SEQ ID NO: 81989 - RNA, 64 nt, hsa
aaugagguaaaggcuuucuggguauuugcugccaaggccacaucaccaauuuucucgauuuaaa

SEQ ID NO: 81990 - RNA, 64 nt, hsa
cacagcgcccuccagaguuaccuggggaggaccgaggccacacgccacugcccccgaggccaga

SEQ ID NO: 81991 - RNA, 64 nt, hsa
ugcaguuuguuuuaacaaauccuggguuaaacugaggccacaggacaugaugggcuguucuaua

SEQ ID NO: 81992 - RNA, 64 nt, hsa
gacccagauagaaaauauaaagucucugaucuauaggccacaucaggauguuauuuuaugaaga

SEQ ID NO: 81993 - RNA, 64 nt, hsa
aacucagccucgcaagagguggcagaggcacaggaggccacaguccuuccuggggcauuccagg

SEQ ID NO: 81994 - RNA, 64 nt, hsa
uuuccaucuccccagcgggggcucccugggugaaaggccacaguauuuuggguugguaggcaaa

SEQ ID NO: 81995 - RNA, 64 nt, hsa
gauuauucuucagacagugagcagucaaguguucaggccacacagucagcccaggaaaaagaga

SEQ ID NO: 81996 - RNA, 64 nt, hsa
gacucccauccauccucugacaaggaagaaggugaggccacauccgauucugaaucagagguua

SEQ ID NO: 81997 - RNA, 64 nt, hsa
agaucuguaauucucccaggagcugugauagagcaggccacacaaagucccuacgccucccugc

SEQ ID NO: 81998 - RNA, 64 nt, hsa
gagcagggacuggaggcacccccagcccugccccaggccacagcaggacaggccgggacaggcc

SEQ ID NO: 81999 - RNA, 64 nt, hsa
ggccccacccccacaguuccacgccccccccccaaggccacacccucccucccuagagcagcag

SEQ ID NO: 82000 - RNA, 64 nt, hsa
cugcucugggcugcagcuuccagcacugaaucagaggccacacagcccaaagauuagcuucaug

SEQ ID NO: 82001 - RNA, 64 nt, hsa
gccccugucccucucuucuggcccugugguacccaggccacacguugugcccgcucuuggggcu

SEQ ID NO: 82002 - RNA, 64 nt, hsa
uugcugucccuggguccccucuuucaugucccacaggccacagagcccaguguguccaaccagc

SEQ ID NO: 82003 - RNA, 64 nt, hsa
auaguuuaaugaaucauuacauuuauaauaacaaaggccacaauuuaauuaauugguaagauau

SEQ ID NO: 82004 - RNA, 64 nt, hsa
cuauaugcgaaauuguuaauuuuaaaauaaccucaggccacagacuuguaguaaucauuugaag

SEQ ID NO: 82005 - RNA, 64 nt, hsa
acagcacacacauacacacacagagagcauuucaaggccacagcuccacaccugccaugggaug

SEQ ID NO: 82006 - RNA, 64 nt, hsa
ugaaaugaaaauacuguguauuacuuuauuuuacaggccacaauugauuaugaagucacccugu

SEQ ID NO: 82007 - RNA, 64 nt, hsa
gaggcccgggucagagcccugggggugagccugaaggccacagagaaagaaccuugcccaaacu

SEQ ID NO: 82008 - RNA, 64 nt, hsa
aggcacacaaacgaggaaugaggggcuucacgagaggccacagggccuggcuggccacgcuguc

SEQ ID NO: 82009 - RNA, 58 nt, hsa
ccuacuacccaucugggugacccggggcaggccacagaggccaggccagggcuggaag

SEQ ID NO: 82010 - RNA, 64 nt, hsa
gcuaagacaggacgauugugguccucccacacuaaggccacagcccauccgcgugcuguguguc

SEQ ID NO: 82011 - RNA, 64 nt, hsa
ggggagugagaugaguggugcuguccauggaaucaggccacagcaggaacugccccacuggcca

SEQ ID NO: 82012 - RNA, 64 nt, hsa
cugagaacaccaagucuccccuuugaagacuuugaggccacagaaaagacaguuaaagcaaaga

SEQ ID NO: 82013 - RNA, 64 nt, hsa
aucugggccaaccagggguccuugggccucuagaaggccacaguaggccucucuuugugggaau

SEQ ID NO: 82014 - RNA, 64 nt, hsa
cagucuggaccagugugaccuuacgauguucccuaggccacaagagaggccccccauccucaca

SEQ ID NO: 82015 - RNA, 64 nt, hsa
guggacuuugagcugaacaugcccacuggcccccaggccacaugggaccuggaggagccuaccu

SEQ ID NO: 82016 - RNA, 64 nt, hsa
agagcuggggggcagagguaaagcccugcaggggaggccacaggguccaucccgucuucaggau

SEQ ID NO: 82017 - RNA, 63 nt, hsa
gaaaacuggaucaagauucuagcccacuggaguugcaaggaaugagaggcaaaaauucuaaag

SEQ ID NO: 82018 - RNA, 63 nt, hsa
aauuaagaggggccaagaggaagacauucuuucugcaaggaaauuucuuuuaaauucugaacu

SEQ ID NO: 82019 - RNA, 63 nt, hsa
aaaauaacugugccccaagaagugcuccagauuugcaaggaauagccccaagagaauaccaag

SEQ ID NO: 82020 - RNA, 63 nt, hsa
agacaagcaggcuguucccuggaaaaaaucuaaugcaaggagggcuaguucacagcaaauuca

SEQ ID NO: 82021 - RNA, 63 nt, hsa
ccagguuccccucuggugucaugucaggcauuuugcaaggaaaagccacuuggggaaagaugg

SEQ ID NO: 82022 - RNA, 62 nt, hsa
uuuccauuggcccucgggugagcugaggguuuuugcaaggaaguugugguggccaagugugg

SEQ ID NO: 82023 - RNA, 63 nt, hsa
acucauuuugaauugaguuucaaacuuugaaagugcaaggauuuaauuuuuaaguugaauccc

SEQ ID NO: 82024 - RNA, 63 nt, hsa
uuuuauuuuugugaaauucuagagcugcucugcugcaaggauuuccugccuucagacugaaga

SEQ ID NO: 82025 - RNA, 63 nt, hsa
aauaagcaauaagaggcucuaagcugacugaguugcaaggacccuuuccgcccucccuuggau

SEQ ID NO: 82026 - RNA, 63 nt, hsa
gucugcuuuucagggauucucugcuggugcuggugcaaggacuucuguuccaaaggcugggaa

SEQ ID NO: 82027 - RNA, 63 nt, hsa
gaagcaggguggggcguaaccucaccugggaagugcaaggagucggggaucucccuccccuag

SEQ ID NO: 82028 - RNA, 63 nt, hsa
uccucugagcuaaaggagcauguucuaacccaaugcaaggaagcuaagaaccuugaaaaaagg

SEQ ID NO: 82029 - RNA, 63 nt, hsa
uaccucauagaugugggcucuguuuggggaagaugcaaggaaguaaugagaagcccaggaaau

SEQ ID NO: 82030 - RNA, 63 nt, hsa
ccagcccaaugccccagcuggccuuccccagccugcaaggagccuguagcauggcaaaucugc

SEQ ID NO: 82031 - RNA, 64 nt, hsa
cagugucuuaaggagacugguaggaggaggcauggaaaccaaaaggccguguguuuagaagccu

SEQ ID NO: 82032 - RNA, 64 nt, hsa
aaacaaaugcuuguugauagccuuuuucuaucaagaaaccaaggagcuaauuauuaauaacaau

SEQ ID NO: 82033 - RNA, 64 nt, hsa
uuccuggaaucaaggaauccugagucugggcaaugaaaccaaagccaggaguugacgcauccug

SEQ ID NO: 82034 - RNA, 64 nt, hsa
uucuuggcaguauuccaugggauguuaagcaaaggaaaccaaaggaaucguuucaaauggacuc

SEQ ID NO: 82035 - RNA, 64 nt, hsa
aaaugugaacguuuucuaacugccucguaggguagaaaccaauauuuuucaggaugcuguauuu

SEQ ID NO: 82036 - RNA, 64 nt, hsa
gauacauucuucagcauuuggcaguuaaucugcugaaaccaaaguaagaacugaaugacaguga

SEQ ID NO: 82037 - RNA, 64 nt, hsa
aauguuucuuaaaaguuuuugagaaaaaaaggaagaaaccaacucauucagaaggcucggauuc

SEQ ID NO: 82038 - RNA, 64 nt, hsa
guccaggaguccaaguagaucucgaaguaaaucugaaaccaaaucaagacacagaacaaggucu

SEQ ID NO: 82039 - RNA, 64 nt, hsa
ugguggugucaccacuacuuaauugggagauaaugaaaccaaucauggaugcuguuuuuauugg

SEQ ID NO: 82040 - RNA, 64 nt, hsa
uuauguucuguuaaugggaauuuaacauauuuaagaaaccaauauuuaaaauguuggucuaggu

SEQ ID NO: 82041 - RNA, 64 nt, hsa
cuggauugauuguggacuuuuauacuauauugcagaaaccaauaucuguuucuuggugguuaug

SEQ ID NO: 82042 - RNA, 64 nt, hsa
aacuuucuaacagaacuuccauaacuagaagguggaaaccaaaacccucaugguaguauuuccu

SEQ ID NO: 82043 - RNA, 64 nt, hsa
ucuaaacucguccccagaggaggacuugaaugaggaaaccaacacuuugagaaaccaaaguccu

SEQ ID NO: 82044 - RNA, 64 nt, hsa
gaggaggacuugaaugaggaaaccaacacuuugagaaaccaaaguccuuuuucccaaagguucu

SEQ ID NO: 82045 - RNA, 64 nt, hsa
aagcuaaagaagacuaugauaccauacccaucuagaaaccaagaacuaguuugaaaucguuuau

SEQ ID NO: 82046 - RNA, 64 nt, hsa
aauccaagugacugugaaaaggucucauuacaaugaaaccaauccuaaauaauuacaccaacuu

SEQ ID NO: 82047 - RNA, 64 nt, hsa
ucuuuuugaaucucucaaacggcaacauuccucagaaaccaaagcuuuauuucaaaucucuucc

SEQ ID NO: 82048 - RNA, 64 nt, hsa
aucucuguugcuaacacacagagcucaccuguuugaaaccaagcuuucaaacauguugaagcuc

SEQ ID NO: 82049 - RNA, 64 nt, hsa
uuuggggaauuuuggccaggagacccugaaacaugaaaccaaacaggcuuugauauuuuuuuuu

SEQ ID NO: 82050 - RNA, 64 nt, hsa
cuguggcuuugagaaguuaacuuuuguggaauaugaaaccaaaggaagaauuuccauguagaua

SEQ ID NO: 82051 - RNA, 64 nt, hsa
caugggaauuacauaaggauaaugaggcccaacugaaaccaaguuucagucugccuuaccuuua

SEQ ID NO: 82052 - RNA, 64 nt, hsa
auuuuaguuuuauuuuugaaaccaagcaucuauagaaaccaagaaagucagcauguaagcguca

SEQ ID NO: 82053 - RNA, 64 nt, hsa
gauuuggaauuuuuguuauuuuaguuuuauuuuugaaaccaagcaucuauagaaaccaagaaag

SEQ ID NO: 82054 - RNA, 64 nt, hsa
acuuggccucacuaccagaagaaggguggagucagaaaccaaagugaccuccagagcuguccuc

SEQ ID NO: 82055 - RNA, 64 nt, hsa
gagcaaauauuguucuucccauuuuacagauucagaaaccaaggcuaagggacuggucuaaagu

SEQ ID NO: 82056 - RNA, 64 nt, hsa
gaaaccaaaccaccaucuuuuauaaauugccauggaaaccaagugccuucaaugaaacaagccu

SEQ ID NO: 82057 - RNA, 64 nt, hsa
ugaacacccaaacuacgucaucuguuccaaugaagaaaccaaaccaccaucuuuuauaaauugc

SEQ ID NO: 82058 - RNA, 64 nt, hsa
gguccuugugaugguauuacuuuuuacaaagaaugaaaccaaauggacucagcccucucccaca

SEQ ID NO: 82059 - RNA, 64 nt, hsa
guuguccccauugucuacccacacaaauccucaggaaaccaaccaccgcccagguggcccugag

SEQ ID NO: 82060 - RNA, 64 nt, hsa
auugaaauaagcucuuugcaggcguccaauccuagaaaccaauggucuccagaacucucacaca

SEQ ID NO: 82061 - RNA, 64 nt, hsa
aauuccucuuauucuuaaauaucuaaagggaaaggaaaccaacuuuaauuucagaacuucucuu

SEQ ID NO: 82062 - RNA, 64 nt, hsa
agacuuaauaaaagcuuaggauuaauuagaagaagcaaucuaguuaaauuucccauuuguauuu

SEQ ID NO: 82063 - RNA, 64 nt, hsa
auauucuucuuugauaguguaaacaaauaauaaagcaaucuagguccuuuagguuugaaaggca

SEQ ID NO: 82064 - RNA, 64 nt, hsa
uuuaccauuccuacaaaagaggcagaaacuuugagcaaucuagguuuuuuuuuuuuuuaaguuu

SEQ ID NO: 82065 - RNA, 64 nt, hsa
ggcugcuauggucaacucuucagaaauuuucagagcaaucuaaaagcgccaaaauucgcuaugu

SEQ ID NO: 82066 - RNA, 64 nt, hsa
aaugauuuaaauuucuuaucaaauuucuuuuguagcaaucuaggaaacuguauuuuggaagaua

SEQ ID NO: 82067 - RNA, 64 nt, hsa
agaugugauaugaagcuacuucuacaugaaaauugcaaucuaaagcuuucauaccaaaugucac

SEQ ID NO: 82068 - RNA, 64 nt, hsa
uuuuuuuauugacuguauauuuucuggcacauaagcaaucuaaaaaugguaggccauucugaac

SEQ ID NO: 82069 - RNA, 64 nt, hsa
auaugcauguuaacaacauuaaaaacagcaaacagcaaucuaaguacagaaaagcuuuuugugu

SEQ ID NO: 82070 - RNA, 64 nt, hsa
uguccuacagucccugaucuuucauggcugagcugcaaucuaacacuuuacuguaccuuuauaa

SEQ ID NO: 82071 - RNA, 64 nt, hsa
aacaacagccacaaaagagaaaaucaagaguguugcaaucuauaacaguaauauugauucauuc

SEQ ID NO: 82072 - RNA, 64 nt, hsa
aaguauuccauuuagauuugauagauaugcuuaagcaaucuauaaaucauuuucaauguuauaa

SEQ ID NO: 82073 - RNA, 64 nt, hsa
aagacugucuuuaccagaaucugugugaaauaaggcaaucuagucuccuugaaaaaaaaaucuc

SEQ ID NO: 82074 - RNA, 64 nt, hsa
ugggggcucuguuuuccugcacacuaaauagcuagcaaucuaugcaaacaccuuucccauaaag

SEQ ID NO: 82075 - RNA, 64 nt, hsa
aaaaacaacguauuccuuuguagugugaauaugagcaaucuauuuuauaugaacuuuuuugguu

SEQ ID NO: 82076 - RNA, 64 nt, hsa
acaugcaaauuagagcaugcuaucuuuaggugaugcaaucuauguuucccccuuuuuaaguuag

SEQ ID NO: 82077 - RNA, 64 nt, hsa
caggcuuuuaagguauauuuuguagcauggguuggcaaucuacagcaugugggccaaauccagc

SEQ ID NO: 82078 - RNA, 64 nt, hsa
ugacuggauguuuaaugggaugagcauuaaagcugcaaucuacuauaguacuccagaucucuuu

SEQ ID NO: 82079 - RNA, 64 nt, hsa
uaacacuguacccuugauacagcgauccauaguugcaaucuaaaacaacaguauuugacccauu

SEQ ID NO: 82080 - RNA, 64 nt, hsa
gugagggaggcagguuuggaauggugcgaguauggcaaucuaagcaggggucuggucucuuuga

SEQ ID NO: 82081 - RNA, 64 nt, hsa
gcuguggugcacuauuaauuuucuguuucaaaaugcaaucuaaagaugcaauaaauaugaugac

SEQ ID NO: 82082 - RNA, 64 nt, hsa
cuaaagaaaaaagaaaagcaaggaggaggguugagcaaucuagagcauggaguuuguuaagugc

SEQ ID NO: 82083 - RNA, 64 nt, hsa
gcuuucuuaagccucauuaagaaaaaaacugaaagcaaucuauccuugugugccacugguguuc

SEQ ID NO: 82084 - RNA, 64 nt, hsa
agcacuuuguuaaucuccagagagagcaaauacagcaaucuagaguuuagccuuuuuaaaaaug

SEQ ID NO: 82085 - RNA, 64 nt, hsa
cuguuagaaagaaacuaacaaaagagaacccagagcaaucuagaaucuuugagugcuuggcuuu

SEQ ID NO: 82086 - RNA, 64 nt, hsa
uaauaugaaccaacaaucuggagcacaccgaagggcaaucuaaauuguggcuugaaggacugca

SEQ ID NO: 82087 - RNA, 64 nt, hsa
ggcagcuuuuucaaaguguugaugguaaucugaggcaaucuaagggagucauuuuuuaagugac

SEQ ID NO: 82088 - RNA, 64 nt, hsa
uugcaggauacauagccccaaagauggucuaggagcaaucuaagcuguguuacuccaaaggaca

SEQ ID NO: 82089 - RNA, 64 nt, hsa
acuagccccuauauuuuaauguaagaguuacucugcaaucuaagcaaagcacccaacaauggua

SEQ ID NO: 82090 - RNA, 64 nt, hsa
cagagccauuuuuguuaaaguggcaguuuuuucugcaaucuauuguuccauuccaaucauaucc

SEQ ID NO: 82091 - RNA, 64 nt, hsa
gaagggaggaaaaauaauuacagucaaaauauuugcaaucuaucuacucauuuugcuuucaauc

SEQ ID NO: 82092 - RNA, 64 nt, hsa
gauguccucuaggaauuuuuuuucuaguaauuuugcaaucuaccuaauaaguaccuaaauacgc

SEQ ID NO: 82093 - RNA, 64 nt, hsa
uaguguauuaaaaguuaaguauaauuauuuuaaugcaaucuaauacaaucagauuacucaguug

SEQ ID NO: 82094 - RNA, 64 nt, hsa
uuuggucuaggcuucauuuugauaugacugaauugcaaucuauauuuuuaaaaagaaaaaucaa

SEQ ID NO: 82095 - RNA, 64 nt, hsa
uauaauuuuuuaauuaaugucacaaagcucuagugcaaucuaguugaaugcagaugccugugcc

SEQ ID NO: 82096 - RNA, 64 nt, hsa
uuacauagugcuuacauuguauuagguguuauaagcaaucuagagaugauuuagcaaguauaca

SEQ ID NO: 82097 - RNA, 64 nt, hsa
cauugcaacacccuaaauuguuuuuaauacauuagcaaucuauugggucaacugacauccauug

SEQ ID NO: 82098 - RNA, 64 nt, hsa
cuguugccugguggaaagaaggcaaaggccuucagcaaucuauauuaccagcgcuggauccuuu

SEQ ID NO: 82099 - RNA, 64 nt, hsa
auagguuaauguagauaggauguuuugugaaaaagcaaucuauuguguccaaauaaaaaaacaa

SEQ ID NO: 82100 - RNA, 64 nt, hsa
auuuuauauuuauaaugugcaucaacaugugaaagcaaucuaggucacuagcacagaggaaguu

SEQ ID NO: 82101 - RNA, 64 nt, hsa
aguauauggccguuuuuuaucaugucuuaaaaaugcaaucuaaugguaauucuaugcaaguuug

SEQ ID NO: 82102 - RNA, 64 nt, hsa
ucucacaaauaacaggggugaauguuucucucuagcaaucuaggcaggugcugguguuucaucu

SEQ ID NO: 82103 - RNA, 64 nt, hsa
guacaauaucuaaaaagaaagugacaugaaggaagcaaucuacaacuuccuuccgcuuagcgag

SEQ ID NO: 82104 - RNA, 64 nt, hsa
uaauaaucuccuaccuaaaaagauaaaauuaauugcaaucuaccauaucuuaaguauaggaaau

SEQ ID NO: 82105 - RNA, 64 nt, hsa
acuauuuagagaaccguuguuaauuuuaaaacuagcaaucuauaaagugcaccaggucaacuug

SEQ ID NO: 82106 - RNA, 64 nt, hsa
aauuguauguauaaucuguauuugaaaucauuuugcaaucuauggaaauagaguagcaauugcu

SEQ ID NO: 82107 - RNA, 64 nt, hsa
ggaguguaaugcuuauuuuuuuguguauaucuuugcaaucuauuuuauauauauugacaaaaga

SEQ ID NO: 82108 - RNA, 64 nt, hsa
auaaaguauuuugagguaaagggccauaauguaugcaaucuacucucaaaaaauucagaaacau

SEQ ID NO: 82109 - RNA, 64 nt, hsa
uauucaaauucucacgccuuccaacucaaaauuagcaaucuaaaguaauuuccauauccuagau

SEQ ID NO: 82110 - RNA, 64 nt, hsa
aaaaaaaguuuuguugaaagcgcuauugaauauugcaaucuauauaguguauuggauggcuucu

SEQ ID NO: 82111 - RNA, 64 nt, hsa
gacaugcuaccagacauggggaaccauuagaggugcaaucuacauugggcaucuggucauucaa

SEQ ID NO: 82112 - RNA, 64 nt, hsa
gcuuuuauaaaaagugguagcuacagaugauauagcaaucuaccuuauauagagccuucagaaa

SEQ ID NO: 82113 - RNA, 64 nt, hsa
aaaaauuaauuucagcuucauuucguauuucgaagcaaucuagacuguugugaugaguguaugu

SEQ ID NO: 82114 - RNA, 64 nt, hsa
ugggggagccccacagcuuucuggcuggccaguggcaaucuacuggccuuguccagaggcucac

SEQ ID NO: 82115 - RNA, 64 nt, hsa
uuuccauaagcuuggugacaaaauucauuugcuugcaaucuaaucugaacugaccuugaaucuu

SEQ ID NO: 82116 - RNA, 64 nt, hsa
cauugugaagaaugcaguuuaaaauauacugaaugcaaucuagauguauuguacacgaaaggug

SEQ ID NO: 82117 - RNA, 64 nt, hsa
cacugucugaauuaaacaaaaagcugcccgacuugcaaucuaauguagauuaucucaggcauug

SEQ ID NO: 82118 - RNA, 64 nt, hsa
uuuuaaauacuaacugggucuuucagauagcaaagcaaucuauaaacacuggaaacgcuggguu

SEQ ID NO: 82119 - RNA, 54 nt, hsa
acguaaccugggcucugugauuuggcaaucuauuucuugcaguauaugcucauc

SEQ ID NO: 82120 - RNA, 64 nt, hsa
cauccaauuaucuacccaccugucuuccucucuagcaaucuauuuacuguuuaucaaucuauca

SEQ ID NO: 82121 - RNA, 64 nt, hsa
guaaacuuguaaaaauagagauuugacagacauagcaaucuagucaauguguaaggggucaaaa

SEQ ID NO: 82122 - RNA, 64 nt, hsa
ucuucccuguaaaaugcagauuacagguauuaaagcaaucuagugguauacccgccccuugccu

SEQ ID NO: 82123 - RNA, 64 nt, hsa
ggagggaggguggcuuugcuguuguugggacauggcaaucuagaccgguagcagcgcucgcuga

SEQ ID NO: 82124 - RNA, 64 nt, hsa
agggcccaggccaggagacuguuaaagugaaaaggcaaucuaugacucaccuugcucugccauc

SEQ ID NO: 82125 - RNA, 64 nt, hsa
ugccaaagagauagggacgcauaugcuuuuuaaagcaaucuaaaaauaauaauaaguauagcga

SEQ ID NO: 82126 - RNA, 64 nt, hsa
gcuauauaaaauguuaaagucugaugcugugaaagcaaucuagugcuauauuucuaccuccuca

SEQ ID NO: 82127 - RNA, 64 nt, hsa
caccugcuuuuccacgcacuguggucaucacugugcaaucuacaucuaguaugaaauccacaca

SEQ ID NO: 82128 - RNA, 64 nt, hsa
cgaauccaaguuucaugugguaggacagagaacggcaaucuacaaaacuacaccaagccuaaga

SEQ ID NO: 82129 - RNA, 64 nt, hsa
ugaaaaaauaucuuaacgacauggggcaaaaagugcaaucuaaaugguagccuuuacuaaugug

SEQ ID NO: 82130 - RNA, 64 nt, hsa
guuuaugcaacuuaaaauguguacaaacugcagugcaaucuacuguuggugaaugucaguguau

SEQ ID NO: 82131 - RNA, 64 nt, hsa
aggcuggagugcaguggcaggaucucggcucacugcaaucuagguggaggucuuuuuaaauaac

SEQ ID NO: 82132 - RNA, 64 nt, hsa; identical to SEQ ID NO: 82130

SEQ ID NO: 82133 - RNA, 64 nt, hsa
guuuaugcaacuuaaaauguuuacacacuguggugcaaucuacuguuugugaaugucuguauua

SEQ ID NO: 82134 - RNA, 64 nt, hsa
ccuguugaggaaggauugagcugaugacuuaagggcaaucuaccaagagacuuauucuguauuu

SEQ ID NO: 82135 - RNA, 64 nt, hsa
agugguucacguucuaguguuuuuccugaaaugugcaaucuacuguauaguauugccacauaau

SEQ ID NO: 82136 - RNA, 64 nt, hsa
uuugcacuucuacuaagcuugauagggcaggagugcaaucuacaauuauuuuaaagugaauuuc

SEQ ID NO: 82137 - RNA, 64 nt, hsa
uuaaccgcacaugcacacacacacgcuuucuuaugcaaucuauguuugcacuugugcuuucagu

SEQ ID NO: 82138 - RNA, 64 nt, hsa
uccaguuuuuccaagugauacucccaguucuagagcaaucuacagcuguuuaugugaggugccc

SEQ ID NO: 82139 - RNA, 64 nt, hsa
uacaguuaucgcagauauucuagcuucauuguaagcaaucuaggaaauaagcccugcugcuuuc

SEQ ID NO: 82140 - RNA, 64 nt, hsa
acccuaagaugaagcugagcuuuugaugccaggugcaaucuacuggaaauguagcacuuacgua

SEQ ID NO: 82141 - RNA, 64 nt, hsa
cauuuuacauucccaccagcagugcacaaggauugcaaucuauauacauccucaccaacauugu

SEQ ID NO: 82142 - RNA, 64 nt, hsa
auuccaggaaucuuccccaaaucccagauccucugcaaucuaccugcaccccugacccacccag

SEQ ID NO: 82143 - RNA, 64 nt, hsa
acaaggucaguaaugcugcaggaaaagcaaaauugcaaucuacguaucuaugguacuaaggaag

SEQ ID NO: 82144 - RNA, 64 nt, hsa
cuauauuggcuaaauugaaaccuggaauuguggggcaaucuauuaauagcugccuuaaagucag

SEQ ID NO: 82145 - RNA, 64 nt, hsa
uuauagaaagcaagauguacuauaacauagaauugcaaucuauaauauuuguguguucacuaaa

SEQ ID NO: 82146 - RNA, 64 nt, hsa
auaaugcuaacagaaagaagagaaccguucguuugcaaucuacagcuaguagagacuuugagga

SEQ ID NO: 82147 - RNA, 64 nt, hsa
uuuuaguucuuacagugguaaucacaucaguuuggcaaucuaagaugucuuuaucaagggucag

SEQ ID NO: 82148 - RNA, 64 nt, hsa
ggggccuuuuucugucucauaaagacaggauugugcaaucuaaguugaucagucucucaguggg

SEQ ID NO: 82149 - RNA, 64 nt, hsa
cucuuuagacuacucuuugaauaacaaguaagaugcaaucuagcaaaagucagucagggugaaa

SEQ ID NO: 82150 - RNA, 64 nt, hsa
gcagggugggauggggaagaccaggagcagagucgagccucacagaagccagcgcgggucucug

SEQ ID NO: 82151 - RNA, 64 nt, hsa
ggguaacagccccaguucaucccaaccccucucagagccucaagagggguagcucggcugccgg

SEQ ID NO: 82152 - RNA, 64 nt, hsa
cagaagcaguagacaaugaaccaccugauuacaagagccucauuccucuggaacgugcagucau

SEQ ID NO: 82153 - RNA, 64 nt, hsa
cuaaggaguuagagagguaccggcauuucaguaagagccucaggccuagucucaauggaagaag

SEQ ID NO: 82154 - RNA, 64 nt, hsa
gcagccccaccccacccugccccuuguccucucagagccucagcuucugggggagacaugcucu

SEQ ID NO: 82155 - RNA, 64 nt, hsa
ggcuucugcagcuuuggcugcacgucacccuccugagccucaccuuuccugccgucccuccugu

SEQ ID NO: 82156 - RNA, 64 nt, hsa
acggacagcguuguucacccagagccuuacuugggagccucacugaacgccugcucugguugaa

SEQ ID NO: 82157 - RNA, 64 nt, hsa
cccugcccgauccaccguccugaggcagaguguugagccucauaccuguaccagguccccggcc

SEQ ID NO: 82158 - RNA, 64 nt, hsa
auuagcacaggaguagcagcagcaggacaggcaagagccucacaagugggacucugggccucug

SEQ ID NO: 82159 - RNA, 64 nt, hsa
cuagaugcugccccaaggaguugcugcaguucuggagccucaucuggcugggaucuccaagggg

SEQ ID NO: 82160 - RNA, 64 nt, hsa
cugcagcucccaucuccagcuauuccuaggcaaagagccucauggcuaaggcagccucaaagcc

SEQ ID NO: 82161 - RNA, 64 nt, hsa
gggcuuuagccaagccaccuacugccaggaauuggagccucaguucccuccugugucaaguagc

SEQ ID NO: 82162 - RNA, 64 nt, hsa
ugcccuccugggcccugggcuggcacagccccuggagccucagaaaucuguuugauuggauauu

SEQ ID NO: 82163 - RNA, 64 nt, hsa
ccucacuccuccgugagcaccaccagggcuccaggagccucauccagccucagagaucucccuu

SEQ ID NO: 82164 - RNA, 64 nt, hsa
gccuccuggggauggggugguacacugagcuucugagccucauuguagaguagaaagguacugg

SEQ ID NO: 82165 - RNA, 64 nt, hsa
cucagccucucugagcuuggaagaagccuguucugagccucacccuaucagucaguagagagag

SEQ ID NO: 82166 - RNA, 64 nt, hsa
augacucccauccucuccucaucuccccuuugacgagccucaaacugcucagcucaucaaagag

SEQ ID NO: 82167 - RNA, 64 nt, hsa
uggucaaaagucagcugccagcccugcggaaccagagccucaggcugggauggggaggccuccc

SEQ ID NO: 82168 - RNA, 64 nt, hsa
uaccuauguccugagcccugacacucccacaccugagccucagauuccaauagcucacucccua

SEQ ID NO: 82169 - RNA, 64 nt, hsa
ucccuagagccugacgccggggccccugaccccugagccucagauuccaauaccucacucccca

SEQ ID NO: 82170 - RNA, 64 nt, hsa
aaaggaaaaagagugaugagaagagaauggagagaauuugaauaaaaggugggaaaggagagca

SEQ ID NO: 82171 - RNA, 64 nt, hsa
uaggcuuaacauaaagccgaagaagguaccuagaaauuugaaacuucccuaaaaagcuccuaau

SEQ ID NO: 82172 - RNA, 64 nt, hsa
ccuuaaaaaguugauuuccuugaagcaguuugaaaauuugaauugagucuuaacuuuaggaaau

SEQ ID NO: 82173 - RNA, 64 nt, hsa
ucagacucuuuuaaggguauuuuaaaaauuaguaaauuugaaugaacuaaagauauaucucuac

SEQ ID NO: 82174 - RNA, 64 nt, hsa
uaucuugaaucuacaaauaucuuuauauguauauaauuugaauauauacauguauguauauaca

SEQ ID NO: 82175 - RNA, 64 nt, hsa
acaucuguaaaacuaaauauagcauggaaaauccaauuugaauaagucaugcuuuccuagaauu

SEQ ID NO: 82176 - RNA, 64 nt, hsa
aaaaaguuuucuagaauaagcaggaugauuguuuaauuugaagauggaacaggaaacuagagug

SEQ ID NO: 82177 - RNA, 64 nt, hsa
aagcuguuaccaaaaaauuuuuaaguauuuucuuaauuugaauaauaaaaccagaggaaaugca

SEQ ID NO: 82178 - RNA, 64 nt, hsa
cuuuaaagggaagaagggacuuuaacauccuaugaauuugaaacauccuaugaauuugaaaguu

SEQ ID NO: 82179 - RNA, 64 nt, hsa
acuuuaacauccuaugaauuugaaacauccuaugaauuugaaaguuuccuaaguguuguuuuca

SEQ ID NO: 82180 - RNA, 64 nt, hsa
cuauuuuauuaagauggaaauuucuuuuuaggcuaauuugaaauccaacugaagcuuuuuaacc

SEQ ID NO: 82181 - RNA, 64 nt, hsa
gaaauccaacugaagcuuuuuaaccaauauuuuaaauuugaaccacuagaguuuuuuaugaugc

SEQ ID NO: 82182 - RNA, 64 nt, hsa
ucuucuguugugugcuuuucaaacacuguaaauaaauuugaaauuugaauaacuuuccacagua

SEQ ID NO: 82183 - RNA, 62 nt, hsa
uugugugcuuuucaaacacuguaaauaaauuugaaauuugaauaacuuuccacaguauaacu

SEQ ID NO: 82184 - RNA, 64 nt, hsa
acauuuauauaucuacaaaaauauggagaagaguaauuugaaagccuacuuucugaagaaaaug

SEQ ID NO: 82185 - RNA, 64 nt, hsa
uaguuugaugaauaauuuaaagaaaaacaccuaaaauuugaaaaaugauuguaggaucaaaaaa

SEQ ID NO: 82186 - RNA, 64 nt, hsa
cgugcagcaauugcuacucuauacgaauugucuuaauuugaaaaccuugcuguuacaaauugga

SEQ ID NO: 82187 - RNA, 64 nt, hsa
gugacaagaugagagcagaaucguaagagcuuugaauuugaagugaguuuuuuuccccccauaa

SEQ ID NO: 82188 - RNA, 64 nt, hsa
auuauuuagauuaacaaacauauuuguuaauuugaauuugaagaaaaucuugauuacuaauuac

SEQ ID NO: 82189 - RNA, 64 nt, hsa
auguauauuauuuagauuaacaaacauauuuguuaauuugaauuugaagaaaaucuugauuacu

SEQ ID NO: 82190 - RNA, 64 nt, hsa
gaauuuauaugaaugucuauauuuaaggaagaauaauuugaaagauuuaugucagucuuagaua

SEQ ID NO: 82191 - RNA, 64 nt, hsa
uuugaaaagccacagagucuugaguuccuaaaugaauuugaaggcaaaaccguggaauccuaac

SEQ ID NO: 82192 - RNA, 64 nt, hsa
uaaaaugcuaugggcaacacaaucaugcaauuauaauuugaaaauauuuccuuuaaagacagag

SEQ ID NO: 82193 - RNA, 64 nt, hsa
cauugucuuugugguagcauuaucuuagacauuaaauuugaaguaacauauauccuguaguaac

SEQ ID NO: 82194 - RNA, 64 nt, hsa
gaaacaguaaacuguaacuaaacacuucaacaugaauuugaaaauaaauaauuguggauauaaa

SEQ ID NO: 82195 - RNA, 64 nt, hsa
uauaugagaagagaacugacugaacuugggaaauaauuugaacaaaaagauaaaucuucacaga

SEQ ID NO: 82196 - RNA, 64 nt, hsa
aaacuugccaguaccaacugggaugugugccuucaauuugaaaauuguauguuuuauuuuuuaa

SEQ ID NO: 82197 - RNA, 64 nt, hsa
gaucuggaugcuuaagugucauggacaguaaaugaauuugaacuuuauguugaggacaugacau

SEQ ID NO: 82198 - RNA, 64 nt, hsa
cuguaucacuuaauuuuuaccuuauuuuggcucuaauuugaauaagcugaguaaaaccaccaaa

SEQ ID NO: 82199 - RNA, 64 nt, hsa
auauguaccauguuguuacauguaaacaaacuucaauuugaagugcagcuauuaugugguaucc

SEQ ID NO: 82200 - RNA, 64 nt, hsa
aucccucuguauggguuagauuuuccaaaaucauaauuugaagaaggccagcauuuaugguaga

SEQ ID NO: 82201 - RNA, 64 nt, hsa
uuguacucugaaaguuuuggaaacguauucaaacaauuugaauauaaauuuaucauuuaguuau

SEQ ID NO: 82202 - RNA, 64 nt, hsa
caguggacauugggauuguugcuugaaaaauuaaaauuugaauauuuucucucucauuugcauc

SEQ ID NO: 82203 - RNA, 64 nt, hsa
uuuuuucuuuuggagggacaagaugaaaauauauaauuugaauugauuaaaauuggucguuacu

SEQ ID NO: 82204 - RNA, 64 nt, hsa
cuuuuaaagaucaucucuucagagcugcaugguaaauuugaauuuccccauuguucucuagagc

SEQ ID NO: 82205 - RNA, 64 nt, hsa
uauuacuauauggaaaugaauugcucugugcugaaauuugaagaccagauaaugaaacugaaaa

SEQ ID NO: 82206 - RNA, 64 nt, hsa
auggucuugcauuuuaaaagcuuaugggaaacucaauuugaaaugauuagaaaaugucaaguau

SEQ ID NO: 82207 - RNA, 64 nt, hsa
aacccaaaucaaagauaauuuggugcccauuaugaauuugaaguuaagugauagcucacuugua

SEQ ID NO: 82208 - RNA, 64 nt, hsa
uuauagugaggcacaucucacuguuuugcagcagaauuugaauugugcaacuccuguguaaagu

SEQ ID NO: 82209 - RNA, 64 nt, hsa
cccaauuuuaaucugaaaauuuaucauguuuuauaauuugaauuaaaguuuugucccccccccc

SEQ ID NO: 82210 - RNA, 64 nt, hsa
auacauuuuauaauuucuuuuggaauguaaaucaaauuugaauaaaaaucuuacacgugaaauu

SEQ ID NO: 82211 - RNA, 64 nt, hsa
guauaucuauaugaucuugauauuguuuuauaauaauuugaagucuaaaagacugcauuuuuaa

SEQ ID NO: 82212 - RNA, 64 nt, hsa
ucaaaccuaagcauauuugaauaugaucucccauaauuugaaauugaaaucguauuguguggcu

SEQ ID NO: 82213 - RNA, 64 nt, hsa
auaaaugaacucaaucuaaauuaaaaaagaaagaaauuugaaaaaacuuucucuuugccauuuc

SEQ ID NO: 82214 - RNA, 64 nt, hsa
caguuucauuaacuccuucccccgcucccccaaaaauuugaauuuuuuuuucaacacucuuaca

SEQ ID NO: 82215 - RNA, 64 nt, hsa
aucuugguuguuguauuguaccagugaaaugccaaauuugaaaggccuguacugcaauuuuaua

SEQ ID NO: 82216 - RNA, 64 nt, hsa
cauggccuuaacaaaguuguuuguguuauuguacaauuugaaaauuaugucgggacauacccua

SEQ ID NO: 82217 - RNA, 64 nt, hsa
ugauuuaauugagccaaauuugggucagaacacaaauuugaagaugacuuuucaguauaugaug

SEQ ID NO: 82218 - RNA, 64 nt, hsa
uucuuuguugagucacaaaucuugagccagucagaauuugaaccuaagauuuuugacugcuggu

SEQ ID NO: 82219 - RNA, 64 nt, hsa
uguuugaguuaaaaaccaaacaucccuguaauuuaauuugaagauucuuuaacagauugcagca

SEQ ID NO: 82220 - RNA, 64 nt, hsa
auacuauauucuuugaaaauucuugaaguucuuuaauuugaaauugaaacauuaauuuuugagg

SEQ ID NO: 82221 - RNA, 64 nt, hsa
uguauuuugaccaaauaaugacaacuucuuuagaaauuugaauggcuuggugaggaaaguaguu

SEQ ID NO: 82222 - RNA, 64 nt, hsa
guuugucuuuucuuucagaaacaucucuuagccuaauuugaaauagcacaaucacaauucaaaa

SEQ ID NO: 82223 - RNA, 64 nt, hsa
agccgaaguaugaacaguccauuuuguuucuuaaaauuugaagucgugucugucauagcauuuu

SEQ ID NO: 82224 - RNA, 64 nt, hsa
ccuacauuaccuucaggagacuguucuaccuuuuaauuugaaaacaaggaaauuaaauuuuaac

SEQ ID NO: 82225 - RNA, 64 nt, hsa
uuuugagggguggggaaaaaaaacacuaagugauaauuugaaaaaggcauauugcuuccagauu

SEQ ID NO: 82226 - RNA, 64 nt, hsa
ucuguguauuggauuguugucuugauuuggucuaaauuugaauauauaugaguuacuugaauau

SEQ ID NO: 82227 - RNA, 64 nt, hsa
cuagaauuucuaaaauggaauuuaaugccaucacaauuugaaaaacuuuuuuuuuuuuuuuacu

SEQ ID NO: 82228 - RNA, 64 nt, hsa
cuuagcuauauuauuauaagcuacauuugcccugaauuugaacacucaacaucacuagauuuaa

SEQ ID NO: 82229 - RNA, 64 nt, hsa
ucccacauuuuauaggagggauccagugagagauaauuugaaucaagggggcgguuucccccau

SEQ ID NO: 82230 - RNA, 64 nt, hsa
aaugugaaacuucaugaaguuuuaaacuucaugcaauuugaaauuccauauaaguuuuuaucug

SEQ ID NO: 82231 - RNA, 64 nt, hsa
caaguacagaaauuauagagacuacagcuaaauaaauuugaacauuaaauauaauuuuaccacu

SEQ ID NO: 82232 - RNA, 64 nt, hsa
caauagugcacaacuuagguuauuuuugcuuccgaauuugaaugaaaaacuuaaugccauggau

SEQ ID NO: 82233 - RNA, 64 nt, hsa
aggaaagauagagggaaggaaguucacucacuugaauuugaauugcuucucauucucaucagac

SEQ ID NO: 82234 - RNA, 64 nt, hsa
aaaauaauauguuuaaaaauguaaauguuuuacaaauuugaaacuuucauaauuguauuaauca

SEQ ID NO: 82235 - RNA, 64 nt, hsa
cuugaggcacagaguuauaaaguaacauaucuggaauuugaaaucagaucuguuuagggcuaau

SEQ ID NO: 82236 - RNA, 64 nt, hsa
agcuauuauuaagaaaaacaguugagagaggaagaauuugaagagggcucaagauuuugagucc

SEQ ID NO: 82237 - RNA, 64 nt, hsa
aaacagaauucuaaaaugugaguucaauucaauaaauuugaauuucuguaggaagaaucaaauc

SEQ ID NO: 82238 - RNA, 64 nt, hsa
aaaucagcucuaaaaccaaagcugauuuuuagaaaauuugaaaauguaaaucagcccuauccau

SEQ ID NO: 82239 - RNA, 64 nt, hsa
aggugauuucuuauauguagaugcucgauuuuggaauuugaaauaguagaugcaccucuuuacc

SEQ ID NO: 82240 - RNA, 64 nt, hsa
uuuuuauauccaucaagggaaggaugaaauguugaauuugaagacuaauucaguaagaaguccu

SEQ ID NO: 82241 - RNA, 64 nt, hsa; identical to SEQ ID NO: 82238

SEQ ID NO: 82242 - RNA, 64 nt, hsa; identical to SEQ ID NO: 82237

SEQ ID NO: 82243 - RNA, 64 nt, hsa
ugccguguagaauuuuuuuuagauauccauuguaaauuugaaacaaagaccgaucuguguaaaa

SEQ ID NO: 82244 - RNA, 64 nt, hsa
cugcuagagugcagcauuugugacacguauuugaaauuugaaauuuccuucugcacuguauaaa

SEQ ID NO: 82245 - RNA, 64 nt, hsa
gagccaaccuggccaaucagauuguuuugucaauaauuugaaauuugaacuggagagauccaga

SEQ ID NO: 82246 - RNA, 64 nt, hsa
ccuggccaaucagauuguuuugucaauaauuugaaauuugaacuggagagauccagaaccuugg

SEQ ID NO: 82247 - RNA, 64 nt, hsa
auuauguucuuuuucccccuuuauggucuuaacuaauuugaauccuucaagaaggauuuuucca

SEQ ID NO: 82248 - RNA, 64 nt, hsa
cggauugaaugaauguaaauagaaauuaaaugcaaauuugaaugaacauaaauagaagugauuu

SEQ ID NO: 82249 - RNA, 64 nt, hsa
uuaccuuauuuaucuguaugaaauuccaguaguuaauuugaacauuuauuuauaugacguuugu

SEQ ID NO: 82250 - RNA, 64 nt, hsa
gaaacaaaaucauggaucaagagauacucuugauaauuugaauagggccaaaacaaaguuggug

SEQ ID NO: 82251 - RNA, 64 nt, hsa
uggacgcaaaugacagauaaaaacagcuuuaaauaauuugaacuuguuaauuagaauguuguug

SEQ ID NO: 82252 - RNA, 64 nt, hsa
guuuucaguccauuaaaaaauccuaaccaaauuuaauuugaauucaacuuaauuuaagccaccu

SEQ ID NO: 82253 - RNA, 64 nt, hsa
uuaauguaaugagauaccuuuguucauuuuuuuaaauuugaaauauacuuuaccugauccacuu

SEQ ID NO: 82254 - RNA, 64 nt, hsa
caucugauuggcugguaccgagagcuguggguaaaauuugaaaauuguauuuagaauaagaaau

SEQ ID NO: 82255 - RNA, 64 nt, hsa
aaggcuuggaugagauggggcaccagugcccaggaauuugaacauuuuccuuuacccaggaaau

SEQ ID NO: 82256 - RNA, 64 nt, hsa
agagcaccagcuuugugcauaauuuggauguccaaauuugaacuccuuccuaaagaaacccagc

SEQ ID NO: 82257 - RNA, 64 nt, hsa
uuuagagcaaguauagcucuuaccuuuauuacugaauuugaaucuucuuuuauuucuaggcugu

SEQ ID NO: 82258 - RNA, 64 nt, hsa
uucucccuuuagcaauuuucauuuuauuucucauaauuugaacagagacaguucucauacauga

SEQ ID NO: 82259 - RNA, 64 nt, hsa
uuuuuuaaucuuuuaguguuuacuuccugcagugaauuugaauaaaugagaaaaaaugcauugu

SEQ ID NO: 82260 - RNA, 64 nt, hsa
agaaugcuguucugauuuacuagagaauguucccaauuugaauuuagggugauuuuaaagaaca

SEQ ID NO: 82261 - RNA, 64 nt, hsa
aauuaaaagcuuggagagauaguuuccugaauagaauuugaagcagucugaauguucuuugaaa

SEQ ID NO: 82262 - RNA, 64 nt, hsa
gaccuucaaaccauuuguaaacuaaccccugggaaauuugaaauuaccugauaacuuaagacuc

SEQ ID NO: 82263 - RNA, 64 nt, hsa
aaucaguacacugugaccaagguccucaaauuggaauuugaacaacaauguaaaaccuguucug

SEQ ID NO: 82264 - RNA, 64 nt, hsa
aaaauaagucaccguguuggauugaaagcuucaaaauuugaaagaauuccaucaaauacuugcu

SEQ ID NO: 82265 - RNA, 64 nt, hsa; identical to SEQ ID NO: 74019

SEQ ID NO: 82266 - RNA, 64 nt, hsa; identical to SEQ ID NO: 74020

SEQ ID NO: 82267 - RNA, 64 nt, hsa; identical to SEQ ID NO: 74021

SEQ ID NO: 82268 - RNA, 64 nt, hsa; identical to SEQ ID NO: 74022

SEQ ID NO: 82269 - RNA, 64 nt, hsa; identical to SEQ ID NO: 74023

SEQ ID NO: 82270 - RNA, 64 nt, hsa; identical to SEQ ID NO: 74024

SEQ ID NO: 82271 - RNA, 64 nt, hsa; identical to SEQ ID NO: 74025

SEQ ID NO: 82272 - RNA, 64 nt, hsa; identical to SEQ ID NO: 74026

SEQ ID NO: 82273 - RNA, 64 nt, hsa; identical to SEQ ID NO: 74027

SEQ ID NO: 82274 - RNA, 64 nt, hsa; identical to SEQ ID NO: 74028

SEQ ID NO: 82275 - RNA, 64 nt, hsa; identical to SEQ ID NO: 74029

SEQ ID NO: 82276 - RNA, 64 nt, hsa; identical to SEQ ID NO: 74030

SEQ ID NO: 82277 - RNA, 64 nt, hsa; identical to SEQ ID NO: 74031

SEQ ID NO: 82278 - RNA, 64 nt, hsa; identical to SEQ ID NO: 74032

SEQ ID NO: 82279 - RNA, 64 nt, hsa; identical to SEQ ID NO: 74033

SEQ ID NO: 82280 - RNA, 64 nt, hsa; identical to SEQ ID NO: 74034

SEQ ID NO: 82281 - RNA, 64 nt, hsa; identical to SEQ ID NO: 74035

SEQ ID NO: 82282 - RNA, 64 nt, hsa; identical to SEQ ID NO: 74036

SEQ ID NO: 82283 - RNA, 64 nt, hsa; identical to SEQ ID NO: 74037

SEQ ID NO: 82284 - RNA, 64 nt, hsa; identical to SEQ ID NO: 74038

SEQ ID NO: 82285 - RNA, 64 nt, hsa; identical to SEQ ID NO: 74039

SEQ ID NO: 82286 - RNA, 64 nt, hsa; identical to SEQ ID NO: 74040

SEQ ID NO: 82287 - RNA, 64 nt, hsa; identical to SEQ ID NO: 74041

SEQ ID NO: 82288 - RNA, 64 nt, hsa; identical to SEQ ID NO: 74042

SEQ ID NO: 82289 - RNA, 64 nt, hsa; identical to SEQ ID NO: 74043

SEQ ID NO: 82290 - RNA, 64 nt, hsa; identical to SEQ ID NO: 74044

SEQ ID NO: 82291 - RNA, 64 nt, hsa; identical to SEQ ID NO: 74045

SEQ ID NO: 82292 - RNA, 64 nt, hsa; identical to SEQ ID NO: 74046

SEQ ID NO: 82293 - RNA, 64 nt, hsa; identical to SEQ ID NO: 74047

SEQ ID NO: 82294 - RNA, 64 nt, hsa; identical to SEQ ID NO: 74048

SEQ ID NO: 82295 - RNA, 64 nt, hsa; identical to SEQ ID NO: 74049

SEQ ID NO: 82296 - RNA, 64 nt, hsa; identical to SEQ ID NO: 74050

SEQ ID NO: 82297 - RNA, 64 nt, hsa; identical to SEQ ID NO: 74051

SEQ ID NO: 82298 - RNA, 64 nt, hsa; identical to SEQ ID NO: 74052

SEQ ID NO: 82299 - RNA, 64 nt, hsa; identical to SEQ ID NO: 74053

SEQ ID NO: 82300 - RNA, 64 nt, hsa; identical to SEQ ID NO: 74054

SEQ ID NO: 82301 - RNA, 64 nt, hsa; identical to SEQ ID NO: 74055

SEQ ID NO: 82302 - RNA, 64 nt, hsa; identical to SEQ ID NO: 74056

SEQ ID NO: 82303 - RNA, 64 nt, hsa; identical to SEQ ID NO: 74057

SEQ ID NO: 82304 - RNA, 64 nt, hsa; identical to SEQ ID NO: 74058

SEQ ID NO: 82305 - RNA, 64 nt, hsa; identical to SEQ ID NO: 74059

SEQ ID NO: 82306 - RNA, 64 nt, hsa; identical to SEQ ID NO: 74060

SEQ ID NO: 82307 - RNA, 64 nt, hsa; identical to SEQ ID NO: 74061

SEQ ID NO: 82308 - RNA, 62 nt, hsa
aauacauccuuucacucagcagagauggccauauuaaacacguuuugcuauguuaaaagugg

SEQ ID NO: 82309 - RNA, 62 nt, hsa
gaauacaaauuucaguucugcaaaagugaaacauuaaacauugccaacgcaaauguauguac

SEQ ID NO: 82310 - RNA, 62 nt, hsa
augguuguacaacucugaauacaugaaacagcauuaaacaucacuuuaaguaagucaacugu

SEQ ID NO: 82311 - RNA, 62 nt, hsa
guuuggaaaacaguuuggcaguuucucaaaggauuaaacauaaaauuaccauaggauucagc

SEQ ID NO: 82312 - RNA, 62 nt, hsa
gucccuaauuuaacccagcucauuauaaugucauuaaacaugacauuagcauugugguuuua

SEQ ID NO: 82313 - RNA, 62 nt, hsa
cacuaaaauuaaucuggaauuuaaggcccaacauuaaacacaaagcuguugaaauauugaug

SEQ ID NO: 82314 - RNA, 62 nt, hsa
uaaucuuaaagagaaaaucuuuggagguuuuaauuaaacauuuuauacauuuaaagucuugu

SEQ ID NO: 82315 - RNA, 62 nt, hsa
uaagaacugccuccacuguuuauauauucauaauuaaacacauugagaaugcaacacuauaa

SEQ ID NO: 82316 - RNA, 62 nt, hsa
ggauuauuaagcaaccuuaaagcaauaaguucauuaaacagaagguaauaggaagaacagua

SEQ ID NO: 82317 - RNA, 62 nt, hsa
ugucucaaagcaucaaauaauacaucuuuaucauuaaacaugaauuuaaugucuaggauaau

SEQ ID NO: 82318 - RNA, 62 nt, hsa
caagagaagucuuuaaaaagccugcauuguguauuaaacaccagguaauaugugcaaaaccg

SEQ ID NO: 82319 - RNA, 62 nt, hsa
auauccuaccaggcuuuccaucugaauaguaaauuaaacaguuguuaucaaaaugauuuuaa

SEQ ID NO: 82320 - RNA, 62 nt, hsa
caaguaauguuuugaggauaucaguguuuuauauuaaacauauuuccaauucauuaaauuga

SEQ ID NO: 82321 - RNA, 62 nt, hsa
gaauucaugugauaaugguggcauuauauaugauuaaacacuucagaacuuucuaauguuau

SEQ ID NO: 82322 - RNA, 62 nt, hsa
guuaagguuguucacuaugauggcaucuuagaauuaaacaaaacuuuuacuagggcugaaaa

SEQ ID NO: 82323 - RNA, 62 nt, hsa
gcugucuucaucagaaaacaguuggcauaagaauuaaacauaugaacaucacaaaacaauuu

SEQ ID NO: 82324 - RNA, 62 nt, hsa
cauuccccagaccauucagaaucacacagcguauuaaacacugacagaaucuucaucuagau

SEQ ID NO: 82325 - RNA, 62 nt, hsa
gacauuuucuagacaaucgcaccuuuggguauauuaaacagcugguaucauaacaaagaauc

SEQ ID NO: 82326 - RNA, 62 nt, hsa
uuucaguucuuguguuuuggaguccuagucauauuaaacaugagagauacucuuaauuucag

SEQ ID NO: 82327 - RNA, 62 nt, hsa
aguggucuuaagguuagcaaauaauugucuguauuaaacauggcguuauuuaaguaguccug

SEQ ID NO: 82328 - RNA, 62 nt, hsa
auagaaaugauuuagauuaaacaagccugaagauuaaacaguaaucauuuuugucaaccacu

SEQ ID NO: 82329 - RNA, 62 nt, hsa
agcucuuuuuaaagaaaauagaaaugauuuagauuaaacaagccugaagauuaaacaguaau

SEQ ID NO: 82330 - RNA, 62 nt, hsa
cuguaacagaaucaagaaacaaauacauuuuaauuaaacaaucuauauggaacaaacauucc

SEQ ID NO: 82331 - RNA, 62 nt, hsa
auguauauaacagaaucaagaaacaaauuuuaauuaaacaaucuguaacagaaucaagaaac

SEQ ID NO: 82332 - RNA, 62 nt, hsa
aaacaaaugacaggguuguuaaguuguacuauauuaaacaacuuggucugguuuauaucauu

SEQ ID NO: 82333 - RNA, 62 nt, hsa
aaauuuuccuuuuaaaaaauccaggcaauggcauuaaacauucuugcuaucauuuaccaugg

SEQ ID NO: 82334 - RNA, 62 nt, hsa
gugacuauccccauguaagagggcacuuggcaauuaaacaugcuacacagcauggcaucacu

SEQ ID NO: 82335 - RNA, 62 nt, hsa
acacagcauggcaucacuuuuuuuuauaacucauuaaacacaguaaaauuuuaaucauuuuu

SEQ ID NO: 82336 - RNA, 60 nt, hsa
aaugugacuggauuucccucaaaaaaguaacuauuaaacagucuugaucucuuugugacu

SEQ ID NO: 82337 - RNA, 62 nt, hsa
uuuaccuauguaaguguucaaaacucugcagcauuaaacaacguguaugcaaauuguuaugg

SEQ ID NO: 82338 - RNA, 62 nt, hsa
auaagggcaaagggagagaaucauaacaucugauuaaacagaaaaagcaagauuuuuaaaac

SEQ ID NO: 82339 - RNA, 62 nt, hsa
acacccaggguggaaaccacaguugcagagucauuaaacaaucaauuguuuguuuaacaucu

SEQ ID NO: 82340 - RNA, 62 nt, hsa
uauuuuuagaaagauuuuuugcuaagaaaaaaauuaaacauauuuacauauuuuucauuuua

SEQ ID NO: 82341 - RNA, 62 nt, hsa
uaccauaauacucuauucaggcuaggauaucaauuaaacacaaaaacccaacaacacacuuu

SEQ ID NO: 82342 - RNA, 62 nt, hsa
uuauaauuaaaaauaagaaauuaagacuuuaaauuaaacauuugguagagucaucauaaaac

SEQ ID NO: 82343 - RNA, 62 nt, hsa
ggacuguucuauuuuuuucaauaaccaaaaagauuaaacaaaaaauacuauaaaaccccuga

SEQ ID NO: 82344 - RNA, 62 nt, hsa
cuaaaguuuauauuaaaugaauucauuacucaauuaaacauuggguaaauuauuaaaugugu

SEQ ID NO: 82345 - RNA, 62 nt, hsa
aaagaguauauuuuaaauauauuguuuuuaacauuaaacaaauaugaaauuaaaguaaauua

SEQ ID NO: 82346 - RNA, 62 nt, hsa
gguuuuaucuuuguuuaaacuagcuuuaaaguauuaaacaauaauugaaaugaaaagcuuac

SEQ ID NO: 82347 - RNA, 62 nt, hsa
gugguucggaugugaaauaaccaguuauacguauuaaacaguuuacagucuaaaggaaacaa

SEQ ID NO: 82348 - RNA, 62 nt, hsa
aauuuuguuuccuccauaaaauguggaagugaauuaaacaaguuuuagucauuuauacaaag

SEQ ID NO: 82349 - RNA, 62 nt, hsa
cuacugauguagccacaacuuuuuagaggccuauuaaacaugacguuauccaauugcagguc

SEQ ID NO: 82350 - RNA, 62 nt, hsa
aucuuggaccuuggucaguugugcuauucauuauuaaacacuaaaacuuuggcgguucuugc

SEQ ID NO: 82351 - RNA, 62 nt, hsa
cuguuuggauaaaaguugaugugugauuuuuuauuaaacaaauaguaaacccuucaauuaua

SEQ ID NO: 82352 - RNA, 62 nt, hsa
aagauuagacuacacaaaagcuuccuuccaguauuaaacaaaaagaauuaaacauaacuaug

SEQ ID NO: 82353 - RNA, 62 nt, hsa
caaaagcuuccuuccaguauuaaacaaaaagaauuaaacauaacuaugaaaaaacuuugcua

SEQ ID NO: 82354 - RNA, 64 nt, hsa
gccacaaggacugagguuggguaggugugggguuccagaggacagcaggacacucucgcauacu

SEQ ID NO: 82355 - RNA, 64 nt, hsa
agguuucaggggccuccuuuguugucaucagaacccagaggaauucuucuccuaaaaaauacgu

SEQ ID NO: 82356 - RNA, 64 nt, hsa
ucuuccaccuuucuguucaaggcuguuugucuacccagaggaaggaggcacugcugaauggcua

SEQ ID NO: 82357 - RNA, 64 nt, hsa
caguucuggguuaucuccucucauacaucaagccccagaggaggcggcaagaggaacagccaca

SEQ ID NO: 82358 - RNA, 64 nt, hsa
acuaaggaugucaguguacgagacggugcgaagcccagaggaggcggcuugggauccucugggc

SEQ ID NO: 82359 - RNA, 64 nt, hsa
ccgcagggagccaggcuggggccaugggcugcugccagaggaccguggauaccucaguguccac

SEQ ID NO: 82360 - RNA, 64 nt, hsa
guggguucugccgaacccuccucucacaggaaguccagaggaagggggaguaucugugggcaac

SEQ ID NO: 82361 - RNA, 64 nt, hsa
agagugagcuuggccaagccagcugcaaaccuggccagaggaguucuauugcaucucucaccug

SEQ ID NO: 82362 - RNA, 64 nt, hsa
gcucuuucagaagacccaggaagggcagcuccagccagaggaccuuccuggcuaugcaggugca

SEQ ID NO: 82363 - RNA, 64 nt, hsa
ucucuuuccuuugugccacugagucguucccuggccagaggacauaaauggugcugguaggagg

SEQ ID NO: 82364 - RNA, 64 nt, hsa
cuuccuccuaacugucaggguggggagcugguucccagaggauugucuacccugaaguccauca

SEQ ID NO: 82365 - RNA, 64 nt, hsa
aacaaaaaaucugugagggucugacuugcucaaaccagaggaggaaacagaaaccccugcacau

SEQ ID NO: 82366 - RNA, 64 nt, hsa
gggcgucauucacccacuaccccuagugcuagucccagaggaugcugcggagggggcagccuca

SEQ ID NO: 82367 - RNA, 64 nt, hsa
acugucuaggaggacugggcagggugggggcaacccagaggacccauggcuagcagggaagggc

SEQ ID NO: 82368 - RNA, 64 nt, hsa
ucagaggcccucgcugccagcucuguaucaggacccagaggaaggggccagaggcucguugacu

SEQ ID NO: 82369 - RNA, 64 nt, hsa
gcccaagggaauucggugugcaccaggguugaccccagaggauugcugccccaucagugcuccc

SEQ ID NO: 82370 - RNA, 64 nt, hsa
cuuagcucuuagucucuuugguaggaguuuuguuccagaggagcucucccccuuggauuugaac

SEQ ID NO: 82371 - RNA, 64 nt, hsa
caggucaggggcacacauggcuuaagugacaaagccagaggagaagacaacccugacagcauca

SEQ ID NO: 82372 - RNA, 64 nt, hsa
gcaccauuucacacacacuccuuguagaugggagccagaggaaaccugaacguggguggagcgu

SEQ ID NO: 82373 - RNA, 64 nt, hsa
cccccggagguggcagcagccccgagggacgcccccagaggaccgggaggcaccccacccuccc

SEQ ID NO: 82374 - RNA, 64 nt, hsa
ggggcuuuagccggaagucaguccuccucauucaccagaggacacacaggggagacgccccagu

SEQ ID NO: 82375 - RNA, 64 nt, hsa
agggcuuuagccggaagucagaccuccucagucaccagaggacacacacaggggagaagccuua

SEQ ID NO: 82376 - RNA, 64 nt, hsa
gcuuccuggggccacagggccuauggcagucagaccagaggaagcgguccgggggcugggggcu

SEQ ID NO: 82377 - RNA, 64 nt, hsa
uccugagggccgggaagccgaagaguccacaggcccagaggaagcagaagcccccgaguccuuu

SEQ ID NO: 82378 - RNA, 64 nt, hsa
auuccucgggacccacagucucaccacgucuccuccagaggacggcagaggguacagguggugg

SEQ ID NO: 82379 - RNA, 64 nt, hsa
cuaaauguuuacuuaagaaacacccuguuuacagccagaggagaaacacccaacacugagugga

SEQ ID NO: 82380 - RNA, 64 nt, hsa
acugucucccugccugucaaucaccaccuuuccuccagaggaggaaaauuaucuccccugcaaa

SEQ ID NO: 82381 - RNA, 64 nt, hsa
acaggaaggggcaugugagcguaaauagaggugaccagaggagagcaugagggguggggcuuug

SEQ ID NO: 82382 - RNA, 64 nt, hsa
ucccacuuaugugagugaccccauccauccaugaccagaggauuauuuuccugccuuggcagag

SEQ ID NO: 82383 - RNA, 64 nt, hsa
aagcucuuggcuuggagucccgugucgucuccacccagaggaaguucuccagaguucaccuuuc

SEQ ID NO: 82384 - RNA, 64 nt, hsa
ccagaggaugccaccuccgcccccacccccgccgccagaggaguacaagagccagaggcccguc

SEQ ID NO: 82385 - RNA, 64 nt, hsa
uccaggggucuguuauuagcaguccacgcccucaccagaggaugccaccuccgcccccaccccc

SEQ ID NO: 82386 - RNA, 64 nt, hsa
gaugaacuugaagauuacauaaaagugcagaaagccagaggacuagagccaaaaacuuguuuca

SEQ ID NO: 82387 - RNA, 64 nt, hsa
gaugaacuugaagauuacaucaaaguacagaaagccagaggacuagauccaaagacuuguuuca

SEQ ID NO: 82388 - RNA, 64 nt, hsa
aaugagugugcagauuacaucaaugugcagaaagccagaggacuagaggccaagacuuguuuca

SEQ ID NO: 82389 - RNA, 63 nt, hsa
ucauuuccuuaaguuuugaucuccgucuuccugaugaagcaggcagagcucagaggaucuugg

SEQ ID NO: 82390 - RNA, 63 nt, hsa
ugcuuccugccagcacgugccugaagguuucacaugaagcaugggaagcgcacccugucguuc

SEQ ID NO: 82391 - RNA, 63 nt, hsa
uagccuaaaaaaaucuuaauuauuucauggaucaugaagcaaggaugaauaauaucaugucuu

SEQ ID NO: 82392 - RNA, 63 nt, hsa
ugucuuuaaagauauaaaaauuaggaugccuuuaugaagcacugauuauaccaaaaaaaaaag

SEQ ID NO: 82393 - RNA, 63 nt, hsa
ugauuaaaucaaccaccuauuuuugacauggaaaugaagcaggguuucuuuucuucacucaaa

SEQ ID NO: 82394 - RNA, 63 nt, hsa
acauacacccaaacacuuacaccaaacuacugaaugaagcaguauuuugguaaccaggccauu

SEQ ID NO: 82395 - RNA, 63 nt, hsa
aaaacuucuucucugggcuaccuaucuuccuucaugaagcaggugcucaggacccggaagaau

SEQ ID NO: 82396 - RNA, 63 nt, hsa
cugguuaaguguuuacuaccauuaaagcgaggcaugaagcaaagagcugagugaguccucugc

SEQ ID NO: 82397 - RNA, 63 nt, hsa
agguucaucuuugaaaucuagggcucuucacucaugaagcagacuccuaguccuggagugacu

SEQ ID NO: 82398 - RNA, 63 nt, hsa
auaagucaaaggaaaaugagcccaggccuugcuaugaagcagugugugaauggacaauguuga

SEQ ID NO: 82399 - RNA, 63 nt, hsa
aaaggaugcagagcugugcaaauuguuccucaaaugaagcaguguggaguguauuggggauuu

SEQ ID NO: 82400 - RNA, 63 nt, hsa
ugaggugauuuugaaucuuguccauauaggaaaaugaagcacagaauuacucagucuuccaua

SEQ ID NO: 82401 - RNA, 63 nt, hsa
aaaacauuuaacauaaugguugugaaauguaacaugaagcaaacuaacuuuuuuuuuuuuaac

SEQ ID NO: 82402 - RNA, 63 nt, hsa
gaacagacuagaaguauuugugggaggagugacaugaagcaugaguuaucugauuuuuuuugu

SEQ ID NO: 82403 - RNA, 63 nt, hsa
aaguuggaccaagggaagucggggacguaaaaaaugaagcaaaacaaugccagggugucuccc

SEQ ID NO: 82404 - RNA, 63 nt, hsa
uggacuugguacaaaaugucggugugguccuagaugaagcauuggggugggggagggagaggg

SEQ ID NO: 82405 - RNA, 63 nt, hsa
guggauguuacuuaaagagaaaagcauaagagcaugaagcauaucugggaauaucuuuugccu

SEQ ID NO: 82406 - RNA, 63 nt, hsa
aauuuguuuuucugaugaauaguguucaguaaaaugaagcagucuuaagagugacuaauaauu

SEQ ID NO: 82407 - RNA, 63 nt, hsa
cagugacugcuggauagucucccagucugaucaaugaagcauucgauuaguuuuugauuuuuu

SEQ ID NO: 82408 - RNA, 63 nt, hsa
aauuugaugacacugucuaucaaaaaagagcaaaugaagcagaugcaaauguuagugagaagu

SEQ ID NO: 82409 - RNA, 63 nt, hsa
ucauaauggaaaaaaagacugaugaagaaauuuaugaagcagauuuauuuuugaaacaaacau

SEQ ID NO: 82410 - RNA, 63 nt, hsa
acccaagugaagaucugguuccagaaccgccgaaugaagcaaaagaaacgugagaaggagggu

SEQ ID NO: 82411 - RNA, 63 nt, hsa
aacccuuccuuguaucugucuucccaggagagaaugaagcaaaacaggaauuugguuuucuuu

SEQ ID NO: 82412 - RNA, 63 nt, hsa
aacuaccuuagcugcauaguggaagaggagagcaugaagcaaagaauuccaggaaacccaaga

SEQ ID NO: 82413 - RNA, 63 nt, hsa
aaagugauauguauuccaaaaaagucauagaagaugaagcacuauaauauuguucccauauau

SEQ ID NO: 82414 - RNA, 63 nt, hsa
accuagacuucaaagccaguauuuguuuaggucaugaagcaaacaaugcucuaaucacaauau

SEQ ID NO: 82415 - RNA, 63 nt, hsa
cagcuuacaucaguuguuuguuugauuagaaaaaugaagcagacacacacacacacacacaca

SEQ ID NO: 82416 - RNA, 63 nt, hsa
auugaauuucauauuugagagacauuugucuucaugaagcagauuugcacuggaaccauugcu

SEQ ID NO: 82417 - RNA, 63 nt, hsa
uggguaccagcugguguagcgacaucuuauccuaugaagcauauugcugaguggugccugaaa

SEQ ID NO: 82418 - RNA, 63 nt, hsa
aguaaccuuacucugagguuuuacggucugauaaugaagcacuugcaugaguauaguaaguca

SEQ ID NO: 82419 - RNA, 63 nt, hsa
auacuucauuuaauagcucguuaccaagugugaaugaagcaauaugucauaauagaguagcca

SEQ ID NO: 82420 - RNA, 63 nt, hsa
gaaggcucaucaggugaucauuaccuagcauccaugaagcaccugaaauuauuugcaaaaugu

SEQ ID NO: 82421 - RNA, 63 nt, hsa
auaaugcuugaagcuuuucauauaacaaaaggaaugaagcagccccgccucgcaguguggaag

SEQ ID NO: 82422 - RNA, 63 nt, hsa
cuucaaaaguucagucuagucuggaaaacaaacaugaagcaaagaaggcacaacaccauaugg

SEQ ID NO: 82423 - RNA, 63 nt, hsa
cucaaagagauucgaaugacgguaaguguucucaugaagcaggaggcccuugucgugggaugg

SEQ ID NO: 82424 - RNA, 63 nt, hsa
acguacgcaagaggacauggauccaaaaugaugaugaagcaucucccauggggaggugauggu

SEQ ID NO: 82425 - RNA, 63 nt, hsa
ugaagcaauaauuuuuaaauuguguaugugcauaugaagcacagacaugcaugugugugugug

SEQ ID NO: 82426 - RNA, 63 nt, hsa
uaaaugugauuccuuuauggcauuaggguaaagaugaagcaauaauuuuuaaauuguguaugu

SEQ ID NO: 82427 - RNA, 63 nt, hsa
ugaagaaagacucuauaggcuuuuacacagcacaugaagcaguaauccagaaagaaggaaaug

SEQ ID NO: 82428 - RNA, 63 nt, hsa
uaugugaaauauuaugaucugaacuuagcacacaugaagcaacauuucuuugcuacacagagg

SEQ ID NO: 82429 - RNA, 64 nt, hsa
cccucuucagucccaguagacucugcucccuagcccugagcaggaggcugggagcagcucuguu

SEQ ID NO: 82430 - RNA, 64 nt, hsa
cuggaaacuaaacugguuagaaugaaccuggcucccugagcaucccuggauccuucaaauaggc

SEQ ID NO: 82431 - RNA, 64 nt, hsa
guugcagugagccaaucucaccauugcacuucagccugagcaacacgagcaaaacuccgucuca

SEQ ID NO: 82432 - RNA, 64 nt, hsa
agacagccuaacagcagaggcaacuuaaauaacuccugagcaguuggcacuagaacagaauacu

SEQ ID NO: 82433 - RNA, 64 nt, hsa
uauagcaauacacuguaauaucagaaaugguuggccugagcaaccuaguaagaccucgucucua

SEQ ID NO: 82434 - RNA, 64 nt, hsa
uuaguacuaaagagcacagcugcucaaaguaaagccugagcaguguucucaguaauguauuuga

SEQ ID NO: 82435 - RNA, 64 nt, hsa
ggacauggaugccaagcggaggccugcguggccuccugagcagcagcugaccgcccgucucaug

SEQ ID NO: 82436 - RNA, 64 nt, hsa
ggccagggacgccgugcggaggccuacguggcugccugagcagcagcugaccgcccgucucacu

SEQ ID NO: 82437 - RNA, 64 nt, hsa
agccaagcgcaucgggagcacaccagaaaccggcccugagcacgagaagagccuccgcccggcc

SEQ ID NO: 82438 - RNA, 64 nt, hsa
cugcggccacagcuccguggaaggacucccccuaccugagcagagcagaagccccagggcggag

SEQ ID NO: 82439 - RNA, 64 nt, hsa
agcggagacgccuuuuaucucuggaugccacagaccugagcagcauugggcuggcuguccgcug

SEQ ID NO: 82440 - RNA, 64 nt, hsa
cggcaggugccucuguguggagcuagggucaagcccugagcagcuucacuuccccugcgccuuu

SEQ ID NO: 82441 - RNA, 64 nt, hsa
uugcuccccgacagguggggcacagaccucuguuccugagcagagaagcagaaaaggagguucc

SEQ ID NO: 82442 - RNA, 64 nt, hsa
aucuaccaguauccugaccgacccgggccgcaucccugagcaagccacacgggcagucacagag

SEQ ID NO: 82443 - RNA, 64 nt, hsa
ggcccauuccccucgcacagccgagcuuuuacucccugagcacgggccgcuccgcuccccugcu

SEQ ID NO: 82444 - RNA, 64 nt, hsa
ggcagcaauuccaucaagccaagccuccugugguccugagcaugaaggggccaggggaccuccu

SEQ ID NO: 82445 - RNA, 64 nt, hsa
cgaaaugcuugcucaggcucagagggaccucaccccugagcaggucaggacucagaacagucug

SEQ ID NO: 82446 - RNA, 64 nt, hsa
cauauuucaaaccacaauauccagcaaaaugucuccugagcacccagaacuccauaccaucggc

SEQ ID NO: 82447 - RNA, 64 nt, hsa
cccagcauccagacuggaaaccuacccauuuuccccugagcauccucuagaugcugccccaagg

SEQ ID NO: 82448 - RNA, 64 nt, hsa
uccaaggggccuccuggauucaguccccacuggcccugagcacgacagcccuucuuacccuccc

SEQ ID NO: 82449 - RNA, 64 nt, hsa
gauuuuaaaaugaagugucaagacaaaggcaaaaccugagcaguuccuaaaaagauuugcuguu

SEQ ID NO: 82450 - RNA, 64 nt, hsa
aagguaaauaucuguuuucuuccugaugucacagccugagcauacucugugcauuaggaagacc

SEQ ID NO: 82451 - RNA, 64 nt, hsa
ugcagugagccaagacagcaccauugcaccccagccugagcaacaagagcgaaacuccaucuca

SEQ ID NO: 82452 - RNA, 64 nt, hsa
ggagaauggcuugagcccaggaguucaagaccggccugagcaacauagugaggaucccaucucu

SEQ ID NO: 82453 - RNA, 64 nt, hsa
gagugcccgacagcugagaccggcgcccacccguccugagcauagcucuguaggcagugcgggc

SEQ ID NO: 82454 - RNA, 64 nt, hsa
uggagucuccagcccacccuccgcaccguccccuccugagcagcacucggcgccagcagccucu

SEQ ID NO: 82455 - RNA, 64 nt, hsa
aucugaaugccuuuuauuuauuuuucccaauugcccugagcaguacaaugaugaacacacguuu

SEQ ID NO: 82456 - RNA, 64 nt, hsa
ccagacagacuuucacaccacaauuacuuccaugccugagcaggauagauuugaagugcaagcc

SEQ ID NO: 82457 - RNA, 64 nt, hsa
gguguaguauaaauaauaauaauggcuaauauuuccugagcaucuacuaaaugcaaggaauugu

SEQ ID NO: 82458 - RNA, 64 nt, hsa
cucugugguggaacgaccccaccucgaggagcuuccugagcagguggcagaagaugcgguaaga

SEQ ID NO: 82459 - RNA, 64 nt, hsa
cugggccuaaacacagcagccuccucucuuccugccugagcaccgcagcgggagccagcagggg

SEQ ID NO: 82460 - RNA, 64 nt, hsa
ggaagcuucaggaagcucagccucagccuucaggccugagcaagugcagggcggagcuaccagc

SEQ ID NO: 82461 - RNA, 64 nt, hsa
cagggaccauggcccgagaaagugagaaggcuuuccugagcaagugacaaucuaaccugccauc

SEQ ID NO: 82462 - RNA, 64 nt, hsa
ccagagggaggaaguugaaaggauacuaaugauuccugagcaccuccuguacaugaaccagguc

SEQ ID NO: 82463 - RNA, 64 nt, hsa
gcuggggcucuggccccaggugagguccccagcuccugagcacuucugaggggguggguuccac

SEQ ID NO: 82464 - RNA, 64 nt, hsa
cuguggcuguuccuggacacugugcuguccccguccugagcaacuaugcccccgccccaguagg

SEQ ID NO: 82465 - RNA, 61 nt, hsa
auccccuuggccacagagccauugugauaugaggagauacuggcucuucuggaaaagagag

SEQ ID NO: 82466 - RNA, 61 nt, hsa
agagaggcuuuucuucaucgagagcuaccagaggagauauuaucuguccucuguguggcac

SEQ ID NO: 82467 - RNA, 61 nt, hsa
agugaaccaagaagaggaugacauuagauccaggagauacaacagaggagauaaucuccag

SEQ ID NO: 82468 - RNA, 61 nt, hsa
aggaugacauuagauccaggagauacaacagaggagauaaucuccaggaugccugugaaga

SEQ ID NO: 82469 - RNA, 61 nt, hsa; identical to SEQ ID NO: 82468

SEQ ID NO: 82470 - RNA, 61 nt, hsa; identical to SEQ ID NO: 82467

SEQ ID NO: 82471 - RNA, 61 nt, hsa
gauggggacguuugacuuggugggaggugucaggagauaggaguugguuaagaugauagau

SEQ ID NO: 82472 - RNA, 61 nt, hsa
cauucacaggggcccugcaaccucacgagaaaggagauaguggaagagucaggacagguug

SEQ ID NO: 82473 - RNA, 61 nt, hsa
auggacuuuucccaccauucacugacucauuaggagauaggcaucuucuaaagauuuuuuu

SEQ ID NO: 82474 - RNA, 61 nt, hsa
ugggagcuaaaaauuacaauaaucaaacuuaaggagauagagaguagaaugaugguuacca

SEQ ID NO: 82475 - RNA, 61 nt, hsa
auguccuagguaauaccacuaucaggccuguaggagauacucaguggagccucugcccuuc

SEQ ID NO: 82476 - RNA, 61 nt, hsa
acuaacccuuaauuaucuuacuugucuaugaaggagauaaacaggguacuguacuggagaa

SEQ ID NO: 82477 - RNA, 61 nt, hsa
accucugagccuaaguuuccacaucuguaaaaggagauaauaaacaccuaccuugcaguag

SEQ ID NO: 82478 - RNA, 61 nt, hsa
ugaaucagacaugaucucuacccuccuaguaaggagauacaguggguucaugaaugacuau

SEQ ID NO: 82479 - RNA, 64 nt, hsa
ugaaggccgcuucucguuggguaccguggggggugaacccuagccccagcuuugggaggauguu

SEQ ID NO: 82480 - RNA, 64 nt, hsa
ggaaauugauuggaauagaaacuuaaaggaaauggaacccuaacuauucucccaucaaaucaua

SEQ ID NO: 82481 - RNA, 64 nt, hsa
aggggaauccccuuauuucuguuuugcauaugaggaacccuagagcagccaggugaggcucucu

SEQ ID NO: 82482 - RNA, 64 nt, hsa
auuucauuugcauguuaguccacagaguugcccagaacccuaaauuuauucauaagagaaaaua

SEQ ID NO: 82483 - RNA, 64 nt, hsa
ggacuuuuauggcucuaucuuuuccuucagugaagaacccuauuuaaaacugggucaucauuug

SEQ ID NO: 82484 - RNA, 64 nt, hsa
ugcagaggugacccucggacccgcugccguucgcgaacccuagcagaggacucagccaccgccg

SEQ ID NO: 82485 - RNA, 64 nt, hsa
uaucuuugaaaaauguaaauaguuuauuuauagagaacccuaccucugagguugacucaaaggu

SEQ ID NO: 82486 - RNA, 64 nt, hsa
ccccuuaguuuguuuccuuuuauuuuauagagcagaacccuagucuuuuaaacaguuuagagug

SEQ ID NO: 82487 - RNA, 64 nt, hsa
ggccucauguaaacguggcagccagccucuucuagaacccuagcccagggacuggagcaggaaa

SEQ ID NO: 82488 - RNA, 64 nt, hsa
uuucugguucuugugauuguauccugaggucccagaacccuauucucccacgaggauccucagu

SEQ ID NO: 82489 - RNA, 64 nt, hsa
gccugcaccuuagaagccgaaggugcuuucaucagaacccuaaaauggucguugaaggcgccug

SEQ ID NO: 82490 - RNA, 64 nt, hsa
uaggaauagggucuguuucacaggccauuucugugaacccuacuccauugugguuucugccacu

SEQ ID NO: 82491 - RNA, 64 nt, hsa
uaaguuuuccauauguacaaggagguauugagaggaacccuacuguugacuugaaaauaaauag

SEQ ID NO: 82492 - RNA, 64 nt, hsa
agucagaugaacccaacagucagaugagagaaaugaacccuacuugcuaucucuaucuuagaaa

SEQ ID NO: 82493 - RNA, 64 nt, hsa
uaaucuucaauaguuuuaccuaccccagucuuuggaacccuaaauaauaaaaauaaacauguuu

SEQ ID NO: 82494 - RNA, 64 nt, hsa
ggguggggccuccagagcuuugcagggaacccuggaacccuaggaacaaggagccuuuguucca

SEQ ID NO: 82495 - RNA, 64 nt, hsa
ugcuagguccuugcuuauauggcaaccacugcuagaacccuaaaagaaccaaaaaucugccaca

SEQ ID NO: 82496 - RNA, 63 nt, hsa
cacauuccccuaagaccuaaauuaugcaggggagaacccuacauggaaucauauucuagccgc

SEQ ID NO: 82497 - RNA, 64 nt, hsa
aauagcgaaaaagcaaaucuguuucaacugaugggaacccuauagcuauagaacuugggggcua

SEQ ID NO: 82498 - RNA, 64 nt, hsa
auggugauacuuguuuauaauucuuaugcugcaggaacccuagagacaaaaugagaugaccauu

SEQ ID NO: 82499 - RNA, 64 nt, hsa
gaauuugagauuuuuguaauaauagaaguagugugaacccuagaaauuagaaaaucaagcuuug

SEQ ID NO: 82500 - RNA, 64 nt, hsa
acacaaauacaacugccaguauguauuuuuaauggaacccuauuuuauaaugguacguuacuga

SEQ ID NO: 82501 - RNA, 64 nt, hsa
acccucuuuuuaaaaguuuacccccucuucaacugaacccuaaagacacugucaugaacugugu

SEQ ID NO: 82502 - RNA, 64 nt, hsa
uuugaguagcagaccuaacaaauauuugaggucagaacccuaccauguuaaaacaaacaaaaac

SEQ ID NO: 82503 - RNA, 64 nt, hsa
cucacuaugucacccagguucgucucaaacuccugaacccuaguaauucuccuaucucagccuc

SEQ ID NO: 82504 - RNA, 64 nt, hsa
cauucggaacaauguuuuucacuuggaggauggugaacccuacugugagacugguaagaucagg

SEQ ID NO: 82505 - RNA, 64 nt, hsa
ggaaaaaggaaaucuguauauuaaagagacauuugaacccuauguuuacugcagcacuauucac

SEQ ID NO: 82506 - RNA, 64 nt, hsa
ucuucaaccaugagguaaaagagccaaguucaaagaacccuagcacaaauuugcuuugggauuu

SEQ ID NO: 82507 - RNA, 64 nt, hsa
agccgcaggcacccucucacucaauuuccacucagaacccuauaaacaccagugggaagggcaa

SEQ ID NO: 82508 - RNA, 64 nt, hsa
gaaaugggagggaguaguuuggggaggagggugggaacccuaauuuccacagaaugaaauuuug

SEQ ID NO: 82509 - RNA, 64 nt, hsa
cccagcccaguuaagaggagaugccgaauuuaaugaacccuauuugaauugcagggcugugauu

SEQ ID NO: 82510 - RNA, 64 nt, hsa
ccaauuuagcauaucuagacuaccuauuugaaaggaacccuaucaacugucuuauguacguuac

SEQ ID NO: 82511 - RNA, 64 nt, hsa
ucucggccccggcuuucuuccaagaguugaccaggaacccuaaagcauccagaguagacugcgc

SEQ ID NO: 82512 - RNA, 64 nt, hsa
ugccauuggucacaauaggucaagggcuuguucugaacccuaguuagcuucauucagagaaaga

SEQ ID NO: 82513 - RNA, 57 nt, hsa
cucauuucagacgaaaguaggcgguacgaacccuaauggaggcaguuuugaggaggu

SEQ ID NO: 82514 - RNA, 64 nt, hsa
agcgcuucuucuagccacugcuaucgcuauuuaagaacccuaaaucugucacccauaauaaagc

SEQ ID NO: 82515 - RNA, 64 nt, hsa
uucauaaggacucuuaaaauaauccugaacauuagaacccuaauguucaggaagauuuuaaucu

SEQ ID NO: 82516 - RNA, 64 nt, hsa
uguccaaacccacaggagguguaccaccaagagugaacccuaaugccagcuauagauuuggggu

SEQ ID NO: 82517 - RNA, 64 nt, hsa
gggucaugaaaaucacagaacuuauaaacacauugaacccuagaucucaggcuuccugaccuac

SEQ ID NO: 82518 - RNA, 64 nt, hsa
aggccacugugggugaagcgccucaguuacacaggaacccuaaagcaaaucugccaccgugggg

SEQ ID NO: 82519 - RNA, 64 nt, hsa
uauuucuguuaauuuuguuauauguuuuuugugugaacccuaaagguuaaaccuuagcccugug

SEQ ID NO: 82520 - RNA, 64 nt, hsa
cggaagaucagaugcaauugcucccaucagggaagaacccuauacuugguuugcuacccuuagu

SEQ ID NO: 82521 - RNA, 64 nt, hsa
auuugucagggauuuagcccaugacguguuucuugaacccuacuuucuggaaguggaguugacu

SEQ ID NO: 82522 - RNA, 64 nt, hsa
uguaauucauuuucucaggcuauguguaaauguagaacccuaauuuuucuauaaaaaaacaaac

SEQ ID NO: 82523 - RNA, 64 nt, hsa
ccugcuaaaaggcaauguaauauaauugcagcuagaacccuacaguggggaaugaggaauuuua

SEQ ID NO: 82524 - RNA, 64 nt, hsa
ugaaaacaaacuuauggguaauaaaggcuagucagaacccuauaccauaaaguguaguuaccau

SEQ ID NO: 82525 - RNA, 64 nt, hsa
augagacacacaccuacccuccccagcuuuccaggaacccuacuggcugccagacugaugggcg

SEQ ID NO: 82526 - RNA, 64 nt, hsa
agcacaggucgacuacauaauggaguccauuggcgaacccuauugcaauuugguccaacuauau

SEQ ID NO: 82527 - RNA, 64 nt, hsa
ccuguguccuuucuuauggacucgcaggauuuuagaacccuaaugcacccuggaggguagcugg

SEQ ID NO: 82528 - RNA, 64 nt, hsa
gacgggagggacccgagccuggcuuuugaccuaagaacccuagcaggagaauacagucuccauc

SEQ ID NO: 82529 - RNA, 64 nt, hsa
ccuucaccagcauuucccaaaaguaugcuccugggaacccuaguuccacaggauaauagguuuu

SEQ ID NO: 82530 - RNA, 64 nt, hsa
ucauuuguaacuuuaggauguaaagguauauugugaacccuagcugugucagaaucuccauccc

SEQ ID NO: 82531 - RNA, 64 nt, hsa
gccaccugaccagaagucuuuguuauauggaugggaacccuaacuuagggcuugggcaggggaa

SEQ ID NO: 82532 - RNA, 64 nt, hsa
gccaccugaccagaagucuuuguuauauggaugggaacccuaacuuagggccugggcaggggaa

SEQ ID NO: 82533 - RNA, 64 nt, hsa
gcuuucuuagcuugaacugauaacuaugcauuaugaacccuaagucaauauauuuuuggugguu

SEQ ID NO: 82534 - RNA, 64 nt, hsa
gccuuccugaauuggcaguggucagagcacaccugaacccuauccugggcuggugaugagcaga

SEQ ID NO: 82535 - RNA, 64 nt, hsa
uggagggauacaauucuugguucagugggaaacagaacccuaaaacauccauuugauucaaggu

SEQ ID NO: 82536 - RNA, 64 nt, hsa
agaagagagggaaguaagcuucuguucagcaccugaacccuagaaaaagagccaguuugcuacg

SEQ ID NO: 82537 - RNA, 64 nt, hsa
agaauuagacaucaagucauuaaaagacauauaggaacccuaaaugcuuauuguuaagugaaaa

SEQ ID NO: 82538 - RNA, 64 nt, hsa
gucagcaacagcacuaaaaaucucaaaucacacugaacccuaaaugucauugcaagaaauaaaa

SEQ ID NO: 82539 - RNA, 64 nt, hsa
aggggccugccuaagauugcagugauaaagaacugaacccuaaaucagcucccacuaaugaaac

SEQ ID NO: 82540 - RNA, 64 nt, hsa
guauuuuguaaaugugucagagacacaugggacagaacccuacuuuuuguagaggaacuuaauc

SEQ ID NO: 82541 - RNA, 64 nt, hsa
auuuggcagggaagacaccuggguuuuuaauucagaacccuauuuauauacuguuaaaauuuga

SEQ ID NO: 82542 - RNA, 64 nt, hsa
caagguuccuggaacugacacaggaaggggcugugaacccuaagugggugucaucuccuccgac

SEQ ID NO: 82543 - RNA, 64 nt, hsa
uggguggagacaagcucagucuaaucaaacaccagaacccuaucaagucaaaagagcuggggcc

SEQ ID NO: 82544 - RNA, 64 nt, hsa
uuggucucucccagcucugggggacuccuuccuugaacccuaauaagaccccacuggagucucu

SEQ ID NO: 82545 - RNA, 64 nt, hsa
uucccccgucaaccaaaaucaguguuuauagagugaacccuauucucaucuuucaucugggaag

SEQ ID NO: 82546 - RNA, 64 nt, hsa
gaauggacucugaggacugagaaggggccuuacagaacccuaaagggagggaagguccuacagg

SEQ ID NO: 82547 - RNA, 64 nt, hsa
uguuuuaggaagcugagaugauuuccaagaacaagaacccuaguauuucuugaaguuaauggaa

SEQ ID NO: 82548 - RNA, 64 nt, hsa
cugacguaauuuuuucccugacgucuuuaaaauugaacccuaucaugaaaugauaauuucuucc

SEQ ID NO: 82549 - RNA, 64 nt, hsa
aucaugaugacuuuaccuccauucccucuacccagaacccuaaauuauucuguuauuggaucug

SEQ ID NO: 82550 - RNA, 64 nt, hsa
ucuucugcccuaggugagaacccuugcacuagaggaacccuacaccccaacccuggggggaaug

SEQ ID NO: 82551 - RNA, 64 nt, hsa
caguaggauuuuucaaaccugguaugaauagacagaacccuauccaguggaaggagaauuuaau

SEQ ID NO: 82552 - RNA, 64 nt, hsa
agccuuucaggaggcugagacaggagaaucgcuugaacccuagaggcggaguuugcagugagcc

SEQ ID NO: 82553 - RNA, 64 nt, hsa
cagauggauguugacuuggugucugggaguucccgaacccuagagccaggauguucuguuuaau

SEQ ID NO: 82554 - RNA, 64 nt, hsa
uauacauguucauaugcauauggcagcaacaagagaacccuacuuuucuucuucccaucaccag

SEQ ID NO: 82555 - RNA, 64 nt, hsa
augauuaacugcuauucguggugggggugggggggaacccuaugauuuacuaugcagaugaaga

SEQ ID NO: 82556 - RNA, 64 nt, hsa
uuuagaaaaagacugguagaaauuggagugaaaggaacccuacagauuagcccaguucucucuu

SEQ ID NO: 82557 - RNA, 64 nt, hsa
agaacucugugucagccacuuuuauuuguauauugaacccuagcuagugccccaagcugcacua

SEQ ID NO: 82558 - RNA, 64 nt, hsa
ggugcuacuucuucuucuuuuuguuaacagcaacgaacccuagaaauauauccuguguaccuca

SEQ ID NO: 82559 - RNA, 64 nt, hsa
guuaucauaaauggaacuugcaggcauauaucaagaacccuaugaagaauuccucucccaucau

SEQ ID NO: 82560 - RNA, 64 nt, hsa
uuuuuaaccucaaaaugguguugagauuuacguggaacccuaaagcaguaaaauaaaaaaccug

SEQ ID NO: 82561 - RNA, 64 nt, hsa
uaaccaggucaucagggacccauuguucucuucagaacccuaucugggagagaaggcgaaccac

SEQ ID NO: 82562 - RNA, 64 nt, hsa
ccacaggaaaaaaaauuacuuuguaugcuuguuugaacccuauggguucguuuuauuaauaaaa

SEQ ID NO: 82563 - RNA, 64 nt, hsa
ggcaaccuacccauucaggaaggucagggcuuuggaacccuaaaaaguuggcccgaugacuuaa

SEQ ID NO: 82564 - RNA, 64 nt, hsa
gcuuacugugguauuuggaauguauguaucuucugaacccuacaucaaguugaaaagguuuguu

SEQ ID NO: 82565 - RNA, 64 nt, hsa
auacuuuagugaacguggacuccagacucucugugaacccuaugagagcgcgucugggcccggc

SEQ ID NO: 82566 - RNA, 64 nt, hsa
aaacauaagacacaggggcuguugcuuuugaacagaacccuauauuacucuccugggaucugag

SEQ ID NO: 82567 - RNA, 64 nt, hsa
gguauguaguuaggaaugucuguuaacuuucugagaacccuagugccccaucauauuaacuguc

SEQ ID NO: 82568 - RNA, 64 nt, hsa
aaucagauaccugcugucaccacacuugggucaggaacccuaaugagaacggggagcugccagg

SEQ ID NO: 82569 - RNA, 64 nt, hsa
cccauuugauccuaaccuuuuagccugcucucuagaacccuacuuacaguugaccaagcugcuu

SEQ ID NO: 82570 - RNA, 59 nt, hsa
cggaacacaugagcauguaacagagccaggaacccuacugcaguaaacugaagacaaga

SEQ ID NO: 82571 - RNA, 64 nt, hsa
gugccccaaaucaaauugaauagccuucagaauagaacccuagagaaugucuuauaaggauugu

SEQ ID NO: 82572 - RNA, 64 nt, hsa
accuacucccaccccaagggaaaauuuuagacaugaacccuacuauuuaguuauucuaaaauag

SEQ ID NO: 82573 - RNA, 64 nt, hsa
ucuuacuaaacauaagaacauucauacugaagaggaacccuaugagugugaagaauauggcaaa

SEQ ID NO: 82574 - RNA, 64 nt, hsa
ccauuggaaggaaugcucuaccucacagaacucugaacccuacagaaauaugggccugcugcca

SEQ ID NO: 82575 - RNA, 64 nt, hsa
ggaggcccagggcuggugagucuagaaugcucuggaacccuacaccuagugaugugugucuauu

SEQ ID NO: 82576 - RNA, 64 nt, hsa
uucugaccuuugauccgcuaggccccccaucucugaacccuagagccccgcuuucccuccaagg

SEQ ID NO: 82577 - RNA, 64 nt, hsa
gccccgcgggccgggcuccaggaagggccugcacgaacccuacagcgagagugacgaugauugg

SEQ ID NO: 82578 - RNA, 52 nt, hsa
accaaaggguccauacaugagagaacccuauugcugcaaugaauacagcaag

SEQ ID NO: 82579 - RNA, 64 nt, hsa
agguuuacauuugcaccuuagccucaauagcuacgaacccuagagaagcagcuagcuggagcuc

SEQ ID NO: 82580 - RNA, 64 nt, hsa
gaaagcaauaacuuugucucguuccuguugggcugaacccuaaggugagugugcaguacagugu

SEQ ID NO: 82581 - RNA, 64 nt, hsa
accaugaucucaauagucaguuacugaugcuccugaacccuauguguccauuucugcacacacg

SEQ ID NO: 82582 - RNA, 64 nt, hsa
cccugccuccagccuuccugaguuucucucuccugaacccuacucucuccuuuuugcuuccuca

SEQ ID NO: 82583 - RNA, 64 nt, hsa
uguuauggagcuucaagaaucgaguuacccaccagaacccuaaugguaaagcuaugauuuuagg

SEQ ID NO: 82584 - RNA, 64 nt, hsa
cucccucagaagcacguuggcaggaggccgaucagaacccuagcgccuuugguccuaagaaugg

SEQ ID NO: 82585 - RNA, 64 nt, hsa
cgccgccggcaguggaccgcugugcgcgaacccugaacccuacggucccgacccgcgggcgagg

SEQ ID NO: 82586 - RNA, 64 nt, hsa
uuuccuaauaugccuuuacugauccguuugcugugaacccuauguuauuuccaugugucaagug

SEQ ID NO: 82587 - RNA, 64 nt, hsa
acucacugcucacccucuucugugagcaggaaaagaacccuacugacaugcaugguuuaacuuc

SEQ ID NO: 82588 - RNA, 64 nt, hsa
acaaaaaacuaagucugcucagugaaaugcuguagaacccuaaauaagugguagaagaguguca

SEQ ID NO: 82589 - RNA, 64 nt, hsa
aaaugccagaccacguuucuaugaucuguugaaugaacccuagacaguucugugagaaagcagc

SEQ ID NO: 82590 - RNA, 64 nt, hsa
uuaaccuccugcuucucuagacuguuccaaagcugaacccuagaaagcaaagcugauacagaag

SEQ ID NO: 82591 - RNA, 64 nt, hsa
auucaucauucacccuugauuuaauuauuucucuggcaaugauuuaauagacuucucggagucu

SEQ ID NO: 82592 - RNA, 64 nt, hsa
uuuauaauacucacuugacccuuguaacugaugaggcaaugaugccaccacaguauucuaauuu

SEQ ID NO: 82593 - RNA, 64 nt, hsa
ucccgccauugggccaucuucccaaaguuauccaggcaaugaaucauaggaacaaugccauucc

SEQ ID NO: 82594 - RNA, 64 nt, hsa
cagccacuaaggcucagauuguuaaagcucucaaggcaaugacucgaaguuugcaguauggaga

SEQ ID NO: 82595 - RNA, 64 nt, hsa
cugagguucuccuagugcaggaacguugaauauuggcaaugauuccugguuccagaaagggcug

SEQ ID NO: 82596 - RNA, 64 nt, hsa
guugauuuuggugugacuuguguaaaugguucauggcaaugacguuggguugcuuccuaggccu

SEQ ID NO: 82597 - RNA, 64 nt, hsa
aaucaaguauaaucccugagauuuguagacuaaaggcaaugaugugggacuacuuggucgaauu

SEQ ID NO: 82598 - RNA, 64 nt, hsa
uuuacuuuuggacuggguuuguaacacgguuaaaggcaaugagaaacaagcagaauuccaggag

SEQ ID NO: 82599 - RNA, 64 nt, hsa
uggcaguuuguguagacaaucuuacugagcaaaaggcaaugaaaagucuugguucccacacugc

SEQ ID NO: 82600 - RNA, 64 nt, hsa
cuccauucauuucagugcugccuggaggaaacucggcaaugauuucuuucaguugugaaguucc

SEQ ID NO: 82601 - RNA, 64 nt, hsa
acugaguaacuuuuaaguggaaaccaaguuuagauuuggggagugguaaaggaaucagcuuuuu

SEQ ID NO: 82602 - RNA, 64 nt, hsa
agugcucuggccucaucauuccugcaaagcuugcuuuggggaguuggauaaugugaaaauuuua

SEQ ID NO: 82603 - RNA, 64 nt, hsa
uaaugcugcagaacugcaaccuuuuguaccuuucuuuggggaauggggugggggugggagagga

SEQ ID NO: 82604 - RNA, 64 nt, hsa
cuucauauacagucuacuucguguucugucacccuuuggggaggggaguucuccugggacagug

SEQ ID NO: 82605 - RNA, 64 nt, hsa
uugcucaucucucccuucuguuuuaugugauuuguuuggggagaaagcuaaaaaaaccugaaac

SEQ ID NO: 82606 - RNA, 64 nt, hsa
uacuggggauggggacauuccugcccauaaaggauuuggggaaagaagauuaauccuaaaauac

SEQ ID NO: 82607 - RNA, 64 nt, hsa
uuauuacugccauuaaucagauuuaugaauuuucuuuggggaucacuauagggaauauuguaua

SEQ ID NO: 82608 - RNA, 64 nt, hsa
aagauacgguuggaaaggaaaaaugagacacagguuuggggaccaaggacccaucaaugauggu

SEQ ID NO: 82609 - RNA, 64 nt, hsa
auuuauaauuucuaguauuucucugaaagaucguuuuggggacaaaagugacuugacaugucca

SEQ ID NO: 82610 - RNA, 64 nt, hsa
aggugauucuguggugccaugaaauuuaagguaauuuggggaaaaggauuagucaguuuuaagc

SEQ ID NO: 82611 - RNA, 64 nt, hsa
auacuacuacacuauuacacuuccacacuauuuauuuggggaugggcugggagugacaguagcc

SEQ ID NO: 82612 - RNA, 64 nt, hsa
cuagagggaaacaaaagggagagccccacaaaacuuuggggacaagggagagagagacucaucu

SEQ ID NO: 82613 - RNA, 64 nt, hsa
uggaugugagagaccacauugccucucccacugcuuuggggagcacuuuccugucauuucuaac

SEQ ID NO: 82614 - RNA, 64 nt, hsa
gguaaaaugcagaagacaguguuaauguguuugguuuggggacugguuguuauaaaaugcaauu

SEQ ID NO: 82615 - RNA, 64 nt, hsa
uauuuuuuccauuuugacauuggcacuaaaugcauuuggggaugguuaaaacaaauuacuauag

SEQ ID NO: 82616 - RNA, 64 nt, hsa
gacuuaauugaaucacauuuugggaccagauguauuuggggauagaauucuuuaaauguauggg

SEQ ID NO: 82617 - RNA, 64 nt, hsa
uaaaacgauaccagacauuugucacagugucuuauuuggggaaaguuugcuaauauacauuuug

SEQ ID NO: 82618 - RNA, 64 nt, hsa
agagggaaugguguuugaugguaaacacaggguguuuggggaucaaggagccuagauucucucc

SEQ ID NO: 82619 - RNA, 64 nt, hsa
caucugcauuuucuaaaaaauuccaugcagguguuuuggggagagguauuuuuuaagcaaugaa

SEQ ID NO: 82620 - RNA, 64 nt, hsa
ucacugccuucuugggauacuaagacuugaauuuuuuggggacuauuaaggguguuagucuugg

SEQ ID NO: 82621 - RNA, 64 nt, hsa
ugucagucaggcagggagggaguggcuguguugguuuggggaacuaauuuccacggacggcugc

SEQ ID NO: 82622 - RNA, 64 nt, hsa
uguauugaaucaucaaauaaaagaauguggcuauuuuggggagaaaauuaugugugugugugcu

SEQ ID NO: 82623 - RNA, 64 nt, hsa
cauucagauccagccauuacuaaccuauuccuuuuuuggggaaaucugagccuagcucagaaaa

SEQ ID NO: 82624 - RNA, 64 nt, hsa
cauugagucauuauccuugcuaugaugaugguguuuuggggaugagagggugcuauccauuucu

SEQ ID NO: 82625 - RNA, 64 nt, hsa
agaagccuuuccuguagccuucuguaggaauucuuuuggggaagugaggaagccagguccacgg
